United States Patent 7,745,391 (HUMAN THROMBOSPONDIN POLYPEPTIDE) - sequence listing, part 135

SEQ ID NO: 364846 - DNA, 842 bp, Homo sapiens
agccagcgagaggctctgaggctgccagagtggttgtgtctgttcctccggtaaggggtgattcgccgaggggcgcggaccagacagacctcgggtcaggcccgggaaccccgagaggagagcccagcccctggtggaggcggcttggcggagattcggagccgtcagcagctcagccagacgtccaggatcccaccccttgcaaaagaccaggccgtggaagccatgttcccaccagccagggggaaggagctgctctcgtttgaggatgtggcgatgtacttcaccagagaggagtggggccacctcaactggggtcagaaggacctctaccgagatgtgatgttggagaactacaggaacatggtcttgctgggatttcagtttcccaaacctgagatgatctgtcagctggagaactgggacgagcagtggatcctggatctaccgagaactgggaataggaaggcttccggtagtgcttgcccaggcggactctcgctctgtcgccaggctgtcttagcctcctgagtagcttggactacaggcgcgcgccaccatgcccggctactttctgtattttagtagagatggggtttcaccatgttggtcaggctggtctggaactcctgacctcgtgatccgcctgccccggcctcccaaagtgctgggattacaggcgtgagccgctgcgcccagttggaaaaagttttgttttttttttaaaactaagtgcttccatgtacatcagatgttaacgactttgatcctaacaaacaaacaaaaaagatgaggaaattgaggctcaaagatgtgtcctggcctggctcagtggcgtatgc

SEQ ID NO: 364847 - DNA, 4556 bp, Homo sapiens
gcgaggacttcttggagtgctttctgcacctgaaactcagttcagggattggggctggctttgagttcaggccaggagagacggaagaactggcaagccgggagcctgcgtccagggaagttgcttggaattccaggcccctcctgtcctcctgctctgagccccacgtggagggagtggctctgtgctttctacccaagggtttcggcttatccagtgggaaaaacgggtggagtgcgcttacaccgccctcggaaccagagcctggagtagcccttctgttgccgctcgtttttgtcaggaggtagcagtctgggactcaagggtgggtctttggagctgattagagatgcctttgtgagtgctatgttgtgtggatgtggagatgactccatccctgtgccctgccttgcttcctccaggacttgggaccctggaggactgacgctgctggcctgggcgtccccttccgctgagccatggcgactcccgacgtgagtgtgcacatggaggaggtggtggttgtgacaactccggacactgcagtggacggcagtggtgtggagggggtgaagaccgtgttggtgacgaccaacttggcccctcacgggggcgacctgacggaagataacatggagacagaaaatgcagcggcggcagctgccgcggccttcacagcctcctcccagctcaaggaagccgtgttagtgaagatggctgaagagggggagaacctggaagctgagattgtgtaccccatcacctgtggagacagcagagccaacctcatctggaggaagtttgtgtgtcccggcatcaatgtgaaatgtgttcagtacgacgagcatgtaatcagcccaaaggaatttgtgcacctggccgggaagtccaccctgaaggactggaagagagccatccgcatgaacggcatcatgctcaggaagatcatggactccggggaactggacttctaccagcacgacaaggtctgctccaacacctgccgcagcacaaagattgacctctcaggagcccgtgtgtccctgagcagccccacgtcggccgagtacattcccctcacgcccgccgcagccgacgtgaatgggtctcctgcgaccatcaccatagagacctgtgaagaccctggcgactggaccgcggccattggagatgacacatttaccttctggcgggggctgaaggacgccggcctgctggacgaggtcatccaggagttccaccaggagctggtggagaccatgagaggcctgcagcagcgggtccaggaccctcccctgcagcttcgagatgctgtacttctcaacaacatcgtgcagaacttcggcatgctggacctggtgaagaaggtgctggccagccacaagtgccagatggaccgctcgcgggagcagtacgcccgggacctggcagccctggagcagcagtgtgatgagcatcgtcgccgagccaaggagctgaagcacaagtcccagcacctcagcaacgtgctcatgacgctgacgccggtctccctgccaccgcctgtgaagcggccccggcttgcacgtgccacatcaggaccggccgccatggcctcgcaggtgctcacccagtctgcccagctggcgcttggcccgggcgtgcccgtcccccagctgaccagcgtgccccttggtaaagtggtgtccaccctgccgtccaccgtcctgggcaagggttcccttcaggcgccccccgccagctccccggcctccccgctgctcgggggatacacagtcttggcctcttccggctccacctaccccagcacagtggagatccacccggacgcgtccagcctcacggtcctgagcacggccgccgtgcaggacggtagcacggtgttcaaggtggtcagcccgctgcagctgctcacgttgcctggcctgggccccaccctgcagaacgtggcccaggcctcgcctggctccagcacaattgtgacagtgcccgcaggggctgcccccgggcctgaggagcacacggccaccattgaggtggctgccatggcagaggaccacgagcggaagtagccgacaggagggcgaggcccctgggacggacagggctggctgtctctcagccgcggcagcagggagcgggcagaggccgcagggctggctcgggcaggtgggtcacgtggtctgcagaaccaaagagaggaatcgccaaaacaaatcacgagaagagagaaggggacagaacagcgagagcaacctggaaaaccggtcttcaggtcccacgtttcctcccccttttttcttgggaaatatatttttccatctgttgcttattaatactgtttacacattgggccttgatcaggagccaggtgggcgggggctagggggagcctgggtgcagcagagacagaggaagcagagccaggtgccgagcgcgaccctgcaggtgctggacgcggtgcagcaggtcacgaggcccccatgtctgcacccagccaggtccctggggacgttactaactcatgacttgggagctaagcccaagtgtgaaacctctggatcctatggatttggtttcttcccacagttttctgtaggtttagtgtggctggcgccccgttctcctccagttgggaacatgcacccggagcttggggtgcagatcctgatgggtgcctgcctcccccgcccccagccggtgctcaggtggcccaggggccgcacagacgaggcgtggtccaggcattgttgcacatgtactgagggtgtttttaagtgaattgcttagtaggcttctaggaagagtcagatttatagcattttcaaccaaaataatggtgagtgcctaggcttcccgagttagctctttgggtggcccctgagcccctgtgagtgcacttgaccgggtgcggaggtcctgggcagcctgtccctgagccggcccctcccaggggtctgagatccatgaggtgtgtccctagggcttcagtcctggggcagaggcataaacagaaccagtcactatggaggtcgaggattcccatgtgggcccttcagcttgggctgcttggccacggaacagcccttggctccctggcccccggcccccatgcagcccctgggctggcccttggtggtctctgtccaagggagagcccctgggtgttcaggaggctgccccgggtgggctgctcagggcagctgccgaaggtggagcccagagcctgtctggaagggctgtctgtggctgtcctgagacctggccttggactcacaaggaagaccaggctgaggcccctccaggccagggtcctggggcaggcatctcagggagcagccagcccaggcctcctgccgtctccaacagggcatgtcccgggaggaccctgagtgccagattcccctggacgctcctgctgattctgtcggcagttgaaggcccgtctgaggccccgcaatgcgagggtcctgtgtcccacttcactgctccgaagggaactggctggctgtccgtccagtgagcggcccagaccccacctctgcgccattgtcaccagggccctgtcctggctgccctcacccatgtcaagctactgaggctgtgtcttgtttgttttctctgttacatttttgtttgctgttgtcacagtcagctggtttcggcgtgatgttgaccttttgatgtacatactccgttttaaactcatttccactctagttgagttctgcagcatgcagcggtatgaccctacgggggtcaggagagccctgcggcccccacccaccagctcagaacctgtcactaatacagctgcctgtgaccctgggacccgcaaccttccagctgcttccctttgtcaaagtcacgagtgcgtctgccttgacagccctcgtcaacagaacttccagtgggttgtgggttcatttcctttctttttaagaacagggttgggaccttttctgcccctgccccttagctactgaggcatagggagaggaagttaatttcagagccatacaaaaataagccacaaccagcttcagaattaattcccaatcccccattccaccagggctgggagcccattcccagtgcttcccaaggccctcggggacatctaccgccaacccagctgcttctggcaggggctccaagccccagcgtggggaagggccctggagaagccctcatcctcatgggaaccacactgcagtgggtggggaaggttgttgtcagcaccgcccccggctcctccaggtcctgctggctcctcgggggcagggttccctggacctcccagttctgcgccttggggccagccagtactcagagaggaggaccttctcaaccacgtacagaacacgggttttcatggctgcctttggtttggttttctgagaagataggattggattggattttgcagagggtgagaacttctctgtgcctgctcagaggcgccctagggaagggccatgtttgagttttgctttgtatgttgttttgcaagtatctgcctggtactttgatttaaaataaaaacaattttcata

SEQ ID NO: 364848 - DNA, 664 bp, Homo sapiens
cggacgcgtgggtcgacccacgcgtccgggttcatttcctttctttttaagaacagggttgggaccttttctgcccctgccccttagctactgaggcatagggagaggaagttaatttcagagccatacaaaaataagccacaaccagcttcagaattaattcccaatcccccattccaccagggctgggagcccattcccagtgcttcccaaggccctcggggacatctaccgccaacccagctgcttctggcaggggctccaagccccagcgtggggaagggccctggagaagccctcatcctcatgggaaccacactgcagtgggtggggaaggttgttgtcagcaccgcccccggctcctccaggtcctgctggctcctcgggggcagggttccctggacctcccagttctgcgccttggggccagccagtactcagagaggaggaccttctcaaccacgtacagaacacgggttttcatggctgcctttggtttggttttctgagaagataggattggattggattttgcagagggtgagaacttctctgtgcctgctcagaggcgccctagggaagggccatgtttgagttttgctttgtatgttgttttgcaagtatctgcctggtactttgatttaaaataaaaacaattttcata

SEQ ID NO: 364849 - DNA, 2332 bp, Homo sapiens
gcgaggacttcttggagtgctttctgcacctgaaactcagttcagggattggggctggctttgagttcaggccaggagagacggaagaactggcaagccgggagcctgcgtccagggaagttgcttggaattccaggcccctcctgtcctcctgctctgagccccacgtggagggagtggctctgtgctttctacccaagggtttcggcttatccagtgggaaaaacgggtggagtgcgcttacaccgccctcggaaccagagcctggagtagcccttctgttgccgctcgtttttgtcaggaggtagcagtctgggactcaagggtgggtctttggagctgattagagatgcctttgtgagtgctatgttgtgtggatgtggagatgactccatccctgtgccctgccttgcttcctccaggacttgggaccctggaggactgacgctgctggcctgggcgtccccttccgctgagccatggcgactcccgacgtgagtgtgcacatggaggaggtggtggttgtgacaactccggacactgcagtggacggcagtggtgtggagggggtgaagaccgtgttggtgacgaccaacttggcccctcacgggggcgacctgacggaagataacatggagacagaaaatgcagcggcggcagctgccgcggccttcacagcctcctcccagctcaaggaagccgtgttagtgaagatggctgaagagggggagaacctggaagctgagattgtgtaccccatcacctgtggagacagcagagccaacctcatctggaggaagtttgtgtgtcccggcatcaatgtgaaatgtgttcagtacgacgagcatgtaatcagcccaaaggaatttgtgcacctggccgggaagtccaccctgaaggactggaagagagccatccgcatgaacggcatcatgctcaggaagatcatggactccggggaactggacttctaccagcacgacaaggtctgctccaacacctgccgcagcacaaagattgacctctcaggagcccgtgtgtccctgagcagccccacgtcggccgagtacattcccctcacgcccgccgcagccgacgtgaatgggtctcctgcgaccatcaccatagagacctgtgaagaccctggcgactggaccgcggccattggagatgacacatttaccttctggcgggggctgaaggacgccggcctgctggacgaggtcatccaggagttccaccaggagctggtggagaccatgagaggcctgcagcagcgggtccaggaccctcccctgcagcttcgagatgctgtacttctcaacaacatcgtgcagaacttcggcatgctggacctggtgaagaaggtgctggccagccacaagtgccagatggaccgctcgcgggagcagtacgcccgggacctggcagccctggagcagcagtgtgatgagcatcgtcgccgagccaaggagctgaagcacaagtcccagcacctcagcaacgtgctcatgacgctgacgccggtctccctgccaccgcctgtgaagcggccccggcttgcacgtgccacatcaggaccggccgccatggcctcgcaggtgctcacccagtctgcccagctggcgcttggcccgggcgtgcccgtcccccagctgaccagcgtgccccttggtaaagtggtgtccaccctgccgtccaccgtcctgggcaagggttcccttcaggcgccccccgccagctccccggcctccccgctgctcgggggatacacagtcttggcctcttccggctccacctaccccagcacagtggagatccacccggacgcgtccagcctcacggtcctgagcacggccgccgtgcaggacggtagcacggtgttcaaggtggtcagcccgctgcagctgctcacgttgcctggcctgggccccaccctgcagaacgtggcccaggcctcgcctggctccagcacaattgtgacagtgcccgcaggggctgcccccgggcctgaggagcacacggccaccattgaggtggctgccatggcagaggaccacgagcggaagtagccgacaggagggcgaggcccctgggacggacagggctggctgtctctcagccgcggcagcagggagcgggcagaggccgcagggctggctcgggcaggtgggtcacgtggtctgcagaaccaaagagaggaatcgccaaaacaaatcacgagaagagagaaggggacagaacagcgagagcaacctggaaaaccggtcttcaggtcccacgtttcctcccccttttttcttgggaaatatatttttccatctgttgctta

SEQ ID NO: 364850 - DNA, 4203 bp, Homo sapiens
ccgccgccgccgcagctcccgacgccgccgcccccgccgggtgcctaagcaggcccggcgcggccccaggacttgggaccctggaggactgacgctgctggcctgggcgtccccttccgctgagccatggcgactcccgacgtgagtgtgcacatggaggaggtggtggttgtgacaactccggacactgcagtggacggcagtggtgtggagggggtgaagaccgtgttggtgacgaccaacttggcccctcacgggggcgacctgacggaagataacatggagacagaaaatgcagcggcggcagctgccgcggccttcacagcctcctcccagctcaaggaagccgtgttagtgaagatggctgaagagggggagaacctggaagctgagattgtgtaccccatcacctgtggagacagcagagccaacctcatctggaggaagtttgtgtgtcccggcatcaatgtgaaatgtgttcagtacgacgagcatgtaatcagcccaaaggaatttgtgcacctggccgggaagtccaccctgaaggactggaagagagccatccgcatgaacggcatcatgctcaggaagatcatggactccggggaactggacttctaccagcacgacaaggtctgctccaacacctgccgcagcacaaagattgacctctcaggagcccgtgtgtccctgagcagccccacgtcggccgagtacattcccctcacgcccgccgcagccgacgtgaatgggtctcctgcgaccatcaccatagagacctgtgaagaccctggcgactggaccgcggccattggagatgacacatttaccttctggcgggggctgaaggacgccggcctgctggacgaggtcatccaggagttccaccaggagctggtggagaccatgagaggcctgcagcagcgggtccaggaccctcccctgcagcttcgagatgctgtacttctcaacaacatcgtgcagaacttcggcatgctggacctggtgaagaaggtgctggccagccacaagtgccagatggaccgctcgcgggagcagtacgcccgggacctggcagccctggagcagcagtgtgatgagcatcgtcgccgagccaaggagctgaagcacaagtcccagcacctcagcaacgtgctcatgacgctgacgccggtctccctgccaccgcctgtgaagcggccccggcttgcacgtgccacatcaggaccggccgccatggcctcgcaggtgctcacccagtctgcccagctggcgcttggcccgggcgtgcccgtcccccagctgaccagcgtgccccttggtaaagtggtgtccaccctgccgtccaccgtcctgggcaagggttcccttcaggcgccccccgccagctccccggcctccccgctgctcgggggatacacagtcttggcctcttccggctccacctaccccagcacagtggagatccacccggacgcgtccagcctcacggtcctgagcacggccgccgtgcaggacggtagcacggtgttcaaggtggtcagcccgctgcagctgctcacgttgcctggcctgggccccaccctgcagaacgtggcccaggcctcgcctggctccagcacaattgtgacagtgcccgcaggggctgcccccgggcctgaggagcacacggccaccattgaggtggctgccatggcagaggaccacgagcggaagtagccgacaggagggcgaggcccctgggacggacagggctggctgtctctcagccgcggcagcagggagcgggcagaggccgcagggctggctcgggcaggtgggtcacgtggtctgcagaaccaaagagaggaatcgccaaaacaaatcacgagaagagagaaggggacagaacagcgagagcaacctggaaaaccggtcttcaggtcccacgtttcctcccccttttttcttgggaaatatatttttccatctgttgcttattaatactgtttacacattgggccttgatcaggagccaggtgggcgggggctagggggagcctgggtgcagcagagacagaggaagcagagccaggtgccgagcgcgaccctgcaggtgctggacgcggtgcagcaggtcacgaggcccccatgtctgcacccagccaggtccctggggacgttactaactcatgacttgggagctaagcccaagtgtgaaacctctggatcctatggatttggtttcttcccacagttttctgtaggtttagtgtggctggcgccccgttctcctccagttgggaacatgcacccggagcttggggtgcagatcctgatgggtgcctgcctcccccgcccccagccggtgctcaggtggcccaggggccgcacagacgaggcgtggtccaggcattgttgcacatgtactgagggtgtttttaagtgaattgcttagtaggcttctaggaagagtcagatttatagcattttcaaccaaaataatggtgagtgcctaggcttcccgagttagctctttgggtggcccctgagcccctgtgagtgcacttgaccgggtgcggaggtcctgggcagcctgtccctgagccggcccctcccaggggtctgagatccatgaggtgtgtccctagggcttcagtcctggggcagaggcataaacagaaccagtcactatggaggtcgaggattcccatgtgggcccttcagcttgggctgcttggccacggaacagcccttggctccctggcccccggcccccatgcagcccctgggctggcccttggtggtctctgtccaagggagagcccctgggtgttcaggaggctgccccgggtgggctgctcagggcagctgccgaaggtggagcccagagcctgtctggaagggctgtctgtggctgtcctgagacctggccttggactcacaaggaagaccaggctgaggcccctccaggccagggtcctggggcaggcatctcagggagcagccagcccaggcctcctgccgtctccaacagggcatgtcccgggaggaccctgagtgccagattcccctggacgctcctgctgattctgtcggcagttgaaggcccgtctgaggccccgcaatgcgagggtcctgtgtcccacttcactgctccgaagggaactggctggctgtccgtccagtgagcggcccagaccccacctctgcgccattgtcaccagggccctgtcctggctgccctcacccatgtcaagctactgaggctgtgtcttgtttgttttctctgttacatttttgtttgctgttgtcacagtcagctggtttcggcgtgatgttgaccttttgatgtacatactccgttttaaactcatttccactctagttgagttctgcagcatgcagcggtatgaccctacgggggtcaggagagccctgcggcccccacccaccagctcagaacctgtcactaatacagctgcctgtgaccctgggacccgcaaccttccagctgcttccctttgtcaaagtcacgagtgcgtctgccttgacagccctcgtcaacagaacttccagtgggttgtgggttcatttcctttctttttaagaacagggttgggaccttttctgcccctgccccttagctactgaggcatagggagaggaagttaatttcagagccatacaaaaataagccacaaccagcttcagaattaattcccaatcccccattccaccagggctgggagcccattcccagtgcttcccaaggccctcggggacatctaccgccaacccagctgcttctggcaggggctccaagccccagcgtggggaagggccctggagaagccctcatcctcatgggaaccacactgcagtgggtggggaaggttgttgtcagcaccgcccccggctcctccaggtcctgctggctcctcgggggcagggttccctggacctcccagttctgcgccttggggccagccagtactcagagaggaggaccttctcaaccacgtacagaacacgggttttcatggctgcctttggtttggttttctgagaagataggattggattggattttgcagagggtgagaacttctctgtgcctgctcagaggcgccctagggaagggccatgtttgagttttgctttgtatgttgttttgcaagtatctgcctggtactttgatttaaaataaaaacaattttcata

SEQ ID NO: 364851 - DNA, 1346 bp, Homo sapiens
cggacgcgtgggtcgacccacgcgtccggctgtctgtggctgtcctgagacctggccttggactcacaaggaagaccaggctgaggcccctccaggccagggtcctggggcaggcatctcagggagcagccagcccaggcctcctgccgtctccaacagggcatgtcccgggaggaccctgagtgccagattcccctggacgctcctgctgattctgtcggcagttgaaggcccgtctgaggccccgcaatgcgagggtcctgtgtcccacttcactgctccgaagggaactggctggctgtccgtccagtgagcggcccagaccccacctctgcgccattgtcaccagggccctgtcctggctgccctcacccatgtcaagctactgaggctgtgtcttgtttgttttctctgttacatttttgtttgctgttgtcacagtcagctggtttcggcgtgatgttgaccttttgatgtacatactccgttttaaactcatttccactctagttgagttctgcagcatgcagcggtatgaccctacgggggtcaggagagccctgcggcccccacccaccagctcagaacctgtcactaatacagctgcctgtgaccctgggacccgcaaccttccagctgcttccctttgtcaaagtcacgagtgcgtctgccttgacagccctcgtcaacagaacttccagtgggttgtgggttcatttcctttctttttaagaacagggttgggaccttttctgcccctgccccttagctactgaggcatagggagaggaagttaatttcagagccatacaaaaataagccacaaccagcttcagaattaattcccaatcccccattccaccagggctgggagcccattcccagtgcttcccaaggccctcggggacatctaccgccaacccagctgcttctggcaggggctccaagccccagcgtggggaagggccctggagaagccctcatcctcatgggaaccacactgcagtgggtggggaaggttgttgtcagcaccgcccccggctcctccaggtcctgctggctcctcgggggcagggttccctggacctcccagttctgcgccttggggccagccagtactcagagaggaggaccttctcaaccacgtacagaacacgggttttcatggctgcctttggtttggttttctgagaagataggattggattggattttgcagagggtgagaacttctctgtgcctgctcagaggcgccctagggaagggccatgtttgagttttgctttgtatgttgttttgcaagtatctgcctggtactttgatttaaaataaaaacaattttcata

SEQ ID NO: 364852 - DNA, 4305 bp, Homo sapiens
ccgccgccgccgcagctcccgacgccgccgcccccgccgggtgcctaagcaggcccggcgcggccccaggacttgggaccctggaggactgacgctgctggcctgggcgtccccttccgctgagccatggcgactcccgacgtgagtgtgcacatggaggaggtggtggttgtgacaactccggacactgcagtggacggcagtggtgtggagggggtgaagaccgtgttggtgacgaccaacttggcccctcacgggggcgacctgacggaagataacatggagacagaaaatgcagcggcggcagctgccgcggccttcacagcctcctcccagctcaaggaagccgtgttagtgaagatggctgaagagggggagaacctggaagctgagattgtgtaccccatcacctgtggagacagcagagccaacctcatctggaggaagtttgtgtgtcccggcatcaatgtgaaatgtgttcagtacgacgagcatgtaatcagcccaaaggaatttgtgcacctggccgggaagtccaccctgaaggactggaagagagccatccgcatgaacggcatcatgctcaggaagatcatggactccggggaactggacttctaccagcacgacaaggtctgctccaacacctgccgcagcacaaagattgacctctcaggagcccgtgtgtccctgagcagccccacgtcggccgagtacattcccctcacgcccgccgcagccgacgtgaatgggtctcctgcgaccatcaccatagagacctgtgaagaccctggcgactggaccgcggccattggagatgacacatttaccttctggcgggggctgaaggacgccggcctgctggacgaggtcatccaggagttccaccaggagctggtggagaccatgagaggcctgcagcagcgggtccaggaccctcccctgcagcttcgagatgctgtacttctcaacaacatcgtgcagaacttcggcatgctggacctggtgaagaaggtgctggccagccacaagtgccagatggaccgctcgcgggagcagtacgcccgggacctggcagccctggagcagcagtgtgatgagcatcgtcgccgagccaaggagctgaagcacaagtcccagcacctcagcaacgtgctcatgacgctgacgccggtctccctgccaccgcctgtgaagcggccccggcttgcacgtgccacatcaggaccggccgccatggcctcgcaggtgctcacccagtctgcccagctggcgcttggcccgggcgtgcccgtcccccagctgaccagcgtgccccttggtaaagtggtgtccaccctgccgtccaccgtcctgggcaagggttcccttcaggcgccccccgccagctccccggcctccccgctgctcgggggatacacagtcttggcctcttccggctccacctaccccagcacagtggagatccacccggacgcgtccagcctcacggtcctgagcacggccgccgtgcaggacggtagcacggtgttcaaggtggtcagcccgctgcagctgctcacgttgcctggcctgggccccaccctgcagaacgtggcccaggcctcgcctggctccagcacaattgtgacagtgcccgcaggggctgcccccgggcctgaggagcacacggccaccattgaggtggctgccatggcagaggaccacgagcggaagtagccgacaggagggcgaggcccctgggacggacagggctggctgtctctcagccgcggcagcagggagcgggcagaggccgcagggctggctcgggcaggtgggtcacgtggtctgcagaaccaaagagaggaatcgccaaaacaaatcacgagaagagagaaggggacagaacagcgagagcaacctggaaaaccggtcttcaggtcccacgtttcctcccccttttttcttgggaaatatatttttccatctgttgcttattaatactgtttacacattgggccttgatcaggagccaggtgggcgggggctagggggagcctgggtgcagcagagacagaggaagcagagccaggtgccgagcgcgaccctgcaggtgctggacgcggtgcagcaggtcacgaggcccccatgtctgcacccagccaggtccctggggacgttactaactcatgacttgggagctaagcccaagtgtgaaacctctggatcctatggatttggtttcttcccacagttttctgtaggtttagtgtggctggcgccccgttctcctccagttgggaacatgcacccggagcttggggtgcagatcctgatgggtgcctgcctcccccgcccccagccggtgctcaggtggcccaggggccgcacagacgaggcgtggtccaggcattgttgcacatgtactgagggtgtttttaagtgaattgcttagtaggcttctaggaagagtcagatttatagcattttcaaccaaaataatggtgagtgcctaggcttcccgagttagctctttgggtggcccctgagcccctgtgagtgcacttgaccgggtgcggaggtcctgggcagcctgtccctgagccggcccctcccaggggtctgagatccatgaggtgtgtccctagggcttcagtcctggggcagaggcataaacagaaccagtcactatggaggtcgaggattcccatgtgggcccttcagcttgggctgcttggccacggaacagcccttggctccctggcccccggcccccatgcagcccctgggctggcccttggtggtctctgtccaagggagagcccctgggtgttcaggaggctgccccgggtgggctgctcagggcagctgccgaaggtggagcccagagcctgtctggaagggctgtctgtggctgtcctgagacctggccttggactcacaaggaagaccaggctgaggcccctccaggccagggtcctggggcaggcatctcagggagcagccagcccaggcctcctgccgtctccaacagggcatgtcccgggaggaccctgagtgccagattcccctggacgctcctgctgattctgtcggcagttgaaggcccgtctgaggccccgcaatgcgagggtcctgtgtcccacttcactgctccgaagggaactggctggctgtccgtccagtgagcggcccagaccccacctctgcgccattgtcaccagggccctgtcctggctgccctcacccatgtcaagctactgaggctgtgtcttgtttgttttctctgttacatttttgtttgctgttgtcacagtcagctggtttcggcgtgatgttgaccttttgatgtacatactccgttttaaactcatttccactctagttgagttctgcagcatgcagcggtatgaccctacgggggtcaggagagccctgcggcccccacccaccagctcagaacctgtcactaatacagctgcctgtgaccctgggacccgcaaccttccagctgcttccctttgtcaaagtcacgagtgcgtctgccttgacagccctcgtcaacagaacttccagtgggttgtgggttcatttcctttctttttaagaacagggttgggaccttttctgcccctgccccttagctactgaggcatagggagaggaagttaatttcagagccatacaaaaataagccacaaccagcttcagaattaattcccaatcccccattccaccagggctgggagcccattcccagtgcttcccaaggccctcggggacatctaccgccaacccagctgcttctggcaggggctccaagccccagcgtggggaagggccctggagaagccctcatcctcatgggaaccacactgcagtgggtggggaaggttgttgtcagcaccgcccccggctcctccaggtcctgctggctcctcgggggcagggttccctggacctcccagttctgcgccttggggccagccagtactcagagaggaggaccttctcaaccacgtacagaacacgggttttcatggctgcctttggtttggttttctgagaagataggattggattggattttgcagagggtgagaacttctctgtgcctgctcagaggcgccctagggaagggccatgtttgagttttgctttgtatgttgttttgcaagtatctgcctggtactttgatttaaaataaaaacaattttcataaaaaaaagacagaaggaaaaacagaaaaacaaaagaaaacaacagagaaaagaaaaaaaagacacacaagaaaaaaaaagggggggcgtcaaaaaaaaacag

SEQ ID NO: 364853 - DNA, 4009 bp, Homo sapiens
gtgccctgcaggttgtgccctccgggatcctgattctattctctcctcccttcacttcaccaggggcgacctgacggaagataacatggagacagaaaatgcagcggcggcagctgccgcggccttcacagcctcctcccagctcaaggaagccgtgttagtgaagatggctgaagagggggagaacctggaagctgagattgtgtaccccatcacctgtggagacagcagagccaacctcatctggaggaagtttgtgtgtcccggcatcaatgtgaaatgtgttcagtacgacgagcatgtaatcagcccaaaggaatttgtgcacctggccgggaagtccaccctgaaggactggaagagagccatccgcatgaacggcatcatgctcaggaagatcatggactccggggaactggacttctaccagcacgacaaggtctgctccaacacctgccgcagcacaaagattgacctctcaggagcccgtgtgtccctgagcagccccacgtcggccgagtacattcccctcacgcccgccgcagccgacgtgaatgggtctcctgcgaccatcaccatagagacctgtgaagaccctggcgactggaccgcggccattggagatgacacatttaccttctggcgggggctgaaggacgccggcctgctggacgaggtcatccaggagttccaccaggagctggtggagaccatgagaggcctgcagcagcgggtccaggaccctcccctgcagcttcgagatgctgtacttctcaacaacatcgtgcagaacttcggcatgctggacctggtgaagaaggtgctggccagccacaagtgccagatggaccgctcgcgggagcagtacgcccgggacctggcagccctggagcagcagtgtgatgagcatcgtcgccgagccaaggagctgaagcacaagtcccagcacctcagcaacgtgctcatgacgctgacgccggtctccctgccaccgcctgtgaagcggccccggcttgcacgtgccacatcaggaccggccgccatggcctcgcaggtgctcacccagtctgcccagctggcgcttggcccgggcgtgcccgtcccccagctgaccagcgtgccccttggtaaagtggtgtccaccctgccgtccaccgtcctgggcaagggttcccttcaggcgccccccgccagctccccggcctccccgctgctcgggggatacacagtcttggcctcttccggctccacctaccccagcacagtggagatccacccggacgcgtccagcctcacggtcctgagcacggccgccgtgcaggacggtagcacggtgttcaaggtggtcagcccgctgcagctgctcacgttgcctggcctgggccccaccctgcagaacgtggcccaggcctcgcctggctccagcacaattgtgacagtgcccgcaggggctgcccccgggcctgaggagcacacggccaccattgaggtggctgccatggcagaggaccacgagcggaagtagccgacaggagggcgaggcccctgggacggacagggctggctgtctctcagccgcggcagcagggagcgggcagaggccgcagggctggctcgggcaggtgggtcacgtggtctgcagaaccaaagagaggaatcgccaaaacaaatcacgagaagagagaaggggacagaacagcgagagcaacctggaaaaccggtcttcaggtcccacgtttcctcccccttttttcttgggaaatatatttttccatctgttgcttattaatactgtttacacattgggccttgatcaggagccaggtgggcgggggctagggggagcctgggtgcagcagagacagaggaagcagagccaggtgccgagcgcgaccctgcaggtgctggacgcggtgcagcaggtcacgaggcccccatgtctgcacccagccaggtccctggggacgttactaactcatgacttgggagctaagcccaagtgtgaaacctctggatcctatggatttggtttcttcccacagttttctgtaggtttagtgtggctggcgccccgttctcctccagttgggaacatgcacccggagcttggggtgcagatcctgatgggtgcctgcctcccccgcccccagccggtgctcaggtggcccaggggccgcacagacgaggcgtggtccaggcattgttgcacatgtactgagggtgtttttaagtgaattgcttagtaggcttctaggaagagtcagatttatagcattttcaaccaaaataatggtgagtgcctaggcttcccgagttagctctttgggtggcccctgagcccctgtgagtgcacttgaccgggtgcggaggtcctgggcagcctgtccctgagccggcccctcccaggggtctgagatccatgaggtgtgtccctagggcttcagtcctggggcagaggcataaacagaaccagtcactatggaggtcgaggattcccatgtgggcccttcagcttgggctgcttggccacggaacagcccttggctccctggcccccggcccccatgcagcccctgggctggcccttggtggtctctgtccaagggagagcccctgggtgttcaggaggctgccccgggtgggctgctcagggcagctgccgaaggtggagcccagagcctgtctggaagggctgtctgtggctgtcctgagacctggccttggactcacaaggaagaccaggctgaggcccctccaggccagggtcctggggcaggcatctcagggagcagccagcccaggcctcctgccgtctccaacagggcatgtcccgggaggaccctgagtgccagattcccctggacgctcctgctgattctgtcggcagttgaaggcccgtctgaggccccgcaatgcgagggtcctgtgtcccacttcactgctccgaagggaactggctggctgtccgtccagtgagcggcccagaccccacctctgcgccattgtcaccagggccctgtcctggctgccctcacccatgtcaagctactgaggctgtgtcttgtttgttttctctgttacatttttgtttgctgttgtcacagtcagctggtttcggcgtgatgttgaccttttgatgtacatactccgttttaaactcatttccactctagttgagttctgcagcatgcagcggtatgaccctacgggggtcaggagagccctgcggcccccacccaccagctcagaacctgtcactaatacagctgcctgtgaccctgggacccgcaaccttccagctgcttccctttgtcaaagtcacgagtgcgtctgccttgacagccctcgtcaacagaacttccagtgggttgtgggttcatttcctttctttttaagaacagggttgggaccttttctgcccctgccccttagctactgaggcatagggagaggaagttaatttcagagccatacaaaaataagccacaaccagcttcagaattaattcccaatcccccattccaccagggctgggagcccattcccagtgcttcccaaggccctcggggacatctaccgccaacccagctgcttctggcaggggctccaagccccagcgtggggaagggccctggagaagccctcatcctcatgggaaccacactgcagtgggtggggaaggttgttgtcagcaccgcccccggctcctccaggtcctgctggctcctcgggggcagggttccctggacctcccagttctgcgccttggggccagccagtactcagagaggaggaccttctcaaccacgtacagaacacgggttttcatggctgcctttggtttggttttctgagaagataggattggattggattttgcagagggtgagaacttctctgtgcctgctcagaggcgccctagggaagggccatgtttgagttttgctttgtatgttgttttgcaagtatctgcctggtactttgatttaaaataaaaacaattttcata

SEQ ID NO: 364854 - DNA, 2024 bp, Homo sapiens
attagccaggcatggtggcgggcgcctgtagtcccagctactcgggagcctgggtgcagcagagacagaggaagcagagccaggtgccgagcgcgaccctgcaggtgctggacgcggtgcagcaggtcacgaggcccccatgtctgcacccagccaggtccctggggacgttactaactcatgacttgggagctaagcccaagtgtgaaacctctggatcctatggatttggtttcttcccacagttttctgtaggtttagtgtggctggcgccccgttctcctccagttgggaacatgcacccggagcttggggtgcagatcctgatgggtgcctgcctccccccccctgagcccctgtgagtgcacttgaccgggtgcggaggtcctgggcagcctgtccctgagccggcccctcccaggggtctgagatccatgaggtgtgtccctagggcttcagtcctggggcagaggcataaacagaaccagtcactatggaggtcgaggattcccatgtgggcccttcagcttgggctgcttggccacggaacagcccttggctccctggcccccggcccccatgcagcccctgggctggcccttggtggtctctgtccaagggagagcccctgggtgttcaggaggctgccccgggtgggctgctcagggcagctgccgaaggtggagcccagagcctgtctggaagggctgtctgtggctgtcctgagacctggccttggactcacaaggaagaccaggctgaggcccctccaggccagggtcctggggcaggcatctcagggagcagccagcccaggcctcctgccgtctccaacagggcatgtcccgggaggaccctgagtgccagattcccctggacgctcctgctgattctgtcggcagttgaaggcccgtctgaggccccgcaatgcgagggtcctgtgtcccacttcactgctccgaagggaactggctggctgtccgtccagtgagcggcccagaccccacctctgcgccattgtcaccagggccctgtcctggctgccctcacccatgtcaagctactgaggctgtgtcttgtttgttttctctgttacatttttgtttgctgttgtcacagtcagctggtttcggcgtgatgttgaccttttgatgtacatactccgttttaaactcatttccactctagttgagttctgcagcatgcagcggtatgaccctacgggggtcaggagagccctgcggcccccacccaccagctcagaacctgtcactaatacagctgcctgtgaccctgggacccgcaaccttccagctgcttccctttgtcaaagtcacgagtgcgtctgccttgacagccctcgtcaacagaacttccagtgggttgtgggttcatttcctttctttttaagaacagggttgggaccttttctgcccctgccccttagctactgaggcatagggagaggaagttaatttcagagccatacaaaaataagccacaaccagcttcagaattaattcccaatcccccattccaccagggctgggagcccattcccagtgcttcccaaggccctcggggacatctaccgccaacccagctgcttctggcaggggctccaagccccagcgtggggaagggccctggagaagccctcatcctcatgggaaccacactgcagtgggtggggaaggttgttgtcagcaccgcccccggctcctccaggtcctgctggctcctcgggggcagggttccctggacctcccagttctgcgccttggggccagccagtactcagagaggaggaccttctcaaccacgtacagaacacgggttttcatggctgcctttggtttggttttctgagaagataggattggattggattttgcagagggtgagaacttctctgtgcctgctcagaggcgccctagggaagggccatgtttgagttttgctttgtatgttgttttgcaagtatctgcctggtactttgatttaaaataaaaacaattttcata

SEQ ID NO: 364855 - DNA, 4650 bp, Homo sapiens
ccgccgccgccgcagctcccgacgccgccgcccccgccgggtgcctaagcaggcccggcgcggccccaggacttgggaccctggaggactgacgctgctggcctgggcgtccccttccgctgagccatggcgactcccgacgtgagtgtgcacatggaggaggtggtggttgtgacaactccggacactgcagtggacggcagtggtgtggagggggtgaagaccgtgttggtgacgaccaacttggcccctcacgggggcgacctgacggaagataacatggagacagaaaatgcagcggcggcagctgccgcggccttcacagcctcctcccagctcaaggaagccgtgttagtgaagatggctgaagagggggagaacctggaagctgagattgtgtaccccatcacctgtggagacagcagagccaacctcatctggaggaagtttgtgtgtcccggcatcaatgtgaaatgtgttcagtacgacgagcatgtaatcagcccaaaggaatttgtgcacctggccgggaagtccaccctgaaggactggaagagagccatccgcatgaacggcatcatgctcaggaagatcatggactccggggaactggacttctaccagcacgacaaggtctgctccaacacctgccgcagcacaaagattgacctctcaggagcccgtgtgtccctgagcagccccacgtcggccgagtacattcccctcacgcccgccgcagccgacgtgaatgggtctcctgcgaccatcaccatagagacctgtgaagaccctggcgactggaccgcggccattggagatgacacatttaccttctggcgggggctgaaggacgccggcctgctggacgaggtcatccaggagttccaccaggagctggtggagaccatgagaggcctgcagcagcgggtccaggaccctcccctgcagcttcgagatgctgtacttctcaacaacatcgtgcagaacttcggcatgctggacctggtgaagaaggtgctggccagccacaagtgccagatggaccgctcgcgggagcagtacgcccgggacctggcagccctggagcagcagtgtgatgagcatcgtcgccgagccaaggagctgaagcacaagtcccagcacctcagcaacgtgctcatgacgctgacgccggtctccctgccaccgcctgtgaagcggccccggcttgcacgtgccacatcaggaccggccgccatggcctcgcaggtgctcacccagtctgcccagctggcgcttggcccgggcgtgcccgtcccccagctgaccagcgtgccccttggtaaagtggtgtccaccctgccgtccaccgtcctgggcaagggttcccttcaggcgccccccgccagctccccggcctccccgctgctcgggggatacacagtcttggcctcttccggctccacctaccccagcacagtggagatccacccggacgcgtccagcctcacggtcctgagcacggccgccgtgcaggacggtagcacggtgttcaaggtggtcagcccgctgcagctgctcacgttgcctggcctgggccccaccctgcagaacgtggcccaggcctcgcctggctccagcacaattgtgacagtgcccgcaggggctgcccccgggcctgaggagcacacggccaccattgaggtggctgccatggcagaggaccacgagcggaagtagccgacaggagggcgaggcccctgggacggacagggctggctgtctctcagccgcggcagcagggagcgggcagaggccgcagggctggctcgggcaggtgggtcacgtggtctgcagaaccaaagagaggaatcgccaaaacaaatcacgagaagagagaaggggacagaacagcgagagcaacctggaaaaccggtcttcaggtcccacgtttcctcccccttttttcttgggaaatatatttttccatctgttgcttattaatactgtttacacattgggccttgatcaggagccaggtgggcgggggctagggggagcctgggtgcagcagagacagaggaagcagagccaggtgccgagcgcgaccctgcaggtgctggacgcggtgcagcaggtcacgaggcccccatgtctgcacccagccaggtccctggggacgttactaactcatgacttgggagctaagcccaagtgtgaaacctctggatcctatggatttggtttcttcccacagttttctgtaggtttagtgtggctggcgccccgttctcctccagttgggaacatgcacccggagcttggggtgcagatcctgatgggtgcctgcctcccccgcccccagccggtgctcaggtggcccaggggccgcacagacgaggcgtggtccaggcattgttgcacatgtactgagggtgtttttaagtgaattgcttagtaggcttctaggaagagtcagatttatagcattttcaaccaaaataatggtgagtgcctaggcttcccgagttagctctttgggtggcccctgagcccctgtgagtgcacttgaccgggtgcggaggtcctgggcagcctgtccctgagccggcccctcccaggggtctgagatccatgaggtgtgtccctagggcttcagtcctggggcagaggcataaacagaaccagtcactatggaggtcgaggattcccatgtgggcccttcagcttgggctgcttggccacggaacagcccttggctccctggcccccggcccccatgcagcccctgggctggcccttggtggtctctgtccaagggagagcccctgggtgttcaggaggctgccccgggtgggctgctcagggcagctgccgaaggtggagcccagagcctgtctggaagggctgtctgtggctgtcctgagacctggccttggactcacaaggaagaccaggctgaggcccctccaggccagggtcctggggcaggcatctcagggagcagccagcccaggcctcctgccgtctccaacagggcatgtcccgggaggaccctgagtgccagattcccctggacgctcctgctgattctgtcggcagttgaaggcccgtctgaggccccgcaatgcgagggtcctgtgtcccacttcactgctccgaagggaactggctggctgtccgtccagtgagcggcccagaccccacctctgcgccattgtcaccagggccctgtcctggctgccctcacccatgtcaagctactgaggctgtgtcttgtttgttttctctgttacatttttgtttgctgttgtcacagtcagctggtttcggcgtgatgttgaccttttgatgtacatactccgttttaaactcatttccactctagttgagttctgcagcatgcagcggtatgaccctacgggggtcaggagagccctgcggcccccacccaccagctcagaacctgtcactaatacagctgcctgtgaccctgggacccgcaaccttccagctgcttccctttgtcaaagtcacgagtgcgtctgccttgacagccctcgtcaacagaacttccagtgggttgtgggttcatttcctttctttttaagaacagggttgggaccttttctgcccctgccccttagctactgaggcatagggagaggaagttaatttcagagccatacaaaaataagccacaaccagcttcagaattaattcccaatcccccattccaccagggctgggagcccattcccagtgcttcccaaggccctcggggacatctaccgccaacccagctgcttctggcaggggctccaagccccagcgtggggaagggccctggagaagccctcatcctcatgggaaccacactgcagtgggtggggaaggttgttgtcagcaccgcccccggctcctccaggtcctgctggctcctcgggggcagggttccctggacctcccagttctgcgccttggggccagccagtactcagagaggaggaccttctcaaccacgtacagaacacgggttttcatggctgcctttggtttggttttctgagaagataggattggattggattttgcagagggtgagaacttctctgtgcctgctcagaggcgccctagggaagggccatgtttgagttttgctttgtatgttgttttgcaagtatctgcctggtactttgatttaaaataaaaacaattttcataaaaaaaaaaggaaaaagaaaaaagaaaaaaaaagaagaaaaaaataagaagaaaagaaaagcagacgaaaaaaagaaaaagaaaacgaaaaggaaaaaaagaggggggggggggaaaaaaaaaatacggaggggggaggacaagtgggagcaccacgtttatgagaaaggggggaccccccaacaaggacgagacgaactaaaaaaaaacagagacagcagggccagtcaaaaaacagaacgcgtgcgcgcgaaaacaaccccatgcaagtgcgacaccatggagggagaagacaccccacatgggagggagagacaaaacagagagaaccaccaccacacaagagaagcaaagaccgcgcgaacaacaaaaacggtcgagagtagaggggcaccccgaagcatacgagggccgcaacaaatgtgcacgcgataagaagaaaatacg

SEQ ID NO: 364856 - DNA, 4137 bp, Homo sapiens
ccgccgccgccgcagctcccgacgccgccgcccccgccgggtgcctaagcaggcccggcgcggccccaggacttgggaccctggaggactgacgctgctggcctgggcgtccccttccgctgagccatggcgactcccgacgtgagtgtgcacatggaggaggtggtggttgtgacaactccggacactgcagtggacggcagtggtgtggagggggtgaagaccgtgttggtgacgaccaacttggcccctcacgggggcgacctgacggaagataacatggagacagaaaatgcagcggcggcagctgccgcggccttcacagcctcctcccagctcaaggaagccgtgttagtgaagatggctgaagagggggagaacctggaagctgagattgtgtaccccatcacctgtggagacagcagagccaacctcatctggaggaagtttgtgtgtcccggcatcaatgtgaaatgtgttcagtacgacgagcatgtaatcagcccaaaggaatttgtgcacctggccgggaagtccaccctgaaggactggaagagagccatccgcatgaacggcatcatgctcaggaagatcatggactccggggaactggacttctaccagcacgacaaggtctgctccaacacctgccgcagcacaaagattgacctctcaggagcccgtgtgtccctgagcagccccacgtcggccgagtacattcccctcacgcccgccgcagccgacgtgaatgggtctcctgcgaccatcaccatagagacctgtgaagaccctggcgactggaccgcggccattggagatgacacatttaccttctggcgggggctgaaggacgccggcctgctggacgaggtcatccaggagttccaccaggagctggtggagaccatgagaggcctgcagcagcgggtccaggaccctcccctgcagcttcgagatgctgtacttctcaacaacatcgtgcagaacttcggcatgctggacctggtgaagaaggtgctggccagccacaagtgccagatggaccgctcgcgggagcagtacgcccgggacctggcagccctggagcagcagtgtgatgagcatcgtcgccgagccaaggagctgaagcacaagtcccagcacctcagcaacgtgctcatgacgctgacgccggtctccctgccaccgcctgtgaagcggccccggcttgcacgtgccacatcaggaccggccgccatggcctcgcaggtgctcacccagtctgcccagctggcgcttggcccgggcgtgcccgtcccccagctgaccagcgtgccccttggtaaagtggtgtccaccctgccgtccaccgtcctgggcaagggttcccttcaggcgccccccgccagctccccggcctccccgctgctcgggggatacacagtcttggcctcttccggctccacctaccccagcacagtggagatccacccggacgcgtccagcctcacggtcctgagcacggccgccgtgcaggacggtagcacggtgttcaaggtggtcagcccgctgcagctgctcacgttgcctggcctgggccccaccctgcagaacgtggcccaggcctcgcctggctccagcacaattgtgacagtgcccgcaggggctgcccccgggcctgaggagcacacggccaccattgaggtggctgccatggcagaggaccacgagcggaagtagccgacaggagggcgaggcccctgggacggacagggctggctgtctctcagccgcggcagcagggagcgggcagaggccgcagggctggctcgggcaggtgggtcacgtggtctgcagaaccaaagagaggaatcgccaaaacaaatcacgagaagagagaaggggacagaacagcgagagcaacctggaaaaccggtcttcaggtcccacgtttcctcccccttttttcttgggaaatatatttttccatctgttgcttattaatactgtttacacattgggccttgatcaggagccaggtgggcgggggctagggggagcctgggtgcagcagagacagaggaagcagagccaggtgccgagcgcgaccctgcaggtgctggacgcggtgcagcaggtcacgaggcccccatgtctgcacccagccaggtccctggggacgttactaactcatgacttgggagctaagcccaagtgtgaaacctctggatcctatggatttggtttcttcccacagttttctgtaggtttagtgtggctggcgccccgttctcctccagttgggaacatgcacccggagcttggggtgcagatcctgatgggtgcctgcctcccccgcccccagccggtgctcaggtggcccaggggccgcacagacgaggcgtggtccaggcattgttgcacatgtactgagggtgtttttaagtgaattgcttagtaggcttctaggaagagtcagatttatagcattttcaaccaaaataatggtgagtgcctaggcttcccgagttagctctttgggtggcccctgagcccctgtgagtgcacttgaccgggtgcggaggtcctgggcagcctgtccctgagccggcccctcccaggggtctgagatccatgaggtgtgtccctagggcttcagtcctggggcagaggcataaacagaaccagtcactatggaggtcgaggattcccatgtgggcccttcagcttgggctgcttggccacggaacagcccttggctccctggcccccggcccccatgcagcccctgggctggcccttggtggtctctgtccaagggagagcccctgggtgttcaggaggctgccccgggtgggctgctcagggcagctgccgaaggtggagcccagagcctgtctggaagggctgtctgtggctgtcctgagacctggccttggactcacaaggaagaccaggctgaggcccctccaggccagggtcctggggcaggcatctcagggagcagccagcccaggcctcctgccgtctccaacagggcatgtcccgggaggaccctgagtgccagattcccctggacgctcctgctgattctgtcggcagttgaaggcccgtctgaggccccgcaatgcgagggtcctgtgtcccacttcactgctccgaagggaactggctggctgtccgtccagtgagcggcccagaccccacctctgcgccattgtcaccagggccctgtcctggctgccctcacccatgtcaagctactgaggctgtgtcttgtttgttttctctgttacatttttgtttgctgttgtcacagtcagctggtttcggcgtgatgttgaccttttgatgtacatactccgttttaaactcatttccactctagttgagttctgcagcatgcagcggtatgaccctacgggggtcaggagagccctgcggcccccacccaccagctcagaacctgtcactaatacagctgcctgtgaccctgggacccgcaaccttccagctgcttccctttgtcaaagtcacgagtgcgtctgccttgacagccctcgtcaacagaacttccagtgggttgtgggttcatttcctttctttttaagaacagggttgggaccttttctgcccctgccccttagctactgaggcatagggagaggaagttaatttcagagccatacaaaaataagccacaaccagcttcagaattaattcccaatcccccattccaccagggctgggagcccattcccagtgcttcccaaggccctcggggacatctaccgccaacccagctgcttctggcaggggctccaagccccagcgtggggaagggccctggagaagccctcatcctcatgggaaccacactgcagtgggtggggaaggttgttgtcagcaccgcccccggctcctccagtactcagagaggaggaccttctcaaccacgtacagaacacgggttttcatggctgcctttggtttggttttctgagaagataggattggattggattttgcagagggtgagaacttctctgtgcctgctcagaggcgccctagggaagggccatgtttgagttttgctttgtatgttgttttgcaagtatctgcctggtactttgatttaaaataaaaacaattttcata

SEQ ID NO: 364857 - DNA, 147 bp, Homo sapiens
aaaccaaataacttgcctctaagattagtaatacagtgtgatgtcctctttcatcttctgttggaggtcctagctagtgcagtaaggaaagaaaaaagaaataaaagtacacagattggaaaagaagtataacaatttgcatttgac

SEQ ID NO: 364858 - DNA, 343 bp, Homo sapiens
gagccaaggtcatgccattgtactccagcctgggcaacagagtgagaccctgtctcaaaaaaaaaaaaaaaaaaaaaagcagaattgctttctagctctaaaaatgatctttacagtcaggcccaaatctccagttggtttgtattctagaacttgcctcagcaccagagcttgggatggctgggggagttattctccggaaccttatttaggacagcctgtcaccaaagaagccaaccctaacccgaatgaaaattgatgataaatatttagttaaactgcatggatcaccttgaacacctaacaaacatttgcttttactgtaatataggcagtctacaaa

SEQ ID NO: 364859 - DNA, 2378 bp, Homo sapiens
tccccagaagtgggatggctaggttggaactgatgcacgtacagtctgggtagatttgccaagcttcccacctcaggccatgccagcctgggctggcactacattcccaagaaggtccatttccccacagtctcaccaggctgcaggattcttcctgtcaggtaagaagcctgtcttggggcaattgttaagtttgcttttctgttacagagtgagtttgagcgtgttttcaaaagctgaagatcatttacacagcctttcctgcaaacactgtgtttttcctttgcctgtttttcttatcagtttataggttccttgtatatgtgaaggaggttggttccttgtctgtgatgatttgcaaatgtttttccatgcatcttttatttttgtttatgggcttttgccacatggaggctttgtgtttttctgtagttgagtagtctttttgtggcttctggtttggaaagcacatagagacaccaggacttgatgattgtaacagtcaggggcagctacattccttggcctttcactgcggctcacggtctggtatgggccccctgtacgtcctctccccattgtacagaggagaaaactgaggctcagtcacttgcccagagcacaccgccaaagtcacagatagtctctgccactcccctgcctccaccaccgtgggggaatttggcacctgctccctagtgggctctcctccccaggatatgcagtcagatgaaatgtggccaagtcaggattcgtgctgggcccactcccacctgctgcctgcacacctacaggctcagcattcagcaccccattaaagcccagtgggggctctgttcaaacactgcctgagtcctgcagtatggcgtcgtggcagagcatggacagatggccttgcctggtcccggctccaccgcttccaagtccatcacacaggggtccctggaggtttggggtaaggattgagtgtcccagtgcatgtggagcacagagatcagagcttgcacaagagaagcacacacaggtgtctgtgttcttggctgcagcccgcatgggccaaggagttcagatccagtgccccccacctcccctttcctgccgccatgctctgtaggcttggcccctcctgctgtgatcctgatcacagccttccaccctagagaattaatcacagatccaggccaaggttctcccacaaaaacaagcatcatgtcggttacaagagcaagaaactggcctcaacttggcgagcttcaacgggggtccagcagcggcccagagcagcttccaggagtacgtggggggagtgcgtggtgctctgccttgttctgcggctgtctgaacagtctcctgcctctgcactcagttcagcctccaaacactgagtgcccactctgcacaagatactttgttgaggcagtgagataacacaggacccacttcctgcctctaagtctaatgggggagcaggaggagggcaaggacctggcaggatgaggcagagagatgaatggaatggagccgcatctcaggcagttgcaattcctgcaggccaggggagagaccaggaggaaagggcaggttatgccagaatcagggccaggtgtggaggtgtgccccaagtgatcctcccacctctcaagcctcaggagacaggaggatggcttgagccctagaggttgaggctgcagtgagctatgttcatgacactgcactccagccttggcaacagagtgagaccctgtcttcaaaaaacaaaaacaagccccagaatcagtgggtagaagactcggggcaggggagaagaccacccacctgctgctccttcagctggaaaagctggactgccccaggctgggaggaactctgtaaggactcactagaagcttctgaagtgatcaggccactggaggacaagttgagggctgggtcacaaaagtgagttcaggagggcagtgagagtcactcaaggtcacaggtcacgctggcacgcctggcaggcagcctgggagagataggagtcccggctctgcaggtggagacatcgcagagggccttgggcatccaggaggatggcagtaccataggcgacgctgctgcggcctggccgtgtggagcactgcactcctaggaagcaggaaatggctgttcacaggaacccacaggccaccggctccagctttgacctgggaagctgtttcaggcaggtggagaggatgaggtttgaggagcagagggaagagctgctgagggggtgggcgctgggcagtcgggaggcgaaggcaggagatggcttgagccctagaggtcgaggctgcagtgagctatgttcatgacactgcactccagccttggcaacaaagcaagaccctgtctcc

SEQ ID NO: 364860 - DNA, 173 bp, Homo sapiens
gtagggagaaaggagtagatggaaagtgtagctggaatgcaaactagatataatctgggttttattactctcttcatacttacgaataagaaagactattaaaaaagaatgcctaggccaaaaagattgtcactaatacaaacaataagctaaatgactcttactgcaagaaa

SEQ ID NO: 364861 - DNA, 752 bp, Homo sapiens
caaacgcagatcaaagaccccaagacccctccccaacctggacatcagccggccccgcgccaaggcgcgtctagggggcgctcgctgcgcgccagatgtgcgggccgctctcagacacccgctctctgctccctccaacaaggggaggagctagggacagagggaggagagaaaggcgggggtgtaggggggaagcgaaccaggccccgcccagcccgccaggccccggcgggggaagaaggaggcggagagccgagctggcgtaacgagactttactgaaaacagaaaaccgggcgaaccaaggattacaaacaggaatgtggactcgtagcaaaacaaaacaaaacagaacaaaaaagggaggggggaccggtcgaaagaaccgaaggggggagcgagatcgaggaaaggggcggagaatttttttttcttcttcccatttctttaaaaaaccaacacaagaaaacacacacacacacaaccaacgtttgttcccgagtagaaacataaatagggcagaatcgaacactctgttcttctctcttccaaagaaaaaaaaaaaaaagtaaaagtaaaggaaaggcagggtttgaggctgcgccccctcggagcccccttccgcggcgcggtgtaacaaaggggcagccgagacgcgcgggtttgtgcaacacggggcggccgcgcgggggaaagaggcagcgcgaggacgggggggtcatgcgctcgcccccccgggagcagggggtccagc

SEQ ID NO: 364862 - DNA, 578 bp, Homo sapiens
ggccgcgtcgccttgtaatacgactccctatagggcaaaacctttgcacccaatattctgggtctttgtttcttcctcatgctttggcgtaacgagactttactgaaaacagaaaaccgggcgaaccaaggattacaaacaggaatgtggactcgtagcaaaacaaaacaaaacagaacaaaaaagggaggggggaccggtcgaaagaaccgaaggggggagcgagatcgaggaaaggggcggagaatttttttttcttcttcccatttctttaaaaaaccaacacaagaaaacacacacacacacaaccaacgtttgttcccgagtagaaacataaatagggcagaatcgaacactctgttcttctctcttccaaagaaaaaaaaaaaaaagtaaaagtaaaggaaaggcagggtttgaggctgcgccccctcggagcccccttccgcggcgcggtgtaacaaaggggcagccgagacgcgcgggtttgtgcaacacggggcggccgcgcgggggaaagaggcagcgcgaggacgggggggtcatgcgctcgcccccccgggagcagggggtccagc

SEQ ID NO: 364863 - DNA, 661 bp, Homo sapiens
caaacgcagatcaaagaccccaagacccctccccaacctggacatcagccggccccgcgccaaggcgcgtctagggggcgctcgctgcgcgccagatgtgcgggccgctctcagacacccgctctctgctccctccaacaaggggaggagctagggacagagggaggagagaaaggcgggggtgtaggggggaagcgaaccaggccccgcccagcccgccaggccccggcgggggaagaaggaggcggagagccgagctggcgtaacgagactttactgaaaacagaaaaccgggcgaaccaaggattacaaacaggaatgtggactcgtagcaaaacaaaacaaaacagaacaaaaaagggaggggggaccggtcgaaagaaccgaaggggggagcgagatcgaggaaaggggcggagaatttttttttcttcttcccatttctttaaaaaaccaacacaagaaaacacacacacacacaaccaacgtttgttcccgagtagaaacataaatagggcagaatcgaacactctgttcttctctcttccaaagaaaaaaaaaaaaaagtaaaagtaaaggaaaggcagggtttgaggctgcgccccctttttgagcccaaatcggaaggtccggagctcgatttcgataaatcagtggccaa

SEQ ID NO: 364864 - DNA, 411 bp, Homo sapiens
aaaatgacctggggcataactttctattagcagacatcccaagattaagaggggcaaatgaagacatgtgatatctcttaaggtgtcatcctggaactggagtgtgtcacttctgctcacattccactggccaaagccagatatgaccaagcccattatcagtgggatgaggaagagtactccactcagggaaattgttgaattgcgtcccctaaacttcacatgttgaagtccttacccctagtacctcatgatatgaccttgtttggagatagaatctttacagagataatcaacttaaaaagaggttatcaaagtaggcccaatccaacatgactggtgtccttataaaatgaagaaatttggacatagagacacaaagcaagaaaatgtgaagacttaagggggaga

SEQ ID NO: 364865 - DNA, 1431 bp, Homo sapiens
ataagagatttggagggaggaaaggaattggaagaggaagaggagaaggcaggagatcccacacagtttagtcaaatggtggtacacaaccgagctggatggtattttcttctgcgtgtgagttgtgaagactttttatgagatcttaggagaagaggtgggtgtagtactgggagtaagtgtcacaaattagagtaaacaggaatgagtctggtcaaagaacatatttctgacttccgggttcaaattttaattatgccagaatccctgagctgcaaaaagttgccttcttggggagtcaaagcttttaaacaaatgaactggaacctcagcgcccactgagctatgcagaagagtcctagaagccagcgctccatgcttgccactcattgtcctgtgaaacttgggccacaggatattttccacaccagtggaaaagacatgtatcataccgaattgtgccctttgatatcctgccgaaaaggccaagatgcaatagtccgtgtgacagcttatccctgagtcctgtacataaatcgggcataatcagcaaagacgttccttagtgtttatgaatgccgcgagctgttcagggctgggtatttgtgaagccttgttcaattggctggagcatgactgaggttgaaacttcacaggtcagctgtggcctgagcgctagccttcatgtcttgtgggggaggggaagaaaaggtactggtaagagtctccaaagcactgatagtggactgaatctgcttgatgacccaccttgatccagggcccctttactccagtgggagaccttatacatttttagtgtctagagatttaagttgccactcttcttagtgtttgaaaactacctttttaattgcaagagggaatataaacatacaccaacaaaagacagcacaatggaaggcagcccagaggcagtcctgctcattgctgacttcagttcaaaatattttgcatgcctggaattttcaccatctcagaggtttcctctatgagcaattaaagaacagcctatggatcccagagtttccataaaatagttcttatttaacttgcaacatttggtcaggcactctcctgttaaattctttaaatacatctttgttatttaaagaacaaaacaaaacaccgggcactgtggctcatgcctgtaatcccaacactttgggaagcccacgtgggaggatcgcttgaggccaggagtttgagaccagcctaggcagcatagtaagactactgctctctacaaaaaatttaaaaaagaaaaagaatatgtaagtggggctgggcacagtagcttatccctgtcaccgcagcactttgggaggctcaggtgggaggatcacttgaggtcagcagttcagaatcagcctgggcaatacagcctgtacaacagagtgagaccctattttt

SEQ ID NO: 364866 - DNA, 6065 bp, Homo sapiens
cgggcggggaccgggggcgggggcggcggcggcggccgggagagcggaggaggcggagcagggagccgggagcgggctggcccgcgctcctcctgctggctggggattttccagcctgggcgctgacgccgcggacctccctgcgaccgtcgcggaccatgggcgacaaagggacccgagtgttcaagaaggccagtccaaatggaaagctcaccgtctacctgggaaagcgggactttgtggaccacatcgacctcgtggaccctgtggatggtgtggtcctggtggatcctgagtatctcaaagagcggagagtctatgtgacgctgacctgcgccttccgctatggccgggaggacctggatgtcctgggcctgacctttcgcaaggacctgtttgtggccaacgtacagtcgttcccaccggcccccgaggacaagaagcccctgacgcggctgcaggaacgcctcatcaagaagctgggcgagcacgcttaccctttcacctttgagatccctccaaaccttccatgttctgtgacactgcagccggggcccgaagacacggggaaggcttgcggtgtggactatgaagtcaaagccttctgcgcggagaatttggaggagaagatccacaagcggaattctgtgcgtctggtcatccggaaggttcagtatgccccagagaggcctggcccccagcccacagccgagaccaccaggcagttcctcatgtcggacaagcccttgcacctagaagcctctctggataaggagatctattaccatggagaacccatcagcgtcaacgtccacgtcaccaacaacaccaacaagacggtgaagaagatcaagatctcagtgcgccagtatgcagacatctgccttttcaacacagctcagtacaagtgccctgttgccatggaagaggctgatgacactgtggcacccagctcgacgttctgcaaggtctacacactgacccccttcctagccaataaccgagagaagcggggcctcgccttggacgggaagctcaagcacgaagacacgaacttggcctctagcaccctgttgagggaaggtgccaaccgtgagatcctggggatcattgtttcctacaaagtgaaagtgaagctggtggtgtctcggggcggcctgttgggagatcttgcatccagcgacgtggccgtggaactgcccttcaccctaatgcaccccaagcccaaagaggaacccccgcatcgggaagttccagagaacgagacgccagtagataccaatctcatagaacttgacacaaatgatgacgacattgtatttgaggactttgctcgccagagactgaaaggcatgaaggatgacaaggaggaagaggaggatggtaccggctctccacagctcaacaacagatagacgggccggccctgcctccacgtggctccggctccactctcgtgcactcggatgcttactcgtcttcttcctgttctggtttcttttcccctttgttcttccagtttctaccagggggccccgtgggcttccagatcacggtgatgaacctctggcctcaggattggccccacatcaccacgccaacaggaccacagcgcactggctccaccccatctctgccatctccactcccctccttttcatgctgtctcccagaaaagctgccagggctctggccttggaattggacttgagatggggagcagacaggggaggatggggaatgtgggacacggtgtggtgggcatgagggcttggaggggtggggatgagggctcaagacacgagagaagatgtccacggtcccaggtggttaacaaagttctggcagctaaaagatgaccgcgttgaaggccacctccttctggctgggaggggcagaactgtggacagattctcaatgcctttttgaagttctgacccaccaaagaccttctgccttcaccctcctccccacctgatgtccctctgtgtctgatagtgatgttggtgaaagttcgtagaccccaggagtagagaaaagcaactggactgactttcttaccagcagttacctagactgaggcaagctgtgtggactcacccaagtatatttcagtactgtcaggctgtgacatcttagctaccttgtatttcaagtgcatggccctgtctagagatatgcacagagagaaaagcagagggagggagggagggggtcttcagcaagcaccagcccccagcagagtgagctgaagctcctgaggagggttcccgaaggggggcgctcagagatgggggcagggggcggggagaggagagtctgccttatgtcccttccttgtggacttcacatggtcatgcaggaagtgaggatgggtgtccagcgggggccgaggccactagtatcctcctgcttccccctgccattctccagggctggactgaccctatggactgggagagagtgcctgaggccaccatgccacagtcaaagggggtcctatctcagaaggtggcagcatccactgagatatcctcacccgaagggaaggaggctgctgggtagcaaataagccccttcttttcttggtgagttgatgacctccaatagctcccagtgtcatgggtacccagtacgcattagctggtgttgggttgattgagacctggggcagttcctggggcaagaagccagatgggagatgagatagaaagtgttaggagttatcctctttgcctggcctttgagaataacttactgtgtgactttgggcaagttccttccccactctgggcctcagtttctcacttgggaaagcaaggagtttgaccagatgatcacaatgggccttcctagctctggccaccaagaatttgtgaacattagagctcctggtctggtgggtagagccagagctgctgactggtctctctgcctccagaggggatttattggacctcagaggtggcagggccctatggagcaccaactgccctcaaccccaccctgtgcccaagactgggaagggattgatgtcaggctgtggccataggtagcatgagttgcccaaggagggacagagcatatctttgctgaggcttggctgaggggcttatgatagggcttgcagtacctcacagccccctgtgggcacagacaccctgaggtttacccaggcaaatatattgattagcaggacaagggctctctcctcagtttctgctcccttccatctctctcccatacttgtctgaaaagggagacaaaaaatcttatacaagtggcatctcaatcctttccagtccagcacctcctggggcaggcagtgtgacttatttcctgtggtgaaatcacctgtttcacaagcctggcagcgcgacttctgagtctcatgaccactcaacccaagggacccctccccagaccagaaccaagtcagctgggggctgtcgtactaccctgtccagtcttgagggcctagttgcaggtcccccaggcatccagcccctcctagagcttgctgggcaggctgcacctcatctgggcaggcgcagagctgatgaaatgctggagcaatgcatggcaaacatatgccctccagtgtcttctgaaacctttggggctgacacaagatcctttagtgtttgggatgacctctttcctgcagacttcttccccaccagtcttcatcgcttgccctgcttctcacttaggcagatgtcaaccagaatgagatacagccaatttggctttgatgacccagctgagagggaaatttagatacaattcaggaatatcatgcccaaaaatagtggtcccagcaaccaggacacagagggaagacctggatattgtcagtgattggtggagggggacatcttggaccctcctaggcctggtgtcacatctcccatctctcagaccccacagaggccaaggggccttggctctgacccaggttaaagagagccaccagcccccaggctcagggagctgaaaccacccatccgcagaaatctaagggcaaggagaaatagaaattgtctgttccttcccttcaaagtgtaaggcctcttccaggagcaactggagccaccacagcttctcagtgacattgggagggcttcgggcccaggaaaaacccaagccttttgtcctgagagccgagccacagcggatgcagtggcgtcagcatcccagagcggcagcttctctcctgcctgtcactggggactggttgctctccacccatccaggaggaaggggttaggtcccagtcttacactcttatagggtctcatggacataggcctatgcctgttctgatatctataattttttaaactcaaaaggaccaaaacactcctgaaccctcatctatacggcctgcactgggcttggtgtttcctcctggcccaggcagctccatctcttctgccattcctcctggacgaaagtggcaggaccccacctctaccacttccccacagggtcactgcacagcggcttcaaagacacgccctgttgaaggggaaacatcctccccccatcacactccaactcgtcaccccaaaagggaagtcaaagcacaggtccgtggggcctatggtttgtagacactgacacagtggttttcaaaccaggtgctgcggaacccctgatattccacagagctttgtcaggggatgctaaagtgggaagatgggagtggaggcaaaggataggtttccagccctcctcccatttccgccgccaccagaataactctgcttttatctgtcttgcctactgagatttcattttcaagctttctttgaagaagaacttcaaaccaccatctcgaggtttgatcttagaccagccagcacaggttctattcttgctgttcatgttggaatggctccagcgttccagtacaaagtgtctttgtgttggaacttgggtcacagacccaggcacaagcatttatacacacacacacacacacacacacacacacacacacacgtacatagttgatggtttttctagccaacccaccctgaagctctggccaaggtttgatttggacagggacctggtgctcagtggggatgggtcgtgaccctgatattggcccatgaagcatggggagctctggagcaaggaaacaggctcaatcccccactgaggacttgtgtctgcacccctatctggcaccccactttcctggcctaggcccaagggacacagcaggagaagcagtgtgataggagagaggctagggttaaattcatctttacacagcgccggatggatggaaatcttggctcacataaaagacagactcagggaggattttatgacaaaagtccctcctttgagggcaggattcccccaggaatcctggacactttagtgagaactggaccagcccttggcacaaaaccctgcctgccctgtcccccactcccaccccccagggaattctaggtgaaaatgtgaagctcagggcacagcaagcgcatgacacgggtgtattacattcggtccgagtgtgtccttagtttccctgtgtgcaaaatggggctagtccaggctcttcccacctcactgggacaattgcaagggtcataggagaggtgggtatgataggtggtcatatgaggtggtgagtatgagaggtgggtgcctcacaaactcggggtatggtcctgacctgcatggcagatgagcagagcacttgggaacgagcataggaagtgccatcttcccgggcatctctgctcagtgttaaggtctagccacagacactgtgggacctgcctcttcctatggaatgggggcctgcatgggttgtgtcctggggcaggagtgagggatggctgggaagaatctccaggtctgtggcccttgtgttgagtgattattttgtgacactctcattcctggaccacctgccaggtttatctgttatacctgtggcattcttattatgtcagacaagttattatagttcattcaactctaacaaatgaacaaaagaacaataaataggaggccattaaaggtcttttgtggcagag

SEQ ID NO: 364867 - DNA, 5398 bp, Homo sapiens
cgggcggggaccgggggcgggggcggcggcggcggccgggagagcggaggaggcggagcagggagccgggagcgggctggcccgcgctcctcctgctggctggggattttccagcctgggcgctgacgccgcggacctccctgcgaccgtcgcggaccatgggcgacaaagggacccgagtgttcaagaaggccagtccaaatggaaagctcaccgtctacctgggaaagcgggactttgtggaccacatcgacctcgtggaccctgtggatggtgtggtcctggtggatcctgagtatctcaaagagcggagagtctatgtgacgctgacctgcgccttccgctatggccgggaggacctggatgtcctgggcctgacctttcgcaaggacctgtttgtggccaacgtacagtcgttcccaccggcccccgaggacaagaagcccctgacgcggctgcaggaacgcctcatcaagaagctgggcgagcacgcttaccctttcacctttgagatccctccaaaccttccatgttctgtgacactgcagccggggcccgaagacacggggaaggcttgcggtgtggactatgaagtcaaagccttctgcgcggagaatttggaggagaagatccacaagcggaattctgtgcgtctggtcatccggaaggttcagtatgccccagagaggcctggcccccagcccacagccgagaccaccaggcagttcctcatgtcggacaagcccttgcacctagaagcctctctggataaggagatctattaccatggagaacccatcagcgtcaacgtccacgtcaccaacaacaccaacaagacggtgaagaagatcaagatctcagtgcgccagtatgcagacatctgccttttcaacacagctcagtacaagtgccctgttgccatggaagaggctgatgacactgtggcacccagctcgacgttctgcaaggtctacacactgacccccttcctagccaataaccgagagaagcggggcctcgccttggacgggaagctcaagcacgaagacacgaacttggcctctagcaccctgttgagggaaggtgccaaccgtgagatcctggggatcattgtttcctacaaagtgaaagtgaagctggtggtgtctcggggcggcctgttgggagatcttgcatccagcgacgtggccgtggaactgcccttcaccctaatgcaccccaagcccaaagaggaacccccgcatcgggaagttccagagaacgagacgccagtagataccaatctcatagaacttgacacaaatgatgacgacattgtatttgaggactttgctcgccagagactgaaaggcatgaaggatgacaaggaggaagaggaggatggtaccggctctccacagctcaacaacagatagacgggccggccctgcctccacgtggctccggctccactctcgtgcactcggatgcttactcgtcttcttcctgttctggtttcttttcccctttgttcttccagtttctaccagggggccccgtgggcttccagatcacggtgatgaacctctggcctcaggattggccccacatcaccacgccaacaggaccacagcgcactggctccaccccatctctgccatctccactcccctccttttcatgctgtctcccagaaaagctgccagggctctggccttggaattggacttgagatggggagcagacaggggaggatggggaatgtgggacacggtgtggtgggcatgagggcttggaggggtggggatgagggctcaagacacgagagaagatgtccacggtcccaggtggttaacaaagttctggcagctaaaagatgaccgcgttgaaggccacctccttctggctgggaggggcagaactgtggacagattctcaatgcctttttgaagttctgacccaccaaagaccttctgccttcaccctcctccccacctgatgtccctctgtgtctgatagtgatgttggtgaaagttcgtagaccccaggagtagagaaaagcaactggactgactttcttaccagcagttacctagactgaggcaagctgtgtggactcacccaagtatatttcagtactgtcaggctgtgacatcttagctaccttgtatttcaagtgcatggccctgtctagagatatgcacagagagaaaagcagagggagggagggagggggtcttcagcaagcaccagcccccagcagagtgagctgaagctcctgaggagggttcccgaaggggggcgctcagagatgggggcagggggcggggagaggagagtctgccttatgtcccttccttgtggacttcacatggtcatgcaggaagtgaggatgggtgtccagcgggggccgaggccactagtatcctcctgcttccccctgccattctccagggctggactgaccctatggactgggagagatacctcacagccccctgtgggcacagacaccctgaggtttacccaggcaaatatattgattagcaggacaagggctctctcctcagtttctgctcccttccatctctctcccatacttgtctgaaaagggagacaaaaaatcttatacaagtggcatctcaatcctttccagtccagcacctcctggggcaggcagtgtgacttatttcctgtggtgaaatcacctgtttcacaagcctggcagcgcgacttctgagtctcatgaccactcaacccaagggacccctccccagaccagaaccaagtcagctgggggctgtcgtactaccctgtccagtcttgagggcctagttgcaggtcccccaggcatccagcccctcctagagcttgctgggcaggctgcacctcatctgggcaggcgcagagctgatgaaatgctggagcaatgcatggcaaacatatgccctccagtgtcttctgaaacctttggggctgacacaagatcctttagtgtttgggatgacctctttcctgcagacttcttccccaccagtcttcatcgcttgccctgcttctcacttaggcagatgtcaaccagaatgagatacagccaatttggctttgatgacccagctgagagggaaatttagatacaattcaggaatatcatgcccaaaaatagtggtcccagcaaccaggacacagagggaagacctggatattgtcagtgattggtggagggggacatcttggaccctcctaggcctggtgtcacatctcccatctctcagaccccacagaggccaaggggccttggctctgacccaggttaaagagagccaccagcccccaggctcagggagctgaaaccacccatccgcagaaatctaagggcaaggagaaatagaaattgtctgttccttcccttcaaagtgtaaggcctcttccaggagcaactggagccaccacagcttctcagtgacattgggagggcttcgggcccaggaaaaacccaagccttttgtcctgagagccgagccacagcggatgcagtggcgtcagcatcccagagcggcagcttctctcctgcctgtcactggggactggttgctctccacccatccaggaggaaggggttaggtcccagtcttacactcttatagggtctcatggacataggcctatgcctgttctgatatctataattttttaaactcaaaaggaccaaaacactcctgaaccctcatctatacggcctgcactgggcttggtgtttcctcctggcccaggcagctccatctcttctgccattcctcctggacgaaagtggcaggaccccacctctaccacttccccacagggtcactgcacagcggcttcaaagacacgccctgttgaaggggaaacatcctccccccatcacactccaactcgtcaccccaaaagggaagtcaaagcacaggtccgtggggcctatggtttgtagacactgacacagtggttttcaaaccaggtgctgcggaacccctgatattccacagagctttgtcaggggatgctaaagtgggaagatgggagtggaggcaaaggataggtttccagccctcctcccatttccgccgccaccagaataactctgcttttatctgtcttgcctactgagatttcattttcaagctttctttgaagaagaacttcaaaccaccatctcgaggtttgatcttagaccagccagcacaggttctattcttgctgttcatgttggaatggctccagcgttccagtacaaagtgtctttgtgttggaacttgggtcacagacccaggcacaagcatttatacacacacacacacacacacacacacacacacacacacgtacatagttgatggtttttctagccaacccaccctgaagctctggccaaggtttgatttggacagggacctggtgctcagtggggatgggtcgtgaccctgatattggcccatgaagcatggggagctctggagcaaggaaacaggctcaatcccccactgaggacttgtgtctgcacccctatctggcaccccactttcctggcctaggcccaagggacacagcaggagaagcagtgtgataggagagaggctagggttaaattcatctttacacagcgccggatggatggaaatcttggctcacataaaagacagactcagggaggattttatgacaaaagtccctcctttgagggcaggattcccccaggaatcctggacactttagtgagaactggaccagcccttggcacaaaaccctgcctgccctgtcccccactcccaccccccagggaattctaggtgaaaatgtgaagctcagggcacagcaagcgcatgacacgggtgtattacattcggtccgagtgtgtccttagtttccctgtgtgcaaaatggggctagtccaggctcttcccacctcactgggacaattgcaagggtcataggagaggtgggtatgataggtggtcatatgaggtggtgagtatgagaggtgggtgcctcacaaactcggggtatggtcctgacctgcatggcagatgagcagagcacttgggaacgagcataggaagtgccatcttcccgggcatctctgctcagtgttaaggtctagccacagacactgtgggacctgcctcttcctatggaatgggggcctgcatgggttgtgtcctggggcaggagtgagggatggctgggaagaatctccaggtctgtggcccttgtgttgagtgattattttgtgacactctcattcctggaccacctgccaggtttatctgttatacctgtggcattcttattatgtcagacaagttattatagttcattcaactctaacaaatgaacaaaagaacaataaataggaggccattaaaggtcttttgtggcagag

SEQ ID NO: 364868 - DNA, 4773 bp, Homo sapiens
cgggcggggaccgggggcgggggcggcggcggcggccgggagagcggaggaggcggagcagggagccgggagcgggctggcccgcgctcctcctgctggctggggattttccagcctgggcgctgacgccgcggacctccctgcgaccgtcgcggaccatgggcgacaaagggacccgagtgttcaagaaggccagtccaaatggaaagctcaccgtctacctgggaaagcgggactttgtggaccacatcgacctcgtggaccctgtggatggtgtggtcctggtggatcctgagtatctcaaagagcggagagtctatgtgacgctgacctgcgccttccgctatggccgggaggacctggatgtcctgggcctgacctttcgcaaggacctgtttgtggccaacgtacagtcgttcccaccggcccccgaggacaagaagcccctgacgcggctgcaggaacgcctcatcaagaagctgggcgagcacgcttaccctttcacctttgagatccctccaaaccttccatgttctgtgacactgcagccggggcccgaagacacggggaaggcttgcggtgtggactatgaagtcaaagccttctgcgcggagaatttggaggagaagatccacaagcggaattctgtgcgtctggtcatccggaaggttcagtatgccccagagaggcctggcccccagcccacagccgagaccaccaggcagttcctcatgtcggacaagcccttgcacctagaagcctctctggataaggagatctattaccatggagaacccatcagcgtcaacgtccacgtcaccaacaacaccaacaagacggtgaagaagatcaagatctcagtgcgccagtatgcagacatctgccttttcaacacagctcagtacaagtgccctgttgccatggaagaggctgatgacactgtggcacccagctcgacgttctgcaaggtctacacactgacccccttcctagccaataaccgagagaagcggggcctcgccttggacgggaagctcaagcacgaagacacgaacttggcctctagcaccctgttgagggaaggtgccaaccgtgagatcctggggatcattgtttcctacaaagtgaaagtgaagctggtggtgtctcggggcggcctgttgggagatcttgcatccagcgacgtggccgtggaactgcccttcaccctaatgcaccccaagcccaaagaggaacccccgcatcgggaagttccagagaacgagacgccagtagataccaatctcatagaacttgacacaaatgatgacgacattgtatttgaggactttgctcgccagagactgaaaggcatgaaggatgacaaggaggaagaggaggatggtaccggctctccacagctcaacaacagatagacgggccggccctgcctccacgtggctccggctccactctcgtgcactcggatgcttactcgtcttcttcctgttctggtttcttttcccctttgttcttccagtttctaccagggggccccgtgggcttccagatcacggtgatgaacctctggcctcaggattggccccacatcaccacgccaacaggaccacagcgcactggctccaccccatctctgccatctccactcccctccttttcatgctgtctcccagaaaagctgccagggctctggccttggaattggacttgagatggggagcagacaggggaggatggggaatgtgggacacggtgtggtgggcatgagggcttggaggggtggggatgagggctcaagacacgagagaagatgtccacggtcccaggtggttaacaaagttctggcagctaaaagatgaccgcgttgaaggccacctccttctggctgggaggggcagaactgtggacagattctcaatgcctttttgaagttctgacccaccaaagaccttctgccttcaccctcctccccacctgatgtccctctgtgtctgatagtgatgttggtgaaagttcgtagaccccaggagtagagaaaagcaactggactgactttcttaccagcagttacctagactgaggcaagctgtgtggactcacccaagtatatttcagtactgtcaggctgtgacatcttagctaccttgtatttcaagtgcatggccctgtctagagatatgcacagagagaaaagcagagggagggagggagggggtcttcagcaagcaccagcccccagcagagtgagctgaagctcctgaggagggttcccgaaggggggcgctcagagatgggggcagggggcggggagaggagagtctgccttatgtcccttccttgtggacttcacatggtcatgcaggaagtgaggatgggtgtccagcgggggccgaggccactagtatcctcctgcttccccctgccattctccagggctggactgaccctatggactgggagagagtgcctgaggccaccatgccacagtcaaagggggtcctatctcagaaggtggcagcatccactgagatatcctcacccgaagggaaggaggctgctgggtagcaaataagccccttcttttcttggtgagttgatgacctccaatagctcccagtgtcatgggtacccagtacgcattagctggtgttgggttgattgagacctggggcagttcctggggcaagaagccagatgggagatgagatagaaagtgttaggagttatcctctttgcctggcctttgagaataacttactgtgtgactttgggcaagttccttccccactctgggcctcagtttctcacttgggaaagcaaggagtttgaccagatgatcacaatgggccttcctagctctggccaccaagaatttgtgaacattagagctcctggtctggtgggtagagccagagctgctgactggtctctctgcctccagaggggatttattggacctcagaggtggcagggccctatggagcaccaactgccctcaaccccaccctgtgcccaagactgggaagggattgatgtcaggctgtggccataggtagcatgagttgcccaaggagggacagagcatatctttgctgaggcttggctgaggggcttatgatagggcttgcagtacctcacagccccctgtgggcacagacaccctgaggtttacccaggcaaatatattgattagcaggacaagggctctctcctcagtttctgctcccttccatctctctcccatacttgtctgaaaagggagacaaaaaatcttatacaagtggcatctcaatcctttccagtccagcacctcctggggcaggcagtgtgacttatttcctgtggtgaaatcacctgtttcacaagcctggcagcgcgacttctgagtctcatgaccactcaacccaagggacccctccccagaccagaaccaagtcagctgggggctgtcgtactaccctgtccagtcttgagggcctagttgcaggtcccccaggcatccagcccctcctagagcttgctgggcaggctgcacctcatctgggcaggcgcagagctgatgaaatgctggagcaatgcatggcaaacatatgccctccagtgtcttctgaaacctttggggctgacacaagatcctttagtgtttgggatgacctctttcctgcagacttcttccccaccagtcttcatcgcttgccctgcttctcacttaggcagatgtcaaccagaatgagatacagccaatttggctttgatgacccagctgagagggaaatttagatacaattcaggaatatcatgcccaaaaatagtggtcccagcaaccaggacacagagggaagacctggatattgtcagtgattggtggagggggacatcttggaccctcctaggcctggtgtcacatctcccatctctcagaccccacagaggccaaggggccttggctctgacccaggttaaagagagccaccagcccccaggctcagggagctgaaaccacccatccgcagaaatctaagggcaaggagaaatagaaattgtctgttccttcccttcaaagtgtaaggcctcttccaggagcaactggagccaccacagcttctcagtgacattgggagggcttcgggcccaggaaaaacccaagccttttgtcctgagagccgagccacagcggatgcagtggcgtcagcatcccagagcggcagcttctctcctgcctgtcactggggactggttgctctccacccatccaggaggaaggggttaggtcccagtcttacactcttatagggtctcatggacataggcctatgcctgttctgatatctataattttttaaactcaaaaggaccaaaacactcctgaaccctcatctatacggcctgcactgggcttggtgtttcctcctggcccaggcagctccatctcttctgccattcctcctggacgaaagtggcaggaccccacctctaccacttccccacagggtcactgcacagcggcttcaaagacacgccctgttgaaggggaaacatcctccccccatcacactccaactcgtcaccccaaaagggaagtcaaagcacaggtccgtggggcctatggtttgtagacactgacacagtggttttcaaaccaggtgctgcggaacccctttttttcccacattttttggaggggaatcttaaaagggaaaattggcaagggaaggttatggattctttcccatccttcgctccaaaaaaacctcgctcctaaaatacctttgt

SEQ ID NO: 364869 - DNA, 3931 bp, Homo sapiens
cgggcggggaccgggggcgggggcggcggcggcggccgggagagcggaggaggcggagcagggagccgggagcgggctggcccgcgctcctcctgctggctggggattttccagcctgggcgctgacgccgcggacctccctgcgaccgtcgcggaccatgggcgacaaagggacccgagtgttcaagaaggccagtccaaatggaaagctcaccgtctacctgggaaagcgggactttgtggaccacatcgacctcgtggaccctgtggatggtgtggtcctggtggatcctgagtatctcaaagagcggagagtctatgtgacgctgacctgcgccttccgctatggccgggaggacctggatgtcctgggcctgacctttcgcaaggacctgtttgtggccaacgtacagtcgttcccaccggcccccgaggacaagaagcccctgacgcggctgcaggaacgcctcatcaagaagctgggcgagcacgcttaccctttcacctttgagatccctccaaaccttccatgttctgtgacactgcagccggggcccgaagacacggggaaggcttgcggtgtggactatgaagtcaaagccttctgcgcggagaatttggaggagaagatccacaagcggaattctgtgcgtctggtcatccggaaggttcagtatgccccagagaggcctggcccccagcccacagccgagaccaccaggcagttcctcatgtcggacaagcccttgcacctagaagcctctctggataaggagatctattaccatggagaacccatcagcgtcaacgtccacgtcaccaacaacaccaacaagacggtgaagaagatcaagatctcagtgcgccagtatgcagacatctgccttttcaacacagctcagtacaagtgccctgttgccatggaagaggctgatgacactgtggcacccagctcgacgttctgcaaggtctacacactgacccccttcctagccaataaccgagagaagcggggcctcgccttggacgggaagctcaagcacgaagacacgaacttggcctctagcaccctgttgagggaaggtgccaaccgtgagatcctggggatcattgtttcctacaaagtgaaagtgaagctggtggtgtctcggggcggcctgttgggagatcttgcatccagcgacgtggccgtggaactgcccttcaccctaatgcaccccaagcccaaagaggaacccccgcatcgggaagttccagagaacgagacgccagtagataccaatctcatagaacttgacacaaatgatgacgacattgtatttgaggactttgctcgccagagactgaaaggcatgaaggatgacaaggaggaagaggaggatggtaccggctctccacagctcaacaacagatagacgggccggccctgcctccacgtggctccggctccactctcgtgcactcggatgcttactcgtcttcttcctgttctggtttcttttcccctttgttcttccagtttctaccagggggccccgtgggcttccagatcacggtgatgaacctctggcctcaggattggccccacatcaccacgccaacaggaccacagcgcactggctccaccccatctctgccatctccactcccctccttttcatgctgtctcccagaaaagctgccagggctctggccttggaattggacttgagatggggagcagacaggggaggatggggaatgtgggacacggtgtggtgggcatgagggcttggaggggtggggatgagggctcaagacacgagagaagatgtccacggtcccaggtggttaacaaagttctggcagctaaaagatgaccgcgttgaaggccacctccttctggctgggaggggcagaactgtggacagattctcaatgcctttttgaagttctgacccaccaaagaccttctgccttcaccctcctccccacctgatgtccctctgtgtctgatagtgatgttggtgaaagttcgtagaccccaggagtagagaaaagcaactggactgactttcttaccagcagttacctagactgaggcaagctgtgtggactcacccaagtatatttcagtactgtcaggctgtgacatcttagctaccttgtatttcaagtgcatggccctgtctagagatatgcacagagagaaaagcagagggagggagggagggggtcttcagcaagcaccagcccccagcagagtgagctgaagctcctgaggagggttcccgaaggggggcgctcagagatgggggcagggggcggggagaggagagtctgccttatgtcccttccttgtggacttcacatggtcatgcaggaagtgaggatgggtgtccagcgggggccgaggccactagtatcctcctgcttccccctgccattctccagggctggactgaccctatggactgggagagagtgcctgaggccaccatgccacagtcaaagggggtcctatctcagaaggtggcagcatccactgagatatcctcacccgaagggaaggaggctgctgggtagcaaataagccccttcttttcttggtgagttgatgacctccaatagctcccagtgtcatgggtacccagtacgcattagctggtgttgggttgattgagacctggggcagttcctggggcaagaagccagatgggagatgagatagaaagtgttaggagttatcctctttgcctggcctttgagaataacttactgtgtgactttgggcaagttccttccccactctgggcctcagtttctcacttgggaaagcaaggagtttgaccagatgatcacaatgggccttcctagctctggccaccaagaatttgtgaacattagagctcctggtctggtgggtagagccagagctgctgactggtctctctgcctccagaggggatttattggacctcagaggtggcagggccctatggagcaccaactgccctcaaccccaccctgtgcccaagactgggaagggattgatgtcaggctgtggccataggtagcatgagttgcccaaggagggacagagcatatctttgctgaggcttggctgaggggcttatgatagggcttgcagtacctcacagccccctgtgggcacagacaccctgaggtttacccaggcaaatatattgattagcaggacaagggctctctcctcagtttctgctcccttccatctctctcccatacttgtctgaaaagggagacaaaaaatcttatacaagtggcatctcaatcctttccagtccagcacctcctggggcaggcagtgtgacttatttcctgtggtgaaatcacctgtttcacaagcctggcagcgcgacttctgagtctcatgaccactcaacccaagggacccctccccagaccagaaccaagtcagctgggggctgtcgtactaccctgtccagtcttgagggcctagttgcaggtcccccaggcatccagcccctcctagagcttgctgggcaggctgcacctcatctgggcaggcgcagagctgatgaaatgctggagcaatgcatggcaaacatatgccctccagtgtcttctgaaacctttggggctgacacaagatcctttagtgtttgggatgacctctttcctgcagacttcttccccaccagtcttcatcgcttgccctgcttctcacttaggcaggagtgagggatggctgggaagaatctccaggtctgtggcccttgtgttgagtgattattttgtgacactctcattcctggaccacctgccaggtttatctgttatacctgtggcattcttattatgtcagacaagttattatagttcattcaactctaacaaatgaacaaaagaacaataaataggaggccattaaaggtcttttgtggcagag

SEQ ID NO: 364870 - DNA, 6457 bp, Homo sapiens
cactccagcctgagtgacagagtgaaaccttgtctcaaaaaagagagtgatgagtgctatggaaaaagaagaagtagagcaagagagggacttcaggccccggaggcacagtggggctgagcatgcagatgtctcggggagagcctcccagaagagaactgtccccgaggtgggaatcgccctggtgtgcttgaggaccagccgggggtagatgtggctggagatgggtgagggagagtagtaggaggtgacaccgggaggtgagggtagatcacacagaccttacagcatgccaggcttttcctcacttgagctcagaaaacttgcacttggagactcccgcagcctgccctgcaaagacctgactgcaaggcggctgttgcgtagcccaggagagctctaatggctatcgtggaggcttaccagtggagatggtaagagcggattacatgggcactgttcggatctcaagcctgcatggtgcctgtcagtcactccagccctggtccccagtcctgcctcaaggtggcccgcaggagcttgcccctgggcaggatacgcgaaccctggcctgacctctctttctctccacagagtgttcaagaaggccagtccaaatggaaagctcaccgtctacctgggaaagcgggactttgtggaccacatcgacctcgtggaccctgtggatggtgtggtcctggtggatcctgagtatctcaaagagcggagagtctatgtgacgctgacctgcgccttccgctatggccgggaggacctggatgtcctgggcctgacctttcgcaaggacctgtttgtggccaacgtacagtcgttcccaccggcccccgaggacaagaagcccctgacgcggctgcaggaacgcctcatcaagaagctgggcgagcacgcttaccctttcacctttgagatccctccaaaccttccatgttctgtgacactgcagccggggcccgaagacacggggaaggcttgcggtgtggactatgaagtcaaagccttctgcgcggagaatttggaggagaagatccacaagcggaattctgtgcgtctggtcatccggaaggttcagtatgccccagagaggcctggcccccagcccacagccgagaccaccaggcagttcctcatgtcggacaagcccttgcacctagaagcctctctggataaggagatctattaccatggagaacccatcagcgtcaacgtccacgtcaccaacaacaccaacaagacggtgaagaagatcaagatctcagtgcgccagtatgcagacatctgccttttcaacacagctcagtacaagtgccctgttgccatggaagaggctgatgacactgtggcacccagctcgacgttctgcaaggtctacacactgacccccttcctagccaataaccgagagaagcggggcctcgccttggacgggaagctcaagcacgaagacacgaacttggcctctagcaccctgttgagggaaggtgccaaccgtgagatcctggggatcattgtttcctacaaagtgaaagtgaagctggtggtgtctcggggcggcgacgtggccgtggaactgcccttcaccctaatgcaccccaagcccaaagaggaacccccgcatcgggaagttccagagaacgagacgccagtagataccaatctcatagaacttgacacaaatgatgacgacattgtatttgaggactttgctcgccagagactgaaaggcatgaaggatgacaaggaggaagaggaggatggtaccggctctccacagctcaacaacagatagacgggccggccctgcctccacgtggctccggctccactctcgtgcactcggatgcttactcgtcttcttcctgttctggtttcttttcccctttgttcttccagtttctaccagggggccccgtgggcttccagatcacggtgatgaacctctggcctcaggattggccccacatcaccacgccaacaggaccacagcgcactggctccaccccatctctgccatctccactcccctccttttcatgctgtctcccagaaaagctgccagggctctggccttggaattggacttgagatggggagcagacaggggaggatggggaatgtgggacacggtgtggtgggcatgagggcttggaggggtggggatgagggctcaagacacgagagaagatgtccacggtcccaggtggttaacaaagttctggcagctaaaagatgaccgcgttgaaggccacctccttctggctgggaggggcagaactgtggacagattctcaatgcctttttgaagttctgacccaccaaagaccttctgccttcaccctcctccccacctgatgtccctctgtgtctgatagtgatgttggtgaaagttcgtagaccccaggagtagagaaaagcaactggactgactttcttaccagcagttacctagactgaggcaagctgtgtggactcacccaagtatatttcagtactgtcaggctgtgacatcttagctaccttgtatttcaagtgcatggccctgtctagagatatgcacagagagaaaagcagagggagggagggagggggtcttcagcaagcaccagcccccagcagagtgagctgaagctcctgaggagggttcccgaaggggggcgctcagagatgggggcagggggcggggagaggagagtctgccttatgtcccttccttgtggacttcacatggtcatgcaggaagtgaggatgggtgtccagcgggggccgaggccactagtatcctcctgcttccccctgccattctccagggctggactgaccctatggactgggagagagtgcctgaggccaccatgccacagtcaaagggggtcctatctcagaaggtggcagcatccactgagatatcctcacccgaagggaaggaggctgctgggtagcaaataagccccttcttttcttggtgagttgatgacctccaatagctcccagtgtcatgggtacccagtacgcattagctggtgttgggttgattgagacctggggcagttcctggggcaagaagccagatgggagatgagatagaaagtgttaggagttatcctctttgcctggcctttgagaataacttactgtgtgactttgggcaagttccttccccactctgggcctcagtttctcacttgggaaagcaaggagtttgaccagatgatcacaatgggccttcctagctctggccaccaagaatttgtgaacattagagctcctggtctggtgggtagagccagagctgctgactggtctctctgcctccagaggggatttattggacctcagaggtggcagggccctatggagcaccaactgccctcaaccccaccctgtgcccaagactgggaagggattgatgtcaggctgtggccataggtagcatgagttgcccaaggagggacagagcatatctttgctgaggcttggctgaggggcttatgatagggcttgcagtacctcacagccccctgtgggcacagacaccctgaggtttacccaggcaaatatattgattagcaggacaagggctctctcctcagtttctgctcccttccatctctctcccatacttgtctgaaaagggagacaaaaaatcttatacaagtggcatctcaatcctttccagtccagcacctcctggggcaggcagtgtgacttatttcctgtggtgaaatcacctgtttcacaagcctggcagcgcgacttctgagtctcatgaccactcaacccaagggacccctccccagaccagaaccaagtcagctgggggctgtcgtactaccctgtccagtcttgagggcctagttgcaggtcccccaggcatccagcccctcctagagcttgctgggcaggctgcacctcatctgggcaggcgcagagctgatgaaatgctggagcaatgcatggcaaacatatgccctccagtgtcttctgaaacctttggggctgacacaagatcctttagtgtttgggatgacctctttcctgcagacttcttccccaccagtcttcatcgcttgccctgcttctcacttaggcagatgtcaaccagaatgagatacagccaatttggctttgatgacccagctgagagggaaatttagatacaattcaggaatatcatgcccaaaaatagtggtcccagcaaccaggacacagagggaagacctggatattgtcagtgattggtggagggggacatcttggaccctcctaggcctggtgtcacatctcccatctctcagaccccacagaggccaaggggccttggctctgacccaggttaaagagagccaccagcccccaggctcagggagctgaaaccacccatccgcagaaatctaagggcaaggagaaatagaaattgtctgttccttcccttcaaagtgtaaggcctcttccaggagcaactggagccaccacagcttctcagtgacattgggagggcttcgggcccaggaaaaacccaagccttttgtcctgagagccgagccacagcggatgcagtggcgtcagcatcccagagcggcagcttctctcctgcctgtcactggggactggttgctctccacccatccaggaggaaggggttaggtcccagtcttacactcttatagggtctcatggacataggcctatgcctgttctgatatctataattttttaaactcaaaaggaccaaaacactcctgaaccctcatctatacggcctgcactgggcttggtgtttcctcctggcccaggcagctccatctcttctgccattcctcctggacgaaagtggcaggaccccacctctaccacttccccacagggtcactgcacagcggcttcaaagacacgccctgttgaaggggaaacatcctccccccatcacactccaactcgtcaccccaaaagggaagtcaaagcacaggtccgtggggcctatggtttgtagacactgacacagtggttttcaaaccaggtgctgcggaacccctgatattccacagagctttgtcaggggatgctaaagtgggaagatgggagtggaggcaaaggataggtttccagccctcctcccatttccgccgccaccagaataactctgcttttatctgtcttgcctactgagatttcattttcaagctttctttgaagaagaacttcaaaccaccatctcgaggtttgatcttagaccagccagcacaggttctattcttgctgttcatgttggaatggctccagcgttccagtacaaagtgtctttgtgttggaacttgggtcacagacccaggcacaagcatttatacacacacacacacacacacacacacacacacacacacgtacatagttgatggtttttctagccaacccaccctgaagctctggccaaggtttgatttggacagggacctggtgctcagtggggatgggtcgtgaccctgatattggcccatgaagcatggggagctctggagcaaggaaacaggctcaatcccccactgaggacttgtgtctgcacccctatctggcaccccactttcctggcctaggcccaagggacacagcaggagaagcagtgtgataggagagaggctagggttaaattcatctttacacagcgccggatggatggaaatcttggctcacataaaagacagactcagggaggattttatgacaaaagtccctcctttgagggcaggattcccccaggaatcctggacactttagtgagaactggaccagcccttggcacaaaaccctgcctgccctgtcccccactcccaccccccagggaattctaggtgaaaatgtgaagctcagggcacagcaagcgcatgacacgggtgtattacattcggtccgagtgtgtccttagtttccctgtgtgcaaaatggggctagtccaggctcttcccacctcactgggacaattgcaagggtcataggagaggtgggtatgataggtggtcatatgaggtggtgagtatgagaggtgggtgcctcacaaactcggggtatggtcctgacctgcatggcagatgagcagagcacttgggaacgagcataggaagtgccatcttcccgggcatctctgctcagtgttaaggtctagccacagacactgtgggacctgcctcttcctatggaatgggggcctgcatgggttgtgtcctggggcaggagtgagggatggctgggaagaatctccaggtctgtggcccttgtgttgagtgattattttgtgacactctcattcctggaccacctgccaggtttatctgttatacctgtggcattcttattatgtcagacaagttattatagttcattcaactctaacaaatgaacaaaagaacaataaataggaggccattaaaggtcttttgtggcagag

SEQ ID NO: 364871 - DNA, 5615 bp, Homo sapiens
gcctggattccatggcttgaccctgcccccttcacaaacagttcacaacaggagctggcggaggcaagctgcagccgggctcatgcaccaagactggtcaccgtttaagcagccagcatttagcgaggacctcaggcattacctgcttagtttgctctctctgaaatacctctagctgctccacctgggcagtgagtttctgcctctcttcctggagaagtgcgcctgggtgcgcacccaggcgcacttctggggaaccccagaagatcgcgtgggggcttttctccctcccctttccctagaaccttgctgtcctcccagccaaccccgtcccttcttatgccccccagatctattaccatggagaacccatcagcgtcaacgtccacgtcaccaacaacaccaacaagacggtgaagaagatcaagatctcagtgcgccagtatgcagacatctgccttttcaacacagctcagtacaagtgccctgttgccatggaagaggctgatgacactgtggcacccagctcgacgttctgcaaggtctacacactgacccccttcctagccaataaccgagagaagcggggcctcgccttggacgggaagctcaagcacgaagacacgaacttggcctctagcaccctgttgagggaaggtgccaaccgtgagatcctggggatcattgtttcctacaaagtgaaagtgaagctggtggtgtctcggggcggcgacgtggccgtggaactgcccttcaccctaatgcaccccaagcccaaagaggaacccccgcatcgggaagttccagagaacgagacgccagtagataccaatctcatagaacttgacacaaatgatgacgacattgtatttgaggactttgctcgccagagactgaaaggcatgaaggatgacaaggaggaagaggaggatggtaccggctctccacagctcaacaacagatagacgggccggccctgcctccacgtggctccggctccactctcgtgcactcggatgcttactcgtcttcttcctgttctggtttcttttcccctttgttcttccagtttctaccagggggccccgtgggcttccagatcacggtgatgaacctctggcctcaggattggccccacatcaccacgccaacaggaccacagcgcactggctccaccccatctctgccatctccactcccctccttttcatgctgtctcccagaaaagctgccagggctctggccttggaattggacttgagatggggagcagacaggggaggatggggaatgtgggacacggtgtggtgggcatgagggcttggaggggtggggatgagggctcaagacacgagagaagatgtccacggtcccaggtggttaacaaagttctggcagctaaaagatgaccgcgttgaaggccacctccttctggctgggaggggcagaactgtggacagattctcaatgcctttttgaagttctgacccaccaaagaccttctgccttcaccctcctccccacctgatgtccctctgtgtctgatagtgatgttggtgaaagttcgtagaccccaggagtagagaaaagcaactggactgactttcttaccagcagttacctagactgaggcaagctgtgtggactcacccaagtatatttcagtactgtcaggctgtgacatcttagctaccttgtatttcaagtgcatggccctgtctagagatatgcacagagagaaaagcagagggagggagggagggggtcttcagcaagcaccagcccccagcagagtgagctgaagctcctgaggagggttcccgaaggggggcgctcagagatgggggcagggggcggggagaggagagtctgccttatgtcccttccttgtggacttcacatggtcatgcaggaagtgaggatgggtgtccagcgggggccgaggccactagtatcctcctgcttccccctgccattctccagggctggactgaccctatggactgggagagagtgcctgaggccaccatgccacagtcaaagggggtcctatctcagaaggtggcagcatccactgagatatcctcacccgaagggaaggaggctgctgggtagcaaataagccccttcttttcttggtgagttgatgacctccaatagctcccagtgtcatgggtacccagtacgcattagctggtgttgggttgattgagacctggggcagttcctggggcaagaagccagatgggagatgagatagaaagtgttaggagttatcctctttgcctggcctttgagaataacttactgtgtgactttgggcaagttccttccccactctgggcctcagtttctcacttgggaaagcaaggagtttgaccagatgatcacaatgggccttcctagctctggccaccaagaatttgtgaacattagagctcctggtctggtgggtagagccagagctgctgactggtctctctgcctccagaggggatttattggacctcagaggtggcagggccctatggagcaccaactgccctcaaccccaccctgtgcccaagactgggaagggattgatgtcaggctgtggccataggtagcatgagttgcccaaggagggacagagcatatctttgctgaggcttggctgaggggcttatgatagggcttgcagtacctcacagccccctgtgggcacagacaccctgaggtttacccaggcaaatatattgattagcaggacaagggctctctcctcagtttctgctcccttccatctctctcccatacttgtctgaaaagggagacaaaaaatcttatacaagtggcatctcaatcctttccagtccagcacctcctggggcaggcagtgtgacttatttcctgtggtgaaatcacctgtttcacaagcctggcagcgcgacttctgagtctcatgaccactcaacccaagggacccctccccagaccagaaccaagtcagctgggggctgtcgtactaccctgtccagtcttgagggcctagttgcaggtcccccaggcatccagcccctcctagagcttgctgggcaggctgcacctcatctgggcaggcgcagagctgatgaaatgctggagcaatgcatggcaaacatatgccctccagtgtcttctgaaacctttggggctgacacaagatcctttagtgtttgggatgacctctttcctgcagacttcttccccaccagtcttcatcgcttgccctgcttctcacttaggcagatgtcaaccagaatgagatacagccaatttggctttgatgacccagctgagagggaaatttagatacaattcaggaatatcatgcccaaaaatagtggtcccagcaaccaggacacagagggaagacctggatattgtcagtgattggtggagggggacatcttggaccctcctaggcctggtgtcacatctcccatctctcagaccccacagaggccaaggggccttggctctgacccaggttaaagagagccaccagcccccaggctcagggagctgaaaccacccatccgcagaaatctaagggcaaggagaaatagaaattgtctgttccttcccttcaaagtgtaaggcctcttccaggagcaactggagccaccacagcttctcagtgacattgggagggcttcgggcccaggaaaaacccaagccttttgtcctgagagccgagccacagcggatgcagtggcgtcagcatcccagagcggcagcttctctcctgcctgtcactggggactggttgctctccacccatccaggaggaaggggttaggtcccagtcttacactcttatagggtctcatggacataggcctatgcctgttctgatatctataattttttaaactcaaaaggaccaaaacactcctgaaccctcatctatacggcctgcactgggcttggtgtttcctcctggcccaggcagctccatctcttctgccattcctcctggacgaaagtggcaggaccccacctctaccacttccccacagggtcactgcacagcggcttcaaagacacgccctgttgaaggggaaacatcctccccccatcacactccaactcgtcaccccaaaagggaagtcaaagcacaggtccgtggggcctatggtttgtagacactgacacagtggttttcaaaccaggtgctgcggaacccctgatattccacagagctttgtcaggggatgctaaagtgggaagatgggagtggaggcaaaggataggtttccagccctcctcccatttccgccgccaccagaataactctgcttttatctgtcttgcctactgagatttcattttcaagctttctttgaagaagaacttcaaaccaccatctcgaggtttgatcttagaccagccagcacaggttctattcttgctgttcatgttggaatggctccagcgttccagtacaaagtgtctttgtgttggaacttgggtcacagacccaggcacaagcatttatacacacacacacacacacacacacacacacacacacacgtacatagttgatggtttttctagccaacccaccctgaagctctggccaaggtttgatttggacagggacctggtgctcagtggggatgggtcgtgaccctgatattggcccatgaagcatggggagctctggagcaaggaaacaggctcaatcccccactgaggacttgtgtctgcacccctatctggcaccccactttcctggcctaggcccaagggacacagcaggagaagcagtgtgataggagagaggctagggttaaattcatctttacacagcgccggatggatggaaatcttggctcacataaaagacagactcagggaggattttatgacaaaagtccctcctttgagggcaggattcccccaggaatcctggacactttagtgagaactggaccagcccttggcacaaaaccctgcctgccctgtcccccactcccaccccccagggaattctaggtgaaaatgtgaagctcagggcacagcaagcgcatgacacgggtgtattacattcggtccgagtgtgtccttagtttccctgtgtgcaaaatggggctagtccaggctcttcccacctcactgggacaattgcaagggtcataggagaggtgggtatgataggtggtcatatgaggtggtgagtatgagaggtgggtgcctcacaaactcggggtatggtcctgacctgcatggcagatgagcagagcacttgggaacgagcataggaagtgccatcttcccgggcatctctgctcagtgttaaggtctagccacagacactgtgggacctgcctcttcctatggaatgggggcctgcatgggttgtgtcctggggcaggagtgagggatggctgggaagaatctccaggtctgtggcccttgtgttgagtgattattttgtgacactctcattcctggaccacctgccaggtttatctgttatacctgtggcattcttattatgtcagacaagttattatagttcattcaactctaacaaatgaacaaaagaacaataaataggaggccattaaaggtcttttgtggcagag

SEQ ID NO: 364872 - DNA, 3616 bp, Homo sapiens
tctcctggagccaggactgcacaaggcaatggccaaatttagttgaattcagcctaccatcctttgctgatgactcagctctatgccaagtactggagccacagagatgggtcagtcccagcccctgtcctcaggaagcccatggtcagggaaacgttgtagggataagtaatagagggcagttgccttcagggctcctggtggctgctggtccctatggtgccttgatgtgaattagaagacggtgccctttccaggtggattcagacctacactagaacgcacagctttgggagtgacacacaggttggattttagcaccccttgccccttggccagaggtgccctgctgcacggccatacgctgcagcctcgagggacacacaggccaaagtgtttccttcagcctcttcctggagaggaagccgcaggtcatgtttccaagcttctggtcaactccaggcaccacctcccagcccccaaacatggccgagccagtgcttctctgcagggcccctttcctttctggagtcagcctgcccaggtgataccttgaagtgaaactaggggtgggggagcctcactaggccccaggcaccatcccacagtactggcggtttctctgccaagtgtttggggcctgcactggccaagccatccgtcactgggactttgcagtgtgccctgtgggtggcgtgtggacaccggtccgggcaggaaggaaaagcatgccccggtgaaaacccaccgagcagagagccagcgggacctcctcagcattccacccaggggaagagttcagtccccatgaagataaggactgagttatttggctgcacctctcctcagcctcaaagctcagacctgctagagtgggttcacctggctgttggttctgtgggagagttcctgacaagctggttcctacatggtgcagtgaaaggaactctgtcctggaagtccccaatgccgcctctcagtcctgcctgtcaccaaccacctggggggcttgggcaagctactcaacctctggggctcaatttccctaactgtaaaatgggattgtaatcccttccctgcctgacgcaggaattgttatgaggcccagatgagatgaaagtcagcggtcagggctctgtaagttgaaaatggctggatgtgtgtggccctgccactgcagggatggcccaaggtcacacagaaagtttgctgcaggaggagccctccccaccagtcttcatcgcttgccctgcttctcacttaggcagatgtcaaccagaatgagatacagccaatttggctttgatgacccagctgagagggaaatttagatacaattcaggaatatcatgcccaaaaatagtggtcccagcaaccaggacacagagggaagacctggatattgtcagtgattggtggagggggacatcttggaccctcctaggcctggtgtcacatctcccatctctcagaccccacagaggccaaggggccttggctctgacccaggttaaagagagccaccagcccccaggctcagggagctgaaaccacccatccgcagaaatctaagggcaaggagaaatagaaattgtctgttccttcccttcaaagtgtaaggcctcttccaggagcaactggagccaccacagcttctcagtgacattgggagggcttcgggcccaggaaaaacccaagccttttgtcctgagagccgagccacagcggatgcagtggcgtcagcatcccagagcggcagcttctctcctgcctgtcactggggactggttgctctccacccatccaggaggaaggggttaggtcccagtcttacactcttatagggtctcatggacataggcctatgcctgttctgatatctataattttttaaactcaaaaggaccaaaacactcctgaaccctcatctatacggcctgcactgggcttggtgtttcctcctggcccaggcagctccatctcttctgccattcctcctggacgaaagtggcaggaccccacctctaccacttccccacagggtcactgcacagcggcttcaaagacacgccctgttgaaggggaaacatcctccccccatcacactccaactcgtcaccccaaaagggaagtcaaagcacaggtccgtggggcctatggtttgtagacactgacacagtggttttcaaaccaggtgctgcggaacccctgatattccacagagctttgtcaggggatgctaaagtgggaagatgggagtggaggcaaaggataggtttccagccctcctcccatttccgccgccaccagaataactctgcttttatctgtcttgcctactgagatttcattttcaagctttctttgaagaagaacttcaaaccaccatctcgaggtttgatcttagaccagccagcacaggttctattcttgctgttcatgttggaatggctccagcgttccagtacaaagtgtctttgtgttggaacttgggtcacagacccaggcacaagcatttatacacacacacacacacacacacacacacacacacacacgtacatagttgatggtttttctagccaacccaccctgaagctctggccaaggtttgatttggacagggacctggtgctcagtggggatgggtcgtgaccctgatattggcccatgaagcatggggagctctggagcaaggaaacaggctcaatcccccactgaggacttgtgtctgcacccctatctggcaccccactttcctggcctaggcccaagggacacagcaggagaagcagtgtgataggagagaggctagggttaaattcatctttacacagcgccggatggatggaaatcttggctcacataaaagacagactcagggaggattttatgacaaaagtccctcctttgagggcaggattcccccaggaatcctggacactttagtgagaactggaccagcccttggcacaaaaccctgcctgccctgtcccccactcccaccccccagggaattctaggtgaaaatgtgaagctcagggcacagcaagcgcatgacacgggtgtattacattcggtccgagtgtgtccttagtttccctgtgtgcaaaatggggctagtccaggctcttcccacctcactgggacaattgcaagggtcataggagaggtgggtatgataggtggtcatatgaggtggtgagtatgagaggtgggtgcctcacaaactcggggtatggtcctgacctgcatggcagatgagcagagcacttgggaacgagcataggaagtgccatcttcccgggcatctctgctcagtgttaaggtctagccacagacactgtgggacctgcctcttcctatggaatgggggcctgcatgggttgtgtcctggggcaggagtgagggatggctgggaagaatctccaggtctgtggcccttgtgttgagtgattattttgtgacactctcattcctggaccacctgccaggtttatctgttatacctgtggcattcttattatgtcagacaagttattatagttcattcaactctaacaaatgaacaaaagaacaataaataggaggccattaaaggtcttttgtggcagag

SEQ ID NO: 364873 - DNA, 1381 bp, Homo sapiens
cgggcggggaccgggggcgggggcggcggcggcggccgggagagcggaggaggcggagcagggagccgggagcgggctggcccgcgctcctcctgctggctggggattttccagcctgggcgctgacgccgcggacctccctgcgaccgtcgcggaccatgggcgacaaagggacccgagtgttcaagaaggccagtccaaatggaaagctcaccgtctacctgggaaagcgggactttgtggaccacatcgacctcgtggaccctgtggatggtgtggtcctggtggatcctgagtatctcaaagagcggagagtctatgtgacgctgacctgcgccttccgctatggccgggaggacctggatgtcctgggcctgacctttcgcaaggacctgtttgtggccaacgtacagtcgttcccaccggcccccgaggacaagaagcccctgacgcggctgcaggaacgcctcatcaagaagctgggcgagcacgcttaccctttcacctttgagatccctccaaaccttccatgttctgtgacactgcagccggggcccgaagacacggggaaggcttgcggtgtggactatgaagtcaaagccttctgcgcggagaatttggaggagaagatccacaagcggaattctgtgcgtctggtcatccggaaggttcagtatgccccagagaggcctggcccccagcccacagccgagaccaccaggcagttcctcatgtcggacaagcccttgcacctagaagcctctctggataaggagatctattaccatggagaacccatcagcgtcaacgtccacgtcaccaacaacaccaacaagacggtgaagaagatcaagatctcagtgcgccagtatgcagacatctgccttttcaacacagctcagtacaagtgccctgttgccatggaagaggctgatgacactgtggcacccagctcgacgttctgcaaggtctacacactgacccccttcctagccaataaccgagagaagcggggcctcgccttggacgggaagctcaagcacgaagacacgaacttggcctctagcaccctgttgagggaaggtgccaaccgtgagatcctggggatcattgtttcctacaaagtgaaagtgaagctggtggtgtctcggggcggaggccaggcctggcgtggaagaggctgtgaaaggcctgcatggcacaggctgtcaccagcacatggctcaaggtcatgaccctgaggagagtctcactgcagctcttcaccaggccttccgggaagcagggcagcaggtccttcagcagcgtcagcatgtgcagcgtggtggtgccctccttggagcctccagacttctcatctcctgatgcacactgtcgattc

SEQ ID NO: 364874 - DNA, 298 bp, Homo sapiens
caagcctgcatggtgcctgtcagtcactccagccctggtccccagtcctgcctcaaggtggcccgcaggagcttgcccctgggcaggatacgcgaaccctggcctgacctctctttctctccacagagtgttcaagaaggccagtccaaatggaaaggtgagtctgtaacagctgcgcccagcgcctccctgacctcacactctggtcattttctcttgggaagcagaggaaacggcatgtcccctgaaatgcacacctctgtgggagggggcaggtgctgctccccgtcttaggggt

SEQ ID NO: 364875 - DNA, 429 bp, Homo sapiens
atctatttaaaccattgctgcgaggactgggctgggccaaaccctttagataaagaaagctctttatctaaagagttttagatggggcatggcttggcatggtctgatgggatagacatggcctgtcccctggggcccttggtctgatgggtgtatgggagtgtctgggctgcaatacatgagacaggacagtggtggatgtgacaggtggctcgttctgtcctcttcttgacagatccctccaaaccttccatgttctgtgacactgcagccggggcccgaagacacggggaaggtaggtcaccccaaggggaccatctctctggctccaggagtctcatgtccccaggtccctggctttctccctgggaggtgctggacacacaggaccactctccctgttgaacagtctttgtgtctaggctaagc

SEQ ID NO: 364876 - DNA, 681 bp, Homo sapiens
  misc_feature (611)..(611): n is a, c, g, or t
  misc_feature (656)..(656): n is a, c, g, or t
  misc_feature (674)..(674): n is a, c, g, or t
cgggcggggaccgggggcgggggcggcggcggcggccgggagagcggaggaggcggagcagggagccgggagcgggctggcccgcgctcctcctgctggctggggattttccagcctgggcgctgacgccgcggacctccctgcgaccgtcgcggaccatgggcgacaaagggacccgagtgttcaagaaggccagtccaaatggaaagctcaccgtctacctgggaaagcgggactttgtggaccacatcgacctcgtggaccctgtggatggtgtggtcctggtggatcctgagtatctcaaagagcggagagtctatgtgacgctgacctgcgccttccgctatggccgggaggacctggatgtcctgggcctgacctttcgcaaggacctgtttgtggccaacgtacagtcgttcccaccggcccccgaggacaagaagcccctgacgcggctgcaggaacgcctcatcaagaagctgggcgagcacgcttaccctttcacctttgagatccctccaaaccttccatgttctgtgacactgcagccggggcccgaagacacggggaaggcttgcggtgtggactatgaagtcaaagccttctgccgnccggggggagaaattttgggaagggaagaaagattccaacaaagncgggaaattctggtgcgntctgggt

SEQ ID NO: 364877 - DNA, 6041 bp, Homo sapiens
cgggcggggaccgggggcgggggcggcggcggcggccgggagagcggaggaggcggagcagggagccgggagcgggctggcccgcgctcctcctgctggctggggattttccagcctgggcgctgacgccgcggacctccctgcgaccgtcgcggaccatgggcgacaaagggacccgagtgttcaagaaggccagtccaaatggaaagctcaccgtctacctgggaaagcgggactttgtggaccacatcgacctcgtggaccctgtggatggtgtggtcctggtggatcctgagtatctcaaagagcggagagtctatgtgacgctgacctgcgccttccgctatggccgggaggacctggatgtcctgggcctgacctttcgcaaggacctgtttgtggccaacgtacagtcgttcccaccggcccccgaggacaagaagcccctgacgcggctgcaggaacgcctcatcaagaagctgggcgagcacgcttaccctttcacctttgagatccctccaaaccttccatgttctgtgacactgcagccggggcccgaagacacggggaaggcttgcggtgtggactatgaagtcaaagccttctgcgcggagaatttggaggagaagatccacaagcggaattctgtgcgtctggtcatccggaaggttcagtatgccccagagaggcctggcccccagcccacagccgagaccaccaggcagttcctcatgtcggacaagcccttgcacctagaagcctctctggataaggagatctattaccatggagaacccatcagcgtcaacgtccacgtcaccaacaacaccaacaagacggtgaagaagatcaagatctcagtgcgccagtatgcagacatctgccttttcaacacagctcagtacaagtgccctgttgccatggaagaggctgatgacactgtggcacccagctcgacgttctgcaaggtctacacactgacccccttcctagccaataaccgagagaagcggggcctcgccttggacgggaagctcaagcacgaagacacgaacttggcctctagcaccctgttgagggaaggtgccaaccgtgagatcctggggatcattgtttcctacaaagtgaaagtgaagctggtggtgtctcggggcggcgacgtggccgtggaactgcccttcaccctaatgcaccccaagcccaaagaggaacccccgcatcgggaagttccagagaacgagacgccagtagataccaatctcatagaacttgacacaaatgatgacgacattgtatttgaggactttgctcgccagagactgaaaggcatgaaggatgacaaggaggaagaggaggatggtaccggctctccacagctcaacaacagatagacgggccggccctgcctccacgtggctccggctccactctcgtgcactcggatgcttactcgtcttcttcctgttctggtttcttttcccctttgttcttccagtttctaccagggggccccgtgggcttccagatcacggtgatgaacctctggcctcaggattggccccacatcaccacgccaacaggaccacagcgcactggctccaccccatctctgccatctccactcccctccttttcatgctgtctcccagaaaagctgccagggctctggccttggaattggacttgagatggggagcagacaggggaggatggggaatgtgggacacggtgtggtgggcatgagggcttggaggggtggggatgagggctcaagacacgagagaagatgtccacggtcccaggtggttaacaaagttctggcagctaaaagatgaccgcgttgaaggccacctccttctggctgggaggggcagaactgtggacagattctcaatgcctttttgaagttctgacccaccaaagaccttctgccttcaccctcctccccacctgatgtccctctgtgtctgatagtgatgttggtgaaagttcgtagaccccaggagtagagaaaagcaactggactgactttcttaccagcagttacctagactgaggcaagctgtgtggactcacccaagtatatttcagtactgtcaggctgtgacatcttagctaccttgtatttcaagtgcatggccctgtctagagatatgcacagagagaaaagcagagggagggagggagggggtcttcagcaagcaccagcccccagcagagtgagctgaagctcctgaggagggttcccgaaggggggcgctcagagatgggggcagggggcggggagaggagagtctgccttatgtcccttccttgtggacttcacatggtcatgcaggaagtgaggatgggtgtccagcgggggccgaggccactagtatcctcctgcttccccctgccattctccagggctggactgaccctatggactgggagagagtgcctgaggccaccatgccacagtcaaagggggtcctatctcagaaggtggcagcatccactgagatatcctcacccgaagggaaggaggctgctgggtagcaaataagccccttcttttcttggtgagttgatgacctccaatagctcccagtgtcatgggtacccagtacgcattagctggtgttgggttgattgagacctggggcagttcctggggcaagaagccagatgggagatgagatagaaagtgttaggagttatcctctttgcctggcctttgagaataacttactgtgtgactttgggcaagttccttccccactctgggcctcagtttctcacttgggaaagcaaggagtttgaccagatgatcacaatgggccttcctagctctggccaccaagaatttgtgaacattagagctcctggtctggtgggtagagccagagctgctgactggtctctctgcctccagaggggatttattggacctcagaggtggcagggccctatggagcaccaactgccctcaaccccaccctgtgcccaagactgggaagggattgatgtcaggctgtggccataggtagcatgagttgcccaaggagggacagagcatatctttgctgaggcttggctgaggggcttatgatagggcttgcagtacctcacagccccctgtgggcacagacaccctgaggtttacccaggcaaatatattgattagcaggacaagggctctctcctcagtttctgctcccttccatctctctcccatacttgtctgaaaagggagacaaaaaatcttatacaagtggcatctcaatcctttccagtccagcacctcctggggcaggcagtgtgacttatttcctgtggtgaaatcacctgtttcacaagcctggcagcgcgacttctgagtctcatgaccactcaacccaagggacccctccccagaccagaaccaagtcagctgggggctgtcgtactaccctgtccagtcttgagggcctagttgcaggtcccccaggcatccagcccctcctagagcttgctgggcaggctgcacctcatctgggcaggcgcagagctgatgaaatgctggagcaatgcatggcaaacatatgccctccagtgtcttctgaaacctttggggctgacacaagatcctttagtgtttgggatgacctctttcctgcagacttcttccccaccagtcttcatcgcttgccctgcttctcacttaggcagatgtcaaccagaatgagatacagccaatttggctttgatgacccagctgagagggaaatttagatacaattcaggaatatcatgcccaaaaatagtggtcccagcaaccaggacacagagggaagacctggatattgtcagtgattggtggagggggacatcttggaccctcctaggcctggtgtcacatctcccatctctcagaccccacagaggccaaggggccttggctctgacccaggttaaagagagccaccagcccccaggctcagggagctgaaaccacccatccgcagaaatctaagggcaaggagaaatagaaattgtctgttccttcccttcaaagtgtaaggcctcttccaggagcaactggagccaccacagcttctcagtgacattgggagggcttcgggcccaggaaaaacccaagccttttgtcctgagagccgagccacagcggatgcagtggcgtcagcatcccagagcggcagcttctctcctgcctgtcactggggactggttgctctccacccatccaggaggaaggggttaggtcccagtcttacactcttatagggtctcatggacataggcctatgcctgttctgatatctataattttttaaactcaaaaggaccaaaacactcctgaaccctcatctatacggcctgcactgggcttggtgtttcctcctggcccaggcagctccatctcttctgccattcctcctggacgaaagtggcaggaccccacctctaccacttccccacagggtcactgcacagcggcttcaaagacacgccctgttgaaggggaaacatcctccccccatcacactccaactcgtcaccccaaaagggaagtcaaagcacaggtccgtggggcctatggtttgtagacactgacacagtggttttcaaaccaggtgctgcggaacccctgatattccacagagctttgtcaggggatgctaaagtgggaagatgggagtggaggcaaaggataggtttccagccctcctcccatttccgccgccaccagaataactctgcttttatctgtcttgcctactgagatttcattttcaagctttctttgaagaagaacttcaaaccaccatctcgaggtttgatcttagaccagccagcacaggttctattcttgctgttcatgttggaatggctccagcgttccagtacaaagtgtctttgtgttggaacttgggtcacagacccaggcacaagcatttatacacacacacacacacacacacacacacacacacacacgtacatagttgatggtttttctagccaacccaccctgaagctctggccaaggtttgatttggacagggacctggtgctcagtggggatgggtcgtgaccctgatattggcccatgaagcatggggagctctggagcaaggaaacaggctcaatcccccactgaggacttgtgtctgcacccctatctggcaccccactttcctggcctaggcccaagggacacagcaggagaagcagtgtgataggagagaggctagggttaaattcatctttacacagcgccggatggatggaaatcttggctcacataaaagacagactcagggaggattttatgacaaaagtccctcctttgagggcaggattcccccaggaatcctggacactttagtgagaactggaccagcccttggcacaaaaccctgcctgccctgtcccccactcccaccccccagggaattctaggtgaaaatgtgaagctcagggcacagcaagcgcatgacacgggtgtattacattcggtccgagtgtgtccttagtttccctgtgtgcaaaatggggctagtccaggctcttcccacctcactgggacaattgcaagggtcataggagaggtgggtatgataggtggtcatatgaggtggtgagtatgagaggtgggtgcctcacaaactcggggtatggtcctgacctgcatggcagatgagcagagcacttgggaacgagcataggaagtgccatcttcccgggcatctctgctcagtgttaaggtctagccacagacactgtgggacctgcctcttcctatggaatgggggcctgcatgggttgtgtcctggggcaggagtgagggatggctgggaagaatctccaggtctgtggcccttgtgttgagtgattattttgtgacactctcattcctggaccacctgccaggtttatctgttatacctgtggcattcttattatgtcagacaagttattatagttcattcaactctaacaaatgaacaaaagaacaataaataggaggccattaaaggtcttttgtggcagag

SEQ ID NO: 364878 - DNA, 6011 bp, Homo sapiens
cgggcggggaccgggggcgggggcggcggcggcggccgggagagcggaggaggcggagcagggagccgggagcgggctggcccgcgctcctcctgctggctggggattttccagcctgggcgctgacgccgcggacctccctgcgaccgtcgcggaccatgggcgacaaagggacccgagtgttcaagaaggccagtccaaatggaaagctcaccgtctacctgggaaagcgggactttgtggaccacatcgacctcgtggaccctgtggatggtgtggtcctggtggatcctgagtatctcaaagagcggagagtctatgtgacgctgacctgcgccttccgctatggccgggaggacctggatgtcctgggcctgacctttcgcaaggacctgtttgtggccaacgtacagtcgttcccaccggcccccgaggacaagaagcccctgacgcggctgcaggaacgcctcatcaagaagctgggcgagcacgcttaccctttcacctttgagatccctccaaaccttccatgttctgtgacactgcagccggggcccgaagacacggggaaggcttgcggtgtggactatgaagtcaaagccttctgcgcggagaatttggaggagaagatccacaagcggaattctgtgcgtctggtcatccggaaggttcagtatgccccagagaggcctggcccccagcccacagccgagaccaccaggcagttcctcatgtcggacaagcccttgcacctagaagcctctctggataaggagatctattaccatggagaacccatcagcgtcaacgtccacgtcaccaacaacaccaacaagacggtgaagaagatcaagatctcagtgcgccagtatgcagacatctgccttttcaacacagctcagtacaagtgccctgttgccatggaagaggctgatgacactgtggcacccagctcgacgttctgcaaggtctacacactgacccccttcctagccaataaccgagagaagcggggcctcgccttggacgggaagctcaagcacgaagacacgaacttggcctctagcaccctgttgagggaaggtgccaaccgtgagatcctggggatcattgtttcctacaaagtgaaagtgaagctggtggtgtctcggggcggcctgttgggagatcttgcatccagcgacgtggccgtggaactgcccttcaccctaatgcaccccaagcccaaagaggaacccccgcatcgggaagttccagagaacgagacgccagtagataccaatctcatagaacttgacacaaatgatgacgacattgtatttgaggactttgctcgccagagactgaaaggcatgaaggatgacaaggaggaagaggaggatggtaccggctctccacagctcaacaacagatagacgggccggccctgcctccacgtggctccggctccactctcgtgcactcggatgcttactcgtcttcttcctgttctggtttcttttcccctttgttcttccagtttctaccagggggccccgtgggcttccagatcacggtgatgaacctctggcctcaggattggccccacatcaccacgccaacaggaccacagcgcactggctccaccccatctctgccatctccactcccctccttttcatgctgtctcccagaaaagctgccagggctctggccttggaattggacttgagatggggagcagacaggggaggatggggaatgtgggacacggtgtggtgggcatgagggcttggaggggtggggatgagggctcaagacacgagagaagatgtccacggtcccaggtggttaacaaagttctggcagctaaaagatgaccgcgttgaaggccacctccttctggctgggaggggcagaactgtggacagattctcaatgcctttttgaagttctgacccaccaaagaccttctgccttcaccctcctccccacctgatgtccctctgtgtctgatagtgatgttggtgaaagttcgtagaccccaggagtagagaaaagcaactggactgactttcttaccagcagttacctagactgaggcaagctgtgtggactcacccaagtatatttcagtactgtcaggctgtgacatcttagctaccttgtatttcaagtgcatggccctgtctagagatatgcacagagagaaaagcagagggagggagggagggggtcttcagcaagcaccagcccccagcagagtgagctgaagctcctgaggagggttcccgaaggggggcgctcagagatgggggcagggggcggggagaggagagtctgccttatgtcccttccttgtggacttcacatggtcatgcaggaagtgaggatgggtgtccagcgggggccgaggccactagtatcctcctgcttccccctgccattctccagggctggactgaccctatggactgggagagagtgcctgaggccaccatgccacagtcaaagggggtcctatctcagaaggtggcagcatccactgagatatcctcacccgaagggaaggaggctgctgggtagcaaataagccccttcttttcttggtgagttgatgacctccaatagctcccagtgtcatgggtacccagtacgcattagctggtgttgggttgattgagacctggggcagttcctggggcaagaagccagatgggagatgagatagaaagtgttaggagttatcctctttgcctggcctttgagaataacttactgtgtgactttgggcaagttccttccccactctgggcctcagtttctcacttgggaaagcaaggagtttgaccagatgatcacaatgggccttcctagctctggccaccaagaatttgtgaacattagagctcctggtctggtgggtagagccagagctgctgactggtctctctgcctccagaggggatttattggacctcagaggtggcagggccctatggagcaccaactgccctcaaccccaccctgtgcccaagactgggaagggattgatgtcaggctgtggccataggtagcatgagttgcccaaggagggacagagcatatctttgctgaggcttggctgaggggcttatgatagggcttgcagtacctcacagccccctgtgggcacagacaccctgaggtttacccaggcaaatatattgattagcaggacaagggctctctcctcagtttctgctcccttccatctctctcccatacttgtctgaaaagggagacaaaaaatcttatacaagtggcatctcaatcctttccagtccagcacctcctggggcaggcagtgtgacttatttcctgtggtgaaatcacctgtttcacaagcctggcagcgcgacttctgagtctcatgaccactcaacccaagggacccctccccagaccagaaccaagtcagctgggggctgtcgtactaccctgtccagtcttgagggcctagttgcaggtcccccaggcatccagcccctcctagagcttgctgggcaggctgcacctcatctgggcaggcgcagagctgatgaaatgctggagcaatgcatggcaaacatatgccctccagtgtcttctgaaacctttggggctgacacaagatcctttagtgtttgggatgacctctttcctgcagacttcttccccaccagtcttcatcgcttgccctgcttctcacttaggcagatgtcaaccagaatgagatacagccaatttggctttgatgacccagctgagagggaaatttagatacaattcaggaatatcatgcccaaaaatagtggtcccagcaaccaggacacagagggaagacctggatattgtcagtgattggtggagggggacatcttggaccctcctaggcctggtgtcacatctcccatctctcagaccccacagaggccaaggggccttggctctgacccaggttaaagagagccaccagcccccaggctcagggagctgaaaccacccatccgcagaaatctaagggcaaggagaaatagaaattgtctgttccttcccttcaaagtgtaaggcctcttccaggagcaactggagccaccacagcttctcagtgacattgggagggcttcgggcccaggaaaaacccaagccttttgtcctgagagccgagccacagcggatgcagtggcgtcagcatcccagagcggcagcttctctcctgcctgtcactggggactggttgctctccacccatccaggaggaaggggttaggtcccagtcttacactcttatagggtctcatggacataggcctatgcctgttctgatatctataattttttaaactcaaaaggaccaaaacactcctgaaccctcatctatacggcctgcactgggcttggtgtttcctcctggcccaggcagctccatctcttctgccattcctcctggacgaaagtggcaggaccccacctctaccacttccccacagggtcactgcacagcggcttcaaagacacgccctgttgaaggggaaacatcctccccccatcacactccaactcgtcaccccaaaagggaagtcaaagcacaggtccgtggggcctatggtttgtagacactgacacagtggttttcaaaccaggtgctgcggaacccctgatattccacagagctttgtcaggggatgctaaagtgggaagatgggagtggaggcaaaggataggtttccagccctcctcccatttccgccgccaccagaataactctgcttttatctgtcttgcctactgagatttcattttcaagctttctttgaagaagaacttcaaaccaccatctcgaggtttgatcttagaccagccagcacaggttctattcttgctgttcatgttggaatggctccagcgttccagtacaaagtgtctttgtgttggaacttgggtcacagacccaggcacaagcatttatacacacacacacacacacacacacacacacacacacacgtacatagttgatggtttttctagccaacccaccctgaagctctggccaaggtttgatttggacagggacctggtgctcagtggggatgggtcgtgaccctgatattggcccatgaagcatggggagctctggagcaaggaaacaggctcaatcccccactgaggacttgtgtctgcacccctatctggcaccccactttcctggcctaggcccaagggacacagcaggagaagcagtgtgataggagagaggctagggttaaattcatctttacacagcgccggatggatggaaatcttggctcacataaaagacagactcagggaggattttatgacaaaagtccctcctttgagggcaggattcccccaggaatcctggacactttagtgagaactggaccagcccttggcacaaaaccctgcctgccctgtcccccactcccaccccccagggaattctaggtgaaaatgtgaagctcagggcacagcaagcgcatgacacgggtgtattacattcggtccgagtgtgtccttagtttccctgtgtgctaggagaggtgggtatgataggtggtcatatgaggtggtgagtatgagaggtgggtgcctcacaaactcggggtatggtcctgacctgcatggcagatgagcagagcacttgggaacgagcataggaagtgccatcttcccgggcatctctgctcagtgttaaggtctagccacagacactgtgggacctgcctcttcctatggaatgggggcctgcatgggttgtgtcctggggcaggagtgagggatggctgggaagaatctccaggtctgtggcccttgtgttgagtgattattttgtgacactctcattcctggaccacctgccaggtttatctgttatacctgtggcattcttattatgtcagacaagttattatagttcattcaactctaacaaatgaacaaaagaacaataaataggaggccattaaaggtcttttgtggcagag

SEQ ID NO: 364879 - DNA, 6020 bp, Homo sapiens
gggagagctgagcctgcggggctggccctggcctggctgctgctgcctgcagcccccagctcaggctccctccacctcacagtccactgctttggcgctgcttctgggctggcctcttcactccactgaatctttgggctctcatctgtaaaatgggagtgttcaagaaggccagtccaaatggaaagctcaccgtctacctgggaaagcgggactttgtggaccacatcgacctcgtggaccctgtggatggtgtggtcctggtggatcctgagtatctcaaagagcggagagtctatgtgacgctgacctgcgccttccgctatggccgggaggacctggatgtcctgggcctgacctttcgcaaggacctgtttgtggccaacgtacagtcgttcccaccggcccccgaggacaagaagcccctgacgcggctgcaggaacgcctcatcaagaagctgggcgagcacgcttaccctttcacctttgagatccctccaaaccttccatgttctgtgacactgcagccggggcccgaagacacggggaaggcttgcggtgtggactatgaagtcaaagccttctgcgcggagaatttggaggagaagatccacaagcggaattctgtgcgtctggtcatccggaaggttcagtatgccccagagaggcctggcccccagcccacagccgagaccaccaggcagttcctcatgtcggacaagcccttgcacctagaagcctctctggataaggagatctattaccatggagaacccatcagcgtcaacgtccacgtcaccaacaacaccaacaagacggtgaagaagatcaagatctcagtgcgccagtatgcagacatctgccttttcaacacagctcagtacaagtgccctgttgccatggaagaggctgatgacactgtggcacccagctcgacgttctgcaaggtctacacactgacccccttcctagccaataaccgagagaagcggggcctcgccttggacgggaagctcaagcacgaagacacgaacttggcctctagcaccctgttgagggaaggtgccaaccgtgagatcctggggatcattgtttcctacaaagtgaaagtgaagctggtggtgtctcggggcggcgacgtggccgtggaactgcccttcaccctaatgcaccccaagcccaaagaggaacccccgcatcgggaagttccagagaacgagacgccagtagataccaatctcatagaacttgacacaaatgatgacgacattgtatttgaggactttgctcgccagagactgaaaggcatgaaggatgacaaggaggaagaggaggatggtaccggctctccacagctcaacaacagatagacgggccggccctgcctccacgtggctccggctccactctcgtgcactcggatgcttactcgtcttcttcctgttctggtttcttttcccctttgttcttccagtttctaccagggggccccgtgggcttccagatcacggtgatgaacctctggcctcaggattggccccacatcaccacgccaacaggaccacagcgcactggctccaccccatctctgccatctccactcccctccttttcatgctgtctcccagaaaagctgccagggctctggccttggaattggacttgagatggggagcagacaggggaggatggggaatgtgggacacggtgtggtgggcatgagggcttggaggggtggggatgagggctcaagacacgagagaagatgtccacggtcccaggtggttaacaaagttctggcagctaaaagatgaccgcgttgaaggccacctccttctggctgggaggggcagaactgtggacagattctcaatgcctttttgaagttctgacccaccaaagaccttctgccttcaccctcctccccacctgatgtccctctgtgtctgatagtgatgttggtgaaagttcgtagaccccaggagtagagaaaagcaactggactgactttcttaccagcagttacctagactgaggcaagctgtgtggactcacccaagtatatttcagtactgtcaggctgtgacatcttagctaccttgtatttcaagtgcatggccctgtctagagatatgcacagagagaaaagcagagggagggagggagggggtcttcagcaagcaccagcccccagcagagtgagctgaagctcctgaggagggttcccgaaggggggcgctcagagatgggggcagggggcggggagaggagagtctgccttatgtcccttccttgtggacttcacatggtcatgcaggaagtgaggatgggtgtccagcgggggccgaggccactagtatcctcctgcttccccctgccattctccagggctggactgaccctatggactgggagagagtgcctgaggccaccatgccacagtcaaagggggtcctatctcagaaggtggcagcatccactgagatatcctcacccgaagggaaggaggctgctgggtagcaaataagccccttcttttcttggtgagttgatgacctccaatagctcccagtgtcatgggtacccagtacgcattagctggtgttgggttgattgagacctggggcagttcctggggcaagaagccagatgggagatgagatagaaagtgttaggagttatcctctttgcctggcctttgagaataacttactgtgtgactttgggcaagttccttccccactctgggcctcagtttctcacttgggaaagcaaggagtttgaccagatgatcacaatgggccttcctagctctggccaccaagaatttgtgaacattagagctcctggtctggtgggtagagccagagctgctgactggtctctctgcctccagaggggatttattggacctcagaggtggcagggccctatggagcaccaactgccctcaaccccaccctgtgcccaagactgggaagggattgatgtcaggctgtggccataggtagcatgagttgcccaaggagggacagagcatatctttgctgaggcttggctgaggggcttatgatagggcttgcagtacctcacagccccctgtgggcacagacaccctgaggtttacccaggcaaatatattgattagcaggacaagggctctctcctcagtttctgctcccttccatctctctcccatacttgtctgaaaagggagacaaaaaatcttatacaagtggcatctcaatcctttccagtccagcacctcctggggcaggcagtgtgacttatttcctgtggtgaaatcacctgtttcacaagcctggcagcgcgacttctgagtctcatgaccactcaacccaagggacccctccccagaccagaaccaagtcagctgggggctgtcgtactaccctgtccagtcttgagggcctagttgcaggtcccccaggcatccagcccctcctagagcttgctgggcaggctgcacctcatctgggcaggcgcagagctgatgaaatgctggagcaatgcatggcaaacatatgccctccagtgtcttctgaaacctttggggctgacacaagatcctttagtgtttgggatgacctctttcctgcagacttcttccccaccagtcttcatcgcttgccctgcttctcacttaggcagatgtcaaccagaatgagatacagccaatttggctttgatgacccagctgagagggaaatttagatacaattcaggaatatcatgcccaaaaatagtggtcccagcaaccaggacacagagggaagacctggatattgtcagtgattggtggagggggacatcttggaccctcctaggcctggtgtcacatctcccatctctcagaccccacagaggccaaggggccttggctctgacccaggttaaagagagccaccagcccccaggctcagggagctgaaaccacccatccgcagaaatctaagggcaaggagaaatagaaattgtctgttccttcccttcaaagtgtaaggcctcttccaggagcaactggagccaccacagcttctcagtgacattgggagggcttcgggcccaggaaaaacccaagccttttgtcctgagagccgagccacagcggatgcagtggcgtcagcatcccagagcggcagcttctctcctgcctgtcactggggactggttgctctccacccatccaggaggaaggggttaggtcccagtcttacactcttatagggtctcatggacataggcctatgcctgttctgatatctataattttttaaactcaaaaggaccaaaacactcctgaaccctcatctatacggcctgcactgggcttggtgtttcctcctggcccaggcagctccatctcttctgccattcctcctggacgaaagtggcaggaccccacctctaccacttccccacagggtcactgcacagcggcttcaaagacacgccctgttgaaggggaaacatcctccccccatcacactccaactcgtcaccccaaaagggaagtcaaagcacaggtccgtggggcctatggtttgtagacactgacacagtggttttcaaaccaggtgctgcggaacccctgatattccacagagctttgtcaggggatgctaaagtgggaagatgggagtggaggcaaaggataggtttccagccctcctcccatttccgccgccaccagaataactctgcttttatctgtcttgcctactgagatttcattttcaagctttctttgaagaagaacttcaaaccaccatctcgaggtttgatcttagaccagccagcacaggttctattcttgctgttcatgttggaatggctccagcgttccagtacaaagtgtctttgtgttggaacttgggtcacagacccaggcacaagcatttatacacacacacacacacacacacacacacacacacacacgtacatagttgatggtttttctagccaacccaccctgaagctctggccaaggtttgatttggacagggacctggtgctcagtggggatgggtcgtgaccctgatattggcccatgaagcatggggagctctggagcaaggaaacaggctcaatcccccactgaggacttgtgtctgcacccctatctggcaccccactttcctggcctaggcccaagggacacagcaggagaagcagtgtgataggagagaggctagggttaaattcatctttacacagcgccggatggatggaaatcttggctcacataaaagacagactcagggaggattttatgacaaaagtccctcctttgagggcaggattcccccaggaatcctggacactttagtgagaactggaccagcccttggcacaaaaccctgcctgccctgtcccccactcccaccccccagggaattctaggtgaaaatgtgaagctcagggcacagcaagcgcatgacacgggtgtattacattcggtccgagtgtgtccttagtttccctgtgtgcaaaatggggctagtccaggctcttcccacctcactgggacaattgcaagggtcataggagaggtgggtatgataggtggtcatatgaggtggtgagtatgagaggtgggtgcctcacaaactcggggtatggtcctgacctgcatggcagatgagcagagcacttgggaacgagcataggaagtgccatcttcccgggcatctctgctcagtgttaaggtctagccacagacactgtgggacctgcctcttcctatggaatgggggcctgcatgggttgtgtcctggggcaggagtgagggatggctgggaagaatctccaggtctgtggcccttgtgttgagtgattattttgtgacactctcattcctggaccacctgccaggtttatctgttatacctgtggcattcttattatgtcagacaagttattatagttcattcaactctaacaaatgaacaaaagaacaataaataggaggccattaaaggtcttttgtggcagag

SEQ ID NO: 364880 - DNA, 5702 bp, Homo sapiens
ctctaggggcttcttgtcctcgggggccggtgggaacgactgtacgttggccacaaacaggtccttgcgaaaggtcgggcccaggaccatccaggtcctccccgccatagcggaaggcgcaggtcagcctcatcaagaagctgggcgagcacgcttaccctttcacctttgagatccctccaaaccttccatgttctgtgacactgcagccggggcccgaagacacggggaaggcttgcggtgtggactatgaagtcaaagccttctgcgcggagaatttggaggagaagatccacaagcggaattctgtgcgtctggtcatccggaaggttcagtatgccccagagaggcctggcccccagcccacagccgagaccaccaggcagttcctcatgtcggacaagcccttgcacctagaagcctctctggataaggagatctattaccatggagaacccatcagcgtcaacgtccacgtcaccaacaacaccaacaagacggtgaagaagatcaagatctcagtgcgccagtatgcagacatctgccttttcaacacagctcagtacaagtgccctgttgccatggaagaggctgatgacactgtggcacccagctcgacgttctgcaaggtctacacactgacccccttcctagccaataaccgagagaagcggggcctcgccttggacgggaagctcaagcacgaagacacgaacttggcctctagcaccctgttgagggaaggtgccaaccgtgagatcctggggatcattgtttcctacaaagtgaaagtgaagctggtggtgtctcggggcggcgacgtggccgtggaactgcccttcaccctaatgcaccccaagcccaaagaggaacccccgcatcgggaagttccagagaacgagacgccagtagataccaatctcatagaacttgacacaaatgatgacgacattgtatttgaggactttgctcgccagagactgaaaggcatgaaggatgacaaggaggaagaggaggatggtaccggctctccacagctcaacaacagatagacgggccggccctgcctccacgtggctccggctccactctcgtgcactcggatgcttactcgtcttcttcctgttctggtttcttttcccctttgttcttccagtttctaccagggggccccgtgggcttccagatcacggtgatgaacctctggcctcaggattggccccacatcaccacgccaacaggaccacagcgcactggctccaccccatctctgccatctccactcccctccttttcatgctgtctcccagaaaagctgccagggctctggccttggaattggacttgagatggggagcagacaggggaggatggggaatgtgggacacggtgtggtgggcatgagggcttggaggggtggggatgagggctcaagacacgagagaagatgtccacggtcccaggtggttaacaaagttctggcagctaaaagatgaccgcgttgaaggccacctccttctggctgggaggggcagaactgtggacagattctcaatgcctttttgaagttctgacccaccaaagaccttctgccttcaccctcctccccacctgatgtccctctgtgtctgatagtgatgttggtgaaagttcgtagaccccaggagtagagaaaagcaactggactgactttcttaccagcagttacctagactgaggcaagctgtgtggactcacccaagtatatttcagtactgtcaggctgtgacatcttagctaccttgtatttcaagtgcatggccctgtctagagatatgcacagagagaaaagcagagggagggagggagggggtcttcagcaagcaccagcccccagcagagtgagctgaagctcctgaggagggttcccgaaggggggcgctcagagatgggggcagggggcggggagaggagagtctgccttatgtcccttccttgtggacttcacatggtcatgcaggaagtgaggatgggtgtccagcgggggccgaggccactagtatcctcctgcttccccctgccattctccagggctggactgaccctatggactgggagagagtgcctgaggccaccatgccacagtcaaagggggtcctatctcagaaggtggcagcatccactgagatatcctcacccgaagggaaggaggctgctgggtagcaaataagccccttcttttcttggtgagttgatgacctccaatagctcccagtgtcatgggtacccagtacgcattagctggtgttgggttgattgagacctggggcagttcctggggcaagaagccagatgggagatgagatagaaagtgttaggagttatcctctttgcctggcctttgagaataacttactgtgtgactttgggcaagttccttccccactctgggcctcagtttctcacttgggaaagcaaggagtttgaccagatgatcacaatgggccttcctagctctggccaccaagaatttgtgaacattagagctcctggtctggtgggtagagccagagctgctgactggtctctctgcctccagaggggatttattggacctcagaggtggcagggccctatggagcaccaactgccctcaaccccaccctgtgcccaagactgggaagggattgatgtcaggctgtggccataggtagcatgagttgcccaaggagggacagagcatatctttgctgaggcttggctgaggggcttatgatagggcttgcagtacctcacagccccctgtgggcacagacaccctgaggtttacccaggcaaatatattgattagcaggacaagggctctctcctcagtttctgctcccttccatctctctcccatacttgtctgaaaagggagacaaaaaatcttatacaagtggcatctcaatcctttccagtccagcacctcctggggcaggcagtgtgacttatttcctgtggtgaaatcacctgtttcacaagcctggcagcgcgacttctgagtctcatgaccactcaacccaagggacccctccccagaccagaaccaagtcagctgggggctgtcgtactaccctgtccagtcttgagggcctagttgcaggtcccccaggcatccagcccctcctagagcttgctgggcaggctgcacctcatctgggcaggcgcagagctgatgaaatgctggagcaatgcatggcaaacatatgccctccagtgtcttctgaaacctttggggctgacacaagatcctttagtgtttgggatgacctctttcctgcagacttcttccccaccagtcttcatcgcttgccctgcttctcacttaggcagatgtcaaccagaatgagatacagccaatttggctttgatgacccagctgagagggaaatttagatacaattcaggaatatcatgcccaaaaatagtggtcccagcaaccaggacacagagggaagacctggatattgtcagtgattggtggagggggacatcttggaccctcctaggcctggtgtcacatctcccatctctcagaccccacagaggccaaggggccttggctctgacccaggttaaagagagccaccagcccccaggctcagggagctgaaaccacccatccgcagaaatctaagggcaaggagaaatagaaattgtctgttccttcccttcaaagtgtaaggcctcttccaggagcaactggagccaccacagcttctcagtgacattgggagggcttcgggcccaggaaaaacccaagccttttgtcctgagagccgagccacagcggatgcagtggcgtcagcatcccagagcggcagcttctctcctgcctgtcactggggactggttgctctccacccatccaggaggaaggggttaggtcccagtcttacactcttatagggtctcatggacataggcctatgcctgttctgatatctataattttttaaactcaaaaggaccaaaacactcctgaaccctcatctatacggcctgcactgggcttggtgtttcctcctggcccaggcagctccatctcttctgccattcctcctggacgaaagtggcaggaccccacctctaccacttccccacagggtcactgcacagcggcttcaaagacacgccctgttgaaggggaaacatcctccccccatcacactccaactcgtcaccccaaaagggaagtcaaagcacaggtccgtggggcctatggtttgtagacactgacacagtggttttcaaaccaggtgctgcggaacccctgatattccacagagctttgtcaggggatgctaaagtgggaagatgggagtggaggcaaaggataggtttccagccctcctcccatttccgccgccaccagaataactctgcttttatctgtcttgcctactgagatttcattttcaagctttctttgaagaagaacttcaaaccaccatctcgaggtttgatcttagaccagccagcacaggttctattcttgctgttcatgttggaatggctccagcgttccagtacaaagtgtctttgtgttggaacttgggtcacagacccaggcacaagcatttatacacacacacacacacacacacacacacacacacacacgtacatagttgatggtttttctagccaacccaccctgaagctctggccaaggtttgatttggacagggacctggtgctcagtggggatgggtcgtgaccctgatattggcccatgaagcatggggagctctggagcaaggaaacaggctcaatcccccactgaggacttgtgtctgcacccctatctggcaccccactttcctggcctaggcccaagggacacagcaggagaagcagtgtgataggagagaggctagggttaaattcatctttacacagcgccggatggatggaaatcttggctcacataaaagacagactcagggaggattttatgacaaaagtccctcctttgagggcaggattcccccaggaatcctggacactttagtgagaactggaccagcccttggcacaaaaccctgcctgccctgtcccccactcccaccccccagggaattctaggtgaaaatgtgaagctcagggcacagcaagcgcatgacacgggtgtattacattcggtccgagtgtgtccttagtttccctgtgtgcaaaatggggctagtccaggctcttcccacctcactgggacaattgcaagggtcataggagaggtgggtatgataggtggtcatatgaggtggtgagtatgagaggtgggtgcctcacaaactcggggtatggtcctgacctgcatggcagatgagcagagcacttgggaacgagcataggaagtgccatcttcccgggcatctctgctcagtgttaaggtctagccacagacactgtgggacctgcctcttcctatggaatgggggcctgcatgggttgtgtcctggggcaggagtgagggatggctgggaagaatctccaggtctgtggcccttgtgttgagtgattattttgtgacactctcattcctggaccacctgccaggtttatctgttatacctgtggcattcttattatgtcagacaagttattatagttcattcaactctaacaaatgaacaaaagaacaataaataggaggccattaaaggtcttttgtggcagag

SEQ ID NO: 364881 - DNA, 517 bp, Homo sapiens
ggcccgagtcctgatgtgactgtccccactgccacaggtggcatccacatgtgccagccagacaggcctttctgctcatggtcagccccagaggccagagacctcagagagggtggttctccccggccccagagccatactctgagtcacatctggccgggcctctggataagcctactctccctgcccctgcaaacacaccacattttccttgtctctcccaccagtgatgacgacattgtatttgaggactttgctcgccagagactgaaaggcatgaaggatgacaaggaggaagaggaggatggtaccggctctccacagctcaacaacagatagacgggccggccctgcctccacgtggctccggctccactctcgtgcactcggatgcttactcgtcttcttcctgttctggtttcttttcccctttgttcttccagtttctaccagggggccccgtgggcttccagatcacggtgatgaacctctggcctcaggattggccccacatcac

SEQ ID NO: 364882 - DNA, 318 bp, Homo sapiens
accaggagtttaagaccaacctgggcaatacagcaagaccccatctctacaaaacatttaaaaattagccagatgtggtggtcacgtgcctgtagtcccagctattcaggaggctgaggcaggaggatcccttgaggcgaggagtttgaggctgtagtgagctatgatcatgatcgtgccactgcactccaacctgggtgacggagtgagactcttgtctcttaaaaaaaataaaaagtacaagagtagctgtagtatgccaccctctatataataaagaagatatatgaaattcatatgtatgtatctactttgtac

SEQ ID NO: 364883 - DNA, 2842 bp, Homo sapiens
acccagtgagcggctagggtgcagcaggagtttgggggatagccccagtcttgggatctctgtcctgggctggggactgccccctcccctggcctggctcctgacgcccgtgctgccggtgaaacgctgttgacatgtcctgaattattaagcgtggggagggctccggagcacatgctgagcggagcggctggggctgcgcggcgtggcggagcagcgctcgctccctcgctcactcgctcgctcgcagggacacacgcaggggctgacagctgtgctggtgctgataagggaagccacaaggagacgatcgaggagagagacaagcggcagcagaggcagcagcggcagaggcagcaccagggctgcggagctgctgggagtgggagtgactcccccacctcgggcccccaccctgtccctgtcctcttcccgcttgccctgagtttagaagagcagccgctgccaccactgccactcgggagggcaccagggctgctggctagggagggacagggcagggaggctctggccagtcccagcagccggggacagatgccgatcgagattgtgtgcaaaatcaaatttgctgaggaggatgcgaaacccaaggagaaggaggcaggggatgagcagagcctcctcggggctgttgcccctggagcagccccccgagacctggccacctttgccagcaccagcaccctgcatggactgggccgggcctgtggcccaggcccccacggactgcgcagaaccctgtgggcactggccctactcacctcgctggctgccttcctgtaccaggcggctggcctggcccggggctacctgacccggcctcacctggtggcaatggaccccgctgccccagccccagtggcgggcttcccggctgtcaccctctgcaatatcaaccgcttccggcattcggcactcagcgatgccgacatcttccacctggccaatctgacagggctgccccccaaagaccgggatgggcaccgtgcggctggcctgcgctacccagagcctgacatggtagacatcctcaaccgcactggccaccagctcgccgacatgcttaagagctgcaacttcagtgggcatcactgctccgccagcaacttctctgtggtctatactcgctatgggaagtgttacaccttcaacgcggacccgcggagctcgctgcccagccgggcagggggcatgggcagtggcctggagatcatgctggacatccagcaggaggagtacctgcccatctggagggagacaaatgagacgtcgtttgaggcaggtattcgggtgcagatccacagccaggaggagccgccctacatccaccagctggggttcggggtgtccccaggcttccagacctttgtgtcctgccaggaacagcggctgacctacctgccccagccctggggcaactgccgcgcagagagtgagctcagggagcctgagcttcagggctactcggcctacagtgtgtctgcctgccggctgcgctgtgaaaaggaggccgtgcttcagcgctgccactgccggatggtgcacatgccagactccctgggtgggggccctgagggcccgtgcttctgccccaccccctgcaacctgacacgctatgggaaagagatctccatggtcaggatccccaacaggggctcagcccggtacctggcgaggaagtacaaccgcaacgagacctacatacgggagaacttcctggtcctagatgtcttctttgaggccctgacctctgaagccatggagcagcgagcagcctatggcctgtcagccctgctgggagacctcgggggacagatgggcctgttcattggggccagcatcctcacgttgctggagatcctcgactacatctatgaggtgtcctgggatcgactgaagcgggtatggaggcgtcccaagacccccctgcggacctccactgggggcatctccactttggggcttcaggagctgaaggaacagagtccctgcccgagcctgggccgagcggagggtgggggggtcagcagtctgctccccaatcaccaccacccccacggtcccccaggaggtctctttgaagattttgcttgctaggacggtgctgtgactgaaaggacccaggagtctgggacccctcctgggatccccagcacattctcctgctcctgggagaggcctgggggcggtgctcactgggagggccaggactcagttcctgctctcatcctcccctgccctgatgtcagctgctttgcacaaaggtccttcttgtccacaccccttatccccaggctggtgccccgggagggctggagaccaggccatgggccctcacggagaggaagggaaggaaggagagggagggggaggatagagcccatcccagccggggagggggagccctctgtacatttgtaaatatttagggaaagccgggtggggggaggggatacagatgtagaaggtgggtagggctacaggggtgggtgatttagggacagccagggtcccagccccaatgtcagcaggatagggagagccccaggactcaggagtgctgggctggtcctacttcctgcccctctccaggcccagctcccctcttggcagggggagaggatggcccagcaggcctggcccagctcccagttccccctgcaccagccccacccctagagtcccttctatagggagggggcaggagaccttccagacttcggctgagcttggagggtgggaagggagccttctcagtcctctctccctccagtctgattttataaagtgctgacgagattgggaataaagaggcataaag

SEQ ID NO: 364884 - DNA, 2421 bp, Homo sapiens
  misc_feature (1553)..(1553): n is a, c, g, or t
ggaagggtgatgagacctcagtgagaggaaaggagaggaagagctggagggggtgaggaagtaaggggagggaggcagagggttctgcttggtctccaggctaggaggcggtgcctggaggatacaggaacggggatcctctgatcaaggctggtctatactcgctatgggaagtgttacaccttcaacgcggacccgcggagctcgctgcccagccgggcagggggcatgggcagtggcctggagatcatgctggacatccagcaggaggagtacctgcccatctggagggagacaaatgagacgtcgtttgaggcaggtattcgggtgcagatccacagccaggaggagccgccctacatccaccagctggggttcggggtgtccccaggcttccagacctttgtgtcctgccaggaacagcggctgacctacctgccccagccctggggcaactgccgcgcagagagtgagctcagggagcctgagcttcagggctactcggcctacagtgtgtctgcctgccggctgcgctgtgaaaaggaggccgtgcttcagcgctgccactgccggatggtgcacatgccaggcaatgagaccatctgcccaccaaatatctacatcgagtgtgcagaccacacactggactccctgggtgggggccctgagggcccgtgcttctgccccaccccctgcaacctgacacgctatgggaaagagatctccatggtcaggatccccaacaggggctcagcccggtacctggcgaggaagtacaaccgcaacgagacctacatacgggagaacttcctggtcctagatgtcttctttgaggccctgacctctgaagccatggagcagcgagcagcctatggcctgtcagccctgctgggagacctcgggggacagatgggcctgttcattggggccagcatcctcacgttgctggagatcctcgactacatctatgaggcaagggccctggagaaggcagggtgggagtgggggccgtgggcaaagcagaagggggcagtgcggggtgcctggtggagctggcctggctggaaagtcaggttcagggttctctgccagggtcccctgactggctggcaggcctgagggctcagagtcaggagaaggggatgggtgaggaggaggagggtgtcctactgggagtttgctgtggcagtaagtcctgtgggcagctgggcatggtaaggctcacgcttctcctcaaccaaatttcctgagcccactgctgtccccgaccctgaaccccaaggtgtcctgggatcgactgaagcgggtatggaggcgtcccaagacccccctgcggacctccactgggggcatctccactttggggcttcaggagctgaaggaacaggtgaggacaagctctaaatgcctgcagcatgcagccacacctccccaggactgaatacatccattgtttctgaaccagcctgtggagggggccctggagcctctgcccgaggtgacaaggaaaggctggcggtgtgagccctgggggcaccacttgagctctcccngtcccactctctcttttctttctcctgcagagtccctgcccgagcctgggccgagcggagggtgggggggtcagcagtctgctccccaatcaccaccacccccacggtcccccaggaggtctctttgaagattttgcttgctaggacggtgctgtgactgaaaggacccaggagtctgggacccctcctgggatccccagcacattctcctgctcctgggagaggcctgggggcggtgctcactgggagggccaggactcagttcctgctctcatcctcccctgccctgatgtcagctgctttgcacaaaggtccttcttgtccacaccccttatccccaggctggtgccccgggagggctggagaccaggccatgggccctcacggagaggaagggaaggaaggagagggagggggaggatagagcccatcccagccggggagggggagccctctgtacatttgtaaatatttagggaaagccgggtggggggaggggatacagatgtagaaggtgggtagggctacaggggtgggtgatttagggacagccagggtcccagccccaatgtcagcaggatagggagagccccaggactcaggagtgctgggctggtcctacttcctgcccctctccaggcccagctcccctcttggcagggggagaggatggcccagcaggcctggcccagctcccagttccccctgcaccagccccacccctagagtcccttctatagggagggggcaggagaccttccagacttcggctgagcttggagggtgggaagggagccttctcagtcctctctccctccagtctgattttataaagtgctgacgagattgggaataaagaggcataaag

SEQ ID NO: 364885 - DNA, 2481 bp, Homo sapiens
acccagtgagcggctagggtgcagcaggagtttgggggatagccccagtcttgggatctctgtcctgggctggggactgccccctcccctggcctggctcctgacgcccgtgctgccggtgaaacgctgttgacatgtcctgaattattaagcgtggggagggctccggagcacatgctgagcggagcggctggggctgcgcggcgtggcggagcagcgctcgctccctcgctcactcgctcgctcgcagggacacacgcaggggctgacagctgtgctggtgctgataagggaagccacaaggagacgatcgaggagagagacaagcggcagcagaggcagcagcggcagaggcagcaccagggctgcggagctgctgggagtgggagtgactcccccacctcgggcccccaccctgtccctgtcctcttcccgcttgccctgagtttagaagagcagccgctgccaccactgccactcgggagggcaccagggctgctggctagggagggacagggcagggaggctctggccagtcccagcagccggggacagatgccgatcgagattgtgtgcaaaatcaaatttgctgaggaggatgcgaaacccaaggagaaggaggcaggggatgagcagagcctcctcggggctgttgcccctggagcagccccccgagacctggccacctttgccagcaccagcaccctgcatggactgggccgggcctgtggcccaggcccccacggactgcgcagaaccctgtgggcactggccctactcacctcgctggctgccttcctgtaccaggcggctggcctggcccggggctacctgacccggcctcacctggtggcaatggaccccgctgccccagccccagtggcgggcttcccggctgtcaccctctgcaatatcaaccgcttccggcattcggcactcagcgatgccgacatcttccacctggccaatctgacagggctgccccccaaagaccgggatgggcaccgtgcggctggcctgcgctacccagagcctgacatggtagacatcctcaaccgcactggccaccagctcgccgacatgcttaagagctgcaacttcagtgggcatcactgctccgccagcaacttctctgtggtctatactcgctatgggaagtgttacaccttcaacgcggacccgcggagctcgctgcccagccgggcagggggcatgggcagtggcctggagatcatgctggacatccagcaggaggagtacctgcccatctggagggagacaaatgagacgtcgtttgaggcaggtattcgggtgcagatccacagccaggaggagccgccctacatccaccagctggggttcggggtgtccccaggcttccagacctttgtgtcctgccaggaacagcggctgacctacctgccccagccctggggcaactgccgcgcagagagtgagctcagggagcctgagcttcagggctactcggcctacagtgtgtctgcctgccggctgcgctgtgaaaaggaggccgtgcttcagcgctgccactgccggatggtgcacatgccaggcaatgagaccatctgcccaccaaatatctacatcgagtgtgcagaccacacactgggtccgtgctgcctaccctttcctacctctccatcagcctcttcatgtctctgtccactcttctcctcactgtcttggatcctcccctcccaatctcttcctggagggttcttcctgggggttgagccttagcccatacttcagtggggtcggggagaggtctgcggacctctgcaggtacagacacttgggtaagtggaggcagcagggtggggggttgcagagaagccaggactgggagtgaaggtctgggcttctcatcttggttcagccaatgagctcacccactttgagaaagtgaaatgacttctctcttggtctcaggaaaaatgcattgctggctatcggtgtgggtaaggcaaaccccatctgtccacagatcttgcctgatctgcagttcatccatctatccatccattcatcgattcgcgcattctccagacctttacagcctgtgctgggtactggaggtgagagtgggggcgacagccctgcccttggagagcttacaccccggcagggctgtggacagccattcccacacagcccgtcaactcctggagaggggagcctcgggtgtgctgcaaggccccaaggaggggtgtgcagccctagcctgggaaggtagggaggattcctagaggaagggacacattagctgaggcttgatgggtgtataagagtcaggtgcaaagggggacatacactgaagacctgtggccagaaagagcatgctgtgtccggggcactgaaaggtctgtgtggctgcagggcagagaacaggggagggagtagaaagagtagaggagggaggccaggcacggtggctcacaagtgtagacccagcacttt

SEQ ID NO: 364886 - DNA, 3874 bp, Homo sapiens
  misc_feature (3006)..(3006): n is a, c, g, or t
acccagtgagcggctagggtgcagcaggagtttgggggatagccccagtcttgggatctctgtcctgggctggggactgccccctcccctggcctggctcctgacgcccgtgctgccggtgaaacgctgttgacatgtcctgaattattaagcgtggggagggctccggagcacatgctgagcggagcggctggggctgcgcggcgtggcggagcagcgctcgctccctcgctcactcgctcgctcgcagggacacacgcaggggctgacagctgtgctggtgctgataagggaagccacaaggagacgatcgaggagagagacaagcggcagcagaggcagcagcggcagaggcagcaccagggctgcggagctgctgggagtgggagtgactcccccacctcgggcccccaccctgtccctgtcctcttcccgcttgccctgagtttagaagagcagccgctgccaccactgccactcgggagggcaccagggctgctggctagggagggacagggcagggaggctctggccagtcccagcagccggggacagatgccgatcgagattgtgtgcaaaatcaaatttgctgaggaggatgcgaaacccaaggagaaggaggcaggggatgagcagagcctcctcggggctgttgcccctggagcagccccccgagacctggccacctttgccagcaccagcaccctgcatggactgggccgggcctgtggcccaggcccccacggactgcgcagaaccctgtgggcactggccctactcacctcgctggctgccttcctgtaccaggcggctggcctggcccggggctacctgacccggcctcacctggtggcaatggaccccgctgccccagccccagtggcgggcttcccggctgtcaccctctgcaatatcaaccgcttccggcattcggcactcagcgatgccgacatcttccacctggccaatctgacagggctgccccccaaagaccgggatgggcaccgtgcggctggcctgcgctacccagagcctgacatggtagacatcctcaaccgcactggccaccagctcgccgacatgcttaagagctgcaacttcagtgggcatcactgctccgccagcaacttctctgtggtctatactcgctatgggaagtgttacaccttcaacgcggacccgcggagctcgctgcccagccgggcagggggcatgggcagtggcctggagatcatgctggacatccagcaggaggagtacctgcccatctggagggagacaaatgagacgtcgtttgaggcaggtattcgggtgcagatccacagccaggaggagccgccctacatccaccagctggggttcggggtgtccccaggcttccagacctttgtgtcctgccaggaacagcggctgacctacctgccccagccctggggcaactgccgcgcagagagtgagctcagggagcctgagcttcagggctactcggcctacagtgtgtctgcctgccggctgcgctgtgaaaaggaggccgtgcttcagcgctgccactgccggatggtgcacatgccaggcaatgagaccatctgcccaccaaatatctacatcgagtgtgcagaccacacactgggtccgtgctgcctaccctttcctacctctccatcagcctcttcatgtctctgtccactcttctcctcactgtcttggatcctcccctcccaatctcttcctggagggttcttcctgggggttgagccttagcccatacttcagtggggtcggggagaggtctgcggacctctgcaggtacagacacttgggtaagtggaggcagcagggtggggggttgcagagaagccaggactgggagtgaaggtctgggcttctcatcttggttcagccaatgagctcacccactttgagaaagtgaaatgacttctctcttggtctcaggaaaaatgcattgctggctatcggtgtgggtaaggcaaaccccatctgtccacagatcttgcctgatctgcagttcatccatctatccatccattcatcgattcgcgcattctccagacctttacagcctgtgctgggtactggagactccctgggtgggggccctgagggcccgtgcttctgccccaccccctgcaacctgacacgctatgggaaagagatctccatggtcaggatccccaacaggggctcagcccggtacctggcgaggaagtacaaccgcaacgagacctacatacgggagaacttcctggtcctagatgtcttctttgaggccctgacctctgaagccatggagcagcgagcagcctatggcctgtcagccctgctgggagacctcgggggacagatgggcctgttcattggggccagcatcctcacgttgctggagatcctcgactacatctatgaggcaagggccctggagaaggcagggtgggagtgggggccgtgggcaaagcagaagggggcagtgcggggtgcctggtggagctggcctggctggaaagtcaggttcagggttctctgccagggtcccctgactggctggcaggcctgagggctcagagtcaggagaaggggatgggtgaggaggaggagggtgtcctactgggagtttgctgtggcagtaagtcctgtgggcagctgggcatggtaaggctcacgcttctcctcaaccaaatttcctgagcccactgctgtccccgaccctgaaccccaaggtgtcctgggatcgactgaagcgggtatggaggcgtcccaagacccccctgcggacctccactgggggcatctccactttggggcttcaggagctgaaggaacaggtgaggacaagctctaaatgcctgcagcatgcagccacacctccccaggactgaatacatccattgtttctgaaccagcctgtggagggggccctggagcctctgcccgaggtgacaaggaaaggctggcggtgtgagccctgggggcaccacttgagctctcccngtcccactctctcttttctttctcctgcagagtccctgcccgagcctgggccgagcggagggtgggggggtcagcagtctgctccccaatcaccaccacccccacggtcccccaggaggtctctttgaagattttgcttgctaggacggtgctgtgactgaaaggacccaggagtctgggacccctcctgggatccccagcacattctcctgctcctgggagaggcctgggggcggtgctcactgggagggccaggactcagttcctgctctcatcctcccctgccctgatgtcagctgctttgcacaaaggtccttcttgtccacaccccttatccccaggctggtgccccgggagggctggagaccaggccatgggccctcacggagaggaagggaaggaaggagagggagggggaggatagagcccatcccagccggggagggggagccctctgtacatttgtaaatatttagggaaagccgggtggggggaggggatacagatgtagaaggtgggtagggctacaggggtgggtgatttagggacagccagggtcccagccccaatgtcagcaggatagggagagccccaggactcaggagtgctgggctggtcctacttcctgcccctctccaggcccagctcccctcttggcagggggagaggatggcccagcaggcctggcccagctcccagttccccctgcaccagccccacccctagagtcccttctatagggagggggcaggagaccttccagacttcggctgagcttggagggtgggaagggagccttctcagtcctctctccctccagtctgattttataaagtgctgacgagattgggaataaagaggcataaag

SEQ ID NO: 364887 - DNA, 2899 bp, Homo sapiens
acccagtgagcggctagggtgcagcaggagtttgggggatagccccagtcttgggatctctgtcctgggctggggactgccccctcccctggcctggctcctgacgcccgtgctgccggtgaaacgctgttgacatgtcctgaattattaagcgtggggagggctccggagcacatgctgagcggagcggctggggctgcgcggcgtggcggagcagcgctcgctccctcgctcactcgctcgctcgcagggacacacgcaggggctgacagctgtgctggtgctgataagggaagccacaaggagacgatcgaggagagagacaagcggcagcagaggcagcagcggcagaggcagcaccagggctgcggagctgctgggagtgggagtgactcccccacctcgggcccccaccctgtccctgtcctcttcccgcttgccctgagtttagaagagcagccgctgccaccactgccactcgggagggcaccagggctgctggctagggagggacagggcagggaggctctggccagtcccagcagccggggacagatgccgatcgagattgtgtgcaaaatcaaatttgctgaggaggatgcgaaacccaaggagaaggaggcaggggatgagcagagcctcctcggggctgttgcccctggagcagccccccgagacctggccacctttgccagcaccagcaccctgcatggactgggccgggcctgtggcccaggcccccacggactgcgcagaaccctgtgggcactggccctactcacctcgctggctgccttcctgtaccaggcggctggcctggcccggggctacctgacccggcctcacctggtggcaatggaccccgctgccccagccccagtggcgggcttcccggctgtcaccctctgcaatatcaaccgcttccggcattcggcactcagcgatgccgacatcttccacctggccaatctgacagggctgccccccaaagaccgggatgggcaccgtgcggctggcctgcgctacccagagcctgacatggtagacatcctcaaccgcactggccaccagctcgccgacatgcttaagagctgcaacttcagtgggcatcactgctccgccagcaacttctctgtggtctatactcgctatgggaagtgttacaccttcaacgcggacccgcggagctcgctgcccagccgggcagggggcatgggcagtggcctggagatcatgctggacatccagcaggaggagtacctgcccatctggagggagacaaatgagacgtcgtttgaggcaggtattcgggtgcagatccacagccaggaggagccgccctacatccaccagctggggttcggggtgtccccaggcttccagacctttgtgtcctgccaggaacagcggctgacctacctgccccagccctggggcaactgccgcgcagagagtgagctcagggagcctgagcttcagggctactcggcctacagtgtgtctgcctgccggctgcgctgtgaaaaggaggccgtgcttcagcgctgccactgccggatggtgcacatgccaggcaatgagaccatctgcccaccaaatatctacatcgagtgtgcagaccacacactggactccctgggtgggggccctgagggcccgtgcttctgccccaccccctgcaacctgacacgctatgggaaagagatctccatggtcaggatccccaacaggggctcagcccggtacctggcgaggaagtacaaccgcaacgagacctacatacgggagaacttcctggtcctagatgtcttctttgaggccctgacctctgaagccatggagcagcgagcagcctatggcctgtcagccctgctgggagacctcgggggacagatgggcctgttcattggggccagcatcctcacgttgctggagatcctcgactacatctatgaggtgtcctgggatcgactgaagcgggtatggaggcgtcccaagacccccctgcggacctccactgggggcatctccactttggggcttcaggagctgaaggaacagagtccctgcccgagcctgggccgagcggagggtgggggggtcagcagtctgctccccaatcaccaccacccccacggtcccccaggaggtctctttgaagattttgcttgctaggacggtgctgtgactgaaaggacccaggagtctgggacccctcctgggatccccagcacattctcctgctcctgggagaggcctgggggcggtgctcactgggagggccaggactcagttcctgctctcatcctcccctgccctgatgtcagctgctttgcacaaaggtccttcttgtccacaccccttatccccaggctggtgccccgggagggctggagaccaggccatgggccctcacggagaggaagggaaggaaggagagggagggggaggatagagcccatcccagccggggagggggagccctctgtacatttgtaaatatttagggaaagccgggtggggggaggggatacagatgtagaaggtgggtagggctacaggggtgggtgatttagggacagccagggtcccagccccaatgtcagcaggatagggagagccccaggactcaggagtgctgggctggtcctacttcctgcccctctccaggcccagctcccctcttggcagggggagaggatggcccagcaggcctggcccagctcccagttccccctgcaccagccccacccctagagtcccttctatagggagggggcaggagaccttccagacttcggctgagcttggagggtgggaagggagccttctcagtcctctctccctccagtctgattttataaagtgctgacgagattgggaataaagaggcataaag

SEQ ID NO: 364888 - DNA, 2890 bp, Homo sapiens
  misc_feature (2022)..(2022): n is a, c, g, or t
ggaagggtgatgagacctcagtgagaggaaaggagaggaagagctggagggggtgaggaagtaaggggagggaggcagagggttctgcttggtctccaggctaggaggcggtgcctggaggatacaggaacggggatcctctgatcaaggctggtctatactcgctatgggaagtgttacaccttcaacgcggacccgcggagctcgctgcccagccgggcagggggcatgggcagtggcctggagatcatgctggacatccagcaggaggagtacctgcccatctggagggagacaaatgagacgtcgtttgaggcaggtattcgggtgcagatccacagccaggaggagccgccctacatccaccagctggggttcggggtgtccccaggcttccagacctttgtgtcctgccaggaacagcggctgacctacctgccccagccctggggcaactgccgcgcagagagtgagctcagggagcctgagcttcagggctactcggcctacagtgtgtctgcctgccggctgcgctgtgaaaaggaggccgtgcttcagcgctgccactgccggatggtgcacatgccaggcaatgagaccatctgcccaccaaatatctacatcgagtgtgcagaccacacactgggtccgtgctgcctaccctttcctacctctccatcagcctcttcatgtctctgtccactcttctcctcactgtcttggatcctcccctcccaatctcttcctggagggttcttcctgggggttgagccttagcccatacttcagtggggtcggggagaggtctgcggacctctgcaggtacagacacttgggtaagtggaggcagcagggtggggggttgcagagaagccaggactgggagtgaaggtctgggcttctcatcttggttcagccaatgagctcacccactttgagaaagtgaaatgacttctctcttggtctcaggaaaaatgcattgctggctatcggtgtgggtaaggcaaaccccatctgtccacagatcttgcctgatctgcagttcatccatctatccatccattcatcgattcgcgcattctccagacctttacagcctgtgctgggtactggagactccctgggtgggggccctgagggcccgtgcttctgccccaccccctgcaacctgacacgctatgggaaagagatctccatggtcaggatccccaacaggggctcagcccggtacctggcgaggaagtacaaccgcaacgagacctacatacgggagaacttcctggtcctagatgtcttctttgaggccctgacctctgaagccatggagcagcgagcagcctatggcctgtcagccctgctgggagacctcgggggacagatgggcctgttcattggggccagcatcctcacgttgctggagatcctcgactacatctatgaggcaagggccctggagaaggcagggtgggagtgggggccgtgggcaaagcagaagggggcagtgcggggtgcctggtggagctggcctggctggaaagtcaggttcagggttctctgccagggtcccctgactggctggcaggcctgagggctcagagtcaggagaaggggatgggtgaggaggaggagggtgtcctactgggagtttgctgtggcagtaagtcctgtgggcagctgggcatggtaaggctcacgcttctcctcaaccaaatttcctgagcccactgctgtccccgaccctgaaccccaaggtgtcctgggatcgactgaagcgggtatggaggcgtcccaagacccccctgcggacctccactgggggcatctccactttggggcttcaggagctgaaggaacaggtgaggacaagctctaaatgcctgcagcatgcagccacacctccccaggactgaatacatccattgtttctgaaccagcctgtggagggggccctggagcctctgcccgaggtgacaaggaaaggctggcggtgtgagccctgggggcaccacttgagctctcccngtcccactctctcttttctttctcctgcagagtccctgcccgagcctgggccgagcggagggtgggggggtcagcagtctgctccccaatcaccaccacccccacggtcccccaggaggtctctttgaagattttgcttgctaggacggtgctgtgactgaaaggacccaggagtctgggacccctcctgggatccccagcacattctcctgctcctgggagaggcctgggggcggtgctcactgggagggccaggactcagttcctgctctcatcctcccctgccctgatgtcagctgctttgcacaaaggtccttcttgtccacaccccttatccccaggctggtgccccgggagggctggagaccaggccatgggccctcacggagaggaagggaaggaaggagagggagggggaggatagagcccatcccagccggggagggggagccctctgtacatttgtaaatatttagggaaagccgggtggggggaggggatacagatgtagaaggtgggtagggctacaggggtgggtgatttagggacagccagggtcccagccccaatgtcagcaggatagggagagccccaggactcaggagtgctgggctggtcctacttcctgcccctctccaggcccagctcccctcttggcagggggagaggatggcccagcaggcctggcccagctcccagttccccctgcaccagccccacccctagagtcccttctatagggagggggcaggagaccttccagacttcggctgagcttggagggtgggaagggagccttctcagtcctctctccctccagtctgattttataaagtgctgacgagattgggaataaagaggcataaag

SEQ ID NO: 364889 - DNA, 1161 bp, Homo sapiens
tgagaagaagggagtgagactgctcagagaggcaggattcctgctgactccagggggacacctggcacctcagcttcctttcccacttctccaggctgcatggaggggtgccgggcaggggcctcctggaagggaacctcctgcagcctcaagcaccaggtcatgacatgacatctatccctttcccaggtgaccgactcctgcaggtggatggagtgattctgtgcggcctcacccacaagcaggctgtgcagtgcctgaagggtcctgggcaggttgcaagactggtcttagagagaagagtccccaggagtacacagcagtgtccttctgctaatgacagcatgggagatgaacgcacggctgtttccttggtaacagccttgcctggcaggccttcgagctgtgtctcagtgacagatggtcctaagtttgaagtcaaactaaaaaagaatgccaatggtttgggattcagtttcgtgcagatggagaaagagagctgcagccatctcaaaagtgatcttgtgaggattaagaggctctttccggggcagccagctgaggagaatggggccattgcagctggtgacattatcctggccgtgaatggaaggtccacggaaggcctcatcttccaggaggtgctgcatttactgagaggggccccacaggaagtcacgctcctcctttgccgaccccctccaggtgcgctgcctgagctggagcaggaatgggcagacacctgaactctcagctgacaaagaattcaccagggcaacatgtactgactcatgtaccagccccatcctggatcaagaggacagctggagggacagtgcctccccagatgcaggggaaggcctgggtctcaggccagagtcttcccaaaaggccatcagagaggcacaatggggccaaaacagagagagaccttgggccagttccttgacacattctcctgagtcccaccctcatttatgcaaacttcaccaagaaagggatgaatcaacattggcgacctctttggaaaaggatgtgaggcaaaactgctattcagtttgtgatatcatgagacttggaagatattccttctcatctcctctaaccagactttcgacagatattttctgagcaccttctctgcatgtctgcagtgctgtg

SEQ ID NO: 364890 - DNA, 1155 bp, Homo sapiens
tgttaagcttatgaacacctaatcttattgctcagtggagaatacaatctaaacgaacaggtgaatacagaagacagtgccagtcggagggtggcattaacaccagtgtgccatatggtggtatctatgtgaaatccattgttcctggaggaccagctgccaaggaagggcagatcctacagggtgaccgactcctgcaggtggatggagtgattctgtgcggcctcacccacaagcaggctgtgcagtgcctgaagggtcctgggcaggttgcaagactggtcttagagagaagagtccccaggagtacacagcagtgtccttctgctaatgacagcatgggagatgaacgcacggctgtttccttggtaacagccttgcctggcaggccttcgagctgtgtctcagtgacagatggtcctaagtttgaagtcaaactaaaaaagaatgccaatggtttgggattcagtttcgtgcagatggagaaagagagctgcagccatctcaaaagtgatcttgtgaggattaagaggctctttccggggcagccagctgaggagaatggggccattgcagctggtgacattatcctggccgtgaatggaaggtccacggaaggcctcatcttccaggaggtgctgcatttactgagaggggccccacaggaagtcacgctcctcctttgccgaccccctccaggtgcgctgcctgagctggagcaggaatgggcagacacctgaactctcagctgacaaagaattcaccagggcaacatgtactgactcatgtaccagccccatcctggatcaagaggacagctggagggacagtgcctccccagatgcaggggaaggcctgggtctcaggccagagtcttcccaaaaggccatcagagaggcacaatggggccaaaacagagagagaccttgggccagttccttgacacattctcctgagtcccaccctcatttatgcaaacttcaccaagaaagggatgaatcaacattggcgacctctttggaaaaggatgtgaggcaaaactgctattcagtttgtgatatcatgagacttggaagatattccttctcatctcctctaaccagactttcgacagatattttctgagcaccttctctgcatgtctgcagtgctgtg

SEQ ID NO: 364891 - DNA, 947 bp, Homo sapiens
taggagcctgggcggagcctggcgtcccctcccgcgtccggccgcgcccgtcctcctggctgcagagagactaccggccaccgccgccgccgccgccgcgagctgtccctgcggcgcgtctgccttggcggagccgaccgcagtgcgctcaggcgtccggtgcgtccccagcctccgccccggcgcgggggcgacggactcgcgcgtgcgcagcgccggaggggcgcgggctgggaccccctagccagcgcgtgcgccgatcgagcgcagggcgatgggtgggcgccgggcgccgggcgccaggcagtgatgggccttcccgcgctgcggccccactgaggaggaggctcggggacagcaggagcacgggctgcccgcgcggtgcggaccatggcgttcctggccgggccgcgcctgctggactgggccagctcgccgccgcacctgcagttcaataagttcgtgctgaccgggtaccggcccgccagcagcggctcgggctgcctgcgcagcctcttctacctgcacaacgaactgggcaacatctacacgcacggtgagccgcgtcccgcaacgcgcttcccacacccccggccgccctacctgcgttgggccgggggcactgaggccgaggagggccccagcgcccaagtccagggctgccccggccctggcaccgccagtagccgcggtgacaaagctgccattgtcccgggccgcgctgccagcttccgttttcccggcgggtgggggccgggtcaggagaggggagcagagtagggtctgagcctgcttaatccctctgagccccaggggtagggagcatggtgtccggcctctgtaatcccagcgccctgggaaccccctcccgccagcacccagccgggagatggtgttgactgcgatgaggagggcccgggaggagcctcccagcgccgccgtcctga

SEQ ID NO: 364892 - DNA, 2631 bp, Homo sapiens
taggagcctgggcggagcctggcgtcccctcccgcgtccggccgcgcccgtcctcctggctgcagagagactaccggccaccgccgccgccgccgccgcgagctgtccctgcggcgcgtctgccttggcggagccgaccgcagtgcgctcaggcgtccggtgcgtccccagcctccgccccggcgcgggggcgacggactcgcgcgtgcgcagcgccggaggggcgcgggctgggaccccctagccagcgcgtgcgccgatcgagcgcagggcgatgggtgggcgccgggcgccgggcgccaggcagtgatgggccttcccgcgctgcggccccactgaggaggaggctcggggacagcaggagcacgggctgcccgcgcggtgcggaccatggcgttcctggccgggccgcgcctgctggactgggccagctcgccgccgcacctgcagttcaataagttcgtgctgaccgggtaccggcccgccagcagcggctcgggctgcctgcgcagcctcttctacctgcacaacgaactgggcaacatctacacgcacggctccgtgctctatcacctctttatgtgccaccaagggggcagcgctgtgtacgcccggctcctcgccctggacatgtgtggggtctgccttgtcaacacccttggggccctgcccatcatccactgcaccctggcctgcaggccctggctgcgcccggctgccctggtgggctacactgtgttgtcgggtgtggccggctggcgtgctctcaccgccccctccaccagtgctcggctccgggcatttggatggcaggctgctgcccgcctactggtatttggggcccggggagtgggtctgggttcaggggctccaggctccctgccctgctacctgcgcatggacgcactggcgctgcttgggggactggtaaatgtagcccgtctgcccgagcgctggggacctggccgctttgactactggggcaactcccaccagatcatgcacctgctgagcgtgggctccatcctgcagctgcacgccggcgtcgtgcccgacctgctctgggctgcccaccacgcctgtccccgggactgagctgccatgccagcctgcccacagcagcctcctagagttagcaacaccaggtgttcctcccaactcgtctgcaaggggctggctccttggatgcttccagctcatgagatgtctcagcaggagccctgttcacccgttcttccctgtggactgacctcttccacccacgccgtggcgctccaacttccttccctgccttttccctccaagctcctattttactgtgtcagctggaaggaaacctttccctcttgggacctctttaccctctgtgacctgtggggttagaccagagagggactctggggtcacgtcttgctctgagagttcaagtcctgccaggccgccagcccagagcctcctcaccctatcctgttcctcccaccaggcctgtggccagtcttcctgatctccatctttctgccctgcataccagccctcccagcagccacaagcttgcccgccctggctccctctgcccagagactatggagtaaggcattcaggacaaaaggaccaagggggcgtggacccgtcttgtaccagctggccacaggcacaagggctgcagctgcttcttccaggaaactgacacagggagctcagcggcctcagatcctgggacccctgggccgtgcctgccctccaccttgagtgccatactcccaacagctccaggtacccaccgggggatgtgcctgctcaggaaacctctttgctccacacagcatggggcttcagctgctggcccaaggccaggagcgctgggttctgcagcagggctcagcctcaggggcgttaagaccctggatgacatcaataaagggacaggaagggccatgttgccacatgagcaagcttgggtgctcccaaggttcaaatactttttattagacacggccaggcagagaagaccatgggagttcccgaggggccccagctttcaagggcgacgggagagacacaggataaaaggttaaaagtgcagaggcagagtctggggctcaggttgggtctagggtgtcctcaaacaggctgaggaggttccgaggctcaaaggaggggaaggagccccgaggaggctctgagttgatgtcacttaggtccagggcatccctgggaggagagagtagtgacactcaggatccaaaagctagccctgcccaccccagcccctggacctgcttacctgggtgtgcacctgctccggggggtggaggtgctccccacagtccgggccaggacagcctcaggggagagtgaaggcctgcaggagggcaggcgagacaaggagggtgtccagggctagggagtgccggatgaaaccagctctgtccctgtgcaggctccaggctcccgcctgacaaacaggcagggagccacagtcagggacaataaaaacttggtgcactctgaaagcagcacttggacagccttcaaagtccttccatctggctgcactccaaggccccctctgtccttttcagaacacatggacttggaggcagatttgaaataaacttttagtaaatgtaa

SEQ ID NO: 364893 - DNA, 2840 bp, Homo sapiens
taggagcctgggcggagcctggcgtcccctcccgcgtccggccgcgcccgtcctcctggctgcagagagactaccggccaccgccgccgccgccgccgcgagctgtccctgcggcgcgtctgccttggcggagccgaccgcagtgcgctcaggcgtccggtgcgtccccagcctccgccccggcgcgggggcgacgggcgccaggcagtgatgggccttcccgcgctgcggccccactgaggaggaggctcggggacagcaggagcacgggctgcccgcgcggtgcggaccatggcgttcctggccgggccgcgcctgctggactgggccagctcgccgccgcacctgcagttcaataagttcgtgctgaccgggtaccggcccgccagcagcggctcgggctgcctgcgcagcctcttctacctgcacaacgaactgggcaacatctacacgcacgggctggccctgctgggcttcctggtgctggtgccaatgaccatgccctggggtcagctgggcaaggatggctggctgggaggcacacattgcgtggcctgccttgcaccccctgcaggctccgtgctctatcacctctttatgtgccaccaagggggcagcgctgtgtacgcccggctcctcgccctggacatgtgtggggtctgccttgtcaacacccttggggccctgcccatcatccactgcaccctggcctgcaggccctggctgcgcccggctgccctggtgggctacactgtgttgtcgggtgtggccggctggcgtgctctcaccgcccccacaatgaaataaagttattttctcattaaaaaaaaactttatttcagtgtggggtctgccttgtcaacacccttggggccctgcccatcatccactgcaccctggcctgcaggccctggctgcgcccggctgccctggtgggctacactgtgttgtcgggtgtggccggctggcgtgctctcaccgccccctccaccagtgctcggctccgggcatttggatggcaggctgctgcccgcctactggtatttggggcccggggagtgggtctgggttcaggggctccaggctccctgccctgctacctgcgcatggacgcactggcgctgcttgggggactggtaaatgtagcccgtctgcccgagcgctggggacctggccgctttgactactggggcaactcccaccagatcatgcacctgctgagcgtgggctccatcctgcagctgcacgccggcgtcgtgcccgacctgctctgggctgcccaccacgcctgtccccgggactgagctgccatgccagcctgcccacagcagcctcctagagttagcaacaccaggtgttcctcccaactcgtctgcaaggggctggctccttggatgcttccagctcatgagatgtctcagcaggagccctgttcacccgttcttccctgtggactgacctcttccacccacgccgtggcgctccaacttccttccctgccttttccctccaagctcctattttactgtgtcagctggaaggaaacctttccctcttgggacctctttaccctctgtgacctgtggggttagaccagagagggactctggggtcacgtcttgctctgagagttcaagtcctgccaggccgccagcccagagcctcctcaccctatcctgttcctcccaccaggcctgtggccagtcttcctgatctccatctttctgccctgcataccagccctcccagcagccacaagcttgcccgccctggctccctctgcccagagactatggagtaaggcattcaggacaaaaggaccaagggggcgtggacccgtcttgtaccagctggccacaggcacaagggctgcagctgcttcttccaggaaactgacacagggagctcagcggcctcagatcctgggacccctgggccgtgcctgccctccaccttgagtgccatactcccaacagctccaggtacccaccgggggatgtgcctgctcaggaaacctctttgctccacacagcatggggcttcagctgctggcccaaggccaggagcgctgggttctgcagcagggctcagcctcaggggcgttaagaccctggatgacatcaataaagggacaggaagggccatgttgccacatgagcaagcttgggtgctcccaaggttcaaatactttttattagacacggccaggcagagaagaccatgggagttcccgaggggccccagctttcaagggcgacgggagagacacaggataaaaggttaaaagtgcagaggcagagtctggggctcaggttgggtctagggtgtcctcaaacaggctgaggaggttccgaggctcaaaggaggggaaggagccccgaggaggctctgagttgatgtcacttaggtccagggcatccctgggaggagagagtagtgacactcaggatccaaaagctagccctgcccaccccagcccctggacctgcttacctgggtgtgcacctgctccggggggtggaggtgctccccacagtccgggccaggacagcctcaggggagagtgaaggcctgcaggagggcaggcgagacaaggagggtgtccagggctagggagtgccggatgaaaccagctctgtccctgtgcaggctccaggctcccgcctgacaaacaggcagggagccacagtcagggacaataaaaacttggtgcactctgaaagcagcacttggacagccttcaaagtccttccatctggctgcactccaaggccccctctgtccttttcagaacacatggacttggaggcagatttgaaataaacttttagtaaatgtaa

SEQ ID NO: 364894 - DNA, 2839 bp, Homo sapiens
ggtggagacctcccagaaagggctaggctggaatcaaactccccagggagaggtctggggagatgggacaagcccctcgaagcccccttcccttcattctggacttgtcttcccccacctggcctcacccctttatagaagataaaaaggcccagtgcctccatttgtctggacacttatggagaggggaggacttgggttgggaagagcaagccaagtggccccgggctggcatcactgctcatgtgtcctcttcacaactcaacttgaggtttcgctgccttagccttctcctgtgacctgcttgtatggggagagcagtgtgggagtgggacggcctaggcctgtcctctgccattgcttacctgctgggctcacccggggccggtcactcagcccctccaagtctgtttcctcacctgcaaagtggggatcatggtctctacttcccagaccatcctgagccatgataagtaaccagtgccaaaagccttttgcccagggcctgtctctggccaaggccaggccgccaactggatgacagcattacctggacctgtcttgccctgtcctgtgttgtgtctgaaccgtggtccccttgaggatgtgactgaaactatctggtagatgactgtctccctccctagggctggccctgctgggcttcctggtgctggtgccaatgaccatgccctggggtcagctgggcaaggatggctggctgggaggcacacattgcgtggcctgccttgcaccccctgcaggctccgtgctctatcacctctttatgtgccaccaagggggcagcgctgtgtacgcccggctcctcgccctggacatgtgtggggtctgccttgtcaacacccttggggccctgcccatcatccactgcaccctggcctgcaggccctggctgcgcccggctgccctggtgggctacactgtgttgtcgggtgtggccggctggcgtgctctcaccgccccctccaccagtgctcggctccgggcatttggatggcaggctgctgcccgcctactggtatttggggcccggggagtgggtctgggttcaggggctccaggctccctgccctgctacctgcgcatggacgcactggcgctgcttgggggactggtaaatgtagcccgtctgcccgagcgctggggacctggccgctttgactactggggcaactcccaccagatcatgcacctgctgagcgtgggctccatcctgcagctgcacgccggcgtcgtgcccgacctgctctgggctgcccaccacgcctgtccccgggactgagctgccatgccagcctgcccacagcagcctcctagagttagcaacaccaggtgttcctcccaactcgtctgcaaggggctggctccttggatgcttccagctcatgagatgtctcagcaggagccctgttcacccgttcttccctgtggactgacctcttccacccacgccgtggcgctccaacttccttccctgccttttccctccaagctcctattttactgtgtcagctggaaggaaacctttccctcttgggacctctttaccctctgtgacctgtggggttagaccagagagggactctggggtcacgtcttgctctgagagttcaagtcctgccaggccgccagcccagagcctcctcaccctatcctgttcctcccaccaggcctgtggccagtcttcctgatctccatctttctgccctgcataccagccctcccagcagccacaagcttgcccgccctggctccctctgcccagagactatggagtaaggcattcaggacaaaaggaccaagggggcgtggacccgtcttgtaccagctggccacaggcacaagggctgcagctgcttcttccaggaaactgacacagggagctcagcggcctcagatcctgggacccctgggccgtgcctgccctccaccttgagtgccatactcccaacagctccaggtacccaccgggggatgtgcctgctcaggaaacctctttgctccacacagcatggggcttcagctgctggcccaaggccaggagcgctgggttctgcagcagggctcagcctcaggggcgttaagaccctggatgacatcaataaagggacaggaagggccatgttgccacatgagcaagcttgggtgctcccaaggttcaaatactttttattagacacggccaggcagagaagaccatgggagttcccgaggggccccagctttcaagggcgacgggagagacacaggataaaaggttaaaagtgcagaggcagagtctggggctcaggttgggtctagggtgtcctcaaacaggctgaggaggttccgaggctcaaaggaggggaaggagccccgaggaggctctgagttgatgtcacttaggtccagggcatccctgggaggagagagtagtgacactcaggatccaaaagctagccctgcccaccccagcccctggacctgcttacctgggtgtgcacctgctccggggggtggaggtgctccccacagtccgggccaggacagcctcaggggagagtgaaggcctgcaggagggcaggcgagacaaggagggtgtccagggctagggagtgccggatgaaaccagctctgtccctgtgcaggctccaggctcccgcctgacaaacaggcagggagccacagtcagggacaataaaaacttggtgcactctgaaagcagcacttggacagccttcaaagtccttccatctggctgcactccaaggccccctctgtccttttcagaacacatggacttggaggcagatttgaaataaacttttagtaaatgtaa

SEQ ID NO: 364895 - DNA, 2805 bp, Homo sapiens
taggagcctgggcggagcctggcgtcccctcccgcgtccggccgcgcccgtcctcctggctgcagagagactaccggccaccgccgccgccgccgccgcgagctgtccctgcggcgcgtctgccttggcggagccgaccgcagtgcgctcaggcgtccggtgcgtccccagcctccgccccggcgcgggggcgacggactcgcgcgtgcgcagcgccggaggggcgcgggctgggaccccctagccagcgcgtgcgccgatcgagcgcagggcgatgggtgggcgccgggcgccgggcgccaggcagtgatgggccttcccgcgctgcggccccactgaggaggaggctcggggacagcaggagcacgggctgcccgcgcggtgcggaccatggcgttcctggccgggccgcgcctgctggactgggccagctcgccgccgcacctgcagttcaataagttcgtgctgaccgggtaccggcccgccagcagcggctcgggctgcctgcgcagcctcttctacctgcacaacgaactgggcaacatctacacgcacgggctggccctgctgggcttcctggtgctggtgccaatgaccatgccctggggtcagctgggcaaggatggctggctgggaggcacacattgcgtggcctgccttgcaccccctgcaggctccgtgctctatcacctctttatgtgccaccaagggggcagcgctgtgtacgcccggctcctcgccctggacatgtgtggggtctgccttgtcaacacccttggggccctgcccatcatccactgcaccctggcctgcaggccctggctgcgcccggctgccctggtgggctacactgtgttgtcgggtgtggccggctggcgtgctctcaccgccccctccaccagtgctcggctccgggcatttggatggcaggctgctgcccgcctactggtatttggggcccggggagtgggtctgggttcaggggctccaggctccctgccctgctacctgcgcatggacgcactggcgctgcttgggggactggtaaatgtagcccgtctgcccgagcgctggggacctggccgctttgactactggggcaactcccaccagatcatgcacctgctgagcgtgggctccatcctgcagctgcacgccggcgtcgtgcccgacctgctctgggctgcccaccacgcctgtccccgggactgagctgccatgccagcctgcccacagcagcctcctagagttagcaacaccaggtgttcctcccaactcgtctgcaaggggctggctccttggatgcttccagctcatgagatgtctcagcaggagccctgttcacccgttcttccctgtggactgacctcttccacccacgccgtggcgctccaacttccttccctgccttttccctccaagctcctattttactgtgtcagctggaaggaaacctttccctcttgggacctctttaccctctgtgacctgtggggttagaccagagagggactctggggtcacgtcttgctctgagagttcaagtcctgccaggccgccagcccagagcctcctcaccctatcctgttcctcccaccaggcctgtggccagtcttcctgatctccatctttctgccctgcataccagccctcccagcagccacaagcttgcccgccctggctccctctgcccagagactatggagtaaggcattcaggacaaaaggaccaagggggcgtggacccgtcttgtaccagctggccacaggcacaagggctgcagctgcttcttccaggaaactgacacagggagctcagcggcctcagatcctgggacccctgggccgtgcctgccctccaccttgagtgccatactcccaacagctccaggtacccaccgggggatgtgcctgctcaggaaacctctttgctccacacagcatggggcttcagctgctggcccaaggccaggagcgctgggttctgcagcagggctcagcctcaggggcgttaagaccctggatgacatcaataaagggacaggaagggccatgttgccacatgagcaagcttgggtgctcccaaggttcaaatactttttattagacacggccaggcagagaagaccatgggagttcccgaggggccccagctttcaagggcgacgggagagacacaggataaaaggttaaaagtgcagaggcagagtctggggctcaggttgggtctagggtgtcctcaaacaggctgaggaggttccgaggctcaaaggaggggaaggagccccgaggaggctctgagttgatgtcacttaggtccagggcatccctgggaggagagagtagtgacactcaggatccaaaagctagccctgcccaccccagcccctggacctgcttacctgggtgtgcacctgctccggggggtggaggtgctccccacagtccgggccaggacagcctcaggggagagtgaaggcctgcaggagggcaggcgagacaaggagggtgtccagggctagggagtgccggatgaaaccagctctgtccctgtgcaggctccaggctcccgcctgacaaacaggcagggagccacagtcagggacaataaaaacttggtgcactctgaaagcagcacttggacagccttcaaagtccttccatctggctgcactccaaggccccctctgtccttttcagaacacatggacttggaggcagatttgaaataaacttttagtaaatgtaaaaaaaaaaaataaaaaactccgagggaattaaaagtaggagggtgggggaaaaaggg

SEQ ID NO: 364896 - DNA, 2961 bp, Homo sapiens
taggagcctgggcggagcctggcgtcccctcccgcgtccggccgcgcccgtcctcctggctgcagagagactaccggccaccgccgccgccgccgccgcgagctgtccctgcggcgcgtctgccttggcggagccgaccgcagtgcgctcaggcgtccggtgcgtccccagcctccgccccggcgcgggggcgacggactcgcgcgtgcgcagcgccggaggggcgcgggctgggaccccctagccagcgcgtgcgccgatcgagcgcagggcgatgggtgggcgccgggcgccgggcgccaggcagtgatgggccttcccgcgctgcggccccactgaggaggaggctcggggacagcaggagcacgggctgcccgcgcggtgcggaccatggcgttcctggccgggccgcgcctgctggactgggccagctcgccgccgcacctgcagttcaataagttcgtgctgaccgggtaccggcccgccagcagcggctcgggctgcctgcgcagcctcttctacctgcacaacgaactgggcaacatctacacgcacgggctggccctgctgggcttcctggtgctggtgccaatgaccatgccctggggtcagctgggcaaggatggctggctgggaggcacacattgcgtggcctgccttgcaccccctgcaggctccgtgctctatcacctctttatgtgccaccaagggggcagcgctgtgtacgcccggctcctcgccctggacatgtgtggggtctgccttgtcaacacccttggggccctgcccatcatccactgcaccctggcctgcaggccctggctgcgcccggctgccctggtgggctacactgtgttgtcgggtgtggccggctggcgtgctctcaccgccccctccaccagtgctcggctccgggcatttggatggcaggctgctgcccgcctactggtatttggggcccggggagtgggtctgggttcaggggctccaggctccctgccctgctacctgcgcatggacgcactggcgctgcttgggggactggtaaatgtagcccgtctgcccgagcgctggggacctggccgctttgactactggggcaactcccaccagatcatgcacctgctgagcgtgggctccatcctgcagctgcacgccggcgtcgtgcccgacctgctctgggctgcccaccacgcctgtccccgggactgagctgccatgccagcctgcccacagcagcctcctagagttagcaacaccaggtgttcctcccaactcgtctgcaaggggctggctccttggatgcttccagctcatgagatgtctcagcaggagccctgttcacccgttcttccctgtggactgacctcttccacccacgccgtggcgctccaacttccttccctgccttttccctccaagctcctattttactgtgtcagctggaaggaaacctttccctcttgggacctctttaccctctgtgacctgtggggttagaccagagagggactctggggtcacgtcttgctctgagagttcaagtcctgccaggccgccagcccagagcctcctcaccctatcctgttcctcccaccaggcctgtggccagtcttcctgatctccatctttctgccctgcataccagccctcccagcagccacaagcttgcccgccctggctccctctgcccagagactatggagtaaggcattcaggacaaaaggaccaagggggcgtggacccgtcttgtaccagctggccacaggcacaagggctgcagctgcttcttccaggaaactgacacagggagctcagcggcctcagatcctgggacccctgggccgtgcctgccctccaccttgagtgccatactcccaacagctccaggtacccaccgggggatgtgcctgctcaggaaacctctttgctccacacagcatggggcttcagctgctggcccaaggccaggagcgctgggttctgcagcagggctcagcctcaggggcgttaagaccctggatgacatcaataaagggacaggaagggccatgttgccacatgagcaagcttgggtgctcccaaggttcaaatactttttattagacacggccaggcagagaagaccatgggagttcccgaggggccccagctttcaagggcgacgggagagacacaggataaaaggttaaaagtgcagaggcagagtctggggctcaggttgggtctagggtgtcctcaaacaggctgaggaggttccgaggctcaaaggaggggaaggagccccgaggaggctctgagttgatgtcacttaggtccagggcatccctgggaggagagagtagtgacactcaggatccaaaagctagccctgcccaccccagcccctggacctgcttacctgggtgtgcacctgctccggggggtggaggtgctccccacagtccgggccaggacagcctcaggggagagtgaaggcctgcaggagggcaggcgagacaaggagggtgtccagggctagggagtgccggatgaaaccagctctgtccctgtgcaggctccaggctcccgcctgacaaacaggcagggagccacagtcagggacaataaaaacttggtgcactctgaaagcagcacttggacagccttcaaagtccttccatctggctgcactccaaggccccctctgtccttttcagaacacatggacttggaggcagatttgaaataaacttttagtaaatgtaaaaaaaaaaaaaaaaaaaaaaaaaaaaaaaaaaaaaaaaaattatagtatttataaatacatttgttgttgtggccgggccccgcgaaattctctcgcttcaaccctattctcttttgagcttccctttttgcggagggccataccgcccttgttcccccccgttgccctctcgataggcgattcgcatacgagcccctattctcttttttttt

SEQ ID NO: 364897 - DNA, 2426 bp, Homo sapiens
taggagcctgggcggagcctggcgtcccctcccgcgtccggccgcgcccgtcctcctggctgcagagagactaccggccaccgccgccgccgccgccgcgagctgtccctgcggcgcgtctgccttggcggagccgaccgcagtgcgctcaggcgtccggtgcgtccccagcctccgccccggcgcgggggcgacggactcgcgcgtgcgcagcgccggaggggcgcgggctgggaccccctagccagcgcgtgcgccgatcgagcgcagggcgatgggtgggcgccgggcgccgggcgccaggcagtgatgggccttcccgcgctgcggccccactgaggaggaggctcggggacagcaggagcacgggctgcccgcgcggtgcggaccatggcgttcctggccgggccgcgcctgctggactgggccagctcgccgccgcacctgcagttcaataagttcgtgctgaccgggtaccggcccgccagcagcggctcgggctgcctgcgcagcctcttctacctgcacaacgaactgggcaacatctacacgcacgggctggccctgctgggcttcctggtgctggtgccaatgaccatgccctggggtcagctgggcaaggatggctggctgggaggcacacattgcgtggcctgccttgcaccccctgcaggctccgtgctctatcacctctttatgtgccaccaagggggcagcgctgtgtacgcccggctcctcgccctggacatgtgtggggtctgccttgtcaacacccttggggccctgcccatcatccactgcaccctggcctgcaggccctggctgcgcccggctgccctggtgggctacactgtgttgtcgggtgtggccggctggcgtgctctcaccgccccctccaccagtgctcggctccgggcatttggatggcaggctgctgcccgcctactggtatttggggcccggggagtgggtctgggttcaggggctccaggctccctgccctgctacctgcgcatggacgcactggcgctgcttgggggactggtaaatgtagcccgtctgcccgagcgctggggacctggccgctttgactactggggcaactcccaccagatcatgcacctgctgagcgtgggctccatcctgcagctgcacgccggcgtcgtgcccgacctgctctgggctgcccaccacgcctgtccccgggactgagctgccatgccagcctgcccacagcagcctcctagagttagcaacaccaggtgttcctcccaactcgtctgcaaggggctggctccttggatgcttccagctcatgagatgtctcagcaggagccctgttcacccgttcttccctgtggactgacctcttccacccacgccgtggcgctccaacttccttccctgccttttccctccaagctcctattttactgtgtcagctggaaggaaacctttccctcttgggacctctttaccctctgtgacctgtggggttagaccagatcctgggacccctgggccgtgcctgccctccaccttgagtgccatactcccaacagctccaggtacccaccgggggatgtgcctgctcaggaaacctctttgctccacacagcatggggcttcagctgctggcccaaggccaggagcgctgggttctgcagcagggctcagcctcaggggcgttaagaccctggatgacatcaataaagggacaggaagggccatgttgccacatgagcaagcttgggtgctcccaaggttcaaatactttttattagacacggccaggcagagaagaccatgggagttcccgaggggccccagctttcaagggcgacgggagagacacaggataaaaggttaaaagtgcagaggcagagtctggggctcaggttgggtctagggtgtcctcaaacaggctgaggaggttccgaggctcaaaggaggggaaggagccccgaggaggctctgagttgatgtcacttaggtccagggcatccctgggaggagagagtagtgacactcaggatccaaaagctagccctgcccaccccagcccctggacctgcttacctgggtgtgcacctgctccggggggtggaggtgctccccacagtccgggccaggacagcctcaggggagagtgaaggcctgcaggagggcaggcgagacaaggagggtgtccagggctagggagtgccggatgaaaccagctctgtccctgtgcaggctccaggctcccgcctgacaaacaggcagggagccacagtcagggacaataaaaacttggtgcactctgaaagcagcacttggacagccttcaaagtccttccatctggctgcactccaaggccccctctgtccttttcagaacacatggacttggaggcagatttgaaataaacttttagtaaatgtaa

SEQ ID NO: 364898 - DNA, 1434 bp, Homo sapiens
taggagcctgggcggagcctggcgtcccctcccgcgtccggccgcgcccgtcctcctggctgcagagagactaccggccaccgccgccgccgccgccgcgagctgtccctgcggcgcgtctgccttggcggagccgaccgcagtgcgctcaggcgtccggtgcgtccccagcctccgccccggcgcgggggcgacggactcgcgcgtgcgcagcgccggaggggcgcgggctgggaccccctagccagcgcgtgcgccgatcgagcgcagggcgatgggtgggcgccgggcgccgggcgccaggcagtgatgggccttcccgcgctgcggccccactgaggaggaggctcggggacagcaggagcacgggctgcccgcgcggtgcggaccatggcgttcctggccgggccgcgcctgctggactgggccagctcgccgccgcacctgcagttcaataagttcgtgctgaccgggtaccggcccgccagcagcggctcgggctgcctgcgcagcctcttctacctgcacaacgaactgggcaacatctacacgcacgggctggccctgctgggcttcctggtgctggtgccaatgaccatgccctggggtcagctgggcaaggatggctggctgggaggcacacattgcgtggcctgccttgcaccccctgcaggctccgtgctctatcacctctttatgtgccaccaagggggcagcgctgtgtacgcccggctcctcgccctggacatgtgtggggtctgccttgtcaacacccttggggccctgcccatcatccactgcaccctggcctgcaggccctggctgcgcccggctgccctggtgggctacactgtgttgtcgggtgtggccggctggcgtgctctcaccgccccctccaccagtgctcggctccgggcatttggatggcaggctgctgcccgcctactggtatttggggcccggggagtgggtctgggttcaggggctccaggctccctgccctgctacctgcgcatggacgcactggcgctgcttgggggactggtaaatgtagcccgtctgcccgagcgctggggacctggccgctttgactactggggcaactcccaccagatcatgcacctgctgagcgtgggctccatcctgcagctgcacgccggcgtcgtgcccgacctgctctgggctgcccaccacgcctgtccccgggactgagctgccatgccagcctgcccacagcagcctcctagagttagcaacaccaggtgttcctcccaactcgtctgcaaggggctggctccttggatgcttccagctcatgagatgtctcagcaggagccctgttcacccgttcttccctgtggactgaccccctctgtccttttcagaacacatggacttggaggcagatttgaaataaacttttagtaaatgtaa

SEQ ID NO: 364899 - DNA, 2748 bp, Homo sapiens
taggagcctgggcggagcctggcgtcccctcccgcgtccggccgcgcccgtcctcctggctgcagagagactaccggccaccgccgccgccgccgccgcgagctgtccctgcggcgcgtctgccttggcggagccgaccgcagtgcgctcaggcgtccggtgcgtccccagcctccgccccggcgcgggggcgacggactcgcgcgtgcgcagcgccggaggggcgcgggctgggaccccctagccagcgcgtgcgccgatcgagcgcagggcgatgggtgggcgccgggcgccgggcgccaggcagtgatgggccttcccgcgctgcggccccactgaggaggaggctcggggacagcaggagcacgggctgcccgcgcggtgcggaccatggcgttcctggccgggccgcgcctgctggactgggccagctcgccgccgcacctgcagttcaataagttcgtgctgaccgggtaccggcccgccagcagcggctcgggctgcctgcgcagcctcttctacctgcacaacgaactgggcaacatctacacgcacgggctggccctgctgggcttcctggtgctggtgccaatgaccatgccctggggtcagctgggcaaggatggctggctgggaggcacacattgcgtggcctgccttgcaccccctgcaggctccgtgctctatcacctctttatgtgccaccaagggggcagcgctgtgtacgcccggctcctcgccctggacatgtgtggggtctgccttgtcaacacccttggggccctgcccatcatccactgcaccctggcctgcaggccctggctgcgcccggctgccctggtgggctacactgtgttgtcgggtgtggccggctggcgtgctctcaccgccccctccaccagtgctcggctccgggcatttggatggcaggctgctgcccgcctactggtatttggggcccggggagtgggtctgggttcaggggctccaggctccctgccctgctacctgcgcatggacgcactggcgctgcttgggggactggtaaatgtagcccgtctgcccgagcgctggggacctggccgctttgactactggggcaactcccaccagatcatgcacctgctgagcgtgggctccatcctgcagctgcacgccggcgtcgtgcccgacctgctctgggctgcccaccacgcctgtccccgggactgagctgccatgccagcctgcccacagcagcctcctagagttagcaacaccaggtgttcctcccaactcgtctgcaaggggctggctccttggatgcttccagctcatgagatgtctcagcaggagccctgttcacccgttcttccctgtggactgacctcttccacccacgccgtggcgctccaacttccttccctgccttttccctccaagctcctattttactgtgtcagctggaaggaaacctttccctcttgggacctctttaccctctgtgacctgtggggttagaccagagagggactctggggtcacgtcttgctctgagagttcaagtcctgccaggccgccagcccagagcctcctcaccctatcctgttcctcccaccaggcctgtggccagtcttcctgatctccatctttctgccctgcataccagccctcccagcagccacaagcttgcccgccctggctccctctgcccagagactatggagtaaggcattcaggacaaaaggaccaagggggcgtggacccgtcttgtaccagctggccacaggcacaagggctgcagctgcttcttccaggaaactgacacagggagctcagcggcctcagatcctgggacccctgggccgtgcctgccctccaccttgagtgccatactcccaacagctccaggtacccaccgggggatgtgcctgctcaggaaacctctttgctccacacagcatggggcttcagctgctggcccaaggccaggagcgctgggttctgcagcagggctcagcctcaggggcgttaagaccctggatgacatcaataaagggacaggaagggccatgttgccacatgagcaagcttgggtgctcccaaggttcaaatactttttattagacacggccaggcagagaagaccatgggagttcccgaggggccccagctttcaagggcgacgggagagacacaggataaaaggttaaaagtgcagaggcagagtctggggctcaggttgggtctagggtgtcctcaaacaggctgaggaggttccgaggctcaaaggaggggaaggagccccgaggaggctctgagttgatgtcacttaggtccagggcatccctgggaggagagagtagtgacactcaggatccaaaagctagccctgcccaccccagcccctggacctgcttacctgggtgtgcacctgctccggggggtggaggtgctccccacagtccgggccaggacagcctcaggggagagtgaaggcctgcaggagggcaggcgagacaaggagggtgtccagggctagggagtgccggatgaaaccagctctgtccctgtgcaggctccaggctcccgcctgacaaacaggcagggagccacagtcagggacaataaaaacttggtgcactctgaaagcagcacttggacagccttcaaagtccttccatctggctgcactccaaggccccctctgtccttttcagaacacatggacttggaggcagatttgaaataaacttttagtaaatgtaa

SEQ ID NO: 364900 - DNA, 2351 bp, Homo sapiens
taggagcctgggcggagcctggcgtcccctcccgcgtccggccgcgcccgtcctcctggctgcagagagactaccggccaccgccgccgccgccgccgcgagctgtccctgcggcgcgtctgccttggcggagccgaccgcagtgcgctcaggcgtccgggctggccctgctgggcttcctggtgctggtgccaatgaccatgccctggggtcagctgggcaaggatggctggctgggaggcacacattgcgtggcctgccttgcaccccctgcaggctccgtgctctatcacctctttatgtgccaccaagggggcagcgctgtgtacgcccggctcctcgccctggacatgtgtggggtctgccttgtcaacacccttggggccctgcccatcatccactgcaccctggcctgcaggccctggctgcgcccggctgccctggtgggctacactgtgttgtcgggtgtggccggctggcgtgctctcaccgccccctccaccagtgctcggctccgggcatttggatggcaggctgctgcccgcctactggtatttggggcccggggagtgggtctgggttcaggggctccaggctccctgccctgctacctgcgcatggacgcactggcgctgcttgggggactggtaaatgtagcccgtctgcccgagcgctggggacctggccgctttgactactggggcaactcccaccagatcatgcacctgctgagcgtgggctccatcctgcagctgcacgccggcgtcgtgcccgacctgctctgggctgcccaccacgcctgtccccgggactgagctgccatgccagcctgcccacagcagcctcctagagttagcaacaccaggtgttcctcccaactcgtctgcaaggggctggctccttggatgcttccagctcatgagatgtctcagcaggagccctgttcacccgttcttccctgtggactgacctcttccacccacgccgtggcgctccaacttccttccctgccttttccctccaagctcctattttactgtgtcagctggaaggaaacctttccctcttgggacctctttaccctctgtgacctgtggggttagaccagagagggactctggggtcacgtcttgctctgagagttcaagtcctgccaggccgccagcccagagcctcctcaccctatcctgttcctcccaccaggcctgtggccagtcttcctgatctccatctttctgccctgcataccagccctcccagcagccacaagcttgcccgccctggctccctctgcccagagactatggagtaaggcattcaggacaaaaggaccaagggggcgtggacccgtcttgtaccagctggccacaggcacaagggctgcagctgcttcttccaggaaactgacacagggagctcagcggcctcagatcctgggacccctgggccgtgcctgccctccaccttgagtgccatactcccaacagctccaggtacccaccgggggatgtgcctgctcaggaaacctctttgctccacacagcatggggcttcagctgctggcccaaggccaggagcgctgggttctgcagcagggctcagcctcaggggcgttaagaccctggatgacatcaataaagggacaggaagggccatgttgccacatgagcaagcttgggtgctcccaaggttcaaatactttttattagacacggccaggcagagaagaccatgggagttcccgaggggccccagctttcaagggcgacgggagagacacaggataaaaggttaaaagtgcagaggcagagtctggggctcaggttgggtctagggtgtcctcaaacaggctgaggaggttccgaggctcaaaggaggggaaggagccccgaggaggctctgagttgatgtcacttaggtccagggcatccctgggaggagagagtagtgacactcaggatccaaaagctagccctgcccaccccagcccctggacctgcttacctgggtgtgcacctgctccggggggtggaggtgctccccacagtccgggccaggacagcctcaggggagagtgaaggcctgcaggagggcaggcgagacaaggagggtgtccagggctagggagtgccggatgaaaccagctctgtccctgtgcaggctccaggctcccgcctgacaaacaggcagggagccacagtcagggacaataaaaacttggtgcactctgaaagcagcacttggacagccttcaaagtccttccatctggctgcactccaaggccccctctgtccttttcagaacacatggacttggaggcagatttgaaataaacttttagtaaatgtaa

SEQ ID NO: 364901 - DNA, 2547 bp, Homo sapiens
taggagcctgggcggagcctggcgtcccctcccgcgtccggccgcgcccgtcctcctggctgcagagagactaccggccaccgccgccgccgccgccgcgagctgtccctgcggcgcgtctgccttggcggagccgaccgcagtgcgctcaggcgtccggtgcgtccccagcctccgccccggcgcgggggcgacggactcgcgcgtgcgcagcgccggaggggcgcgggctgggaccccctagccagcgcgtgcgccgatcgagcgcagggcgatgggtgggcgccgggcgccgggcgccaggcagtgatgggccttcccgcgctgcggccccactgaggaggaggctcggggacagcaggagcacgggctgcccgcgcggtgcggaccatggcgttcctggccgggccgcgcctgctggactgggccagctcgccgccgcacctgcagttcaataagttcgtgctgaccgggtaccggcccgccagcagcggctcgggctgcctgcgcagcctcttctacctgcacaacgaactgggcaacatctacacgcacgggctggccctgctgggcttcctggtgctggtgccaatgaccatgccctggggtcagctgggcaaggatggctggctgggaggcacacattgcgtggcctgccttgcaccccctgcaggctccgtgctctatcacctctttatgtgccaccaagggggcagcgctgtgtacgcccggctcctcgccctggacatgtgtggggtctgccttgtcaacacccttggggccctgcccatcatccactgcaccctggcctgcaggccctggctgcgcccggctgccctggtgggctacactgtgttgtcgggtgtggccggctggcgtgctctcaccgccccctccaccagtgctcggctccgggcatttggatggcaggctgctgcccgcctactgctgcacgccggcgtcgtgcccgacctgctctgggctgcccaccacgcctgtccccgggactgagctgccatgccagcctgcccacagcagcctcctagagttagcaacaccaggtgttcctcccaactcgtctgcaaggggctggctccttggatgcttccagctcatgagatgtctcagcaggagccctgttcacccgttcttccctgtggactgacctcttccacccacgccgtggcgctccaacttccttccctgccttttccctccaagctcctattttactgtgtcagctggaaggaaacctttccctcttgggacctctttaccctctgtgacctgtggggttagaccagagagggactctggggtcacgtcttgctctgagagttcaagtcctgccaggccgccagcccagagcctcctcaccctatcctgttcctcccaccaggcctgtggccagtcttcctgatctccatctttctgccctgcataccagccctcccagcagccacaagcttgcccgccctggctccctctgcccagagactatggagtaaggcattcaggacaaaaggaccaagggggcgtggacccgtcttgtaccagctggccacaggcacaagggctgcagctgcttcttccaggaaactgacacagggagctcagcggcctcagatcctgggacccctgggccgtgcctgccctccaccttgagtgccatactcccaacagctccaggtacccaccgggggatgtgcctgctcaggaaacctctttgctccacacagcatggggcttcagctgctggcccaaggccaggagcgctgggttctgcagcagggctcagcctcaggggcgttaagaccctggatgacatcaataaagggacaggaagggccatgttgccacatgagcaagcttgggtgctcccaaggttcaaatactttttattagacacggccaggcagagaagaccatgggagttcccgaggggccccagctttcaagggcgacgggagagacacaggataaaaggttaaaagtgcagaggcagagtctggggctcaggttgggtctagggtgtcctcaaacaggctgaggaggttccgaggctcaaaggaggggaaggagccccgaggaggctctgagttgatgtcacttaggtccagggcatccctgggaggagagagtagtgacactcaggatccaaaagctagccctgcccaccccagcccctggacctgcttacctgggtgtgcacctgctccggggggtggaggtgctccccacagtccgggccaggacagcctcaggggagagtgaaggcctgcaggagggcaggcgagacaaggagggtgtccagggctagggagtgccggatgaaaccagctctgtccctgtgcaggctccaggctcccgcctgacaaacaggcagggagccacagtcagggacaataaaaacttggtgcactctgaaagcagcacttggacagccttcaaagtccttccatctggctgcactccaaggccccctctgtccttttcagaacacatggacttggaggcagatttgaaataaacttttagtaaatgtaa

SEQ ID NO: 364902 - DNA, 2805 bp, Homo sapiens
taggagcctgggcggagcctggcgtcccctcccgcgtccggccgcgcccgtcctcctggctgcagagagactaccggccaccgccgccgccgccgccgcgagctgtccctgcggcgcgtctgccttggcggagccgaccgcagtgcgctcaggcgtccggtgcgtccccagcctccgccccggcgcgggggcgacggactcgcgcgtgcgcagcgccggaggggcgcgggctgggaccccctagccagcgcgtgcgccgatcgagcgcagggcgatgggtgggcgccgggcgccgggcgccaggcagtgatgggccttcccgcgctgcggccccactgaggaggaggctcggggacagcaggagcacgggctgcccgcgcggtgcggaccatggcgttcctggccgggccgcgcctgctggactgggccagctcgccgccgcacctgcagttcaataagttcgtgctgaccgggtaccggcccgccagcagcggctcgggctgcctgcgcagcctcttctacctgcacaacgaactgggcaacatctacacgcacgggctggccctgctgggcttcctggtgctggtgccaatgaccatgccctggggtcagctgggcaaggatggctggctgggaggcacacattgcgtggcctgccttgcaccccctgcaggctccgtgctctatcacctctttatgtgccaccaagggggcagcgctgtgtacgcccggctcctcgccctggacatgtgtggggtctgccttgtcaacacccttggggccctgcccatcatccactgcaccctggcctgcaggccctggctgcgcccggctgccctggtgggctacactgtgttgtcgggtgtggccggctggcgtgctctcaccgccccctccaccagtgctcggctccgggcatttggatggcaggctgctgcccgcctactggtatttggggcccggggagtgggtctgggttcaggggctccaggctccctgccctgctacctgcgcatggacgcactggcgctgcttgggggactggtaaatgtagcccgtctgcccgagcgctggggacctggccgctttgactatgtggtgcaagttacccaaccatgaatcatagacaaccatcgcattgaagcagatggagcatccaataccttgcaatgcattgcaaacaagacctggcagtctggttgccactgacccttgactcttgcgtgcttgacccacacacagccctgtacccccgtgtgactagcagcttgccattgacatgcctgcccacagcagcctcctagagttagcaacaccaggtgttcctcccaactcgtctgcaaggggctggctccttggatgcttccagctcatgagatgtctcagcaggagccctgttcacccgttcttccctgtggactgacctcttccacccacgccgtggcgctccaacttccttccctgccttttccctccaagctcctattttactgtgtcagctggaaggaaacctttccctcttgggacctctttaccctctgtgacctgtggggttagaccagagagggactctggggtcacgtcttgctctgagagttcaagtcctgccaggccgccagcccagagcctcctcaccctatcctgttcctcccaccaggcctgtggccagtcttcctgatctccatctttctgccctgcataccagccctcccagcagccacaagcttgcccgccctggctccctctgcccagagactatggagtaaggcattcaggacaaaaggaccaagggggcgtggacccgtcttgtaccagctggccacaggcacaagggctgcagctgcttcttccaggaaactgacacagggagctcagcggcctcagatcctgggacccctgggccgtgcctgccctccaccttgagtgccatactcccaacagctccaggtacccaccgggggatgtgcctgctcaggaaacctctttgctccacacagcatggggcttcagctgctggcccaaggccaggagcgctgggttctgcagcagggctcagcctcaggggcgttaagaccctggatgacatcaataaagggacaggaagggccatgttgccacatgagcaagcttgggtgctcccaaggttcaaatactttttattagacacggccaggcagagaagaccatgggagttcccgaggggccccagctttcaagggcgacgggagagacacaggataaaaggttaaaagtgcagaggcagagtctggggctcaggttgggtctagggtgtcctcaaacaggctgaggaggttccgaggctcaaaggaggggaaggagccccgaggaggctctgagttgatgtcacttaggtccagggcatccctgggaggagagagtagtgacactcaggatccaaaagctagccctgcccaccccagcccctggacctgcttacctgggtgtgcacctgctccggggggtggaggtgctccccacagtccgggccaggacagcctcaggggagagtgaaggcctgcaggagggcaggcgagacaaggagggtgtccagggctagggagtgccggatgaaaccagctctgtccctgtgcaggctccaggctcccgcctgacaaacaggcagggagccacagtcagggacaataaaaacttggtgcactctgaaagcagcacttggacagccttcaaagtccttccatctggctgcactccaaggccccctctgtccttttcagaacacatggacttggaggcagatttgaaataaacttttagtaaatgtaa

SEQ ID NO: 364903 - DNA, 2099 bp, Homo sapiens
taggagcctgggcggagcctggcgtcccctcccgcgtccggccgcgcccgtcctcctggctgcagagagactaccggccaccgccgccgccgccgccgcgagctgtccctgcggcgcgtctgccttggcggagccgaccgcagtgcgctcaggcgtccggtgcgtccccagcctccgccccggcgcgggggcgacggactcgcgcgtgcgcagcgccggaggggcgcgggctgggaccccctagccagcgcgtgcgccgatcgagcgcagggcgatgggtgggcgccgggcgccgggcgccaggcagtgatgggccttcccgcgctgcggccccactgaggaggaggctcggggacagcaggagcacgggctgcccgcgcggtgcggaccatggcgttcctggccgggccgcgcctgctggactgggccagctcgccgccgcacctgcagttcaataagttcgtgctgaccgggtaccggcccgccagcagcggctcgggctgcctgcgcagcctcttctacctgcacaacgaactgggcaacatctacacgcacgggctggccctgctgggcttcctggtgctggtgccaatgaccatgccctggggtcagctgggcaaggatggctggctgggaggcacacattgcgtggcctgccttgcaccccctgcaggctccgtgctctatcacctctttatgtgccaccaagggggcagcgctgtgtacgcccggctcctcgccctggacatgtgtggggtctgccttgtcaacacccttggggccctgcccatcatccactgcaccctggcctgcaggccctggctgcgcccggctgccctggtgggctacactgtgttgtcgggtgtggccggctggcgtgctctcaccgccccctccaccagtgctcggctccgggcatttggatggcaggctgctgcccgcctactggtatttggggcccggggagtgggtctgggttcaggggctccaggctccctgccctgctacctgcgcatggacgcactggcgctgcttgggggactggtaaatgtagcccgtctgcccgagcgctggggacctggccgctttgactactggggcaactcccaccagatcatgcacctgctgagcgtgggctccatcctgcagctgcacgccggcgtcgtgcccgacctgctctgggctgcccaccacgcctgtccccgggactgagctgccatgccagcctgcccacagcagcctcctagagttagcaacaccaggtgttcctcccaactcgtctgcaaggggctggctccttggatgcttccagctcatgagatgtctcagcaggagccctgttcacccgttcttccctgtggactgacctcttccacccacgccgtggcgctccaacttccttccctgccttttccctccaagctcctattttactgtgtcagctggaaggaaacctttccctcttgggacctctttaccctctgtgacctgtggggttagaccagagagggactctggggtcacgtcttgctctgagagttcaagtcctgccaggccgccagcccagagcctcctcaccctatcctgttcctcccaccaggcctgtggccagtcttcctgatctccatctttctgccctgcataccagccctcccagcagccacaagcttgcccgccctggctccctctgcccagagactatggagtaaggcattcaggacaaaaggaccaagggggcgtggacccgtcttgtaccagctggccacaggcacaagggctgcagtgctccccacagtccgggccaggacagcctcaggggagagtgaaggcctgcaggagggcaggcgagacaaggagggtgtccagggctagggagtgccggatgaaaccagctctgtccctgtgcaggctccaggctcccgcctgacaaacaggcagggagccacagtcagggacaataaaaacttggtgcactctgaaagcagcacttggacagccttcaaagtccttccatctggctgcactccaaggccccctctgtccttttcagaacacatggacttggaggcagatttgaaataaacttttagtaaatgtaa

SEQ ID NO: 364904 - DNA, 403 bp, Homo sapiens
cagaggcagaggctgagccgctgcactggggattggggccagcgtggaatttcccctgctcatagggaaaagacaagacagaaaacggatggtgggagggctgatgactcttccaaatggctattcctgatgtttcctggcaatgagcagcctatgaaagggacaggttcacatgcgactacaccatgacttttgctgtgccccagtgtaacaggaggttatagacaacagttttatttgcatatataacctttgcttggcttattaacatattgctgatttaaattctgatacattgtcaaagtagaaagctgttcgggtttttggcaagcccagtataaaaaatgcaggcatgcaacaaataggtagtgaatattcacatttaaatacatgtaaatataaa

SEQ ID NO: 364905 - DNA, 274 bp, Homo sapiens
atcatcctcatctgtgttaaaaaggtatgggggtaggaaagccaaagacccatagaggggaggcccttccggggagacatgggggatgaggcggtgcagtgggtggggcctggccctggaggaacagctggggctttgatctttgaatcctcagatgaagtgttggaattaatcagtgaatttagtgtggttgctgggtgaaagatcaaaataaaaaatcatatttcagtatagcaaccatgagcaattagaaaaataaatttgtaattatacc

SEQ ID NO: 364906 - DNA, 430 bp, Homo sapiens
ttccgtctcaaaaaaaaaaaaaaaaagtttcactcagttgcatagtgagtgggtggtgggattctgtctagtaagcagtcaaagatacagactgggagcctggccaacgtggcaaaaccccgtctgtactaaaaatacaaaaaaactagctgtgtgtggtggcaaacgcctataattccagctcttttggaggccaaggcaggcagatcacttgaggtcaggagttcaagaccagcctggccaacattccaaaaccccatctctactaaaaatacaaaaattagccaggcatggtggcatgtgcctataatcccagctactcgagaggctgaagcaggagaattgcttgaacccaggaggcaagggttgtagtgagccaagatcacgccactgcactccagcctgggtgacagcctgggagaccctctca

SEQ ID NO: 364907 - DNA, 673 bp, Homo sapiens
cagactgagactccgtcacacacacaaaaaaaaaaaaaaaaaaagaaagaaagaccaagcagaatgcaaataaaaggtctgaagaacaagttttgttaatttgccacaacagactgtactccaggggaagctttgttgtccattaaagtgagttctctgggaagacgagtagtaaccgacttgcacgattttcctgccttttctatattctctacttactatgacaatacagcactagaatttccaagtgcttataccagcatagtgcaatgtatttaatgagaaaccacgtccaacaacaaagcgttataacttctccagctgagttagatgttttagtctgaaccaggaaaacagatgaagaaagttgaaccaagaattaaaagatttagagtttccactcagacctaagactctccactttgtttcagagggagtgggtatggttattctgaagaagaaggcggcccttatcctgaatgcccggtagcctccgtgggctggtgggtggttcctccggtccagcacctccataatttatgatcaaatgcccaagccaacaaactaatcctccccttctcccccacaaggaggcaacctttatgtcagaacaatgtgcccagaagaagccaaagacacaaggcacatccaaggcaaagacaatcttaattaa

SEQ ID NO: 364908 - DNA, 944 bp, Homo sapiens
gggggagcagcgggggaagtcgtggcgagattaagtaatgagaacttgggcccagttttttttccaagcctagaagggcagaatatgttcgtatcctttctgacctcccaggcatatgcaatgttttccagatttaggagacttcagaaaggtggggcagatagaatggagatggcaaagatctctttgggcatatatgggcctggcgaagtaatggaataatttctaattttcggagaagccctcatgccgggatggcagaagatgagcctgatgctaagagccccaagactgggggaagggcccccccaggtggtgctgaggctggggaacctaccacccttcttcagaggctccgaggtaccatttccaaggccgtgcagaacaaagtagaggggatccggcaagatggcagaagtagagcagaagaagaagcggaccttccgcaagttcacctaccgcggcgtggatctcgaccagctgctggacatgtcctacgagcagctgatgcagctgtacagtgcgcgccagcggcggcggctgaaccggggcctgcggcggaagcagcactccctgctgaagcgcctgcgcaaggccaagaaggaggcgccgcccatgggagaagccggaagtggtgaaacgcacctgcgggacatgatcatcctacccgagatggtgggcagcaatggtggggcgtctacaacggaagacttcaacaggtggagatcaagccggatgatcggccactacctgggcgattctcatcactaaagccggtaagctgcgccggattgggcaccatccccgttatcctttcagaggtcataaaagggcattgtcccaaaaaaaggggcgctaattccaggcacctgtacctttgaaggccaaggtaaaaaggggaaagcggaatggttggcctgtgtgacacaattttaggtgagaaa

SEQ ID NO: 364909 - DNA, 3586 bp, Homo sapiens
agtttctctttctcccttacctttattgttgcttgtgttggaaggcgactgttcagagttttccagatttaggagacttcagaaaggtggggcagatagaatggagatggcaaagatctctttgggcatatatgggcctggcgaagtaatggaataatttctaattttcggagaagccctcatgccgggatggcagaagatgagcctgatgctaagagccccaagactgggggaagggcccccccaggtggtgctgaggctggggaacctaccacccttcttcagaggctccgaggtaccatttccaaggccgtgcagaacaaagtagaggggatcctgcaagatgtacagaaattttctgacaatgacaagctgtatctctaccttcagctcccctcaggacccaccactggagacaaaagctcagagccaagtacactgagcaatgaggagtacatgtatgcctataggtggatccgcaaccacctggaagagcacactgacacctgtctgccaaagcaaagtgtttatgatgcctatcggaagtactgtgagagtcttgcctgttgccgcccactcagcacagccaactttggcaagatcatcagagagatcttccctgacatcaaagctcgaaggcttggtggccggggccagtccaaatattgctacagtggcataaggaggaagaccttggtgtctatgccacccctgcctggacttgacctaaagggttctgagagtccagaaatgggcccagaagtaaccccagcacctcgagatgaactggtggaggcagcgtgtgccctgacctgtgactgggcagagcggatcctgaaacggtccttcagttccatcgttgaggtcgcccgcttcctgctacagcagcatctcatctctgcccgatctgcacatgcccatgtgcttaaggccatggggcttgctgaagaggacgaacatgcacctcgggaacggtcatctaaaccaaagaatggtttagagaacccagagggtggagcccacaagaagccagagagactggcccagcctcctaaggatctggaagcccgaactggggccggtcctctcgcacgtggagagcggaagaagagtgtagttgagagctcggccccaggagccaataacctgcaggttaatgccctagtggctcggctgcctctgctccttccccgggcccctcgctcactaattccgccaatcccagtctctccacctattctggcccccaggctttcttcaggtgccctgaaagtggctacactgcctctgtctagtagggccggggcacccccagcagctgtgcccatcattaacatgatcttaccaactgttcctgctttgcctggacctggacctgggcctgggcgagctccacctgggggactcactcagccccggggcacagagaacagagaggtaggcataggtggtgaccaaggaccacatgacaagggtgtcaagaggacagctgaagtacctgtgagtgaggccagtgggcaggctccaccagctaaagcagcaaagcaggatatagaggatacagcaagtgatgccaaaaggaaacgggggcgccctcgaaaaaagtcaggtggaagtggggaaaggaattctacccctctcaagtcagcagctgccatggaatctgcccagtcctcaaggttaccatgggagacatggggctcaggaggggaaggcaactcagctggaggggcagagaggccagggccaatgggagaggctgaaaagggggcagtacttgcccagggtcagggagatggtactgtttccaaaggaggaaggggccccggttcccagcataccaaagaagcagaagataaaattcccttggtcccctcaaaagtgagtgtcatcaagggcagcagaagccaaaaggaggcttttcctttggcaaagggagaggtagacactgcaccacagggtaataaagacttaaaggagcatgtgcttcaaagttccttatcccaggagcataaagacccaaaagcaacacccccatgatacaggtctgtggggaagagtgtttatatccctacgttaactttgcctagtagaggcccttctttgcacttgcttctcatttggctattcttttcctaaggaagtccattctcctctgtacagacagctgagtcacccagtctacttagtacctggttgctgcctctgaccttttcagcttgataccctgggctttagtgtaaccaataaatctgtagtgaccttacctgtattccctgtgctatcctgtgggaaggtaggaatgggctaagtatgatgaatgtataggttagggatcttttggttttaaatcacagaaaacctaattcaaactggcttaaaataaaaaggatttattggttcatgtaactagaaagtccataggtagtgctggctccaggtgaagacttgacccagtagttcagtatgtctctaaataccggactgacttttttctcactgttgcatcttctgtaggaccatttaagtctgggccacttaatggctgccagcattcctaagattacacttttccccatttatgtccaatcagaaaaagaaggcatctttgtaccagaaatctcagcaaaagccctaatattcacactgattaggcctgggtcacatgtccaccctgaccaatcactgtggccaggaggatgatacatgctaatttgcttattctatatcatggacaacacctttggggaaaagggtgggggtcagcctccccaaaatcacatggattccccaagtggaaactaggagcagggagttgcttgggtggccgctaacaccaggctactcttattttagcttgctaagttgagatcagctagacctgctttcttttctcctcagtcttgcatttccctcaatacaagctgcagcctctttcctcgtttctagtctcagaaggaaggagagggaagccattctcctctagggactcttcagtctcatttagatgatagtccctttttttctacctccatattagagatggagctccttccttttcctgtttcttaatttttgtcttctcattcctgcttccctctcaccctattgccagttccaccaactagagtgaaagacttcctagccatttcattaaatctattctgtatccaccaggtggcagcatcttgtcatacgtgtcaggacttaggactgcggggtttaggttagatgtcacggaaaaagctagttctgtggtcaggcggcaccaatgagaaaggaatgcagaccctccagatgtatccttgggaaaagcagtaaaccaactaatatttattgaagacctactttgtcctctacatagggtagcttctgtcagggaatcttggttcttcccaagaaacactgattttctttcagggagacttcatgtgttcatttatttccaccacagcagattttaagaaattataatatgtaatatttgatatctataaagagtatatctaacgtgaataaattatgaagcatactaatgagtacctatgacccataacacatatacattaaaacattttaaatacca

SEQ ID NO: 364910 - DNA, 3651 bp, Homo sapiens
gggggagcagcgggggaagtcgtggcgagattaagtaatgagaacttgggcccagttttttttccaagcctagaagggcagaatatgttcgtatcctttctgacctcccaggcatatgcaatgttttccagatttaggagacttcagaaaggtggggcagatagaatggagatggcaaagatctctttgggcatatatgggcctggcgaagtaatggaataatttctaattttcggagaagccctcatgccgggatggcagaagatgagcctgatgctaagagccccaagactgggggaagggcccccccaggtggtgctgaggctggggaacctaccacccttcttcagaggctccgaggtaccatttccaaggccgtgcagaacaaagtagaggggatcctgcaagatgtacagaaattttctgacaatgacaagctgtatctctaccttcagctcccctcaggacccaccactggagacaaaagctcagagccaagtacactgagcaatgaggagtacatgtatgcctataggtggatccgcaaccacctggaagagcacactgacacctgtctgccaaagcaaagtgtttatgatgcctatcggaagtactgtgagagtcttgcctgttgccgcccactcagcacagccaactttggcaagatcatcagagagatcttccctgacatcaaagctcgaaggcttggtggccggggccagtccaaatattgctacagtggcataaggaggaagaccttggtgtctatgccacccctgcctggacttgacctaaagggttctgagagtccagaaatgggcccagaagtaaccccagcacctcgagatgaactggtggaggcagcgtgtgccctgacctgtgactgggcagagcggatcctgaaacggtccttcagttccatcgttgaggtcgcccgcttcctgctacagcagcatctcatctctgcccgatctgcacatgcccatgtgcttaaggccatggggcttgctgaagaggacgaacatgcacctcgggaacggtcatctaaaccaaagaatggtttagagaacccagagggtggagcccacaagaagccagagagactggcccagcctcctaaggatctggaagcccgaactggggccggtcctctcgcacgtggagagcggaagaagagtgtagttgagagctcggccccaggagccaataacctgcaggttaatgccctagtggctcggctgcctctgctccttccccgggcccctcgctcactaattccgccaatcccagtctctccacctattctggcccccaggctttcttcaggtgccctgaaagtggctacactgcctctgtctagtagggccggggcacccccagcagctgtgcccatcattaacatgatcttaccaactgttcctgctttgcctggacctggacctgggcctgggcgagctccacctgggggactcactcagccccggggcacagagaacagagaggtaggcataggtggtgaccaaggaccacatgacaagggtgtcaagaggacagctgaagtacctgtgagtgaggccagtgggcaggctccaccagctaaagcagcaaagcaggatatagaggatacagcaagtgatgccaaaaggaaacgggggcgccctcgaaaaaagtcaggtggaagtggggaaaggaattctacccctctcaagtcagcagctgccatggaatctgcccagtcctcaaggttaccatgggagacatggggctcaggaggggaaggcaactcagctggaggggcagagaggccagggccaatgggagaggctgaaaagggggcagtacttgcccagggtcagggagatggtactgtttccaaaggaggaaggggccccggttcccagcataccaaagaagcagaagataaaattcccttggtcccctcaaaagtgagtgtcatcaagggcagcagaagccaaaaggaggcttttcctttggcaaagggagaggtagacactgcaccacagggtaataaagacttaaaggagcatgtgcttcaaagttccttatcccaggagcataaagacccaaaagcaacacccccatgatacaggtctgtggggaagagtgtttatatccctacgttaactttgcctagtagaggcccttctttgcacttgcttctcatttggctattcttttcctaaggaagtccattctcctctgtacagacagctgagtcacccagtctacttagtacctggttgctgcctctgaccttttcagcttgataccctgggctttagtgtaaccaataaatctgtagtgaccttacctgtattccctgtgctatcctgtgggaaggtaggaatgggctaagtatgatgaatgtataggttagggatcttttggttttaaatcacagaaaacctaattcaaactggcttaaaataaaaaggatttattggttcatgtaactagaaagtccataggtagtgctggctccaggtgaagacttgacccagtagttcagtatgtctctaaataccggactgacttttttctcactgttgcatcttctgtaggaccatttaagtctgggccacttaatggctgccagcattcctaagattacacttttccccatttatgtccaatcagaaaaagaaggcatctttgtaccagaaatctcagcaaaagccctaatattcacactgattaggcctgggtcacatgtccaccctgaccaatcactgtggccaggaggatgatacatgctaatttgcttattctatatcatggacaacacctttggggaaaagggtgggggtcagcctccccaaaatcacatggattccccaagtggaaactaggagcagggagttgcttgggtggccgctaacaccaggctactcttattttagcttgctaagttgagatcagctagacctgctttcttttctcctcagtcttgcatttccctcaatacaagctgcagcctctttcctcgtttctagtctcagaaggaaggagagggaagccattctcctctagggactcttcagtctcatttagatgatagtccctttttttctacctccatattagagatggagctccttccttttcctgtttcttaatttttgtcttctcattcctgcttccctctcaccctattgccagttccaccaactagagtgaaagacttcctagccatttcattaaatctattctgtatccaccaggtggcagcatcttgtcatacgtgtcaggacttaggactgcggggtttaggttagatgtcacggaaaaagctagttctgtggtcaggcggcaccaatgagaaaggaatgcagaccctccagatgtatccttgggaaaagcagtaaaccaactaatatttattgaagacctactttgtcctctacatagggtagcttctgtcagggaatcttggttcttcccaagaaacactgattttctttcagggagacttcatgtgttcatttatttccaccacagcagattttaagaaattataatatgtaatatttgatatctataaagagtatatctaacgtgaataaattatgaagcatactaatgagtacctatgacccataacacatatacattaaaacattttaaatacca

SEQ ID NO: 364911 - DNA, 3790 bp, Homo sapiens
gaaaataaagcaacgcacgagccggctgggccaggaccttggggctgggctggagtgaaggtggctacgagttttccagatttaggagacttcagaaaggtggggcagatagaatggagatggcaaagatctctttgggcatatatgggcctggcgaagtaatggaataatttctaattttcggagaagccctcatgccgggatggcagaagatgagcctgatgctaagagccccaagactgggggaagggcccccccaggtggtgctgaggctggggaacctaccacccttcttcagaggctccgaggtaccatttccaaggccgtgcagaacaaagtagaggggatcctgcaagatgtacagaaattttctgacaatgacaagctgtatctctaccttcagctcccctcaggacccaccactggagacaaaagctcagagccaagtacactgagcaatgaggagtacatgtatgcctataggtggatccgcaaccacctggaagagcacactgacacctgtctgccaaagcaaagtgtttatgatgcctatcggtgggtggaggggtgggtggtgggatgagtggattggtgggcataggaccccctcacccatgaagagcttcctgccttgataaagcctgccttcttaaagggttcctcacacttgatccctagggactcttcgagcctacccatggcctccttctctgagtatcttcccactctgctcccctctcactcaggaagtactgtgagagtcttgcctgttgccgcccactcagcacagccaactttggcaagatcatcagagagatcttccctgacatcaaagctcgaaggcttggtggccggggccagtccaaatattgctacagtggcataaggaggaagaccttggtgtctatgccacccctgcctggacttgacctaaagggttctgagagtccagaaatgggcccagaagtaaccccagcacctcgagatgaactggtggaggcagcgtgtgccctgacctgtgactgggcagagcggatcctgaaacggtccttcagttccatcgttgaggtcgcccgcttcctgctacagcagcatctcatctctgcccgatctgcacatgcccatgtgcttaaggccatggggcttgctgaagaggacgaacatgcacctcgggaacggtcatctaaaccaaagaatggtttagagaacccagagggtggagcccacaagaagccagagagactggcccagcctcctaaggatctggaagcccgaactggggccggtcctctcgcacgtggagagcggaagaagagtgtagttgagagctcggccccaggagccaataacctgcaggttaatgccctagtggctcggctgcctctgctccttccccgggcccctcgctcactaattccgccaatcccagtctctccacctattctggcccccaggctttcttcaggtgccctgaaagtggctacactgcctctgtctagtagggccggggcacccccagcagctgtgcccatcattaacatgatcttaccaactgttcctgctttgcctggacctggacctgggcctgggcgagctccacctgggggactcactcagccccggggcacagagaacagagaggtaggcataggtggtgaccaaggaccacatgacaagggtgtcaagaggacagctgaagtacctgtgagtgaggccagtgggcaggctccaccagctaaagcagcaaagcaggatatagaggatacagcaagtgatgccaaaaggaaacgggggcgccctcgaaaaaagtcaggtggaagtggggaaaggaattctacccctctcaagtcagcagctgccatggaatctgcccagtcctcaaggttaccatgggagacatggggctcaggaggggaaggcaactcagctggaggggcagagaggccagggccaatgggagaggctgaaaagggggcagtacttgcccagggtcagggagatggtactgtttccaaaggaggaaggggccccggttcccagcataccaaagaagcagaagataaaattcccttggtcccctcaaaagtgagtgtcatcaagggcagcagaagccaaaaggaggcttttcctttggcaaagggagaggtagacactgcaccacagggtaataaagacttaaaggagcatgtgcttcaaagttccttatcccaggagcataaagacccaaaagcaacacccccatgatacaggtctgtggggaagagtgtttatatccctacgttaactttgcctagtagaggcccttctttgcacttgcttctcatttggctattcttttcctaaggaagtccattctcctctgtacagacagctgagtcacccagtctacttagtacctggttgctgcctctgaccttttcagcttgataccctgggctttagtgtaaccaataaatctgtagtgaccttacctgtattccctgtgctatcctgtgggaaggtaggaatgggctaagtatgatgaatgtataggttagggatcttttggttttaaatcacagaaaacctaattcaaactggcttaaaataaaaaggatttattggttcatgtaactagaaagtccataggtagtgctggctccaggtgaagacttgacccagtagttcagtatgtctctaaataccggactgacttttttctcactgttgcatcttctgtaggaccatttaagtctgggccacttaatggctgccagcattcctaagattacacttttccccatttatgtccaatcagaaaaagaaggcatctttgtaccagaaatctcagcaaaagccctaatattcacactgattaggcctgggtcacatgtccaccctgaccaatcactgtggccaggaggatgatacatgctaatttgcttattctatatcatggacaacacctttggggaaaagggtgggggtcagcctccccaaaatcacatggattccccaagtggaaactaggagcagggagttgcttgggtggccgctaacaccaggctactcttattttagcttgctaagttgagatcagctagacctgctttcttttctcctcagtcttgcatttccctcaatacaagctgcagcctctttcctcgtttctagtctcagaaggaaggagagggaagccattctcctctagggactcttcagtctcatttagatgatagtccctttttttctacctccatattagagatggagctccttccttttcctgtttcttaatttttgtcttctcattcctgcttccctctcaccctattgccagttccaccaactagagtgaaagacttcctagccatttcattaaatctattctgtatccaccaggtggcagcatcttgtcatacgtgtcaggacttaggactgcggggtttaggttagatgtcacggaaaaagctagttctgtggtcaggcggcaccaatgagaaaggaatgcagaccctccagatgtatccttgggaaaagcagtaaaccaactaatatttattgaagacctactttgtcctctacatagggtagcttctgtcagggaatcttggttcttcccaagaaacactgattttctttcagggagacttcatgtgttcatttatttccaccacagcagattttaagaaattataatatgtaatatttgatatctataaagagtatatctaacgtgaataaattatgaagcatactaatgagtacctatgacccataacacatatacattaaaacattttaaatacca

SEQ ID NO: 364912 - DNA, 3619 bp, Homo sapiens
  misc_feature (3619)..(3619): n is a, c, g, or t
gaaaataaagcaacgcacgagccggctgggccaggaccttggggctgggctggagtgaaggtggctacgagttttccagatttaggagacttcagaaaggtggggcagatagaatggagatggcaaagatctctttgggcatatatgggcctggcgaagtaatggaataatttctaattttcggagaagccctcatgccgggatggcagaagatgagcctgatgctaagagccccaagactgggggaagggcccccccaggtggtgctgaggctggggaacctaccacccttcttcagaggctccgaggtaccatttccaaggccgtgcagaacaaagtagaggggatcctgcaagatgtacagaaattttctgacaatgacaagctgtatctctaccttcagctcccctcaggacccaccactggagacaaaagctcagagccaagtacactgagcaatgaggagtacatgtatgcctataggtggatccgcaaccacctggaagagcacactgacacctgtctgccaaagcaaagtgtttatgatgcctatcggaagtactgtgagagtcttgcctgttgccgcccactcagcacagccaactttggcaagatcatcagagagatcttccctgacatcaaagctcgaaggcttggtggccggggccagtccaaatattgctacagtggcataaggaggaagaccttggtgtctatgccacccctgcctggacttgacctaaagggttctgagagtccagaaatgggcccagaagtaaccccagcacctcgagatgaactggtggaggcagcgtgtgccctgacctgtgactgggcagagcggatcctgaaacggtccttcagttccatcgttgaggtcgcccgcttcctgctacagcagcatctcatctctgcccgatctgcacatgcccatgtgcttaaggccatggggcttgctgaagaggacgaacatgcacctcgggaacggtcatctaaaccaaagaatggtttagagaacccagagggtggagcccacaagaagccagagagactggcccagcctcctaaggatctggaagcccgaactggggccggtcctctcgcacgtggagagcggaagaagagtgtagttgagagctcggccccaggagccaataacctgcaggttaatgccctagtggctcggctgcctctgctccttccccgggcccctcgctcactaattccgccaatcccagtctctccacctattctggcccccaggctttcttcaggtgccctgaaagtggctacactgcctctgtctagtagggccggggcacccccagcagctgtgcccatcattaacatgatcttaccaactgttcctgctttgcctggacctggacctgggcctgggcgagctccacctgggggactcactcagccccggggcacagagaacagagaggtaggcataggtggtgaccaaggaccacatgacaagggtgtcaagaggacagctgaagtacctgtgagtgaggccagtgggcaggctccaccagctaaagcagcaaagcaggatatagaggatacagcaagtgatgccaaaaggaaacgggggcgccctcgaaaaaagtcaggtggaagtggggaaaggaattctacccctctcaagtcagcagctgccatggaatctgcccagtcctcaaggttaccatgggagacatggggctcaggaggggaaggcaactcagctggaggggcagagaggccagggccaatgggagaggctgaaaagggggcagtacttgcccagggtcagggagatggtactgtttccaaaggaggaaggggccccggttcccagcataccaaagaagcagaagataaaattcccttggtcccctcaaaagtgagtgtcatcaagggcagcagaagccaaaaggaggcttttcctttggcaaagggagaggtagacactgcaccacagggtaataaagacttaaaggagcatgtgcttcaaagttccttatcccaggagcataaagacccaaaagcaacacccccatgatacaggtctgtggggaagagtgtttatatccctacgttaactttgcctagtagaggcccttctttgcacttgcttctcatttggctattcttttcctaaggaagtccattctcctctgtacagacagctgagtcacccagtctacttagtacctggttgctgcctctgaccttttcagcttgataccctgggctttagtgtaaccaataaatctgtagtgaccttacctgtattccctgtgctatcctgtgggaaggtaggaatgggctaagtatgatgaatgtataggttagggatcttttggttttaaatcacagaaaacctaattcaaactggcttaaaataaaaaggatttattggttcatgtaactagaaagtccataggtagtgctggctccaggtgaagacttgacccagtagttcagtatgtctctaaataccggactgacttttttctcactgttgcatcttctgtaggaccatttaagtctgggccacttaatggctgccagcattcctaagattacacttttccccatttatgtccaatcagaaaaagaaggcatctttgtaccagaaatctcagcaaaagccctaatattcacactgattaggcctgggtcacatgtccaccctgaccaatcactgtggccaggaggatgatacatgctaatttgcttattctatatcatggacaacacctttggggaaaagggtgggggtcagcctccccaaaatcacatggattccccaagtggaaactaggagcagggagttgcttgggtggccgctaacaccaggctactcttattttagcttgctaagttgagatcagctagacctgctttcttttctcctcagtcttgcatttccctcaatacaagctgcagcctctttcctcgtttctagtctcagaaggaaggagagggaagccattctcctctagggactcttcagtctcatttagatgatagtccctttttttctacctccatattagagatggagctccttccttttcctgtttcttaatttttgtcttctcattcctgcttccctctcaccctattgccagttccaccaactagagtgaaagacttcctagccatttcattaaatctattctgtatccaccaggtggcagcatcttgtcatacgtgtcaggacttaggactgcggggtttaggttagatgtcacggaaaaagctagttctgtggtcaggcggcaccaatgagaaaggaatgcagaccctccagatgtatccttgggaaaagcagtaaaccaactaatatttattgaagacctactttgtcctctacatagggtagcttctgtcagggaatcttggttcttccagaaaatgatttcttccggcgaatctgtgtctttttccccaggattttgaatttattgtgtttgtctttaaaagattttcgggaattgagctaaaaaaaaggggggaaatttcaggggggagacacgtgtaaggcaaggtataaaggcgggcaaggagaggttggcactgtgtacaacaaatgtgtgttgtttgatgattgatgggtagn

SEQ ID NO: 364913 - DNA, 2861 bp, Homo sapiens
gaaaataaagcaacgcacgagccggctgggccaggaccttggggctgggctggagtgaaggtggctacgagttttccagatttaggagacttcagaaaggtggggcagatagaatggagatggcaaagatctctttgggcatatatgggcctggcgaagtaatggaataatttctaattttcggagaagccctcatgccgggatggcagaagatgagcctgatgctaagagccccaagactgggggaagggcccccccaggtggtgctgaggctggggaacctaccacccttcttcagaggctccgaggtaccatttccaaggccgtgcagaacaaagtagaggggatcctgcaagatgtacagaaattttctgacaatgacaagctgtatctctaccttcagctcccctcaggacccaccactggagacaaaagctcagagccaagtacactgagcaatgaggagtacatgtatgcctataggtggatccgcaaccacctggaagagcacactgacacctgtctgccaaagcaaagtgtttatgatgcctatcggaagtactgtgagagtcttgcctgttgccgcccactcagcacagccaactttggcaagatcatcagagagatcttccctgacatcaaagctcgaaggcttggtggccggggccagtccaaatattgctacagtggcataaggaggaagaccttggtgtctatgccacccctgcctggacttgacctaaagggttctgagagtccagaaatgggcccagaagtaaccccagcacctcgagatgaactggtggaggcagcgtgtgccctgacctgtgactgggcagagcggatcctgaaacggtccttcagttccatcgttgaggtcgcccgcttcctgctacagcagcatctcatctctgcccgatctgcacatgcccatgtgcttaaggccatggggcttgctgcatgggagacatggggctcaggaggggaaggcaactcagctggaggggcagagaggccagggccaatgggagaggctgaaaagggggcagtacttgcccagggtcagggagatggtactgtttccaaaggaggaaggggccccggttcccagcataccaaagaagcagaagataaaattcccttggtcccctcaaaagtgagtgtcatcaagggcagcagaagccaaaaggaggcttttcctttggcaaagggagaggtagacactgcaccacagggtaataaagacttaaaggagcatgtgcttcaaagttccttatcccaggagcataaagacccaaaagcaacacccccatgatacaggtctgtggggaagagtgtttatatccctacgttaactttgcctagtagaggcccttctttgcacttgcttctcatttggctattcttttcctaaggaagtccattctcctctgtacagacagctgagtcacccagtctacttagtacctggttgctgcctctgaccttttcagcttgataccctgggctttagtgtaaccaataaatctgtagtgaccttacctgtattccctgtgctatcctgtgggaaggtaggaatgggctaagtatgatgaatgtataggttagggatcttttggttttaaatcacagaaaacctaattcaaactggcttaaaataaaaaggatttattggttcatgtaactagaaagtccataggtagtgctggctccaggtgaagacttgacccagtagttcagtatgtctctaaataccggactgacttttttctcactgttgcatcttctgtaggaccatttaagtctgggccacttaatggctgccagcattcctaagattacacttttccccatttatgtccaatcagaaaaagaaggcatctttgtaccagaaatctcagcaaaagccctaatattcacactgattaggcctgggtcacatgtccaccctgaccaatcactgtggccaggaggatgatacatgctaatttgcttattctatatcatggacaacacctttggggaaaagggtgggggtcagcctccccaaaatcacatggattccccaagtggaaactaggagcagggagttgcttgggtggccgctaacaccaggctactcttattttagcttgctaagttgagatcagctagacctgctttcttttctcctcagtcttgcatttccctcaatacaagctgcagcctctttcctcgtttctagtctcagaaggaaggagagggaagccattctcctctagggactcttcagtctcatttagatgatagtccctttttttctacctccatattagagatggagctccttccttttcctgtttcttaatttttgtcttctcattcctgcttccctctcaccctattgccagttccaccaactagagtgaaagacttcctagccatttcattaaatctattctgtatccaccaggtggcagcatcttgtcatacgtgtcaggacttaggactgcggggtttaggttagatgtcacggaaaaagctagttctgtggtcaggcggcaccaatgagaaaggaatgcagaccctccagatgtatccttgggaaaagcagtaaaccaactaatatttattgaagacctactttgtcctctacatagggtagcttctgtcagggaatcttggttcttcccaagaaacactgattttctttcagggagacttcatgtgttcatttatttccaccacagcagattttaagaaattataatatgtaatatttgatatctataaagagtatatctaacgtgaataaattatgaagcatactaatgagtacctatgacccataacacatatacattaaaacattttaaatacca

SEQ ID NO: 364914 - DNA, 2104 bp, Homo sapiens
agtttctctttctcccttacctttattgttgcttgtgttggaaggcgactgttcagagttttccagatttaggagacttcagaaaggtggggcagatagaatggagatggcaaagatctctttgggcatatatgggcctggcgaagtaatggaataatttctaattttcggagaagccctcatgccgggatggcagaagatgagcctgatgctaagagccccaagactgggggaagggcccccccaggtggtgctgaggctggggaacctaccacccttcttcagaggctccgaggtaccatttccaaggccgtgcagaacaaagtagaggggatcctgcaagatgtacagaaattttctgacaatgacaagctgtatctctaccttcagctcccctcaggacccaccactggagacaaaagctcagagccaagtacactgagcaatgaggagtacatgtatgcctataggtggatccgcaaccacctggaagagcacactgacacctgtctgccaaagcaaagtgtttatgatgcctatcggaagtactgtgagagtcttgcctgttgccgcccactcagcacagccaactttggcaagatcatcagagagatcttccctgacatcaaagctcgaaggcttggtggccggggccagtccaaatattgctacagtggcataaggaggaagaccttggtgtctatgccacccctgctgctgcctctgaccttttcagcttgataccctgggctttagtgtaaccaataaatctgtagtgaccttacctgtattccctgtgctatcctgtgggaaggtaggaatgggctaagtatgatgaatgtataggttagggatcttttggttttaaatcacagaaaacctaattcaaactggcttaaaataaaaaggatttattggttcatgtaactagaaagtccataggtagtgctggctccaggtgaagacttgacccagtagttcagtatgtctctaaataccggactgacttttttctcactgttgcatcttctgtaggaccatttaagtctgggccacttaatggctgccagcattcctaagattacacttttccccatttatgtccaatcagaaaaagaaggcatctttgtaccagaaatctcagcaaaagccctaatattcacactgattaggcctgggtcacatgtccaccctgaccaatcactgtggccaggaggatgatacatgctaatttgcttattctatatcatggacaacacctttggggaaaagggtgggggtcagcctccccaaaatcacatggattccccaagtggaaactaggagcagggagttgcttgggtggccgctaacaccaggctactcttattttagcttgctaagttgagatcagctagacctgctttcttttctcctcagtcttgcatttccctcaatacaagctgcagcctctttcctcgtttctagtctcagaaggaaggagagggaagccattctcctctagggactcttcagtctcatttagatgatagtccctttttttctacctccatattagagatggagctccttccttttcctgtttcttaatttttgtcttctcattcctgcttccctctcaccctattgccagttccaccaactagagtgaaagacttcctagccatttcattaaatctattctgtatccaccaggtggcagcatcttgtcatacgtgtcaggacttaggactgcggggtttaggttagatgtcacggaaaaagctagttctgtggtcaggcggcaccaatgagaaaggaatgcagaccctccagatgtatccttgggaaaagcagtaaaccaactaatatttattgaagacctactttgtcctctacatagggtagcttctgtcagggaatcttggttcttcccaagaaacactgattttctttcagggagacttcatgtgttcatttatttccaccacagcagattttaagaaattataatatgtaatatttgatatctataaagagtatatctaacgtgaataaattatgaagcatactaatgagtacctatgacccataacacatatacattaaaacattttaaatacca

SEQ ID NO: 364915 - DNA, 684 bp, Homo sapiens
ctaaatggctgtacctatggctgtgcagcctctttcctcgtttctagtctcagaaggaaggagagggaagccattctcctctagggactcttcagtctcatttagatgatagtccctttttttctacctccatattagagatggagctccttccttttcctgtttcttaatttttgtcttctcattcctgcttccctctcaccctattgccagttccaccaactagagtgaaagacttcctagccatttcattaaatctattctgtatccaccaggtggcagcatcttgtcatacgtgtcaggacttaggactgcggggtttaggttagatgtcacggaaaaagctagttctgtggtcaggcggcaccaatgagaaaggaatgcagaccctccagatgtatccttgggaaaagcagtaaaccaactaatatttattgaagacctactttgtcctctacatagggtagcttctgtcagggaatcttggttcttcccaagaaacactgattttctttcagggagacttcatgtgttcatttatttccaccacagcagattttaagaaattataatatgtaatatttgatatctataaagagtatatctaacgtgaataaattatgaagcatactaatgagtacctatgacccataacacatatacattaaaacattttaaatacca

SEQ ID NO: 364916 - DNA, 857 bp, Homo sapiens
gaaaataaagcaacgcacgagccggctgggccaggaccttggggctgggctggagtgaaggtggctacgagttttccagatttaggagacttcagaaaggtggggcagatagaatggagatggcaaagatctctttgggcatatatgggcctggcgaagtaatggaataatttctaattttcggagaagccctcatgccgggatggcagaagatgagcctgatgctaagagccccaagactgggggaagggcccccccaggtggtgctgaggctggggaacctaccacccttcttcagaggctccgaggtaccatttccaaggccgtgcagaacaaagtagaggggatcctgcaagatgtacagaaattttctgacaatgacaagctgtatctctaccttcagctcccctcaggacccaccactggagacaaaagctcagagccaagtacactgagcaatgaggagtacatgtatgcctataggtggatccgcaaccacctggaagagcacactgacacctgtctgccaaagcaaagtgtttatgatgcctatcggaagtactgtgagagtcttgcctgttgccgcccactcagcacagccaactttggcaagatcatcagagagatcttccctgacatcaaagctcgaaggcttggtggccggggccagtccaaatattgctacagtggcataaggaggaagaccttggtgtctatgccacccctgcctggacttgacctaaagggttctgagagtccagaaatgggcccagaagtaaccccagcactgctgcctctgaccttttcagcttgataccctgggctttagtgtaaccaataaatctgtagtgacctta

SEQ ID NO: 364917 - DNA, 797 bp, Homo sapiens
gaaaataaagcaacgcacgagccggctgggccaggaccttggggctgggctggagtgaaggtggctacgagttttccagatttaggagacttcagaaaggtggggcagatagaatggagatggcaaagatctctttgggcatatatgggcctggcgaagtaatggaataatttctaattttcggagaagccctcatgccgggatggcagaagatgagcctgatgctaagagccccaagactgggggaagggcccccccaggtggtgctgaggctggggaacctaccacccttcttcagaggctccgaggtaccatttccaaggccgtgcagaacaaagtagaggggatcctgcaagatgtacagaaattttctgacaatgacaagctgtatctctaccttcagctcccctcaggacccaccactggagacaaaagctcagagccaagtacactgagcaatgaggagtacatgtatgcctataggtggatccgcaaccacctggaagagcacactgacacctgtctgccaaagcaaagtgtttatgatgcctatcggaagtactgtgagagtcttgcctgttgccgcccactcagcacagccaactttggcaagatcatcagagagatcttccctgacatcaaagctcgaaggcttggtggccggggccagtccaaatattgctacagtggcataaggaggaagaccttggtgtctatgccacccctgctgctgcctctgaccttttcagcttgataccctgggctttagtgtaaccaataaatctgtagtgacctta

SEQ ID NO: 364918 - DNA, 770 bp, Homo sapiens
gaaaataaagcaacgcacgagccggctgggccaggaccttggggctgggctggagtgaaggtggctacgagttttccagatttaggagacttcagaaaggtggggcagatagaatggagatggcaaagatctctttgggcatatatgggcctggcgaagtaatggaataatttctaattttcggagaagccctcatgccgggatggcagaagatgagcctgatgctaagagccccaagactgggggaagggcccccccaggtggtgctgaggctggggaacctaccacccttcttcagaggctccgaggtaccatttccaaggccgtgcagaacaaagtagaggggatcctgcaagatgtacagaaattttctgacaatgacaagctgtatctctaccttcagctcccctcaggacccaccactggagacaaaagctcagagccaagtacactgagcaatgaggagtacatgtatgcctataggtggatccgcaaccacctggaagagcacactgacacctgtctgccaaagcaaagtgtttatgatgcctatcggaagtactgtgagagtcttgcctgttgccgcccactcagcacagccaactttggcaagatcatcagagagatcttccctgacatcaaagctcgaaggcttggtggccggggccagtccaagtatccttgactagagaggttgggggtggaggacctgggaggaagacttaggatgtggagagcaaggagtggaacagcttaacttgctcgagggg

SEQ ID NO: 364919 - DNA, 3599 bp, Homo sapiens
gaaaataaagcaacgcacgagccggctgggccaggaccttggggctgggctggagtgaaggtggctacgagttttccagatttaggagacttcagaaaggtggggcagatagaatggagatggcaaagatctctttgggcatatatgggcctggcgaagtaatggaataatttctaattttcggagaagccctcatgccgggatggcagaagatgagcctgatgctaagagccccaagactgggggaagggcccccccaggtggtgctgaggctggggaacctaccacccttcttcagaggctccgaggtaccatttccaaggccgtgcagaacaaagtagaggggatcctgcaagatgtacagaaattttctgacaatgacaagctgtatctctaccttcagctcccctcaggacccaccactggagacaaaagctcagagccaagtacactgagcaatgaggagtacatgtatgcctataggtggatccgcaaccacctggaagagcacactgacacctgtctgccaaagcaaagtgtttatgatgcctatcggaagtactgtgagagtcttgcctgttgccgcccactcagcacagccaactttggcaagatcatcagagagatcttccctgacatcaaagctcgaaggcttggtggccggggccagtccaaatattgctacagtggcataaggaggaagaccttggtgtctatgccacccctgcctggacttgacctaaagggttctgagagtccagaaatgggcccagaagtaaccccagcacctcgagatgaactggtggaggcagcgtgtgccctgacctgtgactgggcagagcggatcctgaaacggtccttcagttccatcgttgaggtcgcccgcttcctgctacagcagcatctcatctctgcccgatctgcacatgcccatgtgcttaaggccatggggcttgctgaagaggacgaacatgcacctcgggaacggtcatctaaaccaaagaatggtttagagaacccagagggtggagcccacaagaagccagagagactggcccagcctcctaaggatctggaagcccgaactggggccggtcctctcgcacgtggagagcggaagaagagtgtagttgagagctcggccccaggagccaataacctgcaggttaatgccctagtggctcggctgcctctgctccttccccgggcccctcgctcactaattccgccaatcccagtctctccacctattctggcccccaggctttcttcaggtgccctgaaagtggctacactgcctctgtctagtagggccggggcacccccagcagctgtgcccatcattaacatgatcttaccaactgttcctgctttgcctggacctggacctgggcctgggcgagctccacctgggggactcactcagccccggggcacagagaacagagaggtaggcataggtggtgaccaaggaccacatgacaagggtgtcaagaggacagctgaagtacctgtgagtgaggccagtgggcaggctccaccagctaaagcagcaaagcaggatatagaggatacagcaagtgatgccaaaaggaaacgggggcgccctcgaaaaaagtcaggtggaagtggggaaaggaattctacccctctcaagtcagcagctgccatggaatctgcccagtcctcaaggttaccatgggagacatggggctcaggaggggaaggcaactcagctggaggggcagagaggccagggccaatgggagaggctgaaaagggggcagtacttgcccagggtcagggagatggtactgtttccaaaggaggaaggggccccggttcccagcataccaaagaagcagaagataaaattcccttggtcccctcaaaagtgagtgtcatcaagggcagcagaagccaaaaggaggcttttcctttggcaaagggagaggtagacactgcaccacagggtaataaagacttaaaggagcatgtgcttcaaagttccttatcccaggagcataaagacccaaaagcaacacccccatgatacaggtctgtggggaagagtgtttatatccctacgttaactttgcctagtagaggcccttctttgcacttgcttctcatttggctattcttttcctaaggaagtccattctcctctgtacagacagctgagtcacccagtctacttagtacctggttgctgcctctgaccttttcagcttgataccctgggctttagtgtaaccaataaatctgtagtgaccttacctgtattccctgtgctatcctgtgggaaggtaggaatgggctaagtatgatgaatgtataggttagggatcttttggttttaaatcacagaaaacctaattcaaactggcttaaaataaaaaggatttattggttcatgtaactagaaagtccataggtagtgctggctccaggtgaagacttgacccagtagttcagtatgtctctaaataccggactgacttttttctcactgttgcatcttctgtaggaccatttaagtctgggccacttaatggctgccagcattcctaagattacacttttccccatttatgtccaatcagaaaaagaaggcatctttgtaccagaaatctcagcaaaagccctaatattcacactgattaggcctgggtcacatgtccaccctgaccaatcactgtggccaggaggatgatacatgctaatttgcttattctatatcatggacaacacctttggggaaaagggtgggggtcagcctccccaaaatcacatggattccccaagtggaaactaggagcagggagttgcttgggtggccgctaacaccaggctactcttattttagcttgctaagttgagatcagctagacctgctttcttttctcctcagtcttgcatttccctcaatacaagctgcagcctctttcctcgtttctagtctcagaaggaaggagagggaagccattctcctctagggactcttcagtctcatttagatgatagtccctttttttctacctccatattagagatggagctccttccttttcctgtttcttaatttttgtcttctcattcctgcttccctctcaccctattgccagttccaccaactagagtgaaagacttcctagccatttcattaaatctattctgtatccaccaggtggcagcatcttgtcatacgtgtcaggacttaggactgcggggtttaggttagatgtcacggaaaaagctagttctgtggtcaggcggcaccaatgagaaaggaatgcagaccctccagatgtatccttgggaaaagcagtaaaccaactaatatttattgaagacctactttgtcctctacatagggtagcttctgtcagggaatcttggttcttcccaagaaacactgattttctttcagggagacttcatgtgttcatttatttccaccacagcagattttaagaaattataatatgtaatatttgatatctataaagagtatatctaacgtgaataaattatgaagcatactaatgagtacctatgacccataacacatatacattaaaacattttaaatacca

SEQ ID NO: 364920 - DNA, 3440 bp, Homo sapiens
gaaaataaagcaacgcacgagccggctgggccaggaccttggggctgggctggagtgaaggtggctacgagttttccagatttaggagacttcagaaaggtggggcagatagaatggagatgctaccacccttcttcagaggctccgaggtaccatttccaaggccgtgcagaacaaagtagaggggatcctgcaagatgtacagaaattttctgacaatgacaagctgtatctctaccttcagctcccctcaggacccaccactggagacaaaagctcagagccaagtacactgagcaatgaggagtacatgtatgcctataggtggatccgcaaccacctggaagagcacactgacacctgtctgccaaagcaaagtgtttatgatgcctatcggaagtactgtgagagtcttgcctgttgccgcccactcagcacagccaactttggcaagatcatcagagagatcttccctgacatcaaagctcgaaggcttggtggccggggccagtccaaatattgctacagtggcataaggaggaagaccttggtgtctatgccacccctgcctggacttgacctaaagggttctgagagtccagaaatgggcccagaagtaaccccagcacctcgagatgaactggtggaggcagcgtgtgccctgacctgtgactgggcagagcggatcctgaaacggtccttcagttccatcgttgaggtcgcccgcttcctgctacagcagcatctcatctctgcccgatctgcacatgcccatgtgcttaaggccatggggcttgctgaagaggacgaacatgcacctcgggaacggtcatctaaaccaaagaatggtttagagaacccagagggtggagcccacaagaagccagagagactggcccagcctcctaaggatctggaagcccgaactggggccggtcctctcgcacgtggagagcggaagaagagtgtagttgagagctcggccccaggagccaataacctgcaggttaatgccctagtggctcggctgcctctgctccttccccgggcccctcgctcactaattccgccaatcccagtctctccacctattctggcccccaggctttcttcaggtgccctgaaagtggctacactgcctctgtctagtagggccggggcacccccagcagctgtgcccatcattaacatgatcttaccaactgttcctgctttgcctggacctggacctgggcctgggcgagctccacctgggggactcactcagccccggggcacagagaacagagaggtaggcataggtggtgaccaaggaccacatgacaagggtgtcaagaggacagctgaagtacctgtgagtgaggccagtgggcaggctccaccagctaaagcagcaaagcaggatatagaggatacagcaagtgatgccaaaaggaaacgggggcgccctcgaaaaaagtcaggtggaagtggggaaaggaattctacccctctcaagtcagcagctgccatggaatctgcccagtcctcaaggttaccatgggagacatggggctcaggaggggaaggcaactcagctggaggggcagagaggccagggccaatgggagaggctgaaaagggggcagtacttgcccagggtcagggagatggtactgtttccaaaggaggaaggggccccggttcccagcataccaaagaagcagaagataaaattcccttggtcccctcaaaagtgagtgtcatcaagggcagcagaagccaaaaggaggcttttcctttggcaaagggagaggtagacactgcaccacagggtaataaagacttaaaggagcatgtgcttcaaagttccttatcccaggagcataaagacccaaaagcaacacccccatgatacaggtctgtggggaagagtgtttatatccctacgttaactttgcctagtagaggcccttctttgcacttgcttctcatttggctattcttttcctaaggaagtccattctcctctgtacagacagctgagtcacccagtctacttagtacctggttgctgcctctgaccttttcagcttgataccctgggctttagtgtaaccaataaatctgtagtgaccttacctgtattccctgtgctatcctgtgggaaggtaggaatgggctaagtatgatgaatgtataggttagggatcttttggttttaaatcacagaaaacctaattcaaactggcttaaaataaaaaggatttattggttcatgtaactagaaagtccataggtagtgctggctccaggtgaagacttgacccagtagttcagtatgtctctaaataccggactgacttttttctcactgttgcatcttctgtaggaccatttaagtctgggccacttaatggctgccagcattcctaagattacacttttccccatttatgtccaatcagaaaaagaaggcatctttgtaccagaaatctcagcaaaagccctaatattcacactgattaggcctgggtcacatgtccaccctgaccaatcactgtggccaggaggatgatacatgctaatttgcttattctatatcatggacaacacctttggggaaaagggtgggggtcagcctccccaaaatcacatggattccccaagtggaaactaggagcagggagttgcttgggtggccgctaacaccaggctactcttattttagcttgctaagttgagatcagctagacctgctttcttttctcctcagtcttgcatttccctcaatacaagctgcagcctctttcctcgtttctagtctcagaaggaaggagagggaagccattctcctctagggactcttcagtctcatttagatgatagtccctttttttctacctccatattagagatggagctccttccttttcctgtttcttaatttttgtcttctcattcctgcttccctctcaccctattgccagttccaccaactagagtgaaagacttcctagccatttcattaaatctattctgtatccaccaggtggcagcatcttgtcatacgtgtcaggacttaggactgcggggtttaggttagatgtcacggaaaaagctagttctgtggtcaggcggcaccaatgagaaaggaatgcagaccctccagatgtatccttgggaaaagcagtaaaccaactaatatttattgaagacctactttgtcctctacatagggtagcttctgtcagggaatcttggttcttcccaagaaacactgattttctttcagggagacttcatgtgttcatttatttccaccacagcagattttaagaaattataatatgtaatatttgatatctataaagagtatatctaacgtgaataaattatgaagcatactaatgagtacctatgacccataacacatatacattaaaacattttaaatacca

SEQ ID NO: 364921 - DNA, 2638 bp, Homo sapiens
gaaaataaagcaacgcacgagccggctgggccaggaccttggggctgggctggagtgaaggtggctacgagttttccagatttaggagacttcagaaaggtggggcagatagaatggagatggcaaagatctctttgggcatatatgggcctggcgaagtaatggaataatttctaattttcggagaagccctcatgccgggatggcagaagatgagcctgatgctaagagccccaagactgggggaagggcccccccaggtggtgctgaggctggggaacctaccacccttcttcagaggctccgaggtaccatttccaaggccgtgcagaacaaagtagaggggatcctgcaagatgtacagaaattttctgacaatgacaagctgtatctctaccttcagctcccctcaggacccaccactggagacaaaagctcagagccaagtacactgagcaatgaggagtacatgtatgcctataggtggatccgcaaccacctggaagagcacactgacacctgtctgccaaagcaaagtgtttatgatgcctatcggaagtactgtgagagtcttgcctgttgccgcccactcagcacagccaactttggcaagatcatcagagagatcttccctgacatcaaagctcgaaggcttggtggccggggccagtccaaatattgctacagtggcataaggaggaagaccttggtgtctatgccacccctgcctggacttgacctaaagggttctgagagtccagaaatgggcccagaagtaaccccagcacctcgagatgaactggtggaggcagcgtgtgccctgacctgtgactgggcagagcggatcctgaaacggtccttcagttccatcgttgaggtcgcccgcttcctgctacagcagcatctcatctctgcccgatctgcacatgcccatgtgcttaaggccatggggcttgctgaagaggacgaacatgcacctcgggaacggtcatctaaaccaaagaatggtttagagaacccagagggtggagcccacaagaagccagagagactggcccagcctcctaaggatctggaagcccgaactggggccggtcctctcgcacgtggagagcggaagaagagtgtagttgagagctcggccccaggagccaataacctgcaggttaatgccctagtggctcggctgcctctgctccttccccgggcccctcgctcactaattccgccaatcccagtctctccacctattctggcccccaggctttcttcaggtgccctgaaagtggctacactgcctctgtctagtagggccggggcacccccagcagctgtgcccatcattaacatgatcttaccaactgttcctgctttgcctggacctggacctgggcctgggcgagctccacctgggggactcactcagccccggggcacagagaacagagaggtaggcataggtggtgaccaaggaccacatgacaagggtgtcaagaggacagctgaagtacctgtgagtgaggccagtgggcaggctccaccagctaaagcagcaaagcaggatatagaggatacagcaagtgatgccaaaaggaaacgggggcgccctcgaaaaaagtcaggtggaagtggggaaaggaattctacccctctcaagtcagcagctgccatggaatctgcccagtcctcaaggttaccatgggagacatggggctcaggaggggaaggcaactcagctggaggggcagagaggccagggccaatgggagaggctgaaaagggggcagtacttgcccagggtcagggagatggtactgtttccaaaggaggaaggggccccggttcccagcataccaaagaagcagaagataaaattcccttggtcccctcaaaagtgagtgtcatcaagggcagcagaagccaaaaggaggcttttcctttggcaaagggagaggtagacactgcaccacagggtaataaagacttaaaggagcatgtgcttcaaagttccttatcccaggagcataaagacccaaaagcaacacccccatgatacaggtctgtggggaagagtgtttatatccctacgttaactttgcctagtagaggcccttctttgcacttgcttctcatttggctattcttttcctaaggaagtccattctcctctgtacagacagctgagtcacccagtctacttagtacctggttgctgcctctgaccttttcagcttgataccctgggctttagtgtaaccaataaatctgtagtgaccttacctgtattccctgtgctatcctgtgggaaggtaggaatgggctaagtatgatgaatgtataggttagggatcttttggttttaaatcacagaaaaccaactaatatttattgaagacctactttgtcctctacatagggtagcttctgtcagggaatcttggttcttcccaagaaacactgattttctttcagggagacttcatgtgttcatttatttccaccacagcagattttaagaaattataatatgtaatatttgatatctataaagagtatatctaacgtgaataaattatgaagcatactaatgagtacctatgacccataacacatatacattaaaacattttaaatacca

SEQ ID NO: 364922 - DNA, 2279 bp, Homo sapiens
gaaaataaagcaacgcacgagccggctgggccaggaccttggggctgggctggagtgaaggtggctacgagttttccagatttaggagacttcagaaaggtggggcagatagaatggagatggcaaagatctctttgggcatatatgggcctggcgaagtaatggaataatttctaattttcggagaagccctcatgccgggatggcagaagatgagcctgatgctaagagccccaagactgggggaagggcccccccaggtggtgctgaggctggggaacctaccacccttcttcagaggctccgaggtaccatttccaaggccgtgcagaacaaagtagaggggatcctgcaagatgtacagaaattttctgacaatgacaagctgtatctctaccttcagctcccctcaggacccaccactggagacaaaagctcagagccaagtacactgagcaatgaggagtacatgtatgcctataggtggatccgcaaccacctggaagagcacactgacacctgtctgccaaagcaaagtgtttatgatgcctatcggaagtactgtgagagtcttgcctgttgccgcccactcagcacagccaactttggcaagatcatcagagagatcttccctgacatcaaagctcgaaggcttggtggccggggccagtccaaatattgctacagtggcataaggaggaagaccttggtgtctatgccacccctgcctggacttgacctaaagggttctgagagtccagaaatgggcccagaagtaaccccagcacctcgagatgaactggtggaggcagcgtgtgccctgacctgtgactgggcagagcggatcctgaaacggtccttcagttccatcgttgaggtcgcccgcttcctgctacagcagcatctcatctctgcccgatctgcacatgcccatgtgcttaaggccatggggcttgctgaagaggacgaacatgcacctcgggaacggtcatctaaaccaaagaatggtttagagaacccagagggtggagcccacaagaagccagagagactggcccagcctcctaaggatctggaagcccgaactggggccggtcctctcgcacgtggagagcggaagaagagtgtagttgagagctcggccccaggagccaataacctgcaggttaatgccctagtggctcggctgcctctgctccttccccgggcccctcgctcactaattccgccaatcccagtctctccacctattctggcccccaggctttcttcaggtgccctgaaagtggctacactgcctctgtctagtagggccggggcacccccagcagctgtgcccatcattaacatgatcttaccaactgttcctgctttgcctggacctggacctgggcctgggcgagctccacctgggggactcactcagccccggggcacagagaacagagaggtaggcataggtggtgaccaaggaccacatgacaagggtgtcaagaggacagctgaagtacctgtgagtgaggccagtgggcaggctccaccagctaaagcagcaaagcaggatatagaggatacagcaagtgatgccaaaaggaaacgggggcgccctcgaaaaaagtcaggtggaagtggggaaaggaattctacccctctcaagtcagcagctgccatggaatctgcccagtcctcaaggttaccatgggagacatggggctcaggaggggaaggcaactcagctggaggggcagagaggccagggccaatgggagaggctgaaaagggggcagtacttgcccagggtcagggagatggtactgtttccaaaggaggaaggggccccggttcccagcataccaaagaagcagaagataaaattcccttggtcccctcaaaagtgagtgtcatcaagggcagcagaagccaaaaggaggcttttcctttggcaaagggagaggtagacactgcaccacagggtaataaagacttaaaggagcatgtgcttcaaagttccttatcccaggagcataaagacccaaaagcaacacccccatgatacaggtctgtggggaagagtgtttatatccctacgttaactttgcctagtagaggcccttctttgcacttgcttctcatttggctattcttttcctaaggaagtccattctcctctgtacagacagctgagtcacccagtctacttagtacctggttgctgcctctgaccttttcagcttgataccctgggctttagtgtaaccaataaatctgtagtgacctta

SEQ ID NO: 364923 - DNA, 2068 bp, Homo sapiens
gaaaataaagcaacgcacgagccggctgggccaggaccttggggctgggctggagtgaaggtggctacgagttttccagatttaggagacttcagaaaggtggggcagatagaatggagatggcaaagatctctttgggcatatatgggcctggcgaagtaatggaataatttctaattttcggagaagccctcatgccgggatggcagaagatgagcctgatgctaagagccccaagactgggggaagggcccccccaggtggtgctgaggctggggaacctaccacccttcttcagaggctccgaggtaccatttccaaggccgtgcagaacaaagtagaggggatcctgcaagatgtacagaaattttctgacaatgacaagctgtatctctaccttcagctcccctcaggacccaccactggagacaaaagctcagagccaagtacactgagcaatgaggagtacatgtatgcctataggtggatccgcaaccacctggaagagcacactgacacctgtctgccaaagcaaagtgtttatgatgcctatcggaagtactgtgagagtcttgcctgttgccgcccactcagcacagccaactttggcaagatcatcagagagatcttccctgacatcaaagctcgaaggcttggtggccggggccagtccaaatattgctacagtggcataaggaggaagaccttggtgtctatgccacccctgcctggacttgacctaaagggttctgagagtccagaaatgggcccagaagtaaccccagcacctcgagatgaactggtggaggcagcgtgtgccctgacctgtgactgggcagagcggatcctgaaacggtccttcagttccatcgttgaggtcgcccgcttcctgctacagcagcatctcatctctgcccgatctgcacatgcccatgtgcttaaggccatggggcttgctgaagaggacgaacatgcacctcgggaacggtcatctaaaccaaagaatggtttagagaacccagagggtggagcccacaagaagccagagagactggcccagcctcctaaggatctggaagcccgaactggggccggtcctctcgcacgtggagagcggaagaagagtgtagttgagagctcggccccaggagccaataacctgcaggttaatgccctagtggctcggctgcctctgctccttccccgggcccctcgctcactaattccgccaatcccagtctctccacctattctggcccccaggctttcttcaggtgccctgaaagtggctacactgcctctgtctagtagggccggggcacccccagcagctgtgcccatcattaacatgatcttaccaactgttcctgctttgcctggacctggacctgggcctgggcgagctccacctgggggactcactcagccccggggcacagagaacagagaggtaggcataggtggtgaccaaggaccacatgacaagggtgtcaagaggacagctgaagtacctgtgagtgaggccagtgggcaggctccaccagctaaagcagcaaagcaggatatagaggatacagcaagtgatgccaaaaggaaacgggggcgccctcgaaaaaagtcaggtggaagtggggaaaggaattctacccctctcaagtcagcagctgccatggaatctgcccagtcctcaaggttaccatgggagacatggggctcaggaggggaaggcaactcagctggaggggcagagaggccagggccaatgggagaggctgaaaagggggcagtacttgcccagggtcagggagatggtactgtttccaaaggaggaaggggccccggttcccagcataccaaagaagcagaagataaaattcccttggtcccctcaaaagtgagtgtcatcaagggcagcagaagccaaaaggaggcttttcctaaggaagtccattctcctctgtacagacagctgagtcacccagtctacttagtacctggttgctgcctctgaccttttcagcttgataccctgggctttagtgtaaccaataaatctgtagtgacctta

SEQ ID NO: 364924 - DNA, 1023 bp, Homo sapiens
  misc_feature (896)..(896): n is a, c, g, or t
  misc_feature (911)..(911): n is a, c, g, or t
  misc_feature (928)..(928): n is a, c, g, or t
  misc_feature (950)..(950): n is a, c, g, or t
  misc_feature (981)..(981): n is a, c, g, or t
  misc_feature (991)..(991): n is a, c, g, or t
  misc_feature (998)..(998): n is a, c, g, or t
  misc_feature (1007)..(1007): n is a, c, g, or t
  misc_feature (1013)..(1013): n is a, c, g, or t
cactgtgtttggggcctgagtcactggagccctttttgccacatatagttttaatcaccctctaaagaggctttccctttccaggtcttgcgagattcacggatccaccatctccggctgctcaacatcctgggctgccacgccgtcttctttatgatccccacctgggttctggtggacctctcggctttcctggtcagcagcgacttggtgagttgtacagcaccaagaacacgccattttcttggctagttccagaataggtgctttgttgaggagctgtagctgcatgttaacattgtggtatcttttgggcacctgacagccagcgctttcagcagtcagtcctctgtaatgcctcacggtgacgatgcacgccatcgaggaagtgggtttcctgtgtatttccttctctggtgtgcttgatcccaggtgctgatagctgctgtgtgtgcgccagtagcgtcaaggaagagaaggtgactctttcacctcctgacagtatagtccagatagcacattgactttttatttttactcattttttattttaaatgtttattttttagagacagaacctcgctctgcactccagcctgggtgacagagggagactttgtctcaaaaaaactattttttaaaaagagggaatgggggagccttatagaggatcagggcttcaaaccctggtgcgtcagtggcagctgaacagatctgtggagttaggaccagccccgggctgtggcctggagcagaggctcttaatgggggtgacggtatggggatggggctacccacaaataagccctgcccctggcgctctgataaccacctgcccccagccacccaccagagcgtcactggcacagcaaacaccactttcaaagtgttaggtngtattccctttggtngagggaggagaggggtnttccctggggcatctgtgggcntgtgggcccagtgttagttatgggcctgtgnagccttattnggttganctcttgccnacgagntgttattgtt

SEQ ID NO: 364925 - DNA, 730 bp, Homo sapiens
ttctagcactgtgggtcagcgtttctcccagcgggatgcccgccttcaccttgtgtacttcccatcccagagctgcagtcagcccctccttcaggactccaggtgccgttagtggggagcggtatttagagacacaatccaggtgccatgggtgctttttgctgctgggtggtcattgttgttaggcctttactgtgaaaaattaggaagtacacacttggggcagcagcaaagagttcctagcaattagcgtcactttcagttgaacagtccagatctttgctgttttgaatttcatatttagatctcgtcgctggtatgcttggttccgctcctcgtttcttagttgcttattctacccgttattcactgatgttattctactgtacactcactcatataattgctttagaatgagcattctcacagcacaattgcaactggagtgctgagaaaaggttagtatttctttgcaggctgggtgtggtggctcacgcctggaatcccagcactttgggagaccgaggtaggtggatcccttgaggccaggagttcgaaaccagcctggccaacgtggggaaaccccatctctagaaaaaatataaaaattatctggtgtggtggcgtacgcctataatcctagctactaggtaggtggaggttgcagtgagctgagatcacgacactgcactccaacctgggtgacaaagtgagactgtctcataaaaat

SEQ ID NO: 364926 - DNA, 5074 bp, Homo sapiens
cggccgcggtgggcgcgggccacggcgcggggggcccgggcgcagcgagcagcagtggtggggcgcgcgagggcgcgcgggtggcggcgctgtgcctgctgtggtacgcgctgagcgcgggcggcaacgtggtcaacaaggtgatcctgagcgccttcccgttcccggtgaccgtgtcgctgtgccacatcctggctctgtgcgctgggctcccgccgctgctgcgcgcctggcgcgtgccccccgcgccgcccgtctcgggccccggacccagtccgcatccgtcgtccggcccgctgctgccgccgcgcttctacccgcgctacgtgctaccgctcgccttcggcaagtacttcgcgtccgtgtcagcgcacgtcagcatctggaaggtgcccgtgtcctatgcacacaccgtcaaggccaccatgcccatctgggtggtcctcctgtcccggatcattatgaaggagaagcagagcaccaaggtatacttgtcactcatccccatcatcagcggtgtcctgctggccaccgtcaccgagttgtcttttgacatgtggggactcgtcagcgccctcgccgccacgctgtgcttctcgcttcagaacattttctccaaaaaggtcttgcgagattcacggatccaccatctccggctgctcaacatcctgggctgccacgccgtcttctttatgatccccacctgggttctggtggacctctcggctttcctggtcagcagcgacttgacctacgtctaccagtggccctggacgctcctgctcctggctgtcagcggcttctgtaactttgcccagaatgttatcgccttcagcatcctcaacctcgttagccccctgagctactcggtcgccaatgccaccaaaagaatcatggtcatcacggtgtccctgatcatgctgcgcaacccagtcaccagcaccaacgtcctgggcatgatgaccgccatcctgggggtcttcctctataacaagaccaagtacgatgcaaaccagcaagccaggaagcacctcctccccgtcaccacagcagacctgagcagcaaggagcgtcaccggagcccactggagaagccccacaacggcctcctcttcccccagcacggggactatcagtacggccgcaacaacatcttaacagaccacttccaatacagccggcagagctacccaaactcgtacagtttgaaccgctatgatgtgtagagtccaaaggacaggaccagactgttggtgactccttccccggcccccacagcagtatcagaaacttctgacaatcagtgaatgtacaacccagccgaggggacggtgcataactctccatcagaagccctggggttcctggccccccgtgagccgcaggaggatgcgttgcctgcagtgcagacggccgtgagctctgggcaaacctaaacagagaccagtgtctcatgctctttcttcctggagtctgtcatctgagggccgtgtccctgcggagatcttggccacgttgtacctttccatgtggaattattccccaagcagtgtagctcagagcacttgtgtctgcattccagataacattcaggacctgtgtgaaaagctggggtcactgtggctgtagaccatgaactggcagtgggggtgtccagggcggtgcttgagaacgtcagactggctagtttaattccctggcgcagatacgcataggaccaacagggtcaccaagcagacagggagcccgcgagaatcattcaaaacatccccagccacagagatggatccagtttcctggtcatccccttagcagttcacaagttcctggcaaatgttccaaagcaaaaagcgattgcaattagcatccagttcctgcagcctggtgctctgccctgcacgtcagggttggcatccacccagatccagatggaagggaaacttctctcttctcctttgcctcctcttccctcaccagagcagggcgcttctcttggggtggtgagaaggatcttcgagaaatcgtgttcagtatttcaagctctatttctgtggcacatgtcttttgagaggcatcttcacctcttctgtgatgacttggtatgttgtttggtagagagatcttgattttcggaggatcttgcatttttctagggaatattttgtagttgtgtgtgtgtgtttttgccttggtccccattatgggatgcattaggactggcctatgcatcgaaaatctttttgtttgtaaacgtttaaaaacaaagttccccggccaggcacagtggctcacacctgtaatcccagcactttgggaggccaagatgggcggatcacgaggtcaggagttcgagaccagcctggccaacatagtgaaaccccatctctactaaaaatacagaaattagccgggcatggtgtcgcgtgcctgtagtcccagctcctcaggctgctgaggcaggcgaattgcttgaacctgggaggcagaagttgtggtgagccgagattgtgcactccagcctgggtaacagagcgagactccatctcaaaaaaaaaaacaaaacaaaaccaagttcccactggtgatgcctgtctgacacgttttggtatttagtaggaaatgaagtgtttcgaagcttcgagagaagcttcaaaattgtcacaattgctgaaaacagaatgaatcgtgaacattatctcaatattttgtataatagacaagaccacagtgttttggttccctgacctgtttttgtgtttatgttaggatctgaatcatgttctgggtaaggggacgaggagcgaacactgcactaagatttggtttgccaaatcagattctttggtcaagagtcagtttggggccaggcgtggtggctcatgcctgtaatctcagcactttgggaggctgaggtgggtggatcactggagtttgagaccaccctggccaacatggtgaaaccccatctctactaaaacaaaaattagccaggcatggtggcacctgcctgtaatcccagctacttgggaggctgaggcaggagaatcacttgagcccaggaggtggaggtttcagcgagctgagatcacaccactgcactccagccttggtgacagagtgagactctgtctcaaaaaaaaaaaaaaaaaaaaggaatcagtttgggtcttggcagaaatcaacataaggaatatgacaagaccccagtaggtaaccctgagtgctcaggtccgagctgtggtctcttttacggcttcatgaaaggaccgtgccctcacggaggggaccacggcttggcttgtggggtcttaggtgatggctgccttctttcttcatcaccacacccagcttcttgctggcacttaggggaagagagcagcaaatgagagatttaccttttatctcccagcgagcgagatgtttccctgttcagagaggaagtaacatcacttatgcttgactggtgtttcttttgttgttgtttgtttttctttcaattggaattctgtatttaagatgttatgtcagctgacacatgggacactcctgaagaggtgactggccccccaccctgtttggcggtgagtttccgcaccaccggcctcagaagtgtccctcttgcttcgtctcttgttcgcttgctttgtaaatactttggtcccaagctgagacaattgctgtgtaaaacgtgaagagtcaatcccaaagggtgttatttgtcagaagaacttgccgtgtgccttcaccgaaggcagtcaagtctgcagttggatttttctcactggtgaatgacaagaaacagggataattttgcactgcggagatattacgggagttgtctatatgattatatatagtacctgattctttgaacatattattgaactccaaaatgaattcgacctccattcaggcttcctgaaatctctgaagttgctgaaatttgtatattattttccttttccaatgcaagatctgctggtgacgggaaatgactgtctggttttattatggtttataaattaataaatgggctatttaattctgtatataaatttacagcaagtacgtacactggaatgaatgaggcaatcacgttacaccaaatcagcagatcaaaagacaaacacatatttctgagacttgaaggtccacatccccccgccccctgccaagatggagtcttgctttgttgctcaggctggagtgcagtggcgcagtctcagctcactacaacctccatcccccgggttcaggtgattctcgtgcctcagcctcccgagtagctgggattacaggcatgcaccaccacggctggctaattttttgtgtttttagtagagacagggtttcaccatgttggccaggctggtctcgaactcctggcctcaaatgatccgcccaccttggcctcccaaagtgctaggatgacaggcatgagccaccgtgcccagcctgattgacaatggcctcttgaaggctgggttttcccagccggacagtgcccgccccacatgctccactcccacgctttcatctgcaggcctgccttcctctcagccacctcactgctgagctctgtggtagagaatttcctttacccatcagggtatggtctggctggtaatactgactccaacccagctccttcattttatagaaggaggcatttctgaatcatgtttgttcaccatggcgagactcactgcagaatttttaaccaccttattttaagtcattcattctaggaacagtcaagcccctaccacaaaggggccagatccgttcaagtgaggaagcacttgcagtttctgaattttgctgtatatttgtcctatgtcacccaacaggccctttgctatagctgggacattaccagaccccaataccttagggtctcacagcctgaaggacacagagcattgaattattaaaagacctgaaaatattataatgtttttcaattgtcacctgttttcaagacttaaatgctatagacttttctgcaggaatgacgtgtatattcctcactggcatttaccaaaaataaatgatggtttccagggaatcaaaa

SEQ ID NO: 364927 - DNA, 4951 bp, Homo sapiens
cggccgcggtgggcgcgggccacggcgcggggggcccgggcgcagcgagcagcagtggtggggcgcgcgagggcgcgcgggtggcggcgctgtgcctgctgtggtacgcgctgagcgcgggcggcaacgtggtcaacaaggtgatcctgagcgccttcccgttcccggtgaccgtgtcgctgtgccacatcctggctctgtgcgctgggctcccgccgctgctgcgcgcctggcgcgtgccccccgcgccgcccgtctcgggccccggacccagtccgcatccgtcgtccggcccgctgctgccgccgcgcttctacccgcgctacgtgctaccgctcgccttcggcaagtacttcgcgtccgtgtcagcgcacgtcagcatctggaaggtgcccgtgtcctatgcacacaccgtcaaggccaccatgcccatctgggtggtcctcctgtcccggatcattatgaaggagaagcagagcaccaaggtatacttgtcactcatccccatcatcagcggtgtcctgctggccaccgtcaccgagttgtcttttgacatgtggggactcgtcagcgccctcgccgccacgctgtgcttctcgcttcagaacattttctccaaaaaggtcttgcgagattcacggatccaccatctccggctgctcaacatcctgggctgccacgccgtcttctttatgatccccacctgggttctggtggacctctcggctttcctggtcagcagcgacttgacctacgtctaccagtggccctggacgctcctgctcctggctgtcagcggcttctgtaactttgcccagaatgttatcgccttcagcatcctcaacctcgttagccccctgagctactcggtcgccaatgccaccaaaagaatcatggtcatcacggtgtccctgatcatgctgcgcaacccagtcaccagcaccaacgtcctgggcatgatgaccgccatcctgggggtcttcctctataacaagaccaagtacgatgcaaaccagcaagccaggaagcacctcctccccgtcaccacagcagacctgagcagcaaggagcgtcaccggagcccactggagaagccccacaacggcctcctcttcccccagcacggggactatcagtacggccgcaacaacatcttaacagaccacttccaatacagccggcagagctacccaaactcgtacagtttgaaccgctatgatgtgtagagtccaaaggacaggaccagactgttggtgactccttccccggcccccacagcagtatcagaaacttctgacaatcagtgaatgtacaacccagccgaggggacggtgcataactctccatcagaagccctggggttcctggccccccgtgagccgcaggaggatgcgttgcctgcagtgcagacggccgtgagctctgggcaaacctaaacagagaccagtgtctcatgctctttcttcctggagtctgtcatctgagggccgtgtccctgcggagatcttggccacgttgtacctttccatgtggaattattccccaagcagtgtagctcagagcacttgtgtctgcattccagataacattcaggacctgtgtgaaaagctggggtcactgtggctgtagaccatgaactggcagtgggggtgtccagggcggtgcttgagaacgtcagactggctagtttaattccctggcgcagatacgcataggaccaacagggtcaccaagcagacagggagcccgcgagaatcattcaaaacatccccagccacagagatggatccagtttcctggtcatccccttagcagttcacaagttcctggcaaatgttccaaagcaaaaagcgattgcaattagcatccagttcctgcagcctggtgctctgccctgcacgtcagggttggcatccacccagatccagatggaagggaaacttctctcttctcctttgcctcctcttccctcaccagagcagggcgcttctcttggggtggtgagaaggatcttcgagaaatcgtgttcagtatttcaagctctatttctgtggcacatgtcttttgagaggcatcttcacctcttctgtgatgacttggtatgttgtttggtagagagatcttgattttcggaggatcttgcatttttctagggaatattttgtagttgtgtgtgtgtgtttttgccttggtccccattatgggatgcattaggactggcctatgcatcgaaaatctttttgtttgtaaacgtttaaaaacaaagttccccggccaggcacagtggctcacacctgtaatcccagcactttgggaggccaagatgggcggatcacgaggtcaggagttcgagaccagcctggccaacatagtgaaaccccatctctactaaaaatacagaaattagccgggcatggtgtcgcgtgcctgtagtcccagctcctcaggctgctgaggcaggcgaattgcttgaacctgggaggcagaagttgtggtgagccgagattgtgcactccagcctgggtaacagagcgagactccatctcaaaaaaaaaaacaaaacaaaaccaagttcccactggtgatgcctgtctgacacgttttggtatttagtaggaaatgaagtgtttcgaagcttcgagagaagcttcaaaattgtcacaattgctgaaaacagaatgaatcgtgaacattatctcaatattttgtataatagacaagaccacagtgttttggttccctgacctgtttttgtgtttatgttaggatctgaatcatgttctgggtaaggggacgaggagcgaacactgcactaagatttggtttgccaaatcagattctttggtcaagagtcagtttggggccaggcgtggtggctcatgcctgtaatctcagcactttgggaggctgaggtgggtggatcactggagtttgagaccaccctggccaacatggtgaaaccccatctctactaaaacaaaaattagccaggcatggtggcacctgcctgtaatcccagctacttgggaggctgaggcaggagaatcacttgagcccaggaggtggaggtttcagcgagctgagatcacaccactgcactccagccttggtgacagagtgagactctgtctcaaaaaaaaaaaaaaaaaaaaggaatcagtttgggtcttggcagaaatcaacataaggaatatgacaagaccccagtaggtaaccctgagtgctcaggtccgagctgtggtctcttttacggcttcatgaaaggaccgtgccctcacggaggggaccacggcttggcttgtggggtcttaggtgatggctgccttctttcttcatcaccacacccagcttcttgctggcacttaggggaagagagcagcaaatgagagatttaccttttatctcccagcgagcgagatgtttccctgttcagagaggaagtaacatcacttatgcttgactggtgtttcttttgttgttgtttgtttttctttcaattggaattctgtatttaagatgttatgtcagctgacacatgggacactcctgaagaggtgactggccccccaccctgtttggcggtgagtttccgcaccaccggcctcagaagtgtccctcttgcttcgtctcttgttcgcttgctttgtaaatactttggtcccaagctgagacaattgctgtgtaaaacgtgaagagtcaatcccaaagggtgttatttgtcagaagaacttgccgtgtgccttcaccgaaggcagtcaagtctgcagttggatttttctcactggtgaatgacaagaaacagggataattttgcactgcggagatattacgggagttgtctatatgattatatatagtacctgattctttgaacatattattgaactccaaaatgaattcgacctccattcaggcttcctgaaatctctgaagttgctgaaatttgtatattattttccttttccaatgcaagatctgctggtgacgggaaatgactgtctggttttattatggtttataaattaataaatgggctatttaattctgtatataaatttacagcaagtacgtacactggaatgaatgaggcaatcacgttacaccaaatcagcagatcaaaagacaaacacatatttctgagacttgaaggtccacatccccccgccccctgccaagatggagtcttgctttgttgctcaggctggagtgcagtggcgcagtctcagctcactacaacctccatcccccgggttcaggtgattctcgtgcctcagcctcccgagtagctgggattacaggcatgcaccaccacggctggctaattttttgtgtttttagtagagacagggtttcaccatgttggccaggctggtctcgaactcctggcctcaaatgatccgcccaccttggcctcccaaagtgctaggatgacaggcatgagccaccgtgcccagcctgattgacaatggcctcttgaaggctgggttttcccagccggacagtgcccgccccacatgctccactcccacgctttcatctgcaggcctgccttcctctcagccacctcactgctgagctctgtggtagagaatttcctttacccatcagggtatggtctggctggtaatactgactccaacccagctccttcattttatagaaggaggcatttctgaatcatgtttgttcaccatggcgagactcactgcagaatttttaaccaccttattttaagtcattcattctaggaacagtcaagcccctaccacaaaggggccagatccgttcaagtgaggaagcacttgcagtttctgaattttgctgtatatttgtcctatgtcacccaacaggccctttgctatagctgggacattaccagaccccaataccttagggtctcacagcctgaaggacacagagcattgaattattaaaagacctgaaaatatta

SEQ ID NO: 364928 - DNA, 4198 bp, Homo sapiens
  misc_feature (4059)..(4059): n is a, c, g, or t
  misc_feature (4067)..(4067): n is a, c, g, or t
cggccgcggtgggcgcgggccacggcgcggggggcccgggcgcagcgagcagcagtggtggggcgcgcgagggcgcgcgggtggcggcgctgtgcctgctgtggtacgcgctgagcgcgggcggcaacgtggtcaacaaggtgatcctgagcgccttcccgttcccggtgaccgtgtcgctgtgccacatcctggctctgtgcgctgggctcccgccgctgctgcgcgcctggcgcgtgccccccgcgccgcccgtctcgggccccggacccagtccgcatccgtcgtccggcccgctgctgccgccgcgcttctacccgcgctacgtgctaccgctcgccttcggcaagtacttcgcgtccgtgtcagcgcacgtcagcatctggaaggtgcccgtgtcctatgcacacaccgtcaaggccaccatgcccatctgggtggtcctcctgtcccggatcattatgaaggagaagcagagcaccaaggtatacttgtcactcatccccatcatcagcggtgtcctgctggccaccgtcaccgagttgtcttttgacatgtggggactcgtcagcgccctcgccgccacgctgtgcttctcgcttcagaacattttctccaaaaaggtcttgcgagattcacggatccaccatctccggctgctcaacatcctgggctgccacgccgtcttctttatgatccccacctgggttctggtggacctctcggctttcctggtcagcagcgacttgacctacgtctaccagtggccctggacgctcctgctcctggctgtcagcggcttctgtaactttgcccagaatgttatcgccttcagcatcctcaacctcgttagccccctgagctactcggtcgccaatgccaccaaaagaatcatggtcatcacggtgtccctgatcatgctgcgcaacccagtcaccagcaccaacgtcctgggcatgatgaccgccatcctgggggtcttcctctataacaagaccaagtacgatgcaaaccagcaagccaggaagcacctcctccccgtcaccacagcagacctgagcagcaaggagcgtcaccggagcccactggagaagccccacaacggcctcctcttcccccagcacggggactatcagtacggccgcaacaacatcttaacagaccacttccaatacagccggcagagctacccaaactcgtacagtttgaaccgctatgatgtgtagagtccaaaggacaggaccagactgttggtgactccttccccggcccccacagcagtatcagaaacttctgacaatcagtgaatgtacaacccagccgaggggacggtgcataactctccatcagaagccctggggttcctggccccccgtgagccgcaggaggatgcgttgcctgcagtgcagacggccgtgagctctgggcaaacctaaacagagaccagtgtctcatgctctttcttcctggagtctgtcatctgagggccgtgtccctgcggagatcttggccacgttgtacctttccatgtggaattattccccaagcagtgtagctcagagcacttgtgtctgcattccagataacattcaggacctgtgtgaaaagctggggtcactgtggctgtagaccatgaactggcagtgggggtgtccagggcggtgcttgagaacgtcagactggctagtttaattccctggcgcagatacgcataggaccaacagggtcaccaagcagacagggagcccgcgagaatcattcaaaacatccccagccacagagatggatccagtttcctggtcatccccttagcagttcacaagttcctggcaaatgttccaaagcaaaaagcgattgcaattagcatccagttcctgcagcctggtgctctgccctgcacgtcagggttggcatccacccagatccagatggaagggaaacttctctcttctcctttgcctcctcttccctcaccagagcagggcgcttctcttggggtggtgagaaggatcttcgagaaatcgtgttcagtatttcaagctctatttctgtggcacatgtcttttgagaggcatcttcacctcttctgtgatgacttggtatgttgtttggtagagagatcttgattttcggaggatcttgcatttttctagggaatattttgtagttgtgtgtgtgtgtttttgccttggtccccattatgggatgcattaggactggcctatgcatcgaaaatctttttgtttgtaaacgtttaaaaacaaagttccccggccaggcacagtggctcacacctgtaatcccagcactttgggaggccaagatgggcggatcacgaggtcaggagttcgagaccagcctggccaacatagtgaaaccccatctctactaaaaatacagaaattagccgggcatggtgtcgcgtgcctgtagtcccagctcctcaggctgctgaggcaggcgaattgcttgaacctgggaggcagaagttgtggtgagccgagattgtgcactccagcctgggtaacagagcgagactccatctcaaaaaaaaaaacaaaacaaaaccaagttcccactggtgatgcctgtctgacacgttttggtatttagtaggaaatgaagtgtttcgaagcttcgagagaagcttcaaaattgtcacaattgctgaaaacagaatgaatcgtgaacattatctcaatattttgtataatagacaagaccacagtgttttggttccctgacctgtttttgtgtttatgttaggatctgaatcatgttctgggtaaggggacgaggagcgaacactgcactaagatttggtttgccaaatcagattctttggtcaagagtcagtttggggccaggcgtggtggctcatgcctgtaatctcagcactttgggaggctgaggtgggtggatcactggagtttgagaccaccctggccaacatggtgaaaccccatctctactaaaacaaaaattagccaggcatggtggcacctgcctgtaatcccagctacttgggaggctgaggcaggagaatcacttgagcccaggaggtggaggtttcagcgagctgagatcacaccactgcactccagccttggtgacagagtgagactctgtctcaaaaaaaaaaaaaaaaaaaaggaatcagtttgggtcttggcagaaatcaacataaggaatatgacaagaccccagtaggtaaccctgagtgctcaggtccgagctgtggtctcttttacggcttcatgaaaggaccgtgccctcacggaggggaccacggcttggcttgtggggtcttaggtgatggctgccttctttcttcatcaccacacccagcttcttgctggcacttaggggaagagagcagcaaatgagagatttaccttttatctcccagcgagcgagatgtttccctgttcagagaggaagtaacatcacttatgcttgactggtgtttcttttgttgttgtttgtttttctttcaattggaattctgtatttaagatgttatgtcagctgacacatgggacactcctgaagaggtgactggccccccaccctgtttggcggtgagtttccgcaccaccggcctcagaagtgtccctcttgcttcgtctcttgttcgcttgctttgtaaatactttggtcccaagctgagacaattgctgtgtaaaacgtgaagagtcaatcccaaagggtgttatttgtcagaagaacttgccgtgtgccttcaccgaaggcagtcaagtctgcagttggatttttctcactggtgaatgacaagaaacagggataattttgcactgcggagatattacgggagttgtctatatgattatatatagtacctgattctttgaacatattattgaactccaaaatgaattcgacctccattcaggcttcctgaaatctctgaagttgctgaaatttgtatattattttccttttccaatgcaagatctgctggtgacgggaaatgactgtctggttttattatggtttataaattaataaatgggctatttaattctgtaaaaaaaaaanacttaaanaaaaaccaatacaacgaacccaatctcggcgcaacttaatactatgcgtgaatgcatcacaactacagggaatgaaaactttggggggggccccgttccaaatttcgcctttatggggaacttttcccggc

SEQ ID NO: 364929 - DNA, 5083 bp, Homo sapiens
cggccgcggtgggcgcgggccacggcgcggggggcccgggcgcagcgagcagcagtggtggggcgcgcgagggcgcgcgggtggcggcgctgtgcctgctgtggtacgcgctgagcgcgggcggcaacgtggtcaacaaggtgatcctgagcgccttcccgttcccggtgaccgtgtcgctgtgccacatcctggctctgtgcgctgggctcccgccgctgctgcgcgcctggcgcgtgccccccgcgccgcccgtctcgggccccggacccagtccgcatccgtcgtccggcccgctgctgccgccgcgcttctacccgcgctacgtgctaccgctcgccttcggcaagtacttcgcgtccgtgtcagcgcacgtcagcatctggaaggtgcccgtgtcctatgcacacaccgtcaaggccaccatgcccatctgggtggtcctcctgtcccggatcattatgaaggagaagcagagcaccaaggtatacttgtcactcatccccatcatcagcggtgtcctgctggccaccgtcaccgagttgtcttttgacatgtggggactcgtcagcgccctcgccgccacgctgtgcttctcgcttcagaacattttctccaaaaaggtcttgcgagattcacggatccaccatctccggctgctcaacatcctgggctgccacgccgtcttctttatgatccccacctgggttctggtggacctctcggctttcctggtcagcagcgacttgacctacgtctaccagtggccctggacgctcctgctcctggctgtcagcggcttctgtaactttgcccagaatgttatcgccttcagcatcctcaacctcgttagccccctgagctactcggtcgccaatgccaccaaaagaatcatggtcatcacggtgtccctgatcatgctgcgcaacccagtcaccagcaccaacgtcctgggcatgatgaccgccatcctgggggtcttcctctataacaagaccaagtacgatgcaaaccagcaagccaggaagcacctcctccccgtcaccacagcagacctgagcagcaaggagcgtcaccggagcccactggagaagccccacaacggcctcctcttcccccagcacggggactatcagtacggccgcaacaacatcttaacagaccacttccaatacagccggcagagctacccaaactcgtacagtttgaaccgctatgatgtgtagagtccaaaggacaggaccagactgttggtgactccttccccggcccccacagcagtatcagaaacttctgacaatcagtgaatgtacaacccagccgaggggacggtgcataactctccatcagaagccctggggttcctggccccccgtgagccgcaggaggatgcgttgcctgcagtgcagacggccgtgagctctgggcaaacctaaacagagaccagtgtctcatgctctttcttcctggagtctgtcatctgagggccgtgtccctgcggagatcttggccacgttgtacctttccatgtggaattattccccaagcagtgtagctcagagcacttgtgtctgcattccagataacattcaggacctgtgtgaaaagctggggtcactgtggctgtagaccatgaactggcagtgggggtgtccagggcggtgcttgagaacgtcagactggctagtttaattccctggcgcagatacgcataggaccaacagggtcaccaagcagacagggagcccgcgagaatcattcaaaacatccccagccacagagatggatccagtttcctggtcatccccttagcagttcacaagttcctggcaaatgttccaaagcaaaaagcgattgcaattagcatccagttcctgcagcctggtgctctgccctgcacgtcagggttggcatccacccagatccagatggaagggaaacttctctcttctcctttgcctcctcttccctcaccagagcagggcgcttctcttggggtggtgagaaggatcttcgagaaatcgtgttcagtatttcaagctctatttctgtggcacatgtcttttgagaggcatcttcacctcttctgtgatgacttggtatgttgtttggtagagagatcttgattttcggaggatcttgcatttttctagggaatattttgtagttgtgtgtgtgtgtttttgccttggtccccattatgggatgcattaggactggcctatgcatcgaaaatctttttgtttgtaaacgtttaaaaacaaagttccccggccaggcacagtggctcacacctgtaatcccagcactttgggaggccaagatgggcggatcacgaggtcaggagttcgagaccagcctggccaacatagtgaaaccccatctctactaaaaatacagaaattagccgggcatggtgtcgcgtgcctgtagtcccagctcctcaggctgctgaggcaggcgaattgcttgaacctgggaggcagaagttgtggtgagccgagattgtgcactccagcctgggtaacagagcgagactccatctcaaaaaaaaaaacaaaacaaaaccaagttcccactggtgatgcctgtctgacacgttttggtatttagtaggaaatgaagtgtttcgaagcttcgagagaagcttcaaaattgtcacaattgctgaaaacagaatgaatcgtgaacattatctcaatattttgtataatagacaagaccacagtgttttggttccctgacctgtttttgtgtttatgttaggatctgaatcatgttctgggtaaggggacgaggagcgaacactgcactaagatttggtttgccaaatcagattctttggtcaagagtcagtttggggccaggcgtggtggctcatgcctgtaatctcagcactttgggaggctgaggtgggtggatcactggagtttgagaccaccctggccaacatggtgaaaccccatctctactaaaacaaaaattagccaggcatggtggcacctgcctgtaatcccagctacttgggaggctgaggcaggagaatcacttgagcccaggaggtggaggtttcagcgagctgagatcacaccactgcactccagccttggtgacagagtgagactctgtctcaaaaaaaaaaaaaaaaaaaaggaatcagtttgggtcttggcagaaatcaacataaggaatatgacaagaccccagtaggtaaccctgagtgctcaggtccgagctgtggtctcttttacggcttcatgaaaggaccgtgccctcacggaggggaccacggcttggcttgtggggtcttaggtgatggctgccttctttcttcatcaccacacccagcttcttgctggcacttaggggaagagagcagcaaatgagagatttaccttttatctcccagcgagcgagatgtttccctgttcagagaggaagtaacatcacttatgcttgactggtgtttcttttgttgttgtttgtttttctttcaattggaattctgtatttaagatgttatgtcagctgacacatgggacactcctgaagaggtgactggccccccaccctgtttggcggtgagtttccgcaccaccggcctcagaagtgtccctcttgcttcgtctcttgttcgcttgctttgtaaatactttggtcccaagctgagacaattgctgtgtaaaacgtgaagagtcaatcccaaagggtgttatttgtcagaagaacttgccgtgtgccttcaccgaaggcagtcaagtctgcagttggatttttctcactggtgaatgacaagaaacagggataattttgcactgcggagatattacgggagttgtctatatgattatatatagtacctgattctttgaacatattattgaactccaaaatgaattcgacctccattcaggcttcctgaaatctctgaagttgctgaaatttgtatattattttccttttccaatgcaagatctgctggtgacgggaaatgactgtctggttttattatggtttataaattaataaatgggctatttaattctgtatataaatttacagcaagtacgtacactggaatgaatgaggcaatcacgttacaccaaatcagcagatcaaaagacaaacacatatttctgagacttgaaggtccacatccccccgccccctgccaagatggagtcttgctttgttgctcaggctggagtgcagtggcgcagtctcagctcactacaacctccatcccccgggttcaggtgattctcgtgcctcagcctcccgagtagctgggattacaggcatgcaccaccacggctggctaattttttgtgtttttagtagagacagggtttcaccatgttggccaggctggtctcgaactcctggcctcaaatgatccgcccaccttggcctcccaaagtgctaggatgacaggcatgagccaccgtgcccagcctgattgacaatggcctcttgaaggctgggttttcccagccggacagtgcccgccccacatgctccactcccacgctttcatctgcaggcctgccttcctctcagccacctcactgctgagctctgtggtagagaatttcctttacccatcagggtatggtctggctggtaatactgactccaacccagctccttcattttatagaaggaggcatttctgaatcatgtttgttcaccatggcgagactcactgcagaatttttaaccaccttattttaagtcattcattctaggaacagtcaagcccctaccacaaaggggccagatccgttcaagtgaggaagcacttgcagtttctgaattttgctgtatatttgtcctatgtcacccaacaggccctttgctatagctgggacattaccagaccccaataccttagggtctcacagcctgaaggacacagagcattgaattattaaaagacctgaaaatattataatgtttttcaattgtcacctgttttcaagacttaaatgctatagacttttctgcaggaatgacgtgtatattcctcaccatcatttatttttggtaaatgccagtgaggtcgacgcggccgcgaatttag

SEQ ID NO: 364930 - DNA, 4049 bp, Homo sapiens
cggccgcggtgggcgcgggccacggcgcggggggcccgggcgcagcgagcagcagtggtggggcgcgcgagggcgcgcgggtggcggcgctgtgcctgctgtggtacgcgctgagcgcgggcggcaacgtggtcaacaaggtgatcctgagcgccttcccgttcccggtgaccgtgtcgctgtgccacatcctggctctgtgcgctgggctcccgccgctgctgcgcgcctggcgcgtgccccccgcgccgcccgtctcgggccccggacccagtccgcatccgtcgtccggcccgctgctgccgccgcgcttctacccgcgctacgtgctaccgctcgccttcggcaagtacttcgcgtccgtgtcagcgcacgtcagcatctggaaggtgcccgtgtcctatgcacacaccgtcaaggccaccatgcccatctgggtggtcctcctgtcccggatcattatgaaggagaagcagagcaccaaggtatacttgtcactcatccccatcatcagcggtgtcctgctggccaccgtcaccgagttgtcttttgacatgtggggactcgtcagcgccctcgccgccacgctgtgcttctcgcttcagaacattttctccaaaaaggtcttgcgagattcacggatccaccatctccggctgctcaacatcctgggctgccacgccgtcttctttatgatccccacctgggttctggtggacctctcggctttcctggtcagcagcgacttgacctacgtctaccagtggccctggacgctcctgctcctggctgtcagcggcttctgtaactttgcccagaatgttatcgccttcagcatcctcaacctcgttagccccctgagctactcggtcgccaatgccaccaaaagaatcatggtcatcacggtgtccctgatcatgctgcgcaacccagtcaccagcaccaacgtcctgggcatgatgaccgccatcctgggggtcttcctctataacaagaccaagtacgatgcaaaccagcaagccaggaagcacctcctccccgtcaccacagcagacctgagcagcaaggagcgtcaccggagcccactggagaagccccacaacggcctcctcttcccccagcacggggactatcagtacggccgcaacaacatcttaacagaccacttccaatacagccggcagagctacccaaactcgtacagtttgaaccgctatgatgtgtagagtccaaaggacaggaccagactgttggtgactccttccccggcccccacagcagtatcagaaacttctgacaatcagtgaatgtacaacccagccgaggggacggtgcataactctccatcagaagccctggggttcctggccccccgtgagccgcaggaggatgcgttgcctgcagtgcagacggccgtgagctctgggcaaacctaaacagagaccagtgtctcatgctctttcttcctggagtctgtcatctgagggccgtgtccctgcggagatcttggccacgttgtacctttccatgtggaattattccccaagcagtgtagctcagagcacttgtgtctgcattccagataacattcaggacctgtgtgaaaagctggggtcactgtggctgtagaccatgaactggcagtgggggtgtccagggcggtgcttgagaacgtcagactggctagtttaattccctggcgcagatacgcataggaccaacagggtcaccaagcagacagggagcccgcgagaatcattcaaaacatccccagccacagagatggatccagtttcctggtcatccccttagcagttcacaagttcctggcaaatgttccaaagcaaaaagcgattgcaattagcatccagttcctgcagcctggtgctctgccctgcacgtcagggttggcatccacccagatccagatggaagggaaacttctctcttctcctttgcctcctcttccctcaccagagcagggcgcttctcttggggtggtgagaaggatcttcgagaaatcgtgttcagtatttcaagctctatttctgtggcacatgtcttttgagaggcatcttcacctcttctgtgatgacttggtatgttgtttggtagagagatcttgattttcggaggatcttgcatttttctagggaatattttgtagttgtgtgtgtgtgtttttgccttggtccccattatgggatgcattaggactggcctatgcatcgaaaatctttttgtttgtaaacgtttaaaaacaaagttccccggccaggcacagtggctcacacctgtaatcccagcactttgggaggccaagatgggcggatcacgaggtcaggagttcgagaccagcctggccaacatagtgaaaccccatctctactaaaaatacagaaattagccgggcatggtgtcgcgtgcctgtagtcccagctcctcaggctgctgaggcaggcgaattgcttgaacctgggaggcagaagttgtggtgagccgagattgtgcactccagcctgggtaacagagcgagactccatctcaaaaaaaaaaacaaaacaaaaccaagttcccactggtgatgcctgtctgacacgttttggtatttagtaggaaatgaagtgtttcgaagcttcgagagaagcttcaaaattgtcacaattgctgaaaacagaatgaatcgtgaacattatctcaatattttgtataatagacaagaccacagtgttttggttccctgacctgtttttgtgtttatgttaggatctgaatcatgttctgggtaaggggacgaggagcgaacactgcactaagatttggtttgccaaatcagattctttggtcaagagtcagtttggggccaggcgtggtggctcatgcctgtaatctcagcactttgggaggctgaggtgggtggatcactggagtttgagaccaccctggccaacatggtgaaaccccatctctactaaaacaaaaattagccaggcatggtggcacctgcctgtaatcccagctacttgggaggctgaggcaggagaatcacttgagcccaggaggtggaggtttcagcgagctgagatcacaccactgcactccagccttggtgacagagtgagactctgtctcaaaaaaaaaaaaaaaaaaaaggaatcagtttgggtcttggcagaaatcaacataaggaatatgacaagaccccagtaggtaaccctgagtgctcaggtccgagctgtggtctcttttacggcttcatgaaaggaccgtgccctcacggaggggaccacggcttggcttgtggggtcttaggtgatggctgccttctttcttcatcaccacacccagcttcttgctggcacttaggggaagagagcagcaaatgagagatttaccttttatctcccagcgagcgagatgtttccctgttcagagaggaagtaacatcacttatgcttgactggtgtttcttttgttgttgtttgtttttctttcaattggaattctgtatttaagatgttatgtcagctgacacatgggacactcctgaagaggtgactggccccccaccctgtttggcggtgagtttccgcaccaccggcctcagaagtgtccctcttgcttcgtctcttgttcgcttgctttgtaaatactttggtcccaagctgagacaattgctgtgtaaaacgtgaagagtcaatcccaaagggtgttatttgtcagaagaacttgccgtgtgccttcaccgaaggcagtcaagtctgcagttggatttttctcactggtgaatgacaagaaacagggataattttgcactgcggagatattacgggagttgtctatatgattatatatagtacctgattctttgaacatattattgaactccaaaatgaattcgacctccattcaggcttcctgaaatctctgaagttgctgaaatttgtatattattttccttttccaatgcaagatctgctggtgacgggaaatgactgtctggttttattatggtttataaattaataaatgggctatttaattctgta

SEQ ID NO: 364931 - DNA, 4427 bp, Homo sapiens
ttctagcactgtgggtcagcgtttctcccagcgggatgcccgccttcaccttgtgtacttcccatcccagagctgcagtcagcccctccttcaggactccagacctacgtctaccagtggccctggacgctcctgctcctggctgtcagcggcttctgtaactttgcccagaatgttatcgccttcagcatcctcaacctcgttagccccctgagctactcggtcgccaatgccaccaaaagaatcatggtcatcacggtgtccctgatcatgctgcgcaacccagtcaccagcaccaacgtcctgggcatgatgaccgccatcctgggggtcttcctctataacaagaccaagtacgatgcaaaccagcaagccaggaagcacctcctccccgtcaccacagcagacctgagcagcaaggagcgtcaccggagcccactggagaagccccacaacggcctcctcttcccccagcacggggactatcagtacggccgcaacaacatcttaacagaccacttccaatacagccggcagagctacccaaactcgtacagtttgaaccgctatgatgtgtagagtccaaaggacaggaccagactgttggtgactccttccccggcccccacagcagtatcagaaacttctgacaatcagtgaatgtacaacccagccgaggggacggtgcataactctccatcagaagccctggggttcctggccccccgtgagccgcaggaggatgcgttgcctgcagtgcagacggccgtgagctctgggcaaacctaaacagagaccagtgtctcatgctctttcttcctggagtctgtcatctgagggccgtgtccctgcggagatcttggccacgttgtacctttccatgtggaattattccccaagcagtgtagctcagagcacttgtgtctgcattccagataacattcaggacctgtgtgaaaagctggggtcactgtggctgtagaccatgaactggcagtgggggtgtccagggcggtgcttgagaacgtcagactggctagtttaattccctggcgcagatacgcataggaccaacagggtcaccaagcagacagggagcccgcgagaatcattcaaaacatccccagccacagagatggatccagtttcctggtcatccccttagcagttcacaagttcctggcaaatgttccaaagcaaaaagcgattgcaattagcatccagttcctgcagcctggtgctctgccctgcacgtcagggttggcatccacccagatccagatggaagggaaacttctctcttctcctttgcctcctcttccctcaccagagcagggcgcttctcttggggtggtgagaaggatcttcgagaaatcgtgttcagtatttcaagctctatttctgtggcacatgtcttttgagaggcatcttcacctcttctgtgatgacttggtatgttgtttggtagagagatcttgattttcggaggatcttgcatttttctagggaatattttgtagttgtgtgtgtgtgtttttgccttggtccccattatgggatgcattaggactggcctatgcatcgaaaatctttttgtttgtaaacgtttaaaaacaaagttccccggccaggcacagtggctcacacctgtaatcccagcactttgggaggccaagatgggcggatcacgaggtcaggagttcgagaccagcctggccaacatagtgaaaccccatctctactaaaaatacagaaattagccgggcatggtgtcgcgtgcctgtagtcccagctcctcaggctgctgaggcaggcgaattgcttgaacctgggaggcagaagttgtggtgagccgagattgtgcactccagcctgggtaacagagcgagactccatctcaaaaaaaaaaacaaaacaaaaccaagttcccactggtgatgcctgtctgacacgttttggtatttagtaggaaatgaagtgtttcgaagcttcgagagaagcttcaaaattgtcacaattgctgaaaacagaatgaatcgtgaacattatctcaatattttgtataatagacaagaccacagtgttttggttccctgacctgtttttgtgtttatgttaggatctgaatcatgttctgggtaaggggacgaggagcgaacactgcactaagatttggtttgccaaatcagattctttggtcaagagtcagtttggggccaggcgtggtggctcatgcctgtaatctcagcactttgggaggctgaggtgggtggatcactggagtttgagaccaccctggccaacatggtgaaaccccatctctactaaaacaaaaattagccaggcatggtggcacctgcctgtaatcccagctacttgggaggctgaggcaggagaatcacttgagcccaggaggtggaggtttcagcgagctgagatcacaccactgcactccagccttggtgacagagtgagactctgtctcaaaaaaaaaaaaaaaaaaaaggaatcagtttgggtcttggcagaaatcaacataaggaatatgacaagaccccagtaggtaaccctgagtgctcaggtccgagctgtggtctcttttacggcttcatgaaaggaccgtgccctcacggaggggaccacggcttggcttgtggggtcttaggtgatggctgccttctttcttcatcaccacacccagcttcttgctggcacttaggggaagagagcagcaaatgagagatttaccttttatctcccagcgagcgagatgtttccctgttcagagaggaagtaacatcacttatgcttgactggtgtttcttttgttgttgtttgtttttctttcaattggaattctgtatttaagatgttatgtcagctgacacatgggacactcctgaagaggtgactggccccccaccctgtttggcggtgagtttccgcaccaccggcctcagaagtgtccctcttgcttcgtctcttgttcgcttgctttgtaaatactttggtcccaagctgagacaattgctgtgtaaaacgtgaagagtcaatcccaaagggtgttatttgtcagaagaacttgccgtgtgccttcaccgaaggcagtcaagtctgcagttggatttttctcactggtgaatgacaagaaacagggataattttgcactgcggagatattacgggagttgtctatatgattatatatagtacctgattctttgaacatattattgaactccaaaatgaattcgacctccattcaggcttcctgaaatctctgaagttgctgaaatttgtatattattttccttttccaatgcaagatctgctggtgacgggaaatgactgtctggttttattatggtttataaattaataaatgggctatttaattctgtatataaatttacagcaagtacgtacactggaatgaatgaggcaatcacgttacaccaaatcagcagatcaaaagacaaacacatatttctgagacttgaaggtccacatccccccgccccctgccaagatggagtcttgctttgttgctcaggctggagtgcagtggcgcagtctcagctcactacaacctccatcccccgggttcaggtgattctcgtgcctcagcctcccgagtagctgggattacaggcatgcaccaccacggctggctaattttttgtgtttttagtagagacagggtttcaccatgttggccaggctggtctcgaactcctggcctcaaatgatccgcccaccttggcctcccaaagtgctaggatgacaggcatgagccaccgtgcccagcctgattgacaatggcctcttgaaggctgggttttcccagccggacagtgcccgccccacatgctccactcccacgctttcatctgcaggcctgccttcctctcagccacctcactgctgagctctgtggtagagaatttcctttacccatcagggtatggtctggctggtaatactgactccaacccagctccttcattttatagaaggaggcatttctgaatcatgtttgttcaccatggcgagactcactgcagaatttttaaccaccttattttaagtcattcattctaggaacagtcaagcccctaccacaaaggggccagatccgttcaagtgaggaagcacttgcagtttctgaattttgctgtatatttgtcctatgtcacccaacaggccctttgctatagctgggacattaccagaccccaataccttagggtctcacagcctgaaggacacagagcattgaattattaaaagacctgaaaatattataatgtttttcaattgtcacctgttttcaagacttaaatgctatagacttttctgcaggaatgacgtgtatattcctcactggcatttaccaaaaataaatgatggtttccagggaatcaaaa

SEQ ID NO: 364932 - DNA, 3495 bp, Homo sapiens
cggccgcggtgggcgcgggccacggcgcggggggcccgggcgcagcgagcagcagtggtggggcgcgcgagggcgcgcgggtggcggcgctgtgcctgctgtggtacgcgctgagcgcgggcggcaacgtggtcaacaaggtgatcctgagcgccttcccgttcccggtgaccgtgtcgctgtgccacatcctggctctgtgcgctgggctcccgccgctgctgcgcgcctggcgcgtgccccccgcgccgcccgtctcgggccccggacccagtccgcatccgtcgtccggcccgctgctgccgccgcgcttctacccgcgctacgtgctaccgctcgccttcggcaagtacttcgcgtccgtgtcagcgcacgtcagcatctggaaggtgcccgtgtcctatgcacacaccgtcaaggccaccatgcccatctgggtggtcctcctgtcccggatcattatgaaggagaagcagagcaccaaggtatacttgtcactcatccccatcatcagcggtgtcctgctggccaccgtcaccgagttgtcttttgacatgtggggactcgtcagcgccctcgccgccacgctgtgcttctcgcttcagaacattttctccaaaaaggtcttgcgagattcacggatccaccatctccggctgctcaacatcctgggctgccacgccgtcttctttatgatccccacctgggttctggtggacctctcggctttcctggtcagcagcgacttgacctacgtctaccagtggccctggacgctcctgctcctggctgtcagcggcttctgtaactttgcccagaatgttatcgccttcagcatcctcaacctcgttagccccctgagctactcggtcgccaatgccaccaaaagaatcatggtcatcacggtgtccctgatcatgctgcgcaacccagtcaccagcaccaacgtcctgggcatgatgaccgccatcctgggggtcttcctctataacaagaccaagtacgatgcaaaccagcaagccaggaagcacctcctccccgtcaccacagcagacctgagcagcaaggagcgtcaccggagcccactggagaagccccacaacggcctcctcttcccccagcacggggactatcagtacggccgcaacaacatcttaacagaccacttccaatacagccggcagagctacccaaactcgtacagtttgaaccgctatgatgtgtagagtccaaaggacaggaccagactgttggtgactccttccccggcccccacagcagtatcagaaacttctgacaatcagtgaatgtacaacccagccgaggggacggtgcataactctccatcagaagccctggggttcctggccccccgtgagccgcaggaggatgcgttgcctgcagtgcagacggccgtgagctctgggcaaacctaaacagagaccagtgtctcatgctctttcttcctggagtctgtcatctgagggccgtgtccctgcggagatcttggccacgttgtacctttccatgtggaattattccccaagcagtgtagctcagagcacttgtgtctgcattccagataacattcaggacctgtgtgaaaagctggggtcactgtggctgtagaccatgaactggcagtgggggtgtccagggcggtgcttgagaacgtcagactggctagtttaattccctggcgcagatacgcataggaccaacagggtcaccaagcagacagggagcccgcgagaatcattcaaaacatccccagccacagagatggatccagtttcctggtcatccccttagcagttcacaagttcctggcaaatgttccaaagcaaaaagcgattgcaattagcatccagttcctgcagcctggtgctctgccctgcacgtcagggttggcatccacccagatccagatggaagggaaacttctctcttctcctttgcctcctcttccctcaccagagcagggcgcttctcttggggtggtgagaaggatcttcgagaaatcgtgttcagtatttcaagctctatttctgtggcacatgtcttttgagaggcatcttcacctcttctgtgatgacttggtatgttgtttggtagagagatcttgattttcggaggatcttgcatttttctagggaatattttgtagttgtgtgtgtgtgtttttgccttggtccccattatgggatgcattaggactggcctatgcatcgaaaatctttttgtttgtaaacgtttaaaaacaaagttccccggccaggcacagtggctcacacctgtaatcccagcactttgggaggccaagatgggcggatcacgaggtcaggagttcgagaccagcctggccaacatagtgaaaccccatctctactaaaaatacagaaattagccgggcatggtgtcgcgtgcctgtagtcccagctcctcaggctgctgaggcaggcgaattgcttgaacctgggaggcagaagttgtggtgagccgagattgtgcactccagcctgggtaacagagcgagactccatctcaaaaaaaaaaacaaaacaaaaccaagttcccactggtgatgcctgtctgacacgttttggtatttagtaggaaatgaagtgtttcgaagcttcgagagaagcttcaaaattgtcacaattgctgaaaacagaatgaatcgtgaacattatctcaatattttgtataatagacaagaccacagtgttttggttccctgacctgtttttgtgtttatgttaggatctgaatcatgttctgggtaaggggacgaggagcgaacactgcactaagatttggtttgccaaatcagattctttggtcaagagtcagtttgggccaccgtgcccagcctgattgacaatggcctcttgaaggctgggttttcccagccggacagtgcccgccccacatgctccactcccacgctttcatctgcaggcctgccttcctctcagccacctcactgctgagctctgtggtagagaatttcctttacccatcagggtatggtctggctggtaatactgactccaacccagctccttcattttatagaaggaggcatttctgaatcatgtttgttcaccatggcgagactcactgcagaatttttaaccaccttattttaagtcattcattctaggaacagtcaagcccctaccacaaaggggccagatccgttcaagtgaggaagcacttgcagtttctgaattttgctgtatatttgtcctatgtcacccaacaggccctttgctatagctgggacattaccagaccccaataccttagggtctcacagcctgaaggacacagagcattgaattattaaaagacctgaaaatattataatgtttttcaattgtcacctgttttcaagacttaaatgctatagacttttctgcaggaatgacgtgtatattcctcactggcatttaccaaaaataaatgatggtttccagggaatcaaaa

SEQ ID NO: 364933 - DNA, 3169 bp, Homo sapiens
ccagagcaggggcgctctctggtgagggaagaggaggcaaaggagaagagagaagtttccccttccatctggatctgggcgcttctcttggggtggtgagaaggatcttcgagaaatcgtgttcagtatttcaagctctatttctgtggcacatgtcttttgagaggcatcttcacctcttctgtgatgacttggtatgttgtttggtagagagatcttgattttcggaggatcttgcatttttctagggaatattttgtagttgtgtgtgtgtgtttttgccttggtccccattatgggatgcattaggactggcctatgcatcgaaaatctttttgtttgtaaacgtttaaaaacaaagttccccggccaggcacagtggctcacacctgtaatcccagcactttgggaggccaagatgggcggatcacgaggtcaggagttcgagaccagcctggccaacatagtgaaaccccatctctactaaaaatacagaaattagccgggcatggtgtcgcgtgcctgtagtcccagctcctcaggctgctgaggcaggcgaattgcttgaacctgggaggcagaagttgtggtgagccgagattgtgcactccagcctgggtaacagagcgagactccatctcaaaaaaaaaaacaaaacaaaaccaagttcccactggtgatgcctgtctgacacgttttggtatttagtaggaaatgaagtgtttcgaagcttcgagagaagcttcaaaattgtcacaattgctgaaaacagaatgaatcgtgaacattatctcaatattttgtataatagacaagaccacagtgttttggttccctgacctgtttttgtgtttatgttaggatctgaatcatgttctgggtaaggggacgaggagcgaacactgcactaagatttggtttgccaaatcagattctttggtcaagagtcagtttggggccaggcgtggtggctcatgcctgtaatctcagcactttgggaggctgaggtgggtggatcactggagtttgagaccaccctggccaacatggtgaaaccccatctctactaaaacaaaaattagccaggcatggtggcacctgcctgtaatcccagctacttgggaggctgaggcaggagaatcacttgagcccaggaggtggaggtttcagcgagctgagatcacaccactgcactccagccttggtgacagagtgagactctgtctcaaaaaaaaaaaaaaaaaaaaggaatcagtttgggtcttggcagaaatcaacataaggaatatgacaagaccccagtaggtaaccctgagtgctcaggtccgagctgtggtctcttttacggcttcatgaaaggaccgtgccctcacggaggggaccacggcttggcttgtggggtcttaggtgatggctgccttctttcttcatcaccacacccagcttcttgctggcacttaggggaagagagcagcaaatgagagatttaccttttatctcccagcgagcgagatgtttccctgttcagagaggaagtaacatcacttatgcttgactggtgtttcttttgttgttgtttgtttttctttcaattggaattctgtatttaagatgttatgtcagctgacacatgggacactcctgaagaggtgactggccccccaccctgtttggcggtgagtttccgcaccaccggcctcagaagtgtccctcttgcttcgtctcttgttcgcttgctttgtaaatactttggtcccaagctgagacaattgctgtgtaaaacgtgaagagtcaatcccaaagggtgttatttgtcagaagaacttgccgtgtgccttcaccgaaggcagtcaagtctgcagttggatttttctcactggtgaatgacaagaaacagggataattttgcactgcggagatattacgggagttgtctatatgattatatatagtacctgattctttgaacatattattgaactccaaaatgaattcgacctccattcaggcttcctgaaatctctgaagttgctgaaatttgtatattattttccttttccaatgcaagatctgctggtgacgggaaatgactgtctggttttattatggtttataaattaataaatgggctatttaattctgtatataaatttacagcaagtacgtacactggaatgaatgaggcaatcacgttacaccaaatcagcagatcaaaagacaaacacatatttctgagacttgaaggtccacatccccccgccccctgccaagatggagtcttgctttgttgctcaggctggagtgcagtggcgcagtctcagctcactacaacctccatcccccgggttcaggtgattctcgtgcctcagcctcccgagtagctgggattacaggcatgcaccaccacggctggctaattttttgtgtttttagtagagacagggtttcaccatgttggccaggctggtctcgaactcctggcctcaaatgatccgcccaccttggcctcccaaagtgctaggatgacaggcatgagccaccgtgcccagcctgattgacaatggcctcttgaaggctgggttttcccagccggacagtgcccgccccacatgctccactcccacgctttcatctgcaggcctgccttcctctcagccacctcactgctgagctctgtggtagagaatttcctttacccatcagggtatggtctggctggtaatactgactccaacccagctccttcattttatagaaggaggcatttctgaatcatgtttgttcaccatggcgagactcactgcagaatttttaaccaccttattttaagtcattcattctaggaacagtcaagcccctaccacaaaggggccagatccgttcaagtgaggaagcacttgcagtttctgaattttgctgtatatttgtcctatgtcacccaacaggccctttgctatagctgggacattaccagaccccaataccttagggtctcacagcctgaaggacacagagcattgaattattaaaagacctgaaaatattataatgtttttcaattgtcacctgttttcaagacttaaatgctatagacttttctgcaggaatgacgtgtatattcctcactggcatttaccaaaaataaatgatggtttccagggaatcaaaa

SEQ ID NO: 364934 - DNA, 2670 bp, Homo sapiens
gagacagggtctcactgtgttgcccaggctgccctcgaatgattttttttccttagcctcccagagtgctgggattacaggcatgagccaccacgcccaacctaaactggtttttttgtttgttttttcgagactccatctcaaaaaaaaaaacaaaacaaaaccaagttcccactggtgatgcctgtctgacacgttttggtatttagtaggaaatgaagtgtttcgaagcttcgagagaagcttcaaaattgtcacaattgctgaaaacagaatgaatcgtgaacattatctcaatattttgtataatagacaagaccacagtgttttggttccctgacctgtttttgtgtttatgttaggatctgaatcatgttctgggtaaggggacgaggagcgaacactgcactaagatttggtttgccaaatcagattctttggtcaagagtcagtttggggccaggcgtggtggctcatgcctgtaatctcagcactttgggaggctgaggtgggtggatcactggagtttgagaccaccctggccaacatggtgaaaccccatctctactaaaacaaaaattagccaggcatggtggcacctgcctgtaatcccagctacttgggaggctgaggcaggagaatcacttgagcccaggaggtggaggtttcagcgagctgagatcacaccactgcactccagccttggtgacagagtgagactctgtctcaaaaaaaaaaaaaaaaaaaaggaatcagtttgggtcttggcagaaatcaacataaggaatatgacaagaccccagtaggtaaccctgagtgctcaggtccgagctgtggtctcttttacggcttcatgaaaggaccgtgccctcacggaggggaccacggcttggcttgtggggtcttaggtgatggctgccttctttcttcatcaccacacccagcttcttgctggcacttaggggaagagagcagcaaatgagagatttaccttttatctcccagcgagcgagatgtttccctgttcagagaggaagtaacatcacttatgcttgactggtgtttcttttgttgttgtttgtttttctttcaattggaattctgtatttaagatgttatgtcagctgacacatgggacactcctgaagaggtgactggccccccaccctgtttggcggtgagtttccgcaccaccggcctcagaagtgtccctcttgcttcgtctcttgttcgcttgctttgtaaatactttggtcccaagctgagacaattgctgtgtaaaacgtgaagagtcaatcccaaagggtgttatttgtcagaagaacttgccgtgtgccttcaccgaaggcagtcaagtctgcagttggatttttctcactggtgaatgacaagaaacagggataattttgcactgcggagatattacgggagttgtctatatgattatatatagtacctgattctttgaacatattattgaactccaaaatgaattcgacctccattcaggcttcctgaaatctctgaagttgctgaaatttgtatattattttccttttccaatgcaagatctgctggtgacgggaaatgactgtctggttttattatggtttataaattaataaatgggctatttaattctgtatataaatttacagcaagtacgtacactggaatgaatgaggcaatcacgttacaccaaatcagcagatcaaaagacaaacacatatttctgagacttgaaggtccacatccccccgccccctgccaagatggagtcttgctttgttgctcaggctggagtgcagtggcgcagtctcagctcactacaacctccatcccccgggttcaggtgattctcgtgcctcagcctcccgagtagctgggattacaggcatgcaccaccacggctggctaattttttgtgtttttagtagagacagggtttcaccatgttggccaggctggtctcgaactcctggcctcaaatgatccgcccaccttggcctcccaaagtgctaggatgacaggcatgagccaccgtgcccagcctgattgacaatggcctcttgaaggctgggttttcccagccggacagtgcccgccccacatgctccactcccacgctttcatctgcaggcctgccttcctctcagccacctcactgctgagctctgtggtagagaatttcctttacccatcagggtatggtctggctggtaatactgactccaacccagctccttcattttatagaaggaggcatttctgaatcatgtttgttcaccatggcgagactcactgcagaatttttaaccaccttattttaagtcattcattctaggaacagtcaagcccctaccacaaaggggccagatccgttcaagtgaggaagcacttgcagtttctgaattttgctgtatatttgtcctatgtcacccaacaggccctttgctatagctgggacattaccagaccccaataccttagggtctcacagcctgaaggacacagagcattgaattattaaaagacctgaaaatattataatgtttttcaattgtcacctgttttcaagacttaaatgctatagacttttctgcaggaatgacgtgtatattcctcactggcatttaccaaaaataaatgatggtttccagggaatcaaaa

SEQ ID NO: 364935 - DNA, 2734 bp, Homo sapiens
cggccgcggtgggcgcgggccacggcgcggggggcccgggcgcagcgagcagcagtggtggggcgcgcgagggcgcgcgggtggcggcgctgtgcctgctgtggtacgcgctgagcgcgggcggcaacgtggtcaacaaggtgatcctgagcgccttcccgttcccggtgaccgtgtcgctgtgccacatcctggctctgtgcgctgggctcccgccgctgctgcgcgcctggcgcgtgccccccgcgccgcccgtctcgggccccggacccagtccgcatccgtcgtccggcccgctgctgccgccgcgcttctacccgcgctacgtgctaccgctcgccttcggcaagtacttcgcgtccgtgtcagcgcacgtcagcatctggaaggtgcccgtgtcctatgcacacaccgtcaaggccaccatgcccatctgggtggtcctcctgtcccggatcattatgaaggagaagcagagcaccaaggtatacttgtcactcatccccatcatcagcggtgtcctgctggccaccgtcaccgagttgtcttttgacatgtggggactcgtcagcgccctcgccgccacgctgtgcttctcgcttcagaacattttctccaaaaaggtcttgcgagattcacggatccaccatctccggctgctcaacatcctgggctgccacgccgtcttctttatgatccccacctgggttctggtggacctctcggctttcctggtcagcagcgacttggtgagttgtacagcaccaagaacacgccattttcttggctagttccagaataggtgctttgttgaggagctgtagctgcatgttaacattgtggtatcttttgggcacctgacagccagcgctttcagcagtcagtcctctgtaatgcctcacggtgacgatgcacgccatcgaggaagtgggtttcctgtgtatttccttctctggtgtgcttgatcccaggtgctgatagctgctgtgtgtgcgccagtagcgtcaaggaagagaaggtgactctttcacctcctgacagtatagtccagatagcacattgactttttatttttactcattttttattttaaatgtttattttttagagacagaacctcgctctgttgccagggctggagtgcagtggcacaatcatggctcactgcggccttgacctcaatccggggctcaagcgatcctcccacagcctcccgagtaactgggactgcaggcgaataccaccatgcctggctaatttttttttgtttgatttttgtttttttactgtttttggagagacagggtctcgctatgttgcccaggctggtcctgaactcctggcgttaagagatctgccttggcctcccaaagtgctgggattacagatgtgagccactgtgccttgccagccctggaactttgaaaactatgcactggccaaaaaaaaaaaaaaaaaaaaaaaaaaagccgggcgcagtggctcacgcctgtaatcccagcactctgggaggccaaggcgggcggatcacgaggtcaggagtttgagaccagcctggccaatatggtgacaccctgtttctcccaaaaatacaaaaattagccaggcatggtggctcgcgcctgtagtcccagctacttgggaggctgaggcagaagaattgcttgaacccaggatgtggcggttgcagtgagccgagatggtgccactgcactccagcctgggtgacagagggagactccgtgtcaaaaaaaaaaagaaaaaaacgtgcgctgcctgggtgtggtggcttacgcctataatcccagcactttgggaggccaaggtgtgtgaatcattcgaggtcaggagttcgagaccagcctgaccaatatggtgaaatcctgtctctactaaaaatacaaaattagccaggcgtggtggtgcacgcctgtaatcccagccacttgggaggctgaggtgggagaatcgcttgaacccagaaggcagagtttgcagtgagccgagatcgcaccactgcactccagcctgggcaacaagtgtgaagctccgtctcaaaaaaaaaaaagaaagaaagaaaactgtgcagctcagttcctccctggtctctgtttccatttactccacgtcgaatctttttgccacctgcagggtctgccttcagagaatgtgttataaatgaatgcaagtgcctgcggtgaggaggaggccagtgcgattcttccagactcgagttagaaaggaaaagtaaatatttattgaggtcttaatgtggtctagctggatttgtgacatttcttatctttaatccttggctccacctgctgaagtagtggatattacctctattttcccaatcagtaaaccatggctcacttttctaactttcgtttcacattgatgagctgtaattcttctgtgaagaactttccatcttccaggactagtttgttaccttgaagtatggtacgagaaaggcagtttaatgcttaactgttccttttgatgactaattttcaggatagagagttggagcttactccaaatgttgaccagagttgagggtttgtttgggggtagggaaggggttctctttttttctccagcatcattgtgaacttttatgtgtttgtcagttgcatgaattgcttgaacctggaaggcggaggttgcggtgagctgagatcgtaccactgcactccagcctgggcaacaagtgtgaagctccgtctca

SEQ ID NO: 364936 - DNA, 818 bp, Homo sapiens
gcataatattggagtattcctaaatgccactgaattgtgcactttaaaacagggaagttggtaaattttatgttgtttattttaccaccaccaccacaactaaagataaagaaaacacaacaagtgtgaagctccgtctcaaaaaaaaaaaagaaagaaagaaaactgtgcagctcagttcctccctggtctctgtttccatttactccacgtcgaatctttttgccacctgcagggtctgccttcagagaatgtgttataaatgaatgcaagtgcctgcggtgaggaggaggccagtgcgattcttccagactcgagttagaaaggaaaagtaaatatttattgaggtcttaatgtggtctagctggatttgtgacatttcttatctttaatccttggctccacctgctgaagtagtggatattacctctattttcccaatcagtaaaccatggctcacttttctaactttcgtttcacattgatgagctgtaattcttctgtgaagaactttccatcttccaggactagtttgttaccttgaagtatggtacgagaaaggcagtttaatgcttaactgttccttttgatgactaattttcaggatagagagttggagcttactccaaatgttgaccagagttgagggtttgtttgggggtagggaaggggttctctttttttctccagcatcattgtgaacttttatgtgtttgtcagttgcatgaattgcttgaacctggaaggcggaggttgcggtgagctgagatcgtaccactgcactccagcctgggcaacaagtgtgaagctccgtctca

SEQ ID NO: 364937 - DNA, 472 bp, Homo sapiens
gcgcggggggcccgggcgcagcgagcagcagtggtggggcgcgcgagggcgcgcgggtggcggcgctgtgcctgctgtggtacgcgctgagcgcgggcggcaacgtggtcaacaaggtgatcctgagcgccttcccgttcccggtgaccgtgtcgctgtgccacatcctggctctgtgcgctgggctcccgccgctgctgcgcgcctggcgcgtgccccccgcgccgcccgtctcgggccccggacccagtccgcatccgtcgtccggcccgctgctgccgccgcgcttctacccgcgctacgtgctaccgctcgccttcggcaagtacttcgcgtccgtgtcagcgcacgtcagcatctggaaggtgcccgtgtcctatgcacacaccggtaggttccgcgcccggcctcgggggcggcggccgggcccgccgcttcgggtttgggcgcatggataggagtgcgccgcccg

SEQ ID NO: 364938 - DNA, 622 bp, Homo sapiens
acagcgtcttgctctgtctcccaggctggagtgcagtggtatggtcccagctcactgcaacctccgcctcctgggttcaagtgattcttgtgcctcagaacgcctgagtagctggaactacagcatgcgccaccacacccggttaattttttgtatttttagtagagacggggttttgccatgttgcccaggctggtctcaaactcctgagctcaggtgatcctcccgcctcgacctcccaaagtgctgggattacaggtgtgagccaccgcagccagccagttgattgactttgaattacgagctcttatgccccgggcatgtcctgtctcattgctctctttctggcacagaccaagtacgatgcaaaccagcaagccaggaagcacctcctccccgtcaccacagcagacctgagcagcaaggagcgtcaccggagcccactggagaagccccacaacggcctcctcttcccccagcacggggactatcagtacggccgcaacaacatcttaacagaccacttccaatacagccggcagagctacccaaactcgtacagtttgaaccgctatgatgtgtagagtccaaaggacaggaccagactgttggtgactccttc

SEQ ID NO: 364939 - DNA, 812 bp, Homo sapiens
cggccgcggtgggcgcgggccacggcgcggggggcccgggcgcagcgagcagcagtggtggggcgcgcgagggcgcgcgggtggcggcgctgtgcctgctgtggtacgcgctgagcgcgggcggcaacgtggtcaacaaggtgatcctgagcgccttcccgttcccggtgaccgtgtcgctgtgccacatcctggctctgtgcgctgggctcccgccgctgctgcgcgcctggcgcgtgccccccgcgccgcccgtctcgggccccggacccagtccgcatccgtcgtccggcccgctgctgccgccgcgcttctacccgcgctacgtgctaccgctcgccttcggcaagtacttcgcgtccgtgtcagcgcacgtcagcatctggaaggtgcccgtgtcctatgcacacaccgtcaaggccaccatgcccatctgggtggtcctcctgtcccggatcattatgaaggagaagcagagcaccaaggtaaccccgggcagggactctgggcagatgggagctccagggggttcctccctgttgccaactggtgacgtggtcaggatcctggtctgcaggctgcctggcttcccgtcaaatagggaagtcagtgtagaggtctccagtggccttttactactcaagttctagaatcaccctgtgagcagtggtgtgtggagtatgtgtccctctgtgatctctgctgtgtggtcttaggaacactgttgtccctttcagatccaattttcctccccgttttgattccctacctgggtttgctggtaggtgatgggttggtcacatcttggccat

SEQ ID NO: 364940 - DNA, 5422 bp, Homo sapiens
cggccgcggtgggcgcgggccacggcgcggggggcccgggcgcagcgagcagcagtggtggggcgcgcgagggcgcgcgggtggcggcgctgtgcctgctgtggtacgcgctgagcgcgggcggcaacgtggtcaacaaggtgatcctgagcgccttcccgttcccggtgaccgtgtcgctgtgccacatcctggctctgtgcgctgggctcccgccgctgctgcgcgcctggcgcgtgccccccgcgccgcccgtctcgggccccggacccagtccgcatccgtcgtccggcccgctgctgccgccgcgcttctacccgcgctacgtgctaccgctcgccttcggcaagtacttcgcgtccgtgtcagcgcacgtcagcatctggaaggtgcccgtgtcctatgcacacaccgtcaaggccaccatgcccatctgggtggtcctcctgtcccggatcattatgaaggagaagcagagcaccaaggtatacttgtcactcatccccatcatcagcggtgtcctgctggccaccgtcaccgagttgtcttttgacatgtggggactcgtcagcgccctcgccgccacgctgtgcttctcgcttcagaacattttctccaaaaaggtcttgcgagattcacggatccaccatctccggctgctcaacatcctgggctgccacgccgtcttctttatgatccccacctgggttctggtggacctctcggctttcctggtcagcagcgacttgacctacgtctaccagtggccctggacgctcctgctcctggctgtcagcggcttctgtaactttgcccagaatgttatcgccttcagcatcctcaacctcgttagccccctgagctactcggtcgccaatgccaccaaaagaatcatggtcatcacggtgtccctgatcatgctgcgcaacccagtcaccagcaccaacgtcctgggcatgatgaccgccatcctgggggtcttcctctataacaagaccaagtacgatgcaaaccagcaagccaggaagcacctcctccccgtcaccacagcagacctgagcagcaaggagcgtcaccggagcccactggagaagccccacaacggcctcctcttcccccagcacggggactatcagtacggccgcaacaacatcttaacagaccacttccaatacagccggcagagctacccaaactcgtacagtttgaaccgctatgatgtgtagagtccaaaggacaggaccagactgttggtgactccttccccggcccccacagcagtatcagaaacttctgacaatcagtgaatgtacaacccagccgaggggacggtgcataactctccatcagaagccctggggttcctggccccccgtgagccgcaggaggatgcgttgcctgcagtgcagacggccgtgagctctgggcaaacctaaacagagaccagtgtctcatgctctttcttcctggagtctgtcatctgagggccgtgtccctgcggagatcttggccacgttgtacctttccatgtggaattattccccaagcagtgtagctcagagcacttgtgtctgcattccagataacattcaggacctgtgtgaaaagctggggtcactgtggctgtagaccatgaactggcagtgggggtgtccagggcggtgcttgagaacgtcagactggctagtttaattccctggcgcagatacgcataggaccaacagggtcaccaagcagacagggagcccgcgagaatcattcaaaacatccccagccacagagatggatccagtttcctggtcatccccttagcagttcacaagttcctggcaaatgttccaaagcaaaaagcgattgcaattagcatccagttcctgcagcctggtgctctgccctgcacgtcagggttggcatccacccagatccagatggaagggaaacttctctcttctcctttgcctcctcttccctcaccagagcagggcgcttctcttggggtggtgagaaggatcttcgagaaatcgtgttcagtatttcaagctctatttctgtggcacatgtcttttgagaggcatcttcacctcttctgtgatgacttggtatgttgtttggtagagagatcttgattttcggaggatcttgcatttttctagggaatattttgtagttgtgtgtgtgtgtttttgccttggtccccattatgggatgcattaggactggcctatgcatcgaaaatctttttgtttgtaaacgtttaaaaacaaagttccccggccaggcacagtggctcacacctgtaatcccagcactttgggaggccaagatgggcggatcacgaggtcaggagttcgagaccagcctggccaacatagtgaaaccccatctctactaaaaatacagaaattagccgggcatggtgtcgcgtgcctgtagtcccagctcctcaggctgctgaggcaggcgaattgcttgaacctgggaggcagaagttgtggtgagccgagattgtgcactccagcctgggtaacagagcgagactccatctcaaaaaaaaaaacaaaacaaaaccaagttcccactggtgatgcctgtctgacacgttttggtatttagtaggaaatgaagtgtttcgaagcttcgagagaagcttcaaaattgtcacaattgctgaaaacagaatgaatcgtgaacattatctcaatattttgtataatagacaagaccacagtgttttggttccctgacctgtttttgtgtttatgttaggatctgaatcatgttctgggtaaggggacgaggagcgaacactgcactaagatttggtttgccaaatcagattctttggtcaagagtcagtttggggccaggcgtggtggctcatgcctgtaatctcagcactttgggaggctgaggtgggtggatcactggagtttgagaccaccctggccaacatggtgaaaccccatctctactaaaacaaaaattagccaggcatggtggcacctgcctgtaatcccagctacttgggaggctgaggcaggagaatcacttgagcccaggaggtggaggtttcagcgagctgagatcacaccactgcactccagccttggtgacagagtgagactctgtctcaaaaaaaaaaaaaaaaaaaaggaatcagtttgggtcttggcagaaatcaacataaggaatatgacaagaccccagtaggtaaccctgagtgctcaggtccgagctgtggtctcttttacggcttcatgaaaggaccgtgccctcacggaggggaccacggcttggcttgtggggtcttaggtgatggctgccttctttcttcatcaccacacccagcttcttgctggcacttaggggaagagagcagcaaatgagagatttaccttttatctcccagcgagcgagatgtttccctgttcagagaggaagtaacatcacttatgcttgactggtgtttcttttgttgttgtttgtttttctttcaattggaattctgtatttaagatgttatgtcagctgacacatgggacactcctgaagaggtgactggccccccaccctgtttggcggtgagtttccgcaccaccggcctcagaagtgtccctcttgcttcgtctcttgttcgcttgctttgtaaatactttggtcccaagctgagacaattgctgtgtaaaacgtgaagagtcaatcccaaagggtgttatttgtcagaagaacttgccgtgtgccttcaccgaaggcagtcaagtctgcagttggatttttctcactggtgaatgacaagaaacagggataattttgcactgcggagatattacgggagttgtctatatgattatatatagtacctgattctttgaacatattattgaactccaaaatgaattcgacctccattcaggcttcctgaaatctctgaagttgctgaaatttgtatattattttccttttccaatgcaagatctgctggtgacgggaaatgactgtctggttttattatggtttataaattaataaatgggctatttaattctgtatataaatttacagcaagtacgtacactggaatgaatgaggcaatcacgttacaccaaatcagcagatcaaaagacaaacacatatttctgagacttgaaggtccacatccccccgccccctgccaagatggagtcttgctttgttgctcaggctggagtgcagtggcgcagtctcagctcactacaacctccatcccccgggttcaggtgattctcgtgcctcagcctcccgagtagctgggattacaggcatgcaccaccacggctggctaattttttgtgtttttagtagagacagggtttcaccatgttggccaggctggtctcgaactcctggcctcaaatgatccgcccaccttggcctcccaaagtgctaggatgacaggcatgagccaccgtgcccagcctgattgacaatggcctcttgaaggctgggttttcccagccggacagtgcccgccccacatgctccactcccacgctttcatctgcaggcctgccttcctctcagccacctcactgctgagctctgtggtagagaatttcctttacccatcagggtatggtctggctggtaatactgactccaacccagctccttcattttatagaaggaggcatttctgaatcatgtttgttcaccatggcgagactcactgcagaatttttaaccaccttattttaagtcattcattctaggaacagtcaagcccctaccacaaaggggccagatccgttcaagtgaggaagcacttgcagtttctgaattttgctgtatatttgtcctatgtcacccaacaggccctttgctatagctgggacattaccagaccccaataccttagggtctcacagcctgaaggacacagagcattgaattattaaaagacctgaaaatattataatgtttttcaattgtcacctgttttcaagacttaaatgctatagacttttctgcaggaatgacgtgtatattcctcactggcatttaccaaaaataaatgatggtttccagggaatcaaaaaaaaaacaaaaaaaaaaaaaaaaaaaaaaaaaaaaaaaacaaaaaaaaaaaaaaaaaaaaaaaaaaaaaaaaaaaaaaggggggcgcacgtaataacaaaccacgggcgacaaagacattgaggacagccacagactgaaggaaagacgagaccacaaatgacgagagataataaccaacgagaccggggcgacaacaacacacgggtgagaagaaaccgagacggggcatgtggaaaacacactctgggggggaagaagggagacacaccagaaaaaaaaccggaagggaaaaacaaacagtaaagggaacaccagcaatgcagggaaagtgtagatttataacaac

SEQ ID NO: 364941 - DNA, 4192 bp, Homo sapiens
  misc_feature (4059)..(4059): n is a, c, g, or t
  misc_feature (4067)..(4067): n is a, c, g, or t
cggccgcggtgggcgcgggccacggcgcggggggcccgggcgcagcgagcagcagtggtggggcgcgcgagggcgcgcgggtggcggcgctgtgcctgctgtggtacgcgctgagcgcgggcggcaacgtggtcaacaaggtgatcctgagcgccttcccgttcccggtgaccgtgtcgctgtgccacatcctggctctgtgcgctgggctcccgccgctgctgcgcgcctggcgcgtgccccccgcgccgcccgtctcgggccccggacccagtccgcatccgtcgtccggcccgctgctgccgccgcgcttctacccgcgctacgtgctaccgctcgccttcggcaagtacttcgcgtccgtgtcagcgcacgtcagcatctggaaggtgcccgtgtcctatgcacacaccgtcaaggccaccatgcccatctgggtggtcctcctgtcccggatcattatgaaggagaagcagagcaccaaggtatacttgtcactcatccccatcatcagcggtgtcctgctggccaccgtcaccgagttgtcttttgacatgtggggactcgtcagcgccctcgccgccacgctgtgcttctcgcttcagaacattttctccaaaaaggtcttgcgagattcacggatccaccatctccggctgctcaacatcctgggctgccacgccgtcttctttatgatccccacctgggttctggtggacctctcggctttcctggtcagcagcgacttgacctacgtctaccagtggccctggacgctcctgctcctggctgtcagcggcttctgtaactttgcccagaatgttatcgccttcagcatcctcaacctcgttagccccctgagctactcggtcgccaatgccaccaaaagaatcatggtcatcacggtgtccctgatcatgctgcgcaacccagtcaccagcaccaacgtcctgggcatgatgaccgccatcctgggggtcttcctctataacaagaccaagtacgatgcaaaccagcaagccaggaagcacctcctccccgtcaccacagcagacctgagcagcaaggagcgtcaccggagcccactggagaagccccacaacggcctcctcttcccccagcacggggactatcagtacggccgcaacaacatcttaacagaccacttccaatacagccggcagagctacccaaactcgtacagtttgaaccgctatgatgtgtagagtccaaaggacaggaccagactgttggtgactccttccccggcccccacagcagtatcagaaacttctgacaatcagtgaatgtacaacccagccgaggggacggtgcataactctccatcagaagccctggggttcctggccccccgtgagccgcaggaggatgcgttgcctgcagtgcagacggccgtgagctctgggcaaacctaaacagagaccagtgtctcatgctctttcttcctggagtctgtcatctgagggccgtgtccctgcggagatcttggccacgttgtacctttccatgtggaattattccccaagcagtgtagctcagagcacttgtgtctgcattccagataacattcaggacctgtgtgaaaagctggggtcactgtggctgtagaccatgaactggcagtgggggtgtccagggcggtgcttgagaacgtcagactggctagtttaattccctggcgcagatacgcataggaccaacagggtcaccaagcagacagggagcccgcgagaatcattcaaaacatccccagccacagagatggatccagtttcctggtcatccccttagcagttcacaagttcctggcaaatgttccaaagcaaaaagcgattgcaattagcatccagttcctgcagcctggtgctctgccctgcacgtcagggttggcatccacccagatccagatggaagggaaacttctctcttctcctttgcctcctcttccctcaccagagcagggcgcttctcttggggtggtgagaaggatcttcgagaaatcgtgttcagtatttcaagctctatttctgtggcacatgtcttttgagaggcatcttcacctcttctgtgatgacttggtatgttgtttggtagagagatcttgattttcggaggatcttgcatttttctagggaatattttgtagttgtgtgtgtgtgtttttgccttggtccccattatgggatgcattaggactggcctatgcatcgaaaatctttttgtttgtaaacgtttaaaaacaaagttccccggccaggcacagtggctcacacctgtaatcccagcactttgggaggccaagatgggcggatcacgaggtcaggagttcgagaccagcctggccaacatagtgaaaccccatctctactaaaaatacagaaattagccgggcatggtgtcgcgtgcctgtagtcccagctcctcaggctgctgaggcaggcgaattgcttgaacctgggaggcagaagttgtggtgagccgagattgtgcactccagcctgggtaacagagcgagactccatctcaaaaaaaaaaacaaaacaaaaccaagttcccactggtgatgcctgtctgacacgttttggtatttagtaggaaatgaagtgtttcgaagcttcgagagaagcttcaaaattgtcacaattgctgaaaacagaatgaatcgtgaacattatctcaatattttgtataatagacaagaccacagtgttttggttccctgacctgtttttgtgtttatgttaggatctgaatcatgttctgggtaaggggacgaggagcgaacactgcactaagatttggtttgccaaatcagattctttggtcaagagtcagtttggggccaggcgtggtggctcatgcctgtaatctcagcactttgggaggctgaggtgggtggatcactggagtttgagaccaccctggccaacatggtgaaaccccatctctactaaaacaaaaattagccaggcatggtggcacctgcctgtaatcccagctacttgggaggctgaggcaggagaatcacttgagcccaggaggtggaggtttcagcgagctgagatcacaccactgcactccagccttggtgacagagtgagactctgtctcaaaaaaaaaaaaaaaaaaaaggaatcagtttgggtcttggcagaaatcaacataaggaatatgacaagaccccagtaggtaaccctgagtgctcaggtccgagctgtggtctcttttacggcttcatgaaaggaccgtgccctcacggaggggaccacggcttggcttgtggggtcttaggtgatggctgccttctttcttcatcaccacacccagcttcttgctggcacttaggggaagagagcagcaaatgagagatttaccttttatctcccagcgagcgagatgtttccctgttcagagaggaagtaacatcacttatgcttgactggtgtttcttttgttgttgtttgtttttctttcaattggaattctgtatttaagatgttatgtcagctgacacatgggacactcctgaagaggtgactggccccccaccctgtttggcggtgagtttccgcaccaccggcctcagaagtgtccctcttgcttcgtctcttgttcgcttgctttgtaaatactttggtcccaagctgagacaattgctgtgtaaaacgtgaagagtcaatcccaaagggtgttatttgtcagaagaacttgccgtgtgccttcaccgaaggcagtcaagtctgcagttggatttttctcactggtgaatgacaagaaacagggataattttgcactgcggagatattacgggagttgtctatatgattatatatagtacctgattctttgaacatattattgaactccaaaatgaattcgacctccattcaggcttcctgaaatctctgaagttgctgaaatttgtatattattttccttttccaatgcaagatctgctggtgacgggaaatgactgtctggttttattatggtttataaattaataaatgggctatttaattctgtaaaaaaaaaanacttaaanaaaaacactaaccccttacatattataaaataatatttaattttttaccctcccacatccaaaataatttttttttccttggggggggcccgggcccatttcgcccttttttgagttttttcccc

SEQ ID NO: 364942 - DNA, 4227 bp, Homo sapiens
cggccgcggtgggcgcgggccacggcgcggggggcccgggcgcagcgagcagcagtggtggggcgcgcgagggcgcgcgggtggcggcgctgtgcctgctgtggtacgcgctgagcgcgggcggcaacgtggtcaacaaggtgatcctgagcgccttcccgttcccggtgaccgtgtcgctgtgccacatcctggctctgtgcgctgggctcccgccgctgctgcgcgcctggcgcgtgccccccgcgccgcccgtctcgggccccggacccagtccgcatccgtcgtccggcccgctgctgccgccgcgcttctacccgcgctacgtgctaccgctcgccttcggcaagtacttcgcgtccgtgtcagcgcacgtcagcatctggaaggtgcccgtgtcctatgcacacaccgtcaaggccaccatgcccatctgggtggtcctcctgtcccggatcattatgaaggagaagcagagcaccaaggtatacttgtcactcatccccatcatcagcggtgtcctgctggccaccgtcaccgagttgtcttttgacatgtggggactcgtcagcgccctcgccgccacgctgtgcttctcgcttcagaacattttctccaaaaaggtcttgcgagattcacggatccaccatctccggctgctcaacatcctgggctgccacgccgtcttctttatgatccccacctgggttctggtggacctctcggctttcctggtcagcagcgacttgacctacgtctaccagtggccctggacgctcctgctcctggctgtcagcggcttctgtaactttgcccagaatgttatcgccttcagcatcctcaacctcgttagccccctgagctactcggtcgccaatgccaccaaaagaatcatggtcatcacggtgtccctgatcatgctgcgcaacccagtcaccagcaccaacgtcctgggcatgatgaccgccatcctgggggtcttcctctataacaagaccaagtacgatgcaaaccagcaagccaggaagcacctcctccccgtcaccacagcagacctgagcagcaaggagcgtcaccggagcccactggagaagccccacaacggcctcctcttcccccagcacggggactatcagtacggccgcaacaacatcttaacagaccacttccaatacagccggcagagctacccaaactcgtacagtttgaaccgctatgatgtgtagagtccaaaggacaggaccagactgttggtgactccttccccggcccccacagcagtatcagaaacttctgacaatcagtgaatgtacaacccagccgaggggacggtgcataactctccatcagaagccctggggttcctggccccccgtgagccgcaggaggatgcgttgcctgcagtgcagacggccgtgagctctgggcaaacctaaacagagaccagtgtctcatgctctttcttcctggagtctgtcatctgagggccgtgtccctgcggagatcttggccacgttgtacctttccatgtggaattattccccaagcagtgtagctcagagcacttgtgtctgcattccagataacattcaggacctgtgtgaaaagctggggtcactgtggctgtagaccatgaactggcagtgggggtgtccagggcggtgcttgagaacgtcagactggctagtttaattccctggcgcagatacgcataggaccaacagggtcaccaagcagacagggagcccgcgagaatcattcaaaacatccccagccacagagatggatccagtttcctggtcatccccttagcagttcacaagttcctggcaaatgttccaaagcaaaaagcgattgcaattagcatccagttcctgcagcctggtgctctgccctgcacgtcagggttggcatccacccagatccagatggaagggaaacttctctcttctcctttgcctcctcttccctcaccagagcagggcgcttctcttggggtggtgagaaggatcttcgagaaatcgtgttcagtatttcaagctctatttctgtggcacatgtcttttgagaggcatcttcacctcttctgtgatgacttggtatgttgtttggtagagagatcttgattttcggaggatcttgcatttttctagggaatattttgtagttgtgtgtgtgtgtttttgccttggtccccattatgggatgcattaggactggcctatgcatcgaaaatctttttgtttgtaaacgtttaaaaacaaagttccccggccaggcacagtggctcacacctgtaatcccagcactttgggaggccaagatgggcggatcacgaggtcaggagttcgagaccagcctggccaacatagtgaaaccccatctctactaaaaatacagaaattagccgggcatggtgtcgcgtgcctgtagtcccagctcctcaggctgctgaggcaggcgaattgcttgaacctgggaggcagaagttgtggtgagccgagattgtgcactccagcctgggtaacagagcgagactccatctcaaaaaaaaaaacaaaacaaaaccaagttcccactggtgatgcctgtctgacacgttttggtatttagtaggaaatgaagtgtttcgaagcttcgagagaagcttcaaaattgtcacaattgctgaaaacagaatgaatcgtgaacattatctcaatattttgtataatagacaagaccacagtgttttggttccctgacctgtttttgtgtttatgttaggatctgaatcatgttctgggtaaggggacgaggagcgaacactgcactaagatttggtttgccaaatcagattctttggtcaagagtcagtttggggccaggcgtggtggctcatgcctgtaatctcagcactttgggaggctgaggtgggtggatcactggagtttgagaccaccctggccaacatggtgaaaccccatctctactaaaacaaaaattagccaggcatggtggcacctgcctgtaatcccagctacttgggaggctgaggcaggagaatcacttgagcccaggaggtggaggtttcagcgagctgagatcacaccactgcactccagccttggtgacagagtgagactctgtctcaaaaaaaaaaaaaaaaaaaaggaatcagtttgggtcttggcagaaatcaacataaggaatatgacaagaccccagtaggtaaccctgagtgctcaggtccgagctgtggtctcttttacggcttcatgaaaggaccgtgccctcacggaggggaccacggcttggcttgtggggtcttaggtgatggctgccttctttcttcatcaccacacccagcttcttgctggcacttaggggaagagagcagcaaatgagagatttaccttttatctcccagcgagcgagatgtttccctgttcagagaggaagtaacatcacttatgcttgactggtgtttcttttgttgttgtttgtttttctttcaattggaattctgtatttaagatgttatgtcagctgacacatgggacactcctgaagaggtgactggccccccaccctgtttggcggtgagtttccgcaccaccggcctcagaagtgtccctcttgcttcgtctcttgttcgcttgctttgtaaatactttggtcccaagctgagacaattgctgtgtaaaacgtgaagagtcaatcccaaagggtgttatttgtcagaagaacttgccgtgtgccttcaccgaaggcagtcaagtctgcagttggatttttctcactggtgaatgacaagaaacagggataattttgcactgcggagatattacgggagttgtctatatgattatatatagtacctgattctttgaacatattattgaactccaaaatgaattcgacctccattcaggcttcctgaaatctctgaagttgctgaaatttgtatattattttccttttccaatgcaagatctgctggtgacgggaaatgactgtctggttttattatggtttataaattaataaatgggctatttaattctgtatataaatttacagcaagtacgtacactggaatgaatgaggcaatcacgttacaccaaatcagcagatcaaaagacaaacacatatttctgagacttgaaggtccacatccccccgccccctgccaagatggagtcactgcactccagcctgggtgacagagcaagactctgtctcaaa

SEQ ID NO: 364943 - DNA, 4893 bp, Homo sapiens
tggcagctgaacagatctgtggagttaggaccagccccgggctgtggccctgagcagaggctcttaatgggggtgacggtatggggatggggctacccacaaataagccctgcccctggcgctctgataaccacctgcccccagccacccaccagagcgtcactggcacagcaaacaccactttcaaagtgttaggtggtatccctttgctgagggaggagaggggctcttccctgggcatctgtggcatgtggcccagctctagtctggcctgtgagcccttcttgatgacctcttcctgcaggtatacttgtcactcatccccatcatcagcggtgtcctgctggccaccgtcaccgagttgtcttttgacatgtggggactcgtcagcgccctcgccgccacgctgtgcttctcgcttcagaacattttctccaaaaaggtcttgcgagattcacggatccaccatctccggctgctcaacatcctgggctgccacgccgtcttctttatgatccccacctgggttctggtggacctctcggctttcctggtcagcagcgacttgacctacgtctaccagtggccctggacgctcctgctcctggctgtcagcggcttctgtaactttgcccagaatgttatcgccttcagcatcctcaacctcgttagccccctgagctactcggtcgccaatgccaccaaaagaatcatggtcatcacggtgtccctgatcatgctgcgcaacccagtcaccagcaccaacgtcctgggcatgatgaccgccatcctgggggtcttcctctataacaagaccaagtacgatgcaaaccagcaagccaggaagcacctcctccccgtcaccacagcagacctgagcagcaaggagcgtcaccggagcccactggagaagccccacaacggcctcctcttcccccagcacggggactatcagtacggccgcaacaacatcttaacagaccacttccaatacagccggcagagctacccaaactcgtacagtttgaaccgctatgatgtgtagagtccaaaggacaggaccagactgttggtgactccttccccggcccccacagcagtatcagaaacttctgacaatcagtgaatgtacaacccagccgaggggacggtgcataactctccatcagaagccctggggttcctggccccccgtgagccgcaggaggatgcgttgcctgcagtgcagacggccgtgagctctgggcaaacctaaacagagaccagtgtctcatgctctttcttcctggagtctgtcatctgagggccgtgtccctgcggagatcttggccacgttgtacctttccatgtggaattattccccaagcagtgtagctcagagcacttgtgtctgcattccagataacattcaggacctgtgtgaaaagctggggtcactgtggctgtagaccatgaactggcagtgggggtgtccagggcggtgcttgagaacgtcagactggctagtttaattccctggcgcagatacgcataggaccaacagggtcaccaagcagacagggagcccgcgagaatcattcaaaacatccccagccacagagatggatccagtttcctggtcatccccttagcagttcacaagttcctggcaaatgttccaaagcaaaaagcgattgcaattagcatccagttcctgcagcctggtgctctgccctgcacgtcagggttggcatccacccagatccagatggaagggaaacttctctcttctcctttgcctcctcttccctcaccagagcagggcgcttctcttggggtggtgagaaggatcttcgagaaatcgtgttcagtatttcaagctctatttctgtggcacatgtcttttgagaggcatcttcacctcttctgtgatgacttggtatgttgtttggtagagagatcttgattttcggaggatcttgcatttttctagggaatattttgtagttgtgtgtgtgtgtttttgccttggtccccattatgggatgcattaggactggcctatgcatcgaaaatctttttgtttgtaaacgtttaaaaacaaagttccccggccaggcacagtggctcacacctgtaatcccagcactttgggaggccaagatgggcggatcacgaggtcaggagttcgagaccagcctggccaacatagtgaaaccccatctctactaaaaatacagaaattagccgggcatggtgtcgcgtgcctgtagtcccagctcctcaggctgctgaggcaggcgaattgcttgaacctgggaggcagaagttgtggtgagccgagattgtgcactccagcctgggtaacagagcgagactccatctcaaaaaaaaaaacaaaacaaaaccaagttcccactggtgatgcctgtctgacacgttttggtatttagtaggaaatgaagtgtttcgaagcttcgagagaagcttcaaaattgtcacaattgctgaaaacagaatgaatcgtgaacattatctcaatattttgtataatagacaagaccacagtgttttggttccctgacctgtttttgtgtttatgttaggatctgaatcatgttctgggtaaggggacgaggagcgaacactgcactaagatttggtttgccaaatcagattctttggtcaagagtcagtttggggccaggcgtggtggctcatgcctgtaatctcagcactttgggaggctgaggtgggtggatcactggagtttgagaccaccctggccaacatggtgaaaccccatctctactaaaacaaaaattagccaggcatggtggcacctgcctgtaatcccagctacttgggaggctgaggcaggagaatcacttgagcccaggaggtggaggtttcagcgagctgagatcacaccactgcactccagccttggtgacagagtgagactctgtctcaaaaaaaaaaaaaaaaaaaaggaatcagtttgggtcttggcagaaatcaacataaggaatatgacaagaccccagtaggtaaccctgagtgctcaggtccgagctgtggtctcttttacggcttcatgaaaggaccgtgccctcacggaggggaccacggcttggcttgtggggtcttaggtgatggctgccttctttcttcatcaccacacccagcttcttgctggcacttaggggaagagagcagcaaatgagagatttaccttttatctcccagcgagcgagatgtttccctgttcagagaggaagtaacatcacttatgcttgactggtgtttcttttgttgttgtttgtttttctttcaattggaattctgtatttaagatgttatgtcagctgacacatgggacactcctgaagaggtgactggccccccaccctgtttggcggtgagtttccgcaccaccggcctcagaagtgtccctcttgcttcgtctcttgttcgcttgctttgtaaatactttggtcccaagctgagacaattgctgtgtaaaacgtgaagagtcaatcccaaagggtgttatttgtcagaagaacttgccgtgtgccttcaccgaaggcagtcaagtctgcagttggatttttctcactggtgaatgacaagaaacagggataattttgcactgcggagatattacgggagttgtctatatgattatatatagtacctgattctttgaacatattattgaactccaaaatgaattcgacctccattcaggcttcctgaaatctctgaagttgctgaaatttgtatattattttccttttccaatgcaagatctgctggtgacgggaaatgactgtctggttttattatggtttataaattaataaatgggctatttaattctgtatataaatttacagcaagtacgtacactggaatgaatgaggcaatcacgttacaccaaatcagcagatcaaaagacaaacacatatttctgagacttgaaggtccacatccccccgccccctgccaagatggagtcttgctttgttgctcaggctggagtgcagtggcgcagtctcagctcactacaacctccatcccccgggttcaggtgattctcgtgcctcagcctcccgagtagctgggattacaggcatgcaccaccacggctggctaattttttgtgtttttagtagagacagggtttcaccatgttggccaggctggtctcgaactcctggcctcaaatgatccgcccaccttggcctcccaaagtgctaggatgacaggcatgagccaccgtgcccagcctgattgacaatggcctcttgaaggctgggttttcccagccggacagtgcccgccccacatgctccactcccacgctttcatctgcaggcctgccttcctctcagccacctcactgctgagctctgtggtagagaatttcctttacccatcagggtatggtctggctggtaatactgactccaacccagctccttcattttatagaaggaggcatttctgaatcatgtttgttcaccatggcgagactcactgcagaatttttaaccaccttattttaagtcattcattctaggaacagtcaagcccctaccacaaaggggccagatccgttcaagtgaggaagcacttgcagtttctgaattttgctgtatatttgtcctatgtcacccaacaggccctttgctatagctgggacattaccagaccccaataccttagggtctcacagcctgaaggacacagagcattgaattattaaaagacctgaaaatattataatgtttttcaattgtcacctgttttcaagacttaaatgctatagacttttctgcaggaatgacgtgtatattcctcactggcatttaccaaaaataaatgatggtttccagggaatcaaaa

SEQ ID NO: 364944 - DNA, 2408 bp, Homo sapiens
  misc_feature (2298)..(2298): n is a, c, g, or t
cggccgcggtgggcgcgggccacggcgcggggggcccgggcgcagcgagcagcagtggtggggcgcgcgagggcgcgcgggtggcggcgctgtgcctgctgtggtacgcgctgagcgcgggcggcaacgtggtcaacaaggtgatcctgagcgccttcccgttcccggtgaccgtgtcgctgtgccacatcctggctctgtgcgctgggctcccgccgctgctgcgcgcctggcgcgtgccccccgcgccgcccgtctcgggccccggacccagtccgcatccgtcgtccggcccgctgctgccgccgcgcttctacccgcgctacgtgctaccgctcgccttcggcaagtacttcgcgtccgtgtcagcgcacgtcagcatctggaaggtgcccgtgtcctatgcacacaccgtcaaggccaccatgcccatctgggtggtcctcctgtcccggatcattatgaaggagaagcagagcaccaaggtatacttgtcactcatccccatcatcagcggtgtcctgctggccaccgtcaccgagttgtcttttgacatgtggggactcgtcagcgccctcgccgccacgctgtgcttctcgcttcagaacattttctccaaaaaggtcttgcgagattcacggatccaccatctccggctgctcaacatcctgggctgccacgccgtcttctttatgatccccacctgggttctggtggacctctcggctttcctggtcagcagcgacttgacctacgtctaccagtggccctggacgctcctgctcctggctgtcagcggcttctgtaactttgcccagaatgttatcgccttcagcatcctcaacctcgttagccccctgagctactcggtcgccaatgccaccaaaagaatcatggtcatcacggtgtccctgatcatgctgcgcaacccagtcaccagcaccaacgtcctgggcatgatgaccgccatcctgggggtcttcctctataacaagaccaagtacgatgcaaaccagcaagccaggaagcacctcctccccgtcaccacagcagacctgagcagcaaggagcgtcaccggagcccactggagaagccccacaacggcctcctcttcccccagcacggggactatcagtacggccgcaacaacatcttaacagaccacttccaatacagccggcagagctacccaaactcgtacagtttgaaccgctatgatgtgtagagtccaaaggacaggaccagactgttggtgactccttccccggcccccacagcagtatcagaaacttctgacaatcagtgaatgtacaacccagccgaggggacggtgcataactctccatcagaagccctggggttcctggccccccgtgagccgcaggaggatgcgttgcctgcagtgcagacggccgtgagctctgggcaaacctaaacagagaccagtgtctcatgctctttcttcctggagtctgtcatctgagggccgtgtccctgcggagatcttggccacgttgtacctttccatgtggaattattccccaagcagtgtagctcagagcacttgtgtctgcattccagataacattcaggacctgtgtgaaaagctggggtcactgtggctgtagaccatgaactggcagtgggggtgtccagggcggtgcttgagaacgtcagactggctagtttaattccctggcgcagatacgcataggaccaacagggtcaccaagcagacagggagcccgcgagaatcattcaaaacatccccagccacagagatggatccagtttcctggtcatccccttagcagttcacaagttcctggcaaatgttccaaagcaaaaagcgattgcaattagcatccagttcctgcagcctggtgctctgccctgcacgtcagggttggcatccacccagatccagatggaagggaaacttctctcttctcctttgcctcctcttccctcaccagagcagggcgcttctcttggggtggtgagaaggatcttcgagaaatcgtgttcagtatttcaagctctatttctgtggcacatgtcttttgagaggcatcttcacctcttctgtgatgacttggtatgttgtttggtagagagatcttgattttcggaggatcttgcatttttctagggaatattttgtagttgtgtgtgtgtgtttttgccttggtccccattatgggatgcattaggactggcctatgcatcgaaaatctttttgtttgtaaacgtttaaaaacaaagttccccaaagtgccgggattaacggcgccccngcacgcccggctgtctgttaggtttttttctattttcttttttgccttcatctcttgcttcccaggctcctgacaatcctacgttggtggcagcagcagcaggcaaatca

SEQ ID NO: 364945 - DNA, 1562 bp, Homo sapiens
  misc_feature (1435)..(1435): n is a, c, g, or t
  misc_feature (1450)..(1450): n is a, c, g, or t
  misc_feature (1467)..(1467): n is a, c, g, or t
  misc_feature (1489)..(1489): n is a, c, g, or t
  misc_feature (1520)..(1520): n is a, c, g, or t
  misc_feature (1530)..(1530): n is a, c, g, or t
  misc_feature (1537)..(1537): n is a, c, g, or t
  misc_feature (1546)..(1546): n is a, c, g, or t
  misc_feature (1552)..(1552): n is a, c, g, or t
cggccgcggtgggcgcgggccacggcgcggggggcccgggcgcagcgagcagcagtggtggggcgcgcgagggcgcgcgggtggcggcgctgtgcctgctgtggtacgcgctgagcgcgggcggcaacgtggtcaacaaggtgatcctgagcgccttcccgttcccggtgaccgtgtcgctgtgccacatcctggctctgtgcgctgggctcccgccgctgctgcgcgcctggcgcgtgccccccgcgccgcccgtctcgggccccggacccagtccgcatccgtcgtccggcccgctgctgccgccgcgcttctacccgcgctacgtgctaccgctcgccttcggcaagtacttcgcgtccgtgtcagcgcacgtcagcatctggaaggtgcccgtgtcctatgcacacaccgtcaaggccaccatgcccatctgggtggtcctcctgtcccggatcattatgaaggagaagcagagcaccaaggtatacttgtcactcatccccatcatcagcggtgtcctgctggccaccgtcaccgagttgtcttttgacatgtggggactcgtcagcgccctcgccgccacgctgtgcttctcgcttcagaacattttctccaaaaaggtcttgcgagattcacggatccaccatctccggctgctcaacatcctgggctgccacgccgtcttctttatgatccccacctgggttctggtggacctctcggctttcctggtcagcagcgacttggtgagttgtacagcaccaagaacacgccattttcttggctagttccagaataggtgctttgttgaggagctgtagctgcatgttaacattgtggtatcttttgggcacctgacagccagcgctttcagcagtcagtcctctgtaatgcctcacggtgacgatgcacgccatcgaggaagtgggtttcctgtgtatttccttctctggtgtgcttgatcccaggtgctgatagctgctgtgtgtgcgccagtagcgtcaaggaagagaaggtgactctttcacctcctgacagtatagtccagatagcacattgactttttatttttactcattttttattttaaatgtttattttttagagacagaacctcgctctgcactccagcctgggtgacagagggagactttgtctcaaaaaaactattttttaaaaagagggaatgggggagccttatagaggatcagggcttcaaaccctggtgcgtcagtggcagctgaacagatctgtggagttaggaccagccccgggctgtggcctggagcagaggctcttaatgggggtgacggtatggggatggggctacccacaaataagccctgcccctggcgctctgataaccacctgcccccagccacccaccagagcgtcactggcacagcaaacaccactttcaaagtgttaggtngtattccctttggtngagggaggagaggggtnttccctggggcatctgtgggcntgtgggcccagtgttagttatgggcctgtgnagccttattnggttganctcttgccnacgagntgttattgtt

SEQ ID NO: 364946 - DNA, 780 bp, Homo sapiens
ctcaacgctttatacttctggatatatttcctgtccaagagaagaatcatactgtagtatctcctagagcattagaactaagtgatccagtacttgatgagcaccaccaaggtgatcaagatggaggagatcaagatgaaagggctgaaaaatcaaaattaactgggaccaggcaaaatcattcattcatatggtcaggggcatcatttgatctaagtccaggactgcaaaggattttagataaagtatccagtcctctagaaaatgaaaagctaaaatcaatgactataaacttttccagtttgaatagaaaaaatacagagttaaatgaagaacaagaagttatttcaaacttggagacaaaacaagtgcagggaatttcattttcttctaataatgaagtataaagcgttgagtcaacgctttatacttcagagaagcttcagatgaaagaaatgacctgccgtgatatcgttaaagaagttgcaaaaataatttacatagtacatgacgaagttaaggataaagcttttgaactagaactcagctgggttggtgaattaactaatggaagacatgaaattgttccaaaagatataagagaagaagcagagaaatatgctaaggaatctctgaaggaagaagatgaatcagatgatgataatatgtaacatttactccagcatctattgtattttaaatttctactccagtccaatgtaactatttagccctggattatacatactgtccaattttcattaaatttttgtcttataa

SEQ ID NO: 364947 - DNA, 509 bp, Homo sapiens
taaggattggggttgaagggaactcggacagaccacatggggttcgcggacccggggtgctctgagaccgccttcggctgggtgggccatttgcagctgtttggagaccggtcgtctttatcccctatatgctaggcctgcgtctcaggtgaccgtgactcctgaagcttttcagcgcaggtgtagccggcttggcgtcgccgcagtgaggtttggagccgctttggattgctgagtcactttcttcagccacttagggaaaccgaaagtggaaactcgtggggcttgaaatagtgtgttctcttgagaaccaccgaggcagtgagatttgggattccggggtctggagatcgtgctttttgtggactgcgtttgcagttcctagggtgctgctgattcacaggccttctctgtctttaagtgtgcagatcattgaccgctcagtttaagagtcactggaaatcctgtcggaacagaactaataaaaatggtctgaaaaacaaaaaaaa

SEQ ID NO: 364948 - DNA, 276 bp, Homo sapiens
gcggccgactactactactactactgctcgaattcaagcttctaacgatgtacggggtaactaatggaagacatgaaattgttccaaaagatataagagaagaagcagagaaatatgctaaggaatctctgaaggaagaagatgaatcagatgatgataatatgtaacatttactccagcatctattgtattttaaatttctactccagtccaatgtaactatttagccctggattatacatactgtccaattttcattaaatttttgtcttataa

SEQ ID NO: 364949 - DNA, 983 bp, Homo sapiens
ggcagttcagccaatgagcgggcctgttactagtttgcggcatcctgtggtataggggaagcgctccgggcctggaatccctacgcgtccctttgggtttagcacgatgagctcaatcggcactgggtatgacctgtcagcctctacattctctcctgacggaagagtttttcaagttgaatatgctatgaaggctgtggaaaatagtagtacagctattggaatcagatgcaaagatggtgttgtctttggggtagaaaaattagtcctttctaaactttatgaagaaggttccaacaaaagactttttaatgttgatcggcatgttggaatggcagtagcaggtttgttggcagatgctcgttctttagcagacatagcaagagaagaagcttccaacttcagatctaactttggctacaacattccactaaaacatcttgcagacagagtggccatgtatgtgcatgcatatacactctacagtgctgttagaccttttggctgcagtttcatgttagggtcttacagtgtgaatgacggtgcgcaactctacatgattgacccatcaggtgtttcatacggttattggggctgtgccatcggcaaagccaggcaagctgcaaagacggaaatagagaagcttcagatgaaagaaatgacctgccgtgatatcgttaaagaagttgcaaaaataatttacatagtacatgacgaagttaaggataaagcttttgaactagaactcagctgggttggtgaattaactaatggaagacatgaaattgttccaaaagatataagagaagaagcagagaaatatgctaaggaatctctgaaggaagaagatgaatcagatgatgataatatgtaacatttactccagcatctattgtattttaaatttctactccagtccaatgtaactatttagccctggattatacatactgtccaattttcattaaatttttgtcttataa

SEQ ID NO: 364950 - DNA, 1008 bp, Homo sapiens
ggcagttcagccaatgagcgggcctgttactagtttgcggcatcctgtggtataggggaagcgctccgggcctggaatccctacgcgtccctttgggtttagcacgatgagctcaatcggcactgggtatgacctgtcagcctctacattctctcctgacggaagagtttttcaagttgaatatgctatgaaggctgtggaaaatagtagtacagctattggaatcagatgcaaagatggtgttgtctttggggtagaaaaattagtcctttctaaactttatgaagaaggttccaacaaaagactttttaatgttgatcggcatgttggaatggcagtagcaggtttgttggcagatgctcgttctttagcagacatagcaagagaagaagcttccaacttcagatctaactttggctacaacattccactaaaacatcttgcagacagagtggccatgtatgtgcatgcatatacactctacagtgctgttagaccttttggctgcagtttcatgttagggtcttacagtgtgaatgacggtgcgcaactctacatgattgacccatcaggtgtttcatacggttattggggctgtgccatcggcaaagccaggcaagctgcaaagacggaaatagagaagcttcagatgaaagaaatgacctgccgtgatatcgttaaagaagttgcaaaaataatttacatagtacatgacgaagttaaggataaagcttttgaactagaactcagctgggttggtgaattaactaatggaagacatgaaattgttccaaaagatataagagaagaagcagagaaatatgctaaggaatctctgaaggaagaagatgaatcagatgatgataatatgtaacatttactccagcatctattgtattttaaatttctactccagtccaatgtaactatttagccctggattatacatactgtccaattttcattaaatttttgtcttataaaaaaaaaaaaaaaagtggaaaaaaa

SEQ ID NO: 364951 - DNA, 1021 bp, Homo sapiens
  misc_feature (1)..(1): n is a, c, g, or t
  misc_feature (49)..(50): n is a, c, g, or t
  misc_feature (93)..(93): n is a, c, g, or t
  misc_feature (95)..(95): n is a, c, g, or t
  misc_feature (97)..(97): n is a, c, g, or t
nccacccccagccaggctatggttgccaccccaacccaataaaactganngttactagcctctcaaaaaaaaaaacctcgtgccgaattcggngngncagcatccgggcctggaatccctacgcgtccctttgggtttagcacgatgagctcaatcggcactgggtatgacctgtcagcctctacattctctcctgacggaagagtttttcaagttgaatatgctatgaaggctgtggaaaatagtagtacagctattggaatcagatgcaaagatggtgttgtctttggggtagaaaaattagtcctttctaaactttatgaagaaggttccaacaaaagactttttaatgttgatcggcatgttggaatggcagtagcaggtttgttggcagatgctcgttctttagcagacatagcaagagaagaagcttccaacttcagatctaactttggctacaacattccactaaaacatcttgcagacagagtggccatgtatgtgcatgcatatacactctacagtgctgttagaccttttggctgcagtttcatgttagggtcttacagtgtgaatgacggtgcgcaactctacatgattgacccatcaggtgtttcatacggttattggggctgtgccatcggcaaagccaggcaagctgcaaagacggaaatagagaagcttcagatgaaagaaatgacctgccgtgatatcgttaaagaagttgcaaaaataatttacatagtacatgacgaagttaaggataaagcttttgaactagaactcagctgggttggtgaattaactaatggaagacatgaaattgttccaaaagatataagagaagaagcagagaaatatgctaaggaatctctgaaggaagaagatgaatcagatgatgataatatgtaacatttactccagcatctattgtattttaaatttctactccagtccaatgtaactatttagccctggattatacatactgtccaattttcattaaatttttgtcttataa

SEQ ID NO: 364952 - DNA, 1835 bp, Homo sapiens
ggcagttcagccaatgagcgggcctgttactagtttgcggcatcctgtggtataggggaagcgctccgggcctggaatccctacgcgtccctttgggtttagcacgatgagctcaatcggcactgggtatgacctgtcagcctctacattctctcctgacggaagagtttttcaagttgaatatgctatgaaggctgtggaaaatagtagtacagctattggaatcagatgcaaagatggtgttgtctttggggtagaaaaattagtcctttctaaactttatgaagaaggttccaacaaaagactttttaatgttgatcggcatgttggaatggcagtagcaggtttgttggcagatgctcgttctttagcagacatagcaagagaagaagcttccaacttcagatctaactttggctacaacattccactaaaacatcttgcagacagagtggccatgtatgtgcatgcatatacactctacagtgctgttagaccttttggctgcagtttcatgttagggtcttacagtgtgaatgacggtgcgcaactctacatgattgacccatcaggtgtttcatacggttattggggctgtgccatcggcaaagccaggcaagctgcaaagacggaaatagagaagcttcagatgaaagaaatgacctgccgtgatatcgttaaagaagttgcaaaaataatttacatagtacatgacgaagttaaggataaagcttttgaactagaactcagctgggttggtgaattaactaatggaagacatgaaattgttccaaaagatataagagaagaagcagagaaatatgctaaggtaagccacagcacaaaaacttctcttggccaggtacagtcagggaatcacttagcccaggagtttgagaccagcctgagcagcacagcaagacccccatccctaatttaaaaaaaaaaaaaaattctctaaccaaaattatgtgttgaataatataaatagactggggtggtttctatgaaataacactgagagttcagttgaactaaagatagaaattttctaggttatctctagtgggtaaagttgccttggttccaaaaaaaaaaaacttgggaggtttagactgcaaagagttttttaggacttttaatactttaaatatttgttcttttttttttttttttttgagacggagtcttgctctgtcacccaggctggagggcagtggcaccatctctgctcactgcaacctctgcctccagggttcaagcgatcctcctgcctccgcctcccaagtagctgggattacaggaacatgccaccatacctggctacttttgtatttttggcttcaccaataatacagagacgggttttcaccaggctagtttcaaactcttgaactcacgtgatctgcctactttggcccccgtaaagtgctgggattacaggcatgaacactgcaccaggcctcttaagtatatattctatcaaagatacagtcattgcatgttagagcaacatttgcttaattaactttgcttgggtatcttattctgaaactgttcattcagttacaagtagaggaatttaaccacttaattcaggttgttgtagcttaacttgcccacaggtgtgggatataacaattttaaaaatcaattttaaacacctgttttctcttaacaggaatctctgaaggaagaagatgaatcagatgatgataatatgtaacatttactccagcatctattgtattttaaatttctactccagtccaatgtaactatttagccctggattatacatactgtccaattttcattaaatttttgtcttataa

SEQ ID NO: 364953 - DNA, 1135 bp, Homo sapiens
ggcagttcagccaatgagcgggcctgttactagtttgcggcatcctgtggtataggggaagcgctccgggcctggaatccctacgcgtccctttgggtttagcacgatgagctcaatcggcactgggtatgacctgtcagcctctacattctctcctgacggaagagtttttcaagttgaatatgctatgaaggctgtggaaaatagtagtacagctattggaatcagatgcaaagatggtgttgtctttggggtagaaaaattagtcctttctaaactttatgaagaaggttccaacaaaagactttttaatgttgatcggcatgttggaatggcagtagcaggtttgttggcagatgctcgttctttagcagacatagcaagagaagaagcttccaacttcagatctaactttggctacaacattccactaaaacatcttgcagacagagtggccatgtatgtgcatgcatatacactctacagtgctgttagaccttttggctgcagtttcatgttagggtcttacagtgtgaatgacggtgcgcaactctacatgattgacccatcaggtgtttcatacggttattggggctgtgccatcggcaaagccaggcaagctgcaaagacggaaatagagaagcttcagatgaaagaaatgacctgccgtgatatcgttaaagaagttgcaaaaataatttacatagtacatgacgaagttaaggataaagcttttgaactagaactcagctgggttggtgaattaactaatggaagacatgaaattgttccaaaagatataagagaagaagcagagaaatatgctaaggtaagccacagcacaaaaacttctcttggccaggtacagtcagggaatcacttagcccaggagtttgagaccagcgtgggtggatcacctgaggtcaggagttcgagaccagcctgaccaacatggtgaaatcctgtctctactaaaaatacaaaaattagctgggtgtggtggcaggcacctgtaatcccagctgctcaggaggctgaggcaggagaattgcttgaacccgggaggcggaggttgcagtgagccaagatcatgccgttgcactccagcctgggtaacagagctagactccatctc

SEQ ID NO: 364954 - DNA, 3298 bp, Homo sapiens
ggcagttcagccaatgagcgggcctgttactagtttgcggcatcctgtggtataggggaagcgctccgggcctggaatccctacgcgtccctttgggtttagcacgatgagctcaatcggcactgggtatgacctgtcagcctctacattctctcctgacggaagagtttttcaagttgaatatgctatgaaggctgtggaaaatagtagtacagctattggaatcagatgcaaagatggtgttgtctttggggtagaaaaattagtcctttctaaactttatgaagaaggttccaacaaaagactttttaatgttgatcggcatgttggaatggcagtagcaggtttgttggcagatgctcgttctttagcagacatagcaagagaagaagcttccaacttcagatctaactttggctacaacattccactaaaacatcttgcagacagagtggccatgtatgtgcatgcatatacactctacagtgctgttagaccttttggctgcagtttcatgttagggtcttacagtgtgaatgacggtgcgcaactctacatgattgacccatcaggtgtttcatacggttattggggctgtgccatcggcaaagccaggcaagctgcaaagacggaaatagagaagcttcagatgaaagaaatgacctgccgtgatatcgttaaagaagttgcaaaaataatttacatagtacatgacgaagttaaggataaagcttttgaactagaactcagctgggttggtgaatgtaagttatttttgtacatttatttgccttaggaatgatctgtaccacagctaatttacaactgagtgtcctttctaatataatgaaagctaaagcaaatttactaggttgtctaatgaagggaaagttctgcttaataattgacttaagttgtgaacacgttattttttgaaacatccatttcatggttttaagatactatgctataaattaatgctcaggatttataaatagcataatttactttcatttccataagaacttaatatgtaggcacatataatctcatgtagaagcagcacacaaaaatattcgagtattactcatagtacaactttgcaaccttaggtgagtcagatatgtggattgggtagatcctatggtatactgcaagttacaatatggtactcaatttaaaattcatttacacatgtggcttaatttacagttaactaatggaagacatgaaattgttccaaaagatataagagaagaagcagagaaatatgctaaggtaagccacagcacaaaaacttctcttggccaggtacagtcagggaatcacttagcccaggagtttgagaccagcctgagcagcacagcaagacccccatccctaatttaaaaaaaaaaaaaaattctctaaccaaaattatgtgttgaataatataaatagactggggtggtttctatgaaataacactgagagttcagttgaactaaagatagaaattttctaggttatctctagtgggtaaagttgccttggttccaaaaaaaaaaaacttgggaggtttagactgcaaagagttttttaggacttttaatactttaaatatttgttcttttttttttttttttttgagacggagtcttgctctgtcacccaggctggagggcagtggcaccatctctgctcactgcaacctctgcctccagggttcaagcgatcctcctgcctccgcctcccaagtagctgggattacaggaacatgccaccatacctggctacttttgtatttttggcttcaccaataatacagagacgggttttcaccaggctagtttcaaactcttgaactcacgtgatctgcctactttggcccccgtaaagtgctgggattacaggcatgaacactgcaccaggcctcttaagtatatattctatcaaagatacagtcattgcatgttagagcaacatttgcttaattaactttgcttgggtatcttattctgaaactgttcattcagttacaagtagaggaatttaaccacttaattcaggttgttgtagcttaacttgcccacaggtgtgggatataacaattttaaaaatcaattttaaacacctgttttctcttaacaggaatctctgaaggaagaagatgaatcagatgatgataatatgtaacatttactccagcatctattgtattttaaatttctactccagtccaatgtaactatttagccctggattatacatactgtccaattttcattaaatttttgtcttataactattgaagtttggttaatatctgctttacaaaattggtgggggtaaatgaggacatttactcagtattaaaatatagatttatgactactgaaaaattccctggttaaaatgctgcagaattaattccaagactgtagattaattcaaagccccatcttcatcactcaactagaatttacagatcatattctcctgggcttttgtacaaaaagcacctaccaacttagtggacaaataactgatacggtttcccaccttcatatgaagtaactggtggtcatcagtcactgttaatctttagatgtgatacagatgacagatgtttcagttttggataatttttcaaaaactgacccttcctcaaaaaagacccttcaatacatgagtcaaggatgtttttgcttttttcctttattgtggtgaggggcggatttaaggatcaataaagtccctattctgtcactaaaaaaatttcttgatctctaaagattaaaataaaaataccaacatcagacagctttcatgttaaaaatcagaatttatgttaaagtgctctgtaaacagaactgttactaagtggaataaacagtactgtggccgataagaataacttgaagctgaaaagcagtactcacagcaggaacaatttgaactcaggccatgtatacacaccctctagtggactcatgccagtgtcactccattgaagtgttgtgctttcctaagaaggtaatctagccactgaatttgggtgcagggtatcgctggactttgagcatttgtgtagtttaaatagcaaatcattatacctgagtattaatagctaactactacacaaacaactcaaaaccagtaatgtcatgtcattaccatggcttcttttatgtaacattatctgctacattttaccactcaaaatatatttaaaatatgtattttaaaatatattagagcatatggctcaagcaatcctcccacctcagcctcccaagtagctgggaccacaggcaag

SEQ ID NO: 364955 - DNA, 859 bp, Homo sapiens
ggcagttcagccaatgagcgggcctgttactagtttgcggcatcctgtggtataggggaagcgctccgggcctggaatccctacgcgtccctttgggtttagcacgatgagctcaatcggcactgggtatgacctgtcagcctctacattctctcctgacggaagagtttttcaagttgaatatgctatgaaggctgtggaaaatagtaggcagtagcaggtttgttggcagatgctcgttctttagcagacatagcaagagaagaagcttccaacttcagatctaactttggctacaacattccactaaaacatcttgcagacagagtggccatgtatgtgcatgcatatacactctacagtgctgttagaccttttggctgcagtttcatgttagggtcttacagtgtgaatgacggtgcgcaactctacatgattgacccatcaggtgtttcatacggttattggggctgtgccatcggcaaagccaggcaagctgcaaagacggaaatagagaagcttcagatgaaagaaatgacctgccgtgatatcgttaaagaagttgcaaaaataatttacatagtacatgacgaagttaaggataaagcttttgaactagaactcagctgggttggtgaattaactaatggaagacatgaaattgttccaaaagatataagagaagaagcagagaaatatgctaaggaatctctgaaggaagaagatgaatcagatgatgataatatgtaacatttactccagcatctattgtattttaaatttctactccagtccaatgtaactatttagccctggattatacatactgtccaattttcattaaatttttgtcttataa

SEQ ID NO: 364956 - DNA, 918 bp, Homo sapiens
ggcagttcagccaatgagcgggcctgttactagtttgcggcatcctgtggtataggggaagcgctccgggcctggaatccctacgcgtccctttgggtttagcacgatgagctcaatcggcactgggtatgacctgtcagcctctacattctctcctgacggaagagtttttcaagttgaatatgctatgaaggctgtggaaaatagtagtacagctattggaatcagatgcaaagatggtgttgtctttggggtagaaaaattagtcctttctaaactttatgaagaaggttccaacaaaagactttttaatgttgatcggcatgttggaatggcagtagcaggtttgttggcagatgctcgttctttagcagacatagcaagagaagaagcttccaacttcagatctaactttggctacaacattccactaaaacatcttgcagacagagtggccatgtatgtgcatgcatatacactctacagtgctgttagaccttttggctgcagtttcatgttagggtcttacagtgtgaatgacggtgcgcaactctacatgattgacccatcaggtgtttcatacggttattggggctgtgccatcggcaaagccaggcaagctgcaaagacggaaatagagaagcttcagatgaaagaaatgacctgccgtgatatcgttaaagaagttgcaaaaataatttacatagtacatgacgaagttaaggataaagcttttgaactagaactcagctgggttggtgaatgaatctctgaaggaagaagatgaatcagatgatgataatatgtaacatttactccagcatctattgtattttaaatttctactccagtccaatgtaactatttagccctggattatacatactgtccaattttcattaaatttttgtcttataa

SEQ ID NO: 364957 - DNA, 1062 bp, Homo sapiens
ggcagttcagccaatgagcgggcctgttactagtttgcggcatcctgtggtataggggaagcgctccgggcctggaatccctacgcgtccctttgggtttagcacgatgagctcaatcggcactgggtatgacctgtcagcctctacattctctcctgacggaagagtttttcaagttgaatatgctatgaaggctgtggaaaatagtagtacagctattggaatcagatgcaaagatggtgttgtctttggggtagaaaaattagtcctttctaaactttatgaagaaggttccaacaaaagactttttaatgttgatcggcatgttggaatggcagtagcaggtttgttggcagatgctcgttctttagcagacatagcaagagaagaagcttccaacttcagatctaactttggctacaacattccactaaaaagtaagttgataacatattgaggaaccttttggacagtaatagaagtttattaataagctcttctgcttccctccatagcatcttgcagacagagtggccatgtatgtgcatgcatatacactctacagtgctgttagaccttttggctgcagtttcatgttagggtcttacagtgtgaatgacggtgcgcaactctacatgattgacccatcaggtgtttcatacggttattggggctgtgccatcggcaaagccaggcaagctgcaaagacggaaatagagaagcttcagatgaaagaaatgacctgccgtgatatcgttaaagaagttgcaaaaataatttacatagtacatgacgaagttaaggataaagcttttgaactagaactcagctgggttggtgaattaactaatggaagacatgaaattgttccaaaagatataagagaagaagcagagaaatatgctaaggaatctctgaaggaagaagatgaatcagatgatgataatatgtaacatttactccagcatctattgtattttaaatttctactccagtccaatgtaactatttagccctggattatacatactgtccaattttcattaaatttttgtcttataa

SEQ ID NO: 364958 - DNA, 909 bp, Homo sapiens
ggcagttcagccaatgagcgggcctgttactagtttgcggcatcctgtggtataggggaagcgctccgggcctggaatccctacgcgtccctttgggtttagcacgatgagctcaatcggcactgggtatgacctgtcagcctctacattctctcctgacggaagagtttttcaagttgaatatgctatgaaggctgtggaaaatagtagtacagctattggaatcagatgcaaagatggtgttgtctttggggtagaaaaattagtcctttctaaactttatgaagaaggttccaacaaaagactttttaatgttgatcggcatgttggaatggcagtagcaggtttgttggcagatgctcgttctttagcagacatagcaagagaagaagcttccaacttcagatctaactttggctacaacattccactaaaatttcatgttagggtcttacagtgtgaatgacggtgcgcaactctacatgattgacccatcaggtgtttcatacggttattggggctgtgccatcggcaaagccaggcaagctgcaaagacggaaatagagaagcttcagatgaaagaaatgacctgccgtgatatcgttaaagaagttgcaaaaataatttacatagtacatgacgaagttaaggataaagcttttgaactagaactcagctgggttggtgaattaactaatggaagacatgaaattgttccaaaagatataagagaagaagcagagaaatatgctaaggaatctctgaaggaagaagatgaatcagatgatgataatatgtaacatttactccagcatctattgtattttaaatttctactccagtccaatgtaactatttagccctggattatacatactgtccaattttcattaaatttttgtcttataa

SEQ ID NO: 364959 - DNA, 4076 bp, Homo sapiens
tttttttttgagatggagtctcactctgtcgtccagactggagggcagtggcacgatcttggctcactgcaacctccgcctcccgtgttcaagcaattctcctgcatcagcctctcaagtagctgggattacaggcgcccaccaccacacctggctaatttttgtatttttagtagagacaggctttaccatcttggccaggctggtcttgaactcctgaccttgtgatccacccaccttggcctcccaaagtgctgggattacagatgtgaaccaccgcacctggcctcttgatactttttatgttactttaatatgttgcatgacagtgcctccttctttgctgtaatttgtaaggtactacaatgtgaaggccaggttatgtggcatatatgccattataaaatggacaaggagcttaaaaagactactgccaagaagctataggttgaagagaccactaataattgcaagcacataaattagtttttttttttttatttttttgaaacagagtctcactctgttgcccaggctggagtgcagtgtcgtgatctcagctcactgcagcccctacctcctgggttcaagcaagtctcctgcctcagtttcccgagtagttgggactacaggcctatggccacctcacctggctaatttttgtatttttagtagagacgtgggttcaccatgttggccaggatggtctcgaactcctgacctcatgatccacccgcctctgcctccccaaagtgctaggattacaggcacgagccaccatgtccagccaattagttggttttaaatatatttaagttaatggacaaaatattctaaaagggcacagttaatgacgcctcttcctagtgaatccgtgttctttatgaggtatcttttatagttgtatctttttttttttctgagatggagtctcgctctactgtagcccaggatggagtgcagtagtgtgatcttggctcactgcaacccctgcctcccgggttcaaggaattctcctgccttagcctcctgagtagctgagattacaggcgcccaccaccacacctggctgatttttgtttcttagtagagacagggtttcaccatgttggccaggctagtctcgaactgacctcaagtgatccatccgccttggtctcccaaagtgttgggattacaggtgtgagccactgtgcccagccaagttatatctctaaagcaatgtgcaaaaataaactgaacttgggttgattaggtatattcaacatttgtcgggagagtagatgtttcattttatttcagtccctgtgtaatttgtcttctctaatgttaaatactatgtagaatgtgtctgtgtaattttatagatacttttattatggatggacattctaatttgtactgactttgggtctgtgaactacttcaatgtttggaggttaccaaaatcttacctttcccttttctattctagaatttacatagtacatgacgaagttaaggataaagcttttgaactagaactcagctgggttggtgaatgtaagttatttttgtacatttatttgccttaggaatgatctgtaccacagctaatttacaactgagtgtcctttctaatataatgaaagctaaagcaaatttactaggttgtctaatgaagggaaagttctgcttaataattgacttaagttgtgaacacgttattttttgaaacatccatttcatggttttaagatactatgctataaattaatgctcaggatttataaatagcataatttactttcatttccataagaacttaatatgtaggcacatataatctcatgtagaagcagcacacaaaaatattcgagtattactcatagtacaactttgcaaccttaggtgagtcagatatgtggattgggtagatcctatggtatactgcaagttacaatatggtactcaatttaaaattcatttacacatgtggcttaatttacagttaactaatggaagacatgaaattgttccaaaagatataagagaagaagcagagaaatatgctaaggtaagccacagcacaaaaacttctcttggccaggtacagtcagggaatcacttagcccaggagtttgagaccagcctgagcagcacagcaagacccccatccctaatttaaaaaaaaaaaaaaattctctaaccaaaattatgtgttgaataatataaatagactggggtggtttctatgaaataacactgagagttcagttgaactaaagatagaaattttctaggttatctctagtgggtaaagttgccttggttccaaaaaaaaaaaacttgggaggtttagactgcaaagagttttttaggacttttaatactttaaatatttgttcttttttttttttttttttgagacggagtcttgctctgtcacccaggctggagggcagtggcaccatctctgctcactgcaacctctgcctccagggttcaagcgatcctcctgcctccgcctcccaagtagctgggattacaggaacatgccaccatacctggctacttttgtatttttggcttcaccaataatacagagacgggttttcaccaggctagtttcaaactcttgaactcacgtgatctgcctactttggcccccgtaaagtgctgggattacaggcatgaacactgcaccaggcctcttaagtatatattctatcaaagatacagtcattgcatgttagagcaacatttgcttaattaactttgcttgggtatcttattctgaaactgttcattcagttacaagtagaggaatttaaccacttaattcaggttgttgtagcttaacttgcccacaggtgtgggatataacaattttaaaaatcaattttaaacacctgttttctcttaacaggaatctctgaaggaagaagatgaatcagatgatgataatatgtaacatttactccagcatctattgtattttaaatttctactccagtccaatgtaactatttagccctggattatacatactgtccaattttcattaaatttttgtcttataactattgaagtttggttaatatctgctttacaaaattggtgggggtaaatgaggacatttactcagtattaaaatatagatttatgactactgaaaaattccctggttaaaatgctgcagaattaattccaagactgtagattaattcaaagccccatcttcatcactcaactagaatttacagatcatattctcctgggcttttgtacaaaaagcacctaccaacttagtggacaaataactgatacggtttcccaccttcatatgaagtaactggtggtcatcagtcactgttaatctttagatgtgatacagatgacagatgtttcagttttggataatttttcaaaaactgacccttcctcaaaaaagacccttcaatacatgagtcaaggatgtttttgcttttttcctttattgtggtgaggggcggatttaaggatcaataaagtccctattctgtcactaaaaaaatttcttgatctctaaagattaaaataaaaataccaacatcagacagctttcatgttaaaaatcagaatttatgttaaagtgctctgtaaacagaactgttactaagtggaataaacagtactgtggccgataagaataacttgaagctgaaaagcagtactcacagcaggaacaatttgaactcaggccatgtatacacaccctctagtggactcatgccagtgtcactccattgaagtgttgtgctttcctaagaaggtaatctagccactgaatttgggtgcagggtatcgctggactttgagcatttgtgtagtttaaatagcaaatcattatacctgagtattaatagctaactactacacaaacaactcaaaaccagtaatgtcatgtcattaccatggcttcttttatgtaacattatctgctacattttaccactcaaaatatatttaaaatatgtattttaaaatatattagagcatatggctcaagcaatcctcccacctcagcctcccaagtagctgggaccacaggcaag

SEQ ID NO: 364960 - DNA, 769 bp, Homo sapiens
  misc_feature (702)..(702): n is a, c, g, or t
  misc_feature (706)..(706): n is a, c, g, or t
  misc_feature (708)..(708): n is a, c, g, or t
  misc_feature (719)..(719): n is a, c, g, or t
  misc_feature (733)..(733): n is a, c, g, or t
  misc_feature (751)..(751): n is a, c, g, or t
ggcagttcagccaatgagcgggcctgttactagtttgcggcatcctgtggtataggggaagcgctccgggcctggaatccctacgcgtccctttgggtttagcacgatgagctcaatcggcactgggtatgacctgtcagcctctacattctctcctgacggaagagtttttcaagttgaatatgctatgaaggctgtggaaaatagtagtacagctattggaatcagatgcaaagatggtgttgtctttggggtagaaaaattagtcctttctaaactttatgaagaaggttccaacaaaagactttttaatgttgatcggcatgttggaatggcagtagcaggtttgttggcagatgctcgttctttagcagacatagcaagagaagaagcttccaacttcagatctaactttggctacaacattccactaaaacatcttgcagacagagtggccatgtatgtgcatgcatatacactctacagtgctgttagaccttttggctgcagtttcatgttagggtcttacagtgtgaatgacggtgcgcaactctacatgattgacccatcaggtgtttcatacggttattggggctgtgccatcggcaaagccaggcaagctgcaaagacggaaatagagaagcttcagatgaaagaaatgacctgccgtgatatcgttaaagaagttgcaaaaattagctnggtngngaattactaanggagacatgaaatngtccaaagattaagagangagcagagattatgctag

SEQ ID NO: 364961 - DNA, 564 bp, Homo sapiens
ctggagtaaatgttacatattatcatcatctgattcatcttcttccttcagagattccttagcatatttctctgcttcttctgttagaccttttcatgttagggtcttacagtgtgaatgacggtgcgcaactctacatgattgacccatcaggtgtttcatacggttattggggctgtgccatcggcaaagccaggcaagctgcaaagacggaaatagagaagcttcagatgaaagaaatgacctgccgtgatatcgttaaagaagttgcaaaaataatttacatagtacatgacgaagttaaggataaagcttttgaactagaactcagctgggttggtgaattaactaatggaagacatgaaattgttccaaaagatataagagaagaagcagagaaatatgctaaggaatctctgaaggaagaagatgaatcagatgatgataatatgtaacatttactccagcatctattgtattttaaatttctactccagtccaatgtaactatttagccctggattatacatactgtccaattttcattaaatttttgtcttataa

SEQ ID NO: 364962 - DNA, 859 bp, Homo sapiens
  misc_feature (669)..(669): n is a, c, g, or t
  misc_feature (676)..(676): n is a, c, g, or t
  misc_feature (680)..(680): n is a, c, g, or t
  misc_feature (838)..(838): n is a, c, g, or t
  misc_feature (845)..(845): n is a, c, g, or t
ggcagttcagccaatgagcgggcctgttactagtttgcggcatcctgtggtataggggaagcgctccgggcctggaatccctacgcgtccctttgggtttagcacgatgagctcaatcggcactgggtatgacctgtcagcctctacattctctcctgacggaagagtttttcaagttgaatatgctatgaaggctgtggaaaatagtagtacagctattggaatcagatgcaaagatggtgttgtctttggggtagaaaaattagtcctttctaaactttatgaagaaggttccaacaaaagactttttaatgttgatcggcatgttggaatggcagtagcaggtttgttggcagatgctcgttctttagcagacatagcaagagaagaagcttccaacttcagatctaactttggctacaacattccactaaaacatcttgcagacagagtggccatgtatgtgcatgcatatacactctacagtgctgttagaccttttggctgcagtttcatgttagggtcttacagtgtgaatgacggtgcgcaactctacatgattgacccatcaggtgtttcatacggttattggggctgtgccatcggcaaagccaggcaagctgcaaagacggaaatagagaagcttcagatgaaagaatgactgcgganatcgtanagangtgcaaaatatttacctagtccaggacgaagttaggggtaagcttttgaccaaaaatcaacggggtgggggaataaataaaggagagatgaaaattgtccaaaaaaattaagccggggaatttcttgggatctctttgggagaggaagccccggtgtnttttttnccccttcccccccc

SEQ ID NO: 364963 - DNA, 934 bp, Homo sapiens
ggcagttcagccaatgagcgggcctgttactagtttgcggcatcctgtggtataggggaagcgctccgggcctggaatccctacgcgtccctttgggtttagcacgatgagctcaatcggcactgggtatgacctgtcagcctctacattctctcctgacggaagagtttttcaagttgaatatgctatgaaggctgtggaaaatagtagtacagctattggaatcagatgcaaagatggtgttgtctttggggtagaaaaattagtcctttctaaactttatgaagaaggttccaacaaaagactttttaatgttgatcggcatgttggaatggcagtagcaggtttgttggcagatgctcgttctttagcagacatagcaagagaagaagcttccaacttcagatctaactttggctacaacattccactaaaatttcatgttagggtcttacagtgtgaatgacggtgcgcaactctacatgattgacccatcaggtgtttcatacggttattggggctgtgccatcggcaaagccaggcaagctgcaaagacggaaatagagaagcttcagatgaaagaaatgacctgccgtgatatcgttaaagaagttgcaaaaataatttacatagtacatgacgaagttaaggataaagcttttgaactagaactcagctgggttggtgaattaactaatggaagacatgaaattgttccaaaagatataagagaagaagcagagaaatatgctaaggaatctctgaaggaagaagatgaatcagatgatgataatatgtaacatttactccagcatctattgtattttaaatttctactccagtccaatgtaactatttagccctggattatacatactgtccaattttcattaaatttttgtcttataaaaaaaaaaaaaaaagtggaaaaaaa

SEQ ID NO: 364964 - DNA, 3627 bp, Homo sapiens
tttttttttgagatggagtctcactctgtcgtccagactggagggcagtggcacgatcttggctcactgcaacctccgcctcccgtgttcaagcaattctcctgcatcagcctctcaagtagctgggattacaggcgcccaccaccacacctggctaatttttgtatttttagtagagacaggctttaccatcttggccaggctggtcttgaactcctgaccttgtgatccacccaccttggcctcccaaagtgctgggattacagatgtgaaccaccgcacctggcctcttgatactttttatgttactttaatatgttgcatgacagtgcctccttctttgctgtaatttgtaaggtactacaatgtgaaggccaggttatgtggcatatatgccattataaaatggacaaggagcttaaaaagactactgccaagaagctataggttgaagagaccactaataattgcaagcacataaattagtttttttttttttatttttttgaaacagagtctcactctgttgcccaggctggagtgcagtgtcgtgatctcagctcactgcagcccctacctcctgggttcaagcaagtctcctgcctcagtttcccgagtagttgggactacaggcctatggccacctcacctggctaatttttgtatttttagtagagacgtgggttcaccatgttggccaggatggtctcgaactcctgacctcatgatccacccgcctctgcctccccaaagtgctaggattacaggcacgagccaccatgtccagccaattagttggttttaaatatatttaagttaatggacaaaatattctaaaagggcacagttaatgacgcctcttcctagtgaatccgtgttctttatgaggtatcttttatagttgtatctttttttttttctgagatggagtctcgctctactgtagcccaggatggagtgcagtagtgtgatcttggctcactgcaacccctgcctcccgggttcaaggaattctcctgccttagcctcctgagtagctgagattacaggcgcccaccaccacacctggctgatttttgtttcttagtagagacagggtttcaccatgttggccaggctagtctcgaactgacctcaagtgatccatccgccttggtctcccaaagtgttgggattacaggtgtgagccactgtgcccagccaagttatatctctaaagcaatgtgcaaaaataaactgaacttgggttgattaggtatattcaacatttgtcgggagagtagatgtttcattttatttcagtccctgtgtaatttgtcttctctaatgttaaatactatgtagaatgtgtctgtgtaattttatagatacttttattatggatggacattctaatttgtactgactttgggtctgtgaactacttcaatgtttggaggttaccaaaatcttacctttcccttttctattctagaatttacatagtacatgacgaagttaaggataaagcttttgaactagaactcagctgggttggtgaattaactaatggaagacatgaaattgttccaaaagatataagagaagaagcagagaaatatgctaaggtaagccacagcacaaaaacttctcttggccaggtacagtcagggaatcacttagcccaggagtttgagaccagcctgagcagcacagcaagacccccatccctaatttaaaaaaaaaaaaaaattctctaaccaaaattatgtgttgaataatataaatagactggggtggtttctatgaaataacactgagagttcagttgaactaaagatagaaattttctaggttatctctagtgggtaaagttgccttggttccaaaaaaaaaaaacttgggaggtttagactgcaaagagttttttaggacttttaatactttaaatatttgttcttttttttttttttttttgagacggagtcttgctctgtcacccaggctggagggcagtggcaccatctctgctcactgcaacctctgcctccagggttcaagcgatcctcctgcctccgcctcccaagtagctgggattacaggaacatgccaccatacctggctacttttgtatttttggcttcaccaataatacagagacgggttttcaccaggctagtttcaaactcttgaactcacgtgatctgcctactttggcccccgtaaagtgctgggattacaggcatgaacactgcaccaggcctcttaagtatatattctatcaaagatacagtcattgcatgttagagcaacatttgcttaattaactttgcttgggtatcttattctgaaactgttcattcagttacaagtagaggaatttaaccacttaattcaggttgttgtagcttaacttgcccacaggtgtgggatataacaattttaaaaatcaattttaaacacctgttttctcttaacaggaatctctgaaggaagaagatgaatcagatgatgataatatgtaacatttactccagcatctattgtattttaaatttctactccagtccaatgtaactatttagccctggattatacatactgtccaattttcattaaatttttgtcttataactattgaagtttggttaatatctgctttacaaaattggtgggggtaaatgaggacatttactcagtattaaaatatagatttatgactactgaaaaattccctggttaaaatgctgcagaattaattccaagactgtagattaattcaaagccccatcttcatcactcaactagaatttacagatcatattctcctgggcttttgtacaaaaagcacctaccaacttagtggacaaataactgatacggtttcccaccttcatatgaagtaactggtggtcatcagtcactgttaatctttagatgtgatacagatgacagatgtttcagttttggataatttttcaaaaactgacccttcctcaaaaaagacccttcaatacatgagtcaaggatgtttttgcttttttcctttattgtggtgaggggcggatttaaggatcaataaagtccctattctgtcactaaaaaaatttcttgatctctaaagattaaaataaaaataccaacatcagacagctttcatgttaaaaatcagaatttatgttaaagtgctctgtaaacagaactgttactaagtggaataaacagtactgtggccgataagaataacttgaagctgaaaagcagtactcacagcaggaacaatttgaactcaggccatgtatacacaccctctagtggactcatgccagtgtcactccattgaagtgttgtgctttcctaagaaggtaatctagccactgaatttgggtgcagggtatcgctggactttgagcatttgtgtagtttaaatagcaaatcattatacctgagtattaatagctaactactacacaaacaactcaaaaccagtaatgtcatgtcattaccatggcttcttttatgtaacattatctgctacattttaccactcaaaatatatttaaaatatgtattttaaaatatattagagcatatggctcaagcaatcctcccacctcagcctcccaagtagctgggaccacaggcaag

SEQ ID NO: 364965 - DNA, 797 bp, Homo sapiens
ggcagttcagccaatgagcgggcctgttactagtttgcggcatcctgtggtataggggaagcgctccgggcctggaatccctacgcgtccctttgggtttagcacgatgagctcaatcggcactgggtatgacctgtcagcctctacattctctcctgacggaagagtttttcaagttgaatatgctatgaaggctgtggaaaatagtagtacagctattggaatcagatgcaaagatggtgttgtctttggggtagaaaaattagtcctttctaaactttatgaagaaggttccaacaaaagactttttaatgttgatcggcatgttggaatggcagtagcaggtttgttggcagatgctcgttctttagcagacatagcaagagaagaagcttccaacttcagatctaactttggctacaacattccactaaaacatcttgcagacagagtggccatgtatgtgcatgcatatacactctacagtgctgttagaccttttggctgcagaatttacatagtacatgacgaagttaaggataaagcttttgaactagaactcagctgggttggtgaattaactaatggaagacatgaaattgttccaaaagatataagagaagaagcagagaaatatgctaaggaatctctgaaggaagaagatgaatcagatgatgataatatgtaacatttactccagcatctattgtattttaaatttctactccagtccaatgtaactatttagccctggattatacatactgtccaattttcattaaatttttgtcttataa

SEQ ID NO: 364966 - DNA, 1761 bp, Homo sapiens
tttttttttgagatggagtctcactctgtcgtccagactggagggcagtggcacgatcttggctcactgcaacctccgcctcccgtgttcaagcaattctcctgcatcagcctctcaagtagctgggattacaggcgcccaccaccacacctggctaatttttgtatttttagtagagacaggctttaccatcttggccaggctggtcttgaactcctgaccttgtgatccacccaccttggcctcccaaagtgctgggattacagatgtgaaccaccgcacctggcctcttgatactttttatgttactttaatatgttgcatgacagtgcctccttctttgctgtaatttgtaaggtactacaatgtgaaggccaggttatgtggcatatatgccattataaaatggacaaggagcttaaaaagactactgccaagaagctataggttgaagagaccactaataattgcaagcacataaattagtttttttttttttatttttttgaaacagagtctcactctgttgcccaggctggagtgcagtgtcgtgatctcagctcactgcagcccctacctcctgggttcaagcaagtctcctgcctcagtttcccgagtagttgggactacaggcctatggccacctcacctggctaatttttgtatttttagtagagacgtgggttcaccatgttggccaggatggtctcgaactcctgacctcatgatccacccgcctctgcctccccaaagtgctaggattacaggcacgagccaccatgtccagccaattagttggttttaaatatatttaagttaatggacaaaatattctaaaagggcacagttaatgacgcctcttcctagtgaatccgtgttctttatgaggtatcttttatagttgtatctttttttttttctgagatggagtctcgctctactgtagcccaggatggagtgcagtagtgtgatcttggctcactgcaacccctgcctcccgggttcaaggaattctcctgccttagcctcctgagtagctgagattacaggcgcccaccaccacacctggctgatttttgtttcttagtagagacagggtttcaccatgttggccaggctagtctcgaactgacctcaagtgatccatccgccttggtctcccaaagtgttgggattacaggtgtgagccactgtgcccagccaagttatatctctaaagcaatgtgcaaaaataaactgaacttgggttgattaggtatattcaacatttgtcgggagagtagatgtttcattttatttcagtccctgtgtaatttgtcttctctaatgttaaatactatgtagaatgtgtctgtgtaattttatagatacttttattatggatggacattctaatttgtactgactttgggtctgtgaactacttcaatgtttggaggttaccaaaatcttacctttcccttttctattctagaatttacatagtacatgacgaagttaaggataaagcttttgaactagaactcagctgggttggtgaattaactaatggaagacatgaaattgttccaaaagatataagagaagaagcagagaaatatgctaaggaatctctgaaggaagaagatgaatcagatgatgataatatgtaacatttactccagcatctattgtattttaaatttctactccagtccaatgtaactatttagccctggattatacatactgtccaattttcattaaatttttgtcttataa

SEQ ID NO: 364967 - DNA, 1999 bp, Homo sapiens
  misc_feature (60)..(60): n is a, c, g, or t
  misc_feature (233)..(233): n is a, c, g, or t
  misc_feature (243)..(243): n is a, c, g, or t
  misc_feature (269)..(269): n is a, c, g, or t
  misc_feature (279)..(279): n is a, c, g, or t
cacaccacctgagtcaaacaaatgcaaagaagcacacgtcaggggtcttataggctcaanagcactgagatgaatcacacaagaaggggaaactttagagaagactacagggaaacacaaagtagttaaacacaactaaccttgaaaataatttgttagtattcctaaacatcacttttgtgtagcaaaatgtttcactgtacaaatgctcacctaaagtgaaaaaaaaaaangtggaaaaanaaatcactcctagggtccaagaaaanttctcatatnttttatggtatgtgtaacttaaagactgcgattatttttttttttttttgagacggagtcttgctctgtcacccaggctggagggcagtggcaccatctctgctcactgcaacctctgcctccagggttcaagcgatcctcctgcctccgcctcccaagtagctgggattacaggaacatgccaccatacctggctacttttgtatttttggcttcaccaataatacagagacgggttttcaccaggctagtttcaaactcttgaactcacgtgatctgcctactttggcccccgtaaagtgctgggattacaggcatgaacactgcaccaggcctcttaagtatatattctatcaaagatacagtcattgcatgttagagcaacatttgcttaattaactttgcttgggtatcttattctgaaactgttcattcagttacaagtagaggaatttaaccacttaattcaggttgttgtagcttaacttgcccacaggtgtgggatataacaattttaaaaatcaattttaaacacctgttttctcttaacaggaatctctgaaggaagaagatgaatcagatgatgataatatgtaacatttactccagcatctattgtattttaaatttctactccagtccaatgtaactatttagccctggattatacatactgtccaattttcattaaatttttgtcttataactattgaagtttggttaatatctgctttacaaaattggtgggggtaaatgaggacatttactcagtattaaaatatagatttatgactactgaaaaattccctggttaaaatgctgcagaattaattccaagactgtagattaattcaaagccccatcttcatcactcaactagaatttacagatcatattctcctgggcttttgtacaaaaagcacctaccaacttagtggacaaataactgatacggtttcccaccttcatatgaagtaactggtggtcatcagtcactgttaatctttagatgtgatacagatgacagatgtttcagttttggataatttttcaaaaactgacccttcctcaaaaaagacccttcaatacatgagtcaaggatgtttttgcttttttcctttattgtggtgaggggcggatttaaggatcaataaagtccctattctgtcactaaaaaaatttcttgatctctaaagattaaaataaaaataccaacatcagacagctttcatgttaaaaatcagaatttatgttaaagtgctctgtaaacagaactgttactaagtggaataaacagtactgtggccgataagaataacttgaagctgaaaagcagtactcacagcaggaacaatttgaactcaggccatgtatacacaccctctagtggactcatgccagtgtcactccattgaagtgttgtgctttcctaagaaggtaatctagccactgaatttgggtgcagggtatcgctggactttgagcatttgtgtagtttaaatagcaaatcattatacctgagtattaatagctaactactacacaaacaactcaaaaccagtaatgtcatgtcattaccatggcttcttttatgtaacattatctgctacattttaccactcaaaatatatttaaaatatgtattttaaaatatattagagcatatggctcaagcaatcctcccacctcagcctcccaagtagctgggaccacaggcaag

SEQ ID NO: 364968 - DNA, 2646 bp, Homo sapiens
ctcaacgctttatacttctggatatatttcctgtccaagagaagaatcatactgtagtatctcctagagcattagaactaagtgatccagtacttgatgagcaccaccaaggtgatcaagatggaggagatcaagatgaaagggctgaaaaatcaaaattaactgggaccaggcaaaatcattcattcatatggtcaggggcatcatttgatctaagtccaggactgcaaaggattttagataaagtatccagtcctctagaaaatgaaaagctaaaatcaatgactataaacttttccagtttgaatagaaaaaatacagagttaaatgaagaacaagaagttatttcaaacttggagacaaaacaagtgcagggaatttcattttcttctaataatgaagtataaagcgttgagtcaacgctttatacttcagagaagcttcagatgaaagaaatgacctgccgtgatatcgttaaagaagttgcaaaaataatttacatagtacatgacgaagttaaggataaagcttttgaactagaactcagctgggttggtgaattaactaatggaagacatgaaattgttccaaaagatataagagaagaagcagagaaatatgctaaggtaagccacagcacaaaaacttctcttggccaggtacagtcagggaatcacttagcccaggagtttgagaccagcctgagcagcacagcaagacccccatccctaatttaaaaaaaaaaaaaaattctctaaccaaaattatgtgttgaataatataaatagactggggtggtttctatgaaataacactgagagttcagttgaactaaagatagaaattttctaggttatctctagtgggtaaagttgccttggttccaaaaaaaaaaaacttgggaggtttagactgcaaagagttttttaggacttttaatactttaaatatttgttcttttttttttttttttttgagacggagtcttgctctgtcacccaggctggagggcagtggcaccatctctgctcactgcaacctctgcctccagggttcaagcgatcctcctgcctccgcctcccaagtagctgggattacaggaacatgccaccatacctggctacttttgtatttttggcttcaccaataatacagagacgggttttcaccaggctagtttcaaactcttgaactcacgtgatctgcctactttggcccccgtaaagtgctgggattacaggcatgaacactgcaccaggcctcttaagtatatattctatcaaagatacagtcattgcatgttagagcaacatttgcttaattaactttgcttgggtatcttattctgaaactgttcattcagttacaagtagaggaatttaaccacttaattcaggttgttgtagcttaacttgcccacaggtgtgggatataacaattttaaaaatcaattttaaacacctgttttctcttaacaggaatctctgaaggaagaagatgaatcagatgatgataatatgtaacatttactccagcatctattgtattttaaatttctactccagtccaatgtaactatttagccctggattatacatactgtccaattttcattaaatttttgtcttataactattgaagtttggttaatatctgctttacaaaattggtgggggtaaatgaggacatttactcagtattaaaatatagatttatgactactgaaaaattccctggttaaaatgctgcagaattaattccaagactgtagattaattcaaagccccatcttcatcactcaactagaatttacagatcatattctcctgggcttttgtacaaaaagcacctaccaacttagtggacaaataactgatacggtttcccaccttcatatgaagtaactggtggtcatcagtcactgttaatctttagatgtgatacagatgacagatgtttcagttttggataatttttcaaaaactgacccttcctcaaaaaagacccttcaatacatgagtcaaggatgtttttgcttttttcctttattgtggtgaggggcggatttaaggatcaataaagtccctattctgtcactaaaaaaatttcttgatctctaaagattaaaataaaaataccaacatcagacagctttcatgttaaaaatcagaatttatgttaaagtgctctgtaaacagaactgttactaagtggaataaacagtactgtggccgataagaataacttgaagctgaaaagcagtactcacagcaggaacaatttgaactcaggccatgtatacacaccctctagtggactcatgccagtgtcactccattgaagtgttgtgctttcctaagaaggtaatctagccactgaatttgggtgcagggtatcgctggactttgagcatttgtgtagtttaaatagcaaatcattatacctgagtattaatagctaactactacacaaacaactcaaaaccagtaatgtcatgtcattaccatggcttcttttatgtaacattatctgctacattttaccactcaaaatatatttaaaatatgtattttaaaatatattagagcatatggctcaagcaatcctcccacctcagcctcccaagtagctgggaccacaggcaag

SEQ ID NO: 364969 - DNA, 501 bp, Homo sapiens
ggcagttcagccaatgagcgggcctgttactagtttgcggcatcctgtggtataggggaagcgctccgggcctggaatccctacgcgtccctttgggtttagcacgatgagctcaatcggcactggggcctgcgtctcaggtgaccgtgactcctgaagcttttcagcgcaggtgtagccggcttggcgtcgccgcagtgaggtttggagccgctttggattgctgagtcactttcttcagccacttagggaaaccgaaagtggaaactcgtggggcttgaaatagtgtgttctcttgagaaccaccgaggcagtgagatttgggattccggggtctggagatcgtgctttttgtggactgcgtttgcagttcctagggtgctgctgattcacaggccttctctgtctttaagtgtgcagatcattgaccgctcagtttaagagtcactggaaatcctgtcggaacagaactaataaaaatggtctgaaaaacaaaaaaaa

SEQ ID NO: 364970 - DNA, 682 bp, Homo sapiens
gtgttgtctttggggtagaaaaattagtcctttctaaactttatgaagaaggttccaacaaaagactttttaatgttgatcggcatgttggaatggtaaggtcatgtttaaaatgttcctttttgtcttgtccaatttcttttgaagtaactgattggaatagatcactgtgcagtcacaaaagtaatcagagcaagttactgcatttgtccagttcactgtccagtagaaaggcagcattctcataaccttattagtgatgggggaaaaaccaagttgctgaaagaagagcaggtgagggagagggctggggagtatgcgtagaaatgagatcttggcagcacacattactaatgaaggtatatgcttgagaggtgaagaatctttagctttctgtatctcttgtggggatcactgtcaaagtaaagatgccatcagatagcgaacacctttatataaggtggaacatcaggaaaggatgtttaatgaaaaggaaaagtgaacacatccataatagtttcatagggcatcactgaaattaagttattcatgcagctggtatctaagttatgagtgactaaattgcaagccaagccatagatacatgactggtatatactaaagttaccctacatagatggcagacttggcttagtgagaaccactactgaaagaaaaaaaa

SEQ ID NO: 364971 - DNA, 372 bp, Homo sapiens
tacatgaattttgaataatctcatgtaatagttttaattaattgaaaccactgtttcaaagtacttactgagttatatgtgtattagtaatttatctcagaaagaaaatataactgcattttaaaataattttttcacaaatacttttatgttattgccatggtttaagctgtttgtatactttcatgtttcatgttagggtcttacagtgtgaatgacggtgcgcaactctacatgattgacccatcaggtgtttcatacgtgagtaattttgaatcatttgaaattctattttagtttaatggtatttcattagcatttaagtctcattataagattatatgaaattaaaaaaaaactcattcaaggaaa

SEQ ID NO: 364972 - DNA, 1130 bp, Homo sapiens
ggcagttcagccaatgagcgggcctgttactagtttgcggcatcctgtggtataggggaagcgctccgggcctggaatccctacgcgtccctttgggtttagcacgatgagctcaatcggcactgggtatgacctgtcagcctctacattctctcctgacggaagagtttttcaagttgaatatgctatgaaggctgtggaaaatagtagtacagctattggaatcagatgcaaagatggtgttgtctttggggtagaaaaattagtcctttctaaactttatgaagaaggttccaacaaaagactttttaatgttgatcggcatgttggaatggcagtagcaggtttgttggcagatgctcgttctttagcagacatagcaagagaagaagcttccaacttcagatctaactttggctacaacattccactaaaacatcttgcagacagagtggccatgtatgtgcatgcatatacactctacagtgctgttagaccttttggctgcagtttcatgttagggtcttacagtgtgaatgacggtgcgcaactctacatgattgacccatcaggtgtttcatacggttattggggctgtgccatcggcaaagccaggcaagctgcaaagacggaaatagagaagcttcagatgaaagaaatgacctgccgtgatatcgttaaagaagttgcaaaaataatttacatagtacatgacgaagttaaggataaagcttttgaactagaactcagctgggttggtgaattaactaatggaagacatgaaattgttccaaaagatataagagaagaagcagagaaatatgctaaggaatctctgaaggaagaagatgaatcagatgatgataatatgtaacatttactccagcatctattgtattttaaatttctactccagtccaatgtaactatttagccctggattatacatactgtccaattttcattaaatttttgtcttataaaaaaaaaaaaggcgggggcttaaaatcccggggcgcatgcgtcccgtctgtaaaggccaaggaggaaaaaaagagggcgggtaaaggggaagcgggtttggaccctctgggtggacccaaaccgaaatgatgactgggggtaaatag

SEQ ID NO: 364973 - DNA, 578 bp, Homo sapiens
gatctaacttggctacaacattccactaaaacatcttgcagacagagtggccatgtatgtgcatgcatatacactctacagtgctgttagaccttttggctgcagtttcatgttagggtcttacagtgtgaatgacggtgcgcaactctacatgattgacccatcaggtgtttcatacggttattggggctgtgccatcggcaaagccaggcaagctgcaaagacggaaatagagaagcttcagatgaaagaaatgacctgccgtgatatcgttaaagaagttgcaaaaataatttacatagtacatgacgaagttaaggataaagcttttgaactagaactcagctgggttggtgaattaactaatggaagacatgaaattgttccaaaagatataagagaagaagcagagaaatatgctaaggaatctctgaaggaagaagatgaatcagatgatgataatatgtaacatttactccagcatctattgtattttaaatttctactccagtccaatgtaactatttagccctggattatacatactgtccaattttcattaaatttttgtcttataa

SEQ ID NO: 364974 - DNA, 384 bp, Homo sapiens
ccgggctgcaggaattcggcacgagagactatattcatataaacattggtgcacttgaactgagtgcaaaccacaacattcttcatattgtggtgtgtgtcatgacgtataaaaggaagacaaagaagaagaaaaagaaaaagaagataaagagtcggaagacaataactaatggaagacatgaaattgttccaaaagatataagagaagaagcagagaaatatgctaaggaatctctgaaggaagaagatgaatcagatgatgataatatgtaacatttactccagcatctattgtattttaaatttctactccagtccaatgtaactatttagccctggattatacatactgtccaattttcattaaatttttgtcttataa

SEQ ID NO: 364975 - DNA, 1997 bp, Homo sapiens
ggcagttcagccaatgagcgggcctgttactagtttgcggcatcctgtggtataggggaagcgctccgggcctggaatccctacgcgtccctttgggtttagcacgatgagctcaatcggcactgggtatgacctgtcagcctctacattctctcctgacggaagagtttttcaagttgaatatgctatgaaggctgtggaaaatagtagtacagctattggaatcagatgcaaagatggtgttgtctttggggtagaaaaattagtcctttctaaactttatgaagaaggttccaacaaaagactttttaatgttgatcggcatgttggaatggcagtagcaggtttgttggcagatgctcgttctttagcagacatagcaagagaagaagcttccaacttcagatctaactttggctacaacattccactaaaacatcttgcagacagagtggccatgtatgtgcatgcatatacactctacagtgctgttagaccttttggctgcagtttcatgttagggtcttacagtgtgaatgacggtgcgcaactctacatgattgacccatcaggtgtttcatacggttattggggctgtgccatcggcaaagccaggcaagctgcaaagacggaaatagagaagcttcagatgaaagaaatgacctgccgtgatatcgttaaagaagttgcaaaaataatttacatagtacatgacgaagttaaggataaagcttttgaactagaactcagctgggttggtgaattaactaatggaagacatgaaattgttccaaaagatataagagaagaagcagagaaatatgctaaggaatctctgaaggaagaagatgaatcagatgatgataatatgtaacatttactccagcatctattgtattttaaatttctactccagtccaatgtaactatttagccctggattatacatactgtccaattttcattaaatttttgtcttataactattgaagtttggttaatatctgctttacaaaattggtgggggtaaatgaggacatttactcagtattaaaatatagatttatgactactgaaaaattccctggttaaaatgctgcagaattaattccaagactgtagattaattcaaagccccatcttcatcactcaactagaatttacagatcatattctcctgggcttttgtacaaaaagcacctaccaacttagtggacaaataactgatacggtttcccaccttcatatgaagtaactggtggtcatcagtcactgttaatctttagatgtgatacagatgacagatgtttcagttttggataatttttcaaaaactgacccttcctcaaaaaagacccttcaatacatgagtcaaggatgtttttgcttttttcctttattgtggtgaggggcggatttaaggatcaataaagtccctattctgtcactaaaaaaatttcttgatctctaaagattaaaataaaaataccaacatcagacagctttcatgttaaaaatcagaatttatgttaaagtgctctgtaaacagaactgttactaagtggaataaacagtactgtggccgataagaataacttgaagctgaaaagcagtactcacagcaggaacaatttgaactcaggccatgtatacacaccctctagtggactcatgccagtgtcactccattgaagtgttgtgctttcctaagaaggtaatctagccactgaatttgggtgcagggtatcgctggactttgagcatttgtgtagtttaaatagcaaatcattatacctgagtattaatagctaactactacacaaacaactcaaaaccagtaatgtcatgtcattaccatggcttcttttatgtaacattatctgctacattttaccactcaaaatatatttaaaatatgtattttaaaatatattagagcatatggctcaagcaatcctcccacctcagcctcccaagtagctgggaccacaggcaag

SEQ ID NO: 364976 - DNA, 903 bp, Homo sapiens
ggcagttcagccaatgagcgggcctgttactagtttgcggcatcctgtggtataggggaagcgctccgggcctggaatccctacgcgtccctttgggtttagcacgatgagctcaatcggcactgggtatgacctgtcagcctctacattctctcctgacggaagagtttttcaagttgaatatgctatgaaggctgtggaaaatagtagtacagctattggaatcagatgcaaagatggtgttgtctttggggtagaaaaattagtcctttctaaactttatgaagaaggttccaacaaaagactttttaatgttgatcggcatgttggaatggcagtagcaggtttgttggcagatgctcgttctttagcagacatagcaagagaagaagcttccaacttcagatctaactttggctacaacattccactaaaacatcttgcagacagagtggccatgtatgtgcatgcatatacactctacagtgctgttagaccttttggctgcagtttcatgttagggtcttacagtgtgaatgacggtgcgcaactctacatgattgacccatcaggtgtttcatacggttattggggctgtgccatcggcaaagccaggcaagctgcaaagacggaaatagagaagcttcagatgaaagaaatgacctgccgtgatatcgttaaagaagttgcaaaaataatttacatagtacatgacgaagttaaggataaagcttttgaactagaactcagctgggttggtgaattaactaatggaagacatgaaattgttccaaaagatataagagaagaagcagagaaatatgctaaggaatctctgaaggaagaagatgaatcagatgatgataatatgcacaagcactccaaaaggggatccttagagtc

SEQ ID NO: 364977 - DNA, 2849 bp, Homo sapiens
ggcagttcagccaatgagcgggcctgttactagtttgcggcatcctgtggtataggggaagcgctccgggcctggaatccctacgcgtccctttgggtttagcacgatgagctcaatcggcactgggtatgacctgtcagcctctacattctctcctgacggaagagtttttcaagttgaatatgctatgaaggctgtggaaaatagtagtacagctattggaatcagatgcaaagatggtgttgtctttggggtagaaaaattagtcctttctaaactttatgaagaaggttccaacaaaagactttttaatgttgatcggcatgttggaatggcagtagcaggtttgttggcagatgctcgttctttagcagacatagcaagagaagaagcttccaacttcagatctaactttggctacaacattccactaaaacatcttgcagacagagtggccatgtatgtgcatgcatatacactctacagtgctgttagaccttttggctgcagtttcatgttagggtcttacagtgtgaatgacggtgcgcaactctacatgattgacccatcaggtgtttcatacggttattggggctgtgccatcggcaaagccaggcaagctgcaaagacggaaatagagaagcttcagatgaaagaaatgacctgccgtgatatcgttaaagaagttgcaaaaataatttacatagtacatgacgaagttaaggataaagcttttgaactagaactcagctgggttggtgaattaactaatggaagacatgaaattgttccaaaagatataagagaagaagcagagaaatatgctaaggtaagccacagcacaaaaacttctcttggccaggtacagtcagggaatcacttagcccaggagtttgagaccagcctgagcagcacagcaagacccccatccctaatttaaaaaaaaaaaaaaattctctaaccaaaattatgtgttgaataatataaatagactggggtggtttctatgaaataacactgagagttcagttgaactaaagatagaaattttctaggttatctctagtgggtaaagttgccttggttccaaaaaaaaaaaacttgggaggtttagactgcaaagagttttttaggacttttaatactttaaatatttgttcttttttttttttttttttgagacggagtcttgctctgtcacccaggctggagggcagtggcaccatctctgctcactgcaacctctgcctccagggttcaagcgatcctcctgcctccgcctcccaagtagctgggattacaggaacatgccaccatacctggctacttttgtatttttggcttcaccaataatacagagacgggttttcaccaggctagtttcaaactcttgaactcacgtgatctgcctactttggcccccgtaaagtgctgggattacaggcatgaacactgcaccaggcctcttaagtatatattctatcaaagatacagtcattgcatgttagagcaacatttgcttaattaactttgcttgggtatcttattctgaaactgttcattcagttacaagtagaggaatttaaccacttaattcaggttgttgtagcttaacttgcccacaggtgtgggatataacaattttaaaaatcaattttaaacacctgttttctcttaacaggaatctctgaaggaagaagatgaatcagatgatgataatatgtaacatttactccagcatctattgtattttaaatttctactccagtccaatgtaactatttagccctggattatacatactgtccaattttcattaaatttttgtcttataactattgaagtttggttaatatctgctttacaaaattggtgggggtaaatgaggacatttactcagtattaaaatatagatttatgactactgaaaaattccctggttaaaatgctgcagaattaattccaagactgtagattaattcaaagccccatcttcatcactcaactagaatttacagatcatattctcctgggcttttgtacaaaaagcacctaccaacttagtggacaaataactgatacggtttcccaccttcatatgaagtaactggtggtcatcagtcactgttaatctttagatgtgatacagatgacagatgtttcagttttggataatttttcaaaaactgacccttcctcaaaaaagacccttcaatacatgagtcaaggatgtttttgcttttttcctttattgtggtgaggggcggatttaaggatcaataaagtccctattctgtcactaaaaaaatttcttgatctctaaagattaaaataaaaataccaacatcagacagctttcatgttaaaaatcagaatttatgttaaagtgctctgtaaacagaactgttactaagtggaataaacagtactgtggccgataagaataacttgaagctgaaaagcagtactcacagcaggaacaatttgaactcaggccatgtatacacaccctctagtggactcatgccagtgtcactccattgaagtgttgtgctttcctaagaaggtaatctagccactgaatttgggtgcagggtatcgctggactttgagcatttgtgtagtttaaatagcaaatcattatacctgagtattaatagctaactactacacaaacaactcaaaaccagtaatgtcatgtcattaccatggcttcttttatgtaacattatctgctacattttaccactcaaaatatatttaaaatatgtattttaaaatatattagagcatatggctcaagcaatcctcccacctcagcctcccaagtagctgggaccacaggcaag

SEQ ID NO: 364978 - DNA, 866 bp, Homo sapiens
ggcagttcagccaatgagcgggcctgttactagtttgcggcatcctgtggtataggggaagcgctccgggcctggaatccctacgcgtccctttgggtttagcacgatgagctcaatcggcactgggtatgacctgtcagcctctacattctctcctgacggaagagtttttcaagttgaatatgctatgaaggctgtggaaaatagtagtacagctattggaatcagatgcaaagatggtgttgtctttggggtagaaaaattagtcctttctaaactttatgaagaaggttccaacaaaagactttttaatgttgatcggcatgttggaatggcagtagcaggtttgttggcagatgctcgttctttagcagacatagcaagagaagaagcttccaacttcagatctaactttggctacaacattccactaaaacatcttgcagacagagtggccatgtatgtgcatgcatatacactctacagtgctgttagaccttttggctgcagtttcatgttagggtcttacagtgtgaatgacggtgcgcaactctacatgattgacccatcaggtgtttcatacggttattggggctgtgccatcggcaaagccaggcaagctgcaaagacggaaatagagaagcttcagatgaaagaaatgacctgccgtgatatcgttaaagaagttgcaaaaataatttacatagtacatgacgaagttaaggataaagcttttgaactagaactcagctgggttggtgaattaactaatggaagacatgaaattgttccaaaagatataagagaagaagcagagaaatatgctaagaatctctgatggacgaaagggatccgctagaacagct

SEQ ID NO: 364979 - DNA, 900 bp, Homo sapiens
ggcagttcagccaatgagcgggcctgttactagtttgcggcatcctgtggtataggggaagcgctccgggcctggaatccctacgcgtccctttgggtttagcacgatgagctcaatcggcactgggtacagctattggaatcagatgcaaagatggtgttgtctttggggtagaaaaattagtcctttctaaactttatgaagaaggttccaacaaaagactttttaatgttgatcggcatgttggaatggcagtagcaggtttgttggcagatgctcgttctttagcagacatagcaagagaagaagcttccaacttcagatctaactttggctacaacattccactaaaacatcttgcagacagagtggccatgtatgtgcatgcatatacactctacagtgctgttagaccttttggctgcagtttcatgttagggtcttacagtgtgaatgacggtgcgcaactctacatgattgacccatcaggtgtttcatacggttattggggctgtgccatcggcaaagccaggcaagctgcaaagacggaaatagagaagcttcagatgaaagaaatgacctgccgtgatatcgttaaagaagttgcaaaaataatttacatagtacatgacgaagttaaggataaagcttttgaactagaactcagctgggttggtgaattaactaatggaagacatgaaattgttccaaaagatataagagaagaagcagagaaatatgctaaggaatctctgaaggaagaagatgaatcagatgatgataatatgtaacatttactccagcatctattgtattttaaatttctactccagtccaatgtaactatttagccctggattatacatactgtccaattttcattaaatttttgtcttataa

SEQ ID NO: 364980 - DNA, 1337 bp, Homo sapiens
ggcagttcagccaatgagcgggcctgttactagtttgcggcatcctgtggtataggggaagcgctccgggcctggaatccctacgcgtccctttgggtttagcacgatgagctcaatcggcactgggtatgacctgtcagcctctacattctctcctgacggaagagtttttcaagttgaatatgctatgaaggctgtggaaaatagtagtacagctattggaatcagatgcaaagatggtgttgtctttggggtagaaaaattagtcctttctaaactttatgaagaaggttccaacaaaagactttttaatgttgatcggcatgttggaatggcagtagcaggtttgttggcagatgctcgttctttagcagacatagcaagagaagaagcttccaacttcagatctaactttggctacaacattccactaaaacatcttgcagacagagtggccatgtatgtgcatgcatatacactctacagtgctgttagaccttttggctgcagtttcatgttagggtcttacagtgtgaatgacggtgcgcaactctacatgattgacccatcaggtgtttcatacggttattggggctgtgccatcggcaaagccaggcaagctgcaaagacggaaatagagaagcttcagatgaaagaaatgacctgccgtgatatcgttaaagaagttgcaaaaataatttacatagtacatgacgaagttaaggataaagcttttgaactagaactcagctgggttggtgaatgtaagttatttttgtacatttatttgccttaggaatgatctgtaccacagctaatttacaactgagtgtcctttctaatataatgaaagctaaagcaaatttactaggttgtctaatgaagggaaagttctgcttaataattgacttaagttgtgaacacgttattttttgaaacatccatttcatggttttaagatactatgctataaattaatgctcaggatttataaatagcataatttactttcatttccataagaacttaatatgtaggcacatataatctcatgtagaagcagcacacaaaaatattcgagtattactcatagtacaactttgcaaccttaggtgagtcagatatgtggattgggtagatcctatggtatactgcaagttacaatatggtactcaatttaaaattcatttacacatgtggcttaatttacagttaactaatggaagacatgaaattgttccaaaagatataagagaagaagcagagaaatatgctaagactctctgaaggaagaagagatcagatgatactaagggaccctctagacccacctcaga

SEQ ID NO: 364981 - DNA, 929 bp, Homo sapiens
ggcagttcagccaatgagcgggcctgttactagtttgcggcatcctgtggtataggggaagcgctccgggcctggaatccctacgcgtccctttgggtttagcacgatgagctcaatcggcactgggtatgacctgtcagcctctacattctctcctgacggaagagtttttcaagttgaatatgctatgaaggctgtggaaaatagtagtacagctattggaatcagatgcaaagatggtgttgtctttggggtagaaaaattagtcctttctaaactttatgaagaaggttccaacgcagatgctcgttctttagcagacatagcaagagaagaagcttccaacttcagatctaactttggctacaacattccactaaaacatcttgcagacagagtggccatgtatgtgcatgcatatacactctacagtgctgttagaccttttggctgcagtttcatgttagggtcttacagtgtgaatgacggtgcgcaactctacatgattgacccatcaggtgtttcatacggttattggggctgtgccatcggcaaagccaggcaagctgcaaagacggaaatagagaagcttcagatgaaagaaatgacctgccgtgatatcgttaaagaagttgcaaaaataatttacatagtacatgacgaagttaaggataaagcttttgaactagaactcagctgggttggtgaattaactaatggaagacatgaaattgttccaaaagatataagagaagaagcagagaaatatgctaaggaatctctgaaggaagaagatgaatcagatgatgataatatgtaacatttactccagcatctattgtattttaaatttctactccagtccaatgtaactatttagccctggattatacatactgtccaattttcattaaatttttgtcttataa

SEQ ID NO: 364982 - DNA, 962 bp, Homo sapiens
ggcagttcagccaatgagcgggcctgttactagtttgcggcatcctgtggtataggggaagcgctccgggcctggaatccctacgcgtccctttgggtttagcacgatgagctcaatcggcactgggtatgacctgtcagcctctacattctctcctgacggaagagtttttcaagttgaatatgctatgaaggctgtggaaaatagtagtacagctattggaatcagatgcaaagatggtgttgtctttggggtagaaaaattagtcctttctaaactttatgaagaaggttccaacaaaagactttttaatgttgatcggcatgttggaatggcagtagcaggtttgttggcagatgctcgttctttagcagacatagcaagagaagaagcttccaacttcagatctaactttggctacaacattccactaaaacatcttgcagacagagtggccatgtatgtgcatgcatatacactctacagtgctgttagaccttttggctgcagtgtgaatgacggtgcgcaactctacatgattgacccatcaggtgtttcatacggttattggggctgtgccatcggcaaagccaggcaagctgcaaagacggaaatagagaagcttcagatgaaagaaatgacctgccgtgatatcgttaaagaagttgcaaaaataatttacatagtacatgacgaagttaaggataaagcttttgaactagaactcagctgggttggtgaattaactaatggaagacatgaaattgttccaaaagatataagagaagaagcagagaaatatgctaaggaatctctgaaggaagaagatgaatcagatgatgataatatgtaacatttactccagcatctattgtattttaaatttctactccagtccaatgtaactatttagccctggattatacatactgtccaattttcattaaatttttgtcttataa

SEQ ID NO: 364983 - DNA, 1036 bp, Homo sapiens
ggcagttcagccaatgagcgggcctgttactagtttgcggcatcctgtggtataggggaagcgctccgggcctggaatccctacgcgtccctttgggtttagcacgatgagctcaatcggcactgggtatgacctgtcagcctctacattctctcctgacggaagagtttttcaagttgaatatgctatgaaggctgtggaaaatagtagtacagctattggaatcagatgcaaagatggtgttgtctttggggtagaaaaattagtcctttctaaactttatgaagaaggttccaacaaaagactttttaatgttgatcggcatgttggaatggcagtagcaggtttgttggcagatgctcgttctttagcagacatagcaagagaagaagcttccaacttcagatctaactttggctacaacattccactaaaacatcttgcagacagagtggccatgtatgtgcatgcatatacactctacagtgctgttagaccttttggctgcagtttcatgttagggtcttacagtgtgaatgacggtgcgcaactctacatgattgacccatcaggtgtttcatacggttattggggctgtgccatcggcaaagccaggcaagctgcaaagacggaaatagagaagcttcagatgaaagaaatgacctgccgtgatatcgttaaagaagttgcaaaaattgtaagttgaaatttttcttaccatccacaaaaatatttcatttgacctttgcatatatatattacattaatcctaagaagctgttttcctgtaaaataacttagtgtataatttttagaaggtaaatttaacattctaagaagcctcacgaaggaagaaaatgtttttaagcaatattttttagtagtaatgaataggatgggaaaaatagcttgacaaaataaactcctgttacaggttaaggacatataccattagggtcttaatttgttagctcccaacttctcaaatctcttaagtcctaataatagtaatcttaagattgcctctattgtaaga

SEQ ID NO: 364984 - DNA, 1914 bp, Homo sapiens
ggcagttcagccaatgagcgggcctgttactagtttgcggcatcctgtggtataggggaagcgctccgggcctggaatccctacgcgtccctttgggtttagcacgatgagctcaatcggcactgggtacagctattggaatcagatgcaaagatggtgttgtctttggggtagaaaaattagtcctttctaaactttatgaagaaggttccaacaaaagactttttaatgttgatcggcatgttggaatggcagtagcaggtttgttggcagatgctcgttctttagcagacatagcaagagaagaagcttccaacttcagatctaactttggctacaacattccactaaaacatcttgcagacagagtggccatgtatgtgcatgcatatacactctacagtgctgttagaccttttggctgcagtttcatgttagggtcttacagtgtgaatgacggtgcgcaactctacatgattgacccatcaggtgtttcatacggttattggggctgtgccatcggcaaagccaggcaagctgcaaagacggaaatagagaagcttcagatgaaagaaatgacctgccgtgatatcgttaaagaagttgcaaaaataatttacatagtacatgacgaagttaaggataaagcttttgaactagaactcagctgggttggtgaattaactaatggaagacatgaaattgttccaaaagatataagagaagaagcagagaaatatgctaaggaatctctgaaggaagaagatgaatcagatgatgataatatgtaacatttactccagcatctattgtattttaaatttctactccagtccaatgtaactatttagccctggattatacatactgtccaattttcattaaatttttgtcttataactattgaagtttggttaatatctgctttacaaaattggtgggggtaaatgaggacatttactcagtattaaaatatagatttatgactactgaaaaattccctggttaaaatgctgcagaattaattccaagactgtagattaattcaaagccccatcttcatcactcaactagaatttacagatcatattctcctgggcttttgtacaaaaagcacctaccaacttagtggacaaataactgatacggtttcccaccttcatatgaagtaactggtggtcatcagtcactgttaatctttagatgtgatacagatgacagatgtttcagttttggataatttttcaaaaactgacccttcctcaaaaaagacccttcaatacatgagtcaaggatgtttttgcttttttcctttattgtggtgaggggcggatttaaggatcaataaagtccctattctgtcactaaaaaaatttcttgatctctaaagattaaaataaaaataccaacatcagacagctttcatgttaaaaatcagaatttatgttaaagtgctctgtaaacagaactgttactaagtggaataaacagtactgtggccgataagaataacttgaagctgaaaagcagtactcacagcaggaacaatttgaactcaggccatgtatacacaccctctagtggactcatgccagtgtcactccattgaagtgttgtgctttcctaagaaggtaatctagccactgaatttgggtgcagggtatcgctggactttgagcatttgtgtagtttaaatagcaaatcattatacctgagtattaatagctaactactacacaaacaactcaaaaccagtaatgtcatgtcattaccatggcttcttttatgtaacattatctgctacattttaccactcaaaatatatttaaaatatgtattttaaaatatattagagcatatggctcaagcaatcctcccacctcagcctcccaagtagctgggaccacaggcaag

SEQ ID NO: 364985 - DNA, 1028 bp, Homo sapiens
ggcagttcagccaatgagcgggcctgttactagtttgcggcatcctgtggtataggggaagcgctccgggcctggaatccctacgcgtccctttgggtttagcacgatgagctcaatcggcactgggtatgacctgtcagcctctacattctctcctgacggaagagtttttcaagttgaatatgctatgaaggctgtggaaaatagtagtacagctattggaatcagatgcaaagatggtgttgtctttggggtagaaaaattagtcctttctaaactttatgaagaaggttccaacaaaagactttttaatgttgatcggcatgttggaatggcagtagcaggtttgttggcagatgctcgttctttagcagacatagcaagagaagaagcttccaacttcagatctaactttggctacaacattccactaaaacatcttgcagacagagtggccatgtatgtgcatgcatatacactctacagtgctgttagaccttttggctgcagtttcatgttagggtcttacagtgtgaatgacggtgcgcaactctacatgattgacccatcaggtgtttcatacggttattggggctgtgccatcggcaaagccaggcaagctgcaaagacggaaatagagaagcttcaggtaataattaatgcttgaatttttactatgtcgtcatcctaatgcagtgaaattttatcaccacagacatttcagtctaaggcagggatgtccaatcatttggcttccctgggccacacataaaatacaccaacactaatgatagctgatgagcttaaaaaaaaatctcatcatgtgttaagaaagtttacgaatttgtgtttggccccatgtggcctgtggctggggaagctcggtgtaaggatatagtgtggtttgatgttgagagtttatgaagctgctaagtcactgaatgggaaagctggtaacatattatctgtagagttgtgttatacatccctttatagattctgaataactgctataaagcctcaatcta

SEQ ID NO: 364986 - DNA, 962 bp, Homo sapiens
ggcagttcagccaatgagcgggcctgttactagtttgcggcatcctgtggtataggggaagcgctccgggcctggaatccctacgcgtccctttgggtttagcacgatgagctcaatcggcactgggtatgacctgtcagcctctacattctctcctgacggaagagtttttcaagttgaatatgctatgaaggctgtggaaaatagtagtacagctattggaatcagatgcaaagatggtgttgtctttggggtagaaaaattagtcctttctaaactttatgaagaaggttccaacaaaagactttttaatgttgatcggcatgttggaatggcagtagcaggtttgttggcagatgctcgttctttagcagacatagcaagagaagaagcttccaacttcagatctaactttggctacaacattccactaaaacatcttgcagacagagtggccatgtatgtgcatgcatatacactctacagtgctgttagaccttttggctgcaggtaagaaattttgtgaattattcaaaaggcagatctgtactatagatatttattatgttccccagcatcttagccttttacatacttaaaaatagaaactcttgtcgataagtattagggcaatgattaaataaaacagtgtacatagaaactacttgaggctgggtgccatggctcaagcctgtaatcccagtactttgggaggttgaggtgggaggatccctcgcgcccaggagtatgagaccagcctggccaacgcagtgagaacctatctctacaaaaaaaatttaaaatttagccaggtgcagtatcacatgcctgtagtcacagctacttaggagctgcttgagaggatcatttgagcccaggagttgaaggctggaatgagctgtggccataccactgtactctagctggcgcaatagagactctgcctctttaaaaaaaaaaaa

SEQ ID NO: 364987 - DNA, 4370 bp, Homo sapiens
gagctccgccacgcgaggtttcgggctcgtggttttgcttcctccggccaaggtccccgccgctgcatccctcgcggcttccgctgcgctccgggccggagccgagccgcctgcgctgccacagcagccgcctccacacactcgcagacgctcacacgctctccctccctgttcccccgccccctccccagctccttgatctctgggtctgttttattactcctggtgcgagtcccgcggactccgcggcccgctatttgtcatcagctcgctctccattggcggggagcggagagcagcgaagaagggggtggggaggggaggggaagggaagggggtggaaactgcctggagccgtttctccgcgccgctgttggtgctgccgctgcctcctcctcctccgccgccgccgccgccgccgccgcctcctccggctcttcgctcggcccctctccgcctccatgtgccggatagcgggagcgctgcggaccctgctgccgctgctggcggccctgcttcaggcgtctgtagaggcttctggtgaaatcgcattatgcaagactggatttcctgaagatgtttacagtgcagtcttatcgaaggatgtgcatgaaggacagcctcttctcaatgtgaagtttagcaactgcaatggaaaaagaaaagtacaatatgagagcagtgagcctgcagattttaaggtggatgaagatggcatggtgtatgccgtgagaagctttccactctcttctgagcatgccaagttcctgatatatgcccaagacaaagagacccaggaaaagtggcaagtggcagtaaaattgagcctgaagccaaccttaactgaggagtcagtgaaggagtcagcagaagttgaagaaatagtgttcccaagacaattcagtaagcacagtggccacctacaaaggcagaagagagactgggtcatccctccaatcaacttgccagaaaactccaggggaccttttcctcaagagcttgtcaggatcaggtctgatagagataaaaacctttcactgcggtacagtgtaactgggccaggagctgaccagcctccaactggtatcttcattatcaaccccatctcgggtcagctgtcggtgacaaagcccctggatcgcgagcagatagcccggtttcatttgagggcacatgcagtagatattaatggaaatcaagtggagaaccccattgacattgtcatcaatgttattgacatgaatgacaacagacctgagttcttacaccaggtttggaatgggacagttcctgagggatcaaagcctggaacatatgtgatgaccgtaacagcaattgatgctgacgatcccaatgccctcaatgggatgttgaggtacagaatcgtgtctcaggctccaagcaccccttcacccaacatgtttacaatcaacaatgagactggtgacatcatcacagtggcagctggacttgatcgagaaaaagtgcaacagtatacgttaataattcaagctacagacatggaaggcaatcccacatatggcctttcaaacacagccacggccgtcatcacagtgacagatgtcaatgacaatcctccagagtttactgccatgacgttttatggtgaagttcctgagaacagggtagacatcatagtagctaatctaactgtgaccgataaggatcaaccccatacaccagcctggaacgcagtgtacagaatcagtggcggagatcctactggacggttcgccatccagaccgacccaaacagcaacgacgggttagtcaccgtggtcaaaccaatcgactttgaaacaaataggatgtttgtccttactgttgctgcagaaaatcaagtgccattagccaagggaattcagcacccgcctcagtcaactgcaaccgtgtctgttacagttattgacgtaaatgaaaacccttattttgcccccaatcctaagatcattcgccaagaagaagggcttcatgccggtaccatgttgacaacattcactgctcaggacccagatcgatatatgcagcaaaatattagatacactaaattatctgatcctgccaattggctaaaaatagatcctgtgaatggacaaataactacaattgctgttttggaccgagaatcaccaaatgtgaaaaacaatatatataatgctactttccttgcttctgacaatggaattcctcctatgagtggaacaggaacgctgcagatctatttacttgatattaatgacaatgcccctcaagtgttacctcaagaggcagagacttgcgaaactccagaccccaattcaattaatattacagcacttgattatgacattgatccaaatgctggaccatttgcttttgatcttcctttatctccagtgactattaagagaaattggaccatcactcggcttaatggtgattttgctcagcttaatttaaagataaaatttcttgaagctggtatctatgaagttcccatcataatcacagattcgggtaatcctcccaaatcaaatatttccatcctgcgcgtgaaggtttgccagtgtgactccaacggggactgcacagatgtggacaggattgtgggtgcggggcttggcaccggtgccatcattgccatcctgctctgcatcatcatcctgcttatccttgtgctgatgtttgtggtatggatgaaacgccgggataaagaacgccaggccaaacaacttttaattgatccagaagatgatgtaagagataatattttaaaatatgatgaagaaggtggaggagaagaagaccaggactatgacttgagccagctgcagcagcctgacactgtggagcctgatgccatcaagcctgtgggaatccgacgaatggatgaaagacccatccacgccgagccccagtatccggtccgatctgcagccccacaccctggagacattggggacttcattaatgagggccttaaagcggctgacaatgaccccacagctccaccatatgactccctgttagtgtttgactatgaaggcagtggctccactgctgggtccttgagctcccttaattcctcaagtagtggtggtgagcaggactatgattacctgaacgactgggggccacggttcaagaaacttgctgacatgtatggtggaggtgatgactgaacttcagggtgaacttggtttttggacaagtacaaacaatttcaactgatattcccaaaaagcattcagaagctaggctttaactttgtagtctactagcacagtgcttgctggaggctttggcataggctgcaaaccaatttgggctcagagggaatatcagtgatccatactgtttggaaaaacactgagctcagttacacttgaattttacagtacagaagcactgggattttatgtgcctttttgtacctttttcagattggaattagttttctgtttaaggctttaatggtactgatttctgaaacgataagtaaaagacaaaatattttgtggtgggagcagtaagttaaaccatgatatgcttcaacacgcttttgttacattgcatttgcttttattaaaatacaaaattaaacaaacaaaaaaactcatggagcgattttattatcttgggggatgagaccatgagattggaaaatgtacattacttctagttttagactttagtttgttttttttttttttcactaaaatcttaaaacttactcagctggttgcaaataaagggagttttcatatcaccaatttgtagcaaaattgaattttttcataaactagaatgttagacacattttggtcttaatccatgtacacttttttatttctgtatttttccacttcactgtaaaaatagtatgtgtacataatgttttattggcatagtctatggagaagtgcagaaacttcagaacatgtgtatgtattatttggactatggattcaggttttttgcatgtttatatctttcgttatggataaagtatttacaaaacagtgacatttgattcaattgttgagctgtagttagaatactcaatttttaatttttttaatttttttattttttattttctttttggtttggggagggagaaaagttcttagcacaaatgttttacataatttgtaccaaaaaaaaaaaaaaaggaaaggaaagaaaggggtggcctgacactggtggcactactaagtgtgtgtttttttaaaaaaaaaatggaaaaaaaaaagcttttaaactggagagacttctgacaacagctttgcctctgtattgtgtaccagaatataaatgatacacctctgaccccagcgttctgaataaaatgctaattttggatctgg

SEQ ID NO: 364988 - DNA, 3852 bp, Homo sapiens
agcagaaggaattatgggaaatggaaacttgatggcatgtttttattaaggcgttatgtgtgtatcttcactgagaaattaaagaaccaagcagaattgtatgttttcctttcagtgaagtttagcaactgcaatggaaaaagaaaagtacaatatgagagcagtgagcctgcagattttaaggtggatgaagatggcatggtgtatgccgtgagaagctttccactctcttctgagcatgccaagttcctgatatatgcccaagacaaagagacccaggaaaagtggcaagtggcagtaaaattgagcctgaagccaaccttaactgaggagtcagtgaaggagtcagcagaagttgaagaaatagtgttcccaagacaattcagtaagcacagtggccacctacaaaggcagaagagagactgggtcatccctccaatcaacttgccagaaaactccaggggaccttttcctcaagagcttgtcaggatcaggtctgatagagataaaaacctttcactgcggtacagtgtaactgggccaggagctgaccagcctccaactggtatcttcattatcaaccccatctcgggtcagctgtcggtgacaaagcccctggatcgcgagcagatagcccggtttcatttgagggcacatgcagtagatattaatggaaatcaagtggagaaccccattgacattgtcatcaatgttattgacatgaatgacaacagacctgagttcttacaccaggtttggaatgggacagttcctgagggatcaaagcctggaacatatgtgatgaccgtaacagcaattgatgctgacgatcccaatgccctcaatgggatgttgaggtacagaatcgtgtctcaggctccaagcaccccttcacccaacatgtttacaatcaacaatgagactggtgacatcatcacagtggcagctggacttgatcgagaaaaagtgcaacagtatacgttaataattcaagctacagacatggaaggcaatcccacatatggcctttcaaacacagccacggccgtcatcacagtgacagatgtcaatgacaatcctccagagtttactgccatgacgttttatggtgaagttcctgagaacagggtagacatcatagtagctaatctaactgtgaccgataaggatcaaccccatacaccagcctggaacgcagtgtacagaatcagtggcggagatcctactggacggttcgccatccagaccgacccaaacagcaacgacgggttagtcaccgtggtcaaaccaatcgactttgaaacaaataggatgtttgtccttactgttgctgcagaaaatcaagtgccattagccaagggaattcagcacccgcctcagtcaactgcaaccgtgtctgttacagttattgacgtaaatgaaaacccttattttgcccccaatcctaagatcattcgccaagaagaagggcttcatgccggtaccatgttgacaacattcactgctcaggacccagatcgatatatgcagcaaaatattagatacactaaattatctgatcctgccaattggctaaaaatagatcctgtgaatggacaaataactacaattgctgttttggaccgagaatcaccaaatgtgaaaaacaatatatataatgctactttccttgcttctgacaatggaattcctcctatgagtggaacaggaacgctgcagatctatttacttgatattaatgacaatgcccctcaagtgttacctcaagaggcagagacttgcgaaactccagaccccaattcaattaatattacagcacttgattatgacattgatccaaatgctggaccatttgcttttgatcttcctttatctccagtgactattaagagaaattggaccatcactcggcttaatggtgattttgctcagcttaatttaaagataaaatttcttgaagctggtatctatgaagttcccatcataatcacagattcgggtaatcctcccaaatcaaatatttccatcctgcgcgtgaaggtttgccagtgtgactccaacggggactgcacagatgtggacaggattgtgggtgcggggcttggcaccggtgccatcattgccatcctgctctgcatcatcatcctgcttatccttgtgctgatgtttgtggtatggatgaaacgccgggataaagaacgccaggccaaacaacttttaattgatccagaagatgatgtaagagataatattttaaaatatgatgaagaaggtggaggagaagaagaccaggactatgacttgagccagctgcagcagcctgacactgtggagcctgatgccatcaagcctgtgggaatccgacgaatggatgaaagacccatccacgccgagccccagtatccggtccgatctgcagccccacaccctggagacattggggacttcattaatgagggccttaaagcggctgacaatgaccccacagctccaccatatgactccctgttagtgtttgactatgaaggcagtggctccactgctgggtccttgagctcccttaattcctcaagtagtggtggtgagcaggactatgattacctgaacgactgggggccacggttcaagaaacttgctgacatgtatggtggaggtgatgactgaacttcagggtgaacttggtttttggacaagtacaaacaatttcaactgatattcccaaaaagcattcagaagctaggctttaactttgtagtctactagcacagtgcttgctggaggctttggcataggctgcaaaccaatttgggctcagagggaatatcagtgatccatactgtttggaaaaacactgagctcagttacacttgaattttacagtacagaagcactgggattttatgtgcctttttgtacctttttcagattggaattagttttctgtttaaggctttaatggtactgatttctgaaacgataagtaaaagacaaaatattttgtggtgggagcagtaagttaaaccatgatatgcttcaacacgcttttgttacattgcatttgcttttattaaaatacaaaattaaacaaacaaaaaaactcatggagcgattttattatcttgggggatgagaccatgagattggaaaatgtacattacttctagttttagactttagtttgttttttttttttttcactaaaatcttaaaacttactcagctggttgcaaataaagggagttttcatatcaccaatttgtagcaaaattgaattttttcataaactagaatgttagacacattttggtcttaatccatgtacacttttttatttctgtatttttccacttcactgtaaaaatagtatgtgtacataatgttttattggcatagtctatggagaagtgcagaaacttcagaacatgtgtatgtattatttggactatggattcaggttttttgcatgtttatatctttcgttatggataaagtatttacaaaacagtgacatttgattcaattgttgagctgtagttagaatactcaatttttaatttttttaatttttttattttttattttctttttggtttggggagggagaaaagttcttagcacaaatgttttacataatttgtaccaaaaaaaaaaaaaaaggaaaggaaagaaaggggtggcctgacactggtggcactactaagtgtgtgtttttttaaaaaaaaaatggaaaaaaaaaagcttttaaactggagagacttctgacaacagctttgcctctgtattgtgtaccagaatataaatgatacacctctgaccccagcgttctgaataaaatgctaattttggatctgg

SEQ ID NO: 364989 - DNA, 4316 bp, Homo sapiens
gagctccgccacgcgaggtttcgggctcgtggttttgcttcctccggccaaggtccccgccgctgcatccctcgcggcttccgctgcgctccgggccggagccgagccgcctgcgctgccacagcagccgcctccacacactcgcagacgctcacacgctctccctccctgttcccccgccccctccccagctccttgatctctgggtctgttttattactcctggtgcgagtcccgcggactccgcggcccgctatttgtcatcagctcgctctccattggcggggagcggagagcagcgaagaagggggtggggaggggaggggaagggaagggggtggaaactgcctggagccgtttctccgcgccgctgttggtgctgccgctgcctcctcctcctccgccgccgccgccgccgccgccgcctcctccggctcttcgctcggcccctctccgcctccatgtgccggatagcgggagcgctgcggaccctgctgccgctgctggcggccctgcttcaggcgtctgtagaggcttctggtgaaatcgcattatgcaagactggatttcctgaagatgtttacagtgcagtcttatcgaaggatgtgcatgaaggacagcctcttctcaatgtgaagtttagcaactgcaatggaaaaagaaaagtacaatatgagagcagtgagcctgcagattttaaggtggatgaagatggcatggtgtatgccgtgagaagctttccactctcttctgagcatgccaagttcctgatatatgcccaagacaaagagacccaggaaaagtggcaagtggcagtaaaattgagcctgaagccaaccttaactgaggagtcagtgaaggagtcagcagaagttgaagaaatagtgttcccaagacaattcagtaagcacagtggccacctacaaaggcagaagagagactgggtcatccctccaatcaacttgccagaaaactccaggggaccttttcctcaagagcttgtcaggatcaggtctgatagagataaaaacctttcactgcggtacagtgtaactgggccaggagctgaccagcctccaactggtatcttcattatcaaccccatctcgggtcagctgtcggtgacaaagcccctggatcgcgagcagatagcccggtttcatttgagggcacatgcagtagatattaatggaaatcaagtggagaaccccattgacattgtcatcaatgttattgacatgaatgacaacagacctgagttcttacaccaggtttggaatgggacagttcctgagggatcaaagcctggaacatatgtgatgaccgtaacagcaattgatgctgacgatcccaatgccctcaatgggatgttgaggtacagaatcgtgtctcaggctccaagcaccccttcacccaacatgtttacaatcaacaatgagactggtgacatcatcacagtggcagctggacttgatcgagaaaaagtgcaacagtatacgttaataattcaagctacagacatggaaggcaatcccacatatggcctttcaaacacagccacggccgtcatcacagtgacagatgtcaatgacaatcctccagagtttactgccatgacgttttatggtgaagttcctgagaacagggtagacatcatagtagctaatctaactgtgaccgataaggatcaaccccatacaccagcctggaacgcagtgtacagaatcagtggcggagatcctactggacggttcgccatccagaccgacccaaacagcaacgacgggttagtcaccgtggtcaaaccaatcgactttgaaacaaataggatgtttgtccttactgttgctgcagaaaatcaagtgccattagccaagggaattcagcacccgcctcagtcaactgcaaccgtgtctgttacagttattgacgtaaatgaaaacccttattttgcccccaatcctaagatcattcgccaagaagaagggcttcatgccggtaccatgttgacaacattcactgctcaggacccagatcgatatatgcagcaaaatattagatacactaaattatctgatcctgccaattggctaaaaatagatcctgtgaatggacaaataactacaattgctgttttggaccgagaatcaccaaatgtgaaaaacaatatatataatgctactttccttgcttctgacaatggaattcctcctatgagtggaacaggaacgctgcagatctatttacttgatattaatgacaatgcccctcaagtgttacctcaagaggcagagacttgcgaaactccagaccccaattcaattaatattacagcacttgattatgacattgatccaaatgctggaccatttgcttttgatcttcctttatctccagtgactattaagagaaattggaccatcactcggcttaatggtgattttgctcagcttaatttaaagataaaatttcttgaagctggtatctatgaagttcccatcataatcacagattcgggtaatcctcccaaatcaaatatttccatcctgcgcgtgaaggtttgccagtgtgactccaacggggactgcacagatgtggacaggattgtgggtgcggggcttggcaccggtgccatcattgccatcctgctctgcatcatcatcctgcttatccttgtgctgatgtttgtggtatggatgaaacgccgggataaagaacgccaggccaaacaacttttaattgatccagaagatgatgtaagagataatattttactgcagcagcctgacactgtggagcctgatgccatcaagcctgtgggaatccgacgaatggatgaaagacccatccacgccgagccccagtatccggtccgatctgcagccccacaccctggagacattggggacttcattaatgagggccttaaagcggctgacaatgaccccacagctccaccatatgactccctgttagtgtttgactatgaaggcagtggctccactgctgggtccttgagctcccttaattcctcaagtagtggtggtgagcaggactatgattacctgaacgactgggggccacggttcaagaaacttgctgacatgtatggtggaggtgatgactgaacttcagggtgaacttggtttttggacaagtacaaacaatttcaactgatattcccaaaaagcattcagaagctaggctttaactttgtagtctactagcacagtgcttgctggaggctttggcataggctgcaaaccaatttgggctcagagggaatatcagtgatccatactgtttggaaaaacactgagctcagttacacttgaattttacagtacagaagcactgggattttatgtgcctttttgtacctttttcagattggaattagttttctgtttaaggctttaatggtactgatttctgaaacgataagtaaaagacaaaatattttgtggtgggagcagtaagttaaaccatgatatgcttcaacacgcttttgttacattgcatttgcttttattaaaatacaaaattaaacaaacaaaaaaactcatggagcgattttattatcttgggggatgagaccatgagattggaaaatgtacattacttctagttttagactttagtttgttttttttttttttcactaaaatcttaaaacttactcagctggttgcaaataaagggagttttcatatcaccaatttgtagcaaaattgaattttttcataaactagaatgttagacacattttggtcttaatccatgtacacttttttatttctgtatttttccacttcactgtaaaaatagtatgtgtacataatgttttattggcatagtctatggagaagtgcagaaacttcagaacatgtgtatgtattatttggactatggattcaggttttttgcatgtttatatctttcgttatggataaagtatttacaaaacagtgacatttgattcaattgttgagctgtagttagaatactcaatttttaatttttttaatttttttattttttattttctttttggtttggggagggagaaaagttcttagcacaaatgttttacataatttgtaccaaaaaaaaaaaaaaaggaaaggaaagaaaggggtggcctgacactggtggcactactaagtgtgtgtttttttaaaaaaaaaatggaaaaaaaaaagcttttaaactggagagacttctgacaacagctttgcctctgtattgtgtaccagaatataaatgatacacctctgaccccagcgttctgaataaaatgctaattttggatctgg

SEQ ID NO: 364990 - DNA, 4316 bp, Homo sapiens
gagctccgccacgcgaggtttcgggctcgtggttttgcttcctccggccaaggtccccgccgctgcatccctcgcggcttccgctgcgctccgggccggagccgagccgcctgcgctgccacagcagccgcctccacacactcgcagacgctcacacgctctccctccctgttcccccgccccctccccagctccttgatctctgggtctgttttattactcctggtgcgagtcccgcggactccgcggcccgctatttgtcatcagctcgctctccattggcggggagcggagagcagcgaagaagggggtggggaggggaggggaagggaagggggtggaaactgcctggagccgtttctccgcgccgctgttggtgctgccgctgcctcctcctcctccgccgccgccgccgccgccgccgcctcctccggctcttcgctcggcccctctccgcctccatgtgccggatagcgggagcgctgcggaccctgctgccgctgctggcggccctgcttcaggcgtctgtagaggcttctggtgaaatcgcattatgcaagactggatttcctgaagatgtttacagtgcagtcttatcgaaggatgtgcatgaaggacagcctcttctcaatgtgaagtttagcaactgcaatggaaaaagaaaagtacaatatgagagcagtgagcctgcagattttaaggtggatgaagatggcatggtgtatgccgtgagaagctttccactctcttctgagcatgccaagttcctgatatatgcccaagacaaagagacccaggaaaagtggcaagtggcagtaaaattgagcctgaagccaaccttaactgaggagtcagtgaaggagtcagcagaagttgaagaaatagtgttcccaagacaattcagtaagcacagtggccacctacaaaggcagaagagagactgggtcatccctccaatcaacttgccagaaaactccaggggaccttttcctcaagagcttgtcaggatcaggtctgatagagataaaaacctttcactgcggtacagtgtaactgggccaggagctgaccagcctccaactggtatcttcattatcaaccccatctcgggtcagctgtcggtgacaaagcccctggatcgcgagcagatagcccggtttcatttgagggcacatgcagtagatattaatggaaatcaagtggagaaccccattgacattgtcatcaatgttattgacatgaatgacaacagacctgagttcttacaccaggtttggaatgggacagttcctgagggatcaaagcctggaacatatgtgatgaccgtaacagcaattgatgctgacgatcccaatgccctcaatgggatgttgaggtacagaatcgtgtctcaggctccaagcaccccttcacccaacatgtttacaatcaacaatgagactggtgacatcatcacagtggcagctggacttgatcgagaaaaagtgcaacagtatacgttaataattcaagctacagacatggaaggcaatcccacatatggcctttcaaacacagccacggccgtcatcacagtgacagatgtcaatgacaatcctccagagtttactgccatgacgttttatggtgaagttcctgagaacagggtagacatcatagtagctaatctaactgtgaccgataaggatcaaccccatacaccagcctggaacgcagtgtacagaatcagtggcggagatcctactggacggttcgccatccagaccgacccaaacagcaacgacgggttagtcaccgtggtcaaaccaatcgactttgaaacaaataggatgtttgtccttactgttgctgcagaaaatcaagtgccattagccaagggaattcagcacccgcctcagtcaactgcaaccgtgtctgttacagttattgacgtaaatgaaaacccttattttgcccccaatcctaagatcattcgccaagaagaagggcttcatgccggtaccatgttgacaacattcactgctcaggacccagatcgatatatgcagcaaaatattagatacactaaattatctgatcctgccaattggctaaaaatagatcctgtgaatggacaaataactacaattgctgttttggaccgagaatcaccaaatgtgaaaaacaatatatataatgctactttccttgcttctgacaatggaattcctcctatgagtggaacaggaacgctgcagatctatttacttgatattaatgacaatgcccctcaagtgttacctcaagaggcagagacttgcgaaactccagaccccaattcaattaatattacagcacttgattatgacattgatccaaatgctggaccatttgcttttgatcttcctttatctccagtgactattaagagaaattggaccatcactcggcttaatggtgattttgctcagcttaatttaaagataaaatttcttgaagctggtatctatgaagttcccatcataatcacagattcgggtaatcctcccaaatcaaatatttccatcctgcgcgtgaaggtttgccagtgtgactccaacggggactgcacagatgtggacaggattgtgggtgcggggcttggcaccggtgccatcattgccatcctgctctgcatcatcatcctgcttatccttgtgctgatgtttgtggtatggatgaaacgccgggataaagaacgccaggccaaacaacttttaattgatccagaagatgatgtaagagataatattttaaaatatgatgaagaaggtggaggagaagaagaccaggactatgacttgagccagctgcagcagcctgacactgtggagcctgatgccatcaagcctgtgggaatccgacgaatggatgaaagacccatccacgccgagccccagtatccggtccgatctgcagccccacaccctggagacattggggacttcattaatgagggccttaaagcggctgacaatgaccccacagctccaccatatgactccctgttagtgtttgactatgaaggcagtggctccactgctgggtccttgagctcccttaattcctcaagtagtggtggtgagcaggactatgattacctgaacgactgggggccacggttcaagaaacttgctgacatgtatggtggaggtgatgactgaacttcagggtgaacttggtttttggacaagtacaaacaatttcaactgatattcccatggaggctttggcataggctgcaaaccaatttgggctcagagggaatatcagtgatccatactgtttggaaaaacactgagctcagttacacttgaattttacagtacagaagcactgggattttatgtgcctttttgtacctttttcagattggaattagttttctgtttaaggctttaatggtactgatttctgaaacgataagtaaaagacaaaatattttgtggtgggagcagtaagttaaaccatgatatgcttcaacacgcttttgttacattgcatttgcttttattaaaatacaaaattaaacaaacaaaaaaactcatggagcgattttattatcttgggggatgagaccatgagattggaaaatgtacattacttctagttttagactttagtttgttttttttttttttcactaaaatcttaaaacttactcagctggttgcaaataaagggagttttcatatcaccaatttgtagcaaaattgaattttttcataaactagaatgttagacacattttggtcttaatccatgtacacttttttatttctgtatttttccacttcactgtaaaaatagtatgtgtacataatgttttattggcatagtctatggagaagtgcagaaacttcagaacatgtgtatgtattatttggactatggattcaggttttttgcatgtttatatctttcgttatggataaagtatttacaaaacagtgacatttgattcaattgttgagctgtagttagaatactcaatttttaatttttttaatttttttattttttattttctttttggtttggggagggagaaaagttcttagcacaaatgttttacataatttgtaccaaaaaaaaaaaaaaaggaaaggaaagaaaggggtggcctgacactggtggcactactaagtgtgtgtttttttaaaaaaaaaatggaaaaaaaaaagcttttaaactggagagacttctgacaacagctttgcctctgtattgtgtaccagaatataaatgatacacctctgaccccagcgttctgaataaaatgctaattttggatctgg

SEQ ID NO: 364991 - DNA, 3228 bp, Homo sapiens
gagctccgccacgcgaggtttcgggctcgtggttttgcttcctccggccaaggtccccgccgctgcatccctcgcggcttccgctgcgctccgggccggagccgagccgcctgcgctgccacagcagccgcctccacacactcgcagacgctcacacgctctccctccctgttcccccgccccctccccagctccttgatctctgggtctgttttattactcctggtgcgagtcccgcggactccgcggcccgctatttgtcatcagctcgctctccattggcggggagcggagagcagcgaagaagggggtggggaggggaggggaagggaagggggtggaaactgcctggagccgtttctccgcgccgctgttggtgctgccgctgcctcctcctcctccgccgccgccgccgccgccgccgcctcctccggctcttcgctcggcccctctccgcctccatgtgccggatagcgggagcgctgcggaccctgctgccgctgctggcggccctgcttcaggcgtctgtagaggcttctggtgaaatcgcattatgcaagactggatttcctgaagatgtttacagtgcagtcttatcgaaggatgtgcatgaaggacagcctcttctcaatgtgaagtttagcaactgcaatggaaaaagaaaagtacaatatgagagcagtgagcctgcagattttaaggtggatgaagatggcatggtgtatgccgtgagaagctttccactctcttctgagcatgccaagttcctgatatatgcccaagacaaagagacccaggaaaagtggcaagtggcagtaaaattgagcctgaagccaaccttaactgaggagtcagtgaaggagtcagcagaagttgaagaaatagtgttcccaagacaattcagtaagcacagtggccacctacaaaggcagaagagagactgggtcatccctccaatcaacttgccagaaaactccaggggaccttttcctcaagagcttgtcaggatcaggtctgatagagataaaaacctttcactgcggtacagtgtaactgggccaggagctgaccagcctccaactggtatcttcattatcaaccccatctcgggtcagctgtcggtgacaaagcccctggatcgcgagcagatagcccggtttcatttgagggcacatgcagtagatattaatggaaatcaagtggagaaccccattgacattgtcatcaatgttattgacatgaatgacaacagacctgagttcttacaccaggtttggaatgggacagttcctgagggatcaaagcctggaacatatgtgatgaccgtaacagcaattgatgctgacgatcccaatgccctcaatgggatgttgaggtacagaatcgtgtctcaggctccaagcaccccttcacccaacatgtttacaatcaacaatgagactggtgacatcatcacagtggcagctggacttgatcgagaaaaagtgcaacagtatacgttaataattcaagctacagacatggaaggcaatcccacatatggcctttcaaacacagccacggccgtcatcacagtgacagatgtcaatgacaatcctccagagtttactgccatgacgttttatggtgaagttcctgagaacagggtagacatcatagtagctaatctaactgtgaccgataaggatcaaccccatacaccagcctggaacgcagtgtacagaatcagtggcggagatcctactggacggttcgccatccagaccgacccaaacagcaacgacgggttagtcaccgtggtcaaaccaatcgactttgaaacaaataggatgtttgtccttactgttgctgcagaaaatcaagtgccattagccaagggaattcagcacccgcctcagtcaactgcaaccgtgtctgttacagttattgacgtaaatgaaaacccttattttgcccccaatcctaagatcattcgccaagaagaagggcttcatgccggtaccatgttgacaacattcactgctcaggacccagatcgatatatgcagcaaaatattagatacactaaattatctgatcctgccaattggctaaaaatagatcctgtgaatggacaaataactacaattgctgttttggaccgagaatcaccaaatgtgaaaaacaatatatataatgctactttccttgcttctgacaatggaattcctcctatgagtggaacaggaacgctgcagatctatttacttgatattaatgacaatgcccctcaagtgttacctcaagaggcagagacttgcgaaactccagaccccaattcaattaatattacagcacttgattatgacattgatccaaatgctggaccatttgcttttgatcttcctttatctccagtgactattaagagaaattggaccatcactcggcttaatggtgattttgctcagcttaatttaaagataaaatttcttgaagctggtatctatgaagttcccatcataatcacagattcgggtaatcctcccaaatcaaatatttccatcctgcgcgtgaaggtttgccagtgtgactccaacggggactgcacagatgtggacaggattgtgggtgcggggcttggcaccggtgccatcattgccatcctgctctgcatcatcatcctgcttatccttgtgctgatgtttgtggtatggatgaaacgccgggataaagaacgccaggccaaacaacttttaattgatccagaagatgatgtaagagataatattttaaaatatgatgaagaaggtggaggagaagaagaccaggactatgacttgagccagctgcagcagcctgacactgtggagcctgatgccatcaagcctgtgggaatccgacgaatggatgaaagacccatccacgccgagccccagtatccggtccgatctgcagccccacaccctggagacattggggacttcattaatgagaaaacctggcccatacagagcttacacctatgaccttggcttcgtgggcaccatgatctcagcaatgcatctatcatgcctgcctttggacctaatgagtatgaaccacattacatcagagaagagtgccagggtcaacaattaatattttagagttacaactacatgtgaacctatgtacttgcattttcagcaatattgcagcatagtattatttatctctaaaataaaaaatgcatgaatatattatctg

SEQ ID NO: 364992 - DNA, 1913 bp, Homo sapiens
  misc_feature (1644)..(1644): n is a, c, g, or t
gagctccgccacgcgaggtttcgggctcgtggttttgcttcctccggccaaggtccccgccgctgcatccctcgcggcttccgctgcgctccgggccggagccgagccgcctgcgctgccacagcagccgcctccacacactcgcagacgctcacacgctctccctccctgttcccccgccccctccccagctccttgatctctgggtctgttttattactcctggtgcgagtcccgcggactccgcggcccgctatttgtcatcagctcgctctccattggcggggagcggagagcagcgaagaagggggtggggaggggaggggaagggaagggggtggaaactgcctggagccgtttctccgcgccgctgttggtgctgccgctgcctcctcctcctccgccgccgccgccgccgccgccgcctcctccggctcttcgctcggcccctctccgcctccatgtgccggatagcgggagcgctgcggaccctgctgccgctgctggcggccctgcttcaggcgtctgtagaggcttctggtgaaatcgcattatgcaagactggatttcctgaagatgtttacagtgcagtcttatcgaaggatgtgcatgaaggacagcctcttctcaatgtgaagtttagcaactgcaatggaaaaagaaaagtacaatatgagagcagtgagcctgcagattttaaggtggatgaagatggcatggtgtatgccgtgagaagctttccactctcttctgagcatgccaagttcctgatatatgcccaagacaaagagacccaggaaaagtggcaagtggcagtaaaattgagcctgaagccaaccttaactgaggagtcagtgaaggagtcagcagaagttgaagaaatagtgttcccaagacaattcagtaagcacagtggccacctacaaaggcagaagagagactgggtcatccctccaatcaacttgccagaaaactccaggggaccttttcctcaagagcttgtcaggatcaggtctgatagagataaaaacctttcactgcggtacagtgtaactgggccaggagctgaccagcctccaactggtatcttcattatcaaccccatctcgggtcagctgtcggtgacaaagcccctggatcgcgagcagatagcccggtttcatttgagggcacatgcagtagatattaatggaaatcaagtggagaaccccattgacattgtcatcaatgttattgacatgaatgacaacagacctgagttcttacaccaggtttggaatgggacagttcctgagggatcaaagcctggaacatatgtgatgaccgtaacagcaattgatgctgacgatcccaatgccctcaatgggatgttgaggtacagaatcgtgtctcaggctccaagcaccccttcacccaacatgtttacaatcaacaatgagactggtgacatcatcacagtggcagctggacttgatcgagaaaaagtgcaacagtatacgttaataattcaagctacagacatggaaggcaatcccacatatggcctttcaaacacagccacggccgtcatcacagtgacagatgtcaatgacaatcctccagagtttactgccatgacggtcctttaaggcaaaactgtggagncctagaggtgtgtgtgttaaggcaggtgtctgcagcagtggccagaggggcagggcacgctaggctgggctaggagttaagagtactgtctaaccagtctggcttcttccttcttccagcagccagccctcccctcccattaaagttttactcccacatcctgaaagctcctaacttgaactttgtctaaatagtctctgagactgcatgtgaatttaatgttttttgaaaaagccttcttttttgtttggactatgtagcaatttgat

SEQ ID NO: 364993 - DNA, 748 bp, Homo sapiens
tgcttaagtaagagtgttccactcagataggctagcatgagcaaggcagaagcctgaaacagttggatgtgttccagaaactgtaagcaattgaatacaatggaaatgaagttcatttacaagaccatgatgagagaattgacttttaggctgtggccacattgttgaaggacatgtgtaacactcaaaggatgaagtttagcaactgcaatggaaaaagaaaagtacaatatgagagcagtgagcctgcagattttaaggtggatgaagatggcatggtgtatgccgtgagaagctttccactctcttctgagcatgccaagttcctgatatatgcccaagacaaagagacccaggaaaagtggcaagtggcagtaaaattgagcctgaagccaaccttaactgaggagtcagtgaaggagtcagcagaagttgaagaaatagtgttcccaagacaattcagtaagcacagtggccacctacaaaggcagaagagagactgggtcatccctccaatcaacttgccagaaaactccaggggaccttttcctcaagagcttgtcaggatcaggtctgatagagataaaaacctttcactgcggtacagtgtaactgggccaggagctgaccagcctccaactggtatcttcattatcaaccccatctcgggtcagctgtcggtgacaaagcccctggatcgcgagcagatagcccggtttcatgtaagattccaaccagctgataattc

SEQ ID NO: 364994 - DNA, 532 bp, Homo sapiens
agaggagccgagaagcgcccctcggcccccacgcagcggaggcgcggagtggcgggactgctgctctttgtgggtgcagcacgcacgacccggagcgccctccccgcggcgctgtccccggcgtcttcgtcgcgccgagcggccctggagcggggacccggaggaagcaaaaccacgagcccgaaacctcgcgtggcggagctcttggggagcgccatccgctccacttccacctccacatcctccaccggccaaggtccccgccgctgcatccctcgcggcttccgctgcgctccgggccggagccgagccgcctgcgctgccacagcagccgcctccacacactcgcagacgctcacacgctctccctccctgttcccccgccccctccccagctccttgatctctgggtctgttttattactcctggtgcgagtcccgcggactccgcggcccgctatttgtcatcagctcgctctccattggcggggagcggagagcagcgaagaagggggtggggaggggaggggaa

SEQ ID NO: 364995 - DNA, 3225 bp, Homo sapiens
  misc_feature (348)..(348): n is a, c, g, or t
  misc_feature (679)..(679): n is a, c, g, or t
caagaacgtcctagccgccagcagcatctatttcaagtccctggtcctgcacgacaacctcatcaacctggacacagacatggtcagctccacagtgttccagcagatcttggacttcatctacacaggcaagctgctgcccagcgaccagccagccgagcccaacttcagcaccctcctcactgccgccagctacctccagctgcccgagttggcagccctctgccgccgcaaactcaagcgagccggcaagccctttggctctgggagggcggggtccactggcatggggcggcccccccgcagccagcggctgtccacggcctctgtcatccaagctcggtatcnggggctcgtggatgggcgcaagggggcccacgccccccaggagctcccccaagccaaaggctcagacgatgaactctttcttggtggctctaaccaggatagcgtgcaaggtctgggccgggctgtctgcccagctggcggggaggcgggtctggggggctgcagcagcagcaccaacgggagcagcgggggctgcgagcaggagctgggcttggacctgtccaagaaaagcccacccttgccccctgccaccccaggtccccacctcactcccgatgacgcagcccagctgagcgacagccaacatggctcgccccctgcggcctctgcncctcccgttgccaacagtgcctcttattctgagctggggggcacccctgatgagcccatggatctggagggggccgaggacaaccacctgagcctgctggaggcgcctggtgggcagcctcggaagagcctccggcactccactcggaagaaggagtggggcaagaaggagcctgtggctggctccccctttgagcggagagaagcagggcccaagggtccctgcccgggagaggagggtgagggggtcggggacagggttcccaatggcatcctggctagtggggctggccctagcgggccctatggggagcccccctacccctgcaaggaggaggaggagaacggcaaggatgcaagtgaagacagtgcgcagagcgggagcgaggggggcagcggccacgccagcgcccactacatgtaccggcaggagggctacgagacggtgtcctacggggacaacttgtatgtgtgcattccctgcgccaagggcttccccagctctgagcagctcaatgcgcacgtggagactcacacggaggaagagctgttcatcaaggaagagggggcctacgagacaggcagtgggggtgccgaggaggaggccgaggacctgtcagcacccagtgcggcctacacggctgagccccggcccttcaagtgttcggtctgcgagaagacctacaaggacccagccacgctgcggcagcacgagaagacgcactggctgacacggcccttcccctgcaacatctgtggcaaaatgttcacgcagcgcggcaccatgacgcgtcacatgcggagccacctgggcctgaagcccttcgcctgcgatgagtgtggcatgcgcttcacccgtcagtaccgcctcacggagcacatgcgtgtgcactcgggcgagaaaccttacgagtgccagctgtgcgggggcaagttcacccagcagcgcaacctcatcagccacctgcgcatgcacacctccccctcctagaagccaaagacccgcgggcgccctctgccaccttgctccccgggaacccatggaaggagaagcgaggtgatgcagcagcaggggcaagaccctgggtccagtggaggctccgggtggcccctctggcccccactgcccacacccagagctttaatggacagtccgtaccaagcagagccgagaggagggaagccaggggtcccagcccgtctacctccccatcccacccaggcccccagctccccgcgggggccaccgcagggcctgtgggctgggtcacgtgggtctcgctgggacctggtccctttgttgcaggcggcttggagaaagggcagtgggacgctggccacggccagggtggtgtcgggagcaggcctcaccccgctggccgtgtctgtgtgtgtgcacgtgtgcttgtgtctgtgcgggcgcgtgcagccctggttctgcagggaaaaggtgctgggggtgcagatccctccctccttgagccagggtggcactgttcactggcgctgggacagtcagggtgaccccaccgcctacctctctacaactaaagagccctctgggcctgtgttgctgttattcctactgatctgttcctctgtttttctttttgatttttgttttttaaaccaaaacagacaatagcttattttctttccgccccctccggggctgagcctgggtctgaagactgaatgtaacaggggccgctggcactcctgcgcgtcccccggctctggcgctgcaggggtgtcggcgcgccacctctccaggccccagaagcccttcttgcccaaaggcttccctggtccctgagccctgcctcggctgcctcaggggagagtgcttttcctgtagtttccaaggaatattctttgtttagaggtacttgttttttattaagagaaaaaccagtgtaacgtttatgtgactgtttgaactggaaggtctggggttccggggggtggggggaggctagactcaatgccggggccgtcggtactcttgttttcatttgtgtgtgcgtgcgtgtgtgtgtgtgtatgtgcgtatgtgtgtgtctatgtgtggtgtgtgccgtatgcatgggcagatgtttcgctttccctccttcctcgctgaacaaggtggagacttctgaccttttgctacctcttgaattcatgacaacgatatgttgggcactggctcatttctcgcaaatacctcgaaggggaggggggagggatggggttatagctgttttgtttaattggaactggaagagggatcatgttttgttttatgcccttcccagaaggggggagggacaccgggatcgcactcctgtactggccaccgccgctgtcacttgtcacattgagttcatgtcccttgagagtttgtataaattcaggtcagagctgcagctacacagctgcccagtgtcatagaaaagcaattcaccaacgactgatctctccattcagaagtgtgcagtcttaaatgtacagcgataagaaactgttattttatgatcttttcattaaaagcttgattgaaaactc

SEQ ID NO: 364996 - DNA, 6391 bp, Homo sapiens
  misc_feature (348)..(348): n is a, c, g, or t
  misc_feature (679)..(679): n is a, c, g, or t
caagaacgtcctagccgccagcagcatctatttcaagtccctggtcctgcacgacaacctcatcaacctggacacagacatggtcagctccacagtgttccagcagatcttggacttcatctacacaggcaagctgctgcccagcgaccagccagccgagcccaacttcagcaccctcctcactgccgccagctacctccagctgcccgagttggcagccctctgccgccgcaaactcaagcgagccggcaagccctttggctctgggagggcggggtccactggcatggggcggcccccccgcagccagcggctgtccacggcctctgtcatccaagctcggtatcnggggctcgtggatgggcgcaagggggcccacgccccccaggagctcccccaagccaaaggctcagacgatgaactctttcttggtggctctaaccaggatagcgtgcaaggtctgggccgggctgtctgcccagctggcggggaggcgggtctggggggctgcagcagcagcaccaacgggagcagcgggggctgcgagcaggagctgggcttggacctgtccaagaaaagcccacccttgccccctgccaccccaggtccccacctcactcccgatgacgcagcccagctgagcgacagccaacatggctcgccccctgcggcctctgcncctcccgttgccaacagtgcctcttattctgagctggggggcacccctgatgagcccatggatctggagggggccgaggacaaccacctgagcctgctggaggcgcctggtgggcagcctcggaagagcctccggcactccactcggaagaaggagtggggcaagaaggagcctgtggctggctccccctttgagcggagagaagcagggcccaagggtccctgcccgggagaggagggtgagggggtcggggacagggttcccaatggcatcctggctagtggggctggccctagcgggccctatggggagcccccctacccctgcaaggaggaggaggagaacggcaaggatgcaagtgaagacagtgcgcagagcgggagcgaggggggcagcggccacgccagcgcccactacatgtaccggcaggagggctacgagacggtgtcctacggggacaacttgtatgtgtgcattccctgcgccaagggcttccccagctctgagcagctcaatgcgcacgtggagactcacacggaggaagagctgttcatcaaggaagagggggcctacgagacaggcagtgggggtgccgaggaggaggccgaggacctgtcagcacccagtgcggcctacacggctgagccccggcccttcaagtgttcggtctgcgagaagacctacaaggacccagccacgctgcggcagcacgagaagacgcactggctgacacggcccttcccctgcaacatctgtggcaaaatgttcacgcagcgcggcaccatgacgcgtcacatgcggagccacctgggcctgaagcccttcgcctgcgatgagtgtggcatgcgcttcacccgtcagtaccgcctcacggagcacatgcgtgtgcactcgggcgagaaaccttacgagtgccagctgtgcgggggcaagttcacccagcagcgcaacctcatcagccacctgcgcatgcacacctccccctcctagaagccaaagacccgcgggcgccctctgccaccttgctccccgggaacccatggaaggagaagcgaggtgatgcagcagcaggggcaagaccctgggtccagtggaggctccgggtggcccctctggcccccactgcccacacccagagctttaatggacagtccgtaccaagcagagccgagaggagggaagccaggggtcccagcccgtctacctccccatcccacccaggcccccagctccccgcgggggccaccgcagggcctgtgggctgggtcacgtgggtctcgctgggacctggtccctttgttgcaggcggcttggagaaagggcagtgggacgctggccacggccagggtggtgtcgggagcaggcctcaccccgctggccgtgtctgtgtgtgtgcacgtgtgcttgtgtctgtgcgggcgcgtgcagccctggttctgcagggaaaaggtgctgggggtgcagatccctccctccttgagccagggtggcactgttcactggcgctgggacagtcagggtgaccccaccgcctacctctctacaactaaagagccctctgggcctgtgttgctgttattcctactgatctgttcctctgtttttctttttgatttttgttttttaaaccaaaacagacaatagcttattttctttccgccccctccggggctgagcctgggtctgaagactgaatgtaacaggggccgctggcactcctgcgcgtcccccggctctggcgctgcaggggtgtcggcgcgccacctctccaggccccagaagcccttcttgcccaaaggcttccctggtccctgagccctgcctcggctgcctcaggggagagtgcttttcctgtagtttccaaggaatattctttgtttagaggtacttgttttttattaagagaaaaaccagtgtaacgtttatgtgactgtttgaactggaaggtctggggttccggggggtggggggaggctagactcaatgccggggccgtcggtactcttgttttcatttgtgtgtgcgtgcgtgtgtgtgtgtgtatgtgcgtatgtgtgtgtctatgtgtggtgtgtgccgtatgcatgggcagatgtttcgctttccctccttcctcgctgaacaaggtggagacttctgaccttttgctacctcttgaattcatgacaacgatatgttggtgactggcagtggaagcccttgacactcttgttttccttcgcttagcacctaggaagtcgtgtgcaggagccagcagggcgccaagtggcccagtgcctgcagctcacctgtgggttttccctttgagcctttggccacatccacctcgaggggaccctggcaccccgggcacacaaacctctgtggtataggtgaggggtgtgaggccccagcctggagccaggcactgggtgctgacaggggaaccatgaggagggtggcaggtctttgcagctcccggccagggtgaggcggaagtgagccctcatcctgccactcctatcctccattcctgcaagagttttaagcttgagagagctgaccacagggccccccggggaacagggatggcacttccctgagcagtcctggcccccggccactgtctcggggcccacctctcgcccctcatcttggtaattagccagcctcagatacttctgtgggccctgaagtgggctctcaaggtcagaccaaggttgctgatctcagtcccactgtcttcagccagctgaagctgtggggctgggctggcagcctttattgtcatcttgcttcaccatttttttttctctctcttttcattctattttaagtttagaccaaaaaaatacagagtcatcccctacccccacccctctagagaccctccagctaaaaacagagcctgagttcagggacccaagtggtgagcggcgtcttttgggggtgagggagcttgggtagatgaggctcctggctgagccctccctgtggtgatcccagcctaagatggcccctcttccctcctggtgggagacagaggactggaccctgggtctcaggttccagcaagtcaggctagggacctggggggaggagacccatggacttcacccatactcagtgagggggctcctgccgtcctgacgccaccccgccccatcagcacttaagccacatgacacaaagtctgtaccgcacgggaaatgttcacgcgcctggccgtgtgcatggcctcccgggctgtgggcagccgcatctgtgaggtgactcgtgaaagtaggtgattcctttgcagaacttcagggactgggagcagaggcccctcactcaacgacgtttgtgcgacatagtattgtatccaccttagtattgtatcgagccttttctgtgttttaatgagaaagcagaacactagtttcctatttaagactttaagggtttgtggggcggggcgggattaacacaacatttggctttgttttctttttcctttgatttccacatcaggtgtgtgcgagtgtgtgtgtgtggagatgttaagagcctcacaaggaaactgggttattggaggccaaggcggcttacagttctctgcgttcgtcacttaattcctgaatgtttcagagaaacaggaatcagaaaatagcagatatcatgtaggaaagagaggataaacaaagaaaaaagaaaaaaaaataagctcatacccaaattcacaaagcctattttttaaaccaaagcacattttgaatgagtatggaacctccatgggctcagaaaaaagatgctaatatatttatctcattgtttacataagcttttacagtttcagacctcagcagctgtaaggccagtccagggaaccctcccctgctgctggaaacccttctgagttggccctggagtggctcacgggcagagaagggtagccctggggctgggggagggattggaagcctccctggagtcacctgagccctcgtccccattcccagggcccctccaagcccagctggcaccaaagagcttgggcccgtgctgaccagcccccaaggccctctggccggaccatgctggtcctgaccagctagcctacgcggggatggccgtcagttctggccacaggacccgagtctgggcttgggtccccctgctgctctgcccgtgacccttggggatgggttgatgcgagggtcccactcaagccaaaaagccgggacctttgcgcagctctgtcgactctggtgggtccccactcctggggccccctaaccccaccccaggcagcggaaggggctgactgggtctggtccttaccaacatagacggtgcaaacactcttaacagtgttgtttttgtatcaatatgtttgtgcagtgatgaatgtatttatttctcagacttggggcgagtgagcgggtggcaggccgggctccgccactgcatgctcccgccggaccgagccccagcaagggctcctccaggattgcaaaaaaaaaggaagagaaaagatgaacctttaagcaaataagaatctcagagactcgcagcatagccatacacctcagcctgtgaaatgaacgatccggaccctcaccaactttccccacctcaggcagccctgtgtgtttaccgttcatcaccactcgggggcaccgggccgcccacccactcccaaaatccgtcagtattcactggacctcaggccctgtgcaggagtgcgatccgggctgggccgctgggcaggctgaccccctgccctcctgcggccatcctgagttggggtgaggcctgggcagccggagggcagggctcagggagcaggaggctgcatccgtccacccccaggcgtgggggacaaaagccaaaggtgccaggccttagagcagacaagggctctcagccctggcatgccccctaaagggaccaaggtcctcctatttcccagaaccccgttggggcagatgttactgaacctgtgaatcagacgccaggagtgagggctggggagggacctaactggagcctcagtctgacattccacgccggggtgggggtgggcatgagcggtgggaactgaggctgcccaggacccccttcctaggatgccccggcttcagtcaccccactttaactttctaccaggaccccctccccctacctcaccttgctatttattgctgtaatttattgacctcaaaaatgctgcataacagacctcactggggcagggaggatccccagggctcccaccctccacttggcgggccccgtggggccaggtgctgaggggagcctctctaccccacccatcactagcttccctctgccctctcccaccccgggggggacccaggttgggcactggctcatttctcgcaaatacctcgaaggggaggggggagggatggggttatagctgttttgtttaattggaactggaagagggatcatgttttgttttatgcccttcccagaaggggggagggacaccgggatcgcactcctgtactggccaccgccgctgtcacttgtcacattgagttcatgtcccttgagagtttgtataaattcaggtcagagctgcagctacacagctgcccagtgtcatagaaaagcaattcaccaacgactgatctctccattcagaagtgtgcagtcttaaatgtacagcgataagaaactgttattttatgatcttttcattaaaagcttgattgaaaactc

SEQ ID NO: 364997 - DNA, 5579 bp, Homo sapiens
  misc_feature (348)..(348): n is a, c, g, or t
  misc_feature (679)..(679): n is a, c, g, or t
caagaacgtcctagccgccagcagcatctatttcaagtccctggtcctgcacgacaacctcatcaacctggacacagacatggtcagctccacagtgttccagcagatcttggacttcatctacacaggcaagctgctgcccagcgaccagccagccgagcccaacttcagcaccctcctcactgccgccagctacctccagctgcccgagttggcagccctctgccgccgcaaactcaagcgagccggcaagccctttggctctgggagggcggggtccactggcatggggcggcccccccgcagccagcggctgtccacggcctctgtcatccaagctcggtatcnggggctcgtggatgggcgcaagggggcccacgccccccaggagctcccccaagccaaaggctcagacgatgaactctttcttggtggctctaaccaggatagcgtgcaaggtctgggccgggctgtctgcccagctggcggggaggcgggtctggggggctgcagcagcagcaccaacgggagcagcgggggctgcgagcaggagctgggcttggacctgtccaagaaaagcccacccttgccccctgccaccccaggtccccacctcactcccgatgacgcagcccagctgagcgacagccaacatggctcgccccctgcggcctctgcncctcccgttgccaacagtgcctcttattctgagctggggggcacccctgatgagcccatggatctggagggggccgaggacaaccacctgagcctgctggaggcgcctggtgggcagcctcggaagagcctccggcactccactcggaagaaggagtggggcaagaaggagcctgtggctggctccccctttgagcggagagaagcagggcccaagggtccctgcccgggagaggagggtgagggggtcggggacagggttcccaatggcatcctggctagtggggctggccctagcgggccctatggggagcccccctacccctgcaaggaggaggaggagaacggcaaggatgcaagtgaagacagtgcgcagagcgggagcgaggggggcagcggccacgccagcgcccactacatgtaccggcaggagggctacgagacggtgtcctacggggacaacttgtatgtgtgcattccctgcgccaagggcttccccagctctgagcagctcaatgcgcacgtggagactcacacggaggaagagctgttcatcaaggaagagggggcctacgagacaggcagtgggggtgccgaggaggaggccgaggacctgtcagcacccagtgcggcctacacggctgagccccggcccttcaagtgttcggtctgcgagaagacctacaaggacccagccacgctgcggcagcacgagaagacgcactggctgacacggcccttcccctgcaacatctgtggcaaaatgttcacgcagcgcggcaccatgacgcgtcacatgcggagccacctgggcctgaagcccttcgcctgcgatgagtgtggcatgcgcttcacccgtcagtaccgcctcacggagcacatgcgtgtgcactcgggcgagaaaccttacgagtgccagctgtgcgggggcaagttcacccagcagcgcaacctcatcagccacctgcgcatgcacacctccccctcctagaagccaaagacccgcgggcgccctctgccaccttgctccccgggaacccatggaaggagaagcgaggtgatgcagcagcaggggcaagaccctgggtccagtggaggctccgggtggcccctctggcccccactgcccacacccagagctttaatggacagtccgtaccaagcagagccgagaggagggaagccaggggtcccagcccgtctacctccccatcccacccaggcccccagctccccgcgggggccaccgcagggcctgtgggctgggtcacgtgggtctcgctgggacctggtccctttgttgcaggcggcttggagaaagggcagtgggacgctggccacggccagggtggtgtcgggagcaggcctcaccccgctggccgtgtctgtgtgtgtgcacgtgtgcttgtgtctgtgcgggcgcgtgcagccctggttctgcagggaaaaggtgctgggggtgcagatccctccctccttgagccagggtggcactgttcactggcgctgggacagtcagggtgaccccaccgcctacctctctacaactaaagagccctctgggcctgtgttgctgttattcctactgatctgttcctctgtttttctttttgatttttgttttttaaaccaaaacagacaatagcttattttctttccgccccctccggggctgagcctgggtctgaagactgaatgtaacaggggccgctggcactcctgcgcgtcccccggctctggcgctgcaggggtgtcggcgcgccacctctccaggccccagaagcccttcttgcccaaaggcttccctggtccctgagccctgcctcggctgcctcaggggagagtgcttttcctgtagtttccaaggaatattctttgtttagaggtacttgttttttattaagagaaaaaccagtgtaacgtttatgtgactgtttgaactggaaggtctggggttccggggggtggggggaggctagactcaatgccggggccgtcggtactcttgttttcatttgtgtgtgcgtgcgtgtgtgtgtgtgtatgtgcgtatgtgtgtgtctatgtgtggtgtgtgccgtatgcatgggcagatgtttcgctttccctccttcctcgctgaacaaggtggagacttctgaccttttgctacctcttgaattcatgacaacgatatgttggtgactggcagtggaagcccttgacactcttgttttccttcgcttagcacctaggaagtcgtgtgcaggagccagcagggcgccaagtggcccagtgcctgcagctcacctgtgggttttccctttgagcctttggccacatccacctcgaggggaccctggcaccccgggcacacaaacctctgtggtataggtgaggggtgtgaggccccagcctggagccaggcactgggtgctgacaggggaaccatgaggagggtggcaggtctttgcagctcccggccagggtgaggcggaagtgagccctcatcctgccactcctatcctccattcctgcaagagttttaagcttgagagagctgaccacagggccccccggggaacagggatggcacttccctgagcagtcctggcccccggccactgtctcggggcccacctctcgcccctcatcttggtaattagccagcctcagatacttctgtgggccctgaagtgggctctcaaggtcagaccaaggttgctgatctcagtcccactgtcttcagccagctgaagctgtggggctgggctggcagcctttattgtcatcttgcttcaccatttttttttctctctcttttcattctattttaagtttagaccaaaaaaatacagagtcatcccctacccccacccctctagagaccctccagctaaaaacagagcctgagttcagggacccaagtggtgagcggcgtcttttgggggtgagggagcttgggtagatgaggctcctggctgagccctccctgtggtgatcccagcctaagatggcccctcttccctcctggtgggagacagaggactggaccctgggtctcaggttccagcaagtcaggctagggacctggggggaggagacccatggacttcacccatactcagtgagggggctcctgccgtcctgacgccaccccgccccatcagcacttaagccacatgacacaaagtctgtaccgcacgggaaatgttcacgcgcctggccgtgtgcatggcctcccgggctgtgggcagccgcatctgtgaggtgactcgtgaaagtaggtgattcctttgcagaacttcagggactgggagcagaggcccctcactcaacgacgtttgtgcgacatagtattgtatccaccttagtattgtatcgagccttttctgtgttttaatgagaaagcagaacactagtttcctatttaagactttaagggtttgtggggcggggcgggattaacacaacatttggctttgttttctttttcctttgatttccacatcaggtgtgtgcgagtgtgtgtgtgtggagatgttaagagcctcacaaggaaactgggttattggaggccaaggcggcttacagttctctgcgttcgtcacttaattcctgaatgtttcagagaaacaggaatcagaaaatagcagatatcatgtaggaaagagaggataaacaaagaaaaaagaaaaaaaaataagctcatacccaaattcacaaagcctattttttaaaccaaagcacattttgaatgagtatggaacctccatgggctcagaaaaaagatgctaatatatttatctcattgtttacataagcttttacagtttcagacctcagcagctgtaaggccagtccagggaaccctcccctgctgctggaaacccttctgagttggccctggagtggctcacgggcagagaagggtagccctggggctgggggagggattggaagcctccctggagtcacctgagccctcgtccccattcccagggcccctccaagcccagctggcaccaaagagcttgggcccgtgctgaccagcccccaaggccctctggccggaccatgctggtcctgaccagctagcctacgcggggatggccgtcagttctggccacaggacccgagtctgggcttgggtccccctgctgctctgcccgtgacccttggggatgggttgatgcgagggtcccactcaagccaaaaagccgggacctttgcgcagctctgtcgactctggtgggtccccactcctggggccccctaaccccaccccaggcagcggaaggggctgactgggtctggtccttaccaacatagacggtgcaaacactcttaacagtgttgtttttgtatcaatatgtttgtgcagtgatgaatgtatttatttctcagacttggggcgagtgagcgggtggcaggccgggctccgccactgcatgctcccgccggaccgagccccagcaagggctcctccaggattgcaaaaaaaaaggaagagaaaagatgaacctttaagcaaataagaatctcagagactcgcagcatagccatacacctcagcctgtgaaatgaacgatccggaccctcaccaactttccccacctcaggcagccctgtgtgtttaccgttcatcaccactcgggggcaccgggccgcccacccactcccaaaatccgtcagtattcactggactggccaccgccgctgtcacttgtcacattgagttcatgtcccttgagagtttgtataaattcaggtcagagctgcagctacacagctgcccagtgtcatagaaaagcaattcaccaacgactgatctctccattcagaagtgtgcagtcttaaatgtacagcgataagaaactgttattttatgatcttttcattaaaagcttgattgaaaactc

SEQ ID NO: 364998 - DNA, 3741 bp, Homo sapiens
tcatgatagccgcgattttatggagaggcggtcttgttttcatttgtgtgtgcgtgcgtgtgtgtgtgtgtatgtgcgtatgtgtgtgtctatgtgtggtgtgtgccgtatgcatgggcagatgtttcgctttccctccttcctcgctgaacaaggtggagacttctgaccttttgctacctcttgaattcatgacaacgatatgttggtgactggcagtggaagcccttgacactcttgttttccttcgcttagcacctaggaagtcgtgtgcaggagccagcagggcgccaagtggcccagtgcctgcagctcacctgtgggttttccctttgagcctttggccacatccacctcgaggggaccctggcaccccgggcacacaaacctctgtggtataggtgaggggtgtgaggccccagcctggagccaggcactgggtgctgacaggggaaccatgaggagggtggcaggtctttgcagctcccggccagggtgaggcggaagtgagccctcatcctgccactcctatcctccattcctgcaagagttttaagcttgagagagctgaccacagggccccccggggaacagggatggcacttccctgagcagtcctggcccccggccactgtctcggggcccacctctcgcccctcatcttggtaattagccagcctcagatacttctgtgggccctgaagtgggctctcaaggtcagaccaaggttgctgatctcagtcccactgtcttcagccagctgaagctgtggggctgggctggcagcctttattgtcatcttgcttcaccatttttttttctctctcttttcattctattttaagtttagaccaaaaaaatacagagtcatcccctacccccacccctctagagaccctccagctaaaaacagagcctgagttcagggacccaagtggtgagcggcgtcttttgggggtgagggagcttgggtagatgaggctcctggctgagccctccctgtggtgatcccagcctaagatggcccctcttccctcctggtgggagacagaggactggaccctgggtctcaggttccagcaagtcaggctagggacctggggggaggagacccatggacttcacccatactcagtgagggggctcctgccgtcctgacgccaccccgccccatcagcacttaagccacatgacacaaagtctgtaccgcacgggaaatgttcacgcgcctggccgtgtgcatggcctcccgggctgtgggcagccgcatctgtgaggtgactcgtgaaagtaggtgattcctttgcagaacttcagggactgggagcagaggcccctcactcaacgacgtttgtgcgacatagtattgtatccaccttagtattgtatcgagccttttctgtgttttaatgagaaagcagaacactagtttcctatttaagactttaagggtttgtggggcggggcgggattaacacaacatttggctttgttttctttttcctttgatttccacatcaggtgtgtgcgagtgtgtgtgtgtggagatgttaagagcctcacaaggaaactgggttattggaggccaaggcggcttacagttctctgcgttcgtcacttaattcctgaatgtttcagagaaacaggaatcagaaaatagcagatatcatgtaggaaagagaggataaacaaagaaaaaagaaaaaaaaataagctcatacccaaattcacaaagcctattttttaaaccaaagcacattttgaatgagtatggaacctccatgggctcagaaaaaagatgctaatatatttatctcattgtttacataagcttttacagtttcagacctcagcagctgtaaggccagtccagggaaccctcccctgctgctggaaacccttctgagttggccctggagtggctcacgggcagagaagggtagccctggggctgggggagggattggaagcctccctggagtcacctgagccctcgtccccattcccagggcccctccaagcccagctggcaccaaagagcttgggcccgtgctgaccagcccccaaggccctctggccggaccatgctggtcctgaccagctagcctacgcggggatggccgtcagttctggccacaggacccgagtctgggcttgggtccccctgctgctctgcccgtgacccttggggatgggttgatgcgagggtcccactcaagccaaaaagccgggacctttgcgcagctctgtcgactctggtgggtccccactcctggggccccctaaccccaccccaggcagcggaaggggctgactgggtctggtccttaccaacatagacggtgcaaacactcttaacagtgttgtttttgtatcaatatgtttgtgcagtgatgaatgtatttatttctcagacttggggcgagtgagcgggtggcaggccgggctccgccactgcatgctcccgccggaccgagccccagcaagggctcctccaggattgcaaaaaaaaaggaagagaaaagatgaacctttaagcaaataagaatctcagagactcgcagcatagccatacacctcagcctgtgaaatgaacgatccggaccctcaccaactttccccacctcaggcagccctgtgtgtttaccgttcatcaccactcgggggcaccgggccgcccacccactcccaaaatccgtcagtattcactggacctcaggccctgtgcaggagtgcgatccgggctgggccgctgggcaggctgaccccctgccctcctgcggccatcctgagttggggtgaggcctgggcagccggagggcagggctcagggagcaggaggctgcatccgtccacccccaggcgtgggggacaaaagccaaaggtgccaggccttagagcagacaagggctctcagccctggcatgccccctaaagggaccaaggtcctcctatttcccagaaccccgttggggcagatgttactgaacctgtgaatcagacgccaggagtgagggctggggagggacctaactggagcctcagtctgacattccacgccggggtgggggtgggcatgagcggtgggaactgaggctgcccaggacccccttcctaggatgccccggcttcagtcaccccactttaactttctaccaggaccccctccccctacctcaccttgctatttattgctgtaatttattgacctcaaaaatgctgcataacagacctcactggggcagggaggatccccagggctcccaccctccacttggcgggccccgtggggccaggtgctgaggggagcctctctaccccacccatcactagcttccctctgccctctcccaccccgggggggacccaggttgggcactggctcatttctcgcaaatacctcgaaggggaggggggagggatggggttatagctgttttgtttaattggaactggaagagggatcatgttttgttttatgcccttcccagaaggggggagggacaccgggatcgcactcctgtactggccaccgccgctgtcacttgtcacattgagttcatgtcccttgagagtttgtataaattcaggtcagagctgcagctacacagctgcccagtgtcatagaaaagcaattcaccaacgactgatctctccattcagaagtgtgcagtcttaaatgtacagcgataagaaactgttattttatgatcttttcattaaaagcttgattgaaaactc

SEQ ID NO: 364999 - DNA, 838 bp, Homo sapiens
  misc_feature (1)..(1): n is a, c, g, or t
ncacttgttgtgccgggcggcggggcctggccccaatacaaaaaacaaaacaaaaaattttacggtgacccgttggacataccagatggtcgaagagctccacttcctgctcattaccggagcagtagtactcgcagcattgacactcagactccttctgtccaggagcgcagcagtagctgcagcagtcattcaccctgtgtctcccctttttgtcccccggaatcccaggatggtagcccttgctcaacagaagatttgctctatgatcgtgataaagacagtgggagtagctcaccgttacccaagtatgcttcatctcccaaaccaaacaacagctacatgttcaaacgggagcccccagagggatgtgagcgagtgaaggtctttgaggaaatggcgtctcgtcagcctatctcggcccctctcttttcatgtcctgacaaaaacaaggttaatttcatcccaaccggatcagctttctgtcctgtaaaacttctaggccccctcttacctgcttctgaccttatgctcaagaactcccctaactctggccagagctcagctttggcaactctgaccgttgagcagctctcatcccgggtttcctttacgtctctttctgatgacaccagcacagcgggctccatggaggcctctgtccagcagccatcccagcagcagcagctcctgcaggaactgcagggtgaggaccacatctctgctcagaactatgtgatcatctaaaaaagggggagctggcctccaccctatgttccatggattcggaacaagatttcagacatctgcatgagtgacaaactttctgaacaccacc

SEQ ID NO: 365000 - DNA, 312 bp, Homo sapiens
aagcttgcggccgcagccccggccgagcaggcgccgcgggccaagggccgcccgagacggtccccagagagccaccggaggagcagctcacctgagagacggagccccggctcgcccgtgtgcagaggtagcgagcccaaccctcccgtcctcccgggctgcgtctccccgacggtgccctccgtggaaacttcagcctcttcgggcttctctttgctagtgcattatcgaaggtgtgaaagtggctttgggaatctcacccccctgcggtcgctgtggggcttggaggagcgaactgaaaagcgactttta

SEQ ID NO: 365001 - DNA, 2246 bp, Homo sapiens
atcagcaggattcccggcggtgggacttgaccccggaagtggggtgtgaagctccggtgctggtgcggcgggggactgcggggccagcctcaggtagcagcagcagcagcagcagcagcagcagcagcagcagcagcagcagcagcaatgtttcacttcttcagaaagcctccggaatctaaaaagccctcagtaccagagacagaagcagatggattcgtccttttaggagatacaacagatgagcaaagaatgacagcaagaggcaaaacttcggacatagaggccaaccaacctttggagaccaacaaagaaaattcatccagtgtgactgtatcagaccctgagatggaaaataaggcaggccagactctggagaacagctcattaatggccgagctcctgagcgatgtgccgttcaccctggccccgcatgtgctggcagtacagggcaccatcactgaccttcccgaccacttactctcctatgatggcagcgaaaacttatcacggttttggtatgatttcactcttgaaaattcagtgctctgtgattcataacctttatgtctgtttgcaccttaacagctttaaaatatgttcgcctattttatctaacctgtttgatgttctttgccgtttcactgtttaaggtcctcagcaaggatcataaagcaaagaaaatagcattatgttcactactctatttttaagaaaaaggtacatttgtatacaaattgaacttaagttctacttcctttctcccatataataaatatacaaattaggctatgaaggttttaggaaaggactcgattccttcagatggtctctcaaaatataacacctcaaatttatcttagaagaactgtgaaaaagaattgtggcatttttcagtcactacagctccgaagtctgagcaagaagtgggtgtgaagtctcctctctggtttgtaggaagttgaattggtgttattcctgcatttttttcttccacagtgtttatgaatgaattcagaaaaaaagttgccagttagcttaatttcttcagatgcattgatgtggaaatttaaaacttgtcctaaacagcagtgctagtttgctgatacaaggatgctagacctgctctgcgtgctctttctggagtggcccatttcggttttctgaaacccatggcagccctttccatcgtgaataatcgttgtgttcccacctttgttctctgcctttttgctacttcagtgtgctctctgaccagctttccaaagaactttccctgcttctgcctcggttgccatttgctctccttaccacatatgttcccagtttatgaagagatccacatttcctttcaacccctctgcctcctgaagaaaaacatctcatgatgatacatattattgctgataacacccttatttagaaatttgttggccacaatacagatggaaatgttttactgctggaaaaactgaaatcaactcatttccaattagagtataggcagaacacctagatatgacttttagttcttgaatatccattacttactttaatgaaaacagaactgccattggtcaataaactgtaaagggaagaggtaaattgtgatagagaattttctatgtcatgggaaattgaaatcacatttattttgattaccagcaatatgatttgttaactctgtgccaagttttaagtatattttttcacaaagatagagtgccatagtgaaactaaacactgtgcataaaggtacatgaattattccagttttaaagtattatgcatgtttgtttaataaatgtggcatggttttaatacaaatgctatgttatttaaaagttagaggaacatttctattgacaaaaatatgcttcatttacatataatgttaccatatggtgttaatgattaaattagatctttacatagttcttacaaagcatcagtctaggaaatatgacttattactgatgcaaacgtgaacattttgtagtagttttgtaaaagaacatccttttcaaatatctgtgttaatgtacccttgaaattaaatgcaagcacatagtcagtttgtctaattttgtgtgaaattttgtcgaaaatacctaaacatttcatctatatttgtgcctaccatgttataaatgttcataagtaccttcatgtgtctataaaaaatgttatatttaaataaatgtgaattaaaataaaatttttgattattttcagatccagaaaaa

SEQ ID NO: 365002 - DNA, 2761 bp, Homo sapiens
ttcaggcttttgccacttgttggctgagggtcgatttactcccttagctgcgtcactctactttctccactttctccacctgtaagaagagagattgatccgattacttctaagacgttttttagcccaacctggccacactgcggaggcgccggttctttcaccccgctaacccctccgtgttggcagccaatagaagcacttaaggatgggtaacggggaagaaccactggccagtactaggggagacaagcttaaatcgttgttagaccccgagctagggttccccgagctagggttctcccttctgaggcgtgttttccccatctgcaaaacgaagggttaggcggaatgatttgcaaggtcccagttgactctgacttttggccatatgtttgactcaacagtttaaaccccctcagcagtctttctgtcgttgccctccacactgcgagactctggagggcgatctggaggtctggaagataaccgattcctgggagatttgggggtagtctccaatctgtccctggctcatcttgtgacccgaagccggcggccttgccaggagtattctagaatgagtgcacataaaaataccttcaaacggtacagcagcagcagcagcagcagcagcagcagcagcagcagcagcagcagcaatgtttcacttcttcagaaagcctccggaatctaaaaagccctcagtaccagagacagaagcagatggattcgtccttttaggagatacaacagatgagcaaagaatgacagcaagaggcaaaacttcggacatagaggccaaccaacctttggagaccaacaaagaaaattcatccagtgtgactgtatcagaccctgagatggaaaataaggcaggccagactctggagaacagctcattaatggccgagctcctgagcgatgtgccgttcaccctggccccgcatgtgctggcagtacagggcaccatcactgaccttcccgaccacttactctcctatgatggcagcgaaaacttatcacggttttggtatgatttcactcttgaaaattcagtgctctgtgattcataacctttatgtctgtttgcaccttaacagctttaaaatatgttcgcctattttatctaacctgtttgatgttctttgccgtttcactgtttaaggtcctcagcaaggatcataaagcaaagaaaatagcattatgttcactactctatttttaagaaaaaggtacatttgtatacaaattgaacttaagttctacttcctttctcccatataataaatatacaaattaggctatgaaggttttaggaaaggactcgattccttcagatggtctctcaaaatataacacctcaaatttatcttagaagaactgtgaaaaagaattgtggcatttttcagtcactacagctccgaagtctgagcaagaagtgggtgtgaagtctcctctctggtttgtaggaagttgaattggtgttattcctgcatttttttcttccacagtgtttatgaatgaattcagaaaaaaagttgccagttagcttaatttcttcagatgcattgatgtggaaatttaaaacttgtcctaaacagcagtgctagtttgctgatacaaggatgctagacctgctctgcgtgctctttctggagtggcccatttcggttttctgaaacccatggcagccctttccatcgtgaataatcgttgtgttcccacctttgttctctgcctttttgctacttcagtgtgctctctgaccagctttccaaagaactttccctgcttctgcctcggttgccatttgctctccttaccacatatgttcccagtttatgaagagatccacatttcctttcaacccctctgcctcctgaagaaaaacatctcatgatgatacatattattgctgataacacccttatttagaaatttgttggccacaatacagatggaaatgttttactgctggaaaaactgaaatcaactcatttccaattagagtataggcagaacacctagatatgacttttagttcttgaatatccattacttactttaatgaaaacagaactgccattggtcaataaactgtaaagggaagaggtaaattgtgatagagaattttctatgtcatgggaaattgaaatcacatttattttgattaccagcaatatgatttgttaactctgtgccaagttttaagtatattttttcacaaagatagagtgccatagtgaaactaaacactgtgcataaaggtacatgaattattccagttttaaagtattatgcatgtttgtttaataaatgtggcatggttttaatacaaatgctatgttatttaaaagttagaggaacatttctattgacaaaaatatgcttcatttacatataatgttaccatatggtgttaatgattaaattagatctttacatagttcttacaaagcatcagtctaggaaatatgacttattactgatgcaaacgtgaacattttgtagtagttttgtaaaagaacatccttttcaaatatctgtgttaatgtacccttgaaattaaatgcaagcacatagtcagtttgtctaattttgtgtgaaattttgtcgaaaatacctaaacatttcatctatatttgtgcctaccatgttataaatgttcataagtaccttcatgtgtctataaaaaatgttatatttaaataaatgtgaattaaaataaaatttttgattattttcagatccagaaaaa

SEQ ID NO: 365003 - DNA, 2412 bp, Homo sapiens
atcagcaggattcccggcggtgggacttgaccccggaagtggggtgtgaagctccggtgctggtgcggcgggggactgcggggccagcctcaggtagcagcagcagcagcagcagcagcagcagcagcagcagcagcagcagcagcaatgtttcacttcttcagaaagcctccggaatctaaaaagccctcagtaccagagacagaagcagatggattcgtccttttaggagatacaacagatgagcaaagaatgacagcaagaggcaaaacttcggacatagaggccaaccaacctttggagaccaacaaagaaaattcatccagtgtgactgtatcagaccctgagatggaaaataaggcaggccagactctggagaacagctcattaatggccgagctcctgagcgatgtgccgttcaccctggccccgcatgtgctggcagtacagggcaccatcactgaccttcccgaccacttactctcctatgatggcagcgaaaacttatcacggttttggtatgatttcactcttgaaaattcagtgctctgtgattcataacctttatgtctgtttgcaccttaacagctttaaaatatgttcgcctattttatctaacctgtttgatgttctttgccgtttcactgtttaaggtcctcagcaaggatcataaagcaaagaaaatagcattatgttcactactctatttttaagaaaaaggtacatttgtatacaaattgaacttaagttctacttcctttctcccatataataaatatacaaattaggctatgaaggttttaggaaaggactcgattccttcagatggtctctcaaaatataacacctcaaatttatcttagaagaactgtgaaaaagaattgtggcatttttcagtcactacagctccgaagtctgagcaagaagtgggtgtgaagtctcctctctggtttgtaggaagttgaattggtgttattcctgcatttttttcttccacagtgtttatgaatgaattcagaaaaaaagttgccagttagcttaatttcttcagatgcattgatgtggaaatttaaaacttgtcctaaacagcagtgctagtttgctgatacaaggatgctagacctgctctgcgtgctctttctggagtggcccatttcggttttctgaaacccatggcagccctttccatcgtgaataatcgttgtgttcccacctttgttctctgcctttttgctacttcagtgtgctctctgaccagctttccaaagaactttccctgcttctgcctcggttgccatttgctctccttaccacatatgttcccagtttatgaagagatccacatttcctttcaacccctctgcctcctgaagaaaaacatctcatgatgatacatattattgctgataacacccttatttagaaatttgttggccacaatacagatggaaatgttttactgctggaaaaactgaaatcaactcatttccaattagagtataggcagaacacctagatatgacttttagttcttgaatatccattacttactttaatgaaaacagaactgccattggtcaataaactgtaaagggaagaggtaaattgtgatagagaattttctatgtcatgggaaattgaaatcacatttattttgattaccagcaatatgatttgttaactctgtgccaagttttaagtatattttttcacaaagatagagtgccatagtgaaactaaacactgtgcataaaggtacatgaattattccagttttaaagtattatgcatgtttgtttaataaatgtggcatggttttaatacaaatgctatgttatttaaaagttagaggaacatttctattgacaaaaatatgcttcatttacatataatgttaccatatggtgttaatgattaaattagatctttacatagttcttacaaagcatcagtctaggaaatatgacttattactgatgcaaacgtgaacattttgtagtagttttgtaaaagaacatccttttcaaatatctgtgttaatgtacccttgaaattaaatgcaagcacatagtcagtttgtctaattttgtgtgaaattttgtcgaaaatacctaaacatttcatctatatttgtgcctaccatgttataaatgttcataagtaccttcatgtgtctataaaaaatgttatatttaaataaatgtgaattaaaataaaatttttgattattttcagatccagaaaaaaaaaaaaaaagaagaaaaaaaaagagaaaaaaaaaagaaaaaaaaagaaaaaaaaataaaaagaggggggtaataaggagaaagagatatgagagaaagaaaagggggaaagagaaaagttagagtgggaacaaaaaatttggtgtgaagaacataggaagagaga

SEQ ID NO: 365004 - DNA, 2192 bp, Homo sapiens
atcagcaggattcccggcggtgggacttgaccccggaagtggggtgtgaagctccggtgctggtgcggcgggggactgcggggccagcctcaggtagcagcagcagcagcagcagcagcagcagcagcagcagcagcagcagcagcaatgtttcacttcttcagaaagcctccggaatctaaaaagccctcagtaccagagacagaagcagatggattcgtccttttaggagatacaacagatgagcaaagaatgacagcaagaggcaaaacttcggacatagaggccaaccaacctttggagaccaacaaagaaaattcatccagtgtgactgtatcagaccctgagatggaaaataaggcaggccagactctggagaacagctcattaatggccgagctcctgagcgatgtgccgttcaccctggccccgcatgtgctggcagtacagggcaccatcactgaccttcccgaccacttactctcctatgatggcagcgaaaacttatcacggttttggtatgatttcactcttgaaaattcagtgctctgtgattcataacctttatgtctgtttgcaccttaacagctttaaaatatgttcgcctattttatctaacctgtttgatgttctttgccgtttcactgtttaaggtcctcagcaaggatcataaagcaaagaaaatagcattatgttcactactctatttttaagaaaaaggtacatttgtatacaaattgaacttaagttctacttcctttctcccatataataaatatacaaattaggctatgaaggttttaggaaaggactcgattccttcagatggtctctcaaaatataacacctcaaatttatcttagaagaactgtgaaaaagaattgtggcatttttcagtcactacagctccgaagtctgagcaagaagtgggtgtgaagtctcctctctggtttgtaggaagttgaattggtgttattcctgcatttttttcttccacagtgtttatgaatgaattcagaaaaaaagttgccagttagcttaatttcttcagatgcattgatgtggaaatttaaaacttgtcctaaacagcagtgctagtttgctgatacaaggatgctagacctgctctgcgtgctctttctggagtggcccatttcggttttctgaaacccatggcagccctttccatcgtgaataatcgttgtgttcccacctttgttctctgcctttttgctacttcagtgtgctctctgaccagctttccaaagaactttccctgcttctgcctcggttgccatttgctctccttaccacatatgttcccagtttatgaagagatccacatttcctttcaacccctctgcctcctgaagaaaaacatctcatgatgatacatattattgctgataacacccttatttagaaatttgttggccacaatacagatggaaatgttttactgctggaaattttagttcttgaatatccattacttactttaatgaaaacagaactgccattggtcaataaactgtaaagggaagaggtaaattgtgatagagaattttctatgtcatgggaaattgaaatcacatttattttgattaccagcaatatgatttgttaactctgtgccaagttttaagtatattttttcacaaagatagagtgccatagtgaaactaaacactgtgcataaaggtacatgaattattccagttttaaagtattatgcatgtttgtttaataaatgtggcatggttttaatacaaatgctatgttatttaaaagttagaggaacatttctattgacaaaaatatgcttcatttacatataatgttaccatatggtgttaatgattaaattagatctttacatagttcttacaaagcatcagtctaggaaatatgacttattactgatgcaaacgtgaacattttgtagtagttttgtaaaagaacatccttttcaaatatctgtgttaatgtacccttgaaattaaatgcaagcacatagtcagtttgtctaattttgtgtgaaattttgtcgaaaatacctaaacatttcatctatatttgtgcctaccatgttataaatgttcataagtaccttcatgtgtctataaaaaatgttatatttaaataaatgtgaattaaaataaaatttttgattattttcagatccagaaaaa

SEQ ID NO: 365005 - DNA, 1405 bp, Homo sapiens
aagcttgcggccgcagccccggccgagcaggcgccgcgggccaagggccgcccgagacggtccccagagagccaccggaggagcagctcacctgagagacggagccccggctcgcccgtgtgcagagcggacaaggcaaaatctcagcaagttcggacctctagtacaataaggcgaacctcctctttggatacaataacaggaccttacctcacaggacagtggccacgggatcctcatgttcactacccttcatgcatgaaagacaaagctactcagacacctagctgttgggcagaagagggtgcagaaaagaggtcacatcagcgttctgcgtcatgggggagtgctgatcaactaaaagagcagatcgccaaactgaggcagcaactacaacgcagtaaacagagtagtcgtcacagtaaggagaaagatcgccagtcacctcttcatggcaaccatataacaatcagtcacactcaggctactggatcaaggtcagttcctatgccactgtcaaatatatcagtgccaaaatcatctgtttcgcgtgtgccctgcaatgtagaaggaataagtcctgaattagaaaaggtattcattaaagaaaataatgggaaggaagaagtatccaagccgttggacataccagatggtcgaagagctccacttcctgctcattaccggagcagtagtactcgcagcattgacactcagactccttctgtccaggagcgcagcagtagctgcagcagtcattcaccctgtgtctcccctttttgtcccccggaatcccaggatggtagcccttgctcaacagaagatttgctctatgatcgtgataaagacagtgggagtagctcaccgttacccaagtatgcttcatctcccaaaccaaacaacagctacatgttcaaacgggagcccccagagggatgtgagcgagtgaaggtctttgaggaaatggcgtctcgtcagcctatctcggcccctctcttttcatgtcctgacaaaaacaaggttaatttcatcccaaccggatcagctttctgtcctgtaaaacttctaggccccctcttacctgcttctgaccttatgctcaagaactcccctaactctggccagagctcagctttggcaactctgaccgttgagcagctctcatcccgggtttcctttacgtctctttctgatgacaccagcacagcgggctccatggaggcctctgtccagcagccatcccagcagcagcagctcctgcaggaactgcagggtgaggaccacatctctgctcagaactatgtgatcatctaaaaaagggggagctggcctccaccctatgttccatggattcggaacaagatttcagacatctgcatgagtgacaaactttctgaacaccacc

SEQ ID NO: 365006 - DNA, 2238 bp, Homo sapiens
ttcaggcttttgccacttgttggctgagggtcgatttactcccttagctgcgtcactctactttctccactttctccacctgtaagaagagagattgatccgattacttctaagacgttttttagcccaacctggccacactgcggaggcgccggttctttcaccccgctaacccctccgtgttggcagccaatagaagcacttaaggatgggtaacggggaagaaccactggccagtactaggggagacaagcttaaatcgttgttagaccccgagctagggttccccgagctagggttctcccttctgaggcgtgttttccccatctgcaaaacgaagggttaggcggaatgatttgcaaggtcccagttgactctgacttttggccatatgtttgactcaacagtttaaaccccctcagcagtctttctgtcgttgccctccacactgcgagactctggagggcgatctggaggtctggaagataaccgattcctgggagatttgggggtagtctccaatctgtccctggctcatcttgtgacccgaagccggcggccttgccaggagtattctagaatgagtgcacataaaaataccttcaaacggtacagcagcagcagcagcagcagcagcagcagcagcagcagcagcagcagcaatgtttcacttcttcagaaagcctccggaatctaaaaagccctcagtaccagagacagaagcagatggattcgtccttttaggagatacaacagatgagcaaagaatgacagcaagaggcaaaacttcggacatagaggccaaccaacctttggagacggagtcttgcactggcacccaggctggagtgcagtggcgcaatctcggctcactgcaagctccgcctcccgggttcacgccatgctcctgcctcagcctcccgagtagctgggactacaggcgcccgccaccatggccagcggacaaggcaaaatctcagcaagttcggacctctagtacaataaggcgaacctcctctttggatacaataacaggaccttacctcacaggacagtggccacgggatcctcatgttcactacccttcatgcatgaaagacaaagctactcagacacctagctgttgggcagaagagggtgcagaaaagaggtcacatcagcgttctgcgtcatgggggagtgctgatcaactaaaagagcagatcgccaaactgaggcagcaactacaacgcagtaaacagagtagtcgtcacagtaaggagaaagatcgccagtcacctcttcatggcaaccatataacaatcagtcacactcaggctactggatcaaggtcagttcctatgccactgtcaaatatatcagtgccaaaatcatctgtttcgcgtgtgccctgcaatgtagaaggaataagtcctgaattagaaaaggtattcattaaagaaaataatgggaaggaagaagtatccaagccgttggacataccagatggtcgaagagctccacttcctgctcattaccggagcagtagtactcgcagcattgacactcagactccttctgtccaggagcgcagcagtagctgcagcagtcattcaccctgtgtctcccctttttgtcccccggaatcccaggatggtagcccttgctcaacagaagatttgctctatgatcgtgataaagacagtgggagtagctcaccgttacccaagtatgcttcatctcccaaaccaaacaacagctacatgttcaaacgggagcccccagagggatgtgagcgagtgaaggtctttgaggaaatggcgtctcgtcagcctatctcggcccctctcttttcatgtcctgacaaaaacaaggttaatttcatcccaaccggatcagctttctgtcctgtaaaacttctaggccccctcttacctgcttctgaccttatgctcaagaactcccctaactctggccagagctcagctttggcaactctgaccgttgagcagctctcatcccgggtttcctttacgtctctttctgatgacaccagcacagcgggctccatggaggcctctgtccagcagccatcccagcagcagcagctcctgcaggaactgcagggtgaggaccacatctctgctcagaactatgtgatcatctaaaaaagggggagctggcctccaccctatgttccatggattcggaacaagatttcagacatctgcatgagtgacaaactttctgaacaccacc

SEQ ID NO: 365007 - DNA, 1504 bp, Homo sapiens
tatgtttattgcggcactattcacaatagcaaagacttggaaccaacccaaatgtccatcagtgatagactggattaagaaaatgtggcatatatacaccatggaatactatgcagccataaaaaagaatgagttcatgacctttgcaaggatgtggatgaagctggaaaccatcattctgagcaaattatcgcaaggaccaaacactgcatgtcctcactcatagcggacaaggcaaaatctcagcaagttcggacctctagtacaataaggcgaacctcctctttggatacaataacaggaccttacctcacaggacagtggccacgggatcctcatgttcactacccttcatgcatgaaagacaaagctactcagacacctagctgttgggcagaagagggtgcagaaaagaggtcacatcagcgttctgcgtcatgggggagtgctgatcaactaaaagagcagatcgccaaactgaggcagcaactacaacgcagtaaacagagtagtcgtcacagtaaggagaaagatcgccagtcacctcttcatggcaaccatataacaatcagtcacactcaggctactggatcaaggtcagttcctatgccactgtcaaatatatcagtgccaaaatcatctgtttcgcgtgtgccctgcaatgtagaaggaataagtcctgaattagaaaaggtattcattaaagaaaataatgggaaggaagaagtatccaagccgttggacataccagatggtcgaagagctccacttcctgctcattaccggagcagtagtactcgcagcattgacactcagactccttctgtccaggagcgcagcagtagctgcagcagtcattcaccctgtgtctcccctttttgtcccccggaatcccaggatggtagcccttgctcaacagaagatttgctctatgatcgtgataaagacagtgggagtagctcaccgttacccaagtatgcttcatctcccaaaccaaacaacagctacatgttcaaacgggagcccccagagggatgtgagcgagtgaaggtctttgaggaaatggcgtctcgtcagcctatctcggcccctctcttttcatgtcctgacaaaaacaaggttaatttcatcccaaccggatcagctttctgtcctgtaaaacttctaggccccctcttacctgcttctgaccttatgctcaagaactcccctaactctggccagagctcagctttggcaactctgaccgttgagcagctctcatcccgggtttcctttacgtctctttctgatgacaccagcacagcgggctccatggaggcctctgtccagcagccatcccagcagcagcagctcctgcaggaactgcagggtgaggaccacatctctgctcagaactatgtgatcatctaaaaaagggggagctggcctccaccctatgttccatggattcggaacaagatttcagacatctgcatgagtgacaaactttctgaacaccacc

SEQ ID NO: 365008 - DNA, 666 bp, Homo sapiens
aagcttgcggccgcagccccggccgagcaggcgccgcgggccaagggccgcccgagacggtccccagagagccaccggaggagcagctcacctgagagacggagccccggctcgcccgtgtgcagagcggacaaggcaaaatctcagcaagttcggacctctagtacaataaggcgaacctcctctttggatacaataacaggaccttacctcacaggacagtggccacgggatcctcatgttcactacccttcatgcatgaaagacaaagctactcagacacctagctgttgggcagaagagggtgcagaaaagaggtcacatcagcgttctgcgtcatgggggagtgctgatcaactaaaagagagacaaggtctcattatgttgcccagactggtctcgaactcctgggctcaagcagtcctcccgcctcagcctcccaaagtgctggaatcacaagtatgagccaccacacgcagctgcagctgatgatttaagccagtgctcatttgccattctgaaaatcctggggatcttaaaaattatgctatgtctattgtgcttgtactttataaagtggaagaacaaagcctggatgatatagcacatctatttacaacatggtttactgaatattttaagcccactatggggacatactgctca

SEQ ID NO: 365009 - DNA, 1141 bp, Homo sapiens
ttcaggcttttgccacttgttggctgagggtcgatttactcccttagctgcgtcactctactttctccactttctccacctgtaagaagagagattgatccgattacttctaagacgttttttagcccaacctggccacactgcggaggcgccggttctttcaccccgctaacccctccgtgttggcagccaatagaagcacttaaggatgggtaacggggaagaaccactggccagtactaggggagacaagcttaaatcgttgttagaccccgagctagggttccccgagctagggttctcccttctgaggcgtgttttccccatctgcaaaacgaagggttaggcggaatgatttgcaaggtcccagttgactctgacttttggccatatgtttgactcaacagtttaaaccccctcagcagtctttctgtcgttgccctccacactgcgagactctggagggcgatctggaggtctggaagataaccgattcctgggagatttgggggtagtctccaatctgtccctggctcatcttgtgacccgaagccggcggccttgccaggagtattctagaatgagtgcacataaaaataccttcaaacggtacagcagcagcagcagcagcagcagcagcagcagcagcagcagcagcagcaatgtttcacttcttcagaaagcctccggaatctaaaaagccctcagtaccagagacagaagcagatggattcgtccttttaggagatacaacagatgagcaaagaatgacagcaagaggcaaaacttcggacatagaggccaaccaacctttggagtatgctttctcgtctgaacacacaaggaagaaaagaaggatggctcctgtacgtgaaagtgacccctgcatatagtgcctgaaatcagaggaagcttgtcagtgtgggcagacaccacgagcagaccaatttgacattgtgcttctcttttaacctcttgaaaattaatgaaagttatccgatgaagatccttacattaattgctcccgattaaggtttaaaaccttggtttactgtggggtaaatttatgtttttgatagtcatccaaaatctttgtacgctttcagtttcattacagaataaaaaacaaatttaccacaat

SEQ ID NO: 365010 - DNA, 826 bp, Homo sapiens
atcagcaggattcccggcggtgggacttgaccccggaagtggggtgtgaagctccggtgctggtgcggcgggggactgcggggccagcctcaggtagtttaaaccccctcagcagtctttctgtcgttgccctccacactgcgagactctggagggcgatctggaggtctggaagataaccgattcctgggagatttgggggtagtctccaatctgtccctggctcatcttgtgacccgaagccggcggccttgccaggagtattctagaatgagtgcacataaaaataccttcaaacggtacagcagcagcagcagcagcagcagcagcagcagcagcagcagcagcagcaatgtttcacttcttcagaaagcctccggaatctaaaaagccctcagtaccagagacagaagcagatggattcgtccttttagatggaatcaagttaagatgaggtcatactcattggagtgggccctcctccttcactgactgatgtccttataagaagagggaaatttggacacagggagacacagaggagaaatggccatgtgagagaggcagagatcgaaatgatgccaccacaagccaagggacaccaaggattgcaagaaaccaccagagctaggaagaggcaaggaaggattctgccctagagacttcagagagagcttagccctactgacaacttgattgacgatttctagtctccagaaatgtgacagaataaatttctgttgtgttaagccaccacgtttgtaccattttgctatggcagctttaggaaactaatacagtatgtgaatctctttttctgtcattt

SEQ ID NO: 365011 - DNA, 472 bp, Homo sapiens
cgattcctgggagatttgggggtagtctccaatctgtccctggctcatcttgtgacccgaagccggcggccttgccaggagtattctagaatgagtgcacataaaaataccttcaaacggtacggtggaaattggacagaagttttaattgggtattataacgttgtggaaactgagtctgtgaattggcccaaagctacagaattgtcatcgttcaaattcccttaagcaaaaaagatccgatttgagacttcacgtggcaatttaagattggaatctcatgtacgataattaaatgatagtctcccttagtgtttccttagcacttaataggtttgtcttagttttactcactaacggtactttaaaggatttcattaaacagatgtagaatgtgtgtcagtggtgtataaaaaagttgtggttgtattggtgcaagtcagtaaagtctattttatattacagctttaag

SEQ ID NO: 365012 - DNA, 521 bp, Homo sapiens
aagcttgcggccgcagccccggccgagcaggcgccgcgggccaagggccgcccgagacggtccccagagagccaccggaggagcagctcacctgagagacggagccccggctcgcccgtgtgcagagcggacaaggcaaaatctcagcaagttcggacctctagtacaataaggcgaacctcctctttggatacaataacaggaccttacctcacaggacagtggccacgggatcctcatgttcactacccttcatgcatgaaagacaaagctactcagacacctagctgttgggcagaagagggtgcagaaaagaggtcacatcagcgttctgcgtcatgggggagtgctgatcaactaaaagaggtaagttatttctgttttccgtctgtaacctgttttggtcctagtagattaccttagtatttcctgaatgtaatgacacttttaaaatttatcctaaccttacctctttcagtaaggttaggacaaattctagggtaaggttagaataaattcta

SEQ ID NO: 365013 - DNA, 467 bp, Homo sapiens
aagcttgcggccgcagccccggccgagcaggcgccgcgggccaagggccgcccgagacggtccccagagagccaccggaggagcagctcacctgagagacggagccccggctcgcccgtgtgcagagcggacaaggcaaaatctcagcaagttcggacctctagtacaataaggcgaacctcctctttggatacaataacaggaccttacctcacaggacagtggccacgggatcctcatgttcactacccttcatgcatgaaagacaaagctactcaggtaaaatcaggaaatcaaaatcagcttattaccctgcacttcttctgttttgatcacagtaaagaaaatgtaatataatcaaatttccccaaatttgaaatacatccaaccaaggaagaaaggaaaaatccattgttttaaataaactttgcagtaattgttttttgtcatctggcttttagaagttt

SEQ ID NO: 365014 - DNA, 2451 bp, Homo sapiens
atcagcaggattcccggcggtgggacttgaccccggaagtggggtgtgaagctccggtgctggtgcggcgggggactgcggggccagcctcaggtagtttaaaccccctcagcagtctttctgtcgttgccctccacactgcgagactctggagggcgatctggaggtctggaagataaccgattcctgggagatttgggggtagtctccaatctgtccctggctcatcttgtgacccgaagccggcggccttgccaggagtattctagaatgagtgcacataaaaataccttcaaacggtacagcagcagcagcagcagcagcagcagcagcagcagcagcagcagcagcaatgtttcacttcttcagaaagcctccggaatctaaaaagccctcagtaccagagacagaagcagatggattcgtccttttaggagatacaacagatgagcaaagaatgacagcaagaggcaaaacttcggacatagaggccaaccaacctttggagaccaacaaagaaaattcatccagtgtgactgtatcagaccctgagatggaaaataaggcaggccagactctggagaacagctcattaatggccgagctcctgagcgatgtgccgttcaccctggccccgcatgtgctggcagtacagggcaccatcactgaccttcccgaccacttactctcctatgatggcagcgaaaacttatcacggttttggtatgatttcactcttgaaaattcagtgctctgtgattcataacctttatgtctgtttgcaccttaacagctttaaaatatgttcgcctattttatctaacctgtttgatgttctttgccgtttcactgtttaaggtcctcagcaaggatcataaagcaaagaaaatagcattatgttcactactctatttttaagaaaaaggtacatttgtatacaaattgaacttaagttctacttcctttctcccatataataaatatacaaattaggctatgaaggttttaggaaaggactcgattccttcagatggtctctcaaaatataacacctcaaatttatcttagaagaactgtgaaaaagaattgtggcatttttcagtcactacagctccgaagtctgagcaagaagtgggtgtgaagtctcctctctggtttgtaggaagttgaattggtgttattcctgcatttttttcttccacagtgtttatgaatgaattcagaaaaaaagttgccagttagcttaatttcttcagatgcattgatgtggaaatttaaaacttgtcctaaacagcagtgctagtttgctgatacaaggatgctagacctgctctgcgtgctctttctggagtggcccatttcggttttctgaaacccatggcagccctttccatcgtgaataatcgttgtgttcccacctttgttctctgcctttttgctacttcagtgtgctctctgaccagctttccaaagaactttccctgcttctgcctcggttgccatttgctctccttaccacatatgttcccagtttatgaagagatccacatttcctttcaacccctctgcctcctgaagaaaaacatctcatgatgatacatattattgctgataacacccttatttagaaatttgttggccacaatacagatggaaatgttttactgctggaaaaactgaaatcaactcatttccaattagagtataggcagaacacctagatatgacttttagttcttgaatatccattacttactttaatgaaaacagaactgccattggtcaataaactgtaaagggaagaggtaaattgtgatagagaattttctatgtcatgggaaattgaaatcacatttattttgattaccagcaatatgatttgttaactctgtgccaagttttaagtatattttttcacaaagatagagtgccatagtgaaactaaacactgtgcataaaggtacatgaattattccagttttaaagtattatgcatgtttgtttaataaatgtggcatggttttaatacaaatgctatgttatttaaaagttagaggaacatttctattgacaaaaatatgcttcatttacatataatgttaccatatggtgttaatgattaaattagatctttacatagttcttacaaagcatcagtctaggaaatatgacttattactgatgcaaacgtgaacattttgtagtagttttgtaaaagaacatccttttcaaatatctgtgttaatgtacccttgaaattaaatgcaagcacatagtcagtttgtctaattttgtgtgaaattttgtcgaaaatacctaaacatttcatctatatttgtgcctaccatgttataaatgttcataagtaccttcatgtgtctataaaaaatgttatatttaaataaatgtgaattaaaataaaatttttgattattttcagatccagaaaaa

SEQ ID NO: 365015 - DNA, 2368 bp, Homo sapiens
cagctggtaccggccctgaggttatggatcggaagctggggtgtgaagctccgtgtgctggatgctgcgcggggactgctcgggccagcctcagtgctagcacgcacgcagacagcagcagcagcagcagcagcagcagcagcagcagcagcagcagcagcaatgtttcacttcttcagaaagcctccggaatctaaaaagccctcagtaccagagacagaagcagatggattcgtccttttagaagcatctcagaggctctccagtgacgtgctgttaaaagtgctgaccctgggtcagaccctttgggttggcttcgtggctccacgacttactctctacccttggcaggagatacaacagatgagcaaagaatgacagcaagaggcaaaacttcggacatagaggccaaccaacctttggagaccaacaaagaaaattcatccagtgtgactgtatcagaccctgagatggaaaataaggcaggccagactctggagaacagctcattaatggccgagctcctgagcgatgtgccgttcaccctggccccgcatgtgctggcagtacagggcaccatcactgaccttcccgaccacttactctcctatgatggcagcgaaaacttatcacggttttggtatgatttcactcttgaaaattcagtgctctgtgattcataacctttatgtctgtttgcaccttaacagctttaaaatatgttcgcctattttatctaacctgtttgatgttctttgccgtttcactgtttaaggtcctcagcaaggatcataaagcaaagaaaatagcattatgttcactactctatttttaagaaaaaggtacatttgtatacaaattgaacttaagttctacttcctttctcccatataataaatatacaaattaggctatgaaggttttaggaaaggactcgattccttcagatggtctctcaaaatataacacctcaaatttatcttagaagaactgtgaaaaagaattgtggcatttttcagtcactacagctccgaagtctgagcaagaagtgggtgtgaagtctcctctctggtttgtaggaagttgaattggtgttattcctgcatttttttcttccacagtgtttatgaatgaattcagaaaaaaagttgccagttagcttaatttcttcagatgcattgatgtggaaatttaaaacttgtcctaaacagcagtgctagtttgctgatacaaggatgctagacctgctctgcgtgctctttctggagtggcccatttcggttttctgaaacccatggcagccctttccatcgtgaataatcgttgtgttcccacctttgttctctgcctttttgctacttcagtgtgctctctgaccagctttccaaagaactttccctgcttctgcctcggttgccatttgctctccttaccacatatgttcccagtttatgaagagatccacatttcctttcaacccctctgcctcctgaagaaaaacatctcatgatgatacatattattgctgataacacccttatttagaaatttgttggccacaatacagatggaaatgttttactgctggaaaaactgaaatcaactcatttccaattagagtataggcagaacacctagatatgacttttagttcttgaatatccattacttactttaatgaaaacagaactgccattggtcaataaactgtaaagggaagaggtaaattgtgatagagaattttctatgtcatgggaaattgaaatcacatttattttgattaccagcaatatgatttgttaactctgtgccaagttttaagtatattttttcacaaagatagagtgccatagtgaaactaaacactgtgcataaaggtacatgaattattccagttttaaagtattatgcatgtttgtttaataaatgtggcatggttttaatacaaatgctatgttatttaaaagttagaggaacatttctattgacaaaaatatgcttcatttacatataatgttaccatatggtgttaatgattaaattagatctttacatagttcttacaaagcatcagtctaggaaatatgacttattactgatgcaaacgtgaacattttgtagtagttttgtaaaagaacatccttttcaaatatctgtgttaatgtacccttgaaattaaatgcaagcacatagtcagtttgtctaattttgtgtgaaattttgtcgaaaatacctaaacatttcatctatatttgtgcctaccatgttataaatgttcataagtaccttcatgtgtctataaaaaatgttatatttaaataaatgtgaattaaaataaaatttttgattattttcagatccagaaaaa

SEQ ID NO: 365016 - DNA, 2246 bp, Homo sapiens
  misc_feature (1688)..(1688): n is a, c, g, or t
  misc_feature (1691)..(1691): n is a, c, g, or t
  misc_feature (1693)..(1693): n is a, c, g, or t
  misc_feature (1747)..(1747): n is a, c, g, or t
  misc_feature (1751)..(1751): n is a, c, g, or t
  misc_feature (1765)..(1766): n is a, c, g, or t
  misc_feature (1774)..(1774): n is a, c, g, or t
  misc_feature (1800)..(1800): n is a, c, g, or t
  misc_feature (1812)..(1812): n is a, c, g, or t
  misc_feature (1823)..(1823): n is a, c, g, or t
atcagcaggattcccggcggtgggacttgaccccggaagtggggtgtgaagctccggtgctggtgcggcgggggactgcggggccagcctcaggtagcagcagcagcagcagcagcagcagcagcagcagcagcagcagcagcagcaatgtttcacttcttcagaaagcctccggaatctaaaaagccctcagtaccagagacagaagcagatggattcgtccttttaggagatacaacagatgagcaaagaatgacagcaagaggcaaaacttcggacatagaggccaaccaacctttggagaccaacaaagaaaattcatccagtgtgactgtatcagaccctgagatggaaaataaggcaggccagactctggagaacagctcattaatggccgagctcctgagcgatgtgccgttcaccctggccccgcatgtgctggcagtacagggcaccatcactgaccttcccgaccacttactctcctatgatggcagcgaaaacttatcacggttttggtatgatttcactcttgaaaattcagtgctctgtgattcataacctttatgtctgtttgcaccttaacagctttaaaatatgttcgcctattttatctaacctgtttgatgttctttgccgtttcactgtttaaggtcctcagcaaggatcataaagcaaagaaaatagcattatgttcactactctatttttaagaaaaaggtacatttgtatacaaattgaacttaagttctacttcctttctcccatataataaatatacaaattaggctatgaaggttttaggaaaggactcgattccttcagatggtctctcaaaatataacacctcaaatttatcttagaagaactgtgaaaaagaattgtggcatttttcagtcactacagctccgaagtctgagcaagaagtgggtgtgaagtctcctctctggtttgtaggaagttgaattggtgttattcctgcatttttttcttccacagtgtttatgaatgaattcagaaaaaaagttgccagttagcttaatttcttcagatgcattgatgtggaaatttaaaacttgtcctaaacagcagtgctagtttgctgatacaaggatgctagacctgctctgcgtgctctttctggagtggcccatttcggttttctgaaacccatggcagccctttccatcgtgaataatcgttgtgttcccacctttgttctctgcctttttgctacttcagtgtgctctctgaccagctttccaaagaactttccctgcttctgcctcggttgccatttgctctccttaccacatatgttcccagtttatgaagagatccacatttcctttcaacccctctgcctcctgaagaaaaacatctcatgatgatacatattattgctgataacacccttatttagaaatttgttggccacaatacagatggaaatgttttactgctggaaaaactgaaatcaactcatttccaattagagtataggcagaacacctagatatgacttttagttcttgaatatccattacttactttaatgaaaacagaactgccattggtcaataaactgtaaagggaagaggtaaattgtgatagagaattttctatgtcatgggaaattgaaatcacatccatcccgaacaccagcaacacgacccgtcaaccccgcnccnanccccaagcacacccccccacaaagacagagcgccacagcgaaaccaaacaccgngcanaaagggacaggaannaccccagngggaaagtattaggcagggggggggnagaaaggggggnggggggtaagncaaaggcgatgtgagggaaaagggagaggaacatttctattgacaaaaatatgcttcatttacatataatgttaccatatggtgttaatgattaaattagatctttacatagttcttacaaagcatcagtctaggaaatatgacttattactgatgcaaacgtgaacattttgtagtagttttgtaaaagaacatccttttcaaatatctgtgttaatgtacccttgaaattaaatgcaagcacatagtcagtttgtctaattttgtgtgaaattttgtcgaaaatacctaaacatttcatctatatttgtgcctaccatgttataaatgttcataagtaccttcatgtgtctataaaaaatgttatatttaaataaatgtgaattaaaataaaatttttgattattttcagatccagaaaaa

SEQ ID NO: 365017 - DNA, 1252 bp, Homo sapiens
aagcttgcggccgcagccccggccgagcaggcgccgcgggccaagggccgcccgagacggtccccagagagccaccggaggagcagctcacctgagagacggagccccggctcgcccgtgtgcagagcggacaaggcaaaatctcagcaagttcggacctctagtacaataaggcgaacctcctctttggatacaataacaggaccttacctcacaggacagtggccacgggatcctcatgttcactacccttcatgcatgaaagacaaagctactcagacacctagctgttgggcagaagagggtgcagaaaagaggtcacatcagcgttctgcgtcatgggggagtgctgatcaactaaaagagcagatcgccaaactgaggcagcaactacaacgcagtaaacagagtagtcgtcacagtaaggagaaagatcgccagtcacctcttcatggcaaccatataacaatcagtcacactcagccgttggacataccagatggtcgaagagctccacttcctgctcattaccggagcagtagtactcgcagcattgacactcagactccttctgtccaggagcgcagcagtagctgcagcagtcattcaccctgtgtctcccctttttgtcccccggaatcccaggatggtagcccttgctcaacagaagatttgctctatgatcgtgataaagacagtgggagtagctcaccgttacccaagtatgcttcatctcccaaaccaaacaacagctacatgttcaaacgggagcccccagagggatgtgagcgagtgaaggtctttgaggaaatggcgtctcgtcagcctatctcggcccctctcttttcatgtcctgacaaaaacaaggttaatttcatcccaaccggatcagctttctgtcctgtaaaacttctaggccccctcttacctgcttctgaccttatgctcaagaactcccctaactctggccagagctcagctttggcaactctgaccgttgagcagctctcatcccgggtttcctttacgtctctttctgatgacaccagcacagcgggctccatggaggcctctgtccagcagccatcccagcagcagcagctcctgcaggaactgcagggtgaggaccacatctctgctcagaactatgtgatcatctaaaaaagggggagctggcctccaccctatgttccatggattcggaacaagatttcagacatctgcatgagtgacaaactttctgaacaccacc

SEQ ID NO: 365018 - DNA, 1581 bp, Homo sapiens
atcagcaggattcccggcggtgggacttgaccccggaagtggggtgtgaagctccggtgctggtgcggcgggggactgcggggccagcctcaggtagcagcagcagcagcagcagcagcagcagcagcagcagcagcagcagcagcaatgtttcacttcttcagaaagcctccggaatctaaaaagccctcagtaccagagacagaagcagatggattcgtccttttaggagatacaacagatgagcaaagaatgacagcaagaggcaaaacttcggacatagaggccaaccaacctttggagcggacaaggcaaaatctcagcaagttcggacctctagtacaataaggcgaacctcctctttggatacaataacaggaccttacctcacaggacagtggccacgggatcctcatgttcactacccttcatgcatgaaagacaaagctactcagacacctagctgttgggcagaagagggtgcagaaaagaggtcacatcagcgttctgcgtcatgggggagtgctgatcaactaaaagagcagatcgccaaactgaggcagcaactacaacgcagtaaacagagtagtcgtcacagtaaggagaaagatcgccagtcacctcttcatggcaaccatataacaatcagtcacactcaggctactggatcaaggtcagttcctatgccactgtcaaatatatcagtgccaaaatcatctgtttcgcgtgtgccctgcaatgtagaaggaataagtcctgaattagaaaaggtattcattaaagaaaataatgggaaggaagaagtatccaagccgttggacataccagatggtcgaagagctccacttcctgctcattaccggagcagtagtactcgcagcattgacactcagactccttctgtccaggagcgcagcagtagctgcagcagtcattcaccctgtgtctcccctttttgtcccccggaatcccaggatggtagcccttgctcaacagaagatttgctctatgatcgtgataaagacagtgggagtagctcaccgttacccaagtatgcttcatctcccaaaccaaacaacagctacatgttcaaacgggagcccccagagggatgtgagcgagtgaaggtctttgaggaaatggcgtctcgtcagcctatctcggcccctctcttttcatgtcctgacaaaaacaaggttaatttcatcccaaccggatcagctttctgtcctgtaaaacttctaggccccctcttacctgcttctgaccttatgctcaagaactcccctaactctggccagagctcagctttggcaactctgaccgttgagcagctctcatcccgggtttcctttacgtctctttctgatgacaccagcacagcgggctccatggaggcctctgtccagcagccatcccagcagcagcagctcctgcaggaactgcagggtgaggaccacatctctgctcagaactatgtgatcatctaaaaaagggggagctggcctccaccctatgttccatggattcggaacaagatttcagacatctgcatgagtgacaaactttctgaacaccacc

SEQ ID NO: 365019 - DNA, 1318 bp, Homo sapiens
aagcttgcggccgcagccccggccgagcaggcgccgcgggccaagggccgcccgagacggtccccagagagccaccggaggagcagctcacctgagagacggagccccggctcgcccgtgtgcagagcggacaaggcaaaatctcagcaagttcggacctctagtacaataaggcgaacctcctctttggatacaataacaggaccttacctcacaggacagtggccacgggatcctcatgttcactacccttcatgcatgaaagacaaagctactcagcagatcgccaaactgaggcagcaactacaacgcagtaaacagagtagtcgtcacagtaaggagaaagatcgccagtcacctcttcatggcaaccatataacaatcagtcacactcaggctactggatcaaggtcagttcctatgccactgtcaaatatatcagtgccaaaatcatctgtttcgcgtgtgccctgcaatgtagaaggaataagtcctgaattagaaaaggtattcattaaagaaaataatgggaaggaagaagtatccaagccgttggacataccagatggtcgaagagctccacttcctgctcattaccggagcagtagtactcgcagcattgacactcagactccttctgtccaggagcgcagcagtagctgcagcagtcattcaccctgtgtctcccctttttgtcccccggaatcccaggatggtagcccttgctcaacagaagatttgctctatgatcgtgataaagacagtgggagtagctcaccgttacccaagtatgcttcatctcccaaaccaaacaacagctacatgttcaaacgggagcccccagagggatgtgagcgagtgaaggtctttgaggaaatggcgtctcgtcagcctatctcggcccctctcttttcatgtcctgacaaaaacaaggttaatttcatcccaaccggatcagctttctgtcctgtaaaacttctaggccccctcttacctgcttctgaccttatgctcaagaactcccctaactctggccagagctcagctttggcaactctgaccgttgagcagctctcatcccgggtttcctttacgtctctttctgatgacaccagcacagcgggctccatggaggcctctgtccagcagccatcccagcagcagcagctcctgcaggaactgcagggtgaggaccacatctctgctcagaactatgtgatcatctaaaaaagggggagctggcctccaccctatgttccatggattcggaacaagatttcagacatctgcatgagtgacaaactttctgaacaccacc

SEQ ID NO: 365020 - DNA, 664 bp, Homo sapiens
tgcttaaggccaggagtttgagaccagccctgggaacgtggaaagaccttgtctctatagacaccaaaaaaatacaaaaattagctaggcatggtggcatgagcctgtagtcccagctacttgggaggcttaggtaggaggatcgcctgagcccaggagttgagaggctgaagtgagctatgattgtgtcactgcactccagcctgggcaagaatgaggaaaaaagacattaaatacagttttaagacagtgtttatagtaataaaggaaaatcacatattcaaaatactatatgcactatacagtttctataaataacatactgaaaaaaaaatctttcctctgcctcgtatcagttattaatgataagaaaacatggctgggcctggtggctcacacctgtaatactcgcactttgggagacccaggtgggtagatctcttgaggactggaattcaagaccagtctggccaacatggcaaaggcctgtttctactaaaaataaaaaaaattagccaggtggtgcacacctgtaatcccagctacccgggaggctgaggcagaagaactgtttgaacctgggaggcagaggttgcagtgagctgtgatcacaccactgtgctccagcctgggccacagtgagaccctgttcccccaaaaagga

SEQ ID NO: 365021 - DNA, 3173 bp, Homo sapiens
agcgggtgcgcggggagcgcggggagcgcggggagcgcggggctgcgctcgtgtgcgctcctgggcgctcgccgccgccgctgccgccgcgcgcctttgagtcagcaaactccgcggcccgcaagcccggctcggcccggccctgctctgttctgcccggaggagccgcccattgatcgtgtcctgtgctgaagatgtttccggaacaacagaaagaggaatttgtaagtgtctgggttcgagatcctaggattcagaaggaggacttctggcattcttacattgactatgagatatgtattcatactaatagcatgtgttttacaatgaaaacatcctgtgtacgaagaagatatagagaattcgtgtggctgaggcagagactccaaagtaatgcgttgctggtacaactgccagaacttccatctaaaaacctgtttttcaacatgaacaatcgccagcacgtggatcagcgtcgccagggtctggaagatttcctcagaaaagtcctacagaatgcacttttgctttcagatagcagccttcacctcttcttacagagccatctgaattcagaagacattgaggcgtgtgtttctgggcagactaagtactctgtggaagaagcaattcacaagtttgccttaatgaatagacgtttccctgaagaagatgaagaaggaaaaaaagaaaatgatatagattatgattcagaaagttcatcctctgggcttggacacagtagtgatgacagcagttcacatggatgtaaagtaaatacagctccgcaggaatcctgaaaaataattctaatgttactatcttaggaatagcaaattatgtccagtcatagagaagaaagcttcataataatacattcttacctaaagctcactgtcatgatgttaggtatttaaattcttaaagatgttgggttgtttattagtggtatttttatgttgtcttattttaggtaagcttctgtgtaaagctaaaaatcctgtgaatacaatactatcctttacaggcagacattattggtaaacaagatcttgccctccaatgaaatgacttacatgttttaaaaaaccgagttggttttattgaatttaaaaagataggtaactaagtagcatttaaaatcaagatagagcattccttcttgtatcagtggggcagtgttaccataaacacggtgtatatgttgttaaaccctatgaagagtaacagtgtagaccagactgcctctctcagatatgtgcctgatattttgtggatacctcccctgcactggcaaaacactatgcttttgggtgttagactgaaatattttaagagtatttaacctttccagtattctgtttcacgcttagatggaaatgtatcttatgaatagagacatattaaaataatgtttacatcttagaaaaaacatagatagtgctagtaatattacttataactgtaatatatagattcagaaatacattttcattatccaaaatcagcttcaacaaatggtttctggagacaaataatttgttttcattatcattgtataatcaggttaatgatttattttttgactaaatgtgcaatttcttatcactagataactttcagtatcagtggtggttacttattacttaaatcagaggaaggattttataaagattaataaatttaattttaccaataaatattcccataatttagaaaaggatgtcgacttgctaatttcagaaataattattcatttttaaaaagccccttttaaagcatctacttgaagattggtataattttcataaaatgtctttttttttagtgtcccaaagatatcttagataaactattttgaagttcagatttcagatgaggcaacattttcttgagataattacccaagtttcatccatgttgaatggtacaaaatatttctgtgaaactaacaggaagatattttcagataactaggataacttgttgctttgttacccagcctaattgaagagtggcagaggctactacaaaaagcaaccttttcattttcactaagagtttaaaagctattgtattattaaaaagtctttacaatgcttgtttcaaagaaccaacagaaaaaaaagctaagaaaactgagaactaacattaaaaaaattaaatttagaataagaatgatttctttaatttgtcctttttttctttggtctaaaacattattaaatttttgtaaatattttgatttaatgtgtcttagatcctcattattttaatacaggaaaagaaaagatttagtaatttcttaccatgctaatatgtaaagttcatgccatccaggcatttaagagcgatcctcatcccttcagcaatatgtatttgagttcacactatttctgttttacagcagttttgaaaaacacatactatgccaccaattgtcatattatttttagatgatgtaacatagccatcaaaattaatattatgtaatgcctaatacttagtatgtaaatgtcacgagatcatttttacattaaacgtgaaaaaaaaaaaaaaaaaaaaaaaaaaaaaaaaaaaaaacaccccacccacaaaaaaaaaaaaaaaaaaaaaaaataaactaaaagaaccacataaggcaaccaataaaagataaaaaacaaagcgatataatcaacacacagaaaacaataaactagagtggtgcgggtgtggtcctctttattctgaatcactgctgggctgtgtgcgcctttctgcgagaggtctcatgtgactcgtaatttgtcgagacgagacagactcgacactccaatcgagtgtgatgtatattcacactgcacaacacgctcctcgtgaacccagtagtgatcaattaatcatcatcgcgatgggtatctgcaagaattatgcgctgctatggcacagctgtacatcggaaagaacatactcgctcttcgttcttcgtgggtgtcggcgtgtgcaaggtatcatgactgaactctcatatatcagtagacgagaaatgaatcgatcggactcatgtgcaatcgttcctccacacttacagatccgtcaggggcttgtgtgtctattaggcgagagaaggtaacaacgataatgacaatgtggcgaggggacggcgaagtgaggcatggagtggttagatc

SEQ ID NO: 365022 - DNA, 3294 bp, Homo sapiens
agcgggtgcgcggggagcgcggggagcgcggggagcgcggggctgcgctcgtgtgcgctcctgggcgctcgccgccgccgctgccgccgcgcgcctttgagtcagcaaactccgcggcccgcaagcccggctcggcccggccctgctctgttctgcccggaggagccgcccattgatcgtgtcctgtgctgaagatgtttccggaacaacagaaagaggcatttatttattcattaaatgatactaatggaaggcattggatgtatgaggcattcaagtcttacaagacagcctaagctgccctacaggagcttagcgtctgctagaggaggcctacaggaatttgtaagtgtctgggttcgagatcctaggattcagaaggaggacttctggcattcttacattgactatgagatatgtattcatactaatagcatgtgttttacaatgaaaacatcctgtgtacgaagaagatatagagaattcgtgtggctgaggcagagactccaaagtaatgcgttgctggtacaactgccagaacttccatctaaaaacctgtttttcaacatgaacaatcgccagcacgtggatcagcgtcgccagggtctggaagatttcctcagaaaagtcctacagaatgcacttttgctttcagatagcagccttcacctcttcttacagagccatctgaattcagaagacattgaggcgtgtgtttctgggcagactaagtactctgtggaagaagcaattcacaagtttgccttaatgaatagacgtttccctgaagaagatgaagaaggaaaaaaagaaaatgatatagattatgattcagaaagttcatcctctgggcttggacacagtagtgatgacagcagttcacatggatgtaaagtaaatacagctccgcaggaatcctgaaaaataattctaatgttactatcttaggaatagcaaattatgtccagtcatagagaagaaagcttcataataatacattcttacctaaagctcactgtcatgatgttaggtatttaaattcttaaagatgttgggttgtttattagtggtatttttatgttgtcttattttaggtaagcttctgtgtaaagctaaaaatcctgtgaatacaatactatcctttacaggcagacattattggtaaacaagatcttgccctccaatgaaatgacttacatgttttaaaaaaccgagttggttttattgaatttaaaaagataggtaactaagtagcatttaaaatcaagatagagcattccttcttgtatcagtggggcagtgttaccataaacacggtgtatatgttgttaaaccctatgaagagtaacagtgtagaccagactgcctctctcagatatgtgcctgatattttgtggatacctcccctgcactggcaaaacactatgcttttgggtgttagactgaaatattttaagagtatttaacctttccagtattctgtttcacgcttagatggaaatgtatcttatgaatagagacatattaaaataatgtttacatcttagaaaaaacatagatagtgctagtaatattacttataactgtaatatatagattcagaaatacattttcattatccaaaatcagcttcaacaaatggtttctggagacaaataatttgttttcattatcattgtataatcaggttaatgatttattttttgactaaatgtgcaatttcttatcactagataactttcagtatcagtggtggttacttattacttaaatcagaggaaggattttataaagattaataaatttaattttaccaataaatattcccataatttagaaaaggatgtcgacttgctaatttcagaaataattattcatttttaaaaagccccttttaaagcatctacttgaagattggtataattttcataaaatgtctttttttttagtgtcccaaagatatcttagataaactattttgaagttcagatttcagatgaggcaacattttcttgagataattacccaagtttcatccatgttgaatggtacaaaatatttctgtgaaactaacaggaagatattttcagataactaggataacttgttgctttgttacccagcctaattgaagagtggcagaggctactacaaaaagcaaccttttcattttcactaagagtttaaaagctattgtattattaaaaagtctttacaatgcttgtttcaaagaaccaacagaaaaaaaagctaagaaaactgagaactaacattaaaaaaattaaatttagaataagaatgatttctttaatttgtcctttttttctttggtctaaaacattattaaatttttgtaaatattttgatttaatgtgtcttagatcctcattattttaatacaggaaaagaaaagatttagtaatttcttaccatgctaatatgtaaagttcatgccatccaggcatttaagagcgatcctcatcccttcagcaatatgtatttgagttcacactatttctgttttacagcagttttgaaaaacacatactatgccaccaattgtcatattatttttagatgatgtaacatagccatcaaaattaatattatgtaatgcctaatacttagtatgtaaatgtcacgagatcatttttacattaaacgtgaaaaaaaaaaaaaaaaaaaaaaaaaaaaaaaaaaaaaacaccccacccacaaaaaaaaaaaaaaaaaaaaaaaataaactaaaagaaccacataaggcaaccaataaaagataaaaaacaaagcgatataatcaacacacagaaaacaataaactagagtggtgcgggtgtggtcctctttattctgaatcactgctgggctgtgtgcgcctttctgcgagaggtctcatgtgactcgtaatttgtcgagacgagacagactcgacactccaatcgagtgtgatgtatattcacactgcacaacacgctcctcgtgaacccagtagtgatcaattaatcatcatcgcgatgggtatctgcaagaattatgcgctgctatggcacagctgtacatcggaaagaacatactcgctcttcgttcttcgtgggtgtcggcgtgtgcaaggtatcatgactgaactctcatatatcagtagacgagaaatgaatcgatcggactcatgtgcaatcgttcctccacacttacagatccgtcaggggcttgtgtgtctattaggcgagagaaggtaacaacgataatgacaatgtggcgaggggacggcgaagtgaggcatggagtggttagatc

SEQ ID NO: 365023 - DNA, 3081 bp, Homo sapiens
tgcccgcacccttgcgggctggaaagaggtttgggtcccttgggcttggagcagaggagccgcctccttttcagccgagattgatcgtgtcctgtgctgaagatgtttccggaacaacagaaagaggaatttgtaagtgtctgggttcgagatcctaggattcagaaggaggacttctggcattcttacattgactatgagatatgtattcatactaatagcatgtgttttacaatgaaaacatcctgtgtacgaagaagatatagagaattcgtgtggctgaggcagagactccaaagtaatgcgttgctggtacaactgccagaacttccatctaaaaacctgtttttcaacatgaacaatcgccagcacgtggatcagcgtcgccagggtctggaagatttcctcagaaaagtcctacagaatgcacttttgctttcagatagcagccttcacctcttcttacagagccatctgaattcagaagacattgaggcgtgtgtttctgggcagactaagtactctgtggaagaagcaattcacaagtttgccttaatgaatagacgtttccctgaagaagatgaagaaggaaaaaaagaaaatgatatagattatgattcagaaagttcatcctctgggcttggacacagtagtgatgacagcagttcacatggatgtaaagtaaatacagctccgcaggaatcctgaaaaataattctaatgttactatcttaggaatagcaaattatgtccagtcatagagaagaaagcttcataataatacattcttacctaaagctcactgtcatgatgttaggtatttaaattcttaaagatgttgggttgtttattagtggtatttttatgttgtcttattttaggtaagcttctgtgtaaagctaaaaatcctgtgaatacaatactatcctttacaggcagacattattggtaaacaagatcttgccctccaatgaaatgacttacatgttttaaaaaaccgagttggttttattgaatttaaaaagataggtaactaagtagcatttaaaatcaagatagagcattccttcttgtatcagtggggcagtgttaccataaacacggtgtatatgttgttaaaccctatgaagagtaacagtgtagaccagactgcctctctcagatatgtgcctgatattttgtggatacctcccctgcactggcaaaacactatgcttttgggtgttagactgaaatattttaagagtatttaacctttccagtattctgtttcacgcttagatggaaatgtatcttatgaatagagacatattaaaataatgtttacatcttagaaaaaacatagatagtgctagtaatattacttataactgtaatatatagattcagaaatacattttcattatccaaaatcagcttcaacaaatggtttctggagacaaataatttgttttcattatcattgtataatcaggttaatgatttattttttgactaaatgtgcaatttcttatcactagataactttcagtatcagtggtggttacttattacttaaatcagaggaaggattttataaagattaataaatttaattttaccaataaatattcccataatttagaaaaggatgtcgacttgctaatttcagaaataattattcatttttaaaaagccccttttaaagcatctacttgaagattggtataattttcataaaatgtctttttttttagtgtcccaaagatatcttagataaactattttgaagttcagatttcagatgaggcaacattttcttgagataattacccaagtttcatccatgttgaatggtacaaaatatttctgtgaaactaacaggaagatattttcagataactaggataacttgttgctttgttacccagcctaattgaagagtggcagaggctactacaaaaagcaaccttttcattttcactaagagtttaaaagctattgtattattaaaaagtctttacaatgcttgtttcaaagaaccaacagaaaaaaaagctaagaaaactgagaactaacattaaaaaaattaaatttagaataagaatgatttctttaatttgtcctttttttctttggtctaaaacattattaaatttttgtaaatattttgatttaatgtgtcttagatcctcattattttaatacaggaaaagaaaagatttagtaatttcttaccatgctaatatgtaaagttcatgccatccaggcatttaagagcgatcctcatcccttcagcaatatgtatttgagttcacactatttctgttttacagcagttttgaaaaacacatactatgccaccaattgtcatattatttttagatgatgtaacatagccatcaaaattaatattatgtaatgcctaatacttagtatgtaaatgtcacgagatcatttttacattaaacgtgaaaaaaaaaaaaaaaaaaaaaaaaaaaaaaaaaaaaaacaccccacccacaaaaaaaaaaaaaaaaaaaaaaaataaactaaaagaaccacataaggcaaccaataaaagataaaaaacaaagcgatataatcaacacacagaaaacaataaactagagtggtgcgggtgtggtcctctttattctgaatcactgctgggctgtgtgcgcctttctgcgagaggtctcatgtgactcgtaatttgtcgagacgagacagactcgacactccaatcgagtgtgatgtatattcacactgcacaacacgctcctcgtgaacccagtagtgatcaattaatcatcatcgcgatgggtatctgcaagaattatgcgctgctatggcacagctgtacatcggaaagaacatactcgctcttcgttcttcgtgggtgtcggcgtgtgcaaggtatcatgactgaactctcatatatcagtagacgagaaatgaatcgatcggactcatgtgcaatcgttcctccacacttacagatccgtcaggggcttgtgtgtctattaggcgagagaaggtaacaacgataatgacaatgtggcgaggggacggcgaagtgaggcatggagtggttagatc

SEQ ID NO: 365024 - DNA, 2959 bp, Homo sapiens
caccctggggcaacactgcttatttccatcatcctggctgtcttcagggctgttatgttcctgggttatgtgcaagatttcagagtactggcataaatataaatatatgtttggtggtttaaatcctatttagagtgaatgttgagatcatattgtgaattatagatacaagaaatgcatttttttcctcagacaactgccagaacttccatctaaaaacctgtttttcaacatgaacaatcgccagcacgtggatcagcgtcgccagggtctggaagatttcctcagaaaagtcctacagaatgcacttttgctttcagatagcagccttcacctcttcttacagagccatctgaattcagaagacattgaggcgtgtgtttctgggcagactaagtactctgtggaagaagcaattcacaagtttgccttaatgaatagacgtttccctgaagaagatgaagaaggaaaaaaagaaaatgatatagattatgattcagaaagttcatcctctgggcttggacacagtagtgatgacagcagttcacatggatgtaaagtaaatacagctccgcaggaatcctgaaaaataattctaatgttactatcttaggaatagcaaattatgtccagtcatagagaagaaagcttcataataatacattcttacctaaagctcactgtcatgatgttaggtatttaaattcttaaagatgttgggttgtttattagtggtatttttatgttgtcttattttaggtaagcttctgtgtaaagctaaaaatcctgtgaatacaatactatcctttacaggcagacattattggtaaacaagatcttgccctccaatgaaatgacttacatgttttaaaaaaccgagttggttttattgaatttaaaaagataggtaactaagtagcatttaaaatcaagatagagcattccttcttgtatcagtggggcagtgttaccataaacacggtgtatatgttgttaaaccctatgaagagtaacagtgtagaccagactgcctctctcagatatgtgcctgatattttgtggatacctcccctgcactggcaaaacactatgcttttgggtgttagactgaaatattttaagagtatttaacctttccagtattctgtttcacgcttagatggaaatgtatcttatgaatagagacatattaaaataatgtttacatcttagaaaaaacatagatagtgctagtaatattacttataactgtaatatatagattcagaaatacattttcattatccaaaatcagcttcaacaaatggtttctggagacaaataatttgttttcattatcattgtataatcaggttaatgatttattttttgactaaatgtgcaatttcttatcactagataactttcagtatcagtggtggttacttattacttaaatcagaggaaggattttataaagattaataaatttaattttaccaataaatattcccataatttagaaaaggatgtcgacttgctaatttcagaaataattattcatttttaaaaagccccttttaaagcatctacttgaagattggtataattttcataaaatgtctttttttttagtgtcccaaagatatcttagataaactattttgaagttcagatttcagatgaggcaacattttcttgagataattacccaagtttcatccatgttgaatggtacaaaatatttctgtgaaactaacaggaagatattttcagataactaggataacttgttgctttgttacccagcctaattgaagagtggcagaggctactacaaaaagcaaccttttcattttcactaagagtttaaaagctattgtattattaaaaagtctttacaatgcttgtttcaaagaaccaacagaaaaaaaagctaagaaaactgagaactaacattaaaaaaattaaatttagaataagaatgatttctttaatttgtcctttttttctttggtctaaaacattattaaatttttgtaaatattttgatttaatgtgtcttagatcctcattattttaatacaggaaaagaaaagatttagtaatttcttaccatgctaatatgtaaagttcatgccatccaggcatttaagagcgatcctcatcccttcagcaatatgtatttgagttcacactatttctgttttacagcagttttgaaaaacacatactatgccaccaattgtcatattatttttagatgatgtaacatagccatcaaaattaatattatgtaatgcctaatacttagtatgtaaatgtcacgagatcatttttacattaaacgtgaaaaaaaaaaaaaaaaaaaaaaaaaaaaaaaaaaaaaacaccccacccacaaaaaaaaaaaaaaaaaaaaaaaataaactaaaagaaccacataaggcaaccaataaaagataaaaaacaaagcgatataatcaacacacagaaaacaataaactagagtggtgcgggtgtggtcctctttattctgaatcactgctgggctgtgtgcgcctttctgcgagaggtctcatgtgactcgtaatttgtcgagacgagacagactcgacactccaatcgagtgtgatgtatattcacactgcacaacacgctcctcgtgaacccagtagtgatcaattaatcatcatcgcgatgggtatctgcaagaattatgcgctgctatggcacagctgtacatcggaaagaacatactcgctcttcgttcttcgtgggtgtcggcgtgtgcaaggtatcatgactgaactctcatatatcagtagacgagaaatgaatcgatcggactcatgtgcaatcgttcctccacacttacagatccgtcaggggcttgtgtgtctattaggcgagagaaggtaacaacgataatgacaatgtggcgaggggacggcgaagtgaggcatggagtggttagatc

SEQ ID NO: 365025 - DNA, 2210 bp, Homo sapiens
agcgggtgcgcggggagcgcggggagcgcggggagcgcggggctgcgctcgtgtgcgctcctgggcgctcgccgccgccgctgccgccgcgcgcctttgagtcagcaaactccgcggcccgcaagcccggctcggcccggccctgctctgttctgcccggaggagccgcccattgatcgtgtcctgtgctgaagatgtttccggaacaacagaaagaggaatttgtaagtgtctgggttcgagatcctaggattcagaaggaggacttctggcattcttacattgactatgagatatgtattcatactaatagcatgtgttttacaatgaaaacatcctgtgtacgaagaagatatagagaattcgtgtggctgaggcagagactccaaagtaatgcgttgctggtacaactgccagaacttccatctaaaaacctgtttttcaacatgaacaatcgccagcacgtggatcagcgtcgccagggtctggaagatttcctcagaaaagtcctacagaatgcacttttgctttcagatagcagccttcacctcttcttacagagccatctgaattcagaagacattgaggcgtgtgtttctgggcagactaagtactctgtggaagaagcaattcacaagtttgccttaatgaatagacgtttccctgaagaagatgaagaaggaaaaaaagaaaatgatatagattatgattcagaaagttcatcctctgggcttggacacagtagtgatgacagcagttcacatggatgtaaagtaaatacagctccgcaggaatcctgaaaaataattctaatgttactatcttaggaatagcaaattatgtccagtcatagagaagaaagcttcataataatacattcttacctaaagctcactgtcatgatgttaggtatttaaattcttaaagatgttgggttgtttattagtggtatttttatgttgtcttattttaggtaagcttctgtgtaaagctaaaaatcctgtgaataactaggataacttgttgctttgttacccagcctaattgaagagtggcagaggctactacaaaaagcaaccttttcattttcactaagagtttaaaagctattgtattattaaaaagtctttacaatgcttgtttcaaagaaccaacagaaaaaaaagctaagaaaactgagaactaacattaaaaaaattaaatttagaataagaatgatttctttaatttgtcctttttttctttggtctaaaacattattaaatttttgtaaatattttgatttaatgtgtcttagatcctcattattttaatacaggaaaagaaaagatttagtaatttcttaccatgctaatatgtaaagttcatgccatccaggcatttaagagcgatcctcatcccttcagcaatatgtatttgagttcacactatttctgttttacagcagttttgaaaaacacatactatgccaccaattgtcatattatttttagatgatgtaacatagccatcaaaattaatattatgtaatgcctaatacttagtatgtaaatgtcacgagatcatttttacattaaacgtgaaaaaaaaaaaaaaaaaaaaaaaaaaaaaaaaaaaaaacaccccacccacaaaaaaaaaaaaaaaaaaaaaaaataaactaaaagaaccacataaggcaaccaataaaagataaaaaacaaagcgatataatcaacacacagaaaacaataaactagagtggtgcgggtgtggtcctctttattctgaatcactgctgggctgtgtgcgcctttctgcgagaggtctcatgtgactcgtaatttgtcgagacgagacagactcgacactccaatcgagtgtgatgtatattcacactgcacaacacgctcctcgtgaacccagtagtgatcaattaatcatcatcgcgatgggtatctgcaagaattatgcgctgctatggcacagctgtacatcggaaagaacatactcgctcttcgttcttcgtgggtgtcggcgtgtgcaaggtatcatgactgaactctcatatatcagtagacgagaaatgaatcgatcggactcatgtgcaatcgttcctccacacttacagatccgtcaggggcttgtgtgtctattaggcgagagaaggtaacaacgataatgacaatgtggcgaggggacggcgaagtgaggcatggagtggttagatc

SEQ ID NO: 365026 - DNA, 3411 bp, Homo sapiens
aaaatgatggtatcagaaaattagaacggggaggaggcttgcacatgatctccatcaaacctttcattttacagacagggaggctaaggccgagggacgctgagtgttgggaccaggatcattcagccagatgggagcagaaccaggcctacaacctggcaggcttctgacttccaccccggagttatgtccacctctggggcctgggaactgggtttggattgcataagctccccctcctctcccaggagggggctgggctggaggctgaggccttcgccaggaagaagcagggactgcttggatagttgaccagcttctgcaggggctcctcagtgagagaatggaggtgaggtcagggactcctgccttgcctctgccatcacttccagtgatgcctattcctaagattgatcgtgtcctgtgctgaagatgtttccggaacaacagaaagaggaatttgtaagtgtctgggttcgagatcctaggattcagaaggaggacttctggcattcttacattgactatgagatatgtattcatactaatagcatgtgttttacaatgaaaacatcctgtgtacgaagaagatatagagaattcgtgtggctgaggcagagactccaaagtaatgcgttgctggtacaactgccagaacttccatctaaaaacctgtttttcaacatgaacaatcgccagcacgtggatcagcgtcgccagggtctggaagatttcctcagaaaagtcctacagaatgcacttttgctttcagatagcagccttcacctcttcttacagagccatctgaattcagaagacattgaggcgtgtgtttctgggcagactaagtactctgtggaagaagcaattcacaagtttgccttaatgaatagacgtttccctgaagaagatgaagaaggaaaaaaagaaaatgatatagattatgattcagaaagttcatcctctgggcttggacacagtagtgatgacagcagttcacatggatgtaaagtaaatacagctccgcaggaatcctgaaaaataattctaatgttactatcttaggaatagcaaattatgtccagtcatagagaagaaagcttcataataatacattcttacctaaagctcactgtcatgatgttaggtatttaaattcttaaagatgttgggttgtttattagtggtatttttatgttgtcttattttaggtaagcttctgtgtaaagctaaaaatcctgtgaatacaatactatcctttacaggcagacattattggtaaacaagatcttgccctccaatgaaatgacttacatgttttaaaaaaccgagttggttttattgaatttaaaaagataggtaactaagtagcatttaaaatcaagatagagcattccttcttgtatcagtggggcagtgttaccataaacacggtgtatatgttgttaaaccctatgaagagtaacagtgtagaccagactgcctctctcagatatgtgcctgatattttgtggatacctcccctgcactggcaaaacactatgcttttgggtgttagactgaaatattttaagagtatttaacctttccagtattctgtttcacgcttagatggaaatgtatcttatgaatagagacatattaaaataatgtttacatcttagaaaaaacatagatagtgctagtaatattacttataactgtaatatatagattcagaaatacattttcattatccaaaatcagcttcaacaaatggtttctggagacaaataatttgttttcattatcattgtataatcaggttaatgatttattttttgactaaatgtgcaatttcttatcactagataactttcagtatcagtggtggttacttattacttaaatcagaggaaggattttataaagattaataaatttaattttaccaataaatattcccataatttagaaaaggatgtcgacttgctaatttcagaaataattattcatttttaaaaagccccttttaaagcatctacttgaagattggtataattttcataaaatgtctttttttttagtgtcccaaagatatcttagataaactattttgaagttcagatttcagatgaggcaacattttcttgagataattacccaagtttcatccatgttgaatggtacaaaatatttctgtgaaactaacaggaagatattttcagataactaggataacttgttgctttgttacccagcctaattgaagagtggcagaggctactacaaaaagcaaccttttcattttcactaagagtttaaaagctattgtattattaaaaagtctttacaatgcttgtttcaaagaaccaacagaaaaaaaagctaagaaaactgagaactaacattaaaaaaattaaatttagaataagaatgatttctttaatttgtcctttttttctttggtctaaaacattattaaatttttgtaaatattttgatttaatgtgtcttagatcctcattattttaatacaggaaaagaaaagatttagtaatttcttaccatgctaatatgtaaagttcatgccatccaggcatttaagagcgatcctcatcccttcagcaatatgtatttgagttcacactatttctgttttacagcagttttgaaaaacacatactatgccaccaattgtcatattatttttagatgatgtaacatagccatcaaaattaatattatgtaatgcctaatacttagtatgtaaatgtcacgagatcatttttacattaaacgtgaaaaaaaaaaaaaaaaaaaaaaaaaaaaaaaaaaaaaacaccccacccacaaaaaaaaaaaaaaaaaaaaaaaataaactaaaagaaccacataaggcaaccaataaaagataaaaaacaaagcgatataatcaacacacagaaaacaataaactagagtggtgcgggtgtggtcctctttattctgaatcactgctgggctgtgtgcgcctttctgcgagaggtctcatgtgactcgtaatttgtcgagacgagacagactcgacactccaatcgagtgtgatgtatattcacactgcacaacacgctcctcgtgaacccagtagtgatcaattaatcatcatcgcgatgggtatctgcaagaattatgcgctgctatggcacagctgtacatcggaaagaacatactcgctcttcgttcttcgtgggtgtcggcgtgtgcaaggtatcatgactgaactctcatatatcagtagacgagaaatgaatcgatcggactcatgtgcaatcgttcctccacacttacagatccgtcaggggcttgtgtgtctattaggcgagagaaggtaacaacgataatgacaatgtggcgaggggacggcgaagtgaggcatggagtggttagatc

SEQ ID NO: 365027 - DNA, 3090 bp, Homo sapiens
agcggagttaacacctactcatctttactgtgctacaaagattcaaactaagctatgatggaaaattttaaaaaacacacctatcacaatggctaaaataaaaaatagtgataatccccctggaaactgtaataggaatttgtaagtgtctgggttcgagatcctaggattcagaaggaggacttctggcattcttacattgactatgagatatgtattcatactaatagcatgtgttttacaatgaaaacatcctgtgtacgaagaagatatagagaattcgtgtggctgaggcagagactccaaagtaatgcgttgctggtacaactgccagaacttccatctaaaaacctgtttttcaacatgaacaatcgccagcacgtggatcagcgtcgccagggtctggaagatttcctcagaaaagtcctacagaatgcacttttgctttcagatagcagccttcacctcttcttacagagccatctgaattcagaagacattgaggcgtgtgtttctgggcagactaagtactctgtggaagaagcaattcacaagtttgccttaatgaatagacgtttccctgaagaagatgaagaaggaaaaaaagaaaatgatatagattatgattcagaaagttcatcctctgggcttggacacagtagtgatgacagcagttcacatggatgtaaagtaaatacagctccgcaggaatcctgaaaaataattctaatgttactatcttaggaatagcaaattatgtccagtcatagagaagaaagcttcataataatacattcttacctaaagctcactgtcatgatgttaggtatttaaattcttaaagatgttgggttgtttattagtggtatttttatgttgtcttattttaggtaagcttctgtgtaaagctaaaaatcctgtgaatacaatactatcctttacaggcagacattattggtaaacaagatcttgccctccaatgaaatgacttacatgttttaaaaaaccgagttggttttattgaatttaaaaagataggtaactaagtagcatttaaaatcaagatagagcattccttcttgtatcagtggggcagtgttaccataaacacggtgtatatgttgttaaaccctatgaagagtaacagtgtagaccagactgcctctctcagatatgtgcctgatattttgtggatacctcccctgcactggcaaaacactatgcttttgggtgttagactgaaatattttaagagtatttaacctttccagtattctgtttcacgcttagatggaaatgtatcttatgaatagagacatattaaaataatgtttacatcttagaaaaaacatagatagtgctagtaatattacttataactgtaatatatagattcagaaatacattttcattatccaaaatcagcttcaacaaatggtttctggagacaaataatttgttttcattatcattgtataatcaggttaatgatttattttttgactaaatgtgcaatttcttatcactagataactttcagtatcagtggtggttacttattacttaaatcagaggaaggattttataaagattaataaatttaattttaccaataaatattcccataatttagaaaaggatgtcgacttgctaatttcagaaataattattcatttttaaaaagccccttttaaagcatctacttgaagattggtataattttcataaaatgtctttttttttagtgtcccaaagatatcttagataaactattttgaagttcagatttcagatgaggcaacattttcttgagataattacccaagtttcatccatgttgaatggtacaaaatatttctgtgaaactaacaggaagatattttcagataactaggataacttgttgctttgttacccagcctaattgaagagtggcagaggctactacaaaaagcaaccttttcattttcactaagagtttaaaagctattgtattattaaaaagtctttacaatgcttgtttcaaagaaccaacagaaaaaaaagctaagaaaactgagaactaacattaaaaaaattaaatttagaataagaatgatttctttaatttgtcctttttttctttggtctaaaacattattaaatttttgtaaatattttgatttaatgtgtcttagatcctcattattttaatacaggaaaagaaaagatttagtaatttcttaccatgctaatatgtaaagttcatgccatccaggcatttaagagcgatcctcatcccttcagcaatatgtatttgagttcacactatttctgttttacagcagttttgaaaaacacatactatgccaccaattgtcatattatttttagatgatgtaacatagccatcaaaattaatattatgtaatgcctaatacttagtatgtaaatgtcacgagatcatttttacattaaacgtgaaaaaaaaaaaaaaaaaaaaaaaaaaaaaaaaaaaaaacaccccacccacaaaaaaaaaaaaaaaaaaaaaaaataaactaaaagaaccacataaggcaaccaataaaagataaaaaacaaagcgatataatcaacacacagaaaacaataaactagagtggtgcgggtgtggtcctctttattctgaatcactgctgggctgtgtgcgcctttctgcgagaggtctcatgtgactcgtaatttgtcgagacgagacagactcgacactccaatcgagtgtgatgtatattcacactgcacaacacgctcctcgtgaacccagtagtgatcaattaatcatcatcgcgatgggtatctgcaagaattatgcgctgctatggcacagctgtacatcggaaagaacatactcgctcttcgttcttcgtgggtgtcggcgtgtgcaaggtatcatgactgaactctcatatatcagtagacgagaaatgaatcgatcggactcatgtgcaatcgttcctccacacttacagatccgtcaggggcttgtgtgtctattaggcgagagaaggtaacaacgataatgacaatgtggcgaggggacggcgaagtgaggcatggagtggttagatc

SEQ ID NO: 365028 - DNA, 3028 bp, Homo sapiens
gagggggcctcccctgcaccgcccagattgatcgtgtcctgtgctgaagatgtttccggaacaacagaaagaggaatttgtaagtgtctgggttcgagatcctaggattcagaaggaggacttctggcattcttacattgactatgagatatgtattcatactaatagcatgtgttttacaatgaaaacatcctgtgtacgaagaagatatagagaattcgtgtggctgaggcagagactccaaagtaatgcgttgctggtacaactgccagaacttccatctaaaaacctgtttttcaacatgaacaatcgccagcacgtggatcagcgtcgccagggtctggaagatttcctcagaaaagtcctacagaatgcacttttgctttcagatagcagccttcacctcttcttacagagccatctgaattcagaagacattgaggcgtgtgtttctgggcagactaagtactctgtggaagaagcaattcacaagtttgccttaatgaatagacgtttccctgaagaagatgaagaaggaaaaaaagaaaatgatatagattatgattcagaaagttcatcctctgggcttggacacagtagtgatgacagcagttcacatggatgtaaagtaaatacagctccgcaggaatcctgaaaaataattctaatgttactatcttaggaatagcaaattatgtccagtcatagagaagaaagcttcataataatacattcttacctaaagctcactgtcatgatgttaggtatttaaattcttaaagatgttgggttgtttattagtggtatttttatgttgtcttattttaggtaagcttctgtgtaaagctaaaaatcctgtgaatacaatactatcctttacaggcagacattattggtaaacaagatcttgccctccaatgaaatgacttacatgttttaaaaaaccgagttggttttattgaatttaaaaagataggtaactaagtagcatttaaaatcaagatagagcattccttcttgtatcagtggggcagtgttaccataaacacggtgtatatgttgttaaaccctatgaagagtaacagtgtagaccagactgcctctctcagatatgtgcctgatattttgtggatacctcccctgcactggcaaaacactatgcttttgggtgttagactgaaatattttaagagtatttaacctttccagtattctgtttcacgcttagatggaaatgtatcttatgaatagagacatattaaaataatgtttacatcttagaaaaaacatagatagtgctagtaatattacttataactgtaatatatagattcagaaatacattttcattatccaaaatcagcttcaacaaatggtttctggagacaaataatttgttttcattatcattgtataatcaggttaatgatttattttttgactaaatgtgcaatttcttatcactagataactttcagtatcagtggtggttacttattacttaaatcagaggaaggattttataaagattaataaatttaattttaccaataaatattcccataatttagaaaaggatgtcgacttgctaatttcagaaataattattcatttttaaaaagccccttttaaagcatctacttgaagattggtataattttcataaaatgtctttttttttagtgtcccaaagatatcttagataaactattttgaagttcagatttcagatgaggcaacattttcttgagataattacccaagtttcatccatgttgaatggtacaaaatatttctgtgaaactaacaggaagatattttcagataactaggataacttgttgctttgttacccagcctaattgaagagtggcagaggctactacaaaaagcaaccttttcattttcactaagagtttaaaagctattgtattattaaaaagtctttacaatgcttgtttcaaagaaccaacagaaaaaaaagctaagaaaactgagaactaacattaaaaaaattaaatttagaataagaatgatttctttaatttgtcctttttttctttggtctaaaacattattaaatttttgtaaatattttgatttaatgtgtcttagatcctcattattttaatacaggaaaagaaaagatttagtaatttcttaccatgctaatatgtaaagttcatgccatccaggcatttaagagcgatcctcatcccttcagcaatatgtatttgagttcacactatttctgttttacagcagttttgaaaaacacatactatgccaccaattgtcatattatttttagatgatgtaacatagccatcaaaattaatattatgtaatgcctaatacttagtatgtaaatgtcacgagatcatttttacattaaacgtgaaaaaaaaaaaaaaaaaaaaaaaaaaaaaaaaaaaaaacaccccacccacaaaaaaaaaaaaaaaaaaaaaaaataaactaaaagaaccacataaggcaaccaataaaagataaaaaacaaagcgatataatcaacacacagaaaacaataaactagagtggtgcgggtgtggtcctctttattctgaatcactgctgggctgtgtgcgcctttctgcgagaggtctcatgtgactcgtaatttgtcgagacgagacagactcgacactccaatcgagtgtgatgtatattcacactgcacaacacgctcctcgtgaacccagtagtgatcaattaatcatcatcgcgatgggtatctgcaagaattatgcgctgctatggcacagctgtacatcggaaagaacatactcgctcttcgttcttcgtgggtgtcggcgtgtgcaaggtatcatgactgaactctcatatatcagtagacgagaaatgaatcgatcggactcatgtgcaatcgttcctccacacttacagatccgtcaggggcttgtgtgtctattaggcgagagaaggtaacaacgataatgacaatgtggcgaggggacggcgaagtgaggcatggagtggttagatc

SEQ ID NO: 365029 - DNA, 2960 bp, Homo sapiens
tctttccagtcctacttgcagttctgaagaatatttctttgtttatgatgccattacaggaatttgtaagtgtctgggttcgagatcctaggattcagaaggaggacttctggcattcttacattgactatgagatatgtattcatactaatagcatgtgttttacaatgaaaacatcctgtgtacgaagaagatatagagaattcgtgtggctgaggcagagactccaaagtaatgcgttgctggtacaactgccagaacttccatctaaaaacctgtttttcaacatgaacaatcgccagcacgtggatcagcgtcgccagggtctggaagatttcctcagaaaagtcctacagaatgcacttttgctttcagatagcagccttcacctcttcttacagagccatctgaattcagaagacattgaggcgtgtgtttctgggcagactaagtactctgtggaagaagcaattcacaagtttgccttaatgaatagacgtttccctgaagaagatgaagaaggaaaaaaagatgatgacagcagttcacatggatgtaaagtaaatacagctccgcaggaatcctgaaaaataattctaatgttactatcttaggaatagcaaattatgtccagtcatagagaagaaagcttcataataatacattcttacctaaagctcactgtcatgatgttaggtatttaaattcttaaagatgttgggttgtttattagtggtatttttatgttgtcttattttaggtaagcttctgtgtaaagctaaaaatcctgtgaatacaatactatcctttacaggcagacattattggtaaacaagatcttgccctccaatgaaatgacttacatgttttaaaaaaccgagttggttttattgaatttaaaaagataggtaactaagtagcatttaaaatcaagatagagcattccttcttgtatcagtggggcagtgttaccataaacacggtgtatatgttgttaaaccctatgaagagtaacagtgtagaccagactgcctctctcagatatgtgcctgatattttgtggatacctcccctgcactggcaaaacactatgcttttgggtgttagactgaaatattttaagagtatttaacctttccagtattctgtttcacgcttagatggaaatgtatcttatgaatagagacatattaaaataatgtttacatcttagaaaaaacatagatagtgctagtaatattacttataactgtaatatatagattcagaaatacattttcattatccaaaatcagcttcaacaaatggtttctggagacaaataatttgttttcattatcattgtataatcaggttaatgatttattttttgactaaatgtgcaatttcttatcactagataactttcagtatcagtggtggttacttattacttaaatcagaggaaggattttataaagattaataaatttaattttaccaataaatattcccataatttagaaaaggatgtcgacttgctaatttcagaaataattattcatttttaaaaagccccttttaaagcatctacttgaagattggtataattttcataaaatgtctttttttttagtgtcccaaagatatcttagataaactattttgaagttcagatttcagatgaggcaacattttcttgagataattacccaagtttcatccatgttgaatggtacaaaatatttctgtgaaactaacaggaagatattttcagataactaggataacttgttgctttgttacccagcctaattgaagagtggcagaggctactacaaaaagcaaccttttcattttcactaagagtttaaaagctattgtattattaaaaagtctttacaatgcttgtttcaaagaaccaacagaaaaaaaagctaagaaaactgagaactaacattaaaaaaattaaatttagaataagaatgatttctttaatttgtcctttttttctttggtctaaaacattattaaatttttgtaaatattttgatttaatgtgtcttagatcctcattattttaatacaggaaaagaaaagatttagtaatttcttaccatgctaatatgtaaagttcatgccatccaggcatttaagagcgatcctcatcccttcagcaatatgtatttgagttcacactatttctgttttacagcagttttgaaaaacacatactatgccaccaattgtcatattatttttagatgatgtaacatagccatcaaaattaatattatgtaatgcctaatacttagtatgtaaatgtcacgagatcatttttacattaaacgtgaaaaaaaaaaaaaaaaaaaaaaaaaaaaaaaaaaaaaacaccccacccacaaaaaaaaaaaaaaaaaaaaaaaataaactaaaagaaccacataaggcaaccaataaaagataaaaaacaaagcgatataatcaacacacagaaaacaataaactagagtggtgcgggtgtggtcctctttattctgaatcactgctgggctgtgtgcgcctttctgcgagaggtctcatgtgactcgtaatttgtcgagacgagacagactcgacactccaatcgagtgtgatgtatattcacactgcacaacacgctcctcgtgaacccagtagtgatcaattaatcatcatcgcgatgggtatctgcaagaattatgcgctgctatggcacagctgtacatcggaaagaacatactcgctcttcgttcttcgtgggtgtcggcgtgtgcaaggtatcatgactgaactctcatatatcagtagacgagaaatgaatcgatcggactcatgtgcaatcgttcctccacacttacagatccgtcaggggcttgtgtgtctattaggcgagagaaggtaacaacgataatgacaatgtggcgaggggacggcgaagtgaggcatggagtggttagatc

SEQ ID NO: 365030 - DNA, 1502 bp, Homo sapiens
agtcacccaatgaatggctgtcctggtcacagggccgcacccctggcccctcacgaggggaatgtgtgtagcagagggggtgctgaccatgctggaactgcggcgactacagagcctgcgggaacctcccctttcgcccaagatctgctctgtccccctcatcctcctcccagggccctggcgtctgggtcaagcagcgccccacacctcgacccctcaccccctcctcccgggctcttcctgcggcctcccctccacagtccgcaggctctgggacaggaccgagtccttggctgcctgtggagctcctgtgccagcagctgcgccccggctgcgctccggatacccccatccccgccaccgccgacctcccgctccaccgactgctgctcacgcccgacgggttcacgccgcccctgccccgtgaaggaccgcgctgcggtgcggaggcaggatgacgcaaaacacggtgattgtgaatggagttgctatggcctctaggccatcccagcccacccacgtcaacgtccacatccaccaggagtcagctttgacacaactgctgaaagctggaggttctctgaagaagtttctttttcaccctggggacactgtgccttccacagccaggattggttatgagcagctggctctaggggtgactcagatattgctgggggttgtgagttgtgttcttggagtgtgtctcagcttggggccctggactgtgctgcgtgcctcaggctgtgccttctgggcggggtctgtggtgatcgcagcaggagctggggccattgtccatgagaagcacccgggcaaacttgctggctatatatccagcctgctcaccctggcaggctttgctacagctatggctgctgttgtcctctgcgtgaatagcttcatctggcaaactgaaccctttttatacatcgacactgtgtgtgatcgctcagaccctgtcttccctaccactgggtacagatggatgcggcgaagtcaagagaaccaatggcagaaggaggagtgtagagcttacatgcagatgctgaggaagttgttcacagcaatccgtgccctgttcctggctgtctgtgtcttgaaggtcattgtgtccttggtttccttgggagtaggtcttcgaaacttgtgtggccagagctcccagcccctgaatgaggaaggatcagagaagaggctactgggggagaattcagtgcccccttcgccctctagggagcagacctccactgccattgtcctgtgagccgccaaagaccccacggggtgcccgcatgtccctgtctagggcagcccagggcccccactcctggctcctcacacttgcctcccctatggccgctctccagaccctcctcctttcttctccccacatccgcacctgctgttcccactctggggttctcaagtccatgaacagatattgttgcattttccacaatgctgattaaacataataaacaatccagaaaagcagtttt

SEQ ID NO: 365031 - DNA, 1378 bp, Homo sapiens
gcgggggtggggctgaacttcagcccctcgggttcatgacaggctgcagggcctggggtccgtctggggttctcctgctgcgcgagggtcactgggctctggggagctgggagggtccgcgggcggacggccctgggaaagcccgtggggtcgttctcgcctccagccccgcccggccagggccggcgtgcaagtgtgcgcgagtgggagcgcagggggcgcgcgggggctcggtcttctcccgcccggtccgctcctccgggcggaaccccctttgccgggcccccgggccgcagctggtttcgggaaaccgcgcagcctgggcggggccgcagcccccacccgtgcatctgccgtctccgccctcccgtcgctcccctgctcggggtcagctagtgtccgctctgctcggccgcgggctcccggaggactgcaggcaggatgacgcaaaacacggtgattgtgaatggagttgctatggcctctaggccatcccagcccacccacgtcaacgtccacatccaccaggagtcagctttgacacaactgctgaaagctggaggttctctgaagaagtttctttttcaccctggggacactgtgccttccacagccaggattggttatgagcagctggctctaggggtgatcgcagcaggagctggggccattgtccatgagaagcacccgggcaaacttgctggctatatatccagcctgctcaccctggcaggctttgctacagctatggctgctgttgtcctctgcgtgaatagcttcatctggcaaactgaaccctttttatacatcgacactgtgtgtgatcgctcagaccctgtcttccctaccactgggtacagatggatgcggcgaagtcaagagaaccaatggcagaaggaggagtgtagagcttacatgcagatgctgaggaagttgttcacagcaatccgtgccctgttcctggctgtctgtgtcttgaaggtcattgtgtccttggtttccttgggagtaggtcttcgaaacttgtgtggccagagctcccagcccctgaatgaggaaggatcagagaagaggctactgggggagaattcagtgcccccttcgccctctagggagcagacctccactgccattgtcctgtgagccgccaaagaccccacggggtgcccgcatgtccctgtctagggcagcccagggcccccactcctggctcctcacacttgcctcccctatggccgctctccagaccctcctcctttcttctccccacatccgcacctgctgttcccactctggggttctcaagtccatgaacagatattgttgcattttccacaatgctgattaaacataataaacaatccagaaaagcagtttt

SEQ ID NO: 365032 - DNA, 496 bp, Homo sapiens
gcctacattcctaggggaacttcatttctgctcaggagagaattttaaatcactgagaaaaagaggatgtattttccgcaaatggaacgtatctttcagaagttaaacatctgaatgacagcaacagaacttggatccgtgtctcccaacggcgaaggttggtcacccagctcccaaattccagatggtcggcatttaaaagtgaaaactgaaagcataaaggcacttagaagaaaatgtggaagattattttataatctcgaaacggggaagtcctttaaaagtgtaagagctagacaccataaatagaatgaaatagaacatggattgtatgaatatacaagcaaggtcaaaaaataaacttcaaattgtaaagaaacatttgaaactcatatcacaaacggtaattttgtgaatagataaagaacttccatagaaaaaagcaaaacaaaacaaaacgaaacaaggacataggatgtgaacggagagctcacaa

SEQ ID NO: 365033 - DNA, 1041 bp, Homo sapiens
gcgggggtggggctgaacttcagcccctcgggttcatgacaggctgcagggcctggggtccgtctggggttctcctgctgcgcgagggtcactgggctctggggagctgggagggtccgcgggcggacggccctgggaaagcccgtggggtcgttctcgcctccagccccgcccggccagggccggcgtgcaagtgtgcgcgagtgggagcgcagggggcgcgcgggggctcggtcttctcccgcccggtccgctcctccgggcggaaccccctttgccgggcccccgggccgcagctggtttcgggaaaccgcgcagcctgggcggggccgcagcccccacccgtgcatctgccgtctccgccctcccgtcgctcccctgctcggggtcagctagtgtccgctctgctcggccgcgggctcccggaggactgcaggcagggcctccgcggcccgggagaccctcttgccgcaggaccctctgtcacgaggagtccccagggccatgcccccaccccgtcctgtccacaggacgtctttcttcctccaacctggtttccaggaggactcacgtaggagggagggacagctgggtgcaggtgtttctccccagaaaaacggctggagagcgggaggagaggcctggggctggcgcgtcccgtccaccttctgccgcctgcacgcctggaccctggctggagccctacggtggggtggctcctgggacggggccagggagcggcggggctgccggacgctttccccagccccggggcacgggaagagctggacagaggaaagtgttcggggcagccgggaagagcccaccacctaccaggcgtcgggcggcccgcaggggaatctccgtggtgccggcctggttcagatccgactcttcaggcgggggcgaggcagatctaggggttggcgtggggcgggggaagcggtggtcctgggggcccggaggtagctggaacccgaggtgccctcagggcgaggcctgggccgtcaagggaaggtctggctggaatctggggctggg

SEQ ID NO: 365034 - DNA, 1623 bp, Homo sapiens
gcgggggtggggctgaacttcagcccctcgggttcatgacaggctgcagggcctggggtccgtctggggttctcctgctgcgcgagggtcactgggctctggggagctgggagggtccgcgggcggacggccctgggaaagcccgtggggtcgttctcgcctccagccccgcccggccagggccggcgtgcaagtgtgcgcgagtgggagcgcagggggcgcgcgggggctcggtcttctcccgcccggtccgctcctccgggcggaaccccctttgccgggcccccgggccgcagctggtttcgggaaaccgcgcagcctgggcggggccgcagcccccacccgtgcatctgccgtctccgccctcccgtcgctcccctgctcggggtcagctagtgtccgctctgctcggccgcgggctcccggaggactgcaggcaggatgacgcaaaacacggtgattgtgaatggagttgctatggcctctaggccatcccagcccacccacgtcaacgtccacatccaccaggagtcagctttgacacaactgctgaaagctggaggttctctgaagaagtttctttttcaccctggggacactgtgccttccacagccaggattggttatgagcagctggctctaggggtgactcagatattgctgggggttgtgagttgtgttcttggagtgtgtctcagcttggggccctggactgtgctgcgtgcctcaggctgtgccttctgggcggggtctgtggtgatcgcagcaggagctggggccattgtccatgagaagcacccgggcaaacttgctggctatatatccagcctgctcaccctggcaggctttgctacagctatggctgctgttgtcctctgcgtgaatagcttcatctggcaaactgaaccctttttatacatcgacactgtgtgtgatcgctcagaccctgtcttccctaccactgggtacagatggatgcggcgaagtcaagagaaccaatggcagaaggaggagtgtagagcttacatgcagatgctgaggaagttgttcacagcaatccgtgccctgttcctggctgtctgtgtcttgaaggtcattgtgtccttggtttccttgggagtaggtcttcgaaacttgtgtggccagagctcccagcccctgaatgaggaaggatcagagaagaggctactgggggagaattcagtgcccccttcgccctctagggagcagacctccactgccattgtcctgtgagccgccaaagaccccacggggtgcccgcatgtccctgtctagggcagcccagggcccccactcctggctcctcacacttgcctcccctatggccgctctccagaccctcctcctttcttctccccacatccgcacctgctgttcccactctggggttctcaagtccatgaacagatattgttgcattttccacaatgctgattaaacataataaacaatccagaaaagcagttttgcccagaaagatatggtttccttttgtttattacacctcgtgcggccatggaaagggctttctttgtgtcggtatgtatgaggttaaatggggagctgatttatcccattaaaacactgtcccaagaagattaa

SEQ ID NO: 365035 - DNA, 1229 bp, Homo sapiens
tcgctagctgttcagaggatcccgacggcattgcagcacgggtgatgacaggccgtgagctattgtgcccagctgggatcttgacaaagacactatttctctcctttcacctgtgctgtgtatttttccctcgcctagttcccagacctcactgctatatgtcttctccctggcaggcaggatgacgcaaaacacggtgattgtgaatggagttgctatggcctctaggccatcccagcccacccacgtcaacgtccacatccaccaggagtcagctttgacacaactgctgaaagctggaggttctctgaagaagtttctttttcaccctggggacactgtgccttccacagccaggattggttatgagcagctggctctaggggtgactcagatattgctgggggttgtgagttgtgttcttggagtgtgtctcagcttggggccctggactgtgctgcgtgcctcaggctgtgccttctgggcggggtctgtggtgatcgcagcaggagctggggccattgtccatgagaagcacccgggcaaacttgctggctatatatccagcctgctcaccctggcaggctttgctacagctatggctgctgttgtcctctgcgtgaatagcttcatctggcaaactgaaccctttttatacatcgacactgtgtgtgatcgctcagaccctgtcttccctaccactgggtacagatggatgcggcgaagtcaagagaaccaatggcagaaggaggagtgtagagcttacatgcagatgctgaggaagttgttcacagcaatccgtgccctgttcctggctgtctgtgtcttgaaggtcattgtgtccttggtttccttgggagtaggtcttcgaaacttgtgtggccagagctcccagcccctgaatgaggaaggatcagagaagaggctactgggggagaattcagtgcccccttcgccctctagggagcagacctccactgccattgtcctgtgagccgccaaagaccccacggggtgcccgcatgtccctgtctagggcagcccagggcccccactcctggctcctcacacttgcctcccctatggccgctctccagaccctcctcctttcttctccccacatccgcacctgctgttcccactctggggttctcaagtccatgaacagatattgttgcattttccacaatgctgattaaacataataaacaatccagaaaagcagtttt

SEQ ID NO: 365036 - DNA, 1841 bp, Homo sapiens
  misc_feature (1524)..(1524): n is a, c, g, or t
  misc_feature (1527)..(1527): n is a, c, g, or t
  misc_feature (1541)..(1541): n is a, c, g, or t
  misc_feature (1551)..(1551): n is a, c, g, or t
  misc_feature (1553)..(1553): n is a, c, g, or t
  misc_feature (1555)..(1555): n is a, c, g, or t
  misc_feature (1557)..(1558): n is a, c, g, or t
  misc_feature (1565)..(1565): n is a, c, g, or t
  misc_feature (1568)..(1568): n is a, c, g, or t
  misc_feature (1571)..(1571): n is a, c, g, or t
  misc_feature (1573)..(1573): n is a, c, g, or t
  misc_feature (1583)..(1583): n is a, c, g, or t
  misc_feature (1585)..(1585): n is a, c, g, or t
gcgggggtggggctgaacttcagcccctcgggttcatgacaggctgcagggcctggggtccgtctggggttctcctgctgcgcgagggtcactgggctctggggagctgggagggtccgcgggcggacggccctgggaaagcccgtggggtcgttctcgcctccagccccgcccggccagggccggcgtgcaagtgtgcgcgagtgggagcgcagggggcgcgcgggggctcggtcttctcccgcccggtccgctcctccgggcggaaccccctttgccgggcccccgggccgcagctggtttcgggaaaccgcgcagcctgggcggggccgcagcccccacccgtgcatctgccgtctccgccctcccgtcgctcccctgctcggggtcagctagtgtccgctctgctcggccgcgggctcccggaggactgcaggcaggatgacgcaaaacacggtgattgtgaatggagttgctatggcctctaggccatcccagcccacccacgtcaacgtccacatccaccaggagtcagctttgacacaactgctgaaagctggaggttctctgaagaagtttctttttcaccctggggacactgtgccttccacagccaggattggttatgagcagctggctctaggggtgactcagatattgctgggggttgtgagttgtgttcttggagtgtgtctcagcttggggccctggactgtgctgcgtgcctcaggctgtgccttctgggcggggtctgtggtgatcgcagcaggagctggggccattgtccatgagaagcacccgggcaaacttgctggctatatatccagcctgctcaccctggcaggctttgctacagctatggctgctgttgtcctctgcgtgaatagcttcatctggcaaactgaaccctttttatacatcgacactgtgtgtgatcgctcagaccctgtcttccctaccactgggtacagatggatgcggcgaagtcaagagaaccaatggcagaaggaggagtgtagagcttacatgcagatgctgaggaagttgttcacagcaatccgtgccctgttcctggctgtctgtgtcttgaaggtcattgtgtccttggtttccttgggagtaggtcttcgaaacttgtgtggccagagctcccagcccctgaatgaggaaggatcagagaagaggctactgggggagaattcagtgcccccttcgccctctagggagcagacctccactgccattgtcctgtgagccgccaaagaccccacggggtgcccgcatgtccctgtctagggcagcccagggcccccactcctggctcctcacacttgcctcccctatggccgctctccagaccctcctcctttcttctccccacatccgcacctgctgttcccactctggggttctcaagtccatgaacagatattgttgcattttccacaatgctgattaaacataataaacaatccagaaaagcagttttaaaaaaaaaaaaaaaaaaaaaaaaaaaaaaaaaanaanaaaaaaaaaaaaangaaaaaaaanananannaacaaanaanacnanaaaaaaaaananagaaagaaaggcgaaacaaaaagttaaaagagaacgactatcacaacaggacaacgagcgccacaataaatgacccagaagactaaacaacaaacaacccggacacgctcgcgaccacaagtgcactcgagcccaaaacgcccatcgagcgggtggcacaatccaggaagaaagcgacccacgagaggtgacccaccaacagggaaagaccacaaccccgcagaaccagtctataccagcggacgcaagactacac

SEQ ID NO: 365037 - DNA, 1091 bp, Homo sapiens
tcatcaaaccctcccctataataaaacttttaagaagtcacattattggaaaactaaacttcaacatttggcctactcaagctcttgtgaagttctcctagggtttcgatgaccatcgaaaccctaccaggagtcagctttgacacaactgctgaaagctggaggttctctgaagaagtttctttttcaccctggggacactgtgccttccacagccaggattggttatgagcagctggctctaggggtgactcagatattgctgggggttgtgagttgtgttcttggagtgtgtctcagcttggggccctggactgtgctgcgtgcctcaggctgtgccttctgggcggggtctgtggtgatcgcagcaggagctggggccattgtccatgagaagcacccgggcaaacttgctggctatatatccagcctgctcaccctggcaggctttgctacagctatggctgctgttgtcctctgcgtgaatagcttcatctggcaaactgaaccctttttatacatcgacactgtgtgtgatcgctcagaccctgtcttccctaccactgggtacagatggatgcggcgaagtcaagagaaccaatggcagaaggaggagtgtagagcttacatgcagatgctgaggaagttgttcacagcaatccgtgccctgttcctggctgtctgtgtcttgaaggtcattgtgtccttggtttccttgggagtaggtcttcgaaacttgtgtggccagagctcccagcccctgaatgaggaaggatcagagaagaggctactgggggagaattcagtgcccccttcgccctctagggagcagacctccactgccattgtcctgtgagccgccaaagaccccacggggtgcccgcatgtccctgtctagggcagcccagggcccccactcctggctcctcacacttgcctcccctatggccgctctccagaccctcctcctttcttctccccacatccgcacctgctgttcccactctggggttctcaagtccatgaacagatattgttgcattttccacaatgctgattaaacataataaacaatccagaaaagcagtttt

SEQ ID NO: 365038 - DNA, 1063 bp, Homo sapiens
aaatagccaagcctatgagaagggtgaggggagacccaggccagtgctgcttcatggattttaaggggacagaatcttccagaatcagagctgcagagaggtcaaggcagaggaaaaggagaggagagccacctaggtaggagccaggcagctggtcccagggcagccggggcatgtggactcacgggaaggggtctggtttctcatcctgtcttgcaggtgactcagatattgctgggggttgtgagttgtgttcttggagtgtgtctcagcttggggccctggactgtgctgcgtgcctcaggctgtgccttctgggcggggtctgtggtgatcgcagcaggagctggggccattgtccatgagaagcacccgggcaaacttgctggctatatatccagcctgctcaccctggcaggctttgctacagctatggctgctgttgtcctctgcgtgaatagcttcatctggcaaactgaaccctttttatacatcgacactgtgtgtgatcgctcagaccctgtcttccctaccactgggtacagatggatgcggcgaagtcaagagaaccaatggcagaaggaggagtgtagagcttacatgcagatgctgaggaagttgttcacagcaatccgtgccctgttcctggctgtctgtgtcttgaaggtcattgtgtccttggtttccttgggagtaggtcttcgaaacttgtgtggccagagctcccagcccctgaatgaggaaggatcagagaagaggctactgggggagaattcagtgcccccttcgccctctagggagcagacctccactgccattgtcctgtgagccgccaaagaccccacggggtgcccgcatgtccctgtctagggcagcccagggcccccactcctggctcctcacacttgcctcccctatggccgctctccagaccctcctcctttcttctccccacatccgcacctgctgttcccactctggggttctcaagtccatgaacagatattgttgcattttccacaatgctgattaaacataataaacaatccagaaaagcagtttt

SEQ ID NO: 365039 - DNA, 1303 bp, Homo sapiens
aggagaaggagaaagaagaagaggcaggaggaggagaaaagagaagggaaaggaaggagaggagagccggcccatcctgagtttgggccctggcgtctgggtcaagcagcgccccacacctcgacccctcaccccctcctcccgggctcttcctgcggcctcccctccacagtccgcaggctctgggacaggaccgagtccttggctgcctgtggagctcctgtgccagcagctgcgccccggctgcgctccggatacccccatccccgccaccgccgacctcccgctccaccgactgctgctcacgcccgacgggttcacgccgcccctgccccgtgaaggaccgcgctgcggtgcggaggcaggatgacgcaaaacacggtgattgtgaatggagttgctatggcctctaggccatcccagcccacccacgtcaacgtccacatccaccaggagtcagctttgacacaactgctgaaagctggaggttctctgaagaagtttctttttcaccctggggacactgtgccttccacagccaggattggttatgagcagctggctctaggggtgatcgcagcaggagctggggccattgtccatgagaagcacccgggcaaacttgctggctatatatccagcctgctcaccctggcaggctttgctacagctatggctgctgttgtcctctgcgtgaatagcttcatctggcaaactgaaccctttttatacatcgacactgtgtgtgatcgctcagaccctgtcttccctaccactgggtacagatggatgcggcgaagtcaagagaaccaatggcagaaggaggagtgtagagcttacatgcagatgctgaggaagttgttcacagcaatccgtgccctgttcctggctgtctgtgtcttgaaggtcattgtgtccttggtttccttgggagtaggtcttcgaaacttgtgtggccagagctcccagcccctgaatgaggaaggatcagagaagaggctactgggggagaattcagtgcccccttcgccctctagggagcagacctccactgccattgtcctgtgagccgccaaagaccccacggggtgcccgcatgtccctgtctagggcagcccagggcccccactcctggctcctcacacttgcctcccctatggccgctctccagaccctcctcctttcttctccccacatccgcacctgctgttcccactctggggttctcaagtccatgaacagatattgttgcattttccacaatgctgattaaacataataaacaatccagaaaagcagtttt

SEQ ID NO: 365040 - DNA, 1394 bp, Homo sapiens
gcgggggtggggctgaacttcagcccctcgggttcatgacaggctgcagggcctggggtccgtctggggttctcctgctgcgcgagggtcactgggctctggggagctgggagggtccgcgggcggacggccctgggaaagcccgtggggtcgttctcgcctccagccccgcccggccagggccggcgtgcaagtgtgcgcgagtgggagcgcagggggcgcgcgggggctcggtcttctcccgcccggtccgctcctccgggcggaaccccctttgccgggcccccgggccgcagctggtttcgggaaaccgcgcagcctgggcggggccgcagcccccacccgtgcatctgccgtctccgccctcccgtcgctcccctgctcggggtcagctagtgtccgctctgctcggccgcgggctcccggaggactgcaggcaggatgacgcaaaacacggtgattgtgaatggagttgctatggcctctaggccatcccagcccacccacgtcaacgtccacatccaccaggagtcagctttgacacaactgctgaaagctggaggttctctgaagaagtttctttttcaccctggggacactgtgccttccacagccaggattggttatgagcagctggctctaggggtgactcagatattgctgggggttgtgagttgtgttcttggagtgtgtctcagcttggggccctggactgtgctgcgtgcctcaggctgtgccttctgggcggggtctgtggtgatcgcagcaggagctggggccattgtccatgagaagcacccgggcaaacttgctggctatatatccagcctgctcaccctggcaggctttgctacagctatggctgctgttgtcctctgcgtgaatagcttcatctggcaaactgaaccctttttatacatcgacactgtgtgtgatcgctcagaccaagttgttcacagcaatccgtgccctgttcctggctgtctgtgtcttgaaggtcattgtgtccttggtttccttgggagtaggtcttcgaaacttgtgtggccagagctcccagcccctgaatgaggaaggatcagagaagaggctactgggggagaattcagtgcccccttcgccctctagggagcagacctccactgccattgtcctgtgagccgccaaagaccccacggggtgcccgcatgtccctgtctagggcagcccagggcccccactcctggctcctcacacttgcctcccctatggccgctctccagaccctcctcctttcttctccccacatccgcacctgctgttcccactctggggttctcaagtccatgaacagatattgttgcattttccacaatgctgattaaacataataaacaatccagaaaagcagtttt

SEQ ID NO: 365041 - DNA, 1292 bp, Homo sapiens
gcgggggtggggctgaacttcagcccctcgggttcatgacaggctgcagggcctggggtccgtctggggttctcctgctgcgcgagggtcactgggctctggggagctgggagggtccgcgggcggacggccctgggaaagcccgtggggtcgttctcgcctccagccccgcccggccagggccggcgtgcaagtgtgcgcgagtgggagcgcagggggcgcgcgggggctcggtcttctcccgcccggtccgctcctccgggcggaaccccctttgccgggcccccgggccgcagctggtttcgggaaaccgcgcagcctgggcggggccgcagcccccacccgtgcatctgccgtctccgccctcccgtcgctcccctgctcggggtcagctagtgtccgctctgctcggccgcgggctcccggaggactgcaggcaggatgacgcaaaacacggtgattgtgaatggagttgctatggcctctaggccatcccagcccacccacgtcaacgtccacatccaccaggagtcagctttgacacaactgctgaaagctggaggttctctgaagaagtttctttttcaccctggggacactgtgccttccacagccaggattggttatgagcagctggctctaggggtgactcagatattgctgggggttgtgagttgtgttcttggagtgtgtctcagcttggggccctggactgtgctgcgtgcctcaggctgtgccttctgggcggggtctgtggtgatcgcagcaggagctggggccattgtccatgagaagcacccgggcaaacttgctggctatatatccagcctgctcaccctggcaggctttgctacagctatggctgctgttgtcctctgcgtgaatagcttcatctggcaaactgaaccctttttatacatcgacactgtgtgtgatcgctcagaccctgtcttccctaccactgggtacagatggatgcggcgaagtcaagagaaccaatggcagaaggaggagtgtagagcttacatgcagatgctgaggctgaacagcaagtgcggagccctggtggaggggcgagcctggcctgtgagaactgtgagggtcaggctggacactgcagagcaggcaacgggttgggaggagcagagtttggaaagatggggttgtgccactgtaaggggctttggctttcatgccgaatgagatgggagccactagagggctcggagcgagcactgagactctctaatgtatatgacgaatagactcccagtgggacacgggataagcct

SEQ ID NO: 365042 - DNA, 738 bp, Homo sapiens
gagtggctagcctggactggctgggctcatgagaatgagttgcctccaccctgtcccaacagctgacagccaggagccactctcccagctgcaggcctttgtggtccatcttgtcctgcttcctcactgtggacccctgtctgggccaccctagtgtgctaagctgagcagtgcagtgtgaacagggcccatggtgtattctaggccacagcccagcactcctctgggctgctctcaaaccatgtcccatcttcagcatccctcccatcagcctctacagaggctgatggaagttgttcacagcaatccgtgccctgttcctggctgtctgtgtcttgaaggtcattgtgtccttggtttccttgggagtaggtcttcgaaacttgtgtggccagagctcccagcccctgaatgaggaaggatcagagaagaggctactgggggagaattcagtgcccccttcgccctctagggagcagacctccactgccattgtcctgtgagccgccaaagaccccacggggtgcccgcatgtccctgtctagggcagcccagggcccccactcctggctcctcacacttgcctcccctatggccgctctccagaccctcctcctttcttctccccacatccgcacctgctgttcccactctggggttctcaagtccatgaacagatattgttgcattttccacaatgctgattaaacataataaacaatccagaaaagcagtttt

SEQ ID NO: 365043 - DNA, 1203 bp, Homo sapiens
gcgggggtggggctgaacttcagcccctcgggttcatgacaggctgcagggcctggggtccgtctggggttctcctgctgcgcgagggtcactgggctctggggagctgggagggtccgcgggcggacggccctgggaaagcccgtggggtcgttctcgcctccagccccgcccggccagggccggcgtgcaagtgtgcgcgagtgggagcgcagggggcgcgcgggggctcggtcttctcccgcccggtccgctcctccgggcggaaccccctttgccgggcccccgggccgcagctggtttcgggaaaccgcgcagcctgggcggggccgcagcccccacccgtgcatctgccgtctccgccctcccgtcgctcccctgctcggggtcagctagtgtccgctctgctcggccgcgggctcccggaggactgcaggcaggatgacgcaaaacacggtgattgtgaatggagttgctatggcctctaggccatcccagcccacccacgtcaacgtccacatccaccaggagtcagctttgacacaactgctgaaagctggaggttctctgaagaagtttctttttcaccctggggacactgtgccttccacagccaggattggttatgagcagctggctctaggggtgactcagatattgctgggggttgtgagttgtgttcttggagtgtgtctcagcttggggccctggactgtgctgcgtgcctcaggctgtgccttctgggcggggtctgtggtgatcgcagcaggagctggggccattgtccatgagaagcacccgggcaaacttgctggctatatatccagcctgctcaccctggcaggctttgctacagctatggctgctgttgtcctctgcgtgaatagcttcatctggcaaactgaaccctttttatacatcgacactgtgtgtgatcgctcagaccctccactgccattgtcctgtgagccgccaaagaccccacggggtgcccgcatgtccctgtctagggcagcccagggcccccactcctggctcctcacacttgcctcccctatggccgctctccagaccctcctcctttcttctccccacatccgcacctgctgttcccactctggggttctcaagtccatgaacagatattgttgcattttccacaatgctgattaaacataataaacaatccagaaaagcagtttt

SEQ ID NO: 365044 - DNA, 611 bp, Homo sapiens
gagtggctagcctggactggctgggctcatgagaatgagttgcctccaccctgtcccaacagctgacagccaggagccactctcccagctgcaggcctttgtggtccatcttgtcctgcttcctcactgtggacccctgtctgggccaccctagtgtgctaagctgagcagtgcagtgtgaacagggcccatggtgtattctaggccacagcccagcactcctctgggctgctctcaaaccatgtcccatcttcagcatccctcccatcagcctctacagaggctgatggaagttgttcacagcaatccgtgccctgttcctggctgtctgtgtcttgaaggtcattgtgtccttggtttccttgggagtaggtcttcgaaacttgtgtggccagagctcccagcccctgaatgaggaaggatcagagaagaggctactgggggagaattcagtgcccccttcgccctctagggagcagaccctcctcctttcttctccccacatccgcacctgctgttcccactctggggttctcaagtccatgaacagatattgttgcattttccacaatgctgattaaacataataaacaatccagaaaagcagtttt

SEQ ID NO: 365045 - DNA, 1489 bp, Homo sapiens
gcgggggtggggctgaacttcagcccctcgggttcatgacaggctgcagggcctggggtccgtctggggttctcctgctgcgcgagggtcactgggctctggggagctgggagggtccgcgggcggacggccctgggaaagcccgtggggtcgttctcgcctccagccccgcccggccagggccggcgtgcaagtgtgcgcgagtgggagcgcagggggcgcgcgggggctcggtcttctcccgcccggtccgctcctccgggcggaaccccctttgccgggcccccgggccgcagctggtttcgggaaaccgcgcagcctgggcggggccgcagcccccacccgtgcatctgccgtctccgccctcccgtcgctcccctgctcggggtcagctagtgtccgctctgctcggccgcgggctcccggaggactgcaggcaggatgacgcaaaacacggtgattgtgaatggagttgctatggcctctaggccatcccagcccacccacgtcaacgtccacatccaccaggagtcagctttgacacaactgctgaaagctggaggttctctgaagaagtttctttttcaccctggggacactgtgccttccacagccaggattggttatgagcagctggctctaggggtgactcagatattgctgggggttgtgagttgtgttcttggagtgtgtctcagcttggggccctggactgtgctgcgtgcctcaggctgtgccttctgggcggggtctgtggtgatcgcagcaggagctggggccattgtccatgagaagcacccgggcaaacttgctggctatatatccagcctgctcaccctggcaggctttgctacagctatggctgctgttgtcctctgcgtgaatagcttcatctggcaaactgaaccctttttatacatcgacactgtgtgtgatcgctcagaccctgtcttccctaccactgggtacagatggatgcggcgaagtcaagagaaccaatggcagaaggaggagtgtagagcttacatgcagatgctgaggaagttgttcacagcaatccgtgccctgttcctggctgtctgtgtcttgaaggtcattgtgtccttggtttccttgggagtaggtcttcgaaacttgtgtggccagagctcccagcccctgaatgaggaaggatcagagaagaggctactgggggagaattcagtgcccccttcgccctctagggagcagacctccactgccattgtcctgtgagccgccaaagaccccacggggtgcccgcatgtccctgtctagggcagcccagggcccccactcctggctcctcacacttgcctcccctatggccgctctccagaccctcctcctttcttctccccacatccgcacctgctgttcccactctggggttctcaagtccatgaacagatattgttgcattttccacaatgctgattaaacataataaacaatccagaaaagcagtttt

SEQ ID NO: 365046 - DNA, 1216 bp, Homo sapiens
caacaccccatctctctctctctaaaaaaagagaactggccgtgagctattgtgcccagctgggatcttgacaaagacactatttctctcctttcacctgtgctgtgtatttttccctcgcctagttcccagacctcactgctatatgtcttctccctggcaggcaggatgacgcaaaacacggtgattgtgaatggagttgctatggcctctaggccatcccagcccacccacgtcaacgtccacatccaccaggagtcagctttgacacaactgctgaaagctggaggttctctgaagaagtttctttttcaccctggggacactgtgccttccacagccaggattggttatgagcagctggctctaggggtgactcagatattgctgggggttgtgagttgtgttcttggagtgtgtctcagcttggggccctggactgtgctgcgtgcctcaggctgtgccttctgggcggggtctgtggtgatcgcagcaggagctggggccattgtccatgagaagcacccgggcaaacttgctggctatatatccagcctgctcaccctggcaggctttgctacagctatggctgctgttgtcctctgcgtgaatagcttcatctggcaaactgaaccctttttatacatcgacactgtgtgtgatcgctcagaccctgtcttccctaccactgggtacagatggatgcggcgaagtcaagagaaccaatggcagaaggaggagtgtagagcttacatgcagatgctgaggaagttgttcacagcaatccgtgccctgttcctggctgtctgtgtcttgaaggtcattgtgtccttggtttccttgggagtaggtcttcgaaacttgtgtggccagagctcccagcccctgaatgaggaaggatcagagaagaggctactgggggagaattcagtgcccccttcgccctctagggagcagacctccactgccattgtcctgtgagccgccaaagaccccacggggtgcccgcatgtccctgtctagggcagcccagggcccccactcctggctcctcacacttgcctcccctatggccgctctccagaccctcctcctttcttctccccacatccgcacctgctgttcccactctggggttctcaagtccatgaacagatattgttgcattttccacaatgctgattaaacataataaacaatccagaaaagcagtttt

SEQ ID NO: 365047 - DNA, 1224 bp, Homo sapiens
gaagacaagccctgcaggaaggcacgcatgtggtcattctgtctgtagcctcccattcctccctgctttccccagctgcatctacctggatcctgaatttgaaccaagtggtccaaacggcccggtcacctgagcaacccctctgcaggaaccgcagatttgtacaaaaacaaaaaagcacaaaaactggaagcagtctggagtctgtcaacaggagaatggatgaataagggaactatctgattgtggcctatttgatggaatattactctgcaatcaaaaggaacagactgagactgatacacgcagcatggatgagtcttcaggacattgtgtcaagtaagagaagtcagattcaaaagatgaagtcctttcctgagcacttactacatgccagacaccataccagggctggctacatactctgttgggaagaaggctcaaaaatgaatcctctcaagcagacccgctttggtttccacccctctattctgagaacccaagctcaacccatgtgttctgccttcaggtagaaaatgtcagaatcatagggaagactaagctgaaaaaagaatttggagttccaaaggaattctgtgccacctgccgtccggcaattccctttgccaggcaggatgacgcaaaacacggtgattgtgaatggagttgctatggcctctaggccatcccagcccacccacgtcaacgtccacatccaccaggagtcagctttgacacaactgctgaaagctggaggttctctgaagaagtttctttttcaccctggggacactgtgccttccacagccaggattggttatgagcagctggctctaggggactcagatattgcgtggggtaggaggtacctcctaccccacggcctcccgaagtgctgggattacaggcacaagccaccacacccggcccaacacacagctttaaaaccttcaatagtttgcaactgttcttaagagacaaaacatgggatgcaactattatgccgtccatagtagcctttacctgtttctctaacctgtaactctgctagtcctttctctttccacttgatcctgataactttctcagtcactggtgatcagatgtaaaggtatgttcttctctccctttctttgactagtctgctactcctcatccttcaaatcttgctcaattacccctttcagataagtctcccttgcgtgaggtaggagggggtaccga

SEQ ID NO: 365048 - DNA, 1414 bp, Homo sapiens
aggagaaggagaaagaagaagaggcaggaggaggagaaaagagaagggaaaggaaggagaggagagccggcccatcctgagtttgggccctggcgtctgggtcaagcagcgccccacacctcgacccctcaccccctcctcccgggctcttcctgcggcctcccctccacagtccgcaggctctgggacaggaccgagtccttggctgcctgtggagctcctgtgccagcagctgcgccccggctgcgctccggatacccccatccccgccaccgccgacctcccgctccaccgactgctgctcacgcccgacgggttcacgccgcccctgccccgtgaaggaccgcgctgcggtgcggaggcaggatgacgcaaaacacggtgattgtgaatggagttgctatggcctctaggccatcccagcccacccacgtcaacgtccacatccaccaggagtcagctttgacacaactgctgaaagctggaggttctctgaagaagtttctttttcaccctggggacactgtgccttccacagccaggattggttatgagcagctggctctaggggtgactcagatattgctgggggttgtgagttgtgttcttggagtgtgtctcagcttggggccctggactgtgctgcgtgcctcaggctgtgccttctgggcggggtctgtggtgatcgcagcaggagctggggccattgtccatgagaagcacccgggcaaacttgctggctatatatccagcctgctcaccctggcaggctttgctacagctatggctgctgttgtcctctgcgtgaatagcttcatctggcaaactgaaccctttttatacatcgacactgtgtgtgatcgctcagaccctgtcttccctaccactgggtacagatggatgcggcgaagtcaagagaaccaatggcagaaggaggagtgtagagcttacatgcagatgctgaggaagttgttcacagcaatccgtgccctgttcctggctgtctgtgtcttgaaggtcattgtgtccttggtttccttgggagtaggtcttcgaaacttgtgtggccagagctcccagcccctgaatgaggaaggatcagagaagaggctactgggggagaattcagtgcccccttcgccctctagggagcagacctccactgccattgtcctgtgagccgccaaagaccccacggggtgcccgcatgtccctgtctagggcagcccagggcccccactcctggctcctcacacttgcctcccctatggccgctctccagaccctcctcctttcttctccccacatccgcacctgctgttcccactctggggttctcaagtccatgaacagatattgttgcattttccacaatgctgattaaacataataaacaatccagaaaagcagtttt

SEQ ID NO: 365049 - DNA, 1210 bp, Homo sapiens
gcctacattcctaggggaacttcatttctgctcaggagagaattttaaatcactgagaaaaagaggatgtattttccgcaaatggaacgtatctttcagaagttaaacatctgaatgacagcaacagaacttggatccgtgtctcccaacggcgaaggcaggatgacgcaaaacacggtgattgtgaatggagttgctatggcctctaggccatcccagcccacccacgtcaacgtccacatccaccaggagtcagctttgacacaactgctgaaagctggaggttctctgaagaagtttctttttcaccctggggacactgtgccttccacagccaggattggttatgagcagctggctctaggggtgactcagatattgctgggggttgtgagttgtgttcttggagtgtgtctcagcttggggccctggactgtgctgcgtgcctcaggctgtgccttctgggcggggtctgtggtgatcgcagcaggagctggggccattgtccatgagaagcacccgggcaaacttgctggctatatatccagcctgctcaccctggcaggctttgctacagctatggctgctgttgtcctctgcgtgaatagcttcatctggcaaactgaaccctttttatacatcgacactgtgtgtgatcgctcagaccctgtcttccctaccactgggtacagatggatgcggcgaagtcaagagaaccaatggcagaaggaggagtgtagagcttacatgcagatgctgaggaagttgttcacagcaatccgtgccctgttcctggctgtctgtgtcttgaaggtcattgtgtccttggtttccttgggagtaggtcttcgaaacttgtgtggccagagctcccagcccctgaatgaggaaggatcagagaagaggctactgggggagaattcagtgcccccttcgccctctagggagcagacctccactgccattgtcctgtgagccgccaaagaccccacggggtgcccgcatgtccctgtctagggcagcccagggcccccactcctggctcctcacacttgcctcccctatggccgctctccagaccctcctcctttcttctccccacatccgcacctgctgttcccactctggggttctcaagtccatgaacagatattgttgcattttccacaatgctgattaaacataataaacaatccagaaaagcagtttt

SEQ ID NO: 365050 - DNA, 1426 bp, Homo sapiens
gcgggggtggggctgaacttcagcccctcgggttcatgacaggctgcagggcctggggtccgtctggggttctcctgctgcgcgagggtcactgggctctggggagctgggagggtccgcgggcggacggccctgggaaagcccgtggggtcgttctcgcctccagccccgcccggccagggccggcgtgcaagtgtgcgcgagtgggagcgcagggggcgcgcgggggctcggtcttctcccgcccggtccgctcctccgggcggaaccccctttgccgggcccccgggccgcagctggtttcgggaaaccgcgcagcctgggcggggccgcagcccccacccgtgcatctgccgtctccgccctcccgtcgctcccctgctcggggtcagctagtgtccgctctgctcggccgcgggctcccggaggactgcagccacccacgtcaacgtccacatccaccaggagtcagctttgacacaactgctgaaagctggaggttctctgaagaagtttctttttcaccctggggacactgtgccttccacagccaggattggttatgagcagctggctctaggggtgactcagatattgctgggggttgtgagttgtgttcttggagtgtgtctcagcttggggccctggactgtgctgcgtgcctcaggctgtgccttctgggcggggtctgtggtgatcgcagcaggagctggggccattgtccatgagaagcacccgggcaaacttgctggctatatatccagcctgctcaccctggcaggctttgctacagctatggctgctgttgtcctctgcgtgaatagcttcatctggcaaactgaaccctttttatacatcgacactgtgtgtgatcgctcagaccctgtcttccctaccactgggtacagatggatgcggcgaagtcaagagaaccaatggcagaaggaggagtgtagagcttacatgcagatgctgaggaagttgttcacagcaatccgtgccctgttcctggctgtctgtgtcttgaaggtcattgtgtccttggtttccttgggagtaggtcttcgaaacttgtgtggccagagctcccagcccctgaatgaggaaggatcagagaagaggctactgggggagaattcagtgcccccttcgccctctagggagcagacctccactgccattgtcctgtgagccgccaaagaccccacggggtgcccgcatgtccctgtctagggcagcccagggcccccactcctggctcctcacacttgcctcccctatggccgctctccagaccctcctcctttcttctccccacatccgcacctgctgttcccactctggggttctcaagtccatgaacagatattgttgcattttccacaatgctgattaaacataataaacaatccagaaaagcagtttt

SEQ ID NO: 365051 - DNA, 1644 bp, Homo sapiens
gcgggggtggggctgaacttcagcccctcgggttcatgacaggctgcagggcctggggtccgtctggggttctcctgctgcgcgagggtcactgggctctggggagctgggagggtccgcgggcggacggccctgggaaagcccgtggggtcgttctcgcctccagccccgcccggccagggccggcgtgcaagtgtgcgcgagtgggagcgcagggggcgcgcgggggctcggtcttctcccgcccggtccgctcctccgggcggaaccccctttgccgggcccccgggccgcagctggtttcgggaaaccgcgcagcctgggcggggccgcagcccccacccgtgcatctgccgtctccgccctcccgtcgctcccctgctcggggtcagctagtgtccgctctgctcggccgcgggctcccggaggactgcaggcaggatgacgcaaaacacggtgattgtgaatggagttgctatggcctctaggccatcccagcccacccacgtcaacgtccacatccaccaggagtcagctttgacacaactgctgaaagctggaggttctctgaagaagtttctttttcaccctggggacactgtgccttccacagccaggattggttatgagcagctggctctaggggtgactcagatattgctgggggttgtgagttgtgttcttggagtgtgtctcagcttggggccctggactgtgctgcgtgcctcaggctgtgccttctgggcggggtctgtggtgatcgcagcaggagctggggccattgtccatgagaagcacccgggcaaacttgctggctatatatccagcctgctcaccctggcaggctttgctacagctatggctgctgttgtcctctgcgtgaatagcttcatctggcaaactgaaccctttttatacatcgacactgtgtgtgatcgctcagaccctgtcttccctaccactgggtacagatggatgcggcgaagtcaagagaaccaatggcagaaggaggagtgtagagcttacatgcagatgctgaggaagttgttcacagcaatccgtgccctgttcctggctgtctgtgtcttgaaggtcattgtgtccttggtttccttgggagtaggtcttcgaaacttgtgtggccagagctcccagcccctgaatgaggaaggatcagagaagaggctactgggggagaattcagtgcccccttcgccctctagggagcagacctccactgccattgtcctgtgagccgccaaagaccccacggggtgcccgcatgtccctgtctagggcagcccagggcccccactcctggctcctcacacttgcctcccctatggccgctctccagaccctcctcctttcttctccccacatccgcacctgctgttcccactctggggttctcaagtccatgaacagatattgttgcattttccacaatgctgattaaacataataaacaatccagaaaagcagttttagcaaagtagactaattatttaaacttaaaatgccacatatttaattaatcggccggaatttaggctcactgggacaattcgcccctatgtgaagtcgttaaccattcactggcccgacgttttacaaccttgggacttgggaaaccctggcgtt

SEQ ID NO: 365052 - DNA, 868 bp, Homo sapiens
tgcttttctggattgtttattatgtttaatcagcattgtggaaaatgcaacaattgtgttcttggagtgtgtctcagcttggggccctggactgtgctgcgtgcctcaggctgtgccttctgggcggggtctgtggtgatcgcagcaggagctggggccattgtccatgagaagcacccgggcaaacttgctggctatatatccagcctgctcaccctggcaggctttgctacagctatggctgctgttgtcctctgcgtgaatagcttcatctggcaaactgaaccctttttatacatcgacactgtgtgtgatcgctcagaccctgtcttccctaccactgggtacagatggatgcggcgaagtcaagagaaccaatggcagaaggaggagtgtagagcttacatgcagatgctgaggaagttgttcacagcaatccgtgccctgttcctggctgtctgtgtcttgaaggtcattgtgtccttggtttccttgggagtaggtcttcgaaacttgtgtggccagagctcccagcccctgaatgaggaaggatcagagaagaggctactgggggagaattcagtgcccccttcgccctctagggagcagacctccactgccattgtcctgtgagccgccaaagaccccacggggtgcccgcatgtccctgtctagggcagcccagggcccccactcctggctcctcacacttgcctcccctatggccgctctccagaccctcctcctttcttctccccacatccgcacctgctgttcccactctggggttctcaagtccatgaacagatattgttgcattttccacaatgctgattaaacataataaacaatccagaaaagcagtttt

SEQ ID NO: 365053 - DNA, 1362 bp, Homo sapiens
gcgggggtggggctgaacttcagcccctcgggttcatgacaggctgcagggcctggggtccgtctggggttctcctgctgcgcgagggtcactgggctctggggagctgggagggtccgcgggcggacggccctgggaaagcccgtggggtcgttctcgcctccagccccgcccggccagggccggcgtgcaagtgtgcgcgagtgggagcgcagggggcgcgcgggggctcggtcttctcccgcccggtccgctcctccgggcggaaccccctttgccgggcccccgggccgcagctggtttcgggaaaccgcgcagcctgggcggggccgcagcccccacccgtgcatctgccgtctccgccctcccgtcgctcccctgctcggggtcagctagtgtccgctctgctcggccgcgggctcccggaggactgcaggcaggatgacgcaaaacacggtgattgtgaatggagttgctatggcctctaggccatcccagcccacccacgtcaacgtccacatccaccaggagtcagctttgacacaactgctgaaagctggaggttctctgaagaagtttctttttcaccctggggacactgtgccttccacagccaggattggttatgagcagctggctctaggggtgactcagatattgctgggggttgtgagttgtgttcttggagtgtgtctcagcttggggccctggactgtgctgcgtgcctcaggctgtgccttctgggcggggtctgtggtgatcgcagcaggagctggggccattgtccatgagaagcacccgggcaaacttgctggctatatatccagcctgctcaccctggcaggctttgctacagctatggctgctgttgtcctctgcgtgaatagcttcatctggcaaactgaaccctttttatacatcgacactgtgtgtgatcgctcagaccctgtcttccctaccactgggtacagatggatgcggcgaagtcaagagaaccaatggcagaaggaggagtgtagagcttacatgcagatgctgaggaagttgttcacagcaatccgtgccctgttcctggctgtctgtgtcttgaaggtcattgtgtccttggtttccttgggagtaggtcttcgaaacttgtgtggccagagctcccagcccctgaatgaggaaggatcagagaagaggctactgggggagaattcagtgcccccttcgccctctagggagcagaccctcctcctttcttctccccacatccgcacctgctgttcccactctggggttctcaagtccatgaacagatattgttgcattttccacaatgctgattaaacataataaacaatccagaaaagcagtttt

SEQ ID NO: 365054 - DNA, 1098 bp, Homo sapiens
gcgggggtggggctgaacttcagcccctcgggttcatgacaggctgcagggcctggggtccgtctggggttctcctgctgcgcgagggtcactgggctctggggagctgggagggtccgcgggcggacggccctgggaaagcccgtggggtcgttctcgcctccagccccgcccggccagggccggcgtgcaagtgtgcgcgagtgggagcgcagggggcgcgcgggggctcggtcttctcccgcccggtccgctcctccgggcggaaccccctttgccgggcccccgggccgcagctggtttcgggaaaccgcgcagcctgggcggggccgcagcccccacccgtgcatctgccgtctccgccctcccgtcgctcccctgctcggggtcagctagtgtccgctctgctcggccgcgggctcccggaggactgcaggcaggatgacgcaaaacacggtgattgtgaatggagttgctatggcctctaggccatcccagcccacccacgtcaacgtccacatccaccaggagtcagctttgacacaactgctgaaagctggaggttctctgaagaagtttctttttcaccctggggacactgtgccttccacagccaggattggttatgagcagctggctctaggggtgactcagatattgctgggggttgtgagttgtgttcttggagtgtgtctcagcttggggccctggactgtgctgcgtgcctcaggctgtgccttctgggcggggtctgtggtgatcgcagcaggagctggggccattgtccatgagaagcacccgggcaaacttgctggctatatatccagcctgctcaccctggcaggctttgctacagctatggctgctgttgtcctctgcgtgaatagcttcatctggcaaactgaaccctttttatacatcgacactgtgtgtgatcgctcagaccctgtcttccctaccactgggtacagatggatgcggcgaagtcaagagaaccaatggcagaaggaggagtgtagagcttacatgcagatgctgaggaagttttacagcaaggcgttaacagattctggccgtgggggttttaaagtttctcct

SEQ ID NO: 365055 - DNA, 582 bp, Homo sapiens
aattgtaaaaaggctttctctatatgtaaattatgctgttatctttttctatacacaaagtatatagacctataaatattatacatatatattatatatataaagactaattcttgtacagaccaacgcggaccgatggtccatattcttttctccatgtttgtttgtgtcgactgttgcagagtgagttgatgtaagaaggtggtttcatgttttcttttggggggccacttctttcttttcctttccgtttctatctctgtctgtctccgtctctgtctctctctttctcacttgttgccaatgtcttgttgctgagaaggaacactctattcagatgccatccaggaaagaaaggccagatggatggagggtccactgtgtatatttgtacagaatcatttataaagttttctacacttctaaaaaaagtatttctaacttgggctgttggacagtttgtgtgcctctgagccggcaagcctgttgtttcttgtgtttagtgcaatgtttagtgagaaaccaatgtctgaattatttatgccaataaaaaatttgagaattactgcattgcactactgc

SEQ ID NO: 365056 - DNA, 356 bp, Homo sapiens
taattagtcaaacatttacaaggtgtttcacatcatgcaaaccaccgagttctgccaaggagttcacagtgtggtaaaggagacagacaagcaaaggcacaattagaacatgatataaggctgggcacggtggttcacgcctgtaatcccagcactttgagaagccaaggcaggaggatcacttgagcttaggagtttgagaccaacctgggcaacatagaaagaccttagttttcaaagtagctgaacatggtggcgcacttctgtggtttcagctgctcagtaagctgagttgggaggatcacttgagcccgggaagttgaggctgcagtgagccacgatcataccactgcact

SEQ ID NO: 365057 - DNA, 736 bp, Homo sapiens
ggaagatcagggtcttactgccttatggcctcttatcctgcagtggtaagtgaggttaactgaaatggaagaggtgacgacctcatagatttgaatagagtgctaaagacttctaaaagccactgtgtgcagtggaagatgttgttgacccaaaacattcattaagaatccaggccaggtggctcatacctgtgatactagcgctttgggaggctgagacaggaggatcgtttgaggccaacagtttgagaccagtctgggcaacatagtgagaccctgtctctacaaaaaaataaatcaataaaatttttaaaaagctgggtgtggtagtgtatgcctgtagtcccagctactcaggaggctgaagtagcaggatcgcttgaggcccaggaggtcgaggctgcagtgagccaagattacactactgcacttcagcctgggttgacagagcaagactttcttaaaaaaaaaaaaaaaaaaaacccagagcagaaatgaaaaacctgtgaattagcagtgacaaatagtgaacagtaatattaattttttgttgataatttagtagcttggatacaggaactgatagagcagatggttggattaatccaaggttaggattttgctgatggaataagaggataaaaaggttgaagatgttaacaaatagtgatttaagtgatagaagttgtagctagagtaaaatattaaaatctaagatttcaaatagagcaagtcc

SEQ ID NO: 365058 - DNA, 467 bp, Homo sapiens
gctcccaagtagcagggactgcagatgcatgccaccatgccaagctaattttatttatttatttttttgagatgaggttttgccatgttgcccaggctggtctcgaacccctgggctcaagcaatctgaccaccttggcctcccaatgtactgagactacaggcgtgaaccactgtgcccagctttgttagatatattcattaaaagagtaattctatggctgggcacagtgactcacacctgtaataccaacactttgggaggctgaggcaggcggatctcgaggtcaggagttcaagaccagtctggccaacatggtgaaaccctgtctctactaaagatacaaaaaattagccgagcatggtggcatgttcctgttaatcccagctacttgggaggctgaggcaggagaattgcttgaacccaggaggtggaggttgcagtgagccaagatcacgctatggcac

SEQ ID NO: 365059 - DNA, 444 bp, Homo sapiens
cctctgtcggccttttaatgaccgttctgtgtcccatgtatgtctctgaccatccacagccgcccctcctccataccccagggataatttttccttcaaaccttccctttccaagggacactgggtttgcagacagcaaggctatgtggcagagaagaaaaagtccagcagactcaggactcctgggctgcaggcccccctctgccctgatcccatgaagtgaccttgggcactccctttccctccctgggcctcagtttccccatctcccaaatgggaggaggagccggattgggttatttcttagggattctctttgtgtgccttgctggcttccagacctgccgtggaccttggcttcctctgaagacttgcaggcaataatctccgccctcccagttgtacctcctccccacctgcttatttaaaatcaagtttattgta

SEQ ID NO: 365060 - DNA, 899 bp, Homo sapiens
  misc_feature (28)..(28): n is a, c, g, or t
  misc_feature (823)..(824): n is a, c, g, or t
  misc_feature (830)..(830): n is a, c, g, or t
  misc_feature (833)..(833): n is a, c, g, or t
  misc_feature (843)..(843): n is a, c, g, or t
  misc_feature (846)..(847): n is a, c, g, or t
  misc_feature (849)..(849): n is a, c, g, or t
  misc_feature (856)..(856): n is a, c, g, or t
aggctaggagaggccgggtttaatcggncgaggatccgcatcggcgagctgcgtctcccgggtgtcggccccggcggctccccgaccgtgcccggctgtggcgaggcggctccagcccagcctgtggcagccgcgacccccggggcgctccggagcccactgcgcggcgcgcgtgccggctgcctgcatggacgcggcactgaagcggagccgctcggaggagccagccgaaatcctgccgcctgcccgggacgaggaggaggaggaggaagaggggatggagcaggggctggaggaggaagaagaggtggatccccggatccagggagaactggagaagttaaatcagtccacggatgatatcaacagacgggagactgaacttgaggatgctcgtcagaagttccgctctgttctggttgaagcaacggtgaaactggatgaactggtgaagaaaattggcaaagctgtggaagactccaagccctactgggaggcacggagggtggcgaggcaggctcagctggaagctcagaaagccacgcaggacttccagagggccacagaggtgctccgtgccgccaaggagaccatctccctggccgagcagcggctgctggaggatgacaagcggcagttcgactccgcctggcaggagatgctgaatcacgccactcagagggtcatggaggcggagcagaccaagaccaggagcgagctggtgcataaggagacggcagccaggtacaatgccgccatgggccgcatgcgacagctggagaagaaactcaagagagccatcaacaagtccaagccttatttnnactcanggnacgtactatntgnngncgagcantgaaagaattgtgttacttaggcaaatgcccttgaaagcggtc

SEQ ID NO: 365061 - DNA, 830 bp, Homo sapiens
  misc_feature (30)..(30): n is a, c, g, or t
cggatcggcagtactatacggtttatggtncgaggcctggtgatccgcatcggcgagctgcgtctcccgggtgtcggccccggcggctccccgaccgtgcccggctgtggcgaggcggctccagcccagcctgtggcagccgcgacccccggggcgctccggagcccactgcgcggcgcgcgtgccggctgcctgcatggacgcggcactgaagcggagccgctcggaggagccagccgaaatcctgccgcctgcccgggacgaggaggaggaggaggaagaggggatggagcaggggctggaggaggaagaagaggtggatccccggatccagggagaactggagaagttaaatcagtccacggatgatatcaacagacgggagactgaacttgaggatgctcgtcagaagttccgctctgttctggttgaagcaacggtgaaactggatgaactggtgaagaaaattggcaaagctgtggaagactccaagccctactgggaggcacggagggtggcgaggcaggctcagctggaagctcagaaagccacgcaggacttccagagggccacagaggtgctccgtgccgccaaggagaccatctccctggccgagcagcggctgctggaggatgacaagcggcagttcgactccgcctggcaggagatgctgaatcacgccactcagaggtcatggaggcggagcaacaagaccaggacgacctgtgctaggagacgggccagtaaaatccgctggcgatacagctgggaagaacagagctcagagcaactattaagacgggagatattcctcaccataaccatgacgg

SEQ ID NO: 365062 - DNA, 2882 bp, Homo sapiens
agcgggcgcccatttcctctgctccgccgcggccggaggtatccgcatcggcgagctgcgtctcccgggtgtcggccccggcggctccccgaccgtgcccggctgtggcgaggcggctccagcccagcctgtggcagccgcgacccccggggcgctccggagcccactgcgcggcgcgcgtgccggctgcctgcatggacgcggcactgaagcggagccgctcggaggagccagccgaaatcctgccgcctgcccgggacgaggaggaggaggaggaagaggggatggagcaggggctggaggaggaagaagaggtggatccccggatccagggagaactggagaagttaaatcagtccacggatgatatcaacagacgggagactgaacttgaggatgctcgtcagaagttccgctctgttctggttgaagcaacggtgaaactggatgaactggtgaagaaaattggcaaagctgtggaagactccaagccctactgggaggcacggagggtggcgaggcaggctcagctggaagctcagaaagccacgcaggacttccagagggccacagaggtgctccgtgccgccaaggagaccatctccctggccgagcagcggctgctggaggatgacaagcggcagttcgactccgcctggcaggagatgctgaatcacgccactcagagggtcatggaggcggagcagaccaagaccaggagcgagctggtgcataaggagacggcagccaggtacaatgccgccatgggccgcatgcgacagctggagaagaaactcaagagagccatcaacaagtccaagccttattttgaactcaaggcaaagtactatgtgcagctcgagcaactgaaaaagactgtggatgacctgcaggccaaactgaccctggcaaaaggcgagtacaagatggccctgaagaacctggagatgatctcagatgagatccacgagcggcggcgctccagtgccatggggcctcggggatgcggtgttggtgctgagggcagcagcacatctgtggaggatctgccagggagcaaacctgagcctgatgccatttctgtggcctcggaggcctttgaagatgacagctgtagcaactttgtgtctgaagatgactcggaaacccagtccgtgtccagctttagttcaggaccaacaagcccgtctgagatgcctgaccagttccctgcggttgtgaggcctggcagcctggatctgcccagccctgtgtccctgtcagagtttgggatgatgttcccagtgttgggccctcgaagtgaatgcagcggggcctcctcccctgaatgtgaagtagaacgaggagacagggcagaaggggcagagaataaaacaagtgacaaagccaacaacaaccggggcctcagcagtagcagtggcagtggtggcagcagtaagagccaaagcagcacctcccctgagggccaggccttggagaaccggatgaagcagctctccctacagtgctcaaagggaagagatggaattattgctgacataaaaatggtgcagattggctgattcatcctgggccctggccgatgtgcatatcaacatttatacatggaactggagaacattgtgccaataatcatttaatatatgccaaatcttacacgtctactctaaactgctctaatgaagtttcagtgaccttgagggctaaagattgttcttctgggtaagagctcttgggctggtttttcagagcagagttcttgttgtgggtagactgtgactaggttcacagcctttgtggaacattccgtataacggcattgtggaagcaataactagttcctatgaaagaaccagagctgggaagatggctgggaagccaggccaaagtgggggcaacagcttgcttctctttctcttctcaccctcagtttgtatgggaaaatggagatgtcctctccactttatcccacgatatctaaatgaaaaagaaagaaaacccacacacaaagcaaaaactcaagtattaagagcacatatttttgacccagtggaggcttaaaaaaaaaaaaatccaagaacacaattcattttcaccacctctggtgttcagagggggcttttaaaaaagcgtgtatgctgggatacccattaaaaccattttctagaaggctaccatgagctgcactttttggggtgggaaaggtgaatgccagtggggatgcggggggatgagggtaggagggacttatagaaggggatttgtggctgtgggggagaaggttctacagcataagccttatcctgccagccaaggggatttattctaagagaagtgcatgtgaagaatggttgccactgttattagattgacaagatgttaatttctctgtaggttgtaactttaaaaataaatgaaattatttaagggttatgctgcactagtattccttagaggaaacagttctttaaagttaggaaagggagtaggcaggcatgtgttggcaaaggctgttaatagtagttaagtgttaagactgcttttctttaacgttttcatggtaatgcatatttagagcactgtatttttgtcttgttaagaaaatttagcatttctaaaagaaaaaagcaaccctctttcaaactgttaattctgtcacagcctgtatattttagtcatttgtaaatctcttcatacaatagtgacttcttttttgactgatacagtatcttaattacaaggttattttgtacttgtcttaatacactaagtgtaataaaaacggcttgagaaaaaaaaaaaacattaactggccgtcgtttacaaacgtcccaactggcatacccaggcagtaccaacttaattcctctgtatacaattcc

SEQ ID NO: 365063 - DNA, 2729 bp, Homo sapiens
agccaaactatatagagagggctggaggacaaactgttccagatgggagttggagaaagccttgctatggatgtgacatttgggctgagatgtggatgatgagaaggagtcaggcagccgtgccctggaggagatagcgatgcagacagcagaagccctgaggacagagccagctgacagcccatgtggtgccagaggggagaactggagaagttaaatcagtccacggatgatatcaacagacgggagactgaacttgaggtccagtaggtgtttgcagatcccttcttaagcctcaactgtgtttcctcggtttcccctggctgcaggatgctcgtcagaagttccgctctgttctggttgaagcaacggtgaaactggatgaactggtgaagaaaattggcaaagctgtggaagactccaagccctactgggaggcacggagggtggcgaggcaggctcagctggaagctcagaaagccacgcaggacttccagagggccacagaggtgctccgtgccgccaaggagaccatctccctggccgagcagcggctgctggaggatgacaagcggcagttcgactccgcctggcaggagatgctgaatcacgccactcagagggtcatggaggcggagcagaccaagaccaggagcgagctggtgcataaggagacggcagccaggtacaatgccgccatgggccgcatgcgacagctggagaagaaactcaagagagccatcaacaagtccaagccttattttgaactcaaggcaaagtactatgtgcagctcgagcaactgaaaaagactgtggatgacctgcaggccaaactgaccctggcaaaaggcgagtacaagatggccctgaagaacctggagatgatctcagatgagatccacgagcggcggcgctccagtgccatggggcctcggggatgcggtgttggtgctgagggcagcagcacatctgtggaggatctgccagggagcaaacctgagcctgatgccatttctgtggcctcggaggcctttgaagatgacagctgtagcaactttgtgtctgaagatgactcggaaacccagtccgtgtccagctttagttcaggaccaacaagcccgtctgagatgcctgaccagttccctgcggttgtgaggcctggcagcctggatctgcccagccctgtgtccctgtcagagtttgggatgatgttcccagtgttgggccctcgaagtgaatgcagcggggcctcctcccctgaatgtgaagtagaacgaggagacagggcagaaggggcagagaataaaacaagtgacaaagccaacaacaaccggggcctcagcagtagcagtggcagtggtggcagcagtaagagccaaagcagcacctcccctgagggccaggccttggagaaccggatgaagcagctctccctacagtgctcaaagggaagagatggaattattgctgacataaaaatggtgcagattggctgattcatcctgggccctggccgatgtgcatatcaacatttatacatggaactggagaacattgtgccaataatcatttaatatatgccaaatcttacacgtctactctaaactgctctaatgaagtttcagtgaccttgagggctaaagattgttcttctgggtaagagctcttgggctggtttttcagagcagagttcttgttgtgggtagactgtgactaggttcacagcctttgtggaacattccgtataacggcattgtggaagcaataactagttcctatgaaagaaccagagctgggaagatggctgggaagccaggccaaagtgggggcaacagcttgcttctctttctcttctcaccctcagtttgtatgggaaaatggagatgtcctctccactttatcccacgatatctaaatgaaaaagaaagaaaacccacacacaaagcaaaaactcaagtattaagagcacatatttttgacccagtggaggcttaaaaaaaaaaaaatccaagaacacaattcattttcaccacctctggtgttcagagggggcttttaaaaaagcgtgtatgctgggatacccattaaaaccattttctagaaggctaccatgagctgcactttttggggtgggaaaggtgaatgccagtggggatgcggggggatgagggtaggagggacttatagaaggggatttgtggctgtgggggagaaggttctacagcataagccttatcctgccagccaaggggatttattctaagagaagtgcatgtgaagaatggttgccactgttattagattgacaagatgttaatttctctgtaggttgtaactttaaaaataaatgaaattatttaagggttatgctgcactagtattccttagaggaaacagttctttaaagttaggaaagggagtaggcaggcatgtgttggcaaaggctgttaatagtagttaagtgttaagactgcttttctttaacgttttcatggtaatgcatatttagagcactgtatttttgtcttgttaagaaaatttagcatttctaaaagaaaaaagcaaccctctttcaaactgttaattctgtcacagcctgtatattttagtcatttgtaaatctcttcatacaatagtgacttcttttttgactgatacagtatcttaattacaaggttattttgtacttgtcttaatacactaagtgtaataaaaacggcttgagaaaa

SEQ ID NO: 365064 - DNA, 2737 bp, Homo sapiens
agcgggcgcccatttcctctgctccgccgcggccggaggtatccgcatcggcgagctgcgtctcccgggtgtcggccccggcggctccccgaccgtgcccggctgtggcgaggcggctccagcccagcctgtggcagccgcgacccccggggcgctccggagcccactgcgcggcgcgcgtgccggctgcctgcatggacgcggcactgaagcggagccgctcggaggagccagccgaaatcctgccgcctgcccgggacgaggaggaggaggaggaagaggggatggagcaggggctggaggaggaagaagaggtggatccccggatccagggagaactggagaagttaaatcagtccacggatgatatcaacagacgggagactgaacttgaggatgctcgtcagaagttccgctctgttctggttgaagcaacggtgaaactggatgaactggtgaagaaaattggcaaagctgtggaagactccaagccctactgggaggcacggagggtggcgaggcaggctcagctggaagctcagaaagccacgcaggacttccagagggccacagaggtgctccgtgccgccaaggagaccatctccctggccgagcagcggctgctggaggatgacaagcggcagttcgactccgcctggcaggagatgctgaatcacgccactcagagggtcatggaggcggagcagaccaagaccaggagcgagctggtgcataaggagacggcagccaggtacaatgccgccatgggccgcatgcgacagctggagaagaaactcaagagagccatcaacaagtccaagccttattttgaactcaaggcaaagtactatgtgcagctcgagcaactgaaaaagactgtggatgacctgcaggccaaactgaccctggcaaaaggcgagtacaagatggccctgaagaacctggagatgatctcagatgagatccacgagcggcggcgctccagtgccatggggcctcggggatgcggtgttggtgctgagggcagcagcacatctgtggaggatctgccagggagcaaacctgagcctgatgccatttctgtggcctcggaggcctttgaagatgacagctgtagcaactttgtgtctgaagatgactcggaaacccagtccgtgtccagctttagttcaggaccaacaagcccgtctgagatgcctgaccagttccctgcggttgtgaggcctggcagcctggatctgcccagccctgtgtccctgtcagagtttgggatgatgttcccagtgttgggccctcgaagtgaatgcagcggggcctcctcccctgaatgtgaagtagaacgaggagacagggcagaaggggcagagaataaaacaagtgacaaagccaacaacaaccggggcctcagcagtagcagtggcagtggtggcagcagtaagagccaaagcagcacctcccctgagggccaggccttggagaaccggatgaagcagctctccctacagtgctcaaagggaagagatggaattattgctgacataaaaatggtgcagattggctgattcatcctgggccctggccgatgtgcatatcaacatttatacatggaactggagaacattgtgccaataatcatttaatatatgccaaatcttacacgtctactctaaactgctctaatgaagtttcagtgaccttgagggctaaagattgttcttctgggtaagagctcttgggctggtttttcagagcagagttcttgttgtgggtagactgtgactaggttcacagcctttgtggaacattccgtataacggcattgtggaagcaataactagttcctatgaaagaaccagagctgggaagatggctgggaagccaggccaaagtgggggcaacagcttgcttctctttctcttctcaccctcagtttgtatgggaaaatggagatgtcctctccactttatcccacgatatctaaatgaaaaagaaagaaaacccacacacaaagcaaaaactcaagtattaagagcacatatttttgacccagtggaggcttaaaaataaaaaagcgtgtatgctgggatacccattaaaaccattttctagaaggctaccatgagctgcactttttggggtgggaaaggtgaatgccagtggggatgcggggggatgagggtaggagggacttatagaaggggatttgtggctgtgggggagaaggttctacagcataagccttatcctgccagccaaggggatttattctaagagaagtgcatgtgaagaatggttgccactgttattagattgacaagatgttaatttctctgtaggttgtaactttaaaaataaatgaaattatttaagggttatgctgcactagtattccttagaggaaacagttctttaaagttaggaaagggagtaggcaggcatgtgttggcaaaggctgttaatagtagttaagtgttaagactgcttttctttaacgttttcatggtaatgcatatttagagcactgtatttttgtcttgttaagaaaatttagcatttctaaaagaaaaaagcaaccctctttcaaactgttaattctgtcacagcctgtatattttagtcatttgtaaatctcttcatacaatagtgacttcttttttgactgatacagtatcttaattacaaggttattttgtacttgtcttaatacactaagtgtaataaaaacggcttgagaaaa

SEQ ID NO: 365065 - DNA, 2661 bp, Homo sapiens
agccaaactatatagagagggctggaggacaaactgttccagatgggagttggagaaagccttgctatggatgtgacatttgggctgagatgtggatgatgagaaggagtcaggcagccgtgccctggaggagatagcgatgcagacagcagaagccctgaggacagagccagctgacagcccatgtggtgccagaggggagaactggagaagttaaatcagtccacggatgatatcaacagacgggagactgaacttgaggatgctcgtcagaagttccgctctgttctggttgaagcaacggtgaaactggatgaactggtgaagaaaattggcaaagctgtggaagactccaagccctactgggaggcacggagggtggcgaggcaggctcagctggaagctcagaaagccacgcaggacttccagagggccacagaggtgctccgtgccgccaaggagaccatctccctggccgagcagcggctgctggaggatgacaagcggcagttcgactccgcctggcaggagatgctgaatcacgccactcagagggtcatggaggcggagcagaccaagaccaggagcgagctggtgcataaggagacggcagccaggtacaatgccgccatgggccgcatgcgacagctggagaagaaactcaagagagccatcaacaagtccaagccttattttgaactcaaggcaaagtactatgtgcagctcgagcaactgaaaaagactgtggatgacctgcaggccaaactgaccctggcaaaaggcgagtacaagatggccctgaagaacctggagatgatctcagatgagatccacgagcggcggcgctccagtgccatggggcctcggggatgcggtgttggtgctgagggcagcagcacatctgtggaggatctgccagggagcaaacctgagcctgatgccatttctgtggcctcggaggcctttgaagatgacagctgtagcaactttgtgtctgaagatgactcggaaacccagtccgtgtccagctttagttcaggaccaacaagcccgtctgagatgcctgaccagttccctgcggttgtgaggcctggcagcctggatctgcccagccctgtgtccctgtcagagtttgggatgatgttcccagtgttgggccctcgaagtgaatgcagcggggcctcctcccctgaatgtgaagtagaacgaggagacagggcagaaggggcagagaataaaacaagtgacaaagccaacaacaaccggggcctcagcagtagcagtggcagtggtggcagcagtaagagccaaagcagcacctcccctgagggccaggccttggagaaccggatgaagcagctctccctacagtgctcaaagggaagagatggaattattgctgacataaaaatggtgcagattggctgattcatcctgggccctggccgatgtgcatatcaacatttatacatggaactggagaacattgtgccaataatcatttaatatatgccaaatcttacacgtctactctaaactgctctaatgaagtttcagtgaccttgagggctaaagattgttcttctgggtaagagctcttgggctggtttttcagagcagagttcttgttgtgggtagactgtgactaggttcacagcctttgtggaacattccgtataacggcattgtggaagcaataactagttcctatgaaagaaccagagctgggaagatggctgggaagccaggccaaagtgggggcaacagcttgcttctctttctcttctcaccctcagtttgtatgggaaaatggagatgtcctctccactttatcccacgatatctaaatgaaaaagaaagaaaacccacacacaaagcaaaaactcaagtattaagagcacatatttttgacccagtggaggcttaaaaaaaaaaaaatccaagaacacaattcattttcaccacctctggtgttcagagggggcttttaaaaaagcgtgtatgctgggatacccattaaaaccattttctagaaggctaccatgagctgcactttttggggtgggaaaggtgaatgccagtggggatgcggggggatgagggtaggagggacttatagaaggggatttgtggctgtgggggagaaggttctacagcataagccttatcctgccagccaaggggatttattctaagagaagtgcatgtgaagaatggttgccactgttattagattgacaagatgttaatttctctgtaggttgtaactttaaaaataaatgaaattatttaagggttatgctgcactagtattccttagaggaaacagttctttaaagttaggaaagggagtaggcaggcatgtgttggcaaaggctgttaatagtagttaagtgttaagactgcttttctttaacgttttcatggtaatgcatatttagagcactgtatttttgtcttgttaagaaaatttagcatttctaaaagaaaaaagcaaccctctttcaaactgttaattctgtcacagcctgtatattttagtcatttgtaaatctcttcatacaatagtgacttcttttttgactgatacagtatcttaattacaaggttattttgtacttgtcttaatacactaagtgtaataaaaacggcttgagaaaa

SEQ ID NO: 365066 - DNA, 2516 bp, Homo sapiens
gtggcgaattcggcaccgaggggaggaggaagaagaggtgatccccggatccaggagaactggagaagttaaatcagtccacggatgatatcaacagacgggagactgaacttgaggatgctcgtcagaagttccgctctgttctggttgaagcaacggtgaaactggatgaactggtgaagaaaattggcaaagctgtggaagactccaagccctactgggaggcacggagggtggcgaggcaggctcagctggaagctcagaaagccacgcaggacttccagagggccacagaggtgctccgtgccgccaaggagaccatctccctggccgagcagcggctgctggaggatgacaagcggcagttcgactccgcctggcaggagatgctgaatcacgccactcagagggtcatggaggcggagcagaccaagaccaggagcgagctggtgcataaggagacggcagccaggtacaatgccgccatgggccgcatgcgacagctggagaagaaactcaagagagccatcaacaagtccaagccttattttgaactcaaggcaaagtactatgtgcagctcgagcaactgaaaaagactgtggatgacctgcaggccaaactgaccctggcaaaaggcgagtacaagatggccctgaagaacctggagatgatctcagatgagatccacgagcggcggcgctccagtgccatggggcctcggggatgcggtgttggtgctgagggcagcagcacatctgtggaggatctgccagggagcaaacctgagcctgatgccatttctgtggcctcggaggcctttgaagatgacagctgtagcaactttgtgtctgaagatgactcggaaacccagtccgtgtccagctttagttcaggaccaacaagcccgtctgagatgcctgaccagttccctgcggttgtgaggcctggcagcctggatctgcccagccctgtgtccctgtcagagtttgggatgatgttcccagtgttgggccctcgaagtgaatgcagcggggcctcctcccctgaatgtgaagtagaacgaggagacagggcagaaggggcagagaataaaacaagtgacaaagccaacaacaaccggggcctcagcagtagcagtggcagtggtggcagcagtaagagccaaagcagcacctcccctgagggccaggccttggagaaccggatgaagcagctctccctacagtgctcaaagggaagagatggaattattgctgacataaaaatggtgcagattggctgattcatcctgggccctggccgatgtgcatatcaacatttatacatggaactggagaacattgtgccaataatcatttaatatatgccaaatcttacacgtctactctaaactgctctaatgaagtttcagtgaccttgagggctaaagattgttcttctgggtaagagctcttgggctggtttttcagagcagagttcttgttgtgggtagactgtgactaggttcacagcctttgtggaacattccgtataacggcattgtggaagcaataactagttcctatgaaagaaccagagctgggaagatggctgggaagccaggccaaagtgggggcaacagcttgcttctctttctcttctcaccctcagtttgtatgggaaaatggagatgtcctctccactttatcccacgatatctaaatgaaaaagaaagaaaacccacacacaaagcaaaaactcaagtattaagagcacatatttttgacccagtggaggcttaaaaaaaaaaaaatccaagaacacaattcattttcaccacctctggtgttcagagggggcttttaaaaaagcgtgtatgctgggatacccattaaaaccattttctagaaggctaccatgagctgcactttttggggtgggaaaggtgaatgccagtggggatgcggggggatgagggtaggagggacttatagaaggggatttgtggctgtgggggagaaggttctacagcataagccttatcctgccagccaaggggatttattctaagagaagtgcatgtgaagaatggttgccactgttattagattgacaagatgttaatttctctgtaggttgtaactttaaaaataaatgaaattatttaagggttatgctgcactagtattccttagaggaaacagttctttaaagttaggaaagggagtaggcaggcatgtgttggcaaaggctgttaatagtagttaagtgttaagactgcttttctttaacgttttcatggtaatgcatatttagagcactgtatttttgtcttgttaagaaaatttagcatttctaaaagaaaaaagcaaccctctttcaaactgttaattctgtcacagcctgtatattttagtcatttgtaaatctcttcatacaatagtgacttcttttttgactgatacagtatcttaattacaaggttattttgtacttgtcttaatacactaagtgtaataaaaacggcttgagaaaa

SEQ ID NO: 365067 - DNA, 2827 bp, Homo sapiens
agcgggcgcccatttcctctgctccgccgcggccggaggtatccgcatcggcgagctgcgtctcccgggtgtcggccccggcggctccccgaccgtgcccggctgtggcgaggcggctccagcccagcctgtggcagccgcgacccccggggcgctccggagcccactgcgcggcgcgcgtgccggctgcctgcatggacgcggcactgaagcggagccgctcggaggagccagccgaaatcctgccgcctgcccgggacgaggaggaggaggaggaagaggggatggagcaggggctggaggaggaagaagaggtggatccccggatccagggagaactggagaagttaaatcagtccacggatgatatcaacagacgggagactgaacttgaggatgctcgtcagaagttccgctctgttctggttgaagcaacggtgaaactggatgaactggtgaagaaaattggcaaagctgtggaagactccaagccctactgggaggcacggagggtggcgaggcaggctcagctggaagctcagaaagccacgcaggacttccagagggccacagaggtgctccgtgccgccaaggagaccatctccctggccgagcagcggctgctggaggatgacaagcggcagttcgactccgcctggcaggagatgctgaatcacgccactcagagggtcatggaggcggagcagaccaagaccaggagcgagctggtgcataaggagacggcagccaggtacaatgccgccatgggccgcatgcgacagctggagaagaaactcaagagagccatcaacaagtccaagccttattttgaactcaaggcaaagtactatgtgcagctcgagcaactgaaaaagactgtggatgacctgcaggccaaactgaccctggcaaaaggcgagtacaagatggccctgaagaacctggagatgatctcagatgagatccacgagcggcggcgctccagtgccatggggcctcggggatgcggtgttggtgctgagggcagcagcacatctgtggaggatctgccagggagcaaacctgagcctgatgccatttctgtggcctcggaggcctttgaagatgacagctgtagcaactttgtgtctgaagatgactcggaaacccagtccgtgtccagctttagttcaggaccaacaagcccgtctgagatgcctgaccagttccctgcggttgtgaggcctggcagcctggatctgcccagccctgtgtccctgtcagagtttgggatgatgttcccagtgttgggccctcgaagtgaatgcagcggggcctcctcccctgaatgtgaagtagaacgaggagacagggcagaaggggcagagaataaaacaagtgacaaagccaacaacaaccggggcctcagcagtagcagtggcagtggtggcagcagtaagagccaaagcagcacctcccctgagggccaggccttggagaaccggatgaagcagctctccctacagtgctcaaagggaagagatggaattattgctgacataaaaatggtgcagattggctgattcatcctgggccctggccgatgtgcatatcaacatttatacatggaactggagaacattgtgccaataatcatttaatatatgccaaatcttacacgtctactctaaactgctctaatgaagtttcagtgaccttgagggctaaagattgttcttctgggtaagagctcttgggctggtttttcagagcagagttcttgttgtgggtagactgtgactaggttcacagcctttgtggaacattccgtataacggcattgtggaagcaataactagttcctatgaaagaaccagagctgggaagatggctgggaagccaggccaaagtgggggcaacagcttgcttctctttctcttctcaccctcagtttgtatgggaaaatggagatgtcctctccactttatcccacgatatctaaatgaaaaagaaagaaaacccacacacaaagcaaaaactcaagtattaagagcacatatttttgacccagtggaggcttaaaaaaaaaaaaatccaagaacacaattcattttcaccacctctggtgttcagagggggcttttaaaaaagcgtgtatgctgggatacccattaaaaccattttctagaaggctaccatgagctgcactttttggggtgggaaaggtgaatgccagtggggatgcggggggatgagggtaggagggacttatagaaggggatttgtggctgtgggggagaaggttctacagcataagccttatcctgccagccaaggggatttattctaagagaagtgcatgtgaagaatggttgccactgttattagattgacaagatgttaatttctctgtaggttgtaactttaaaaataaatgaaattatttaagggttatgctgcactagtattccttagaggaaacagttctttaaagttaggaaagggagtaggcaggcatgtgttggcaaaggctgttaatagtagttaagtgttaagactgcttttctttaacgttttcatggtaatgcatatttagagcactgtatttttgtcttgttaagaaaatttagcatttctaaaatcatttgtaaatctcttcatacaatagtgacttcttttttgactgatacagtatcttaattacaaggttattttgtacttgtcttaatacactaagtgtaataaaaacggcttgagaaaaaaaaaaaacattaactggccgtcgtttacaaacgtcccaactggcatacccaggcagtaccaacttaattcctctgtatacaattcc

SEQ ID NO: 365068 - DNA, 3088 bp, Homo sapiens
agcgggcgcccatttcctctgctccgccgcggccggaggtatccgcatcggcgagctgcgtctcccgggtgtcggccccggcggctccccgaccgtgcccggctgtggcgaggcggctccagcccagcctgtggcagccgcgacccccggggcgctccggagcccactgcgcggcgcgcgtgccggctgcctgcatggacgcggcactgaagcggagccgctcggaggagccagccgaaatcctgccgcctgcccgggacgaggaggaggaggaggaagaggggatggagcaggggctggaggaggaagaagaggtggatccccggatccagggagaactggagaagttaaatcagtccacggatgatatcaacagacgggagactgaacttgaggatgctcgtcagaagttccgctctgttctggttgaagcaacggtgaaactggatgaactggtgaagaaaattggcaaagctgtggaagactccaagccctactgggaggcacggagggtggcgaggcaggctcagctggaagctcagaaagccacgcaggacttccagagggccacagaggtgctccgtgccgccaaggagaccatctccctggccgagcagcggctgctggaggatgacaagcggcagttcgactccgcctggcaggagatgctgaatcacgccactcagagggtcatggaggcggagcagaccaagaccaggagcgagctggtgcataaggagacggcagccaggtacaatgccgccatgggccgcatgcgacagctggagaagaaactcaagagagccatcaacaagtccaagccttattttgaactcaaggcaaagtactatgtgcagctcgagcaactgaaaaagactgtggatgacctgcaggccaaactgaccctggcaaaaggcgagtacaagatggccctgaagaacctggagatgatctcagatgagatccacgagcggcggcgctccagtgccatggggcctcggggatgcggtgttggtgctgagggcagcagcacatctgtggaggatctgccagggagcaaacctgagcctgatgccatttctgtggcctcggaggcctttgaagatgacagctgtagcaactttgtgtctgaagatgactcggaaacccagtccgtgtccagctttagttcaggaccaacaagcccgtctgagatgcctgaccagttccctgcggttgtgaggcctggcagcctggatctgcccagccctgtgtccctgtcagagtttgggatgatgttcccagtgttgggccctcgaagtgaatgcagcggggcctcctcccctgaatgtgaagtagaacgaggagacagggcagaaggggcagagaataaaacaagtgacaaagccaacaacaaccggggcctcagcagtagcagtggcagtggtggcagcagtaagagccaaagcagcacctcccctgagggccaggccttggagaaccggatgaagcagctctccctacagtgctcaaagggaagagatggaattattgctgacataaaaatggtgcagattggctgattcatcctgggccctggccgatgtgcatatcaacatttatacatggaactggagaacattgtgccaataatcatttaatatatgccaaatcttacacgtctactctaaactgctctaatgaagtttcagtgaccttgagggctaaagattgttcttctgggtaagagctcttgggctggtttttcagagcagagttcttgttgtgggtagactgtgactaggttcacagcctttgtggaacattccgtataacggcattgtggaagcaataactagttcctatgaaagaaccagagctgggaagatggctgggaagccaggccaaagtgggggcaacagcttgcttctctttctcttctcaccctcagtttgtatgggaaaatggagatgtcctctccactttatcccacgatatctaaatgaaaaagaaagaaaacccacacacaaagcaaaaactcaagtattaagagcacatatttttgacccagtggaggcttaaaaaaaaaaaaatccaagaacacaattcattttcaccacctctggtgttcagagggggcttttaaaaaagcgtgtatgctgggatacccattaaaaccattttctagaaggctaccatgagctgcactttttggggtgggaaaggtgaatgccagtggggatgcggggggatgagggtaggagggacttatagaaggggatttgtggctgtgggggagaaggttctacagcataagccttatcctgccagccaaggggatttattctaagagaagtgcatgtgaagaatggttgccactgttattagattgacaagatgttaatttctctgtaggttgtaactttaaaaataaatgaaattatttaagggttatgctgcactagtattccttagaggaaacagttctttaaagttaggaaagggagtaggcaggcatgtgttggcaaaggctgttaatagtagttaagtgttaagactgccagccaaggggatttattctaagacgacagctgcctgtgacgaatggttgccactgctattagatggaccagactgtcaatttctctgtaggtggtaactttaaaaactaacatgaccattatttacagggttatgcttgcactagtattccttagaggcacacaggtcctttaaagttaggacaggggacttagccaggcatgttgttggcacaggcggtcaatagtcagtaagcggttcacgaccgtggtttcttaaagcggtgtccgggcaatggcctatctggagcccggtgtttgggcctggctagaacatctcgctttctaacggaaaaaggggcccctttttaaggggtgaatctgttaaagacgtgattttaagagactatgtgaaaattctcctacaaaaaggagagcttttggaggagaagacatctcattacaggagagatataataggtgttcgaaccacagtgcgataaaagcatggtggtcaacaatacacaatcaatcgaagaatcacgaacgtagggggcgatactagtcag

SEQ ID NO: 365069 - DNA, 2731 bp, Homo sapiens
agcgggcgcccatttcctctgctccgccgcggccggaggtatccgcatcggcgagctgcgtctcccgggtgtcggccccggcggctccccgaccgtgcccggctgtggcgaggcggctccagcccagcctgtggcagccgcgacccccggggcgctccggagcccactgcgcggcgcgcgtgccggctgcctgcatggacgcggcactgaagcggagccgctcggaggagccagccgaaatcctgccgcctgcccgggacgaggaggaggaggaggaagaggggatggagcaggggctggaggaggaagaagaggtggatccccggatccagggagaactggagaagttaaatcagtccacggatgatatcaacagacgggagactgaacttgaggatgctcgtcagaagttccgctctgttctggttgaagcaacggtgaaactggatgaactggtgaagaaaattggcaaagctgtggaagactccaagccctactgggaggcacggagggtggcgaggcaggctcagctggaagctcagaaagccacgcaggacttccagagggccacagaggtgctccgtgccgccaaggagaccatctccctggccgagcagcggctgctggaggatgacaagcggcagttcgactccgcctggcaggagatgctgaatcacgccactcagagggtcatggaggcggagcagaccaagaccaggagcgagctggtgcataaggagacggcagccaggtacaatgccgccatgggccgcatgcgacagctggagaagaaactcaagagagccatcaacaagtccaagccttattttgaactcaaggcaaagtactatgtgcagctcgagcaactgaaaaagactgtggatgacctgcaggccaaactgaccctggcaaaaggcgagtacaagatggccctgaagaacctggagatgatctcagatgagatccacgagcggcggcgctccagtgccatggggcctcggggatgcggtgttggtgctgagggcagcagcacatctgtggaggatctgccagggagcaaacctgagcctgatgccatttctgtggcctcggaggcctttgaagatgacagctgtagcaactttgtgtctgaagatgactcggaaacccagtccgtgtccagctttagttcaggaccaacaagcccgtctgagatgcctgaccagttccctgcggttgtgaggcctggcagcctggatctgcccagccctgtgtccctgtcagagtttgggatgatgttcccagtgttgggccctcgaagtgaatgcagcggggcctcctcccctgaatgtgaagtagaacgaggagacagggcagaaggggcagagaataaaacaagtgacaaagccaacaacaaccggggcctcagcagtagcagtggcagtggtggcagcagtaagagccaaagcagcacctcccctgagggccaggccttggagaaccggatgaagcagctctccctacagtgctcaaagggaagagatggaattattgctgacataaaaatggtgcagattggctgattcatcctgggccctggccgatgtgcatatcaacatttatacatggaactggagaacattgtgccaataatcatttaatatatgccaaatcttacacgtctactctaaactgctctaatgaagtttcagtgaccttgagggctaaagattgttcttctgggtaagagctcttgggctggtttttcagagcagagttcttgttgtgggtagactgtgactaggttcacagcctttgtggaacattccgtataacggcattgtggaagcaataactagttcctatgaaagaaccagagctgggaagatggctgggaagccaggccaaagtgggggcaacagcttgcttctctttctcttctcaccctcagtttgtatgggaaaatggagatgtcctctccactttatcccacgatatctaaatgaaaaagaaagaaaacccacacacaaagcaaaaactcaagtattaagagcacatatttttgacccagtggaggcttaaaaaaaaaaaaatccaagaacacaattcattttcaccacctctggtgttcagagggggcttttaaaaaagcgtgtatgctgggatacccattaaaaccattttctagaaggctaccatgagctgcactttttggggtgggaaaggtgaatgccagtggggatgcggggggatgagggtaggagggacttatagaaggggatttgtggctgtggggtatataggttttcggatattcagtatctctgcagtctaggtgttttttctatcgctgtcgtattactttaaactcatgatacctttaaggtcttctcgtctagtgctcctttaggtctcccttttagtcatgacttggagttgttgtcaagagtgtcacttagtggtatgtttactccttttcggtgctctcatacgcctttctatcgattttgctgtattattttctctcgcgggatctttctctcttcgtctatgttctcttttgaaccgcagccttctcttcttactttgtctcggatagctattccttactgttttctgatgatctctcttattccgggtttcattgtcttttttacatctcatcttgattgtaatagtgatttcgtctttctcatatcccacttctctcttttcctcatctttttacatttgctcttatttcctcccttcc

SEQ ID NO: 365070 - DNA, 2605 bp, Homo sapiens
agccaaactatatagagagggctggaggacaaactgttccagatgggagttggagaaagccttgctatggatgtgacatttgggctgagatgtggatgatgagaaggagtcaggcagccgtgccctggaggagatagcgatgcagacagcagaagccctgaggacagagccagctgacagcccatgtggtgccagaggggagaactggagaagttaaatcagtccacggatgatatcaacagacgggagactgaacttgaggatgctcgtcagaagttccgctctgttctggttgaagcaacggtgaaactggatgaactggtgaagaaaattggcaaagctgtggaagactccaagccctactgggaggcacggagggtggcgaggcaggctcagctggaagctcagaaagccacgcaggacttccagagggccacagaggtgctccgtgccgccaaggagaccatctccctggccgagcagcggctgctggaggatgacaagcggcagttcgactccgcctggcaggagatgctgaatcacgccactcagagggtcatggaggcggagcagaccaagaccaggagcgagctggtgcataaggagacggcagccaggtacaatgccgccatgggccgcatgcgacagctggagaagaaactcaagagagccatcaacaagtccaagccttattttgaactcaaggcaaagtactatgtgcagctcgagcaactgaaaaagactgtggatgacctgcaggccaaactgaccctggcaaaaggcgagtacaagatggccctgaagaactcggggatgcggtgttggtgctgagggcagcagcacatctgtggaggatctgccagggagcaaacctgagcctgatgccatttctgtggcctcggaggcctttgaagatgacagctgtagcaactttgtgtctgaagatgactcggaaacccagtccgtgtccagctttagttcaggaccaacaagcccgtctgagatgcctgaccagttccctgcggttgtgaggcctggcagcctggatctgcccagccctgtgtccctgtcagagtttgggatgatgttcccagtgttgggccctcgaagtgaatgcagcggggcctcctcccctgaatgtgaagtagaacgaggagacagggcagaaggggcagagaataaaacaagtgacaaagccaacaacaaccggggcctcagcagtagcagtggcagtggtggcagcagtaagagccaaagcagcacctcccctgagggccaggccttggagaaccggatgaagcagctctccctacagtgctcaaagggaagagatggaattattgctgacataaaaatggtgcagattggctgattcatcctgggccctggccgatgtgcatatcaacatttatacatggaactggagaacattgtgccaataatcatttaatatatgccaaatcttacacgtctactctaaactgctctaatgaagtttcagtgaccttgagggctaaagattgttcttctgggtaagagctcttgggctggtttttcagagcagagttcttgttgtgggtagactgtgactaggttcacagcctttgtggaacattccgtataacggcattgtggaagcaataactagttcctatgaaagaaccagagctgggaagatggctgggaagccaggccaaagtgggggcaacagcttgcttctctttctcttctcaccctcagtttgtatgggaaaatggagatgtcctctccactttatcccacgatatctaaatgaaaaagaaagaaaacccacacacaaagcaaaaactcaagtattaagagcacatatttttgacccagtggaggcttaaaaaaaaaaaaatccaagaacacaattcattttcaccacctctggtgttcagagggggcttttaaaaaagcgtgtatgctgggatacccattaaaaccattttctagaaggctaccatgagctgcactttttggggtgggaaaggtgaatgccagtggggatgcggggggatgagggtaggagggacttatagaaggggatttgtggctgtgggggagaaggttctacagcataagccttatcctgccagccaaggggatttattctaagagaagtgcatgtgaagaatggttgccactgttattagattgacaagatgttaatttctctgtaggttgtaactttaaaaataaatgaaattatttaagggttatgctgcactagtattccttagaggaaacagttctttaaagttaggaaagggagtaggcaggcatgtgttggcaaaggctgttaatagtagttaagtgttaagactgcttttctttaacgttttcatggtaatgcatatttagagcactgtatttttgtcttgttaagaaaatttagcatttctaaaagaaaaaagcaaccctctttcaaactgttaattctgtcacagcctgtatattttagtcatttgtaaatctcttcatacaatagtgacttcttttttgactgatacagtatcttaattacaaggttattttgtacttgtcttaatacactaagtgtaataaaaacggcttgagaaaa

SEQ ID NO: 365071 - DNA, 2751 bp, Homo sapiens
agcgggcgcccatttcctctgctccgccgcggccggaggtatccgcatcggcgagctgcgtctcccgggtgtcggccccggcggctccccgaccgtgcccggctgtggcgaggcggctccagcccagcctgtggcagccgcgacccccggggcgctccggagcccactgcgcggcgcgcgtgccggctgcctgcatggacgcggcactgaagcggagccgctcggaggagccagccgaaatcctgccgcctgcccgggacgaggaggaggaggaggaagaggggatggagcaggggctggaggaggaagaagaggtggatccccggatccagggagaactggagaagttaaatcagtccacggatgatatcaacagacgggagactgaacttgaggatgctcgtcagaagttccgctctgttctggttgaagcaacggtgaaactggatgaactggtgaagaaaattggcaaagctgtggaagactccaagccctactgggaggcacggagggtggcgaggcaggctcagctggaagctcagaaagccacgcaggacttccagagggccacagaggtgctccgtgccgccaaggagaccatctccctggccgagcagcggctgctggaggatgacaagcggcagttcgactccgcctggcaggagatgctgaatcacgccactcagagggtcatggaggcggagcagaccaagaccaggagcgagctggtgcataaggagacggcagccaggtacaatgccgccatgggccgcatgcgacagctggagaagaaactcaagagagccatcaacaagtccaagccttattttgaactcaaggcaaagtactatgtgcagctcgagcaactgaaaaagactgtggatgacctgcaggccaaactgaccctggcaaaaggcgagtacaagatggccctgaagaacctggagatgatctcagatgagatccacgagcggcggcgctccagtgccatggggcctcggggatgcggtgttggtgctgagggcagcagcacatctgtggaggatctgccagggagcaaacctgagcctgatgccatttctgtggcctcggaggcctttgaagatgacagctgtagcaactttgtgtctgaagatgactcggaaacccagtccgtgtccagctttagttcaggaccaacaagcccgtctgagatgcctgaccagttccctgcggttgtgaggcctggcagcctggatctgcccagccctgtgtccctgtcagagtttgggatgatgttcccagtgttgggccctcgaagtgaatgcagcggggcctcctcccctgaatgtgaagtagaacgaggagacagggcagaaggggcagagaataaaacaagtgacaaagccaacaacaaccggggcctcagcagtagcagtggcagtggtggcagcagtaagagccaaacagctctccctacagtgctcaaagggaagagatggaattattgctgacataaaaatggtgcagattggctgattcatcctgggccctggccgatgtgcatatcaacatttatacatggaactggagaacattgtgccaataatcatttaatatatgccaaatcttacacgtctactctaaactgctctaatgaagtttcagtgaccttgagggctaaagattgttcttctgggtaagagctcttgggctggtttttcagagcagagttcttgttgtgggtagactgtgactaggttcacagcctttgtggaacattccgtataacggcattgtggaagcaataactagttcctatgaaagaaccagagctgggaagatggctgggaagccaggccaaagtgggggcaacagcttgcttctctttctcttctcaccctcagtttgtatgggaaaatggagatgtcctctccactttatcccacgatatctaaatgaaaaagaaagaaaacccacacacaaagcaaaaactcaagtattaagagcacatatttttgacccagtggaggcttaaaaaaaaaaaaatccaagaacacaattcattttcaccacctctggtgttcagagggggcttttaaaaaagcgtgtatgctgggatacccattaaaaccattttctagaaggctaccatgagctgcactttttggggtgggaaaggtgaatgccagtggggatgcggggggatgagggtaggagggacttatagaaggggatttgtggctgtgggggagaaggttctacagcataagccttatcctgccagccaaggggatttattctaagagaagtgcatgtgaagaatggttgccactgttattagattgacaagatgttaatttctctgtaggttgtaactttaaaaataaatgaaattatttaagggttatgctgcactagtattccttagaggaaacagttctttaaagttaggaaagggagtaggcaggcatgtgttggcaaaggctgttaatagtagttaagtgttaagactgcttttctttaacgttttcatggtaatgcatatttagagcactgtatttttgtcttgttaagaaaatttagcatttctaaaagaaaaaagcaaccctctttcaaactgttaattctgtcacagcctgtatattttagtcatttgtaaatctcttcatacaatagtgacttcttttttgactgatacagtatcttaattacaaggttattttgtacttgtcttaatacactaagtgtaataaaaacggcttgagaaaa

SEQ ID NO: 365072 - DNA, 2067 bp, Homo sapiens
agcgggcgcccatttcctctgctccgccgcggccggaggtatccgcatcggcgagctgcgtctcccgggtgtcggccccggcggctccccgaccgtgcccggctgtggcgaggcggctccagcccagcctgtggcagccgcgacccccggggcgctccggagcccactgcgcggcgcgcgtgccggctgcctgcatggacgcggcactgaagcggagccgctcggaggagccagccgaaatcctgccgcctgcccgggacgaggaggaggaggaggaagaggggatggagcaggggctggaggaggaagaagaggtggatccccggatccagggagaactggagaagttaaatcagtccacggatgatatcaacagacgggagactgaacttgaggatgctcgtcagaagttccgctctgttctggttgaagcaacggtgaaactggatgaactggtgaagaaaattggcaaagctgtggaagactccaagccctactgggaggcacggagggtggcgaggcaggctcagctggaagctcagaaagccacgcaggacttccagagggccacagaggtgctccgtgccgccaaggagaccatctccctggccgagcagcggctgctggaggatgacaagcggcagttcgactccgcctggcaggagatgctgaatcacgccactcagagggtcatggaggcggagcagaccaagaccaggagcgagctggtgcataaggagacggcagccaggtacaatgccgccatgggccgcatgcgacagctggagaagaaactcaagagagccatcaacaagtccaagccttattttgaactcaaggcaaagtactatgtgcagctcgagcaactgaaaaagactgtggatgacctgcaggccaaactgaccctggcaaaaggcgagtacaagatggccctgaagaacctggagatgatctcagatgagatccacgagcggcggcgctccagtgccatggggcctcggggatgcggtgttggtgctgagggcagcagcacatctgtggaggatctgccagggagcaaacctgagcctgatgccatttctggagacagggcagaaggggcagagaataaaacaagtgacaaagccaacaacaaccggggcctcagcagtagcagtggcatgggggcaacagcttgcttctctttctcttctcaccctcagtttgtatgggaaaatggagatgtcctctccactttatcccacgatatctaaatgaaaaagaaagaaaacccacacacaaagcaaaaactcaagtattaagagcacatatttttgacccagtggaggcttaaaaaaaaaaaaatccaagaacacaattcattttcaccacctctggtgttcagagggggcttttaaaaaagcgtgtatgctgggatacccattaaaaccattttctagaaggctaccatgagctgcactttttggggtgggaaaggtgaatgccagtggggatgcggggggatgagggtaggagggacttatagaaggggatttgtggctgtgggggagaaggttctacagcataagccttatcctgccagccaaggggatttattctaagagaagtgcatgtgaagaatggttgccactgttattagattgacaagatgttaatttctctgtaggttgtaactttaaaaataaatgaaattatttaagggttatgctgcactagtattccttagaggaaacagttctttaaagttaggaaagggagtaggcaggcatgtgttggcaaaggctgttaatagtagttaagtgttaagactgcttttctttaacgttttcatggtaatgcatatttagagcactgtatttttgtcttgttaagaaaatttagcatttctaaaagaaaaaagcaaccctctttcaaactgttaattctgtcacagcctgtatattttagtcatttgtaaatctcttcatacaatagtgacttcttttttgactgatacagtatcttaattacaaggttattttgtacttgtcttaatacactaagtgtaataaaaacggcttgagaaaa

SEQ ID NO: 365073 - DNA, 985 bp, Homo sapiens
aataataactaggtaggatgcccggtgtaattcaggacgcggcaagaactctagtattaagagcacatattggcttgtgtgtgggttttctttctttttcatttagatatcgtgggataaagtggagaggacatctccattttcccatacaaactgagggtgagaagagaaagagaagcaagctgttgcccacacacaaagcaaaaactcaagtattaagagcacatatttttgacccagtggaggcttaaaaaaaaaaaaatccaagaacacaattcattttcaccacctctggtgttcagagggggcttttaaaaaagcgtgtatgctgggatacccattaaaaccattttctagaaggctaccatgagctgcactttttggggtgggaaaggtgaatgccagtggggatgcggggggatgagggtaggagggacttatagaaggggatttgtggctgtgggggagaaggttctacagcataagccttatcctgccagccaaggggatttattctaagagaagtgcatgtgaagaatggttgccactgttattagattgacaagatgttaatttctctgtaggttgtaactttaaaaataaatgaaattatttaagggttatgctgcactagtattccttagaggaaacagttctttaaagttaggaaagggagtaggcaggcatgtgttggcaaaggctgttaatagtagttaagtgttaagactgcttttctttaacgttttcatggtaatgcatatttagagcactgtatttttgtcttgttaagaaaatttagcatttctaaaagaaaaaagcaaccctctttcaaactgttaattctgtcacagcctgtatattttagtcatttgtaaatctcttcatacaatagtgacttcttttttgactgatacagtatcttaattacaaggttattttgtacttgtcttaatacactaagtgtaataaaaacggcttgagaaaa

SEQ ID NO: 365074 - DNA, 1455 bp, Homo sapiens
agcgggcgcccatttcctctgctccgccgcggccggaggtatccgcatcggcgagctgcgtctcccgggtgtcggccccggcggctccccgaccgtgcccggctgtggcgaggcggctccagcccagcctgtggcagccgcgacccccggggcgctccggagcccactgcgcggcgcgcgtgccggctgcctgcatggacgcggcactgaagcggagccgctcggaggagccagccgaaatcctgccgcctgcccgggacgaggaggaggaggaggaagaggggatggagcaggggctggaggaggaagaagaggtggatccccggatccagggagaactggagaagttaaatcagtccacggatgatatcaacagacgggagactgaacttgaggatgctcgtcagaagttccgctctgttctggttgaagcaacggtgaaactggatgaactggtgaagaaaattggcaaagctgtggaagactccaagccctactgggaggcacggagggtggcgaggcaggctcagctggaagctcagaaagccacgcaggacttccagagggccacagaggtgctccgtgccgccaaggagaccatctccctggccgagcagcggctgctggaggatgacaagcggcagttcgactccgcctggcaggagatgctgaatcacgccactcagagggtcatggaggcggagcagaccaagaccaggagcgagctggtgcataaggagacggcagccaggtacaatgccgccatgggccgcatgcgacagctggagaagaaactcaagagagccatcaacaagtccaagccttattttgaactcaaggcaaagtactatgtgcagctcgagcaactgaaaaagactgtggatgacctgcaggccaaactgaccctggcaaaaggcgagtacaagatggccctgaagaacctggagatgatctcagatgagatccacgagcggcggcgctccagtgccatggggcctcggggatgcggtgttggtgctgagggcagcagcacatctgtggaggatctgccagggagcaaacctgagcctgatgccatttctgtggcctcggaggcctttgaagatgacagctgtagcaactttgtgtctgaagatgactcggaaacccagtccgtgtccagctttagttcaggaccaacaagcccgtctgagatgcctgaccagttccctgcggttgtgaggcctggcagcctggatctgcccagccctgtgtccctgtcagagtttgggatgatgttcccagtgttgggccctcgaagtgaatgcagcggggcctcctcccctgaatgtgaagtagaacgaggagacagggcagaaggggcagagaataaaacaagtgacaaagccacggtcaacccacaagccacggtcaacccacaagccacggtcaacccacaagccacggtcaacccac

SEQ ID NO: 365075 - DNA, 490 bp, Homo sapiens
aagggttatgctgcactagtattccttagaggaaacagttctttaaagttaggaaagggagtaggcaggcatgtgttggcaaaggctgttaatagtagttaagtgttaagactgcttttctttaacgttttcatggtaatgcatatttagagcactgtatttttgtcttgttaagaaaatttagcatttctaaaagaaaaaagcaaccctctttcaaactgttaattctgtcacagcctgtatattttagtcatttgtaaatctcttcatacaatagtgacttcttttttgactgatacagtatcttaattacaaggttattttgtacttgtcttaatacactaagtgtaataaaaacggcttgagaaaaagtttctcctttctgtgacttcaaataagaactcccagtattgcctaaatcttctaggcaaccctttttccataaggaagagcatggagtgctgtggtcaccagtaatcattttcaatta

SEQ ID NO: 365076 - DNA, 450 bp, Homo sapiens
tgtgccaataatcatttaatatatgccaaatcttacacgtctactctaaactgctctaatgaagtttcagtgaccttgagggctaaagattgttcttctgggtaagagctcttgggctggtttttcagagcagagttcttgttgtgggtagactgtgactaggttcacagcctttgtggaacattccgtataacggcattgtggaagcaataactagttcctatgaaagaaccagagctgggaagatggctgggaagccaggccaaagtgggggcaacagcttgcttctctttctcttctcaccctcagtttgtatgggaaaatggagatgtcctctccactttatcccacgatatctaaatgaaaaagaaagaaaacccacacacaaagcaaaaactcaagtattaagagcacatatttttgacccagtggaggcttaaaaaaaaaaaa

SEQ ID NO: 365077 - DNA, 2795 bp, Homo sapiens
agcgggcgcccatttcctctgctccgccgcggccggaggtatccgcatcggcgagctgcgtctcccgggtgtcggccccggcggctccccgaccgtgcccggctgtggcgaggcggctccagcccagcctgtggcagccgcgacccccggggcgctccggagcccactgcgcggcgcgcgtgccggctgcctgcatggacgcggcactgaagcggagccgctcggaggagccagccgaaatcctgccgcctgcccgggacgaggaggaggaggaggaagaggggatggagcaggggctggaggaggaagaagaggtggatccccggatccagggagaactggagaagttaaatcagtccacggatgatatcaacagacgggagactgaacttgaggatgctcgtcagaagttccgctctgttctggttgaagcaacggtgaaactggatgaactggtgaagaaaattggcaaagctgtggaagactccaagccctactgggaggcacggagggtggcgaggcaggctcagctggaagctcagaaagccacgcaggacttccagagggccacagaggtgctccgtgccgccaaggagaccatctccctggccgagcagcggctgctggaggatgacaagcggcagttcgactccgcctggcaggagatgctgaatcacgccactcagagggtcatggaggcggagcagaccaagaccaggagcgagctggtgcataaggagacggcagccaggtacaatgccgccatgggccgcatgcgacagctggagaagaaactcaagagagccatcaacaagtccaagccttattttgaactcaaggcaaagtactatgtgcagctcgagcaactgaaaaagactgtggatgacctgcaggccaaactgaccctggcaaaaggcgagtacaagatggccctgaagaacctggagatgatctcagatgagatccacgagcggcggcgctccagtgccatggggcctcggggatgcggtgttggtgctgagggcagcagcacatctgtggaggatctgccagggagcaaacctgagcctgatgccatttctgtggcctcggaggcctttgaagatgacagctgtagcaactttgtgtctgaagatgactcggaaacccagtccgtgtccagctttagttcaggaccaacaagcccgtctgagatgcctgaccagttccctgcggttgtgaggcctggcagcctggatctgcccagccctgtgtccctgtcagagtttgggatgatgttcccagtgttgggccctcgaagtgaatgcagcggggcctcctcccctgaatgtgaagtagaacgaggagacagggcagaaggggcagagaataaaacaagtgacaaagccaacaacaaccggggcctcagcagtagcagtggcagtggtggcagcagtaagagccaaagcagcacctcccctgagggccaggccttggagaaccggatgaagcagctctccctacagtgctcaaagggaagagatggaattattgctgacataaaaatggtgcagattggctgattcatcctgggccctggccgatgtgcatatcaacatttatacatggaactggagaacattgtgccaataatcatttaatatatgccaaatcttacacgtctactctaaactgctctaatgaagtttcagtgaccttgagggctaaagattgttcttctgggtaagagctcttgggctggtttttcagagcagagttcttgttgtgggtagactgtgactaggttcacagcctttgtggaacattccgtataacggcattgtggaagcaataactagttcctatgaaagaaccagagctgggaagatggctgggaagccaggccaaagtgggggcaacagcttgcttctctttctcttctcaccctcagtttgtatgggaaaatggagatgtcctctccactttatcccacgatatctaaatgaaaaagaaagaaaacccacacacaaagcaaaaactcaagtattaagagcacatatttttgacccagtggaggcttaaaaaaaaaaaaatccaagaacacaattcattttcaccacctctggtgttcagagggggcttttaaaaaagcgtgtatgctgggatacccattaaaaccattttctagaaggctaccatgagctgcactttttggggtgggaaaggtgaatgccagtggggatgcggggggatgagggtaggagggacttatagaaggggatttgtggctgtgggggagaaggttctacagcataagccttatcctgccagccaaggggatttattctaagagaagtgcatgtgaagaatggttgccactgttattagattgacaagatgttaatttctctgtaggttgtaactttaaaaataaatgaaattatttaagggttatgctgcactagtattccttagaggaaacagttctttaaagttaggaaagggagtaggcaggcatgtgttggcaaaggctgttaatagtagttaagtgttaagactgcttttctttaacgttttcatggtaatgcatatttagagcactgtatttttgtcttgttaagaaaatttagcatttctaaaagaaaaaagcaaccctctttcaaactgttaattctgtcacagcctgtatattttagtcatttgtaaatctcttcatacaatagtgacttcttttttgactgatacagtatcttaattacaaggttattttgtacttgtcttaatacactaagtgtaataaaaacggcttgagaaaa

SEQ ID NO: 365078 - DNA, 625 bp, Homo sapiens
gtggcgaattcggcaccgaggggaggaggaagaagaggtgatccccggatccaggagaactggagaagttaaatcagtccacggatgatatcaacagacgggagactgaacttgaggatgctcgtcagaagttccgctctgttctggttgaagcaacggtgaaactggatgaactggtgaagaaaattggcaaagctgtggaagactccaagccctactgggaggcacggagggtggcgaggcaggctcagctggaagctcagaaagccacgcaggacttccagagggccacagaggtgctccgtgccgccaaggagaccatctccctggccgagcagcggctgctggaggatgacaagcggcagttcgactccgcctggcaggagatgctgaatcacgccactcagagggtcatggaggcggagcagaccaagaccaggagcgagctggtgcataaggagacggcagccaggtacaatgccgccatgggccgcatgcgacagctggagaagaaactcaagagagccatcaacaagtccaagccttatttgactcaggcaaagactatgtgcgtcgagcaatgaaaagacggggtgaccgagcaactgaccggaaaggatacaag

SEQ ID NO: 365079 - DNA, 2797 bp, Homo sapiens
  misc_feature (30)..(30): n is a, c, g, or t
cggatcggcagtactatacggtttatggtncgaggcctggtgatccgcatcggcgagctgcgtctcccgggtgtcggccccggcggctccccgaccgtgcccggctgtggcgaggcggctccagcccagcctgtggcagccgcgacccccggggcgctccggagcccactgcgcggcgcgcgtgccggctgcctgcatggacgcggcactgaagcggagccgctcggaggagccagccgaaatcctgccgcctgcccgggacgaggaggaggaggaggaagaggggatggagcaggggctggaggaggaagaagaggtggatccccggatccagggagaactggagaagttaaatcagtccacggatgatatcaacagacgggagactgaacttgaggatgctcgtcagaagttccgctctgttctggttgaagcaacggtgaaactggatgaactggtgaagaaaattggcaaagctgtggaagactccaagccctactgggaggcacggagggtggcgaggcaggctcagctggaagctcagaaagccacgcaggacttccagagggccacagaggtgctccgtgccgccaaggagaccatctccctggccgagcagcggctgctggaggatgacaagcggcagttcgactccgcctggcaggagatgctgaatcacgccactcagagggtcatggaggcggagcagaccaagaccaggagcgagctggtgcataaggagacggcagccaggtacaatgccgccatgggccgcatgcgacagctggagaagaaactcaagagagccatcaacaagtccaagccttattttgaactcaaggcaaagtactatgtgcagctcgagcaactgaaaaagactgtggatgacctgcaggccaaactgaccctggcaaaaggcgagtacaagatggccctgaagaacctggagatgatctcagatgagatccacgagcggcggcgctccagtgccatggggcctcggggatgcggtgttggtgctgagggcagcagcacatctgtggaggatctgccagggagcaaacctgagcctgatgccatttctgtggcctcggaggcctttgaagatgacagctgtagcaactttgtgtctgaagatgactcggaaacccagtccgtgtccagctttagttcaggaccaacaagcccgtctgagatgcctgaccagttccctgcggttgtgaggcctggcagcctggatctgcccagccctgtgtccctgtcagagtttgggatgatgttcccagtgttgggccctcgaagtgaatgcagcggggcctcctcccctgaatgtgaagtagaacgaggagacagggcagaaggggcagagaataaaacaagtgacaaagccaacaacaaccggggcctcagcagtagcagtggcagtggtggcagcagtaagagccaaagcagcacctcccctgagggccaggccttggagaaccggatgaagcagctctccctacagtgctcaaagggaagagatggaattattgctgacataaaaatggtgcagattggctgattcatcctgggccctggccgatgtgcatatcaacatttatacatggaactggagaacattgtgccaataatcatttaatatatgccaaatcttacacgtctactctaaactgctctaatgaagtttcagtgaccttgagggctaaagattgttcttctgggtaagagctcttgggctggtttttcagagcagagttcttgttgtgggtagactgtgactaggttcacagcctttgtggaacattccgtataacggcattgtggaagcaataactagttcctatgaaagaaccagagctgggaagatggctgggaagccaggccaaagtgggggcaacagcttgcttctctttctcttctcaccctcagtttgtatgggaaaatggagatgtcctctccactttatcccacgatatctaaatgaaaaagaaagaaaacccacacacaaagcaaaaactcaagtattaagagcacatatttttgacccagtggaggcttaaaaaaaaaaaaatccaagaacacaattcattttcaccacctctggtgttcagagggggcttttaaaaaagcgtgtatgctgggatacccattaaaaccattttctagaaggctaccatgagctgcactttttggggtgggaaaggtgaatgccagtggggatgcggggggatgagggtaggagggacttatagaaggggatttgtggctgtgggggagaaggttctacagcataagccttatcctgccagccaaggggatttattctaagagaagtgcatgtgaagaatggttgccactgttattagattgacaagatgttaatttctctgtaggttgtaactttaaaaataaatgaaattatttaagggttatgctgcactagtattccttagaggaaacagttctttaaagttaggaaagggagtaggcaggcatgtgttggcaaaggctgttaatagtagttaagtgttaagactgcttttctttaacgttttcatggtaatgcatatttagagcactgtatttttgtcttgttaagaaaatttagcatttctaaaagaaaaaagcaaccctctttcaaactgttaattctgtcacagcctgtatattttagtcatttgtaaatctcttcatacaatagtgacttcttttttgactgatacagtatcttaattacaaggttattttgtacttgtcttaatacactaagtgtaataaaaacggcttgagaaaa

SEQ ID NO: 365080 - DNA, 3135 bp, Homo sapiens
agcgggcgcccatttcctctgctccgccgcggccggaggtatccgcatcggcgagctgcgtctcccgggtgtcggccccggcggctccccgaccgtgcccggctgtggcgaggcggctccagcccagcctgtggcagccgcgacccccggggcgctccggagcccactgcgcggcgcgcgtgccggctgcctgcatggacgcggcactgaagcggagccgctcggaggagccagccgaaatcctgccgcctgcccgggacgaggaggaggaggaggaagaggggatggagcaggggctggaggaggaagaagaggtggatccccggatccagggagaactggagaagttaaatcagtccacggatgatatcaacagacgggagactgaacttgaggatgctcgtcagaagttccgctctgttctggttgaagcaacggtgaaactggatgaactggtgaagaaaattggcaaagctgtggaagactccaagccctactgggaggcacggagggtggcgaggcaggctcagctggaagctcagaaagccacgcaggacttccagagggccacagaggtgctccgtgccgccaaggagaccatctccctggccgagcagcggctgctggaggatgacaagcggcagttcgactccgcctggcaggagatgctgaatcacgccactcagagggtcatggaggcggagcagaccaagaccaggagcgagctggtgcataaggagacggcagccaggtacaatgccgccatgggccgcatgcgacagctggagaagaaactcaagagagccatcaacaagtccaagccttattttgaactcaaggcaaagtactatgtgcagctcgagcaactgaaaaagactgtggatgacctgcaggccaaactgaccctggcaaaaggcgagtacaagatggccctgaagaacctggagatgatctcagatgagatccacgagcggcggcgctccagtgccatggggcctcggggatgcggtgttggtgctgagggcagcagcacatctgtggaggatctgccagggagcaaacctgagcctgatgccatttctgtggcctcggaggcctttgaagatgacagctgtagcaactttgtgtctgaagatgactcggaaacccagtccgtgtccagctttagttcaggaccaacaagcccgtctgagatgcctgaccagttccctgcggttgtgaggcctggcagcctggatctgcccagccctgtgtccctgtcagagtttgggatgatgttcccagtgttgggccctcgaagtgaatgcagcggggcctcctcccctgaatgtgaagtagaacgaggagacagggcagaaggggcagagaataaaacaagtgacaaagccaacaacaaccggggcctcagcagtagcagtggcagtggtggcagcagtaagagccaaagcagcacctcccctgagggccaggccttggagaaccggatgaagcagctctccctacagtgctcaaagggaagagatggaattattgctgacataaaaatggtgcagattggctgattcatcctgggccctggccgatgtgcatatcaacatttatacatggaactggagaacattgtgccaataatcatttaatatatgccaaatcttacacgtctactctaaactgctctaatgaagtttcagtgaccttgagggctaaagattgttcttctgggtaagagctcttgggctggtttttcagagcagagttcttgttgtgggtagactgtgactaggttcacagcctttgtggaacattccgtataacggcattgtggaagcaataactagttcctatgaaagaaccagagctgggaagatggctgggaagccaggccaaagtgggggcaacagcttgcttctctttctcttctcaccctcagtttgtatgggaaaatggagatgtcctctccactttatcccacgatatctaaatgaaaaagaaagaaaacccacacacaaagcaaaaactcaagtattaagagcacatatttttgacccagtggaggcttaaaaaaaaaaaaatccaagaacacaattcattttcaccacctctggtgttcagagggggcttttaaaaaagcgtgtatgctgggatacccattaaaaccattttctagaaggctaccatgagctgcactttttggggtgggaaaggtgaatgccagtggggatgcggggggatgagggtaggagggacttatagaaggggatttgtggctgtgggggagaaggttctacagcataagccttatcctgccagccaaggggatttattctaagagaagtgcatgtgaagaatggttgccactgttattagattgacaagatgttaatttctctgtaggttgtaactttaaaaataaatgaaattatttaagggttatgctgcactagtattccttagaggaaacagttctttaaagttaggaaagggagtaggcaggcatgtgttggcaaaggctgttaatagtagttaagtgttaagactgcttttctttaacgttttcatggtaatgcatatttagagcactgtatttttgtcttgttaagaaaatttagcatttctaaaagaaaaaagcaaccctctttcaaactgttaattctgtcacagcctgtatattttagtcatttgtaaatctcttcatacaatagtgacttcttttttgactgatacagtatcttaattacaaggttattttgtacttgtcttaatacactaagtgtaataaaaacggcttgagaaaaaaaaaaaaaaaaaaaaaaaaaaaaaaaaaaaaaaaaaggggggggggggaaaaaaatcccggggggggcaacaggttatggcggtacaccggctcttctgtgcaaaaggggggcccaaaaggaggaggcgatataaaaaagacaacgggacggggcgcgcgcgtaaaccaacagctgggcggtgggacaacccgtctcccggcgacctggggaaggcacccctcctctggcggcgcccacattggggaccaccactacaaaaattaacgcgaggaaaataacactcagggcatcggcggaacagcgaatgcgggggagaagttgcacggttatttgaatg

SEQ ID NO: 365081 - DNA, 2688 bp, Homo sapiens
agcgggcgcccatttcctctgctccgccgcggccggaggtatccgcatcggcgagctgcgtctcccgggtgtcggccccggcggctccccgaccgtgcccggctgtggcgaggcggctccagcccagccgaaatcctgccgcctgcccgggacgaggaggaggaggaggaagaggggatggagcaggggctggaggaggaagaagaggtggatccccggatccagggagaactggagaagttaaatcagtccacggatgatatcaacagacgggagactgaacttgaggatgctcgtcagaagttccgctctgttctggttgaagcaacggtgaaactggatgaactggtgaagaaaattggcaaagctgtggaagactccaagccctactgggaggcacggagggtggcgaggcaggctcagctggaagctcagaaagccacgcaggacttccagagggccacagaggtgctccgtgccgccaaggagaccatctccctggccgagcagcggctgctggaggatgacaagcggcagttcgactccgcctggcaggagatgctgaatcacgccactcagagggtcatggaggcggagcagaccaagaccaggagcgagctggtgcataaggagacggcagccaggtacaatgccgccatgggccgcatgcgacagctggagaagaaactcaagagagccatcaacaagtccaagccttattttgaactcaaggcaaagtactatgtgcagctcgagcaactgaaaaagactgtggatgacctgcaggccaaactgaccctggcaaaaggcgagtacaagatggccctgaagaacctggagatgatctcagatgagatccacgagcggcggcgctccagtgccatggggcctcggggatgcggtgttggtgctgagggcagcagcacatctgtggaggatctgccagggagcaaacctgagcctgatgccatttctgtggcctcggaggcctttgaagatgacagctgtagcaactttgtgtctgaagatgactcggaaacccagtccgtgtccagctttagttcaggaccaacaagcccgtctgagatgcctgaccagttccctgcggttgtgaggcctggcagcctggatctgcccagccctgtgtccctgtcagagtttgggatgatgttcccagtgttgggccctcgaagtgaatgcagcggggcctcctcccctgaatgtgaagtagaacgaggagacagggcagaaggggcagagaataaaacaagtgacaaagccaacaacaaccggggcctcagcagtagcagtggcagtggtggcagcagtaagagccaaagcagcacctcccctgagggccaggccttggagaaccggatgaagcagctctccctacagtgctcaaagggaagagatggaattattgctgacataaaaatggtgcagattggctgattcatcctgggccctggccgatgtgcatatcaacatttatacatggaactggagaacattgtgccaataatcatttaatatatgccaaatcttacacgtctactctaaactgctctaatgaagtttcagtgaccttgagggctaaagattgttcttctgggtaagagctcttgggctggtttttcagagcagagttcttgttgtgggtagactgtgactaggttcacagcctttgtggaacattccgtataacggcattgtggaagcaataactagttcctatgaaagaaccagagctgggaagatggctgggaagccaggccaaagtgggggcaacagcttgcttctctttctcttctcaccctcagtttgtatgggaaaatggagatgtcctctccactttatcccacgatatctaaatgaaaaagaaagaaaacccacacacaaagcaaaaactcaagtattaagagcacatatttttgacccagtggaggcttaaaaaaaaaaaaatccaagaacacaattcattttcaccacctctggtgttcagagggggcttttaaaaaagcgtgtatgctgggatacccattaaaaccattttctagaaggctaccatgagctgcactttttggggtgggaaaggtgaatgccagtggggatgcggggggatgagggtaggagggacttatagaaggggatttgtggctgtgggggagaaggttctacagcataagccttatcctgccagccaaggggatttattctaagagaagtgcatgtgaagaatggttgccactgttattagattgacaagatgttaatttctctgtaggttgtaactttaaaaataaatgaaattatttaagggttatgctgcactagtattccttagaggaaacagttctttaaagttaggaaagggagtaggcaggcatgtgttggcaaaggctgttaatagtagttaagtgttaagactgcttttctttaacgttttcatggtaatgcatatttagagcactgtatttttgtcttgttaagaaaatttagcatttctaaaagaaaaaagcaaccctctttcaaactgttaattctgtcacagcctgtatattttagtcatttgtaaatctcttcatacaatagtgacttcttttttgactgatacagtatcttaattacaaggttattttgtacttgtcttaatacactaagtgtaataaaaacggcttgagaaaa

SEQ ID NO: 365082 - DNA, 2739 bp, Homo sapiens
agcgggcgcccatttcctctgctccgccgcggccggaggtatccgcatcggcgagctgcgtctcccgggtgtcggccccggcggctccccgaccgtgcccggctgtggcgaggcggctccagcccagcctgtggcagccgcgacccccggggcgctccggagcccactgcgcggcgcgcgtgccggctgcctgcatggacgcggcactgaagcggagccgctcggaggagccagccgaaatcctgccgcctgcccgggacgaggaggaggaggaggaagaggggatggagcaggggctggaggaggaagaagaggtggatccccggatccagggagaactggagaagttaaatcagtccacggatgatatcaacagacgggagactgaacttgaggatgctcgtcagaagttccgctctgttctggttgaagcaacggtgaaactggatgaactggtgaagaaaattggcaaagctgtggaagactccaagccctactgggaggcacggagggtggcgaggcaggctcagctggaagctcagaaagccacgcaggacttccagagggccacagaggtgctccgtgccgccaaggagaccatctccctggccgagcagcggctgctggaggatgacaagcggcagttcgactccgcctggcaggagatgctgaatcacgccactcagagggtcatggaggcggagcagaccaagaccaggagcgagctggtgcataaggagacggcagccaggtacaatgccgccatgggccgcatgcgacagctggagaagaaactcaagagagccatcaacaagtccaagccttattttgaactcaaggcaaagtactatgtgcagctcgagcaactgaaaaagactgtggatgacctgcaggccaaactgaccctggcaaaaggcgagtacaagatggccctgaagaactcggggatgcggtgttggtgctgagggcagcagcacatctgtggaggatctgccagggagcaaacctgagcctgatgccatttctgtggcctcggaggcctttgaagatgacagctgtagcaactttgtgtctgaagatgactcggaaacccagtccgtgtccagctttagttcaggaccaacaagcccgtctgagatgcctgaccagttccctgcggttgtgaggcctggcagcctggatctgcccagccctgtgtccctgtcagagtttgggatgatgttcccagtgttgggccctcgaagtgaatgcagcggggcctcctcccctgaatgtgaagtagaacgaggagacagggcagaaggggcagagaataaaacaagtgacaaagccaacaacaaccggggcctcagcagtagcagtggcagtggtggcagcagtaagagccaaagcagcacctcccctgagggccaggccttggagaaccggatgaagcagctctccctacagtgctcaaagggaagagatggaattattgctgacataaaaatggtgcagattggctgattcatcctgggccctggccgatgtgcatatcaacatttatacatggaactggagaacattgtgccaataatcatttaatatatgccaaatcttacacgtctactctaaactgctctaatgaagtttcagtgaccttgagggctaaagattgttcttctgggtaagagctcttgggctggtttttcagagcagagttcttgttgtgggtagactgtgactaggttcacagcctttgtggaacattccgtataacggcattgtggaagcaataactagttcctatgaaagaaccagagctgggaagatggctgggaagccaggccaaagtgggggcaacagcttgcttctctttctcttctcaccctcagtttgtatgggaaaatggagatgtcctctccactttatcccacgatatctaaatgaaaaagaaagaaaacccacacacaaagcaaaaactcaagtattaagagcacatatttttgacccagtggaggcttaaaaaaaaaaaaatccaagaacacaattcattttcaccacctctggtgttcagagggggcttttaaaaaagcgtgtatgctgggatacccattaaaaccattttctagaaggctaccatgagctgcactttttggggtgggaaaggtgaatgccagtggggatgcggggggatgagggtaggagggacttatagaaggggatttgtggctgtgggggagaaggttctacagcataagccttatcctgccagccaaggggatttattctaagagaagtgcatgtgaagaatggttgccactgttattagattgacaagatgttaatttctctgtaggttgtaactttaaaaataaatgaaattatttaagggttatgctgcactagtattccttagaggaaacagttctttaaagttaggaaagggagtaggcaggcatgtgttggcaaaggctgttaatagtagttaagtgttaagactgcttttctttaacgttttcatggtaatgcatatttagagcactgtatttttgtcttgttaagaaaatttagcatttctaaaagaaaaaagcaaccctctttcaaactgttaattctgtcacagcctgtatattttagtcatttgtaaatctcttcatacaatagtgacttcttttttgactgatacagtatcttaattacaaggttattttgtacttgtcttaatacactaagtgtaataaaaacggcttgagaaaa

SEQ ID NO: 365083 - DNA, 2624 bp, Homo sapiens
tgagacagagtctcactttgttgcccaggctggagtgcagtggcacgatcttggcttgctgcaacctccacctcctggattcaagtgattctcctgcctcagcctcccgagtagctgggagtacaggctcccacaaccatgcccagctaatttttgtatttaggtagaggcggggtttcaccatgttggccaagctggtcttgaactcctggcctcaagtgatccacccgccttggccttccatagtgctgggattacaggtgtgttactgcgcccagcccataagctgccttttaaaattttctccatggagctcttcccatgaaagctgttagtgtctgtaagtcatgaaggctcagctggaagctcagaaagccacgcaggacttccagagggccacagaggtgctccgtgccgccaaggagaccatctccctggccgagcagcggctgctggaggatgacaagcggcagttcgactccgcctggcaggagatgctgaatcacgccactcagagggtcatggaggcggagcagaccaagaccaggagcgagctggtgcataaggagacggcagccaggtacaatgccgccatgggccgcatgcgacagctggagaagaaactcaagagagccatcaacaagtccaagccttattttgaactcaaggcaaagtactatgtgcagctcgagcaactgaaaaagactgtggatgacctgcaggccaaactgaccctggcaaaaggcgagtacaagatggccctgaagaacctggagatgatctcagatgagatccacgagcggcggcgctccagtgccatggggcctcggggatgcggtgttggtgctgagggcagcagcacatctgtggaggatctgccagggagcaaacctgagcctgatgccatttctgtggcctcggaggcctttgaagatgacagctgtagcaactttgtgtctgaagatgactcggaaacccagtccgtgtccagctttagttcaggaccaacaagcccgtctgagatgcctgaccagttccctgcggttgtgaggcctggcagcctggatctgcccagccctgtgtccctgtcagagtttgggatgatgttcccagtgttgggccctcgaagtgaatgcagcggggcctcctcccctgaatgtgaagtagaacgaggagacagggcagaaggggcagagaataaaacaagtgacaaagccaacaacaaccggggcctcagcagtagcagtggcagtggtggcagcagtaagagccaaagcagcacctcccctgagggccaggccttggagaaccggatgaagcagctctccctacagtgctcaaagggaagagatggaattattgctgacataaaaatggtgcagattggctgattcatcctgggccctggccgatgtgcatatcaacatttatacatggaactggagaacattgtgccaataatcatttaatatatgccaaatcttacacgtctactctaaactgctctaatgaagtttcagtgaccttgagggctaaagattgttcttctgggtaagagctcttgggctggtttttcagagcagagttcttgttgtgggtagactgtgactaggttcacagcctttgtggaacattccgtataacggcattgtggaagcaataactagttcctatgaaagaaccagagctgggaagatggctgggaagccaggccaaagtgggggcaacagcttgcttctctttctcttctcaccctcagtttgtatgggaaaatggagatgtcctctccactttatcccacgatatctaaatgaaaaagaaagaaaacccacacacaaagcaaaaactcaagtattaagagcacatatttttgacccagtggaggcttaaaaaaaaaaaaatccaagaacacaattcattttcaccacctctggtgttcagagggggcttttaaaaaagcgtgtatgctgggatacccattaaaaccattttctagaaggctaccatgagctgcactttttggggtgggaaaggtgaatgccagtggggatgcggggggatgagggtaggagggacttatagaaggggatttgtggctgtgggggagaaggttctacagcataagccttatcctgccagccaaggggatttattctaagagaagtgcatgtgaagaatggttgccactgttattagattgacaagatgttaatttctctgtaggttgtaactttaaaaataaatgaaattatttaagggttatgctgcactagtattccttagaggaaacagttctttaaagttaggaaagggagtaggcaggcatgtgttggcaaaggctgttaatagtagttaagtgttaagactgcttttctttaacgttttcatggtaatgcatatttagagcactgtatttttgtcttgttaagaaaatttagcatttctaaaagaaaaaagcaaccctctttcaaactgttaattctgtcacagcctgtatattttagtcatttgtaaatctcttcatacaatagtgacttcttttttgactgatacagtatcttaattacaaggttattttgtacttgtcttaatacactaagtgtaataaaaacggcttgagaaaa

SEQ ID NO: 365084 - DNA, 2741 bp, Homo sapiens
agcgggcgcccatttcctctgctccgccgcggccggaggtatccgcatcggcgagctgcgtctcccgggtgtcggccccggcggctccccgaccgtgcccggctgtggcgaggcggctccagcccagcctgtggcagccgcgacccccggggcgctccggagcccactgcgcggcgcgcgtgccggctgcctgcatggacgcggcactgaagcggagccgctcggaggagccagccgaaatcctgccgcctgcccgggacgaggaggaggaggaggaagaggggatggagcaggggctggaggaggaagaagaggtggatccccggatccagggagaactggagaagttaaatcagtccacggatgatatcaacagacgggagactgaacttgaggatgctcgtcagaagttccgctctgttctggttgaagcaacggtgaaactggatgaactggtgaagaaaattggcaaagctgtggaagactccaagccctactgggaggcacggagggtggcgaggcaggctcagctggaagctcagaaagccacgcaggacttccagagggccacagaggtgctccgtgccgccaaggagaccatctccctggccgagcagcggctgctggaggatgacaagcggcagttcgactccgcctggcaggagatgctgaatcacgccactcagagggtcatggaggcggagcagaccaagaccaggagcgagctggtgcataaggagacggcagccaggtacaatgccgccatgggccgcatgcgacagctggagaagaaactcaagagagccatcaacaagtccaagccttattttgaactcaaggcaaagtactatgtgcagctcgagcaactgaaaaagactgtggatgacctgcaggccaaactgaccctggcaaaaggcgagtacaagatggccctgaagaacctggagatgatctcagatgagatccacgagcggcggcgctccagtgccatggggcctcggggatgcggtgttggtgctgagggcagcagcacatctgtggaggatctgccagggagcaaacctgagcctgatgccatttctgtggcctcggaggcctttgaagatgacagctgtagcaactttgtgtctgaagatgactcggaaacccagtccgtgtccagctttagttcaggaccaacaagcccgtctgagatgcctgaccagttccctgcggttgtgaggcctggcagcctggatctgcccagccctgtgtccctgtcagagtttgggatgatgttcccagtgttgggccctcgaagtgaatgcagcggggcctcctcccctgaatgtgaagtagaacgaggagacagggcagaaggggcagagaataaaacaagtgacaaagccaacaacaaccggggcctcagcagtagcagtggcagtggtggcagcagtaagagccaaagcagcacctcccctgagggccaggccttggagaaccggatgaagcagctctccctacagtgctcaaagggaagagatggaattattgctgacataaaaatggtgcagattggctgattcatcctgggccctggccgatgtgcatatcaacatttatacatggaactggagaacattgtgccaataatcatttaatatatgccaaatcttacacgtctactctaaactgctctaatgaagtttcagtgaccttgagggctaaagattgttcttctgggtaagagctcttgggctggtttttcagagcagagttcttgttgtgggtagactgtgactaggttcacagcctttgtggaacattccgtataacggcattgtggaagcaataactagttcctatgaaagaaccagagctgggaagatggctgggaagccaggccaaagtgggggcaacagcttgcttctctttctcttctcaccctcagtttgtatgggaaaatggagatgtcctctccactttatcccacgatatctaaatgaaaaagaaagaaaacccacacacaaagcaaaaactcaagtattaagagcacatatttttgacccagtggaggcttaaaaaaaaaaaaatccaagaacacaattcattttcaccacctctggtgttcagagggggcttttaaaaaagcgtgtatgctgggatacccattaaaaccattttctagaaggctaccatgagctgcactttttggggtgggaaaggtgaatgccagtggggatgcggggggatgagggtaggagggacttatagaaggggatttgtggctgtgggggagaaggttctacagcataagccttatcctgccagccaaggggatttattctaagagaagtgcatgtgaagaatggttgccactgttattagattgacaagatgttaatttctctgtaggttgtaactttaaagttctttaaagttaggaaagggagtaggcaggcatgtgttggcaaaggctgttaatagtagttaagtgttaagactgcttttctttaacgttttcatggtaatgcatatttagagcactgtatttttgtcttgttaagaaaatttagcatttctaaaagaaaaaagcaaccctctttcaaactgttaattctgtcacagcctgtatattttagtcatttgtaaatctcttcatacaatagtgacttcttttttgactgatacagtatcttaattacaaggttattttgtacttgtcttaatacactaagtgtaataaaaacggcttgagaaaa

SEQ ID NO: 365085 - DNA, 2534 bp, Homo sapiens
agcgggcgcccatttcctctgctccgccgcggccggaggtatccgcatcggcgagctgcgtctcccgggtgtcggccccggcggctccccgaccgtgcccggctgtggcgaggcggctccagcccagcctgtggcagccgcgacccccggggcgctccggagcccactgcgcggcgcgcgtgccggctgcctgcatggacgcggcactgaagcggagccgctcggaggagccagccgaaatcctgccgcctgcccgggacgaggaggaggaggaggaagaggggatggagcaggggctggaggaggaagaagaggtggatccccggatccagggagaactggagaagttaaatcagtccacggatgatatcaacagacgggagactgaacttgaggatgctcgtcagaagttccgctctgttctggttgaagcaacggtgaaactggatgaactggtgaagaaaattggcaaagctgtggaagactccaagccctactgggaggcacggagggtggcgaggcaggctcagctggaagctcagaaagccacgcaggacttccagagggccacagaggtgctccgtgccgccaaggagaccatctccctggccgagcagcggctgctggaggatgacaagcggcagttcgactccgcctggcaggagatgctgaatcacgccactcagagggtcatggaggcggagcagaccaagaccaggagcgagctggtgcataaggagacggcagccaggtacaatgccgccatgggccgcatgcgacagctggagaagaaactcaagagagccatcaacaagtccaagccttattttgaactcaaggcaaagtactatgtgcagctcgagcaactgaaaaagactgtggatgacctgcaggccaaactgaccctggcaaaaggcgagtacaagatggccctgaagaacctggagatgatctcagatgagatccacgagcggcggcgctccagtgccatggggcctcggggatgcggtgttggtgctgagggcagcagcacatctgtggaggatctgccagggagcaaacctgagcctgatgccatttctggagacagggcagaaggggcagagaataaaacaagtgacaaagccaacaacaaccggggcctcagcagtagcagtggcagtggtggcagcagtaagagccaaagcagcacctcccctgagggccaggccttggagaaccggatgaagcagctctccctacagtgctcaaagggaagagatggaattattgctgacataaaaatggtgcagattggctgattcatcctgggccctggccgatgtgcatatcaacatttatacatggaactggagaacattgtgccaataatcatttaatatatgccaaatcttacacgtctactctaaactgctctaatgaagtttcagtgaccttgagggctaaagattgttcttctgggtaagagctcttgggctggtttttcagagcagagttcttgttgtgggtagactgtgactaggttcacagcctttgtggaacattccgtataacggcattgtggaagcaataactagttcctatgaaagaaccagagctgggaagatggctgggaagccaggccaaagtgggggcaacagcttgcttctctttctcttctcaccctcagtttgtatgggaaaatggagatgtcctctccactttatcccacgatatctaaatgaaaaagaaagaaaacccacacacaaagcaaaaactcaagtattaagagcacatatttttgacccagtggaggcttaaaaaaaaaaaaatccaagaacacaattcattttcaccacctctggtgttcagagggggcttttaaaaaagcgtgtatgctgggatacccattaaaaccattttctagaaggctaccatgagctgcactttttggggtgggaaaggtgaatgccagtggggatgcggggggatgagggtaggagggacttatagaaggggatttgtggctgtgggggagaaggttctacagcataagccttatcctgccagccaaggggatttattctaagagaagtgcatgtgaagaatggttgccactgttattagattgacaagatgttaatttctctgtaggttgtaactttaaaaataaatgaaattatttaagggttatgctgcactagtattccttagaggaaacagttctttaaagttaggaaagggagtaggcaggcatgtgttggcaaaggctgttaatagtagttaagtgttaagactgcttttctttaacgttttcatggtaatgcatatttagagcactgtatttttgtcttgttaagaaaatttagcatttctaaaagaaaaaagcaaccctctttcaaactgttaattctgtcacagcctgtatattttagtcatttgtaaatctcttcatacaatagtgacttcttttttgactgatacagtatcttaattacaaggttattttgtacttgtcttaatacactaagtgtaataaaaacggcttgagaaaa

SEQ ID NO: 365086 - DNA, 2740 bp, Homo sapiens
agcgggcgcccatttcctctgctccgccgcggccggaggtatccgcatcggcgagctgcgtctcccgggtgtcggccccggcggctccccgaccgtgcccggctgtggcgaggcggctccagcccagcctgtggcagccgcgacccccggggcgctccggagcccactgcgcggcgcgcgtgccggctgcctgcatggacgcggcactgaagcggagccgctcggaggagccagccgaaatcctgccgcctgcccgggacgaggaggaggaggaggaagaggggatggagcaggggctggaggaggaagaagaggtggatccccggatccagggagaactggagaagttaaatcagtccacggatgatatcaacagacgggagactgaacttgaggatgctcgtcagaagttccgctctgttctggttgaagcaacggtgaaactggatgaactggtgaagaaaattggcaaagctgtggaagactccaagccctactgggaggcacggagggtggcgaggcaggctcagctggaagctcagaaagccacgcaggacttccagagggccacagaggtgctccgtgccgccaaggagaccatctccctggccgagcagcggctgctggaggatgacaagcggcagttcgactccgcctggcaggagatgctgaatcacgccactcagagggtcatggaggcggagcagaccaagaccaggagcgagctggtgcataaggagacggcagccaggtacaatgccgccatgggccgcatgcgacagctggagaagaaactcaagagagccatcaacaagtccaagccttattttgaactcaaggcaaagtactatgtgcagctcgagcaactgaaaaagactgtggatgacctgcaggccaaactgaccctggcaaaaggcgagtacaagatggccctgaagaacctggagatgatctcagatgagatccacgagcggcggcgctccagtgccatggggcctcggggatgcggtgttggtgctgagggcagcagcacatctgtggaggatctgccagggagcaaacctgagcctgatgccatttctgtggcctcggaggcctttgaagatgacagctgtagcaactttgtgtctgaagatgactcggaaacccagtccgtgtccagctttagttcaggaccaacaagcccgtctgagatgcctgaccagttccctgcggttgtgaggcctggcagcctggatctgcccagccctgtgtccctgtcagagtttgggatgatgttcccagtgttgggccctcgaagtgaatgcagcggggcctcctcccctgaatgtgaagtagaacgaggagacagggcagaaggggcagagaataaaacaagtgacaaagccaacaacaaccggggcctcagcagtagcagtggcagtggtggcagcagtaagagccaaagcagcacctcccctgagggccaggccttggagaaccggatgaagcagctctccctacagtgctcaaagggaagagatggaattattgctgacataaaaatggtgcagattggctgattcatcctgggccctggccgatgtgcatatcaacatttatacatggaactggagaacattgtgccaataatcatttaatatatgccaaatcttacacgtctactctaaactgctctaatgaagtttcagtgaccttgagggcttgttgtgggtagactgtgactaggttcacagcctttgtggaacattccgtataacggcattgtggaagcaataactagttcctatgaaagaaccagagctgggaagatggctgggaagccaggccaaagtgggggcaacagcttgcttctctttctcttctcaccctcagtttgtatgggaaaatggagatgtcctctccactttatcccacgatatctaaatgaaaaagaaagaaaacccacacacaaagcaaaaactcaagtattaagagcacatatttttgacccagtggaggcttaaaaaaaaaaaaatccaagaacacaattcattttcaccacctctggtgttcagagggggcttttaaaaaagcgtgtatgctgggatacccattaaaaccattttctagaaggctaccatgagctgcactttttggggtgggaaaggtgaatgccagtggggatgcggggggatgagggtaggagggacttatagaaggggatttgtggctgtgggggagaaggttctacagcataagccttatcctgccagccaaggggatttattctaagagaagtgcatgtgaagaatggttgccactgttattagattgacaagatgttaatttctctgtaggttgtaactttaaaaataaatgaaattatttaagggttatgctgcactagtattccttagaggaaacagttctttaaagttaggaaagggagtaggcaggcatgtgttggcaaaggctgttaatagtagttaagtgttaagactgcttttctttaacgttttcatggtaatgcatatttagagcactgtatttttgtcttgttaagaaaatttagcatttctaaaagaaaaaagcaaccctctttcaaactgttaattctgtcacagcctgtatattttagtcatttgtaaatctcttcatacaatagtgacttcttttttgactgatacagtatcttaattacaaggttattttgtacttgtcttaatacactaagtgtaataaaaacggcttgagaaaa

SEQ ID NO: 365087 - DNA, 1780 bp, Homo sapiens
agcgggcgcccatttcctctgctccgccgcggccggaggtatccgcatcggcgagctgcgtctcccgggtgtcggccccggcggctccccgaccgtgcccggctgtggcgaggcggctccagcccagcctgtggcagccgcgacccccggggcgctccggagcccactgcgcggcgcgcgtgccggctgcctgcatggacgcggcactgaagcggagccgctcggaggagccagccgaaatcctgccgcctgcccgggacgaggaggaggaggaggaagaggggatggagcaggggctggaggaggaagaagaggtggatccccggatccagggagaactggagaagttaaatcagtccacggatgatatcaacagacgggagactgaacttgaggatgctcgtcagaagttccgctctgttctggttgaagcaacggtgaaactggatgaactggtgaagaaaattggcaaagctgtggaagactccaagccctactgggaggcacggagggtggcgaggcaggctcagctggaagctcagaaagccacgcaggacttccagagggccacagaggtgctccgtgccgccaaggagaccatctccctggccgagcagcggctgctggaggatgacaagcggcagttcgactccgcctggcaggagatgctgaatcacgccactcagagggtcatggaggcggagcagaccaagaccaggagcgagctggtgcataaggagacggcagccaggtacaatgccgccatgggccgcatgcgacagctggagaagaaactcaagagagccatcaacaagtccaagccttattttgaactcaaggcaaagtactatgtgcagctcgagcaactgaaaaagactgtggatgacctgcaggccaaactgaccctggcaaaaggcgagtacaagatggccctgaagaacctggagatgatctcagatgagatccacgagcggcggcgctccagtgccatggggcctcggggatgcggtgttggtgctgagggcagcagcacatctgtggaggatctgccagggagcaaacctgagcctgatgccatttctgtggcctcggaggcctttgaagatgacagctgtagcaactttgtgtctgaagatgactcggaaacccagtccgtgtccagctttagttcaggaccaacaagcccgtctgagatgcctgaccagttccctgcggttgtgaggcctggcagcctggatctgcccagccctgtgtccctgtcagagtttgggatgatgttcccagtgttgggccctcgaagtgaatgcagcggggcctcctcccctgaatgtgaagtagaacgaggagacagggcagaaggggcagagaataaaacaagtgacaaagccaacaacaaccggggcctcagcagtagcagtggcagtggtggcagcagtaagagccaaagcagcacctcccctgagggccaggccttggagaaccggatgaagcagctctccctacagtgctcaaagggaagagatggaattattgctgacataaaaatggtgcagattggctgattcatcctgggccctggccgatgtgcatatcaacatttatacatggaactggagaacattgtgccaataatcatttaatatatgccaaatcttacacgtctactctaaactgctctaatgaagtttcagtgaccttgagggctacgttgttgttggtacgacttagactagattcccaaccttttgtggacaattccgtttaccgtctttgtggaaca

SEQ ID NO: 365088 - DNA, 875 bp, Homo sapiens
agcgggcgcccatttcctctgctccgccgcggccggaggtatccgcatcggcgagctgcgtctcccgggtgtcggccccggcggctccccgaccgtgcccggctgtggcgaggcggctccagcccagcctgtggcagccgcgacccccggggcgctccggagcccactgcgcggcgcgcgtgccggctgcctgcatggacgcggcactgaagcggagccgctcggaggagccagccgaaatcctgccgcctgcccgggacgaggaggaggaggaggaagaggggatggagcaggggctggaggaggaagaagaggtggatccccggatccagggagaactggagaagttaaatcagtccacggatgatatcaacagacgggagactgaacttgaggatgctcgtcagaagttccgctctgttctggttgaagcaacggtgaaactggatgaactggtgaagaaaattggcaaagctgtggaagactccaagccctactgggaggcacggagggtggcgaggcaggctcagctggaagctcagaaagccacgcaggacttccagagggccacagaggtgctccgtgccgccaaggagaccatctccctggccgagcagcggctgctggaggatgacaagcggcagttcgactccgcctggcaggagatgctgaatcacgccactcagagggtcatggaggcggagcagaccaagaccaggagcgagctggtgcataaggagacggcagccaggtacaatgccgccatgggccgcatgcgacagctggagaagaaactcaagagagccatcaacaagtccaagtaagtctggacagggccttccctggggccgtgcggctgtcctagtctgcatctt

SEQ ID NO: 365089 - DNA, 1908 bp, Homo sapiens
gctttttttacagaaaagtacttgcaggagcatcctgaagaccaggagaaggttgagctgctaaagcgactaatagcattacagatgcccctgctaacagaagggatccgcatccatggggagaaactcacagagcagctgaagccgctgcatgagcggttgtcttcttgcttccgggaactcaaggagaaagtagaaaagcactatggggttataacactgccacccaacttgacggagaggaagcaaagccgcacggggtctattgtgctcccctacatcatgtcttccactctgcggaggttgtccatcacctcagtcacttcctctgtggtttccacctcttcaaactcgtctgacaatgctccttccagaccgggatctgatggctcaatcttggagccacttttggagcgcagggcctcgtcaggtgccagagttgaagatctgtcccttagagaggagaacagcgagaaccggatcagcaagtttaagagaaaagactggagtctgagcaagtcccaggtcattgcagagaaagcaccagaacccgatttgatgagcccaaccagaaaagcacaaaggccaaagagtctccagttgatggataatcggctatcaccatttcacggttcttcacctcctcagtcaacacccttgagcccacctccactcactcccaaagccaccaggaccctaagctccccatcgttgcagacagatggaatcgcggccactcctgtcccacctccacctccccccaaaagcaagccctatgaaggcagccagaggaactccactgagctcgctcccccactgcctgtccgaagagaagccaaagcaccaccccctccacctccaaaggctcggaagtctggcatccctacttccgagcctggatcccagtaaggatcttgccctccctgcaacaccgagtgccttagacagctgctgcctgagaactggcctccagccggtgtcctcattccatggggctccctgctgactgcatttcctgatctgggatgatgtttaccagcccaaaaccagtcatgttcttccaaaagcttctctttgatagaattttgaggccatgccacctcccttccagtccacatggaattccagaatcagtcacagcctctgattttttccaagaagagattgccttcaccattgttaaatgtcagcctgtacggcagagacatggtggtctgcacaagcctggacaagttcttccatattgatggtggagcaacccctgtaatctactccttggaaggattttttgctttgcttatgaaaagctgtgcttgagacttaggtacttttctcacgtggacacactgatcccatcccatattgcatctttgaagagatggatatcaagtacactttggtagctgaaataatcatatctttctgatgtctattgtatctcctttgaggaaaagaacacacatttttaatggagattggctgctttcaggtatgtgtgtctatcattgaaagagcatggactcaaacatcagccctgagttcttgagtccacccaactcccatcttcttgtggcacaggaaagctgccctctccctctcccaccacactcctgactaatggccttcactgcgtcgcagtcactccttccctacggacttctttgaagctcttccttttgcacatacggctttttttttttttttttttttgtcctattacctcctctgagcgcaaatcactggctacaagggacttaccagtctggattcagcagtttcttttctaaaacccatttgggtgactcagcagccgcatctgctacctgattttatcctggagaatacagtgcaatatttctctttgattatttattcctcttgattgtggaattaatttgattgcttgct

SEQ ID NO: 365090 - DNA, 2629 bp, Homo sapiens
cagttacagtttcctggagggagtggatattttcctaagcacttgggctatatcagagaacagaataataccatacattccagaaaatgttgtcatcttcagcttaatactaaaaccctgaacaaaaaaagttttggccaggcacggtagctcacgcctgtaatcccagcactttgggaggccgaggcaggtgaatcacgaggtcaggagatcgagatcatcctggctacagtgaaaccccatctgtactaaaaaatacaaaaaattagctgggcgtgatggtgggtgcctgtagtcccagctacctgggaggctgaggcaggagaatggcgtgaacccgggaggcggagcttgcagtgagctgagatcgcgccactgcactccaacctgggcaacagagcgagactccatctcaaaaaaacaaaaataaaaaaaataaagtttttgcttcagaacaccttgtggagctcttgaaacttctggcgagggcgtcacctgtgtgatgtggggtaagaagtcttcttcgttctatccgcagaaaccatagaatgtggctttcatcagttggttgaccaggttggcttaggtgttacagtgccagcaacatttccatgagcttccttgctcagtgcctctctctgccgcctgcactttctgtcatttctaggctccccatcgttgcagacagatggaatcgcggccactcctgtcccacctccacctccccccaaaagcaagccctatgaaggcagccagaggaactccactgagctcgctcccccactgcctgtccgaagagaagccaaagcaccaccccctccacctccaaaggctcggaagtctggcatccctacttccgagcctggatcccagtaaggatcttgccctccctgcaacaccgagtgccttagacagctgctgcctgagaactggcctccagccggtgtcctcattccatggggctccctgctgactgcatttcctgatctgggatgatgtttaccagcccaaaaccagtcatgttcttccaaaagcttctctttgatagaattttgaggccatgccacctcccttccagtccacatggaattccagaatcagtcacagcctctgattttttccaagaagagattgccttcaccattgttaaatgtcagcctgtacggcagagacatggtggtctgcacaagcctggacaagttcttccatattgatggtggagcaacccctgtaatctactccttggaaggattttttgctttgcttatgaaaagctgtgcttgagacttaggtacttttctcacgtggacacactgatcccatcccatattgcatctttgaagagatggatatcaagtacactttggtagctgaaataatcatatctttctgatgtctattgtatctcctttgaggaaaagaacacacatttttaatggagattggctgctttcaggtatgtgtgtctatcattgaaagagcatggactcaaacatcagccctgagttcttgagtccacccaactcccatcttcttgtggcacaggaaagctgccctctccctctcccaccacactcctgactaatggccttcactgcgtcgcagtcactccttccctacggacttctttgaagctcttccttttgcacatacggctttttttttttttttttttttgtcctattacctcctctgagcgcaaatcactggctacaagggacttaccagtctggattcagcagtttcttttctaaaacccatttgggtgactcagcagccgcatctgctacctgattttatcctggagaatacagtgcaatatttctctttgattatttattcctcttgattgtggaattaatttgattgcttgctaatggtactagtagtactcctttcagaagaaaaaatggagcgatttaggtgaccaaatattacatacataaatagccacatgaagttttagacgtttggacttgaagcctcaaagatcaaccaaccagtccccttatttagtaaataaggaaattgaggctacacacagaaaattgtgctacagattattactaataacccagcttgctaaattaggctatacctaggtaatctctagaagacaactctgacagactctttaatatttacccctggttggaacaatatttgaaatgtcccagatatttctatgctacttagatatttgtggcaaagcagaaagctttttgactgtgaaggcagaggtcagcactgggggaaacttgctggtggtctctcccacaaccttgcccagagtcctttccactaaggaggtgaagagaacagagaaagagatttccatttctgctgccagagctggtatttgcctgcctgattctctgtgtttcctgtttcaccgccaccctttcaggagagaactacaccagttcatcatgagggtcagggaagcaaaagctctcagatgtgtccagggcgttacttaagaaatgagtatgcagattctggaaggggtgtggaaaaggtgatcctttacccccacccaggaaaacctgcattgtgctagcatggaagaatcatgggctttggaattaaacccatttggtggaattaaacccatttggtttcaaatccc

SEQ ID NO: 365091 - DNA, 2976 bp, Homo sapiens
cagttacagtttcctggagggagtggatattttcctaagcacttgggctatatcagagaacagaataataccatacattccagaaaatgttgtcatcttcagcttaatactaaaaccctgaacaaaaaaagttttggccaggcacggtagctcacgcctgtaatcccagcactttgggaggccgaggcaggtgaatcacgaggtcaggagatcgagatcatcctggctacagtgaaaccccatctgtactaaaaaatacaaaaaattagctgggcgtgatggtgggtgcctgtagtcccagctacctgggaggctgaggcaggagaatggcgtgaacccgggaggcggagcttgcagtgagctgagatcgcgccactgcactccaacctgggcaacagagcgagactccatctcaaaaaaacaaaaataaaaaaaataaagtttttgcttcagaacaccttgtggagctcttgaaacttctggcgagggcgtcacctgtgtgatgtggggtaagaagtcttcttcgttctatccgcagaaaccatagaatgtggctttcatcagttggttgaccaggttggcttaggtgttacagtgccagcaacatttccatgagcttccttgctcagtgcctctctctgccgcctgcactttctgtcatttctaggctccccatcgttgcagacagatggaatcgcggccactcctgtcccacctccacctccccccaaaagcaagccctatgaaggcagccagaggaactccactgagctcgctcccccactgcctgtccgaagagaagccaaagcaccaccccctccacctccaaaggctcggaagtctggcatccctacttccgagcctggatcccagtaaggatcttgccctccctgcaacaccgagtgccttagacagctgctgcctgagaactggcctccagccggtgtcctcattccatggggctccctgctgactgcatttcctgatctgggatgatgtttaccagcccaaaaccagtcatgttcttccaaaagcttctctttgatagaattttgaggccatgccacctcccttccagtccacatggaattccagaatcagtcacagcctctgattttttccaagaagagattgccttcaccattgttaaatgtcagcctgtacggcagagacatggtggtctgcacaagcctggacaagttcttccatattgatggtggagcaacccctgtaatctactccttggaaggattttttgctttgcttatgaaaagctgtgcttgagacttaggtacttttctcacgtggacacactgatcccatcccatattgcatctttgaagagatggatatcaagtacactttggtagctgaaataatcatatctttctgatgtctattgtatctcctttgaggaaaagaacacacatttttaatggagattggctgctttcaggtatgtgtgtctatcattgaaagagcatggactcaaacatcagccctgagttcttgagtccacccaactcccatcttcttgtggcacaggaaagctgccctctccctctcccaccacactcctgactaatggccttcactgcgtcgcagtcactccttccctacggacttctttgaagctcttccttttgcacatacggctttttttttttttttttttttgtcctattacctcctctgagcgcaaatcactggctacaagggacttaccagtctggattcagcagtttcttttctaaaacccatttgggtgactcagcagccgcatctgctacctgattttatcctggagaatacagtgcaatatttctctttgattatttattcctcttgattgtggaattaatttgattgcttgctaatggtactagtagtactcctttcagaagaaaaaatggagcgatttaggtgaccaaatattacatacataaatagccacatgaagttttagacgtttggacttgaagcctcaaagatcaaccaaccagtccccttatttagtaaataaggaaattgaggctacacacagaaaattgtgctacagattattactaataacccagcttgctaaattaggctatacctaggtaatctctagaagacaactctgacagactctttaatatttacccctggttggaacaatatttgaaatgtcccagatatttctatgctacttagatatttgtggcaaagcagaaagctttttgactgtgaaggcagaggtcagcactgggggaaacttgctggtggtctctcccacaaccttgcccagagtcctttccactaaggaggtgaagagaacagagaaagagatttccatttctgctgccagagctggtatttgcctgcctgattctctgtgtttcctgtttcaccgccaccctttcaggagagaactacaccagttcatcatgagggtcagggaagcaaaagctctcagatgtgtccagggcgttacttaagaaatgagtatgcagattctggaaggggtgtggaaaaggtgatcctttacccccacccaggaaaacctgcattgtgctagcatggaagaatcatgggctttggaattaaacccatttggtggaattaaacccatttggtttcaaatcccagttatgacatctgttaactttgcaaactcacaaaaattatttgaaattatctgagttttcattttctcaccttccagaatggggataatgcctcctgcatcggttgttgtgaggtttcaatgagatgaaatatgggaaagaagaggtactcacctgatggtccctgctttcctctgctaggctctgagtaggaactggaactctctaagagcattactcatactttttttttcttccaaggtagtttggaatgtgagtgcaagttagttctgcacatacagcccttctccaaatggtggtttcctttgaggtcttttacatgattatttatgactagagacaaact

SEQ ID NO: 365092 - DNA, 1639 bp, Homo sapiens
gctttttttacagaaaagtacttgcaggagcatcctgaagaccaggagaaggttgagctgctaaagcgactaatagcattacagatgcccctgctaacagaagggatccgcatccatggggagaaactcacagagcagctgaagccgctgcatgagcggttgtcttcttgcttccgggaactcaaggagaaagtagaaaagcactatggggttataacactgccacccaacttgacggagaggaagcaaagccgcacggggtctattgtgctcccctacatcatgtcttccactctgcggaggttgtccatcacctcagtcacttcctctgtggtttccacctcttcaaactcgtctgacaatgctccttccagaccgggatctgatggctcaatcttggagccacttttggagcgcagggcctcgtcaggtgccagagttgaagatctgtcccttagagaggagaacagcgagaaccggatcagcaagtttaagagaaaagactggagtctgagcaagtcccaggtcattgcagagaaagcaccagaacccgatttgatgagcccaaccagaaaagcacaaaggccaaagagtctccagttgatggataatcggctatcaccatttcacggttcttcacctcctcagtcaacacccttgagcccacctccactcactcccaaagccaccaggaccctaagctccccatcgttgcagacagatggaatcgcggccactcctgtcccacctccacctccccccaaaagcaagccctatgaaggcagccagaggaactccactgagctcgctcccccactgcctgtccgaagagaagccaaagcaccaccccctccacctccaaaggctcggaagtctggcatccctacttccgagcctggatcccagtaaggatcttgccctccctgcaacaccgagtgccttagacagctgctgcctgagaactggcctccagccggtgtcctcattccatggggctccctgctgactgcatttcctgatctgggatgatgtttaccagcccaaaaccagtcatgttcttccaaaagcttctctttgatagaattttgaggccatgccacctcccttccagtccacatggaattccagaatcagtcacagcctctgattttttccaagaagagattgccttcaccattgttaaatgtcagcctgtacggcagagacatggtggtctgcacaagcctggacaagttcttccatattgatggtggagcaacccctgtaatctactccttggaaggattttttgctttgcttatgaaaagctgtgcttgagacttaggtacttttctcacgtggacacactgatcccatcccatattgcatctttgaagagatggatatcaagtacactttggtagctgaaataatcatatctttctgatgtctattgtatctcctttgaggaaaagaacacacatttttaatggagattggctgctttcaggttgtggatcacatcattgcctaattttattaaagacggagtgaagaaattatttgattccactttagagactcttccaatggaggtatttgggaaacctgtcattgtgcagtagcaaatatttgtattaaaaagaggcggttttccccc

SEQ ID NO: 365093 - DNA, 2091 bp, Homo sapiens
ggactagtgctggtggctttgggagtgagttgatggataatcggctatcaccatttcacggttcttcacctcctcagtcaacacccttgagcccacctccactcactcccaaagccaccaggaccctaagctccccatcgttgcagacagatggaatcgcggccactcctgtcccacctccacctccccccaaaagcaagccctatgaaggcagccagaggaactccactgagctcgctcccccactgcctgtccgaagagaagccaaagcaccaccccctccacctccaaaggctcggaagtctggcatccctacttccgagcctggatcccagtaaggatcttgccctccctgcaacaccgagtgccttagacagctgctgcctgagaactggcctccagccggtgtcctcattccatggggctccctgctgactgcatttcctgatctgggatgatgtttaccagcccaaaaccagtcatgttcttccaaaagcttctctttgatagaattttgaggccatgccacctcccttccagtccacatggaattccagaatcagtcacagcctctgattttttccaagaagagattgccttcaccattgttaaatgtcagcctgtacggcagagacatggtggtctgcacaagcctggacaagttcttccatattgatggtggagcaacccctgtaatctactccttggaaggattttttgctttgcttatgaaaagctgtgcttgagacttaggtacttttctcacgtggacacactgatcccatcccatattgcatctttgaagagatggatatcaagtacactttggtagctgaaataatcatatctttctgatgtctattgtatctcctttgaggaaaagaacacacatttttaatggagattggctgctttcaggtatgtgtgtctatcattgaaagagcatggactcaaacatcagccctgagttcttgagtccacccaactcccatcttcttgtggcacaggaaagctgccctctccctctcccaccacactcctgactaatggccttcactgcgtcgcagtcactccttccctacggacttctttgaagctcttccttttgcacatacggctttttttttttttttttttttgtcctattacctcctctgagcgcaaatcactggctacaagggacttaccagtctggattcagcagtttcttttctaaaacccatttgggtgactcagcagccgcatctgctacctgattttatcctggagaatacagtgcaatatttctctttgattatttattcctcttgattgtggaattaatttgattgcttgctaatggtactagtagtactcctttcagaagaaaaaatggagcgatttaggtgaccaaatattacatacataaatagccacatgaagttttagacgtttggacttgaagcctcaaagatcaaccaaccagtccccttatttagtaaataaggaaattgaggctacacacagaaaattgtgctacagattattactaataacccagcttgctaaattaggctatacctaggtaatctctagaagacaactctgacagactctttaatatttacccctggttggaacaatatttgaaatgtcccagatatttctatgctacttagatatttgtggcaaagcagaaagctttttgactgtgaaggcagaggtcagcactgggggaaacttgctggtggtctctcccacaaccttgcccagagtcctttccactaaggaggtgaagagaacagagaaagagatttccatttctgctgccagagctggtatttgcctgcctgattctctgtgtttcctgtttcaccgccaccctttcaggagagaactacaccagttcatcatgagggtcagggaagcaaaagctctcagatgtgtccagggcgttacttaagaaatgagtatgcagattctggaaggggtgtggaaaaggtgatcctttacccccacccaggaaaacctgcattgtgctagcatggaagaatcatgggctttggaattaaacccatttggtggaattaaacccatttggtttcaaatccc

SEQ ID NO: 365094 - DNA, 727 bp, Homo sapiens
cgcctgtctgtcgccttggcaacgggacgcataagcacgcgaggcgcgcggtggcggtttggatctggcccctggggaatcgcgttatgtcgcgaccgaagatgacatcattgtatccagagaaaactcaaaggatttacaaactaccagaactaatcattcagcaagggcatcaaatacaagaaccaaaattacaagggccatggattgtcaaagggaaaagagcgagagcagagagcatcgatccggttcaagaccaccctcatgaacacactcatggacgtccttcgccacaggccaggatgggtggaagtgaaggagacacaagaagctctgacgaccagaaagatgatattcccgtggagaactatgtggctcagcgttacattgaaaatccttacctgataggaggccgcaagtttgacctgcgtgtctatgtgctggtgatgtcgtacatcccgctgcgggcctggctctaccgggatggctttgcccgattctccaacacccgcttcacactgaacagcattgatgaccagtatgttcacctcaccaacgtggctgtgcaaaaaacatctcccgactaccacccaaagaagggctgcaagtggacgctgcagcgcttccggcagtacctggcgtccaaacacgggcccgaggcagtggagacactcttcagggacatcgacaacatctttgtcaaaagcctgcagagtgtgcagaaggt

SEQ ID NO: 365095 - DNA, 3090 bp, Homo sapiens
  misc_feature (2679)..(2679): n is a, c, g, or t
  misc_feature (2835)..(2835): n is a, c, g, or t
  misc_feature (2923)..(2923): n is a, c, g, or t
  misc_feature (2938)..(2938): n is a, c, g, or t
  misc_feature (2970)..(2970): n is a, c, g, or t
  misc_feature (2985)..(2985): n is a, c, g, or t
  misc_feature (2991)..(2991): n is a, c, g, or t
  misc_feature (2998)..(2998): n is a, c, g, or t
  misc_feature (3034)..(3034): n is a, c, g, or t
  misc_feature (3049)..(3049): n is a, c, g, or t
  misc_feature (3059)..(3059): n is a, c, g, or t
cgcctgtctgtcgccttggcaacgggacgcataagcacgcgaggcgcgcggtggcggtttggatctggcccctggggaatcgcgttatgtcgcgaccgaagaaccaaaattacaagggccatggattgtcaaagggaaaagagcgagagcagagagcatcgatccggttcaagaccaccctcatgaacacactcatggacgtccttcgccacaggccaggatgggtggaagtgaaggacgaaggggagtgggatttctactggtgtgacgtcagctggctccgggagaacttcgaccacacctacatggatgaacatgtgcggatcagtcacttccggaaccactatgagctgacccggaagaactacatggtgaagaacctgaagcggttccggaagcagctggagcgtgaggcaggaaagctggaggcagccaagtgtgacttcttccccaaaacctttgagatgccttgcgagtaccacctgtttgtagaggagtttcgcaaaaacccaggaatcacctggatcatgaagcctgacacaagaagctctgacgaccagaaagatgatattcccgtggagaactatgtggctcagcgttacattgaaaatccttacctgataggaggccgcaagtttgacctgcgtgtctatgtgctggtgatgtcgtacatcccgctgcgggcctggctctaccgggatggctttgcccgattctccaacacccgcttcacactgaacagcattgatgaccagtatgttcacctcaccaacgtggctgtgcaaaaaacatctcccgactaccacccaaagaaggtggctcctggaggtcaatgcgtccccatcactgacagccagcagccaggaagactatgagctcaagacctgcctcctggaagacaccctgcatgttgtggacatggaagcgagagaagtttgagggctgattctccttgctggtaactgggacacattcccattcctaaaccactcactgtgactctgcttgaccaggctcacgggaagggagaagcgagtcgggggctttgacctcatgtggaatgatggccctgttagcagagaggagggggctcctgacctgtcgggaatgggaaactttgtgaccaacacacatctcggtatgtagggccaggtggggagtgggcacaagggatggggtcatgggaggtaccaggtagtctaggaggcagcttgggatagtggttagattgtttgaattcaatctgcaacttaccagctgtgtgaccttgggcaagggacttaacctctgttcctcgtttttaaacttggtttctaaaaagtgaaaactttccctgattataaaaaagggattcacactcattgtagaatatttgaaaactagagaaagaaataaaaacatccagacataagcatctttaacaatctggtgtatttccttccagttcttaaaaaatgcatatattcatactttttcttttataaaattggcattgggctagagttttgaatccctcttttccccttggcatttttcattcaagcatattaagagcctccctcttgaatgcactttttggtccagtccggatgaaatcttttacatacattatctcattttatctttaaggagtttttattgtcattttacagatgaggaaatgatatccaggtgctatgtaacttgctgaatgaaggttttggccataagtggtgagccaggactcaaactcccatctgcctggctccaaaacttgagtgcttgtccgctagactctcctgcctcttggcagagtttaaaaaaattaccatatggctgcaaaatatttcagtttgtacatatgccaaaatttactaaaccaatttcttataattggacatttggcacaattgcattttattttttttttacttttataaattataccatgatgaacatcctttcacattaagctcggctgaaattctggccatttcctgaggacagattcctagaagcagaattattgggccaaagggatgggattattacaaccaaatttctttccagaaagattatacgaatttgtcagatttgaatttttagaaaaaagaaatctgtgccaactggtgaggtaaaacatactgactcgttgttttatgtgcattccattgattactggtgaggtttccgttttttaaatttgcatttcttcttttgtaagctgtccatactctttatccatttttctatgggttgtttagttttctaaatgtataaggcttcagatgactatataacactgtccaagcttaatttaatatgcatacaatcacctggaaatcttgttaaactatagattgtgactccataggtctagggtggggcctaagattgtatttctaacaagctcctgggtgatgctctattgattaaccattgctgtgtaacaagccctcccaaaacctagcagcttaaagcaactattttatttgctcatccttcctcaggtctctcctggggtcacttatagggctgcaggcacctggcagatttactggagacttgatggtgtacgacagcctcattcataggtgtgggggttgatactggctgtcagttgggcctctctttccatgtggccactcgtcttccaacagtctggccctggcttcttcacgtggtagactcggggttctnagagggtgagaaaacacactgcaaagccttttgcggcccggactcagaagtcccataaagtcattctgctacaatcaaagcatttgctggtgtagcccagtcactgggtaagaaaatagaccccacctcgccgggcgcggtggctcacgcctgtantcccaacactttgggaggccgaggcgggcggatcatgaggtcaggagagcgaaaccatcctggctaacacggtgaaacactgtctctnctaaaaaatacaaanaaattagccaggcgtgctggcgggcgcctgtngtcagctactcgggnggctgnggcaggngaatggcgtgaacccgggaggcggagcttgcagtgngccgagattgcgccnctgcactccngcctgggcgacagagcgagactgtctcacac

SEQ ID NO: 365096 - DNA, 1381 bp, Homo sapiens
tgggggcgggggccttaccccaccctggcaccggcaggcgcgggcggatggggggatgtcgcctagagccccccggccggcccacaaactcccgtcccccttccggctctgcctggacgtccctgcgggccccgggggaaagcacccaacttctcccgcctcggcttctagcagaaacgtgacggggctggactttgatcgccgagggctctctgctcttcagagtctgcttggaacgggataagtgggagggatggtgccatccagggaagctctgctgggaccaggcacaactgccattaggtgccccaagaaattacagatgacatcattgtatccagagaaaactcaaaggatttacaaactaccagaactaatcattcagcaagggcatcaaatacaagaaccaaaattacaagggccatggattgtcaaagggaaaagagcgagagcagagagcatcgatccggttcaagaccaccctcatgaacacactcatggacgtccttcgccacaggccaggatgggtggaagtgaaggacgaaggggagtgggatttctactggtgtgacgtcagctggctccgggagaacttcgaccacacctacatggatgaacatgtgcggatcagtcacttccggaaccactatgagctgacccggaagaactacatggtgaagaacctgaagcggttccggaagcagctggagcgtgaggcaggaaagctggaggcagccaagtgtgacttcttccccaaaacctttgagatgccttgcgagtaccacctgtttgtagaggagtttcgcaaaaacccaggaatcacctggatcatgaagcctgtagcccggtctcaagggaaaggcatcttcctcttccgtaggctgaaggacatcgtggactggaggaaggacacaagaagctctgacgaccagaaagatgatattcccgtggagaactatgtggctcagcgttacattgaaaatccttacctgataggaggtgagatggctgtgtctgctcctgctcttccattgcatggtcatcaaacagtcagtcaacaagctttgaccagcagcctgccaagggcccagcctgacaccaggcatgaagggatgcatggaaagagatgggttctgcagtctcccacctcctagccattgcctgtacagttccctctgcccggcatgtccattccactcccttcttggttcagaaaaattctcctcctttaaaaaccaacttattcatgcgtttatccaacaaatattataaagcacctacttggtggcagcactgccctgaatactggctgcccctcaccctgctctcctggagcttacacctgtgatgagcaggctgcaataaaccagaatacaaacca

SEQ ID NO: 365097 - DNA, 3315 bp, Homo sapiens
  misc_feature (2904)..(2904): n is a, c, g, or t
  misc_feature (3060)..(3060): n is a, c, g, or t
  misc_feature (3148)..(3148): n is a, c, g, or t
  misc_feature (3163)..(3163): n is a, c, g, or t
  misc_feature (3195)..(3195): n is a, c, g, or t
  misc_feature (3210)..(3210): n is a, c, g, or t
  misc_feature (3216)..(3216): n is a, c, g, or t
  misc_feature (3223)..(3223): n is a, c, g, or t
  misc_feature (3259)..(3259): n is a, c, g, or t
  misc_feature (3274)..(3274): n is a, c, g, or t
  misc_feature (3284)..(3284): n is a, c, g, or t
tgggggcgggggccttaccccaccctggcaccggcaggcgcgggcggatggggggatgtcgcctagagccccccggccggcccacaaactcccgtcccccttccggctctgcctggacgtccctgcgggccccgggggaaagcacccaacttctcccgcctcggcttctagcagaaacgtgacggggctggactttgatcgccgagggctctctgctcttcagagtctgcttggaacgggataagtgggagggatggtgccatccagggaagctctgctgggaccaggcacaactgccattaggtgccccaagaaattacagatgacatcattgtatccagagaaaactcaaaggatttacaaactaccagaactaatcattcagcaagggcatcaaatacaagaaccaaaattacaagggccatggattgtcaaagggaaaagagcgagagcagagagcatcgatccggttcaagaccaccctcatgaacacactcatggacgtccttcgccacaggccaggatgggtggaagtgaaggacgaaggggagtgggatttctactggtgtgacgtcagctggctccgggagaacttcgaccacacctacatggatgaacatgtgcggatcagtcacttccggaaccactatgagctgacccggaagaactacatggtgaagaacctgaagcggttccggaagcagctggagcgtgaggcaggaaagctggaggcagccaagtgtgacttcttccccaaaacctttgagatgccttgcgagtaccacctgtttgtagaggagtttcgcaaaaacccaggaatcacctggatcatgaagcctgtagcccggtctcaagggaaaggcatcttcctcttccgtaggctgaaggacatcgtggactggaggaaggacacaagaagctctgacgaccagaaagatgatattcccgtggagaactatgtggctcagcgttacattgaaaatccttacctgataggaggccgcaagtttgacctgcgtgtctatgtgctggtgatgtcggtggctcctggaggtcaatgcgtccccatcactgacagccagcagccaggaagactatgagctcaagacctgcctcctggaagacaccctgcatgttgtggacatggaagcgagagaagtttgagggctgattctccttgctggtaactgggacacattcccattcctaaaccactcactgtgactctgcttgaccaggctcacgggaagggagaagcgagtcgggggctttgacctcatgtggaatgatggccctgttagcagagaggagggggctcctgacctgtcgggaatgggaaactttgtgaccaacacacatctcggtatgtagggccaggtggggagtgggcacaagggatggggtcatgggaggtaccaggtagtctaggaggcagcttgggatagtggttagattgtttgaattcaatctgcaacttaccagctgtgtgaccttgggcaagggacttaacctctgttcctcgtttttaaacttggtttctaaaaagtgaaaactttccctgattataaaaaagggattcacactcattgtagaatatttgaaaactagagaaagaaataaaaacatccagacataagcatctttaacaatctggtgtatttccttccagttcttaaaaaatgcatatattcatactttttcttttataaaattggcattgggctagagttttgaatccctcttttccccttggcatttttcattcaagcatattaagagcctccctcttgaatgcactttttggtccagtccggatgaaatcttttacatacattatctcattttatctttaaggagtttttattgtcattttacagatgaggaaatgatatccaggtgctatgtaacttgctgaatgaaggttttggccataagtggtgagccaggactcaaactcccatctgcctggctccaaaacttgagtgcttgtccgctagactctcctgcctcttggcagagtttaaaaaaattaccatatggctgcaaaatatttcagtttgtacatatgccaaaatttactaaaccaatttcttataattggacatttggcacaattgcattttattttttttttacttttataaattataccatgatgaacatcctttcacattaagctcggctgaaattctggccatttcctgaggacagattcctagaagcagaattattgggccaaagggatgggattattacaaccaaatttctttccagaaagattatacgaatttgtcagatttgaatttttagaaaaaagaaatctgtgccaactggtgaggtaaaacatactgactcgttgttttatgtgcattccattgattactggtgaggtttccgttttttaaatttgcatttcttcttttgtaagctgtccatactctttatccatttttctatgggttgtttagttttctaaatgtataaggcttcagatgactatataacactgtccaagcttaatttaatatgcatacaatcacctggaaatcttgttaaactatagattgtgactccataggtctagggtggggcctaagattgtatttctaacaagctcctgggtgatgctctattgattaaccattgctgtgtaacaagccctcccaaaacctagcagcttaaagcaactattttatttgctcatccttcctcaggtctctcctggggtcacttatagggctgcaggcacctggcagatttactggagacttgatggtgtacgacagcctcattcataggtgtgggggttgatactggctgtcagttgggcctctctttccatgtggccactcgtcttccaacagtctggccctggcttcttcacgtggtagactcggggttctnagagggtgagaaaacacactgcaaagccttttgcggcccggactcagaagtcccataaagtcattctgctacaatcaaagcatttgctggtgtagcccagtcactgggtaagaaaatagaccccacctcgccgggcgcggtggctcacgcctgtantcccaacactttgggaggccgaggcgggcggatcatgaggtcaggagagcgaaaccatcctggctaacacggtgaaacactgtctctnctaaaaaatacaaanaaattagccaggcgtgctggcgggcgcctgtngtcagctactcgggnggctgnggcaggngaatggcgtgaacccgggaggcggagcttgcagtgngccgagattgcgccnctgcactccngcctgggcgacagagcgagactgtctcacac

SEQ ID NO: 365098 - DNA, 510 bp, Homo sapiens
cggttcaagaccaccctcatgaacacactcatggacgtccttcgccacaggccaggatgggtggaagtgaaggagtaagaccctccccccagccttgtccctccttccctttgtctcacaggtccttgtcttcctttgtttttctcccagttcccctgggtggccactgggacttgtcccaaagtggctgtgacatttatttagcacccacaatgtgccaggcacattatcactatcatctctgtcttatttaagccttccaactaaaccgtaagataagattatgttcagagttaggaaaccaattgcttaaggtcacacagcattgtaagcatcagagcaggattcaaacccaggcacgtttgtgtcctgtggttttcagtagaaactaggaatgtagctaccacagacctgtggcctggatcctccagtgacgggtccagatcaaggactgctcttccctggccacttgctagttctgtgactttggcctgtaagcctacctttctt

SEQ ID NO: 365099 - DNA, 704 bp, Homo sapiens
gagacagccaatcactgggactgggggaggtttaaccttgacaaactgacttggcagttaggcccaaagagaacaaatacagcaagttctgctacccccaggagatcatatctaataaatgagcacaggccctacttggagtcactgggcaccaggcctggttccggggatactgttggctgcagccaagtcctcctggctttgacacttggatacctcccaagtcagtgctgaaaaggtccttcaggagcaagagtttggaggctaaggaactcgtctttaagctgtgcttacacagcaagcagttattagattgtgtgtttattgggggcctggggaagtactgagccctaaacacatcctcttctccttgcatgtcaggggagcccatggggctccctgaccatcatctgaaaaccagtgggacagggcatccccatttctcagatggacaagacagaccagggaggcagagcttagtgagggtctctgcaaaggtgcatttatctaagtcagatgggtgacttaagtgcttctctaggccttgtgtttgagattgggagctgagccagaaaccggaaaaccctgggctcatgggcaggacagcttcgggagttgagtgtgagtaaaaatctgccttttcacatcttacattgctaagcttcctcttggtttaagaggggttgcaacaagactcggggctg

SEQ ID NO: 365100 - DNA, 3462 bp, Homo sapiens
  misc_feature (3051)..(3051): n is a, c, g, or t
  misc_feature (3207)..(3207): n is a, c, g, or t
  misc_feature (3295)..(3295): n is a, c, g, or t
  misc_feature (3310)..(3310): n is a, c, g, or t
  misc_feature (3342)..(3342): n is a, c, g, or t
  misc_feature (3357)..(3357): n is a, c, g, or t
  misc_feature (3363)..(3363): n is a, c, g, or t
  misc_feature (3370)..(3370): n is a, c, g, or t
  misc_feature (3406)..(3406): n is a, c, g, or t
  misc_feature (3421)..(3421): n is a, c, g, or t
  misc_feature (3431)..(3431): n is a, c, g, or t
tgggggcgggggccttaccccaccctggcaccggcaggcgcgggcggatggggggatgtcgcctagagccccccggccggcccacaaactcccgtcccccttccggctctgcctggacgtccctgcgggccccgggggaaagcacccaacttctcccgcctcggcttctagcagaaacgtgacggggctggactttgatcgccgagggctctctgctcttcagagtctgcttggaacgggataagtgggagggatggtgccatccagggaagctctgctgggaccaggcacaactgccattaggtgccccaagaaattacagatgacatcattgtatccagagaaaactcaaaggatttacaaactaccagaactaatcattcagcaagggcatcaaatacaagaaccaaaattacaagggccatggattgtcaaagggaaaagagcgagagcagagagcatcgatccggttcaagaccaccctcatgaacacactcatggacgtccttcgccacaggccaggatgggtggaagtgaaggacgaaggggagtgggatttctactggtgtgacgtcagctggctccgggagaacttcgaccacacctacatggatgaacatgtgcggatcagtcacttccggaaccactatgagctgacccggaagaactacatggtgaagaacctgaagcggttccggaagcagctggagcgtgaggcaggaaagctggaggcagccaagtgtgacttcttccccaaaacctttgagatgccttgcgagtaccacctgtttgtagaggagtttcgcaaaaacccaggaatcacctggatcatgaagcctgtagcccggtctcaagggaaaggcatcttcctcttccgtaggctgaaggacatcgtggactggaggaaggacacaagaagctctgacgaccagaaagatgatattcccgtggagaactatgtggctcagcgttacattgaaaatccttacctgataggaggccgcaagtttgacctgcgtgtctatgtgctggtgatgtcgtacatcccgctgcgggcctggctctaccgggatggctttgcccgattctccaacacccgcttcacactgaacagcattgatgaccagtatgttcacctcaccaacgtggctgtgcaaaaaacatctcccgactaccacccaaagaaggtggctcctggaggtcaatgcgtccccatcactgacagccagcagccaggaagactatgagctcaagacctgcctcctggaagacaccctgcatgttgtggacatggaagcgagagaagtttgagggctgattctccttgctggtaactgggacacattcccattcctaaaccactcactgtgactctgcttgaccaggctcacgggaagggagaagcgagtcgggggctttgacctcatgtggaatgatggccctgttagcagagaggagggggctcctgacctgtcgggaatgggaaactttgtgaccaacacacatctcggtatgtagggccaggtggggagtgggcacaagggatggggtcatgggaggtaccaggtagtctaggaggcagcttgggatagtggttagattgtttgaattcaatctgcaacttaccagctgtgtgaccttgggcaagggacttaacctctgttcctcgtttttaaacttggtttctaaaaagtgaaaactttccctgattataaaaaagggattcacactcattgtagaatatttgaaaactagagaaagaaataaaaacatccagacataagcatctttaacaatctggtgtatttccttccagttcttaaaaaatgcatatattcatactttttcttttataaaattggcattgggctagagttttgaatccctcttttccccttggcatttttcattcaagcatattaagagcctccctcttgaatgcactttttggtccagtccggatgaaatcttttacatacattatctcattttatctttaaggagtttttattgtcattttacagatgaggaaatgatatccaggtgctatgtaacttgctgaatgaaggttttggccataagtggtgagccaggactcaaactcccatctgcctggctccaaaacttgagtgcttgtccgctagactctcctgcctcttggcagagtttaaaaaaattaccatatggctgcaaaatatttcagtttgtacatatgccaaaatttactaaaccaatttcttataattggacatttggcacaattgcattttattttttttttacttttataaattataccatgatgaacatcctttcacattaagctcggctgaaattctggccatttcctgaggacagattcctagaagcagaattattgggccaaagggatgggattattacaaccaaatttctttccagaaagattatacgaatttgtcagatttgaatttttagaaaaaagaaatctgtgccaactggtgaggtaaaacatactgactcgttgttttatgtgcattccattgattactggtgaggtttccgttttttaaatttgcatttcttcttttgtaagctgtccatactctttatccatttttctatgggttgtttagttttctaaatgtataaggcttcagatgactatataacactgtccaagcttaatttaatatgcatacaatcacctggaaatcttgttaaactatagattgtgactccataggtctagggtggggcctaagattgtatttctaacaagctcctgggtgatgctctattgattaaccattgctgtgtaacaagccctcccaaaacctagcagcttaaagcaactattttatttgctcatccttcctcaggtctctcctggggtcacttatagggctgcaggcacctggcagatttactggagacttgatggtgtacgacagcctcattcataggtgtgggggttgatactggctgtcagttgggcctctctttccatgtggccactcgtcttccaacagtctggccctggcttcttcacgtggtagactcggggttctnagagggtgagaaaacacactgcaaagccttttgcggcccggactcagaagtcccataaagtcattctgctacaatcaaagcatttgctggtgtagcccagtcactgggtaagaaaatagaccccacctcgccgggcgcggtggctcacgcctgtantcccaacactttgggaggccgaggcgggcggatcatgaggtcaggagagcgaaaccatcctggctaacacggtgaaacactgtctctnctaaaaaatacaaanaaattagccaggcgtgctggcgggcgcctgtngtcagctactcgggnggctgnggcaggngaatggcgtgaacccgggaggcggagcttgcagtgngccgagattgcgccnctgcactccngcctgggcgacagagcgagactgtctcacac

SEQ ID NO: 365101 - DNA, 2285 bp, Homo sapiens
tgggggcgggggccttaccccaccctggcaccggcaggcgcgggcggatggggggatgtcgcctagagccccccggccggcccacaaactcccgtcccccttccggctctgcctggacgtccctgcgggccccgggggaaagcacccaacttctcccgcctcggcttctagcagaaacgtgacggggctggactttgatcgccgagggctctctgctcttcagagtctgcttggaacgggataagtgggagggatggtgccatccagggaagctctgctgggaccaggcacaactgccattaggtgccccaagaaattacagatgacatcattgtatccagagaaaactcaaaggatttacaaactaccagaactaatcattcagcaagggcatcaaatacaagaaccaaaattacaagggccatggattgtcaaagggaaaagagcgagagcagagagcatcgatccggttcaagaccaccctcatgaacacactcatggacgtccttcgccacaggccaggatgggtggaagtgaaggacgaaggggagtgggatttctactggtgtgacgtcagctggctccgggagaacttcgaccacacctacatggatgaacatgtgcggatcagtcacttccggaaccactatgagctgacccggaagaactacatggtgaagaacctgaagcggttccggaagcagctggagcgtgaggcaggaaagctggaggcagccaagtgtgacttcttccccaaaacctttgagatgccttgcgagtaccacctgtttgtagaggagtttcgcaaaaacccaggaatcacctggatcatgaagcctgtagcccggtctcaagggaaaggcatcttcctcttccgtaggctgaaggacatcgtggactggaggaaggacacaagaagctctgacgaccagaaagatgatattcccgtggagaactatgtggctcagcgttacattgaaaatccttacctgataggaggccgcaagtttgacctgcgtgtctatgtgctggtgatgtcggtggctcctggaggtcaatgcgtccccatcactgacagccagcagccaggaagactatgagctcaagacctgcctcctggaagacaccctgcatgttgtggacatggaagcgaggctgcgtcaacgatcggaagaaacaactgaggcagctcttctgctcccttcaagttcagaagaaagcttccagttgatccccagctgccaggaggaaatcagccttagcaggccttgtgtttgagattgggagctgagccagaaaccggaaaaccctgggctcatgggcaggacagcttcgggagttgagtgtcaagcccgaagggaagacttttggaaggaaaatactggcaaatccaagaagtgaaccagccgactttaggaaagccagaagccaggctactctagaccttctgccttcagagcatgaggacttctcccactcatccctgtacctgaggcacaccaacccagacaggtccaggcatggactccaggttccctatttccagaaggaatgcgattagctttttttggcccagcacccaccctgccagggaggaaggggcaattttccagtgatgaaattgtgaatcaggcagtcacactggacaacatctagcaaggtgaattctgcaactccctactttatttacattttaaaataagcaatatattcatacggtttaaaatccaaagtttacaaaagggtatagggtgacatctccttccctcccacctgtgcgccccaaccctgcaggtgctgttctgagggaatcacactgtgcttgcacaaaaattattagcttataagacaccagccttccccttgctttcctcacttgatgtatcttggagcttgttccttattcttgattatagttgtatggtattgcactatctggagctaacacctgtgacccacactcatgttttaaaagtttctgcattagtcaaaaatatttaaaaggagattcaacttcacaacccatatgtctagcttctcttgaaaacacgtaagaactggccatgacagcctgtgtttctatgtaactatgagccagagccaaggagcggggggaccaggagaggtgtgcccctgccatgctgccatttgttatcacccgcctgtcaaatcacaggtttatttcaaggcaagaaccatgttcataggttgtattctaaatggagcggcgtgcccttactgaaggactagatgaggcaaataaagactagttgctgctattcatt

SEQ ID NO: 365102 - DNA, 1568 bp, Homo sapiens
tgggggcgggggccttaccccaccctggcaccggcaggcgcgggcggatggggggatgtcgcctagagccccccggccggcccacaaactcccgtcccccttccggctctgcctggacgtccctgcgggccccgggggaaagcacccaacttctcccgcctcggcttctagcagaaacgtgacggggctggactttgatcgccgagggctctctgctcttcagagtctgcttggaacgggataagtgggagggatggtgccatccagggaagctctgctgggaccaggcacaactgccattaggtgccccaagaaattacagatgacatcattgtatccagagaaaactcaaaggatttacaaactaccagaactaatcattcagcaagggcatcaaatacaagaaccaaaattacaagggccatggattgtcaaagggaaaagagcgagagcagagagcatcgatccggttcaagaccaccctcatgaacacactcatggacgtccttcgccacaggccaggatgggtggaagtgaaggacgaaggggagtgggatttctactggtgtgacgtcagctggctccgggagaacttcgaccacacctacatggatgaacatgtgcggatcagtcacttccggaaccactatgagctgacccggaagaactacatggtgaagaacctgaagcggttccggaagcagctggagcgtgaggcaggaaagctggaggcagccaagtgtgacttcttccccaaaacctttgagatgccttgcgagtaccacctgtttgtagaggagtttcgcaaaaacccaggaatcacctggatcatgaagcctgtagcccggtctcaagggaaaggcatcttcctcttccgtaggctgaaggacatcgtggactggaggaaggacacaagaagctctgacgaccagaaagatgatattcccgtggagaactatgtggctcagcgttacattgaaaatccttacctgataggaggccgcaagtttgacctgcgtgtctatgtgctggtgatgtcggtggctcctggaggtcaatgcgtccccatcactgacagccagcagccaggaagactatgagctcaagacctgcctcctggaagacaccctgcatgttgtggacatggaagcgaggctgcgtcaacgatcggaagaaacaactgaggcagctcttctgctcccttcaagttcagaagaaagcttccagttgatccccagctgccaggaggaaatcagccttagcaggtgccacccaggcctcccccccactcccagatcccagcacagcacctcacagcattcgcctccccacctccagcctggcaccagctttgctggcttagcagctgcagcttactacctgaattgggccccttggatacctccagcccatccccaggcatctttgcaccaggagacagccaatcactgggactgggggaggtttaaccttgacaaactgacttggcagttaggcccaaagagaacaaatacagcaagttctgctacccccaggagatcatatctaataaatgagcacaggcccta

SEQ ID NO: 365103 - DNA, 1669 bp, Homo sapiens
ccacccacctccacctcccaaagtgctgggattacaggtgtgagccaccgcacccttaatctccttttttaaaagtccctatagagagatctggggagaaagaagttggggaagcgtggatggggatctgcctggggtttcagaaaggttcctgccccctccttgggctgctggtctgagttctgagtgtgggacaccctgtccacacctccctggctgaacccagactcctccgtgcagcccccggggccctcctcgcctcctcactcccagcataggattcttggacacaccaggctgggacccacagggggcctttgctctcgctggctcttactctgggacactgacccttacctggtctgaccccttgtccacttctggccaccctggccagcagttccccactctgcatgcgcttcccacctgctgtcctgctggtggtgggagccaccctgggaagcttccaggcagtgccccgcgcccacccacagcaggtgcacagggcacaaatgtccactgaatgggtagggatgtaattgacaggtgcctgtgcacaaccactgtcttcccgtggcctcactgcccccttgccctagggccccttccttggctctgtgccagcctcgggggacctcaggctcaccaactctgaggctgagagttccaaagccataggatagatcctggagcttccctgagcctgtttccttgcctgggagttagccatgccttgtggggctgccaagagggtaaagtagagagatgggtctagcttgatacagtataggcagctgctggatgtcagctgtggttatgatcacctccatcttgttatgatgaagaccctgaggtcagagtggaccccaccccaaagccccatctggcagctcacagctgctctctcctacagaaacaggcttgcatgctgatccgaaacctggtggcccacggccaggccttctcgaagcccatcctggacctgggggctgaggcactcatcatgcaggcccgatctgcccaccgtgactgtgaggacgtggccaaggccgccctgcgggacctgggttgtcatgtcgagctccgagagctgtggacaggccagaggggcaacctggcgccatgaccccaggcccagtctgggccgtgactctgggtgagtcgtgtgactcaggaatgggggtagatccatgtcctccactgtcccccattagttctgtccccttcacaatgagaagtgttttctggcaggccctaggtaaagggtcgggggaggggggagccttgtagggaggcctctacacagaagaaagcagcccccatgtcccagccacttctgggtcccagccagcagcacggatgttactgtcctgctccttcccccagccccacgccctaccagagggggcaaagggcacgtcccatcactcactgccctgtctgaaatgtggcagccactgtgggccaggctcagggcagggcaggcgattccagtggggttgggccccctggcgcctgctgcttactgcagtttcatgcaggcctctgctccttgtctttcttacctgtaaaatgggtctcagatgctccgccctgcttggccccagcttgtctgtctctgggtcctgggccagccaggatacctgataataaaagatcattgggtgaa

SEQ ID NO: 365104 - DNA, 2679 bp, Homo sapiens
ggatggccaaagtcttgttcccaagaaccacggagcgcaaatttccagtcctgagaacggaaatgccccaatttccggtggccaatgacctggtcccgagaatcagagtgagaaaattccagatcccggccacattctttgcgaaagtagctgtcatcactgatggaagggttgcttgatctgaaggaaggccctggaaatacgtcacttctcaggccttctcttccggcatctctagagtgagctacagatccactgagggagtatctgccatcgctgtggacgtcatcaaattgcttgatctgggcgccctaggatctagctaatgagattcgtcactcccatgcatcatggattcgttgcttctgtaacagctcaattcctggtatctctgcgcctgtatttgccttggttcgcggtcgtccttggttatcgtgagcgtccgcgagtctctgggaggccaagcctaggggcgccacagcgcctgcgcgcgtacggcggccggaaggggctagaggcggctccctgggtgacaaccgcgcgccccacctttccccacgtggccgcgaagaccgggtgagacgctgcggctgccgaggcctgtcccgcgcggagtggggagtgggggtgccgcagggtcgggctggcgcgaccctcggctcaggagcatctatcggctgcacgccaacatcaacacaggcgaagatggtctccaagcgcattgcccaggagacctttgatgcagctgtgcgcgagaacatcgaggagtttgcgatggggccagaggaggcagtgaaagaggccgtggagcagtttgaatcgcaaggggttgatctgagcaacattgtaaagacggcacctaaagtctctgcagacggatcccaggagcccacacatgacatcctgcagatgctcagtgacctccaggagtctgtggccagctctcgcccccaggaggtgtcagcatacctcacccgcttctgcgaccagtgcaaacaggacaaggcctgccgcttcctcgcggcccagaagggggcctaccccatcatcttcactgcctggaagctggccactgcaggtgaccagggccttctgctccagtccctcaatgccctgtcggtgctgactgatggacagccagacctcctggatgcccagggcctgcagctcctagtggccacgctgacccagaatgctgatgaggctgacctgacctgctctgggatccgctgtgtgcgtcacgcttgcctgaaacatgaacagaatcggcaagacctggtgaaagctggcgtgctgcctctgctgactggtgccatcacccatcatggccaccacactgacgtggtcagggaagcctgctgggccctgcgtgtcatgaccttcgatgacgacatccgtgtgccctttggccatgcccacaaccatgccaagatgattgtgcaggagaacaaaggcttgaaggtgctcatcgaagccaccaaagcgttcctggataaccctggcatcctgagcgagctctgtggaaccctgtcccgcctggccattcgcaacgagttctgccaggaggtcgtcgacctcgggggcctgagcattctggtgtccctgctagccgactgcaatgaccaccagatgagggaccagagcggcgttcaggagctcgtgaagcaagtgctgagcaccctgcgagccatcgcaggcaacgacgacgtgaaagatgctattgtccgtgctggtgggacggagtccatcgtggctgctatgacccagcatctgaccagcccccaggtgtgtgagcagagctgcgcggccctgtgcttcctggccctgcgtaagcccgacaacagccgcatcatcgtggagggtggcggggctgtggcagcactgcaggccatgaaggcacacccgcagaaggccggcgtgcagaaacaggcttgcatgctgatccgaaacctggtggcccacggccaggccttctcgaagcccatcctggacctgggggctgaggcactcatcatgcaggcccgatctgcccaccgtgactgtgaggacgtggccaaggccgccctgcgggacctgggttgtcatgtcgagctccgagagctgtggacaggccagaggggcaacctggcgccatgaccccaggcccagtctgggccgtgactctgggtgagtcgtgtgactcaggaatgggggtagatccatgtcctccactgtcccccattagttctgtccccttcacaatgagaagtgttttctggcaggccctaggtaaagggtcgggggaggggggagccttgtagggaggcctctacacagaagaaagcagcccccatgtcccagccacttctgggtcccagccagcagcacggatgttactgtcctgctccttcccccagccccacgccctaccagagggggcaaagggcacgtcccatcactcactgccctgtctgaaatgtggcagccactgtgggccaggctcagggcagggcaggcgattccagtggggttgggccccctggcgcctgctgcttactgcagtttcatgcaggcctctgctccttgtctttcttacctgtaaaatgggtctcagatgctccgccctgcttggccccagcttgtctgtctctgggtcctgggccagccaggatacctgataataaaagatcattgggtgaa

SEQ ID NO: 365105 - DNA, 2756 bp, Homo sapiens
  misc_feature (2685)..(2685): n is a, c, g, or t
  misc_feature (2691)..(2691): n is a, c, g, or t
ggatggccaaagtcttgttcccaagaaccacggagcgcaaatttccagtcctgagaacggaaatgccccaatttccggtggccaatgacctggtcccgagaatcagagtgagaaaattccagatcccggccacattctttgcgaaagtagctgtcatcactgatggaagggttgcttgatctgaaggaaggccctggaaatacgtcacttctcaggccttctcttccggcatctctagagtgagctacagatccactgagggagtatctgccatcgctgtggacgtcatcaaattgcttgatctgggcgccctaggatctagctaatgagattcgtcactcccatgcatcatggattcgttgcttctgtaacagctcaattcctggtatctctgcgcctgtatttgccttggttcgcggtcgtccttggttatcgtgagcgtccgcgagtctctgggaggccaagcctaggggcgccacagcgcctgcgcgcgtacggcggccggaaggggctagaggcggctccctgggtgacaaccgcgcgccccacctttccccacgtggccgcgaagaccgggtgagacgctgcggctgccgaggcctgtcccgcgcggagtggggagtgggggtgccgcagggtcgggctggcgcgaccctcggctcaggagcatctatcggctgcacgccaacatcaacacaggcgaagatggtctccaagcgcattgcccaggagacctttgatgcagctgtgcgcgagaacatcgaggagtttgcgatggggccagaggaggcagtgaaagaggccgtggagcagtttgaatcgcaaggggttgatctgagcaacattgtaaagacggcacctaaagtctctgcagacggatcccaggagcccacacatgacatcctgcagatgctcagtgacctccaggagtctgtggccagctctcgcccccaggaggtgtcagcatacctcacccgcttctgcgaccagtgcaaacaggacaaggcctgccgcttcctcgcggcccagaagggggcctaccccatcatcttcactgcctggaagctggccactgcaggtgaccagggccttctgctccagtccctcaatgccctgtcggtgctgactgatggacagccagacctcctggatgcccagggcctgcagctcctagtggccacgctgacccagaatgctgatgaggctgacctgacctgctctgggatccgctgtgtgcgtcacgcttgcctgaaacatgaacagaatcggcaagacctggtgaaagctggcgtgctgcctctgctgactggtgccatcacccatcatggccaccacactgacgtggtcagggaagcctgctgggccctgcgtgtcatgaccttcgatgacgacatccgtgtgccctttggccatgcccacaaccatgccaagatgattgtgcaggagaacaaaggcttgaaggtgctcatcgaagccaccaaagcgttcctggataaccctggcatcctgagcgagctctgtggaaccctgtcccgcctggccattcgcaacgagttctgccaggaggtcgtcgacctcgggggcctgagcattctggtgtccctgctagccgactgcaatgaccaccagatgagggaccagagcggcgttcaggagctcgtgaagcaagtgctgagcaccctgcgagccatcgcaggcaacgacgacgtgaaagatgctattgtccgtgctggtgggacggagtccatcgtggctgctatgacccagcatctgaccagcccccaggtgtgtgagcagagctgcgcggccctgtgcttcctggccctgcgtaagcccgacaacagccgcatcatcgtggagggtggcggggctgtggcagcactgcaggccatgaaggcacacccgcagaaggccggcgtgcagaaacaggcttgcatgctgatccgaaacctggtggcccacggccaggccttctcgaagcccatcctggacctgggggctgaggcactcatcatgcaggcccgatctgcccaccgtgactgtgaggacgtggccaaggccgccctgcgggacctgggttgtcatgtcgagctccgagagctgtggacaggccagaggggcaacctggcgccatgaccccaggcccagtctgggccgtgactctgggtgagtcgtgtgactcaggaatgggggtagatccatgtcctccactgtcccccattagttctgtccccttcacaatgagaagtgttttctggcaggccctaggtaaagggtcgggggaggggggagccttgtagggaggcctctacacagaagaaagcagcccccatgtcccagccacttctgggtcccagccagcagcacggatgttactgtcctgctccttcccccagccccacgccctaccagagggggcaaagggcacgtcccatcactcactgccctgtctgaaatgtggcagccactgtgggccaggctcagggcagggcaggcgattccagtggggttgggccccctggcgcctgctgcttactgcagtttcatgcaggcctctgctccttgtctttcttacctgtaaaatgggtctcagatgctccgccctgcttggccccagcttgtctgtctctgggtcctgggccagccaggatacctgataataaaagatcattgggtgaaaaaaanaccacnaacgaaagcacaaacacggggggacgcgaaaaaaagatcaccgagagggccacaaaaaaggccaa

SEQ ID NO: 365106 - DNA, 2528 bp, Homo sapiens
tggtgcgcaggcgcgggccgccgcggcccggctctctggcacgagggcgcgctgtccgcttcttctgggcggacgctctggaggcaaaacatttccctgctgggggcggcgaccaccgtgagcgtcccggaaggggcggcaaagacgcctccgtcgcgcacgaggtggcctcgttggctttaccttggttcgcggtcgtccttggttatcgtgagcgtccgcgagtctctgggaggccaagcctaggggcgccacagcgcctgcgcgcgtacggcggccggaaggggctagaggcggctccctgggtgacaaccgcgcgccccacctttccccacgtggccgcgaagaccggagatggagtttcgccacgtgtccaggctggtctcaaactcctggcctcatgtgatccttccgcctcggcctcccaaagtgcaggccaccatgcctggcctgaagtggaaacttgataattccagaacggaaacttgatattactgcaataagcaagctcaggagcatctatcggctgcacgccaacatcaacacaggcgaagatggtctccaagcgcattgcccaggagacctttgatgcagctgtgcgcgagaacatcgaggagtttgcgatggggccagaggaggcagtgaaagaggccgtggagcagtttgaatcgcaaggggttgatctgagcaacattgtaaagacggcacctaaagtctctgcagacggatcccaggagcccacacatgacatcctgcagatgctcagtgacctccaggagtctgtggccagctctcgcccccaggaggtgtcagcatacctcacccgcttctgcgaccagtgcaaacaggacaaggcctgccgcttcctcgcggcccagaagggggcctaccccatcatcttcactgcctggaagctggccactgcaggtgaccagggccttctgctccagtccctcaatgccctgtcggtgctgactgatggacagccagacctcctggatgcccagggcctgcagctcctagtggccacgctgacccagaatgctgatgaggctgacctgacctgctctgggatccgctgtgtgcgtcacgcttgcctgaaacatgaacagaatcggcaagacctggtgaaagctggcgtgctgcctctgctgactggtgccatcacccatcatggccaccacactgacgtggtcagggaagcctgctgggccctgcgtgtcatgaccttcgatgacgacatccgtgtgccctttggccatgcccacaaccatgccaagatgattgtgcaggagaacaaaggcttgaaggtgctcatcgaagccaccaaagcgttcctggataaccctggcatcctgagcgagctctgtggaaccctgtcccgcctggccattcgcaacgagttctgccaggaggtcgtcgacctcgggggcctgagcattctggtgtccctgctagccgactgcaatgaccaccagatgagggaccagagcggcgttcaggagctcgtgaagcaagtgctgagcaccctgcgagccatcgcaggcaacgacgacgtgaaagatgctattgtccgtgctggtgggacggagtccatcgtggctgctatgacccagcatctgaccagcccccaggtgtgtgagcagagctgcgcggccctgtgcttcctggccctgcgtaagcccgacaacagccgcatcatcgtggagggtggcggggctgtggcagcactgcaggccatgaaggcacacccgcagaaggccggcgtgcagaaacaggcttgcatgctgatccgaaacctggtggcccacggccaggccttctcgaagcccatcctggacctgggggctgaggcactcatcatgcaggcccgatctgcccaccgtgactgtgaggacgtggccaaggccgccctgcgggacctgggttgtcatgtcgagctccgagagctgtggacaggccagaggggcaacctggcgccatgaccccaggcccagtctgggccgtgactctgggtgagtcgtgtgactcaggaatgggggtagatccatgtcctccactgtcccccattagttctgtccccttcacaatgagaagtgttttctggcaggccctaggtaaagggtcgggggaggggggagccttgtagggaggcctctacacagaagaaagcagcccccatgtcccagccacttctgggtcccagccagcagcacggatgttactgtcctgctccttcccccagccccacgccctaccagagggggcaaagggcacgtcccatcactcactgccctgtctgaaatgtggcagccactgtgggccaggctcagggcagggcaggcgattccagtggggttgggccccctggcgcctgctgcttactgcagtttcatgcaggcctctgctccttgtctttcttacctgtaaaatgggtctcagatgctccgccctgcttggccccagcttgtctgtctctgggtcctgggccagccaggatacctgataataaaagatcattgggtgaa

SEQ ID NO: 365107 - DNA, 2728 bp, Homo sapiens
ggatggccaaagtcttgttcccaagaaccacggagcgcaaatttccagtcctgagaacggaaatgccccaatttccggtggccaatgacctggtcccgagaatcagagtgagaaaattccagatcccggccacattctttgcgaaagtagctgtcatcactgatggaagggttgcttgatctgaaggaaggccctggaaatacgtcacttctcaggccttctcttccggcatctctagagtgagctacagatccactgagggagtatctgccatcgctgtggacgtcatcaaattgcttgatctgggcgccctaggatctagctaatgagattcgtcactcccatgcatcatggattcgttgcttctgtaacagctcaattcctggtatctctgcgcctgtatttgccttggttcgcggtcgtccttggttatcgtgagcgtccgcgagtctctgggaggccaagcctaggggcgccacagcgcctgcgcgcgtacggcggccggaaggggctagaggcggctccctgggtgacaaccgcgcgccccacctttccccacgtggccgcgaagaccgggtgagacgctgcggctgccgaggcctgtcccgcgcggagtggggagtgggggtgccgcagggtcgggctggcgcgaccctcggctcaggagcatctatcggctgcacgccaacatcaacacaggcgaagatggtctccaagcgcattgcccaggagacctttgatgcagctgtgcgcgagaacatcgaggagtttgcgatggggccagaggaggcagtgaaagaggccgtggagcagtttgaatcgcaaggggttgatctgagcaacattgtaaagacggcacctaaagtctctgcagacggatcccaggagcccacacatgacatcctgcagatgctcagtgacctccaggagtctgtggccagctctcgcccccaggaggtgtcagcatacctcacccgcttctgcgaccagtgcaaacaggacaaggcctgccgcttcctcgcggcccagaagggggcctaccccatcatcttcactgcctggaagctggccactgcaggtgaccagggccttctgctccagtccctcaatgccctgtcggtgctgactgatggacagccagacctcctggatgcccagggcctgcagctcctagtggccacgctgacccagaatgctgatgaggctgacctgacctgctctgggatccgctgtgtgcgtcacgcttgcctgaaacatgaacagaatcggcaagacctggtgaaagctggcgtgctgcctctgctgactggtgccatcacccatcatggccaccacactgacgtggtcagggaagcctgctgggccctgcgtgtcatgaccttcgatgacgacatccgtgtgccctttggccatgcccacaaccatgccaagatgattgtgcaggagaacaaaggcttgaaggtgctcatcgaagccaccaaagcgttcctggataaccctggcatcctgagcgagctctgtggaaccctgtcccgcctggccattcgcaacgagttctgccaggaggtcgtcgacctcgggggcctgagcattctggtgtccctgctagccgactgcaatgaccaccagatgagggaccagagcggcgttcaggagctcgtgaagcaagtgctgagcaccctgcgagccatcgcaggcaacgacgacgtgaaagatgctattgtccgtgctggtgggacggagtccatcgtggctgctatgacccagcatctgaccagcccccaggtgtgtgagcagagctgcgcggccctgtgcttcctggccctgcgtaagcccgacaacagccgcatcatcgtggagggtggcggggctgtggcagcactgcaggccatgaaggcacacccgcagaaggccggcgtgcaggtgggcagggcaggggatgggggcaggcaggctggtgtgggatgtgcagaaacaggcttgcatgctgatccgaaacctggtggcccacggccaggccttctcgaagcccatcctggacctgggggctgaggcactcatcatgcaggcccgatctgcccaccgtgactgtgaggacgtggccaaggccgccctgcgggacctgggttgtcatgtcgagctccgagagctgtggacaggccagaggggcaacctggcgccatgaccccaggcccagtctgggccgtgactctgggtgagtcgtgtgactcaggaatgggggtagatccatgtcctccactgtcccccattagttctgtccccttcacaatgagaagtgttttctggcaggccctaggtaaagggtcgggggaggggggagccttgtagggaggcctctacacagaagaaagcagcccccatgtcccagccacttctgggtcccagccagcagcacggatgttactgtcctgctccttcccccagccccacgccctaccagagggggcaaagggcacgtcccatcactcactgccctgtctgaaatgtggcagccactgtgggccaggctcagggcagggcaggcgattccagtggggttgggccccctggcgcctgctgcttactgcagtttcatgcaggcctctgctccttgtctttcttacctgtaaaatgggtctcagatgctccgccctgcttggccccagcttgtctgtctctgggtcctgggccagccaggatacctgataataaaagatcattgggtgaa

SEQ ID NO: 365108 - DNA, 2450 bp, Homo sapiens
  misc_feature (2287)..(2287): n is a, c, g, or t
ggatggccaaagtcttgttcccaagaaccacggagcgcaaatttccagtcctgagaacggaaatgccccaatttccggtggccaatgacctggtcccgagaatcagagtgagaaaattccagatcccggccacattctttgcgaaagtagctgtcatcactgatggaagggttgcttgatctgaaggaaggccctggaaatacgtcacttctcaggccttctcttccggcatctctagagtgagctacagatccactgagggagtatctgccatcgctgtggacgtcatcaaattgcttgatctgggcgccctaggatctagctaatgagattcgtcactcccatgcatcatggattcgttgcttctgtaacagctcaattcctggtatctctgcgcctgtatttgccttggttcgcggtcgtccttggttatcgtgagcgtccgcgagtctctgggaggccaagcctaggggcgccacagcgcctgcgcgcgtacggcggccggaaggggctagaggcggctccctgggtgacaaccgcgcgccccacctttccccacgtggccgcgaagaccgggtgagacgctgcggctgccgaggcctgtcccgcgcggagtggggagtgggggtgccgcagggtcgggctggcgcgaccctcggctcaggagcatctatcggctgcacgccaacatcaacacaggcgaagatggtctccaagcgcattgcccaggagacctttgatgcagctgtgcgcgagaacatcgaggagtttgcgatggggccagaggaggcagtgaaagaggccgtggagcagtttgaatcgcaaggggttgatctgagcaacattgtaaagacggcacctaaagtctctgcagacggatcccaggagcccacacatgacatcctgcagatgctcagtgacctccaggagtctgtggccagctctcgcccccaggaggtgtcagcatacctcacccgcttctgcgaccagtgcaaacaggacaaggcctgccgcttcctcgcggcccagaagggggcctaccccatcatcttcactgcctggaagctggccactgcaggtgaccagggccttctgctccagtccctcaatgccctgtcggtgctgactgatggacagccagacctcctggatgcccagggcctgcagctcctagtggccacgctgacccagaatgctgatgaggctgacctgacctgctctgggatccgctgtgtgcgtcacgcttgcctgaaacatgaacagaatcggcaagacctggtgaaagctggcgtgctgcctctgctgactggtgccatcacccatcatggccaccacactgacgtggtcagggaagcctgctgggccctgcgtgtcatgaccttcgatgacgacatccgtgtgccctttggccatgcccacaaccatgccaagatgattgtgcaggagaacaaaggcttgaaggtgctcatcgaagccaccaaagcgttcctggataaccctggcatcctgagcgagctctgtggaaccctgtcccgcctggccattcgcaacgagttctgccaggaggtcgtcgacctcgggggcctgagcattctggtgtccctgctagccgactgcaatgaccaccagatgagggaccagagcggcgttcaggagctcgtgaagcaagtgctgagcaccctgcgagccatcgcaggcaacgacgacgtgaaagatgctattgtccgtgctggtgggacggagtccatcgtggctgctatgacccagcatctgaccagcccccaggtgtgtgagcagagctgcgcggccctgtgcttcctggccctgcgtaagcccgacaacagccgcatcatcgtggagggtggcggggctgtggcagcactgcaggccatgaaggcacacccgcagaaggccggcgtgcagaaacaggcttgcatgctgatccgaaacctggtggcccacggccaggccttctcgaagcccatcctggacctgggggctgaggcactcatcatgcaggcccgatctgcccaccgtgactgtgaggacgtggccaaggccgccctgcgggacctgggttgtcatgtcgagctccgagagctgtggacaggccagaggggcaacctggcgccatgaccccaggcccagtctgggccgtgactctgggtgagtcgtgtgactcaggaatgggggtagatccatgtcctccactgtcccccattagttctgtccccttcacaatgagaagtgttttctggcaggccctaggtaaagggtcgggggaggnatttttttttaaatattgctttacccatattataatccgttccccttgtggctggggttacttttttccaatactcgttaaattatataggccgggttgttgcccccctctgttttcattttgttcaaagggggggggtgtgaacgaatatacaggtttttgc

SEQ ID NO: 365109 - DNA, 893 bp, Homo sapiens
tggtgcgcaggcgcgggccgccgcggcccggctctctggcacgagggcgcgctgtccgcttcttctgggcggacgctctggaggcaaaacatttccctgctgggggcggcgaccaccgtgagcgtcccggaaggggcggcaaagacgcctccgtcgcgcacgaggtggcctcgttggctttaccttggttcgcggtcgtccttggttatcgtgagcgtccgcgagtctctgggaggccaagcctaggggcgccacagcgcctgcgcgcgtacggcggccggaaggggctagaggcggctccctgggtgacaaccgcgcgccccacctttccccacgtggccgcgaagaccggcacctgtgcactgagtgcctgctgcgtgtcgggccccgtcctaggcagtggggacaaggaggctacagggtacaaataaatgagtgaacgatgttgctctagatacagctcaggagcatctatcggctgcacgccaacatcaacacaggcgaagatggtctccaagcgcattgcccaggagacctttgatgcagctgtgcgcgagaacatcgaggagtttgcgatggggccagaggaggcagtgaaagaggccgtggagcagtttgaatcgcaaggggttgatctgagcaacattgtaaagacggcacctaaagtctctgcagacggatcccaggagcccacacatgacatcctgcagatgctcagtgacctccaggagtctgtggccagctctcgcccccaggaggtgtcagcatacctcacccgcttctgcgaccagtgcaaacaggacaaggcctgccgcttcctcgcggcccagaagggggcctaccccatcatcttcactgccaggatacctgataataaaagatcattgggtgaa

SEQ ID NO: 365110 - DNA, 318 bp, Homo sapiens
cactattatagttttctttttttaggtgagaccatgagttggtatggaatttatttggggcatgatggaaggaagcgggttggggggcacattcttaagtcttcccagcagccagcagggggcactgcaggcccaggtagcccctggtgttccctggggccttcctggtgcccgtggccactccaataggcagaagggctggactcttccagtggagcaggatctccaccaaaacagagggccctgcggctggttcttcccgcccccaccaccgtctccctttctccctgcagcgttcctggataaccctggcatcct

SEQ ID NO: 365111 - DNA, 3714 bp, Homo sapiens
tggtgcgcaggcgcgggccgccgcggcccggctctctggcacgagggcgcgctgtccgcttcttctgggcggacgctctggaggcaaaacatttccctgctgggggcggcgaccaccgtgagcgtcccggaaggggcggcaaagacgcctccgtcgcgcacgaggtggcctcgttggctttaccttggttcgcggtcgtccttggttatcgtgagcgtccgcgagtctctgggaggccaagcctaggggcgccacagcgcctgcgcgcgtacggcggccggaaggggctagaggcggctccctgggtgacaaccgcgcgccccacctttccccacgtggccgcgaagaccggcacctgtgcactgagtgcctgctgcgtgtcgggccccgtcctaggcagtggggacaaggaggctacagggtacaaataaatgagtgaacgatgttgctctagatacagctcaggagcatctatcggctgcacgccaacatcaacacaggcgaagatggtctccaagcgcattgcccaggagacctttgatgcagctgtgcgcgagaacatcgaggagtttgcgatggggccagaggaggcagtgaaagaggccgtggagcagtttgaatcgcaaggggttgatctgagcaacattgtaaagacggcacctaaagtctctgcagacggatcccaggagcccacacatgacatcctgcagatgctcagtgacctccaggagtctgtggccagctctcgcccccaggaggtgtcagcatacctcacccgcttctgcgaccagtgcaaacaggacaaggcctgccgcttcctcgcggcccagaagggggcctaccccatcatcttcactgcctggaagctggccactgcaggtgaccagggccttctgctccagtccctcaatgccctgtcggtgctgactgatggacagccagacctcctggatgcccagggcctgcagctcctagtggccacgctgacccagaatgctgatgaggctgacctgacctgctctgggatccgctgtgtgcgtcacgcttgcctgaaacatgaacagaatcggcaagacctggtgaaagctggcgtgctgcctctgctgactggtgccatcacccatcatggccaccacactgacgtggtcagggaagcctgctgggccctgcgtgtcatgaccttcgatgacgacatccgtgtgccctttggccatgcccacaaccatgccaagatgattgtgcaggagaacaaaggcttgaaggtgctcatcgaagccaccaaagcgttcctggataaccctggcatcctgagcgagctctgtggaaccctgtcccgcctggccattcgcaacgagttctgccaggaggtcgtcgacctcgggggcctgagcattctggtgtccctgctagccgactgcaatgaccaccagatgagggaccagagcggcgttcaggagctcgtgaagcaagtgctgagcaccctgcgagccatcgcaggcaacgacgacgtgaaagatgctattgtccgtgctggtgggacggagtccatcgtggctgctatgacccagcatctgaccagcccccaggtgtgtgagcagagctgcgcggccctgtgcttcctggccctgcgtaagcccgacaacagccgcatcatcgtggagggtggcggggctgtggcagcactgcaggccatgaaggcacacccgcagaaggccggcgtgcagaaacaggcttgcatgctgatccgaaacctggtggcccacggccaggccttctcgaagcccatcctggacctgggggctgaggcactcatcatgcaggcccgatctgcccaccgtgactgtgaggacgtggccaaggccgccctgcgggacctgggttgtcatgtcgagctccgagagctgtggacaggccagaggggcaacctggcgccatgaccccaggcccagtctgggccgtgactctgggtgagtcgtgtgactcaggaatgggggtagatccatgtcctccactgtcccccattagttctgtccccttcacaatgagaagtgttttctggcaggccctaggtaaagggtcgggggaggggggagccttgtagggaggcctctacacagaagaaagcagcccccatgtcccagccacttctgggtcccagccagcagcacggatgttactgtcctgctccttcccccagccccacgccctaccagagggggcaaagggcacgtcccatcactcactgccctgtctgaaatgtggcagccactgtgggccaggctcagggcagggcaggcgattccagtggggttgggccccctggcgcctgctgcttactgcagtttcatgcaggcctctgctccttgtctttcttacctgtaaaatgggtctcagatgctccgccctgcttggccccagcttgtctgtctctgggtcctgggccagccaggatacctgataataaaagatcattgggtgaaaaaaaaaaaaaaaaaaaaaaaaaaaaaaaaaaaactcgagactagttctctctctctcattttttcataatcaaaggtcatatgatactgtatagacaagctttgtagtgaagtatagtagcaataatttctgtacctgatcaagtttattgcagcctttcttttcctatttcttttttttaagggttagtattaacaaatggcaatgagtagaaaagttaacatgaagattttagaaggagagaacttacaggacacagatttgtgattctttgactgtgacactattggatgtgattctaaaagcttttattgagcattgtcaaatttgtaagcttcatagggatggacatcatatctataatgcccttctatatgtgctaccatagatgtgacatttttgaccttaatatcgtctttgaaaatgttaaattgagaaacctgttaacttacattttatgaattggcacattgtattacttactgcaagagatatttcattttcagcacagtgcaaaagttctttaaaatgcatatgtctttttttctaattccgttttgttttaaagcacattttaaatgtagttttctcatttagtaaaagttgtctaattgatatgaagcctgactgattttttttttccttacagtgagacatttaagcacacattttattcacatagatactatgtccttgacatattgaaatgattcttttctgaaagtattcatgatctgcatatgatgtattaggttaggtcacaaaggttttatctgaggtgatttaaataacttcctgattggagtgtgtaagctgagcgatttctaataaaattttagttgtacacttttagtagtcatagtgaagcaggtctagaaaataagcctttggcagggaaaaagggcaatgttgattaatctcagtattaaaccacattaatctgtatcccattgtctggcttttgtaaattcatccaggtcaagactaagtatgttggttaataggaatccttttttttttttttaaagactaaatgtgaaaaaataatcactacttaagctaattaatattggtcattaaatttaaaggatggaaatttatcatgtttaaaaattattcaagcactcttaaaaccccttaaacagcctccagtcataaaaatgtgttctttacaaatatttgcttggcaacacgacttgaaataaataaaactttgtttcttaggagaaaatg

SEQ ID NO: 365112 - DNA, 2372 bp, Homo sapiens
tggtgcgcaggcgcgggccgccgcggcccggctctctggcacgagggcgcgctgtccgcttcttctgggcggacgctctggaggcaaaacatttccctgctgggggcggcgaccaccgtgagcgtcccggaaggggcggcaaagacgcctccgtcgcgcacgaggtggcctcgttggctttaccttggttcgcggtcgtccttggttatcgtgagcgtccgcgagtctctgggaggccaagcctaggggcgccacagcgcctgcgcgcgtacggcggccggaaggggctagaggcggctccctgggtgacaaccgcgcgccccacctttccccacgtggccgcgaagaccggctcaggagcatctatcggctgcacgccaacatcaacacaggcgaagatggtctccaagcgcattgcccaggagacctttgatgcagctgtgcgcgagaacatcgaggagtttgcgatggggccagaggaggcagtgaaagaggccgtggagcagtttgaatcgcaaggggttgatctgagcaacattgtaaagacggcacctaaagtctctgcagacggatcccaggagcccacacatgacatcctgcagatgctcagtgacctccaggagtctgtggccagctctcgcccccaggaggtgtcagcatacctcacccgcttctgcgaccagtgcaaacaggacaaggcctgccgcttcctcgcggcccagaagggggcctaccccatcatcttcactgcctggaagctggccactgcaggtgaccagggccttctgctccagtccctcaatgccctgtcggtgctgactgatggacagccagacctcctggatgcccagggcctgcagctcctagtggccacgctgacccagaatgctgatgaggctgacctgacctgctctgggatccgctgtgtgcgtcacgcttgcctgaaacatgaacagaatcggcaagacctggtgaaagctggcgtgctgcctctgctgactggtgccatcacccatcatggccaccacactgacgtggtcagggaagcctgctgggccctgcgtgtcatgaccttcgatgacgacatccgtgtgccctttggccatgcccacaaccatgccaagatgattgtgcaggagaacaaaggcttgaaggtgctcatcgaagccaccaaagcgttcctggataaccctggcatcctgagcgagctctgtggaaccctgtcccgcctggccattcgcaacgagttctgccaggaggtcgtcgacctcgggggcctgagcattctggtgtccctgctagccgactgcaatgaccaccagatgagggaccagagcggcgttcaggagctcgtgaagcaagtgctgagcaccctgcgagccatcgcaggcaacgacgacgtgaaagatgctattgtccgtgctggtgggacggagtccatcgtggctgctatgacccagcatctgaccagcccccaggtgtgtgagcagagctgcgcggccctgtgcttcctggccctgcgtaagcccgacaacagccgcatcatcgtggagggtggcggggctgtggcagcactgcaggccatgaaggcacacccgcagaaggccggcgtgcagaaacaggcttgcatgctgatccgaaacctggtggcccacggccaggccttctcgaagcccatcctggacctgggggctgaggcactcatcatgcaggcccgatctgcccaccgtgactgtgaggacgtggccaaggccgccctgcgggacctgggttgtcatgtcgagctccgagagctgtggacaggccagaggggcaacctggcgccatgaccccaggcccagtctgggccgtgactctgggtgagtcgtgtgactcaggaatgggggtagatccatgtcctccactgtcccccattagttctgtccccttcacaatgagaagtgttttctggcaggccctaggtaaagggtcgggggaggggggagccttgtagggaggcctctacacagaagaaagcagcccccatgtcccagccacttctgggtcccagccagcagcacggatgttactgtcctgctccttcccccagccccacgccctaccagagggggcaaagggcacgtcccatcactcactgccctgtctgaaatgtggcagccactgtgggccaggctcagggcagggcaggcgattccagtggggttgggccccctggcgcctgctgcttactgcagtttcatgcaggcctctgctccttgtctttcttacctgtaaaatgggtctcagatgctccgccctgcttggccccagcttgtctgtctctgggtcctgggccagccaggatacctgataataaaagatcattgggtgaa

SEQ ID NO: 365113 - DNA, 1991 bp, Homo sapiens
gcaggctggtaccgcccgggggttatgggatccccacgtggccgcgaagaccggctcaggagcatctatcggctgcacgccaacatcaacacaggcgaagatggtctccaagcgcattgcccaggagacctttgatgcagctgtgcgcgagaacatcgaggagtttgcgatggggccagaggaggcagtgaaagaggccgtggagcagtttgaatcgcaagatgctcagtgacctccaggagtctgtggccagctctcgcccccaggaggtgtcagcatacctcacccgcttctgcgaccagtgcaaacaggacaaggcctgccgcttcctcgcggcccagaagggggcctaccccatcatcttcactgcctggaagctggccactgcaggtgaccagggccttctgctccagtccctcaatgccctgtcggtgctgactgatggacagccagacctcctggatgcccagggcctgcagctcctagtggccacgctgacccagaatgctgatgaggctgacctgacctgctctgggatccgctgtgtgcgtcacgcttgcctgaaacatgaacagaatcggcaagacctggtgaaagctggcgtgctgcctctgctgactggtgccatcacccatcatggccaccacactgacgtggtcagggaagcctgctgggccctgcgtgtcatgaccttcgatgacgacatccgtgtgccctttggccatgcccacaaccatgccaagatgattgtgcaggagaacaaaggcttgaaggtgctcatcgaagccaccaaagcgttcctggataaccctggcatcctgagcgagctctgtggaaccctgtcccgcctggccattcgcaacgagttctgccaggaggtcgtcgacctcgggggcctgagcattctggtgtccctgctagccgactgcaatgaccaccagatgagggaccagagcggcgttcaggagctcgtgaagcaagtgctgagcaccctgcgagccatcgcaggcaacgacgacgtgaaagatgctattgtccgtgctggtgggacggagtccatcgtggctgctatgacccagcatctgaccagcccccaggtgtgtgagcagagctgcgcggccctgtgcttcctggccctgcgtaagcccgacaacagccgcatcatcgtggagggtggcggggctgtggcagcactgcaggccatgaaggcacacccgcagaaggccggcgtgcagaaacaggcttgcatgctgatccgaaacctggtggcccacggccaggccttctcgaagcccatcctggacctgggggctgaggcactcatcatgcaggcccgatctgcccaccgtgactgtgaggacgtggccaaggccgccctgcgggacctgggttgtcatgtcgagctccgagagctgtggacaggccagaggggcaacctggcgccatgaccccaggcccagtctgggccgtgactctgggtgagtcgtgtgactcaggaatgggggtagatccatgtcctccactgtcccccattagttctgtccccttcacaatgagaagtgttttctggcaggccctaggtaaagggtcgggggaggggggagccttgtagggaggcctctacacagaagaaagcagcccccatgtcccagccacttctgggtcccagccagcagcacggatgttactgtcctgctccttcccccagccccacgccctaccagagggggcaaagggcacgtcccatcactcactgccctgtctgaaatgtggcagccactgtgggccaggctcagggcagggcaggcgattccagtggggttgggccccctggcgcctgctgcttactgcagtttcatgcaggcctctgctccttgtctttcttacctgtaaaatgggtctcagatgctccgccctgcttggccccagcttgtctgtctctgggtcctgggccagccaggatacctgataataaaagatcattgggtgaa

SEQ ID NO: 365114 - DNA, 2541 bp, Homo sapiens
ggatggccaaagtcttgttcccaagaaccacggagcgcaaatttccagtcctgagaacggaaatgccccaatttccggtggccaatgacctggtcccgagaatcagagtgagaaaattccagatcccggccacattctttgcgaaagtagctgtcatcactgatggaagggttgcttgatctgaaggaaggccctggaaatacgtcacttctcaggccttctcttccggcatctctagagtgagctacagatccactgagggagtatctgccatcgctgtggacgtcatcaaattgcttgatctgggcgccctaggatctagctaatgagattcgtcactcccatgcatcatggattcgttgcttctgtaacagctcaattcctggtatctctgcgcctgtatttgccttggttcgcggtcgtccttggttatcgtgagcgtccgcgagtctctgggaggccaagcctaggggcgccacagcgcctgcgcgcgtacggcggccggaaggggctagaggcggctccctgggtgacaaccgcgcgccccacctttccccacgtggccgcgaagaccgggtgagacgctgcggctgccgaggcctgtcccgcgcggagtggggagtgggggtgccgcagggtcgggctggcgcgaccctcggctcaggagcatctatcggctgcacgccaacatcaacacaggcgaagatggtctccaagcgcattgcccaggagacctttgatgcagctgtgcgcgagaacatcgaggagtttgcgatggggccagaggaggcagtgaaagaggccgtggagcagtttgaatcgcaaggggttgatctgagcaacattgtaaagacggcacctaaagtctctgcagacggatcccaggagcccacacatgacatcctgcagatgctcagtgacctccaggagtctgtggccagctctcgcccccaggaggtgtcagcatacctcacccgcttctgcgaccagtgcaaacaggacaaggcctgccgcttcctcgcggcccagaagggggcctaccccatcatcttcactgcctggaagctggccactgcaggtgaccagggccttctgctccagtccctcaatgccctgtcggtgctgactgatggacagccagacctcctggatgcccagggcctgcagctcctagtggccacgctgacccagaatgctgatgaggctgacctgacctgctctgggatccgctgtgtgcgtcacgcttgcctgaaacatgaacagaatcggcaagacctggtgaaagctggcgtgctgcctctgctgactggtgccatcacccatcatggccaccacactgacgtggtcagggaagcctgctgggccctgcgtgtcatgaccttcgatgacgacatccgtgtgccctttggccatgcccacaaccatgccaagatgattgtgcaggagaacaaaggcttgaaggtgctcatcgaagccaccaaagcgttcctggataaccctggcatcctgagcgagctctgtggaaccctgtcccgcctggccattcgcaacgagttctgccaggaggtcgtcgacctcgggggcctgagcattctggtgtccctgctagccgactgcaatgaccaccagatgagggaccagagcggcgttcaggagctcgtgaagcaagtgctgagcaccctgcgagccatcgcaggcaacgacgacgtgaaagatgctattgtccgtgctggtgggacggagtccatcgtggctgctatgacccagcatctgaccagcccccagaaacaggcttgcatgctgatccgaaacctggtggcccacggccaggccttctcgaagcccatcctggacctgggggctgaggcactcatcatgcaggcccgatctgcccaccgtgactgtgaggacgtggccaaggccgccctgcgggacctgggttgtcatgtcgagctccgagagctgtggacaggccagaggggcaacctggcgccatgaccccaggcccagtctgggccgtgactctgggtgagtcgtgtgactcaggaatgggggtagatccatgtcctccactgtcccccattagttctgtccccttcacaatgagaagtgttttctggcaggccctaggtaaagggtcgggggaggggggagccttgtagggaggcctctacacagaagaaagcagcccccatgtcccagccacttctgggtcccagccagcagcacggatgttactgtcctgctccttcccccagccccacgccctaccagagggggcaaagggcacgtcccatcactcactgccctgtctgaaatgtggcagccactgtgggccaggctcagggcagggcaggcgattccagtggggttgggccccctggcgcctgctgcttactgcagtttcatgcaggcctctgctccttgtctttcttacctgtaaaatgggtctcagatgctccgccctgcttggccccagcttgtctgtctctgggtcctgggccagccaggatacctgataataaaagatcattgggtgaa

SEQ ID NO: 365115 - DNA, 2655 bp, Homo sapiens
ggatggccaaagtcttgttcccaagaaccacggagcgcaaatttccagtcctgagaacggaaatgccccaatttccggtggccaatgacctggtcccgagaatcagagtgagaaaattccagatcccggccacattctttgcgaaagtagctgtcatcactgatggaagggttgcttgatctgaaggaaggccctggaaatacgtcacttctcaggccttctcttccggcatctctagagtgagctacagatccactgagggagtatctgccatcgctgtggacgtcatcaaattgcttgatctgggcgccctaggatctagctaatgagattcgtcactcccatgcatcatggattcgttgcttctgtaacagctcaattcctggtatctctgcgcctgtatttgccttggttcgcggtcgtccttggttatcgtgagcgtccgcgagtctctgggaggccaagcctaggggcgccacagcgcctgcgcgcgtacggcggccggaaggggctagaggcggctccctgggtgacaaccgcgcgccccacctttccccacgtggccgcgaagaccgggtgagacgctgcggctgccgaggcctgtcccgcgcggagtggggagtgggggtgccgcagggtcgggctggcgcgaccctcggctcaggagcatctatcggctgcacgccaacatcaacacaggcgaagatggtctccaagcgcattgcccaggagacctttgatgcagctgtgcgcgagaacatcgaggagtttgcgatggggccagaggaggcagtgaaagaggccgtggagcagtttgaatcgcaaggggttgatctgagcaacattgtaaagacggcacctaaagtctctgcagacggatcccaggagcccacacatgacatcctgcagatgctcagtgacctccaggagtctgtggccagctctcgcccccaggaggtgtcagcatacctcacccgcttctgcgaccagtgcaaacaggacaaggcctgccgcttcctcgcggcccagaagggggcctaccccatcatcttcactgcctggaagctggccactgcaggtgaccagggccttctgctccagtccctcaatgccctgtcggtgctgactgatggacagccagacctcctggatgcccagggcctgcagctcctagtggccacgctgacccagaatgctgatgaggctgacctgacctgctctgggatccgctgtgtgcgtcacgcttgcctgaaacatgaacagaatcggcaagacctggtgaaagctggcgtgctgcctctgctgactggtgccatcacccatcatggccaccacactgacgtggtcagggaagcctgctgggccctgcgtgtcatgaccttcgatgacgacatccgtgtgccctttggccatgcccacaaccatgccaagatgattgtgcaggagaacaaaggcttgaaggtgctcatcgaagccaccaaagcgttcctggataaccctggcatcctgagcgagctctgtggaaccctgtcccgcctggccattcgcaacgagttctgccaggaggtcgtcgacctcgggggcctgagcattctggtgtccctgctagccgactgcaatgaccaccagatgagggaccagagcggcgttcaggagctcgtgaagcaagtgctgagcaccctgcgagccatcgcaggcaacgacgacgtgaaagatgctattgtccgtgctggtgggacggagtccatcgtggctgctatgacccagcatctgaccagcccccaggtgtgtgagcagagctgcgcggccctgtgcttcctggccctgcgtaagcccgacaacagccgcatcatcgtggagggtggcggggctgtggcagcactgcaggccatgaaggcacacccgcagaaggccggcgtgcagaaacaggcttgcatgctgatccgaaacctggtggcccacggccaggccttctcgaagcccatcctggacctgggggctgaggcactcatcatgcaggcccgatctgcccaccgtgactgtgaggacgtggccaaggccgccctgcgggacctgggttgtcatgtcgagctccgagagctgtggacaggccagaggggcaacctggcgccatgaccccaggcccagtctgggccgtgactctgggcccccagcttccgtggaatccagccgatgcaaacagctgaggagcgtcaccctggctgcacctctccgtggtgtccccgtctcccctgcccccagcaggaaagggtgctctcagctcagcagggctggcccaaacctctgacccagtcaccccgccctatccctcctccctggagactcccaggatgtgggagaaagatctcgaatctgccccagactgccctgacttaacttctgggccagtgtgaccttgggcagttctcaagcatttcttcatctgtcatgtggcggggtaggtgctcctgagctatttcgaggacggcctgcagtgctggccctgtcattcctgctccagccttgctctcagtctgcccatggctcccctttgccttctacataaaaccaaacctgtctgtggtcccagcaacttgggctaaggcgggaagatcacttgagcccaggagtcaaggctgcagtgagttaggatgg

SEQ ID NO: 365116 - DNA, 4020 bp, Homo sapiens
  misc_feature (4)..(4): n is a, c, g, or t
  misc_feature (6)..(6): n is a, c, g, or t
  misc_feature (8)..(8): n is a, c, g, or t
ggcngngncccgagagtcggggtgggggggctttgtgcgcggcggcggcgggagaggcggcggcggcggccagcacggaggcggaggccgagggggctgtgcacaggtcgccgcggagaggcgtgcgaattccgagccgagcgccgaggaccgtgctacccaggccgggctgccagccgcaggctcctctctggcagcagcggcggcgcggcgacccccgtccctcggcctccccttcccatcccacctcccgagccttcctcttcccgcagcacgcccggcccggcccggccgtggccctcctcagtgccggccgccatggcagaggcgtccggcgcggggaaaatctagcccggggatttcatgcggcctagctcggttccgcctcctcctcgcgcggccccagcggctgcccgcaccccagccccactccgggcctccgtgtctctcctgtgatcgcactgacacggccggggggttagaatggaacaaactgaaggcccgatgagagaaagggaaagttaaggatgctggagcagaacaatggatttctctttctctttcatgcaagggatcatgggaaacacaattcagcaaccacctcaactcattgactccgccaacatccgtcaggaggatgcctttgataacaacagtgacattgctgaagatggtggccagacaccatatgaagctactttgcagcaaggctttcagtacccagctacaacagaagatcttcctccactcacaaatgggtatccatcatcaatcagtgtgtatgaaactcaaaccaaataccagtcatataatcagtatcctaatgggtcagccaatggctttggtgcagttagaaactttagccccactgactattatcattcagaaattccaaacacaagaccacatgaaattctggaaaaaccttcccctccacagccaccacctcctccttcggtaccacaaactgtgattccaaagaagactggctcacctgaaattaaactaaaaataaccaaaactatccagaatggcagggaattgtttgagtcttccctttgtggagaccttttaaatgaagtacaggcaagtgagcacacgaaatcaaagcatgaaagcagaaaagaaaagaggaaaaaaagcaacaagcatgactcatcaagatctgaagagcgcaagtcacacaaaatccccaaattagaaccagaggaacaaaatagaccaaatgagagggttgacactgtatcagaaaaaccaagggaagaaccagtactaaaagaggaagccccagttcagccaatactatcttctgttccaacaacggaagtgtccactggtgttaagtttcaggttggcgatcttgtgtggtccaaggtgggaacctatccttggtggccttgtatggtttcaagtgatccccagcttgaggttcatactaaaattaacacaagaggtgcccgagaatatcatgtccagttttttagcaaccagccagagagggcgtgggttcatgaaaaacgggtacgagagtataaaggtcataaacagtatgaagaattactggctgaggcaaccaaacaagccagcaatcactctgagaaacaaaagattcggaaaccccgacctcagagagaacgtgctcagtgggatattggcattgcccatgcagagaaagcattgaaaatgactcgagaagaaagaatagaacagtatacttttatttacattgataaacagcctgaagaggctttatcccaagcaaaaaagagtgttgcctccaaaaccgaagttaaaaaaacccgacgaccaagatctgtgctgaatactcagccagaacagaccaatgcaggggaggtggcctcctcactctcaagtactgaaattcggagacatagccagaggcggcacacaagtgcggaagaggaagagccaccgcctgttaaaatagcctggaaaactgcggcagcaaggaaatccttaccagcttccattacgatgcacaaagggagcctggatttgcagaagtgtaacatgtctccagttgtgaaaattgaacaagtgtttgctcttcagaatgctacaggggatgggaaatttatcgatcaatttgtttattcaacaaagggaattggtaacaaaacagaaataagtgtcagggggcaagacaggcttataatttctacaccaaaccagagaaatgaaaagccaacgcagagtgtatcatctcctgaagcaacatctggttctacaggctcagtagaaaagaagcaacagagaagatcaattagaactcgttctgaatcagagaaatccactgaggttgtgccaaagaagaagatcaaaaaggagcaggttgaaacagttcctcaggctacagtgaagactggattacagaaagggtcggcggaccggggagtgcagggctctgtcagattcagtgacagctccgtctccgcagcgattgaggaaactgtggactgagattcctgtacaatttcatcccagaaactccagacttgtagtctccatgcaagatttctttgtcggcggcttgataaacagtttctttgttttcgattttgatttcgccaatcatcattattggcattttcctgcctggtttcttcttcaagactctgaacaattgctttaacagtcaaatgatttttttttttcggtttgagctggatgggtacagcttaaatcatgggtccagcctaaaaaccaccatttaacttacactgatcaatttcaacatggactgtttttggttttttgtttttaaataaagcatcattaatgcacatctgcaggggtttgccaaacagcccaaactgtatacattacaatcattaaaagttcttattttttttaatattagtgccgttatcatggagaacagcatgacagctgtctttggcagtctgtcatttttctagcattttcagaaactcatcggaaatggcggtacctgtgtttcccttcgaaagcctctcagtacagcactcctgttcctctgttaaaactccttgttaatccagtgatcttttaggccaaggaaatattttgtgatggtgttctgggtccatacaccagcaatgaaggagatagatttgtgtacttgtgttttttaatcagcattaacatgggcaggcaccctcatttatagatgtcaggaaacattcagtgaaaaacttgtagaatgggatgtgataacgaggttccagtaatctgagcagtctaacgaggcccacctcctccaccacagaacgtggctatgttccaagtgctactctcactcagcctgttgcggatcttcatggcctcaggagacttgtttctccatgggctcttctggactgcacacttccaccatagcttgctgggttgatctagatgtctgtttgttgtatggaaattttgggggaaaaaatccaaaacacaaactgtgggttgaaatattaaccgtctccttggttccttggtattcaccgtgcctgatctgcacatttcatcgtggctgtttctgtatagcctatactgcattagcccaagagattgttgctttgtaactttttgcactattgttttggctggatttgtattacacacagttttaaaaaaaacaattccacactattctctgccttttttttcctatttatttcttcccgcacaaattccacatagaggccttcccatccagctctacgtgatttggctgcacttgaacactgattgtccatttacagccctcagcaatgtgccttctaaatggcatgacatatgtagatgtgctgcagcgcttgttaatggtcacaataaatgccacttcaccaaggaagtctcagatgaacaattatgaacatccaaattttattggggggcaataatcaactgaattgcaaaatttgggggaaaatggcactatccgtgtacgaatcgaatacaaatcaaagatttgtcacatccctaataaaaacaagatggagatgtctctgcaaccatatttgtaagcta

SEQ ID NO: 365117 - DNA, 5492 bp, Homo sapiens
  misc_feature (4)..(4): n is a, c, g, or t
  misc_feature (6)..(6): n is a, c, g, or t
  misc_feature (8)..(8): n is a, c, g, or t
ggcngngncccgagagtcggggtgggggggctttgtgcgcggcggcggcgggagaggcggcggcggcggccagcacggaggcggaggccgagggggctgtgcacaggtcgccgcggagaggcgtgcgaattccgagccgagcgccgaggaccgtgctacccaggccgggctgccagccgcaggctcctctctggcagcagcggcggcgcggcgacccccgtccctcggcctccccttcccatcccacctcccgagccttcctcttcccgcagcacgcccggcccggcccggccgtggccctcctcagtgccggccgccatggcagaggcgtccggcgcggggaaaatctagcccggggatttcatgcggcctagctcggttccgcctcctcctcgcgcggccccagcggctgcccgcaccccagccccactccgggcctccgtgtctctcctgtgatcgcactgacacggccggggggttagaatggaacaaactgaaggcccgatgagagaaagggaaagttaaggatgctggagcagaacaatggatttctctttctctttcatgcaagggatcatgggaaacacaattcagcaaccacctcaactcattgactccgccaacatccgtcaggaggatgcctttgataacaacagtgacattgctgaagatggtggccagacaccatatgaagctactttgcagcaaggctttcagtacccagctacaacagaagatcttcctccactcacaaatgggtatccatcatcaatcagtgtgtatgaaactcaaaccaaataccagtcatataatcagtatcctaatgggtcagccaatggctttggtgcagttagaaactttagccccactgactattatcattcagaaattccaaacacaagaccacatgaaattctggaaaaaccttcccctccacagccaccacctcctccttcggtaccacaaactgtgattccaaagaagactggctcacctgaaattaaactaaaaataaccaaaactatccagaatggcagggaattgtttgagtcttccctttgtggagaccttttaaatgaagtacaggcaagtgagcacacgaaatcaaagcatgaaagcagaaaagaaaagaggaaaaaaagcaacaagcatgactcatcaagatctgaagagcgcaagtcacacaaaatccccaaattagaaccagaggaacaaaatagaccaaatgagagggttgacactgtatcagaaaaaccaagggaagaaccagtactaaaagaggaagccccagttcagccaatactatcttctgttccaacaacggaagtgtccactggtgttaagtttcaggttggcgatcttgtgtggtccaaggtgggaacctatccttggtggccttgtatggtttcaagtgatccccagcttgaggttcatactaaaattaacacaagaggtgcccgagaatatcatgtccagttttttagcaaccagccagagagggcgtgggttcatgaaaaacgggtacgagagtataaaggtcataaacagtatgaagaattactggctgaggcaaccaaacaagccagcaatcactctgagaaacaaaagattcggaaaccccgacctcagagagaacgtgctcagtgggatattggcattgcccatgcagagaaagcattgaaaatgactcgagaagaaagaatagaacagtatacttttatttacattgataaacagcctgaagaggctttatcccaagcaaaaaagagtgttgcctccaaaaccgaagttaaaaaaacccgacgaccaagatctgtgctgaatactcagccagaacagaccaatgcaggggaggtggcctcctcactctcaagtactgaaattcggagacatagccagaggcggcacacaagtgcggaagaggaagagccaccgcctgttaaaatagcctggaaaactgcggcagcaaggaaatccttaccagcttccattacgatgcacaaagggagcctggatttgcagaagtgtaacatgtctccagttgtgaaaattgaacaagtgtttgctcttcagaatgctacaggggatgggaaatttatcgatcaatttgtttattcaacaaagggaattggtaacaaaacagaaataagtgtcagggggcaagacaggcttataatttctacaccaaaccagagaaatgaaaagccaacgcagagtgtatcatctcctgaagcaacatctggttctacaggctcagtagaaaagaagcaacagagaagatcaattagaactcgttctgaatcagagaaatccactgaggttgtgccaaagaagaagatcaaaaaggagcaggttgaaacagttcctcaggctacagtgaagactggattacagaaaggtgccagcgagatttcagattcctgtaaacctctaaagaaaaggagtcgcgcctcaactgatgtagaaatgactagttcagcatacagagacacatctgactccgattctagaggactgagtgacctgcaggtaggctttggaaagcaagtagatagcccttcagctactgcagatgcagacgtttctgatgtgcagtccatggattcaagtttgtcgagaagaggcactggaatgagtaagaaggacactgtatgtcagatttgtgaaagctctggtgactctctgattccttgtgagggagagtgctgcaaacactttcacctggagtgcctgggattggcatcacttcctgatagcaagttcatctgcatggaatgtaaaactgggcagcacccatgtttttcgtgtaaagtgtctggtaaagatgtgaagcgttgttctgttggtgcttgtgggaaattttatcatgaagcctgtgtccgcaaattccccactgccatctttgaatcaaaaggattccgctgtcctcagcactgctgctctgcctgctctatggagaaagatatccacaaagcaagtaaaggccgcatgatgagatgtttaagatgtccagttgcctatcactctggagatgcttgcattgcggccggaagcatgttagtatcctcctacattctcatctgtagtaatcattccaaacggagcagtaattcttctgctgtaaatgtaggcttttgtttcgtttgtgccagagggctgatagttcaggaccattcagaccccatgttcagttcatatgcctataagtcccactacctactgaatgaatcaaatcgtgctgagttgatgaaattacctatgattccttcttcgtcagcttccaaaaagaaatgtgagaaaggtggaagattgctctgctgtgaatcgtgcccagcttccttccacccggaatgcctaagcatagaaatgccagaaggctgctggaattgtaatgactgtaaagctggcaagaaactacattacaagcagattgtttgggtcaaattgggaaattacagatggtggccagcagagatctgcaaccccaggtctgtgccactgaacatccagggccttaaacatgacttgggggacttccctgtattcttctttggttctcatgactactactgggtacaccagggcagagtgttcccttatgttgaaggagacaaaagctttgctgaagggcagactagtattaacaagaccttcaaaaaggcactggaagaagctgcaaaacgtttccaggaattgaaagcacaaagagaaagtaaagaagccctagagattgaaaaaaactcaagaaaaccccctccctacaaacacatcaaagctaacaaagtaataggaaaggtgcagatccaggttgctgacctgtcagagattccccgctgtaactgcaagccagctgatgaaaacccttgtggcttggaatcggagtgcctgaacagaatgttgcagtatgaatgccacccgcaggtgtgcccagctggagatcgttgtcagaaccagtgctttacaaagagactataccctgatgcagagatcatcaaaacggagcggagaggctggggcctcaggaccaaaaggagcattaagaagggtgaatttgtaaatgaatacgtcggtgaattaattgatgaagaagaatgcagattgcgaatcaagcgagcccacgagaacagtgtaactaatttttatatgttaactgttaccaaggaccgtataattgatgccggcccaaaaggaaattattctcgcttcatgaaccacagttgtaatcccaactgtgaaacacaaaagtggacagtgaatggagatgttcgagtgggactatttgctctctgtgatattcctgcagggatggagttaacatttaattataacctagattgtctgggcaacggcagaacggagtgccactgtggagcagataactgcagtggttttctaggagtgcggccaaagtcggcatgtgcgtcaacaaatgaagagaaggcaaaaaatgctaagttaaaacagaagagacgaaagatcaaaacagaaccaaagcagatgcatgaagattactgttttcaatgtggagatggtggagagctggtcatgtgtgacaaaaaagactgtcccaaagcataccacctcctatgccttaacctgactcagccaccatatggaaagtgggagtgtccgtggcatcagtgcgatgagtgcagcagtgcagctgtttccttctgtgaattctgtccacattcattttgtaaagatcatgaaaagggggccctggttccctctgcactggaaggccgcctctgctgctcggaacatgaccccatggctcctgtgtcaccagaatactggagcaagataaaatgtaaatgggaatcacaagatcatggagaagaagtaaaagaataaatgtgtggtgtcccctcctttctatttaagtgaaaaaagcaaatagatcatgcatttaaaaagaagagactgctacagtgcatacagcctttgccatcggaactgccttattaaagcaaaaatgggaaaccagttcatgcaggcagaagcagttggtggtgtctggtttttgtttgatttggttggtttgggattcttttgtggagggttaaattcccttggtcttttcttgccttttattgtgcttcagtgccattgcagcttgaaaaagaaatgtttttgctgttaaaataagaacaaagagaaaagtaagttttgttaatgagataaatttaaagtctaagatgtgttccttggttgtataaagcaaaagtagccatcattcctttatttattttcatttttaggaatttcaagaagtgtagttcaatagtctaatcaagtgtgtgtgtgttttaagtaggaatctgagaaagccctctaggaaagggtatgataagctttatatacctctttactgagcagtaggtaggctcacttctctttcccttcaaaatgcttttcataggcttagagaagggctctatggaagtattaaatctggcctcttgaaaacaatgcctcggtggatttta

SEQ ID NO: 365118 - DNA, 1121 bp, Homo sapiens
  misc_feature (4)..(4): n is a, c, g, or t
  misc_feature (6)..(6): n is a, c, g, or t
  misc_feature (8)..(8): n is a, c, g, or t
ggcngngncccgagagtcggggtgggggggctttgtgcgcggcggcggcgggagaggcggcggcggcggccagcacggaggcggaggccgagggggctgtgcacaggtcgccgcggagaggcgtgcgaattccgagccgagcgccgaggaccgtgctacccaggccgggctgccagccgcaggctcctctctggcagcagcggcggcgcggcgacccccgtccctcggcctccccttcccatcccacctcccgagccttcctcttcccgcagcacgcccggcccggcccggccgtggccctcctcagtgccggccgccatggcagaggcgtccggcgcggggaaaatctagcccggggatttcatgcggcctagctcggttccgcctcctcctcgcgcggccccagcggctgcccgcaccccagccccactccgggcctccgtgtctctcctgtgatcgcactgacacggccggggggttagaatggaacaaactgaaggcccgatgagagaaagggaaagttaaggatgctggagcagaacaatggatttctctttctctttcatgcaagggatcatgggaaacacaattcagcaaccacctcaactcattgactccgccaacatccgtcaggaggatgcctttgataacaacagtgacattgctgaagatggtggccagacaccatatgaagctactttgcagcaaggctttcagtacccagctacaacagaagatcttcctccactcacaaatgggtatccatcatcaatcagtgtgtatgaaactcaaaccaaataccagtcatataatcagtatcctaatgggtcagccaatggctttggtgcagttagaaactttagccccactgactattatcattcagaaattccaaacacaagaccacatgaaattctggaaaaaccttcccctccacagccaccacctcctccttcggtaccacaaactgtgattccaaagaagactggctcacctgaaattaaactaaaaataaccaaaactatccagaatggcagggaattgtttgagtcttccctttgtggagaccttttaaatgaagtacaggcaagtgagcacacgaaatcaaagcatgaaagcag

SEQ ID NO: 365119 - DNA, 3636 bp, Homo sapiens
  misc_feature (4)..(4): n is a, c, g, or t
  misc_feature (6)..(6): n is a, c, g, or t
  misc_feature (8)..(8): n is a, c, g, or t
ggcngngncccgagagtcggggtgggggggctttgtgcgcggcggcggcgggagaggcggcggcggcggccagcacggaggcggaggccgggggttagaatggaacaaactgaaggcccgatgagagaaagggaaagttaaggatgctggagcagaacaatggatttctctttctctttcatgcaagggatcatgggaaacacaattcagcaaccacctcaactcattgactccgccaacatccgtcaggaggatgcctttgataacaacagtgacattgctgaagatggtggccagacaccatatgaagctactttgcagcaaggctttcagtacccagctacaacagaagatcttcctccactcacaaatgggtatccatcatcaatcagtgtgtatgaaactcaaaccaaataccagtcatataatcagtatcctaatgggtcagccaatggctttggtgcagttagaaactttagccccactgactattatcattcagaaattccaaacacaagaccacatgaaattctggaaaaaccttcccctccacagccaccacctcctccttcggtaccacaaactgtgattccaaagaagactggctcacctgaaattaaactaaaaataaccaaaactatccagaatggcagggaattgtttgagtcttccctttgtggagaccttttaaatgaagtacaggcaagtgagcacacgaaatcaaagcatgaaagcagaaaagaaaagaggaaaaaaagcaacaagcatgactcatcaagatctgaagagcgcaagtcacacaaaatccccaaattagaaccagaggaacaaaatagaccaaatgagagggttgacactgtatcagaaaaaccaagggaagaaccagtactaaaagaggaagccccagttcagccaatactatcttctgttccaacaacggaagtgtccactggtgttaagtttcaggttggcgatcttgtgtggtccaaggtgggaacctatccttggtggccttgtatggtttcaagtgatccccagcttgaggttcatactaaaattaacacaagaggtgcccgagaatatcatgtccagttttttagcaaccagccagagagggcgtgggttcatgaaaaacgggtacgagagtataaaggtcataaacagtatgaagaattactggctgaggcaaccaaacaagccagcaatcactctgagaaacaaaagattcggaaaccccgacctcagagagaacgtgctcagtgggatattggcattgcccatgcagagaaagcattgaaaatgactcgagaagaaagaatagaacagtatacttttatttacattgataaacagcctgaagaggctttatcccaagcaaaaaagagtgttgcctccaaaaccgaagttaaaaaaacccgacgaccaagatctgtgctgaatactcagccagaacagaccaatgcaggggaggtggcctcctcactctcaagtactgaaattcggagacatagccagaggcggcacacaagtgcggaagaggaagagccaccgcctgttaaaatagcctggaaaactgcggcagcaaggaaatccttaccagcttccattacgatgcacaaagggagcctggatttgcagaagtgtaacatgtctccagttgtgaaaattgaacaagtgtttgctcttcagaatgctacaggggatgggaaatttatcgatcaatttgtttattcaacaaagggaattggtaacaaaacagaaataagtgtcagggggcaagacaggcttataatttctacaccaaaccagagaaatgaaaagccaacgcagagtgtatcatctcctgaagcaacatctggttctacaggctcagtagaaaagaagcaacagagaagatcaattagaactcgttctgaatcagagaaatccactgaggttgtgccaaagaagaagatcaaaaaggagcaggttgaaacagttcctcaggctacagtgaagactggattacagaaagggtcggcggaccggggagtgcagggctctgtcagattcagtgacagctccgtctccgcagcgattgaggaaactgtggactgagattcctgtacaatttcatcccagaaactccagacttgtagtctccatgcaagatttctttgtcggcggcttgataaacagtttctttgttttcgattttgatttcgccaatcatcattattggcattttcctgcctggtttcttcttcaagactctgaacaattgctttaacagtcaaatgatttttttttttcggtttgagctggatgggtacagcttaaatcatgggtccagcctaaaaaccaccatttaacttacactgatcaatttcaacatggactgtttttggttttttgtttttaaataaagcatcattaatgcacatctgcaggggtttgccaaacagcccaaactgtatacattacaatcattaaaagttcttattttttttaatattagtgccgttatcatggagaacagcatgacagctgtctttggcagtctgtcatttttctagcattttcagaaactcatcggaaatggcggtacctgtgtttcccttcgaaagcctctcagtacagcactcctgttcctctgttaaaactccttgttaatccagtgatcttttaggccaaggaaatattttgtgatggtgttctgggtccatacaccagcaatgaaggagatagatttgtgtacttgtgttttttaatcagcattaacatgggcaggcaccctcatttatagatgtcaggaaacattcagtgaaaaacttgtagaatgggatgtgataacgaggttccagtaatctgagcagtctaacgaggcccacctcctccaccacagaacgtggctatgttccaagtgctactctcactcagcctgttgcggatcttcatggcctcaggagacttgtttctccatgggctcttctggactgcacacttccaccatagcttgctgggttgatctagatgtctgtttgttgtatggaaattttgggggaaaaaatccaaaacacaaactgtgggttgaaatattaaccgtctccttggttccttggtattcaccgtgcctgatctgcacatttcatcgtggctgtttctgtatagcctatactgcattagcccaagagattgttgctttgtaactttttgcactattgttttggctggatttgtattacacacagttttaaaaaaaacaattccacactattctctgccttttttttcctatttatttcttcccgcacaaattccacatagaggccttcccatccagctctacgtgatttggctgcacttgaacactgattgtccatttacagccctcagcaatgtgccttctaaatggcatgacatatgtagatgtgctgcagcgcttgttaatggtcacaataaatgccacttcaccaaggaagtctcagatgaacaattatgaacatccaaattttattggggggcaataatcaactgaattgcaaaatttgggggaaaatggcactatccgtgtacgaatcgaatacaaatcaaagatttgtcacatccctaataaaaacaagatggagatgtctctgcaaccatatttgtaagcta

SEQ ID NO: 365120 - DNA, 5345 bp, Homo sapiens
  misc_feature (4)..(4): n is a, c, g, or t
  misc_feature (6)..(6): n is a, c, g, or t
  misc_feature (8)..(8): n is a, c, g, or t
ggcngngncccgagagtcggggtgggggggctttgtgcgcggcggcggcgggagaggcggcggcggcggccagcacggaggcggaggccgagggggctgtgcacaggtcgccgcggagaggcgtgcgaattccgagccgagcgccgaggaccgtgctacccaggccgggctgccagccgcaggctcctctctggcagcagcggcggcgcggcgacccccgtccctcggcctccccttcccatcccacctcccgagccttcctcttcccgcagcacgcccggcccggcccggccgtggccctcctcagtgccggccgccatggcagaggcgtccggcgcggggaaaatctagcccggggatttcatgcggcctagctcggttccgcctcctcctcgcgcggccccagcggctgcccgcaccccagccccactccgggcctccgtgtctctcctgtgatcgcactgacacggccggggggttagaatggaacaaactgaaggcccgatgagagaaagggaaagttaaggatgctggagcagaacaatggatttctctttctctttcatgcaagggatcatgggaaacacaattcagcaaccacctcaactcattgactccgccaacatccgtcaggaggatgcctttgataacaacagtgacattgctgaagatggtggccagacaccatatgaagctactttgcagcaaggctttcagtacccagctacaacagaagatcttcctccactcacaaatgggtatccatcatcaatcagtgtgtatgaaactcaaaccaaataccagtcatataatcagtatcctaatgggtcagccaatggctttggtgcagttagaaactttagccccactgactattatcattcagaaattccaaacacaagaccacatgaaattctggaaaaaccttcccctccacagccaccacctcctccttcggtaccacaaactgtgattccaaagaagactggctcacctgaaattaaactaaaaataaccaaaactatccagaatggcagggaattgtttgagtcttccctttgtggagaccttttaaatgaagtacaggcaagtgagcacacgaaatcaaagcatgaaagcagaaaagaaaagaggaaaaaaagcaacaagcatgactcatcaagatctgaagagcgcaagtcacacaaaatccccaaattagaaccagaggaacaaaatagaccaaatgagagggttgacactgtatcagaaaaaccaagggaagaaccagtactaaaagaggaagccccagttcagccaatactatcttctgttccaacaacggaagtgtccactggtgttaagtttcaggttggcgatcttgtgtggtccaaggtgggaacctatccttggtggccttgtatggtttcaagtgatccccagcttgaggttcatactaaaattaacacaagaggtgcccgagaatatcatgtccagttttttagcaaccagccagagagggcgtgggttcatgaaaaacgggtacgagagtataaaggtcataaacagtatgaagaattactggctgaggcaaccaaacaagccagcaatcactctgagaaacaaaagattcggaaaccccgacctcagagagaacgtgctcagtgggatattggcattgcccatgcagagaaagcattgaaaatgactcgagaagaaagaatagaacagtatacttttatttacattgataaacagcctgaagaggctttatcccaagcaaaaaagagtgttgcctccaaaaccgaagttaaaaaaacccgacgaccaagatctgtgctgaatactcagccagaacagaccaatgcaggggaggtggcctcctcactctcaagtactgaaattcggagacatagccagaggcggcacacaagtgcggaagaggaagagccaccgcctgttaaaatagcctggaaaactgcggcagcaaggaaatccttaccagcttccattacgatgcacaaagggagcctggatttgcagaagtgtaacatgtctccagttgtgaaaattgaacaagtgtttgctcttcagaatgctacaggggatgggaaatttatcgatcaatttgtttattcaacaaagggaattggtaacaaaacagaaataagtgtcagggggcaagacaggcttataatttctacaccaaaccagagaaatgaaaagccaacgcagagtgtatcatctcctgaagcaacatctggttctacaggctcagtagaaaagaagcaacagagaagatcaattagaactcgttctgaatcagagaaatccactgaggttgtgccaaagaagaagatcaaaaaggagcaggttgaaacagttcctcaggctacagtgaagactggattacagaaaggtgccagcgagatttcagattcctgtaaacctctaaagaaaaggagtcgcgcctcaactgatgtagaaatgactagttcagcatacagagacacatctgactccgattctagaggactgagtgacctgcaggtaggctttggaaagcaagtagatagcccttcagctactgcagatgcagacgtttctgatgtgcagtccatggattcaagtttgtcgagaagaggcactggaatgagtaagaaggacactgtatgtcagatttgtgaaagctctggtgactctctgattccttgtgagggagagtgctgcaaacactttcacctggagtgcctgggattggcatcacttcctgatagcaagttcatctgcatggaatgtaaaactgggcagcacccatgtttttcgtgtaaagtgtctggtaaagatgtgaagcgttgttctgttggtgcttgtgggaaattttatcatgaagcctgtgtccgcaaattccccactgccatctttgaatcaaaaggattccgctgtcctcagcactgctgctctgcctgctctatggagaaagatatccacaaagcaagtaaaggccgcatgatgagatgtttaagatgtccagttgcctatcactctggagatgcttgcattgcggccggaagcatgttagtatcctcctacattctcatctgtagtaatcattccaaacggagcagtaattcttctgctgtaaatgtaggcttttgtttcgtttgtgccagaggtggaagattgctctgctgtgaatcgtgcccagcttccttccacccggaatgcctaagcatagaaatgccagaaggctgctggaattgtaatgactgtaaagctggcaagaaactacattacaagcagattgtttgggtcaaattgggaaattacagatggtggccagcagagatctgcaaccccaggtctgtgccactgaacatccagggccttaaacatgacttgggggacttccctgtattcttctttggttctcatgactactactgggtacaccagggcagagtgttcccttatgttgaaggagacaaaagctttgctgaagggcagactagtattaacaagaccttcaaaaaggcactggaagaagctgcaaaacgtttccaggaattgaaagcacaaagagaaagtaaagaagccctagagattgaaaaaaactcaagaaaaccccctccctacaaacacatcaaagctaacaaagtaataggaaaggtgcagatccaggttgctgacctgtcagagattccccgctgtaactgcaagccagctgatgaaaacccttgtggcttggaatcggagtgcctgaacagaatgttgcagtatgaatgccacccgcaggtgtgcccagctggagatcgttgtcagaaccagtgctttacaaagagactataccctgatgcagagatcatcaaaacggagcggagaggctggggcctcaggaccaaaaggagcattaagaagggtgaatttgtaaatgaatacgtcggtgaattaattgatgaagaagaatgcagattgcgaatcaagcgagcccacgagaacagtgtaactaatttttatatgttaactgttaccaaggaccgtataattgatgccggcccaaaaggaaattattctcgcttcatgaaccacagttgtaatcccaactgtgaaacacaaaagtggacagtgaatggagatgttcgagtgggactatttgctctctgtgatattcctgcagggatggagttaacatttaattataacctagattgtctgggcaacggcagaacggagtgccactgtggagcagataactgcagtggttttctaggagtgcggccaaagtcggcatgtgcgtcaacaaatgaagagaaggcaaaaaatgctaagttaaaacagaagagacgaaagatcaaaacagaaccaaagcagatgcatgaagattactgttttcaatgtggagatggtggagagctggtcatgtgtgacaaaaaagactgtcccaaagcataccacctcctatgccttaacctgactcagccaccatatggaaagtgggagtgtccgtggcatcagtgcgatgagtgcagcagtgcagctgtttccttctgtgaattctgtccacattcattttgtaaagatcatgaaaagggggccctggttccctctgcactggaaggccgcctctgctgctcggaacatgaccccatggctcctgtgtcaccagaatactggagcaagataaaatgtaaatgggaatcacaagatcatggagaagaagtaaaagaataaatgtgtggtgtcccctcctttctatttaagtgaaaaaagcaaatagatcatgcatttaaaaagaagagactgctacagtgcatacagcctttgccatcggaactgccttattaaagcaaaaatgggaaaccagttcatgcaggcagaagcagttggtggtgtctggtttttgtttgatttggttggtttgggattcttttgtggagggttaaattcccttggtcttttcttgccttttattgtgcttcagtgccattgcagcttgaaaaagaaatgtttttgctgttaaaataagaacaaagagaaaagtaagttttgttaatgagataaatttaaagtctaagatgtgttccttggttgtataaagcaaaagtagccatcattcctttatttattttcatttttaggaatttcaagaagtgtagttcaatagtctaatcaagtgtgtgtgtgttttaagtaggaatctgagaaagccctctaggaaagggtatgataagctttatatacctctttactgagcagtaggtaggctcacttctctttcccttcaaaatgcttttcataggcttagagaagggctctatggaagtattaaatctggcctcttgaaaacaatgcctcggtggatttta

SEQ ID NO: 365121 - DNA, 3966 bp, Homo sapiens
  misc_feature (4)..(4): n is a, c, g, or t
  misc_feature (6)..(6): n is a, c, g, or t
  misc_feature (8)..(8): n is a, c, g, or t
ggcngngncccgagagtcggggtgggggggctttgtgcgcggcggcggcgggagaggcggcggcggcggccagcacggaggcggaggccgagggggctgtgcacaggtcgccgcggagaggcgtgcgaattccgagccgagcgccgaggaccgtgctacccaggccgggctgccagccgcaggctcctctctggcagcagcggcggcgcggcgacccccgtccctcggcctccccttcccatcccacctcccgagccttcctcttcccgcagcacgcccggcccggcccggccgtggccctcctcagtgccggccgccatggcagaggcgtccggcgcggggaaaatctagcccggggatttcatgcggcctagctcggttccgcctcctcctcgcgcggccccagcggctgcccgcaccccagccccactccgggcctccgtgtctctcctgtgatcgcactgacacggccggggggttagaatggaacaaactgaaggcccgatgagagaaagggaaagttaaggatgctggagcagaacaatggatttctctttctctttcatgcaagggatcatgggaaacacaattcagcaaccacctcaactcattgactccgccaacatccgtcaggaggatgcctttgataacaacagtgacattgctgaagatggtggccagacaccatatgaagctactttgcagcaaggctttcagtacccagctacaacagaagatcttcctccactcacaaatgggtatccatcatcaatcagtgtgtatgaaactcaaaccaaataccagtcatataatcagtatcctaatgggtcagccaatggctttggtgcagttagaaactttagccccactgactattatcattcagaaattccaaacacaagaccacatgaaattctggaaaaaccttcccctccacagccaccacctcctccttcggtaccacaaactgtgattccaaagaagactggctcacctgaaattaaactaaaaataaccaaaactatccagaatggcagggaattgtttgagtcttccctttgtggagaccttttaaatgaagtacaggcaagtgagcacacgaaatcaaagcatgaaagcagaaaagaaaagaggaaaaaaagcaacaagcatgactcatcaagatctgaagagcgcaagtcacacaaaatccccaaattagaaccagaggaacaaaatagaccaaatgagagggttgacactgtatcagaaaaaccaagggaagaaccagtactaaaagaggaagccccagttcagccaatactatcttctgttccaacaacggaagtgtccactggtgttaagtttcaggttggcgatcttgtgtggtccaaggtgggaacctatccttggtggccttgtatggtttcaagtgatccccagcttgaggttcatactaaaattaacacaagaggtgcccgagaatatcatgtccagttttttagcaaccagccagagagggcgtgggttcatgaaaaacgggtacgagagtataaaggtcataaacagtatgaagaattactggctgaggcaaccaaacaagccagcaatcactctgagaaacaaaagattcggaaaccccgacctcagagagaacgtgctcagtgggatattggcattgcccatgcagagaaagcattgaaaatgactcgagaagaaagaatagaacagtatacttttatttacattgataaacagcctgaagaggctttatcccaagcaaaaaagagtgttgcctccaaaaccgaagttaaaaaaacccgacgaccaagatctgtgctgaatactcagccagaacagaccaatgcaggggaggtggcctcctcactctcaagtactgaaattcggagacatagccagaggcggcacacaagtgcggaagaggaagagccaccgcctgttaaaatagcctggagcctggatttgcagaagtgtaacatgtctccagttgtgaaaattgaacaagtgtttgctcttcagaatgctacaggggatgggaaatttatcgatcaatttgtttattcaacaaagggaattggtaacaaaacagaaataagtgtcagggggcaagacaggcttataatttctacaccaaaccagagaaatgaaaagccaacgcagagtgtatcatctcctgaagcaacatctggttctacaggctcagtagaaaagaagcaacagagaagatcaattagaactcgttctgaatcagagaaatccactgaggttgtgccaaagaagaagatcaaaaaggagcaggttgaaacagttcctcaggctacagtgaagactggattacagaaagggtcggcggaccggggagtgcagggctctgtcagattcagtgacagctccgtctccgcagcgattgaggaaactgtggactgagattcctgtacaatttcatcccagaaactccagacttgtagtctccatgcaagatttctttgtcggcggcttgataaacagtttctttgttttcgattttgatttcgccaatcatcattattggcattttcctgcctggtttcttcttcaagactctgaacaattgctttaacagtcaaatgatttttttttttcggtttgagctggatgggtacagcttaaatcatgggtccagcctaaaaaccaccatttaacttacactgatcaatttcaacatggactgtttttggttttttgtttttaaataaagcatcattaatgcacatctgcaggggtttgccaaacagcccaaactgtatacattacaatcattaaaagttcttattttttttaatattagtgccgttatcatggagaacagcatgacagctgtctttggcagtctgtcatttttctagcattttcagaaactcatcggaaatggcggtacctgtgtttcccttcgaaagcctctcagtacagcactcctgttcctctgttaaaactccttgttaatccagtgatcttttaggccaaggaaatattttgtgatggtgttctgggtccatacaccagcaatgaaggagatagatttgtgtacttgtgttttttaatcagcattaacatgggcaggcaccctcatttatagatgtcaggaaacattcagtgaaaaacttgtagaatgggatgtgataacgaggttccagtaatctgagcagtctaacgaggcccacctcctccaccacagaacgtggctatgttccaagtgctactctcactcagcctgttgcggatcttcatggcctcaggagacttgtttctccatgggctcttctggactgcacacttccaccatagcttgctgggttgatctagatgtctgtttgttgtatggaaattttgggggaaaaaatccaaaacacaaactgtgggttgaaatattaaccgtctccttggttccttggtattcaccgtgcctgatctgcacatttcatcgtggctgtttctgtatagcctatactgcattagcccaagagattgttgctttgtaactttttgcactattgttttggctggatttgtattacacacagttttaaaaaaaacaattccacactattctctgccttttttttcctatttatttcttcccgcacaaattccacatagaggccttcccatccagctctacgtgatttggctgcacttgaacactgattgtccatttacagccctcagcaatgtgccttctaaatggcatgacatatgtagatgtgctgcagcgcttgttaatggtcacaataaatgccacttcaccaaggaagtctcagatgaacaattatgaacatccaaattttattggggggcaataatcaactgaattgcaaaatttgggggaaaatggcactatccgtgtacgaatcgaatacaaatcaaagatttgtcacatccctaataaaaacaagatggagatgtctctgcaaccatatttgtaagcta

SEQ ID NO: 365122 - DNA, 2772 bp, Homo sapiens
gcttctgccacatgatgacgagcgcggtgaaaccgatgaaggacatggcaccgcccacaaccgtcttccactcgttcgagcccctgttcatctcagcaaagctctccttgaacttaatgcgatacaactcgactttctcatccatggagaggctgctccaggaggccttctccttgtccttcagtgccttctggctggcagacaggtgcccgagaatatcatgtccagttttttagcaaccagccagagagggcgtgggttcatgaaaaacgggtacgagagtataaaggtcataaacagtatgaagaattactggctgaggcaaccaaacaagccagcaatcactctgagaaacaaaagattcggaaaccccgacctcagagagaacgtgctcagtgggatattggcattgcccatgcagagaaagcattgaaaatgactcgagaagaaagaatagaacagtatacttttatttacattgataaacagcctgaagaggctttatcccaagcaaaaaagagtgttgcctccaaaaccgaagttaaaaaaacccgacgaccaagatctgtgctgaatactcagccagaacagaccaatgcaggggaggtggcctcctcactctcaagtactgaaattcggagacatagccagaggcggcacacaagtgcggaagaggaagagccaccgcctgttaaaatagcctggaaaactgcggcagcaaggaaatccttaccagcttccattacgatgcacaaagggagcctggatttgcagaagtgtaacatgtctccagttgtgaaaattgaacaagtgtttgctcttcagaatgctacaggggatgggaaatttatcgatcaatttgtttattcaacaaagggaattggtaacaaaacagaaataagtgtcagggggcaagacaggcttataatttctacaccaaaccagagaaatgaaaagccaacgcagagtgtatcatctcctgaagcaacatctggttctacaggctcagtagaaaagaagcaacagagaagatcaattagaactcgttctgaatcagagaaatccactgaggttgtgccaaagaagaagatcaaaaaggagcaggttgaaacagttcctcaggctacagtgaagactggattacagaaagggtcggcggaccggggagtgcagggctctgtcagattcagtgacagctccgtctccgcagcgattgaggaaactgtggactgagattcctgtacaatttcatcccagaaactccagacttgtagtctccatgcaagatttctttgtcggcggcttgataaacagtttctttgttttcgattttgatttcgccaatcatcattattggcattttcctgcctggtttcttcttcaagactctgaacaattgctttaacagtcaaatgatttttttttttcggtttgagctggatgggtacagcttaaatcatgggtccagcctaaaaaccaccatttaacttacactgatcaatttcaacatggactgtttttggttttttgtttttaaataaagcatcattaatgcacatctgcaggggtttgccaaacagcccaaactgtatacattacaatcattaaaagttcttattttttttaatattagtgccgttatcatggagaacagcatgacagctgtctttggcagtctgtcatttttctagcattttcagaaactcatcggaaatggcggtacctgtgtttcccttcgaaagcctctcagtacagcactcctgttcctctgttaaaactccttgttaatccagtgatcttttaggccaaggaaatattttgtgatggtgttctgggtccatacaccagcaatgaaggagatagatttgtgtacttgtgttttttaatcagcattaacatgggcaggcaccctcatttatagatgtcaggaaacattcagtgaaaaacttgtagaatgggatgtgataacgaggttccagtaatctgagcagtctaacgaggcccacctcctccaccacagaacgtggctatgttccaagtgctactctcactcagcctgttgcggatcttcatggcctcaggagacttgtttctccatgggctcttctggactgcacacttccaccatagcttgctgggttgatctagatgtctgtttgttgtatggaaattttgggggaaaaaatccaaaacacaaactgtgggttgaaatattaaccgtctccttggttccttggtattcaccgtgcctgatctgcacatttcatcgtggctgtttctgtatagcctatactgcattagcccaagagattgttgctttgtaactttttgcactattgttttggctggatttgtattacacacagttttaaaaaaaacaattccacactattctctgccttttttttcctatttatttcttcccgcacaaattccacatagaggccttcccatccagctctacgtgatttggctgcacttgaacactgattgtccatttacagccctcagcaatgtgccttctaaatggcatgacatatgtagatgtgctgcagcgcttgttaatggtcacaataaatgccacttcaccaaggaagtctcagatgaacaattatgaacatccaaattttattggggggcaataatcaactgaattgcaaaatttgggggaaaatggcactatccgtgtacgaatcgaatacaaatcaaagatttgtcacatccctaataaaaacaagatggagatgtctctgcaaccatatttgtaagcta

SEQ ID NO: 365123 - DNA, 3936 bp, Homo sapiens
  misc_feature (4)..(4): n is a, c, g, or t
  misc_feature (6)..(6): n is a, c, g, or t
  misc_feature (8)..(8): n is a, c, g, or t
ggcngngncccgagagtcggggtgggggggctttgtgcgcggcggcggcgggagaggcggcggcggcggccagcacggaggcggaggccgagggggctgtgcacaggtcgccgcggagaggcgtgcgaattccgagccgagcgccgaggaccgtgctacccaggccgggctgccagccgcaggctcctctctggcagcagcggcggcgcggcgacccccgtccctcggcctccccttcccatcccacctcccgagccttcctcttcccgcagcacgcccggcccggcccggccgtggccctcctcagtgccggccgccatggcagaggcgtccggcgcggggaaaatctagcccggggatttcatgcggcctagctcggttccgcctcctcctcgcgcggccccagcggctgcccgcaccccagccccactccgggcctccgtgtctctcctgtgatcgcactgacacggccggggggttagaatggaacaaactgaaggcccgatgagagaaagggaaagttaaggatgctggagcagaacaatggatttctctttctctttcatgcaagggatcatgggaaacacaattcagcaaccacctcaactcattgactccgccaacatccgtcaggaggatgcctttgataacaacagtgacattgctgaagatggtggccagacaccatatgaagctactttgcagcaaggctttcagtacccagctacaacagaagatcttcctccactcacaaatgggtatccatcatcaatcagtgtgtatgaaactcaaaccaaataccagtcatataatcagtatcctaatgggtcagccaatggctttggtgcagttagaaactttagccccactgactattatcattcagaaattccaaacacaagaccacatgaaattctggaaaaaccttcccctccacagccaccacctcctccttcggtaccacaaactgtgattccaaagaagactggctcacctgaaattaaactaaaaataaccaaaactatccagaatggcagggaattgtttgagtcttccctttgtggagaccttttaaatgaagtacaggcaagtgagcacacgaaatcaaagcatgaaagcagaaaagaaaagaggaaaaaaagcaacaagcatgactcatcaagatctgaagagcgcaagtcacacaaaatccccaaattagaaccagaggaacaaaatagaccaaatgagagggttgacactgtatcagaaaaaccaagggaagaaccagtactaaaagaggaagccccagttcagccaatactatcttctgttccaacaacggaagtgtccactggtgttaagtttcaggttggcgatcttgtgtggtccaaggtgggaacctatccttggtggccttgtatggtttcaagtgatccccagcttgaggttcatactaaaattaacacaagaggtgcccgagaatatcatgtccagttttttagcaaccagccagagagggcgtgggttcatgaaaaacgggtacgagagtataaaggtcataaacagtatgaagaattactggctgaggcaaccaaacaagccagcaatcactctgagaaacaaaagattcggaaaccccgacctcagagagaacgtgctcagtgggatattggcattgcccatgcagagaaagcattgaaaatgactcgagaagaaagaatagaacagtatacttttatttacattgataaacagcctgaagaggctttatcccaagcaaaaaagagtgttgcctccaaaaccgaagttaaaaaaacccgacgaccaagatctgtgctgaatactcagccagaacagaccaatgcaggggaggtggcctcctcactctcaagtactgaaattcggagacatagccagaggcggcacacaagtgcggaagaggaagagccaccgcctgttaaaatagcctggaaaactgcggcagcaaggaaatccttaccagcttccattacgatgcacaaagggagcctggatttgcagaagtgtaacatgtctccagttgtgaaaattgaacaagtgtttgctcttcagaatgctacaggggatgggaaatttatcgatcaatttgtttattcaacaaagggaattggtaacaaaacagaaataagtgtcagggggcaagacaggcttataatttctacaccaaaccagagaaatgaaaagccaacgcagagtgtatcatctcctgaagcaacatctggttctacaggctcagtagaaaagaagcaacagagaagatcaattagaactcgttctgaatcagagaaatccactgaggttgtgccaaagaagaagatcaaaaaggagcaggttgaaacagttcctcaggctacagtgaagactggattacagaaagggtcggcggaccggggagtgcagggctctgtcagattcagtgacagctccgtctccgcagcgattgaggaaactgtggactgagattcctgtacaatttcatcccagaaactccagacttgtagtctccatgcaagatttctttgtcggcggcttgataaacagtttctttgttttcgattttgatttcgccaatcatcattattggcattttcctgcctggtttcttcttcaagactctgaacaattgctttaacagtcaaatgatttttttttttcggtttgagctggatgggtacagcttaaatcatgggtccagcctaaaaaccaccatttaacttacactgatcaatttcaacatggactgtttttggttttttgtttttaaataaagcatcattaatgcacatctgcaggggtttgccaaacagcccaaactgtatacattacaatcattaaaagttcttattttttttaatattagtgccgttatcatggagaacagcatgacagctgtctttggcagtctgtcatttttctagcattttcagaaactcatcggaaatggcggtacctgtgtttcccttcgaaagcctctcagtacagcactcctgttcctctgttaaaactccttgttaatccagtgatcttttaggccaaggaaatattttgtgatggtgttctgggtccatacaccagcaatgaaggagatagatttgtgtacttgtgttttttaatcagcattaacatgggcaggcaccctcatttatagatgtcaggaaacattcagtgaaaaacttgtagaatgggatgtgataacgaggttccagtaatctgagcagtctaacgaggcccacctcctccaccacagaacgtggctatgttccaagtgctactctcactcagcctgttgcggatcttcatggcctcaggagacttgtttctccatgggctcttctggactgcacacttccaccatagcttgctgggttgatctagatgtctgtttgttgtatggaaattttgggggaaaaaatccaaaacacaaactgtgggttgaaatattaaccgtctccttggttccttggtattcaccgtgcctgatctgcacatttcatcgtggctgtttctgtatagcctatactgcattagcccaagagattgttgctttgtaactttttgcactattgttttggctggatttgtattacacacagttttaaaaaaaacaattcaaaaaaaaaaaaaaaaaaaaaaaaacggggcggagcgggatactaaaaagtaaattccccacggggaggcggcaacaggatctatagcggggatcaccccagcgatttcagtggtaccacgggggggccccatagtagtagaggcggaaataataacgaatgagggaaacgtgggcggagttagacacgcggagtggacagcgggcacacagtgcaagaccggcgacccaccgtgggaaggaaaccataaccgggggcgcgaaacatggtggacagaacactaagagatattaaggaccaggaa

SEQ ID NO: 365124 - DNA, 5459 bp, Homo sapiens
  misc_feature (4)..(4): n is a, c, g, or t
  misc_feature (6)..(6): n is a, c, g, or t
  misc_feature (8)..(8): n is a, c, g, or t
ggcngngncccgagagtcggggtgggggggctttgtgcgcggcggcggcgggagaggcggcggcggcggccagcacggaggcggaggccgagggggctgtgcacaggtcgccgcggagaggcgtgcgaattccgagccgagcgccgaggaccgtgctacccaggccgggctgccagccgcaggctcctctctggcagcagcggcggcgcggcgacccccgtccctcggcctccccttcccatcccacctcccgagccttcctcttcccgcagcacgcccggcccggcccggccgtggccctcctcagtgccggccgccatggcagaggcgtccggcgcggggaaaatctagcccggggatttcatgcggcctagctcggttccgcctcctcctcgcgcggccccagcggctgcccgcaccccagccccactccgggcctccgtgtctctcctgtgatcgcactgacacggccggggggttagaatggaacaaactgaaggcccgatgagagaaagggaaagttaaggatgctggagcagaacaatggatttctctttctctttcatgcaagggatcatgggaaacacaattcagcaaccacctcaactcattgactccgccaacatccgtcaggaggatgcctttgataacaacagtgacattgctgaagatggtggccagacaccatatgaagctactttgcagcaaggctttcagtacccagctacaacagaagatcttcctccactcacaaatgggtatccatcatcaatcagtgtgtatgaaactcaaaccaaataccagtcatataatcagtatcctaatgggtcagccaatggctttggtgcagttagaaactttagccccactgactattatcattcagaaattccaaacacaagaccacatgaaattctggaaaaaccttcccctccacagccaccacctcctccttcggtaccacaaactgtgattccaaagaagactggctcacctgaaattaaactaaaaataaccaaaactatccagaatggcagggaattgtttgagtcttccctttgtggagaccttttaaatgaagtacaggcaagtgagcacacgaaatcaaagcatgaaagcagaaaagaaaagaggaaaaaaagcaacaagcatgactcatcaagatctgaagagcgcaagtcacacaaaatccccaaattagaaccagaggaacaaaatagaccaaatgagagggttgacactgtatcagaaaaaccaagggaagaaccagtactaaaagaggaagccccagttcagccaatactatcttctgttccaacaacggaagtgtccactggtgttaagtttcaggttggcgatcttgtgtggtccaaggtgggaacctatccttggtggccttgtatggtttcaagtgatccccagcttgaggttcatactaaaattaacacaagaggtgcccgagaatatcatgtccagttttttagcaaccagccagagagggcgtgggttcatgaaaaacgggtacgagagtataaaggtcataaacagtatgaagaattactggctgaggcaaccaaacaagccagcaatcactctgagaaacaaaagattcggaaaccccgacctcagagagaacgtgctcagtgggatattggcattgcccatgcagagaaagcattgaaaatgactcgagaagaaagaatagaacagtatacttttatttacattgataaacagcctgaagaggctttatcccaagcaaaaaagagtgttgcctccaaaaccgaagttaaaaaaacccgacgaccaagatctgtgctgaatactcagccagaacagaccaatgcaggggaggtggcctcctcactctcaagtactgaaattcggagacatagccagaggcggcacacaagtgcggaagaggaagagccaccgcctgttaaaatagcctggaaaactgcggcagcaaggaaatccttaccagcttccattacgatgcacaaagggagcctggatttgcagaagtgtaacatgtctccagttgtgaaaattgaacaagtgtttgctcttcagaatgctacaggggatgggaaatttatcgatcaatttgtttattcaacaaagggaattggtaacaaaacagaaataagtgtcagggggcaagacaggcttataatttctacaccaaaccagagaaatgaaaagccaacgcagagtgtatcatctcctgaagcaacatctggttctacaggctcagtagaaaagaagcaacagagaagatcaattagaactcgttctgaatcagagaaatccactgaggttgtgccaaagaagaagatcaaaaaggagcaggttgaaacagttcctcaggctacagtgaagactggattacagaaaggtgccagcgagatttcagattcctgtaaacctctaaagaaaaggagtcgcgcctcaactgatgtagaaatgactagttcagcatacagagacacatctgactccgattctagaggactgagtgacctgcaggtaggctttggaaagcaagtagatagcccttcagctactgcagatgcagacgtttctgatgtgcagtccatggattcaagtttgtcgagaagaggcactggaatgagtaagaaggacactgtatgtcagatttgtgaaagctctggtgactctctgattccttgtgagggagagtgctgcaaacactttcacctggagtgcctgggattggcatcacttcctgatagcaagttcatctgcatggaatgtaaaactgggcagcacccatgtttttcgtgtaaagtgtctggtaaagatgtgaagcgttgttctgttggtgcttgtgggaaattttatcatgaagcctgtgtccgcaaattccccactgccatctttgaatcaaaaggattccgctgtcctcagcactgctgctctgcctgctctatggagaaagatatccacaaagcaagtaaaggccgcatgatgagatgtttaagatgtccagttgcctatcactctggagatgcttgcattgcggccggaagcatgttagtatcctcctacattctcatctgtagtaatcattccaaacggagcagtaattcttctgctgtaaatgtaggcttttgtttcgtttgtgccagagggctgatagttcaggaccattcagaccccatgttcagttcatatgcctataagtcccactacctactgaatgaatcaaatcgtgctgagttgatgaaattacctatgattccttcttcgtcagcttccaaaaagaaatgtgagaaaggtggaagattgctctgctgtgaatcgtgcccagcttccttccacccggaatgcctaagcatagaaatgccagaaggctgctggaattgtaatgactgtaaagctggcaagaaactacattacaagcagattgtttgggtcaaattgggaaattacagatggtggccagcagagatctgcaaccccaggtctgtgccactgaacatccagggccttaaacatgacttgggggacttccctgtattcttctttggttctcatgactactactgggtacaccagggcagagtgttcccttatgttgaaggagacaaaagctttgctgaagggcagactagtattaacaagaccttcaaaaaggcactggaagaagctgcaaaacgtttccaggaattgaaagcacaaagagaaagtaaagaagccctagagattgaaaaaaactcaagaaaaccccctccctacaaacacatcaaagctaacaaagtaataggaaaggtgcagatccaggttgctgacctgtcagagattccccgctgtaactgcaagccagctgatgaaaacccttgtggcttggaatcggagtgcctgaacagaatgttgcagtatgaatgccacccgcaggtgtgcccagctggagatcgttgtcagaaccagtgctttacaaagagactataccctgatgcagagatcatcaaaacggagcggagaggctggggcctcaggaccaaaaggagcattaagaagggtgaatttgtaaatgaatacgtcggtgaattaattgatgaagaagaatgcagattgcgaatcaagcgagcccacgagaacagtgaccgtataattgatgccggcccaaaaggaaattattctcgcttcatgaaccacagttgtaatcccaactgtgaaacacaaaagtggacagtgaatggagatgttcgagtgggactatttgctctctgtgatattcctgcagggatggagttaacatttaattataacctagattgtctgggcaacggcagaacggagtgccactgtggagcagataactgcagtggttttctaggagtgcggccaaagtcggcatgtgcgtcaacaaatgaagagaaggcaaaaaatgctaagttaaaacagaagagacgaaagatcaaaacagaaccaaagcagatgcatgaagattactgttttcaatgtggagatggtggagagctggtcatgtgtgacaaaaaagactgtcccaaagcataccacctcctatgccttaacctgactcagccaccatatggaaagtgggagtgtccgtggcatcagtgcgatgagtgcagcagtgcagctgtttccttctgtgaattctgtccacattcattttgtaaagatcatgaaaagggggccctggttccctctgcactggaaggccgcctctgctgctcggaacatgaccccatggctcctgtgtcaccagaatactggagcaagataaaatgtaaatgggaatcacaagatcatggagaagaagtaaaagaataaatgtgtggtgtcccctcctttctatttaagtgaaaaaagcaaatagatcatgcatttaaaaagaagagactgctacagtgcatacagcctttgccatcggaactgccttattaaagcaaaaatgggaaaccagttcatgcaggcagaagcagttggtggtgtctggtttttgtttgatttggttggtttgggattcttttgtggagggttaaattcccttggtcttttcttgccttttattgtgcttcagtgccattgcagcttgaaaaagaaatgtttttgctgttaaaataagaacaaagagaaaagtaagttttgttaatgagataaatttaaagtctaagatgtgttccttggttgtataaagcaaaagtagccatcattcctttatttattttcatttttaggaatttcaagaagtgtagttcaatagtctaatcaagtgtgtgtgtgttttaagtaggaatctgagaaagccctctaggaaagggtatgataagctttatatacctctttactgagcagtaggtaggctcacttctctttcccttcaaaatgcttttcataggcttagagaagggctctatggaagtattaaatctggcctcttgaaaacaatgcctcggtggatttta

SEQ ID NO: 365125 - DNA, 3411 bp, Homo sapiens
  misc_feature (4)..(4): n is a, c, g, or t
  misc_feature (6)..(6): n is a, c, g, or t
  misc_feature (8)..(8): n is a, c, g, or t
ggcngngncccgagagtcggggtgggggggctttgtgcgcggcggcggcgggagaggcggcggcggcggccagcacggaggcggaggccgagggggctgtgcacaggtcgccgcggagaggcgtgcgaattccgagccgagcgccgaggaccgtgctacccaggccgggctgccagccgcaggctcctctctggcagcagcggcggcgcggcgacccccgtccctcggcctccccttcccatcccacctcccgagccttcctcttcccgcagcacgcccggcccggcccggccgtggccctcctcagtgccggccgccatggcagaggcgtccggcgcggggaaaatctagcccggggatttcatgcggcctagctcggttccgcctcctcctcgcgcggccccagcggctgcccgcaccccagccccactccgggcctccgtgtctctcctgtgatcgcactgacacggccggggggttagaatggaacaaactgaaggcccgatgagagaaagggaaagttaaggatgctggagcagaacaatggatttctctttctctttcatgcaagggatcatgggaaacacaattcagcaaccacctcaactcattgactccgccaacatccgtcaggaggatgcctttgataacaacagtgacattgctgaagatggtggccagacaccatatgaagctactttgcagcaaggctttcagtacccagctacaacagaagatcttcctccactcacaaatgggtatccatcatcaatcagtgtgtatgaaactcaaaccaaataccagtcatataatcagtatcctaatgggtcagccaatggctttggtgcagttagaaactttagccccactgactattatcattcagaaattccaaacacaagaccacatgaaattctggaaaaaccttcccctccacagccaccacctcctccttcggtaccacaaactgtgattccaaagaagactggctcacctgaaattaaactaaaaataaccaaaactatccagaatggcagggaattgtttgagtcttccctttgtggagaccttttaaatgaagtacaggcaagtgagcacacgaaatcaaagcatgaaagcagaaaagaaaagaggaaaaaaagcaacaagcatgactcatcaagatctgaagagcgcaagtcacacaaaatccccaaattagaaccagaggaacaaaatagaccaaatgagagggttgacactgtatcagaaaaaccaagggaagaaccagtactaaaagaggaagccccagttcagccaatactatcttctgttccaacaacggaagtgtccactggtgttaagtttcaggttggcgatcttgtgtggtccaaggtgggaacctatccttggtggccttgtatggtttcaagtgatccccagcttgaggttcatactaaaattaacacaagaggtgcccgagaatatcatgtccagttttttagcaaccagccagagagggcgtgggttcatgaaaaacgggtacgagagtataaaggtcataaacagtatgaagaattactggctgaggcaaccaaacaagccagcaatcactctgagaaacaaaagattcggaaaccccgacctcagagagaacgtgctcagtgggatattggcattgcccatgcagagaaagcattgaaaatgactcgagaagaaagaatagaacagtatacttttatttacattgataaacagcctgaagaggctttatcccaagcaaaaaagagtgttgcctccaaaaccgaagttaaaaaaacccgacgaccaagatctgtgctgaatactcagccagaacagaccaatgcaggggaggtggcctcctcactctcaagtactgaaattcggagacatagccagaggcggcacacaagtgcggaagaggaagagccaccgcctgttaaaatagcctggaaaactgcggcagcaaggaaatccttaccagcttccattacgatgcacaaagggagcctggatttgcagaagtgtaacatgtctccagttgtgaaaattgaacaagtgtttgctcttcagaatgctacaggggatgggaaatttatcgatcaatttgtttattcaacaaagggaattggtaacaaaacagaaataagtgtcagggggcaagacaggcttataatttctacaccaaaccagagaaatgaaaagccaacgcagagtgtatcatctcctgaagcaacatctggttctacaggctcagtagaaaagaagcaacagagaagatcaattagaactcgttctgaatcagagaaatccactgaggttgtgccaaagaagaagatcaaaaaggagcaggttggcttcctacatgtagagagttaaaacattgtatttgtaaatgttgtggcttacattcctgtcttaaaagaaagagaaactttcccccacactgagtttcctttctggactatcttaacgcttctgtcctggtgggttccagtgctcagttttaatacagccatccctgtgattctgcttcaagcattttcacagaaaacaggtttcaggagatgggaagccagtggtgcaagacttaaaaaatccttcacatttatttagaagtttctgttatcagcagaatgatttcatgtttttatgatttttatttggaaccatcattgagttccttttttttttttaagttggattttgggtttaagctggctggtatatattgttttttattttttaaacaaatcaatttaatttatattcttatatttaagaagcagatattcatagatgatctgttttttctggttaatatcgcagattttttggaatgttattttcccagtggaatattcacctgatatcaggttgtcagataaataatatttaggtaaaaaaaggtgtgtgggggggttgcattttgactgaagtgtattaaaccagtgtaatcaatgtagtaagatacatttaaatcaacttttcaaataaaattttagaagccattcttctttaaattaaactcacaatcagattttttcttaatttttttgttaaagaatatccattcttacagcctaaacacctgctagcaaacaaaacaaattctgaatagaattagttccaataagttttatattttttaaaccatttatatggaagaatgtgagcttttctatttaaaatatttccttcatgattttaaacttccaaatttaaaagctaactttgtgggtgctctgtggtatcaccaagcaagtgaaacagtttttccagaatatttaactaaaatttaaatagtatactaatttgtcattcatttatcatattaactttcatatttcatacttaggaaattatattccaaaaaatgaatgacaaattagtatactatttaaattttag

SEQ ID NO: 365126 - DNA, 2443 bp, Homo sapiens
tcatatttcaccacatcttaaagaaacatgaaattcaatttatagcttaaacaggaactcctccaaacagcctcctttctctaattccaatggttcaatcctcaaattaccacgtgttttacatatacattggcagaataacttctgatctcgctctcctaatgtaggatcaagacactgttcataagacactcaagaaagtgcttttgcaatatcacaaacttattttcttaagtttgtactagcagcaaaagtattgagcttccagctgtatggagccctgtagcactctctacagagagggtcctgattcccagcaacttagctgtgagtgcaggcgcggaagggtcttaaagtggcgtgagttacattaacctgagtatcatagtaagtaaaaatttatcctaacgtctttggggcgggaggggtttttagcaacattggggccggttgcagaaacaacccctctcctgccttccagacactgaggaaagtattcttgttctcttcatataccaagggaatggtgggaaaagtctttgctagagagcatgtggctgtgtgttgtcacttgatattcagcacaggcagctaggatttaaaccctccctgatcttgagacagagaactttacccaaaagatgggactgagttcagatttcagatacattaatcactcatcattgcttagattgatgaaagtatcttttccctctgttaataattaaaagggaaaaaaattctttgttaatgctgtatttttctgtccaaacaggttgaaacagttcctcaggctacagtgaagactggattacagaaagggtcggcggaccggggagtgcagggctctgtcagattcagtgacagctccgtctccgcagcgattgaggaaactgtggactgagattcctgtacaatttcatcccagaaactccagacttgtagtctccatgcaagatttctttgtcggcggcttgataaacagtttctttgttttcgattttgatttcgccaatcatcattattggcattttcctgcctggtttcttcttcaagactctgaacaattgctttaacagtcaaatgatttttttttttcggtttgagctggatgggtacagcttaaatcatgggtccagcctaaaaaccaccatttaacttacactgatcaatttcaacatggactgtttttggttttttgtttttaaataaagcatcattaatgcacatctgcaggggtttgccaaacagcccaaactgtatacattacaatcattaaaagttcttattttttttaatattagtgccgttatcatggagaacagcatgacagctgtctttggcagtctgtcatttttctagcattttcagaaactcatcggaaatggcggtacctgtgtttcccttcgaaagcctctcagtacagcactcctgttcctctgttaaaactccttgttaatccagtgatcttttaggccaaggaaatattttgtgatggtgttctgggtccatacaccagcaatgaaggagatagatttgtgtacttgtgttttttaatcagcattaacatgggcaggcaccctcatttatagatgtcaggaaacattcagtgaaaaacttgtagaatgggatgtgataacgaggttccagtaatctgagcagtctaacgaggcccacctcctccaccacagaacgtggctatgttccaagtgctactctcactcagcctgttgcggatcttcatggcctcaggagacttgtttctccatgggctcttctggactgcacacttccaccatagcttgctgggttgatctagatgtctgtttgttgtatggaaattttgggggaaaaaatccaaaacacaaactgtgggttgaaatattaaccgtctccttggttccttggtattcaccgtgcctgatctgcacatttcatcgtggctgtttctgtatagcctatactgcattagcccaagagattgttgctttgtaactttttgcactattgttttggctggatttgtattacacacagttttaaaaaaaacaattccacactattctctgccttttttttcctatttatttcttcccgcacaaattccacatagaggccttcccatccagctctacgtgatttggctgcacttgaacactgattgtccatttacagccctcagcaatgtgccttctaaatggcatgacatatgtagatgtgctgcagcgcttgttaatggtcacaataaatgccacttcaccaaggaagtctcagatgaacaattatgaacatccaaattttattggggggcaataatcaactgaattgcaaaatttgggggaaaatggcactatccgtgtacgaatcgaatacaaatcaaagatttgtcacatccctaataaaaacaagatggagatgtctctgcaaccatatttgtaagcta

SEQ ID NO: 365127 - DNA, 2078 bp, Homo sapiens
tgtttatgtgcctttaaaactaatgtgtctgctgttttagtttgacttttcaatttttaaaaaaccaatccccctttatttgtataatttaggaccctttgtgaatcccagtctcagcttatcagcctttacaatttgatctgttaaataatttatatgctcctgaatgtttagcattttttaatgattttaattaaaattccaaaagtaatgggtaagaaaagcaaggaatgtggtcatatcttaattacatagatgtcaaggtatccttaagtgagtttttgtttgtgtgtttaaatcatttcttaggctcagtagaaaagaagcaacagagaagatcaattagaactcgttctgaatcagagaaatccactgaggttgtgccaaagaagaagatcaaaaaggagcaggttgaaacagttcctcaggctacagtgaagactggattacagaaagggtcggcggaccggggagtgcagggctctgtcagattcagtgacagctccgtctccgcagcgattgaggaaactgtggactgagattcctgtacaatttcatcccagaaactccagacttgtagtctccatgcaagatttctttgtcggcggcttgataaacagtttctttgttttcgattttgatttcgccaatcatcattattggcattttcctgcctggtttcttcttcaagactctgaacaattgctttaacagtcaaatgatttttttttttcggtttgagctggatgggtacagcttaaatcatgggtccagcctaaaaaccaccatttaacttacactgatcaatttcaacatggactgtttttggttttttgtttttaaataaagcatcattaatgcacatctgcaggggtttgccaaacagcccaaactgtatacattacaatcattaaaagttcttattttttttaatattagtgccgttatcatggagaacagcatgacagctgtctttggcagtctgtcatttttctagcattttcagaaactcatcggaaatggcggtacctgtgtttcccttcgaaagcctctcagtacagcactcctgttcctctgttaaaactccttgttaatccagtgatcttttaggccaaggaaatattttgtgatggtgttctgggtccatacaccagcaatgaaggagatagatttgtgtacttgtgttttttaatcagcattaacatgggcaggcaccctcatttatagatgtcaggaaacattcagtgaaaaacttgtagaatgggatgtgataacgaggttccagtaatctgagcagtctaacgaggcccacctcctccaccacagaacgtggctatgttccaagtgctactctcactcagcctgttgcggatcttcatggcctcaggagacttgtttctccatgggctcttctggactgcacacttccaccatagcttgctgggttgatctagatgtctgtttgttgtatggaaattttgggggaaaaaatccaaaacacaaactgtgggttgaaatattaaccgtctccttggttccttggtattcaccgtgcctgatctgcacatttcatcgtggctgtttctgtatagcctatactgcattagcccaagagattgttgctttgtaactttttgcactattgttttggctggatttgtattacacacagttttaaaaaaaacaattccacactattctctgccttttttttcctatttatttcttcccgcacaaattccacatagaggccttcccatccagctctacgtgatttggctgcacttgaacactgattgtccatttacagccctcagcaatgtgccttctaaatggcatgacatatgtagatgtgctgcagcgcttgttaatggtcacaataaatgccacttcaccaaggaagtctcagatgaacaattatgaacatccaaattttattggggggcaataatcaactgaattgcaaaatttgggggaaaatggcactatccgtgtacgaatcgaatacaaatcaaagatttgtcacatccctaataaaaacaagatggagatgtctctgcaaccatatttgtaagcta

SEQ ID NO: 365128 - DNA, 1951 bp, Homo sapiens
tgtttatgtgcctttaaaactaatgtgtctgctgttttagtttgacttttcaatttttaaaaaaccaatccccctttatttgtataatttaggaccctttgtgaatcccagtctcagcttatcagcctttacaatttgatctgttaaataatttatatgctcctgaatgtttagcattttttaatgattttaattaaaattccaaaagtaatgggtaagaaaagcaaggaatgtggtcatatcttaattacatagatgtcaaggtatccttaagtgagtttttgtttgtgtgtttaaatcatttcttaggctcagtagaaaagaagcaacagagaagatcaattagaactcgttctgaatcagagaaatccactgaggttgtgccaaagaagaagatcaaaaaggagcaggttgaaacagttcctcaggctacagtgaagactggattacagaaagggtcggcggaccggggagtgcagggctctgtcagattcagtgacagctccgtctccgcagcgattgaggaaactgtggactgagattcctgtacaatttcatcccagaaactccagacttgtagtctccattcaaatgatttttttttttcggtttgagctggatgggtacagcttaaatcatgggtccagcctaaaaaccaccatttaacttacactgatcaatttcaacatggactgtttttggttttttgtttttaaataaagcatcattaatgcacatctgcaggggtttgccaaacagcccaaactgtatacattacaatcattaaaagttcttattttttttaatattagtgccgttatcatggagaacagcatgacagctgtctttggcagtctgtcatttttctagcattttcagaaactcatcggaaatggcggtacctgtgtttcccttcgaaagcctctcagtacagcactcctgttcctctgttaaaactccttgttaatccagtgatcttttaggccaaggaaatattttgtgatggtgttctgggtccatacaccagcaatgaaggagatagatttgtgtacttgtgttttttaatcagcattaacatgggcaggcaccctcatttatagatgtcaggaaacattcagtgaaaaacttgtagaatgggatgtgataacgaggttccagtaatctgagcagtctaacgaggcccacctcctccaccacagaacgtggctatgttccaagtgctactctcactcagcctgttgcggatcttcatggcctcaggagacttgtttctccatgggctcttctggactgcacacttccaccatagcttgctgggttgatctagatgtctgtttgttgtatggaaattttgggggaaaaaatccaaaacacaaactgtgggttgaaatattaaccgtctccttggttccttggtattcaccgtgcctgatctgcacatttcatcgtggctgtttctgtatagcctatactgcattagcccaagagattgttgctttgtaactttttgcactattgttttggctggatttgtattacacacagttttaaaaaaaacaattccacactattctctgccttttttttcctatttatttcttcccgcacaaattccacatagaggccttcccatccagctctacgtgatttggctgcacttgaacactgattgtccatttacagccctcagcaatgtgccttctaaatggcatgacatatgtagatgtgctgcagcgcttgttaatggtcacaataaatgccacttcaccaaggaagtctcagatgaacaattatgaacatccaaattttattggggggcaataatcaactgaattgcaaaatttgggggaaaatggcactatccgtgtacgaatcgaatacaaatcaaagatttgtcacatccctaataaaaacaagatggagatgtctctgcaaccatatttgtaagcta

SEQ ID NO: 365129 - DNA, 1388 bp, Homo sapiens
gatgtttctgggagagacttaatttatgtaaaaggtacttttcttttctttctgaaggaccgtataattgatgccggcccaaaaggaaattattctcgcttcatgaaccacagttgtaatcccaactgtgaaacacaaaagtggacagtgaatggagatgttcgagtgggactatttgctctctgtgatattcctgcagggatggagttaacatttaattataacctagattgtctgggcaacggcagaacggagtgccactgtggagcagataactgcagtggttttctaggagtgcggccaaagtcggcatgtgcgtcaacaaatgaagagaaggcaaaaaatgctaagttaaaacagaagagacgaaagatcaaaacagaaccaaagcagatgcatgaagattactgttttcaatgtggagatggtggagagctggtcatgtgtgacaaaaaagactgtcccaaagcataccacctcctatgccttaacctgactcagccaccatatggaaagtgggagtgtccgtggcatcagtgcgatgagtgcagcagtgcagctgtttccttctgtgaattctgtccacattcattttgtaaagatcatgaaaagggggccctggttccctctgcactggaaggccgcctctgctgctcggaacatgaccccatggctcctgtgtcaccagaatactggagcaagataaaatgtaaatgggaatcacaagatcatggagaagaagtaaaagaataaatgtgtggtgtcccctcctttctatttaagtgaaaaaagcaaatagatcatgcatttaaaaagaagagactgctacagtgcatacagcctttgccatcggaactgccttattaaagcaaaaatgggaaaccagttcatgcaggcagaagcagttggtggtgtctggtttttgtttgatttggttggtttgggattcttttgtggagggttaaattcccttggtcttttcttgccttttattgtgcttcagtgccattgcagcttgaaaaagaaatgtttttgctgttaaaataagaacaaagagaaaagtaagttttgttaatgagataaatttaaagtctaagatgtgttccttggttgtataaagcaaaagtagccatcattcctttatttattttcatttttaggaatttcaagaagtgtagttcaatagtctaatcaagtgtgtgtgtgttttaagtaggaatctgagaaagccctctaggaaagggtatgataagctttatatacctctttactgagcagtaggtaggctcacttctctttcccttcaaaatgcttttcataggcttagagaagggctctatggaagtattaaatctggcctcttgaaaacaatgcctcggtggatttta

SEQ ID NO: 365130 - DNA, 913 bp, Homo sapiens
gcaataacattttattatttttgtaataaaaacaaccactggacaaaatatgaatgattttaaaggaagctcttatggaagcagattgatatgtgtcaggacactgcttattttgcaaacaccagttttaacctgagacgatctctaacttgggaaataaaaaggaatgtcaaaactatttcgtgtgttggtggtgatgataaaatcttgttgccacagttgttgtgaaagtaatcaggagtttcaaacagataagcattgaagataaaaggtatttgccctgtgtcagaattatatcagttatctgttttagaaatatttaatgtctatgcatatctggatatgaaaattgagttcaaaacattttagtttaatcctttttcagttgattagcctctagcctatgagaatagtaacaccttctaatcccctcttttataattttaggcccgatgagagaaagggaaagttaaggatgctggagcagaacaatggatttctctttctctttcatgcaagggatcatgggaaacacaattcagcaaccacctcaactcattgactccgccaacatccgtcaggaggatgcctttgataacaacagtgacattgctgaagatggtggccagacaccatatgaagctactttgcagcaaggctttcagtacccagctacaacagaagatcttcctccactcacaaatgggtatccatcatcaatcagtgtgtatgaaactcaaaccaaataccagtcatataatcagtatcctaatgggtcagccaatggctttggtgcagttagaaactttagccccactgactattatcattcagaaattccaaacacaagaccacatgaaattctggaaaaaccttcccctccacagccaccacctcctccttcggtaccaca

SEQ ID NO: 365131 - DNA, 3401 bp, Homo sapiens
  misc_feature (4)..(4): n is a, c, g, or t
  misc_feature (6)..(6): n is a, c, g, or t
  misc_feature (8)..(8): n is a, c, g, or t
ggcngngncccgagagtcggggtgggggggctttgtgcgcggcggcggcgggagaggcggcggcggcggccagcacggaggcggaggccgggggttagaatggaacaaactgaaggcccgatgagagaaagggaaagttaaggatgctggagcagaacaatggatttctctttctctttcatgcaagggatcatgggaaacacaattcagcaaccacctcaactcattgactccgccaacatccgtcaggaggatgcctttgataacaacagtgacattgctgaagatggtggccagacaccatatgaagctactttgcagcaaggctttcagtacccagctacaacagaagatcttcctccactcacaaatgggtatccatcatcaatcagtgtgtatgaaactcaaaccaaataccagtcatataatcagtatcctaatgggtcagccaatggctttggtgcagttagaaactttagccccactgactattatcattcagaaattccaaacacaagaccacatgaaattctggaaaaaccttcccctccacagccaccacctcctccttcggtaccacaaactgtgattccaaagaagactggctcacctgaaattaaactaaaaataaccaaaactatccagaatggcagggaattgtttgagtcttccctttgtggagaccttttaaatgaagtacaggcaagtgagcacacgaaatcaaagcatgaaagcagaaaagaaaagaggaaaaaaagcaacaagcatgactcatcaagatctgaagagcgcaagtcacacaaaatccccaaattagaaccagaggaacaaaatagaccaaatgagagggttgacactgtatcagaaaaaccaagggaagaaccagtactaaaagaggaagccccagttcagccaatactatcttctgttccaacaacggaagtgtccactggtgttaagtttcaggttggcgatcttgtgtggtccaaggtgggaacctatccttggtggccttgtatggtttcaagtgatccccagcttgaggttcatactaaaattaacacaagaggtgcccgagaatatcatgtccagttttttagcaaccagccagagagggcgtgggttcatgaaaaacgggtacgagagtataaaggtcataaacagtatgaagaattactggctgaggcaaccaaacaagccagcaatcactctgagaaacaaaagattcggaaaccccgacctcagagagaacgtgctcagtgggatattggcattgcccatgcagagaaagcattgaaaatgactcgagaagaaagaatagaacagtatacttttatttacattgataaacagcctgaagaggctttatcccaagcaaaaaagagtgttgcctccaaaaccgaagttaaaaaaacccgacgaccaagatctgtgctgaatactcagccagaacagaccaatgcaggggaggtggcctcctcactctcaagtactgaaattcggagacatagccagaggcggcacacaagtgcggaagaggaagagccaccgcctgttaaaatagcctggaaaactgcggcagcaaggaaatccttaccagcttccattacgatgcacaaagggagcctggatttgcagaagtgtaacatgtctccagttgtgaaaattgaacaagtgtttgctcttcagaatgctacaggggatgggaaatttatcgatcaatttgtttattcaacaaagggaattggtaacaaaacagaaataagtgtcagggggcaagacaggcttataatttctacaccaaaccagagaaatgaaaagccaacgcagagtgtatcatctcctgaagcaacatctggttctacaggctcagtagaaaagaagcaacagagaagatcaattagaactcgttctgaatcagagaaatccactgaggttgtgccaaagaagaagatcaaaaaggagcaggttgaaacagttcctcaggctacagtgaagactggattacagaaagggtcggcggaccggggagtgcagggctctgtcagattcagtgacagctccgtctccgcagcgattgaggaaactgtggactgagattcctgtacaatttcatcccagaaactccagacttgtagtctccatgcaagatttctttgtcggcggcttgataaacagtttctttgttttcgattttgatttcgccaatcatcattattggcattttcctgcctggtttcttcttcaagactctgaacaattgctttaacagtcaaatgatttttttttttcggtttgagctggatgggtacagcttaaatcatgggtccagcctaaaaaccaccatttaacttacactgatcaatttcaacatggactgtttttggttttttgtttttaaataaagcatcattaatgcacatctgcaggggtttgccaaacagcccaaactgtatacattacaatcattaaaagttcttattttttttaatattagtgccgttatcatggagaacagcatgacagctgtctttggcagtctgtcatttttctagcattttcagaaactcatcggaaatggcggtacctgtgtttcccttcgaaagcctctcagtacagcactcctgttcctctgttaaaactccttgttaatccagtgatcttttaggccaaggaaatattttgtgatggtgttctgggtccatacaccagcaatgaaggagatagatttgtgtacttgtgttttttaatcagcattaacatgggcaggcaccctcatttatagatgtcaggaaacattcagtgaaaaacttgtagaatgggatgtgataacgaggttccagtaatctgagcagtctaacgaggcccacctcctccaccacagaacgtggctatgttccaagtgctactctcactcagcctgttgcggatcttcatggcctcaggagacttgtttctccatgggctcttctggactgcacacttccaccatagcttgctgggttgatctagatgtctgtttgttgtatggaaattttgggggaaaaaatccaaaacacaaactgtgggttgaaatattaaccgtctccttggttccttggtattcaccgtgcctgatctgcacatttcatcgtggctgtttctgtatagcctatactgcattagcccaagagattgttgctttgtaactttttgcactattgttttggctggatttgtattacacacagttttaaaaaaaacaattctaaaaaaaaaaaaaaacatgtcggcgccttggccagcgactttactgagcaaggttttgcatgccggcccgaaattgggctcactttggcaatcccctaaaggggtggttacaattatggccgcggtttacaaacgccggatggaaaacctgt

SEQ ID NO: 365132 - DNA, 2874 bp, Homo sapiens
  misc_feature (4)..(4): n is a, c, g, or t
  misc_feature (6)..(6): n is a, c, g, or t
  misc_feature (8)..(8): n is a, c, g, or t
ggcngngncccgagagtcggggtgggggggctttgtgcgcggcggcggcgggagaggcggcggcggcggccagcacggaggcggaggccgagggggctgtgcacaggtcgccgcggagaggcgtgcgaattccgagccgagcgccgaggaccgtgctacccaggccgggctgccagccgcaggctcctctctggcagcagcggcggcgcggcgacccccgtccctcggcctccccttcccatcccacctcccgagccttcctcttcccgcagcacgcccggcccggcccggccgtggccctcctcagtgccggccgccatggcagaggcgtccggcgcggggaaaatctagcccggggatttcatgcggcctagctcggttccgcctcctcctcgcgcggccccagcggctgcccgcaccccagccccactccgggcctccgtgtctctcctgtgatcgcactgacacggccggggggttagaatggaacaaactgaaggcccgatgagagaaagggaaagttaaggatgctggagcagaacaatggatttctctttctctttcatgcaagggatcatgggaaacacaattcagcaaccacctcaactcattgactccgccaacatccgtcaggaggatgcctttgataacaacagtgacattgctgaagatggtggccagacaccatatgaagctactttgcagcaaggctttcagtacccagctacaacagaagatcttcctccactcacaaatgggtatccatcatcaatcagtgtgtatgaaactcaaaccaaataccagtcatataatcagtatcctaatgggtcagccaatggctttggtgcagttagaaactttagccccactgactattatcattcagaaattccaaacacaagaccacatgaaattctggaaaaaccttcccctccacagccaccacctcctccttcggtaccacaaactgtgattccaaagaagactggctcacctgaaattaaactaaaaataaccaaaactatccagaatggcagggaattgtttgagtcttccctttgtggagaccttttaaatgaagtacaggcaagtgagcacacgaaatcaaagcatgaaagcagaaaagaaaagaggaaaaaaagcaacaagcatgactcatcaagatctgaagagcgcaagtcacacaaaatccccaaattagaaccagaggaacaaaatagaccaaatgagagggttgacactgtatcagaaaaaccaagggaagaaccagtactaaaagaggaagccccagttcagccaatactatcttctgttccaacaacggaagtgtccactggtgttaagtttcaggttggcgatcttgtgtggtccaaggtgggaacctatccttggtggccttgtatggtttcaagtgatccccagcttgaggttcatactaaaattaacacaagaggtgcccgagaatatcatgtccagttttttagcaaccagccagagagggcgtgggttcatgaaaaacgggtacgagagtataaaggtcataaacagtatgaagaattactggctgaggcaaccaaacaagccagcaatcactctgagaaacaaaagattcggaaaccccgacctcagagagaacgtgctcagtgggatattggcattgcccatgcagagaaagcattgaaaatgactcgagaagaaagaatagaacagtatacttttatttacattgataaacagcctgaagaggctttatcccaagcaaaaaagagtgttgcctccaaaaccgaagttaaaaaaacccgacgaccaagatctgtgctgaatactcagccagaacagaccaatgcaggggaggtggcctcctcactctcaagtactgaaattcggagacatagccagaggcggcacacaagtgcggaagaggaagagccaccgcctgttaaaatagcctggaaaactgcggcagcaaggaaatccttaccagcttccattacgatgcacaaagggagcctggatttgcagaagtgtaacatgtctccagttgtgaaaattgaacaagtgtttgctcttcagaatgctacaggggatgggaaatttatcgatcaatttgtttattcaacaaagggaattggtaacaaaacagaaataagtgtcagggggcaagacaggcttataatttctacaccaaaccagagaaatgaaaagccaacgcagagtgtatcatctcctgaagcaacatctggttctacaggctcagtagaaaagaagcaacagagaagatcaattagaactcgttctgaatcagagaaatccactgaggttgtgccaaagaagaagatcaaaaaggagcaggttgaaacagttcctcaggctacagtgaagactggattacagaaagggtcggcggaccggggagtgcagggctctgtcagattcagtgacagctccgtctccgcagcgattgaggaaactgtggactgagattcctgtacaatttcatcccagaaactccagacttgtagtctccatgcaagatttctttgtcggcggcttgataaacagtttctttgttttcgattttgatttcgccaatcatcattattggcattttcctgcctggtttcttcttcaagactctgaacaattgctttaacagtcaaatgatttttttttttcggtttgagctggatgggtacagcttaaatcatgggtccagcctaaaaaccaccatttaacttacactgatcaatttcaacatggactgtttttggttttttgtttttaaataaagcatcattaatgcacatctgcaggggtttgccaaacagcccaaactgtatacattacaatcattaaaagttcttatttttttta

SEQ ID NO: 365133 - DNA, 4064 bp, Homo sapiens
  misc_feature (4)..(4): n is a, c, g, or t
  misc_feature (6)..(6): n is a, c, g, or t
  misc_feature (8)..(8): n is a, c, g, or t
ggcngngncccgagagtcggggtgggggggctttgtgcgcggcggcggcgggagaggcggcggcggcggccagcacggaggcggaggccgagggggctgtgcacaggtcgccgcggagaggcgtgcgaattccgagccgagcgccgaggaccgtgctacccaggccgggctgccagccgcaggctcctctctggcagcagcggcggcgcggcgacccccgtccctcggcctccccttcccattccgcgaccgtccccggatgcgctatccgtcgtttcgccctgcattgcaacttgcccctggggcccgcgtgtgctcactggtgcccgtgttgtgccccgtccgtcatgttgccggccgccatggcagaggcgtccggcgcggggaaaatctagcccggggatttcatgcggcctagctcggttccgcctcctcctcgcgcggccccagcggctgcccgcaccccagccccactccgggcctccgtgtctctcctgtgatcgcactgacacggccggggggttagaatggaacaaactgaaggcccgatgagagaaagggaaagttaaggatgctggagcagaacaatggatttctctttctctttcatgcaagggatcatgggaaacacaattcagcaaccacctcaactcattgactccgccaacatccgtcaggaggatgcctttgataacaacagtgacattgctgaagatggtggccagacaccatatgaagctactttgcagcaaggctttcagtacccagctacaacagaagatcttcctccactcacaaatgggtatccatcatcaatcagtgtgtatgaaactcaaaccaaataccagtcatataatcagtatcctaatgggtcagccaatggctttggtgcagttagaaactttagccccactgactattatcattcagaaattccaaacacaagaccacatgaaattctggaaaaaccttcccctccacagccaccacctcctccttcggtaccacaaactgtgattccaaagaagactggctcacctgaaattaaactaaaaataaccaaaactatccagaatggcagggaattgtttgagtcttccctttgtggagaccttttaaatgaagtacaggcaagtgagcacacgaaatcaaagcatgaaagcagaaaagaaaagaggaaaaaaagcaacaagcatgactcatcaagatctgaagagcgcaagtcacacaaaatccccaaattagaaccagaggaacaaaatagaccaaatgagagggttgacactgtatcagaaaaaccaagggaagaaccagtactaaaagaggaagccccagttcagccaatactatcttctgttccaacaacggaagtgtccactggtgttaagtttcaggttggcgatcttgtgtggtccaaggtgggaacctatccttggtggccttgtatggtttcaagtgatccccagcttgaggttcatactaaaattaacacaagaggtgcccgagaatatcatgtccagttttttagcaaccagccagagagggcgtgggttcatgaaaaacgggtacgagagtataaaggtcataaacagtatgaagaattactggctgaggcaaccaaacaagccagcaatcactctgagaaacaaaagattcggaaaccccgacctcagagagaacgtgctcagtgggatattggcattgcccatgcagagaaagcattgaaaatgactcgagaagaaagaatagaacagtatacttttatttacattgataaacagcctgaagaggctttatcccaagcaaaaaagagtgttgcctccaaaaccgaagttaaaaaaacccgacgaccaagatctgtgctgaatactcagccagaacagaccaatgcaggggaggtggcctcctcactctcaagtactgaaattcggagacatagccagaggcggcacacaagtgcggaagaggaagagccaccgcctgttaaaatagcctggaaaactgcggcagcaaggaaatccttaccagcttccattacgatgcacaaagggagcctggatttgcagaagtgtaacatgtctccagttgtgaaaattgaacaagtgtttgctcttcagaatgctacaggggatgggaaatttatcgatcaatttgtttattcaacaaagggaattggtaacaaaacagaaataagtgtcagggggcaagacaggcttataatttctacaccaaaccagagaaatgaaaagccaacgcagagtgtatcatctcctgaagcaacatctggttctacaggctcagtagaaaagaagcaacagagaagatcaattagaactcgttctgaatcagagaaatccactgaggttgtgccaaagaagaagatcaaaaaggagcaggttgaaacagttcctcaggctacagtgaagactggattacagaaagggtcggcggaccggggagtgcagggctctgtcagattcagtgacagctccgtctccgcagcgattgaggaaactgtggactgagattcctgtacaatttcatcccagaaactccagacttgtagtctccatgcaagatttctttgtcggcggcttgataaacagtttctttgttttcgattttgatttcgccaatcatcattattggcattttcctgcctggtttcttcttcaagactctgaacaattgctttaacagtcaaatgatttttttttttcggtttgagctggatgggtacagcttaaatcatgggtccagcctaaaaaccaccatttaacttacactgatcaatttcaacatggactgtttttggttttttgtttttaaataaagcatcattaatgcacatctgcaggggtttgccaaacagcccaaactgtatacattacaatcattaaaagttcttattttttttaatattagtgccgttatcatggagaacagcatgacagctgtctttggcagtctgtcatttttctagcattttcagaaactcatcggaaatggcggtacctgtgtttcccttcgaaagcctctcagtacagcactcctgttcctctgttaaaactccttgttaatccagtgatcttttaggccaaggaaatattttgtgatggtgttctgggtccatacaccagcaatgaaggagatagatttgtgtacttgtgttttttaatcagcattaacatgggcaggcaccctcatttatagatgtcaggaaacattcagtgaaaaacttgtagaatgggatgtgataacgaggttccagtaatctgagcagtctaacgaggcccacctcctccaccacagaacgtggctatgttccaagtgctactctcactcagcctgttgcggatcttcatggcctcaggagacttgtttctccatgggctcttctggactgcacacttccaccatagcttgctgggttgatctagatgtctgtttgttgtatggaaattttgggggaaaaaatccaaaacacaaactgtgggttgaaatattaaccgtctccttggttccttggtattcaccgtgcctgatctgcacatttcatcgtggctgtttctgtatagcctatactgcattagcccaagagattgttgctttgtaactttttgcactattgttttggctggatttgtattacacacagttttaaaaaaaacaattccacactattctctgccttttttttcctatttatttcttcccgcacaaattccacatagaggccttcccatccagctctacgtgatttggctgcacttgaacactgattgtccatttacagccctcagcaatgtgccttctaaatggcatgacatatgtagatgtgctgcagcgcttgttaatggtcacaataaatgccacttcaccaaggaagtctcagatgaacaattatgaacatccaaattttattggggggcaataatcaactgaattgcaaaatttgggggaaaatggcactatccgtgtacgaatcgaatacaaatcaaagatttgtcacatccctaataaaaacaagatggagatgtctctgcaaccatatttgtaagcta

SEQ ID NO: 365134 - DNA, 3285 bp, Homo sapiens
  misc_feature (2)..(2): n is a, c, g, or t
gntattatttaataaaggagatctgggatgggctggtggggtgtgtatgaaactcaaaccaaataccagtcatataatcagtatcctaatgggtcagccaatggctttggtgcagttagaaactttagccccactgactattatcattcagaaattccaaacacaagaccacatgaaattctggaaaaaccttcccctccacagccaccacctcctccttcggtaccacaaactgtgattccaaagaagactggctcacctgaaattaaactaaaaataaccaaaactatccagaatggcagggaattgtttgagtcttccctttgtggagaccttttaaatgaagtacaggcaagtgagcacacgaaatcaaagcatgaaagcagaaaagaaaagaggaaaaaaagcaacaagcatgactcatcaagatctgaagagcgcaagtcacacaaaatccccaaattagaaccagaggaacaaaatagaccaaatgagagggttgacactgtatcagaaaaaccaagggaagaaccagtactaaaagaggaagccccagttcagccaatactatcttctgttccaacaacggaagtgtccactggtgttaagtttcaggttggcgatcttgtgtggtccaaggtgggaacctatccttggtggccttgtatggtttcaagtgatccccagcttgaggttcatactaaaattaacacaagaggtgcccgagaatatcatgtccagttttttagcaaccagccagagagggcgtgggttcatgaaaaacgggtacgagagtataaaggtcataaacagtatgaagaattactggctgaggcaaccaaacaagccagcaatcactctgagaaacaaaagattcggaaaccccgacctcagagagaacgtgctcagtgggatattggcattgcccatgcagagaaagcattgaaaatgactcgagaagaaagaatagaacagtatacttttatttacattgataaacagcctgaagaggctttatcccaagcaaaaaagagtgttgcctccaaaaccgaagttaaaaaaacccgacgaccaagatctgtgctgaatactcagccagaacagaccaatgcaggggaggtggcctcctcactctcaagtactgaaattcggagacatagccagaggcggcacacaagtgcggaagaggaagagccaccgcctgttaaaatagcctggaaaactgcggcagcaaggaaatccttaccagcttccattacgatgcacaaagggagcctggatttgcagaagtgtaacatgtctccagttgtgaaaattgaacaagtgtttgctcttcagaatgctacaggggatgggaaatttatcgatcaatttgtttattcaacaaagggaattggtaacaaaacagaaataagtgtcagggggcaagacaggcttataatttctacaccaaaccagagaaatgaaaagccaacgcagagtgtatcatctcctgaagcaacatctggttctacaggctcagtagaaaagaagcaacagagaagatcaattagaactcgttctgaatcagagaaatccactgaggttgtgccaaagaagaagatcaaaaaggagcaggttgaaacagttcctcaggctacagtgaagactggattacagaaagggtcggcggaccggggagtgcagggctctgtcagattcagtgacagctccgtctccgcagcgattgaggaaactgtggactgagattcctgtacaatttcatcccagaaactccagacttgtagtctccatgcaagatttctttgtcggcggcttgataaacagtttctttgttttcgattttgatttcgccaatcatcattattggcattttcctgcctggtttcttcttcaagactctgaacaattgctttaacagtcaaatgatttttttttttcggtttgagctggatgggtacagcttaaatcatgggtccagcctaaaaaccaccatttaacttacactgatcaatttcaacatggactgtttttggttttttgtttttaaataaagcatcattaatgcacatctgcaggggtttgccaaacagcccaaactgtatacattacaatcattaaaagttcttattttttttaatattagtgccgttatcatggagaacagcatgacagctgtctttggcagtctgtcatttttctagcattttcagaaactcatcggaaatggcggtacctgtgtttcccttcgaaagcctctcagtacagcactcctgttcctctgttaaaactccttgttaatccagtgatcttttaggccaaggaaatattttgtgatggtgttctgggtccatacaccagcaatgaaggagatagatttgtgtacttgtgttttttaatcagcattaacatgggcaggcaccctcatttatagatgtcaggaaacattcagtgaaaaacttgtagaatgggatgtgataacgaggttccagtaatctgagcagtctaacgaggcccacctcctccaccacagaacgtggctatgttccaagtgctactctcactcagcctgttgcggatcttcatggcctcaggagacttgtttctccatgggctcttctggactgcacacttccaccatagcttgctgggttgatctagatgtctgtttgttgtatggaaattttgggggaaaaaatccaaaacacaaactgtgggttgaaatattaaccgtctccttggttccttggtattcaccgtgcctgatctgcacatttcatcgtggctgtttctgtatagcctatactgcattagcccaagagattgttgctttgtaactttttgcactattgttttggctggatttgtattacacacagttttaaaaaaaacaattccacactattctctgccttttttttcctatttatttcttcccgcacaaattccacatagaggccttcccatccagctctacgtgatttggctgcacttgaacactgattgtccatttacagccctcagcaatgtgccttctaaatggcatgacatatgtagatgtgctgcagcgcttgttaatggtcacaataaatgccacttcaccaaggaagtctcagatgaacaattatgaacatccaaattttattggggggcaataatcaactgaattgcaaaatttgggggaaaatggcactatccgtgtacgaatcgaatacaaatcaaagatttgtcacatccctaataaaaacaagatggagatgtctctgcaaccatatttgtaagcta

SEQ ID NO: 365135 - DNA, 3681 bp, Homo sapiens
  misc_feature (4)..(4): n is a, c, g, or t
  misc_feature (6)..(6): n is a, c, g, or t
  misc_feature (8)..(8): n is a, c, g, or t
ggcngngncccgagagtcggggtgggggggctttgtgcgcggcggcggcgggagaggcggcggcggcggccagcacggaggcggaggccgagggggctgtgcacaggtcgccgcggagaggcgtgcgaattccgagccgagcgccgaggaccgtgctacccaggccgggctgccagccgcaggctcctctctggcagcagcggcggcgcggcgacccccgtccctcggcctccccttcccatcccacctcccgagccttcctcttcccgcagcacgcccggcccggcccggccgtggccctcctcagtgccggccgccatggcagaggcgtccggcgcggggaaaatctagcccggggatttcatgcggcctagctcggttccgcctcctcctcgcgcggccccagcggctgcccgcaccccagccccactccgggcctccgtgtctctcctgtgatcgcactgacacggccggggggttagaatggaacaaactgaaggcccgatgagagaaagggaaagttaaggatgctggagcagaacaatggatttctctttctctttcatgcaagggatcatgggaaacacaattcagcaaccacctcaactcattgactccgccaacatccgtcaggaggatgcctttgataacaacagtgacattgctgaagatggtggccagacaccatatgaagctactttgcagcaaggctttcagtacccagctacaacagaagatcttcctccactcacaaatgggtatccatcatcaatcagtgtgtatgaaactcaaaccaaataccagtcatataatcagtatcctaatgggtcagccaatggctttggtgcagttagaaactttagccccactgactattatcattcagaaattccaaacacaagaccacatgaaattctggaaaaaccttcccctccacagccaccacctcctccttcggtaccacaaactgtgattccaaagaagactggctcacctgaaattaaactaaaaataaccaaaactatccagaatggcagggaattgtttgagtcttccctttgtggagaccttttaaatgaagtacaggcaagtgagcacacgaaatcaaagcatgaaagcagaaaagaaaagaggaaaaaaagcaacaagcatgactcatcaagatctgaagagcgcaagtcacacaaaatccccaaattagaaccagaggaacaaaatagaccaaatgagagggttgacactgtatcagaaaaaccaagggaagaaccagtactaaaagaggaagccccagttcagccaatactatcttctgttccaacaacggaagtgtccactggtgttaagtttcaggttggcgatcttgtgtggtccaaggtgggaacctatccttggtggccttgtatggtttcaagtgatccccagcttgaggttcatactaaaattaacacaagaggtgcccgagaatatcatgtccagttttttagcaaccagccagagagggcgtgggttcatgaaaaacgggtacgagagtataaaggtcataaacagtatgaagaattactggctgaggcaaccaaacaagccagcaatcactctgagaaacaaaagattcggaaaccccgacctcagagagaacgtgctcagtgggatattggcattgcccatgcagagaaagcattgaaaatgactcgagaagaaagaatagaacagtatacttttatttacattgataaacagcctgaagaggctttatcccaagcaaaaaagagtgttgcctccaaaaccgaagttaaaaaaacccgacgaccaagatctgtgctgaatactcagccagaacagaccaatgcaggggaggtggcctcctcactctcaagtactgaaattcggagacatagccagaggcggcacacaagtgcggaagaggaagagccaccgcctgttaaaatagcctggaaaactgcggcagcaaggaaatccttaccagcttccattacgatgcacaaagggagcctggatttgcagaagtgtaacatgtctccagttgtgaaaattgaacaagtgtttgctcttcagaatgctacaggggatgggaaatttatcgatcaatttgtttattcaacaaagggaattggtaacaaaacagaaataagtgtcagggggcaagacaggcttataatttctacaccaaaccagagaaatgaaaagccaacgcagagtgtatcatctcctgaagcaacatctggttctacaggctcagtagaaaagaagcaacagagaagatcaattagaactcgttctgaatcagagaaatccactgaggttgtgccaaagaagaagatcaaaaaggagcaggttggcttcctacatgtagagagttaaaacattgtatttgtaaatgttgtggcttacattcctgtcttaaaagaaagagaaactttcccccacactgagtttcctttctggactatcttaacgcttctgtcctggtgggttccagtgctcagttttaatacagccatccctgtgattctgcttcaagcattttcacagaaaacaggtttcaggagatgggaagccagtggtgcaagacttaaaaaatccttcacatttatttagaagtttctgttatcagcagaatgatttcatgtttttatgatttttatttggaaccatcattgagttccttttttttttttaagttggattttgggtttaagctggctggtatatattgttttttattttttaaacaaatcaatttaatttatattcttatatttaagaagcagatattcatagatgatctgttttttctggttaatatcgcagattttttggaatgttattttcccagtggaatattcacctgatatcaggttgtcagataaataatatttaggtaaaaaaaggtgtgtgggggggttgcattttgactgaagtgtattaaaccagtgtaatcaatgtagtaagatacatttaaatcaacttttcaaataaaattttagaagccattcttctttaaattaaactcacaatcagattttttcttaatttttttgttaaagaatatccattcttacagcctaaacacctgctagcaaacaaaacaaattctgaatagaattagttccaataagttttatattttttaaaccatttatatggaagaatgtgagcttttctatttaaaatatttccttcatgattttaaacttccaaatttaaaagctaactttgtgggtgctctgtggtatcaccaagcaagtgaaacagtttttccagaatatttaactaaaatttaaatagtatactaatttgtcattcatttatcatattaactttcatatttcatacttaggaaattatattccaaaaaatctttctaagctcttgaaaatctatagttattcattaccaaaatgaagttgtgattttgccagctggttcccaaaatcagtctgtgaccagtcagttttaaactaataagcagaatgagtataaaaagtgggacaaattgttaatgccactgtgttatagttagtagtagaacaataccagtgattgtttagaagattttatatttgtattactaattgtatcttataaaagcgtttctgttgtatgtttttttacctgttgtaaaaaaaataaaattttttttaaaaagcttagaacaatcct

SEQ ID NO: 365136 - DNA, 4296 bp, Homo sapiens
  misc_feature (4)..(4): n is a, c, g, or t
  misc_feature (6)..(6): n is a, c, g, or t
  misc_feature (8)..(8): n is a, c, g, or t
ggcngngncccgagagtcggggtgggggggctttgtgcgcggcggcggcgggagaggcggcggcggcggccagcacggaggcggaggccgagggggctgtgcacaggtcgccgcggagaggcgtgcgaattccgagccgagcgccgaggaccgtgctacccaggccgggctgccagccgcaggctcctctctggcagcagcggcggcgcggcgacccccgtccctcggcctccccttcccatcccacctcccgagccttcctcttcccgcagcacgcccggcccggcccggccgtggccctcctcagtgccggccgccatggcagaggcgtccggcgcggggaaaatctagcccggggatttcatgcggcctagctcggttccgcctcctcctcgcgcggccccagcggctgcccgcaccccagccccactccgggcctccgtgtctctcctgtgatcgcactgacacggccggggggttagaatggaacaaactgaaggcccgatgagagaaagggaaagttaaggatgctggagcagaacaatggatttctctttctctttcatgcaagggatcatgggaaacacaattcagcaaccacctcaactcattgactccgccaacatccgtcaggaggatgcctttgataacaacagtgacattgctgaagatggtggccagacaccatatgaagctactttgcagcaaggctttcagtacccagctacaacagaagatcttcctccactcacaaatgggtatccatcatcaatcagtgtgtatgaaactcaaaccaaataccagtcatataatcagtatcctaatgggtcagccaatggctttggtgcagttagaaactttagccccactgactattatcattcagaaattccaaacacaagaccacatgaaattctggaaaaaccttcccctccacagccaccacctcctccttcggtaccacaaactgtgattccaaagaagactggctcacctgaaattaaactaaaaataaccaaaactatccagaatggcagggaattgtttgagtcttccctttgtggagaccttttaaatgaagtacaggcaagtgagcacacgaaatcaaagcatgaaagcagaaaagaaaagaggaaaaaaagcaacaagcatgactcatcaagatctgaagagcgcaagtcacacaaaatccccaaattagaaccagaggaacaaaatagaccaaatgagagggttgacactgtatcagaaaaaccaagggaagaaccagtactaaaagaggaagccccagttcagccaatactatcttctgttccaacaacggaagtgtccactggtgttaagtttcaggttggcgatcttgtgtggtccaaggtgggaacctatccttggtggccttgtatggtttcaagtgatccccagcttgaggttcatactaaaattaacacaagaggtgcccgagaatatcatgtccagttttttagcaaccagccagagagggcgtgggttcatgaaaaacgggtacgagagtataaaggtcataaacagtatgaagaattactggctgaggcaaccaaacaagccagcaatcactctgagaaacaaaagattcggaaaccccgacctcagagagaacgtgctcagtgggatattggcattgcccatgcagagaaagcattgaaaatgactcgagaagaaagaatagaacagtatacttttatttacattgataaacagcctgaagaggctttatcccaagcaaaaaagagtgttgcctccaaaaccgaagttaaaaaaacccgacgaccaagatctgtgctgaatactcagccagaacagaccaatgcaggggaggtggcctcctcactctcaagtactgaaattcggagacatagccagaggcggcacacaagtgcggaagaggaagagccaccgcctgttaaaatagcctggaaaactgcggcagcaaggaaatccttaccagcttccattacgatgcacaaagggagcctggatttgcagaagtgtaacatgtctccagttgtgaaaattgaacaagtgtttgctcttcagaatgctacaggggatgggaaatttatcgatcaatttgtttattcaacaaagggaattggtaacaaaacagaaataagtgtcagggggcaagacaggcttataatttctacaccaaaccagagaaatgaaaagccaacgcagagtgtatcatctcctgaagcaacatctggttctacaggctcagtagaaaagaagcaacagagaagatcaattagaactcgttctgaatcagagaaatccactgaggttgtgccaaagaagaagatcaaaaaggagcaggttgaaacagttcctcaggctacagtgaagactggattacagaaaggtgccagcgagatttcagattcctgtaaacctctaaagaaaaggagtcgcgcctcaactgatgtagaaatgactagttcagcatacagagacacatctgactccgattctagaggactgagtgacctgcaggtaggctttggaaagcaagtagatagcccttcagctactgcagatgcagacgtttctgatgtgcagtccatggattcaagtttgtcgagaagaggcactggaatgagtaagaaggacactgtatgtcagatttgtgaaagctctggtgactctctgattccttgtgagggagagtgctgcaaacactttcacctggagtgcctgggattggcatcacttcctgatagcaagttcatctgcatggaatgtaaaactgggcagcacccatgtttttcgtgtaaagtgtctggtaaagatgtgaagcgttgttctgttggtgcttgtgggaaattttatcatgaagcctgtgtccgcaaattccccactgccatctttgaatcaaaaggattccgctgtcctcagcactgctgctctgcctgctctatggagaaagatatccacaaagcaagtaaaggccgcatgatgagatgtttaagatgtccagttgcctatcactctggagatgcttgcattgcggccggaagcatgttagtatcctcctacattctcatctgtagtaatcattccaaacggagcagtaattcttctgctgtaaatgtaggcttttgtttcgtttgtgccagagggctgatagttcaggaccattcagaccccatgttcagttcatatgcctataagtcccactacctactgaatgaatcaaatcgtgctgagttgatgaaattacctatgattccttcttcgtcagcttccaaaaagaaatgtgagaaaggtggaagattgctctgctgtgaatcgtgcccagcttccttccacccggaatgcctaagcatagaaatgccagaaggctgctggaattgtaatgactgtaaagctggcaagaaactacattacaagcagattgtttgggtcaaattgggaaattacagatggtggccagcagagatctgcaaccccaggtctgtgccactgaacatccagggccttaaacatgacttgggggacttccctgtattcttctttggttctcatgactactactgggtacaccagggcagagtgttcccttatgttgaaggagacaaaagctttgctgaagggcagactagtattaacaagaccttcaaaaaggcactggaagaagctgcaaaacgtttccaggaattgaaagcacaaagagaaagtaaagaagccctagagattgaaaaaaactcaagaaaaccccctccctacaaacacatcaaagctaacaaagtaataggaaaggtgcagatccaggttgctgacctgtcagagattccccgctgtaactgcaagccagctgatgaaaacccttgtggcttggaatcggagtgcctgaacagaatgttgcagtatgaatgccacccgcaggtgtgcccagctggagatcgttgtcagaaccagtgctttacaaagagactataccctgatgcagagatcatcaaaacggagcggagaggctggggcctcaggaccaaaaggagcattaagaagggtgaatttgtaaatgaatacgtcggtgaattaattgatgaagaagaatgcagattgcgaatcaagcgagcccacgagaacagtgaccgtataattgatgccggcccaaaaggaaattattctcgcttcatgaaccacagttgtaatcccaactgtgaaacacaaaagtggacagtgaatggagatgttcgagtgggactatttgctctctgtgatattcctgcagatagaaaaagtgactcgttccccatg

SEQ ID NO: 365137 - DNA, 2579 bp, Homo sapiens
cttttttctagataacagttgagtttgagtttggttcctttttttttgtcaagtgtgttactcaattttgaaaactgttagtcctagccagatcctaagaggcaagcaattagagtaatggaacaaagtaacagatggctactttggggcctccattatcagcctttaaaaagaaaaaaagatctacttcaagaaaaacaaggcagggcacagtgcctcatgcctgtaatcccagcactttgggaggccaaggtgggtggatcacctgaggttaggagttcaagaccagcctggccaatatggtgaaaccccatatctaaaaaaagagtgttgcctccaaaaccgaagttaaaaaaacccgacgaccaagatctgtgctgaatactcagccagaacagaccaatgcaggggaggtggcctcctcactctcaagtactgaaattcggagacatagccagaggcggcacacaagtgcggaagaggaagagccaccgcctgttaaaatagcctggaaaactgcggcagcaaggaaatccttaccagcttccattacgatgcacaaagggagcctggatttgcagaagtgtaacatgtctccagttgtgaaaattgaacaagtgtttgctcttcagaatgctacaggggatgggaaatttatcgatcaatttgtttattcaacaaagggaattggtaacaaaacagaaataagtgtcagggggcaagacaggcttataatttctacaccaaaccagagaaatgaaaagccaacgcagagtgtatcatctcctgaagcaacatctggttctacaggctcagtagaaaagaagcaacagagaagatcaattagaactcgttctgaatcagagaaatccactgaggttgtgccaaagaagaagatcaaaaaggagcaggttgaaacagttcctcaggctacagtgaagactggattacagaaagggtcggcggaccggggagtgcagggctctgtcagattcagtgacagctccgtctccgcagcgattgaggaaactgtggactgagattcctgtacaatttcatcccagaaactccagacttgtagtctccatgcaagatttctttgtcggcggcttgataaacagtttctttgttttcgattttgatttcgccaatcatcattattggcattttcctgcctggtttcttcttcaagactctgaacaattgctttaacagtcaaatgatttttttttttcggtttgagctggatgggtacagcttaaatcatgggtccagcctaaaaaccaccatttaacttacactgatcaatttcaacatggactgtttttggttttttgtttttaaataaagcatcattaatgcacatctgcaggggtttgccaaacagcccaaactgtatacattacaatcattaaaagttcttattttttttaatattagtgccgttatcatggagaacagcatgacagctgtctttggcagtctgtcatttttctagcattttcagaaactcatcggaaatggcggtacctgtgtttcccttcgaaagcctctcagtacagcactcctgttcctctgttaaaactccttgttaatccagtgatcttttaggccaaggaaatattttgtgatggtgttctgggtccatacaccagcaatgaaggagatagatttgtgtacttgtgttttttaatcagcattaacatgggcaggcaccctcatttatagatgtcaggaaacattcagtgaaaaacttgtagaatgggatgtgataacgaggttccagtaatctgagcagtctaacgaggcccacctcctccaccacagaacgtggctatgttccaagtgctactctcactcagcctgttgcggatcttcatggcctcaggagacttgtttctccatgggctcttctggactgcacacttccaccatagcttgctgggttgatctagatgtctgtttgttgtatggaaattttgggggaaaaaatccaaaacacaaactgtgggttgaaatattaaccgtctccttggttccttggtattcaccgtgcctgatctgcacatttcatcgtggctgtttctgtatagcctatactgcattagcccaagagattgttgctttgtaactttttgcactattgttttggctggatttgtattacacacagttttaaaaaaaacaattccacactattctctgccttttttttcctatttatttcttcccgcacaaattccacatagaggccttcccatccagctctacgtgatttggctgcacttgaacactgattgtccatttacagccctcagcaatgtgccttctaaatggcatgacatatgtagatgtgctgcagcgcttgttaatggtcacaataaatgccacttcaccaaggaagtctcagatgaacaattatgaacatccaaattttattggggggcaataatcaactgaattgcaaaatttgggggaaaatggcactatccgtgtacgaatcgaatacaaatcaaagatttgtcacatccctaataaaaacaagatggagatgtctctgcaaccatatttgtaagcta

SEQ ID NO: 365138 - DNA, 2072 bp, Homo sapiens
tgccaatcttgtaaatagtggttttttgtttcgtttttgccctcttgatctaaaattgcttttgttttcagatggtggccagcagagatctgcaaccccaggtctgtgccactgaacatccagggccttaaacatgacttgggggacttccctgtattcttctttggttctcatgactactactgggtacaccagggcagagtgttcccttatgttgaaggagacaaaagctttgctgaagggcagactagtattaacaagaccttcaaaaaggcactggaagaagctgcaaaacgtttccaggaattgaaagcacaaagagaaagtaaagaagccctagagattgaaaaaaactcaagaaaaccccctccctacaaacacatcaaagctaacaaagtaataggaaaggtgcagatccaggttgctgacctgtcagagattccccgctgtaactgcaagccagctgatgaaaacccttgtggcttggaatcggagtgcctgaacagaatgttgcagtatgaatgccacccgcaggtgtgcccagctggagatcgttgtcagaaccagtgctttacaaagagactataccctgatgcagagatcatcaaaacggagcggagaggctggggcctcaggaccaaaaggagcattaagaagggtgaatttgtaaatgaatacgtcggtgaattaattgatgaagaagaatgcagattgcgaatcaagcgagcccacgagaacagtgaccgtataattgatgccggcccaaaaggaaattattctcgcttcatgaaccacagttgtaatcccaactgtgaaacacaaaagtggacagtgaatggagatgttcgagtgggactatttgctctctgtgatattcctgcagggatggagttaacatttaattataacctagattgtctgggcaacggcagaacggagtgccactgtggagcagataactgcagtggttttctaggagtgcggccaaagtcggcatgtgcgtcaacaaatgaagagaaggcaaaaaatgctaagttaaaacagaagagacgaaagatcaaaacagaaccaaagcagatgcatgaagattactgttttcaatgtggagatggtggagagctggtcatgtgtgacaaaaaagactgtcccaaagcataccacctcctatgccttaacctgactcagccaccatatggaaagtgggagtgtccgtggcatcagtgcgatgagtgcagcagtgcagctgtttccttctgtgaattctgtccacattcattttgtaaagatcatgaaaagggggccctggttccctctgcactggaaggccgcctctgctgctcggaacatgaccccatggctcctgtgtcaccagaatactggagcaagataaaatgtaaatgggaatcacaagatcatggagaagaagtaaaagaataaatgtgtggtgtcccctcctttctatttaagtgaaaaaagcaaatagatcatgcatttaaaaagaagagactgctacagtgcatacagcctttgccatcggaactgccttattaaagcaaaaatgggaaaccagttcatgcaggcagaagcagttggtggtgtctggtttttgtttgatttggttggtttgggattcttttgtggagggttaaattcccttggtcttttcttgccttttattgtgcttcagtgccattgcagcttgaaaaagaaatgtttttgctgttaaaataagaacaaagagaaaagtaagttttgttaatgagataaatttaaagtctaagatgtgttccttggttgtataaagcaaaagtagccatcattcctttatttattttcatttttaggaatttcaagaagtgtagttcaatagtctaatcaagtgtgtgtgtgttttaagtaggaatctgagaaagccctctaggaaagggtatgataagctttatatacctctttactgagcagtaggtaggctcacttctctttcccttcaaaatgcttttcataggcttagagaagggctctatggaagtattaaatctggcctcttgaaaacaatgcctcggtggatttta

SEQ ID NO: 365139 - DNA, 707 bp, Homo sapiens
ggctgatagttcaggaccattcagaccccatgttcagttcatatgcctataagtcccactacctactgaatgaatcaaatcgtgctgagttgatgaaattacctatgattccttcttcgtcagcttccaaaaagaaatgtgagaaaggtaataatcaaaatagtttctcttgcttttatttttgcatttcctatttttttctctttcaatataggggggaaatgtatgcctgtcaagcaccatctgttgcttttggtaaattctgccttggtggttgtgactgtttcttcatatggctgcacaattattaaaaagggcttaaaataattccattgttgcacatttttacatactcttcccttgaataaatttttacacattccatatttataagttattaaaataggaagactaggattttggtcagtataaatatagaatcatattctaaatgttctttctctttttcctggtgtgaaactatcattcaagttggaatagaaaagatagggtataatttgttactaactttcaactaaataacaaggtaggttattaaaagagggaaactaagatactgatacttgaaagtttgcttttagaatatgttctgtcattgggcttcttaaatgtttggttaagatgctatgaaaactagttgcccttcccttaggagacattggtgggaagctggttggggagaatac

SEQ ID NO: 365140 - DNA, 1840 bp, Homo sapiens
cctggaatcaagcctcctacgtctgcctcccaaagttttgggattacaggtgtgagccaccacacccagccctgatctgttcttgaatcagttaaagccctcacactcccagaaggccgccagccaatgcacctgttggaactttgcacacagggtgtcttctcccttcaagcttggtctgcagctcagtaacaaatgggctacagacaccaggggcttgcccatgggagccccaaggcctaaagagggtggcagagatttgatgtctgtcactctccacctgcagcctcagtccacggtcggccaggcaccaagagctcacactttgccctcctaaatgccaggcccttcataagtatcatctcattgttaagagcggaggcttcagcgccagacaaatgcgagtttgtgtacaactcaaccacgtgctggtgggagagtcaccatctctgagcagacctgtgactcctgttccaaatggacgaggaaccactgcgatgatgtgttaggactcccagcctgccagaacctcacagcccctggcccttcacagcaaagttgaccgcagtgagcattccatccaccagtcagaacaccctggacgctgagcggccttctctgaaagcctggtgcctttgttagccctgggtgactcctgtgatcccagccaccaggttgtcactatagacctaatttaaccatctgtcctcagtaccgagggctcaacatttggaatgggaggtggttctgggagccaattagaggccaggctttgggaggtggcagaggtgagtctcacacctgggctctgtctgataagtctaggtctcggtcaggggaccttggcctaaagggcctgtcttgcctggagcgtgggagggggctgagtctacacagctggcctggcctcaggcctggagctttagctcaaggacgagaagacccataaagccagacccagctcccaacctcacatctgccacgatgttgctgctcagcctgaccctaagcctggttctcctcggctcctcctggggctgcggcattcctgccatcaaaccggcactgagcttcagccagaggattgtcaacggggagaatgcagtgttgggctcctggccctggcaggtgtccctgcaggacagcagcggcttccacttctgcggtggttctctcatcagccagtcctgggtggtcactgctgcccactgcaatgtcagccctggccgccattttgttgtcctgggcgagtatgaccgatcatcaaacgcagagcccttgcaggttctgtccgtctctcgggccattacacaccctagctggaactctaccaccatgaacaatgacgtgacgctgctgaagctcgcctcgccagcccagtacacaacacgcatctcgccagtttgcctggcatcctcaaacgaggctctgactgaaggcctcacgtgtgtcaccaccggctggggtcgcctcagtggcgtgggcaatgtgacaccagcacatctgcagcaggtggctttgcccctggtcactgtgaatcagtgccggcagtactggggctcaagtatcactgactccatgatctgtgcaggtggcgcaggtgcctcctcgtgccagggtgactccggaggccctcttgtctgccagaagggaaacacatgggtgcttattggtattgtctcctggggcaccaaaaactgcaatgtgcgcgcacctgctgtgtatactcgagttagcaagttcagcacctggatcaaccaggtcatagcctacaactgagctcaccacaggccctccccagctcaacccattaaagacccaggccctgtcccatcatgca

SEQ ID NO: 365141 - DNA, 188 bp, Homo sapiens
gcgcgcacctgcagtttttggtgccccaggagacaataccaaaaactgcaatgtgcgcgcacctgctgtgtatactcgagttagcaagttcagcacctggatcaaccaggtcatagcctacaactgagctcaccacaggccctccccagctcaacccattaaagacccaggccctgtcccatcatgca

SEQ ID NO: 365142 - DNA, 2439 bp, Homo sapiens
cctggaatcaagcctcctacgtctgcctcccaaagttttgggattacaggtgtgagccaccacacccagccctgatctgttcttgaatcagttaaagccctcacactcccagaaggccgccagccaatgcacctgttggaactttgcacacagggtgtcttctcccttcaagcttggtctgcagctcagtaacaaatgggctacagacaccaggggcttgcccatgggagccccaaggcctaaagagggtggcagagatttgatgtctgtcactctccacctgcagcctcagtccacggtcggccaggcaccaagagctcacactttgccctcctaaatgccaggcccttcataagtatcatctcattgttaagagcggaggcttcagcgccagacaaatgcgagtttgtgtacaactcaaccacgtgctggtgggagagtcaccatctctgagcagacctgtgactcctgttccaaatggacgaggaaccactgcgatgatgtgttaggactcccagcctgccagaacctcacagcccctggcccttcacagcaaagttgaccgcagtgagcattccatccaccagtcagaacaccctggacgctgagcggccttctctgaaagcctggtgcctttgttagccctgggtgactcctgtgatcccagccaccaggttgtcactatagacctaatttaaccatctgtcctcagtaccgagggctcaacatttggaatgggaggtggttctgggagccaattagaggccaggctttgggaggtggcagaggtgagtctcacacctgggctctgtctgataagtctaggtctcggtcaggggaccttggcctaaagggcctgtcttgcctggagcgtgggagggggctgagtctacacagctggcctggcctcaggcctggagctttagctcaaggacgagaagacccataaagccagacccagctcccaacctcacatctgccacgatgttgctgctcagcctgaccctaagcctggttctcctcggctcctcctggggtgagtgggccaggaccagccctgattcagccctgggagcaactcagctcccagcaacagcccagggaaggagctaggctggctggaagggacgaaggtggacagagtgggcaaaagaaacaggatatgccagggcagtggagcagggaacaggcctgcagggctgggagggggcaagaggtggggtggtctcacaaataggaccagagattgagccaggccctggagcccgggagggtttaggaagctgagacaggaagacctgtccatgtcttttagaaagaaccttctggctgcatgaagggtatgaactgttcaggtcgggagggggcagagagaccaggggtagagatggggaacagcggggactaggctggagacagatgtaggagaacagcagggctgggggactgggtggatagggataaccaagatagctgtggggcccgaaggtgcttgcatgtaccctgttggggaaggggtagtgctgtaccctctcgacagacctctctggggtgcacagcctggggcacccaaaaggaggtggggaaagatgggctgaggcatgggaagcaggtcctcattagcccaatggccaggctgcggcattcctgccatcaaaccggcactgagcttcagccagaggattgtcaacggggagaatgcagtgttgggctcctggccctggcaggtgtccctgcaggacagcagcggcttccacttctgcggtggttctctcatcagccagtcctgggtggtcactgctgcccactgcaatgtcagccctggccgccattttgttgtcctgggcgagtatgaccgatcatcaaacgcagagcccttgcaggttctgtccgtctctcgggccattacacaccctagctggaactctaccaccatgaacaatgacgtgacgctgctgaagctcgcctcgccagcccagtacacaacacgcatctcgccagtttgcctggcatcctcaaacgaggctctgactgaaggcctcacgtgtgtcaccaccggctggggtcgcctcagtggcgtgggcaatgtgacaccagcacatctgcagcaggtggctttgcccctggtcactgtgaatcagtgccggcagtactggggctcaagtatcactgactccatgatctgtgcaggtggcgcaggtgcctcctcgtgccagggtgactccggaggccctcttgtctgccagaagggaaacacatgggtgcttattggtattgtctcctggggcaccaaaaactgcaatgtgcgcgcacctgctgtgtatactcgagttagcaagttcagcacctggatcaaccaggtcatagcctacaactgagctcaccacaggccctccccagctcaacccattaaagacccaggccctgtcccatcatgca

SEQ ID NO: 365143 - DNA, 131 bp, Homo sapiens
gacagcagcggcttccacttctgcggtggttctctcatcagccagtcctgggtggtcactgctgcccactgcaatgtcaggtgagtgcctgcattccacctgccccgcccctcgcctcttcctgcctcctc

SEQ ID NO: 365144 - DNA, 2142 bp, Homo sapiens
cctggaatcaagcctcctacgtctgcctcccaaagttttgggattacaggtgtgagccaccacacccagccctgatctgttcttgaatcagttaaagccctcacactcccagaaggccgccagccaatgcacctgttggaactttgcacacagggtgtcttctcccttcaagcttggtctgcagctcagtaacaaatgggctacagacaccaggggcttgcccatgggagccccaaggcctaaagagggtggcagagatttgatgtctgtcactctccacctgcagcctcagtccacggtcggccaggcaccaagagctcacactttgccctcctaaatgccaggcccttcataagtatcatctcattgttaagagcggaggcttcagcgccagacaaatgcgagtttgtgtacaactcaaccacgtgctggtgggagagtcaccatctctgagcagacctgtgactcctgttccaaatggacgaggaaccactgcgatgatgtgttaggactcccagcctgccagaacctcacagcccctggcccttcacagcaaagttgaccgcagtgagcattccatccaccagtcagaacaccctggacgctgagcggccttctctgaaagcctggtgcctttgttagccctgggtgactcctgtgatcccagccaccaggttgtcactatagacctaatttaaccatctgtcctcagtaccgagggctcaacatttggaatgggaggtggttctgggagccaattagaggccaggctttgggaggtggcagaggtgagtctcacacctgggctctgtctgataagtctaggtctcggtcaggggaccttggcctaaagggcctgtcttgcctggagcgtgggagggggctgagtctacacagctggcctggcctcaggcctggagctttagctcaaggacgagaagacccataaagccagacccagctcccaacctcacatctgccacgatgttgctgctcagcctgaccctaagcctggttctcctcggctcctcctggggctgcggcattcctgccatcaaaccggcactgagcttcagccagaggattgtcaacggggagaatgcagtgttgggctcctggccctggcaggtgtccctgcaggacagcagcggcttccacttctgcggtggttctctcatcagccagtcctgggtggtcactgctgcccactgcaatgtcagccctggccgccattttgttgtcctgggcgagtatgaccgatcatcaaacgcagagcccttgcaggttctgtccgtctctcgggccattacacaccctagctggaactctaccaccatgaacaatgacgtgacgctgctgaagctcgcctcgccagcccagtacacaacacgcatctcgccagtttgcctggcatcctcaaacgaggctctgactgaaggcctcacgtgtgtcaccaccggctggggtcgcctcagtggcgtgggcaatgtgacaccagcacatctgcagcaggtggctttgcccctggtcactgtgaatcagtgccggcagtactggggctcaagtatcactgactccatgatctgtgcaggtggcgcaggtgcctcctcgtgccagggtgactccggaggccctcttgtctgccagaagggaaacacatgggtgcttattggtattgtctcctggggcaccaaaaactgcaatgtgcgcgcacctgctgtgtatactcgagttagcaagttcagcacctggatcaaccaggtcatagcctacaactgagctcaccacaggccctccccagctcaacccattaaagacccaggccctgtcccatcatgcattcatgtctgtcttcctggctcaggagaaagaagaggctgttgagggtccgactccctacttggacttctggcacagaaggggctgagtgactccttgagtagcagtggctcttcctagagtagccatgccgaggccggggcccccacccctcctccagggcaaccccttggtcctacagcaagaagccagaactgttggaatgaatggcagccctccctggagaggcagcctgtttactgaatacagaggatacgtttacaaactgaatacgcataataaataactgcacattctccatcc

SEQ ID NO: 365145 - DNA, 2537 bp, Homo sapiens
cctggaatcaagcctcctacgtctgcctcccaaagttttgggattacaggtgtgagccaccacacccagccctgatctgttcttgaatcagttaaagccctcacactcccagaaggccgccagccaatgcacctgttggaactttgcacacagggtgtcttctcccttcaagcttggtctgcagctcagtaacaaatgggctacagacaccaggggcttgcccatgggagccccaaggcctaaagagggtggcagagatttgatgtctgtcactctccacctgcagcctcagtccacggtcggccaggcaccaagagctcacactttgccctcctaaatgccaggcccttcataagtatcatctcattgttaagagcggaggcttcagcgccagacaaatgcgagtttgtgtacaactcaaccacgtgctggtgggagagtcaccatctctgagcagacctgtgactcctgttccaaatggacgaggaaccactgcgatgatgtgttaggactcccagcctgccagaacctcacagcccctggcccttcacagcaaagttgaccgcagtgagcattccatccaccagtcagaacaccctggacgctgagcggccttctctgaaagcctggtgcctttgttagccctgggtgactcctgtgatcccagccaccaggttgtcactatagacctaatttaaccatctgtcctcagtaccgagggctcaacatttggaatgggaggtggttctgggagccaattagaggccaggctttgggaggtggcagaggtgagtctcacacctgggctctgtctgataagtctaggtctcggtcaggggaccttggcctaaagggcctgtcttgcctggagcgtgggagggggctgagtctacacagctggcctggcctcaggcctggagctttagctcaaggacgagaagacccataaagccagacccagctcccaacctcacatctgccacgatgttgctgctcagcctgaccctaagcctggttctcctcggctcctcctggggtgagtgggccaggaccagccctgattcagccctgggagcaactcagctcccagcaacagcccagggaaggagctaggctggctggaagggacgaaggtggacagagtgggcaaaagaaacaggatatgccagggcagtggagcagggaacaggcctgcagggctgggagggggcaagaggtggggtggtctcacaaataggaccagagattgagccaggccctggagcccgggagggtttaggaagctgagacaggaagacctgtccatgtcttttagaaagaaccttctggctgcatgaagggtatgaactgttcaggtcgggagggggcagagagaccaggggtagagatggggaacagcggggactaggctggagacagatgtaggagaacagcagggctgggggactgggtggatagggataaccaagatagctgtggggcccgaaggtgcttgcatgtaccctgttggggaaggggtagtgctgtaccctctcgacagacctctctggggtgcacagcctggggcacccaaaaggaggtggggaaagatgggctgaggcatgggaagcaggtcctcattagcccaatggccaggctgcggcattcctgccatcaaaccggcactgagcttcagccagaggattgtcaacggggagaatgcagtgttgggctcctggccctggcaggtgtccctgcaggtacaccaccagaggggtgggcagggtcctgggtacgtcatgcctaggggcagcctcagcagcccacccccactctgacctctgagccctgaccacaggacagcagcggcttccacttctgcggtggttctctcatcagccagtcctgggtggtcactgctgcccactgcaatgtcagccctggccgccattttgttgtcctgggcgagtatgaccgatcatcaaacgcagagcccttgcaggttctgtccgtctctcgggccattacacaccctagctggaactctaccaccatgaacaatgacgtgacgctgctgaagctcgcctcgccagcccagtacacaacacgcatctcgccagtttgcctggcatcctcaaacgaggctctgactgaaggcctcacgtgtgtcaccaccggctggggtcgcctcagtggcgtgggcaatgtgacaccagcacatctgcagcaggtggctttgcccctggtcactgtgaatcagtgccggcagtactggggctcaagtatcactgactccatgatctgtgcaggtggcgcaggtgcctcctcgtgccagggtgactccggaggccctcttgtctgccagaagggaaacacatgggtgcttattggtattgtctcctggggcaccaaaaactgcaatgtgcgcgcacctgctgtgtatactcgagttagcaagttcagcacctggatcaaccaggtcatagcctacaactgagctcaccacaggccctccccagctcaacccattaaagacccaggccctgtcccatcatgca

SEQ ID NO: 365146 - DNA, 2382 bp, Homo sapiens
cctggaatcaagcctcctacgtctgcctcccaaagttttgggattacaggtgtgagccaccacacccagccctgatctgttcttgaatcagttaaagccctcacactcccagaaggccgccagccaatgcacctgttggaactttgcacacagggtgtcttctcccttcaagcttggtctgcagctcagtaacaaatgggctacagacaccaggggcttgcccatgggagccccaaggcctaaagagggtggcagagatttgatgtctgtcactctccacctgcagcctcagtccacggtcggccaggcaccaagagctcacactttgccctcctaaatgccaggcccttcataagtatcatctcattgttaagagcggaggcttcagcgccagacaaatgcgagtttgtgtacaactcaaccacgtgctggtgggagagtcaccatctctgagcagacctgtgactcctgttccaaatggacgaggaaccactgcgatgatgtgttaggactcccagcctgccagaacctcacagcccctggcccttcacagcaaagttgaccgcagtgagcattccatccaccagtcagaacaccctggacgctgagcggccttctctgaaagcctggtgcctttgttagccctgggtgactcctgtgatcccagccaccaggttgtcactatagacctaatttaaccatctgtcctcagtaccgagggctcaacatttggaatgggaggtggttctgggagccaattagaggccaggctttgggaggtggcagaggtgagtctcacacctgggctctgtctgataagtctaggtctcggtcaggggaccttggcctaaagggcctgtcttgcctggagcgtgggagggggctgagtctacacagctggcctggcctcaggcctggagctttagctcaaggacgagaagacccataaagccagacccagctcccaacctcacatctgccacgatgttgctgctcagcctgaccctaagcctggttctcctcggctcctcctggggtgagtgggccaggaccagccctgattcagccctgggagcaactcagctcccagcaacagcccagggaaggagctaggctggctggaagggacgaaggtggacagagtgggcaaaagaaacaggatatgccagggcagtggagcagggaacaggcctgcagggctgggagggggcaagaggtggggtggtctcacaaataggaccagagattgagccaggccctggagcccgggagggtttaggaagctgagacaggaagacctgtccatgtcttttagaaagaaccttctggctgcatgaagggtatgaactgttcaggtcgggagggggcagagagaccaggggtagagatggggaacagcggggactaggctggagacagatgtaggagaacagcagggctgggggactgggtggatagggataaccaagatagctgtggggcccgaaggtgcttgcatgtaccctgttggggaaggggtagtgctgtaccctctcgacagacctctctggggtgcacagcctggggcacccaaaaggaggtggggaaagatgggctgaggcatgggaagcaggtcctcattagcccaatggccaggctgcggcattcctgccatcaaaccggcactgagcttcagccagaggattgtcaacggggagaatgcagtgttgggctcctggccctggcaggtgtccctgcaggtacaccaccagaggggtgggcagggtcctgggtacgtcatgcctaggggcagcctcagcagcccacccccactctgacctctgagccctgaccacaggacagcagcggcttccacttctgcggtggttctctcatcagccagtcctgggtggtcactgctgcccactgcaatgtcagccctggccgccattttgttgtcctgggcgagtatgaccgatcatcaaacgcagagcccttgcaggttctgtccgtctctcgggccattacacaccctagctggaactctaccaccatgaacaatgacgtgacgctgctgaagctcgcctcgccagcccagtacacaacacgcatctcgccagtttgcctggcatcctcaaacgaggctctgactgaaggcctcacgtgtgtcaccaccggctggggtcgcctcagtggcgtgggcaatgtgacaccagcacatctgcagcaggtggctttgcccctggtcactgtgaatcagtgccggcagtactggggctgctgtgtatactcgagttagcaagttcagcacctggatcaaccaggtcatagcctacaactgagctcaccacaggccctccccagctcaacccattaaagacccaggccctgtcccatcatgca

SEQ ID NO: 365147 - DNA, 289 bp, Homo sapiens
accctgataggccagtcccaggcacaggaggaatcatctgcctgaaacaccctcattccttccactgcttatcctttatattgagcaactgctggaataatcagagctaatgtttattgagcacttacactgtgccacacactgttcgaaaccctttatacataccagctcatttaattctcacaccaacccaatgaggtgagtgctgttatgattatctccattttatagttgaggaaactgagacatggcaattaggtaagttgtccacaattttaaagctcatcag

SEQ ID NO: 365148 - DNA, 1546 bp, Homo sapiens
accgctctgggctgcgctcctcgcttgccctcggactcggctcccgctgcgagcggccgccctgcccgcgcaccgcgctcagcgcccaccgccgggcttcccgcgccggacccagtacctcggctccccggggccggaccgaggccgcaagcagcgccgcggggtgtggggcggacccaggagatgaaatgacaacgtcaaccctccagaaagccattgatctggtgacgaaagccacagaggaggacaaagccaagaactacgaggaggcgctgcggctgtaccagcatgcggtggagtacttcctccacgctatcaagtatgaggcccacagcgacaaggccaaggagagcattcgagccaagtgcgtgcagtacctagaccgggccgagaagctgaaggattatttacgaagcaaagagaaacacggcaagaagccagtcaaagagaaccagagtgagggcaagggcagtgacagtgacagtgaaggggataatccggagaaaaagaaactgcaagaacagctgatgggtgccgtcgtgatggagaagcccaacatacggtggaacgacgtggccgggctggagggggccaaggaggccctcaaagaagctgtcattttgccaatcaaattcccacacttgttcacaggcaagcgcaccccctggcgggggattctgctgttcggaccccctggcacagggaaatcctacctggccaaagccgtggcaacagaggccaacaactccaccttcttctctgtgtcctcctcagatctgatgtccaagtggctgggggagagtgaaaagctggtcaagaacctgtttgagctggccaggcagcacaagccctccatcatcttcatcgatgaggtggattccctctgcgggtcccgaaatgaaaatgagagtgaggccgcccggaggatcaaaacggagttcttggtccagatgcagggggtggggaataacaatgatgggactctggttcttggagccacaaacatcccatgggtgttggattcggccatcaggaggaggtttgaaaaacgaatttatatccccttgccggaggaagctgcccgcgcccagatgttccggttgcatctcgggagcactccccacaacctcacggatgcaaacatccacgagctggcccggaagacggaaggctactcgggcgcggacatcagcatcatcgtgcgggactctctcatgcagcccgtgaggaaggtgcagtcggccacacacttcaaaaaggtctgtggcccctctcgcaccaaccccagcatgatgattgatgacctcctgactccatgctcaccaggggacccaggagccatggagatgacttggatggatgtccctggggacaaactcttagagcctgtggtttgcatgtcggacatgctgcggtctctggccaccacccggcccacggtgaatgcagacgacctcctgaaagtgaagaaattctcagaggactttgggcaagagagttaaaaggtcgacccctaagctggtttcaagccaaccccatggcctcg

SEQ ID NO: 365149 - DNA, 2324 bp, Homo sapiens
accgctctgggctgcgctcctcgcttgccctcggactcggctcccgctgcgagcggccgccctgcccgcgcaccgcgctcagcgcccaccgccgggcttcccgcgccggacccagtacctcggctccccggggccggaccgaggccgcaagcagcgccgcggggtgtggggcggacccaggagatgaaatgacaacgtcaaccctccagaaagccattgatctggtgacgaaagccacagaggaggacaaagccaagaactacgaggaggcgctgcggctgtaccagcatgcggtggagtacttcctccacgctatcaagtatgaggcccacagcgacaaggccaaggagagcattcgagccaagtgcgtgcagtacctagaccgggccgagaagctgaaggattatttacgaagcaaagagaaacacggcaagaagccagtcaaagagaaccagagtgagggcaagggcagtgacagtgacagtgaaggggataatccggagaaaaagaaactgcaagaacagctgatgggtgccgtcgtgatggagaagcccaacatacggtggaacgacgtggccgggctggagggggccaaggaggccctcaaagaagctgtcattttgccaatcaaattcccacacttgttcacaggcaagcgcaccccctggcgggggattctgctgttcggaccccctggcacagggaaatcctacctggccaaagccgtggcaacagaggccaacaactccaccttcttctctgtgtcctcctcagatctgatgtccaagtggctgggggagagtgaaaagctggtcaagaacctgtttgagctggccaggcagcacaagccctccatcatcttcatcgatgaggtggattccctctgcgggtcccgaaatgaaaatgagagtgaggccgcccggaggatcaaaacggagttcttggtccagatgcagggggtggggaataacaatgatgggactctggttcttggagccacaaacatcccatgggtgttggattcggccatcaggaggaggtttgaaaaacgaatttatatccccttgccggaggaagctgcccgcgcccagatgttccggttgcatctcgggagcactccccacaacctcacggatgcaaacatccacgagctggcccggaagacggaaggctactcgggcgcggacatcagcatcatcgtgcgggactctctcatgcagcccgtgaggaaggtgcagtcggccacacacttcaaaaaggtctgtggcccctctcgcaccaaccccagcatgatgattgatgacctcctgactccatgctcaccaggggacccaggagccatggagatgacttggatggatgtccctggggacaaactcttagagcctgtggtttgcatgtcggacatgctgcggtctctggccaccacccggcccacggtgaatgcagacgacctcctgaaagtgaagaaattctcagaggactttgggcaagagagttaaaagctgcttcacttgggcaatggtgaaggtgggaggttgattggggcaaatccaggcactccccatgtcaacagccagacagggctccagggcttgtcccagtcaatacagagttccctctgctgtctggccgtctgccagggagccagaaggaagggccttgcagccacagagacactccactgccctggggcacacagtggacactgctcttcctacttcctcctctcctggatgctcatcagctccttctgcctcccccccttttttttccatcttttgttcccctaaattaatgctgcttggattttcatcttatttataaagataaaatcacctggaagtgtcaaggagtggggcggggtggcgggggagaagcagccgtgctgccaggtcacccagacctccagacagccggctagccccactgcccgttccttttacgcccaagttttgctccttgagagcagattggctgatgcccctgcaaccccagcccaagctctgcctcaaagaccgagtgacataagccattcccaccctcctaggttcacatccagggctgtgtcttccttgggggaggagatggtgtcgtttagatcagggtaaggcagtcaggcgggtgttcaccactgccttttcttcctctgagcgtgagaacactgaacccagccactgcccctgggtccctgtcctggaaatggtctaataaatccttttcccttcttgagctacccaagtgatctcatctttccttgactcttaactgagactctgaagggccacccttgcttccaattaaaagaccctctggttttcagt

SEQ ID NO: 365150 - DNA, 2436 bp, Homo sapiens
  misc_feature (2261)..(2262): n is a, c, g, or t
  misc_feature (2266)..(2268): n is a, c, g, or t
  misc_feature (2272)..(2272): n is a, c, g, or t
  misc_feature (2274)..(2274): n is a, c, g, or t
  misc_feature (2276)..(2276): n is a, c, g, or t
  misc_feature (2278)..(2278): n is a, c, g, or t
  misc_feature (2312)..(2312): n is a, c, g, or t
  misc_feature (2314)..(2314): n is a, c, g, or t
  misc_feature (2317)..(2317): n is a, c, g, or t
  misc_feature (2319)..(2321): n is a, c, g, or t
  misc_feature (2323)..(2324): n is a, c, g, or t
  misc_feature (2421)..(2421): n is a, c, g, or t
accgctctgggctgcgctcctcgcttgccctcggactcggctcccgctgcgagcggccgccctgcccgcgcaccgcgctcagcgcccaccgccgggcttcccgcgccggacccagtacctcggctccccggggccggaccgaggccgcaagcagcgccgcggggtgtggggcggacccaggagatgaaatgacaacgtcaaccctccagaaagccattgatctggtgacgaaagccacagaggaggacaaagccaagaactacgaggaggcgctgcggctgtaccagcatgcggtggagtacttcctccacgctatcaagtatgaggcccacagcgacaaggccaaggagagcattcgagccaagtgcgtgcagtacctagaccgggccgagaagctgaaggattatttacgaagcaaagagaaacacggcaagaagccagtcaaagagaaccagagtgagggcaagggcagtgacagtgacagtgaaggggataatccggagaaaaagaaactgcaagaacagctgatgggtgccgtcgtgatggagaagcccaacatacggtggaacgacgtggccgggctggagggggccaaggaggccctcaaagaagctgtcattttgccaatcaaattcccacacttgttcacaggcaagcgcaccccctggcgggggattctgctgttcggaccccctggcacagggaaatcctacctggccaaagccgtggcaacagaggccaacaactccaccttcttctctgtgtcctcctcagatctgatgtccaagtggctgggggagagtgaaaagctggtcaagaacctgtttgagctggccaggcagcacaagccctccatcatcttcatcgatgaggtggattccctctgcgggtcccgaaatgaaaatgagagtgaggccgcccggaggatcaaaacggagttcttggtccagatgcagggggtggggaataacaatgatgggactctggttcttggagccacaaacatcccatgggtgttggattcggccatcaggaggaggtttgaaaaacgaatttatatccccttgccggaggaagctgcccgcgcccagatgttccggttgcatctcgggagcactccccacaacctcacggatgcaaacatccacgagctggcccggaagacggaaggctactcgggcgcggacatcagcatcatcgtgcgggactctctcatgcagcccgtgaggaaggtgcagtcggccacacacttcaaaaaggtctgtggcccctctcgcaccaaccccagcatgatgattgatgacctcctgactccatgctcaccaggggacccaggagccatggagatgacttggatggatgtccctggggacaaactcttagagcctgtggtttgcatgtcggacatgctgcggtctctggccaccacccggcccacggtgaatgcagacgacctcctgaaagtgaagaaattctcagaggactttgggcaagagagttaaaagctgcttcacttgggcaatggtgaaggtgggaggttgattggggcaaatccaggcactccccatgtcaacagccagacagggctccagggcttgtcccagtcaatacagagttccctctgctgtctggccgtctgccagggagccagaaggaagggccttgcagccacagagacactccactgccctggggcacacagtggacactgctcttcctacttcctcctctcctggatgctcatcagctccttctgcctcccccccttttttttccatcttttgttcccctaaattaatgctgcttggattttcatcttatttataaagataaaatcacctggaagtgtcaaggagtggggcggggtggcgggggagaagcagccgtgctgccaggtcacccagacctccagacagccggctagccccactgcccgttccttttacgcccaagttttgctccttgagagcagattggctgatgcccctgcaaccccagcccaagctctgcctcaaagaccgagtgacataagccattcccaccctcctaggttcacatccagggctgtgtcttccttgggggaggagatggtgtcgtttagatcagggtaaggcagtcaggcgggtgttcaccactgccttttcttcctctgagcgtgagaacactgaacccagccactgcccctgggtccctgtcctggaaatggtctaataaatccttttcccttcttgagctaaaaaaaaaaaaaaaaaaaaaaaaanntttnnnaaananananaaaaaaaaaaaaaaaaaaaaaaaaaaaaaaaaananaanannntnnttttttttttttttttttttttttttttttttttttttttttttttttttttttttttttttttttttttttttttttttttttttttttttttttngggggggtttttttt

SEQ ID NO: 365151 - DNA, 2274 bp, Homo sapiens
accgctctgggctgcgctcctcgcttgccctcggactcggctcccgctgcgagcggccgccctgcccgcgcaccgcgctcagcgcccaccgccgggcttcccgcgccggacccagtacctcggctccccggggccggaccgaggccgcaagcagcgccgcggggtgtggggcggacccaggagatgaaatgacaacgtcaaccctccagaaagccattgatctggtgacgaaagccacagaggaggacaaagccaagaactacgaggaggcgctgcggctgtaccagcatgcggtggagtacttcctccacgctatcaagtatgaggcccacagcgacaaggccaaggagagcattcgagccaagtgcgtgcagtacctagaccgggccgagaagctgaaggattatttacgaagcaaagagaaacacggcaagaagccagtcaaagagaaccagagtgagggcaagggcagtgacagtgacagtgaaggggataatccggagaaaaagaaactgcaagaacagctgatgggtgccgtcgtgatggagaagcccaacatacggtggaacgacgtggccgggctggagggggccaaggaggccctcaaagaagctgtcattttgccaatcaaattcccacacttgttcacaggcaagcgcaccccctggcgggggattctgctgttcggaccccctggcacagggaaatcctacctggccaaagccgtggcaacagaggccaacaactccaccttcttctctgtgtcctcctcagatctgatgtccaagtggctgggggagagtgaaaagctggtcaagaacctgtttgagctggccaggcagcacaagccctccatcatcttcatcgatgaggtggattccctctgcgggtcccgaaatgaaaatgagagtgaggccgcccggaggatcaaaacggagttcttggtccagatgcagggggtggggaataacaatgatgggactctggttcttggagccacaaacatcccatgggtgttggattcggccatcaggaggaggtttgaaaaacgaatttatatccccttgccggaggaagctgcccgcgcccagatgttccggttgcatctcgggagcactccccacaacctcacggatgcaaacatccacgagctggcccggaagacggaaggctactcgggcgcggacatcagcatcatcgtgcgggactctctcatgcagcccgtgaggaaggtgcagtcggccacacacttcaaaaaggtctgtggcccctctcgcaccaaccccagcatgatgattgatgacctcctgactccatgctcaccaggggacccaggagccatggagatgacttggatggatgtccctggggacaaactcttagagcctgtggtttgcatgtcggacatgctgcggtctctggccaccacccggcccacggtgaatgcagacgacctcctgaaagtgaagaaattctcagaggactttgggcaagagagttaaaagctgcttcacttgggcaatggtgaaggtgggaggttgattggggcaaatccaggcactccccatgtcaacagccagacagggctccagggcttgtcccagtcaatacagagttccctctgctgtctggccgtctgccagggagccagaaggaagggccttgcagccacagagacactccactgccctggggcacacagtggacactgctcttcctacttcctcctctcctggatgctcatcagctccttctgcctcccccccttttttttccatcttttgttcccctaaattaatgctgcttggattttcatcttatttataaagataaaatcacctggaagtgtcaaggagtggggcggggtggcgggggagaagcagccgtgctgccaggtcacccagacctccagacagccggctagccccactgcccgttccttttacgcccaagttttgctccttgagagcagattggctgatgcccctgcaaccccagcccaagctctgcctcaaagaccgagtgacataagccattcccaccctcctaggttcacatccagggctgtgtcttccttgggggaggagatggtgtcgtttagatcagggtaaggcagtcaggcgggtgttcaccactgccttttcttcctctgagcgtgagaacactgaacccagccactgcccctgggtccctgtcctggaaatggtctaataaatccttttcccttcttgagcttctgttgcccaggctggagtgcagtggcacgatcttggt

SEQ ID NO: 365152 - DNA, 2112 bp, Homo sapiens
accgctctgggctgcgctcctcgcttgccctcggactcggctcccgctgcgagcggccgccctgcccgcgcaccgcgctcagcgcccaccgccgggcttcccgcgccggacccagtacctcggctccccggggccggaccgaggccgcaagcagcgccgcggggtgtggggcggacccaggagatgaaatgacaacgtcaaccctccagaaagccattgatctggtgacgaaagccacagaggaggacaaagccaagaactacgaggaggcgctgcggctgtaccagcatgcggtggagtacttcctccacgctatcaagtatgaggcccacagcgacaaggccaaggagagcattcgagccaagtgcgtgcagtacctagaccgggccgagaagctgaaggattatttacgaagcaaagagaaacacggcaagaagccagtcaaagagaaccagagtgagggcaagggcagtgacagtgacagtgaaggggataatccggagaaaaagaaactgcaagaacagctgatgggtgccgtcgtgatggagaagcccaacatacggtggaacgacgtggccgggctggagggggccaaggaggccctcaaagaagctgtcattttgccaatcaaattcccacacttgttcacaggcaagcgcaccccctggcgggggattctgctgttcggaccccctggcacagggaaatcctacctggccaaagccgtggcaacagaggccaacaactccaccttcttctctgtgtcctcctcagatctgatgtccaagtggctgggggagagtgaaaagctggtcaagaacctgtttgagctggccaggcagcacaagccctccatcatcttcatcgatgaggtggattccctctgcgggtcccgaaatgaaaatgagagtgaggccgcccggaggatcaaaacggagttcttggtccagatgcagggggtggggaataacaatgatgggactctggttcttggagccacaaacatcccatgggtgttggattcggccatcaggaggaggtttgaaaaacgaatttatatccccttgccggaggaagctgcccgcgcccagatgttccggttgcatctcgggagcactccccacaacctcacggatgcaaacatccacgagctggcccggaagacggaaggctactcgggcgcggacatcagcatcatcgtgcgggactctctcatgcagcccgtgaggaaggtgcagtcggccacacacttcaaaaaggtctgtggcccctctcgcaccaaccccagcatgatgattgatgacctcctgactccatgctcaccaggggacccaggagccatggagatgacttggatggatgtccctggggacaaactcttagagcctgtggtttgcatgtcggacatgctgcggtctctggccaccacccggcccacggtgaatgcagacgacctcctgaaagtgaagaaattctcagaggactttgggcaagagagttaaaagctgcttcacttgggcaatggtgaaggtgggaggttgattggggcaaatccaggcactccccatgtcaacagccagacagggctccagggcttgtcccagtcaatacagagttccctctgctgtctggccgtctgccagggagccagaaggaagggccttgcagccacagagacactccactgccctggggcacacagtggacactgctcttcctacttcctcctctcctggatgctcatcagctccttctgcctcccccccttttttttccatcttttgttcccctaaattaatgctgcttggattttcatcttatttataaagataaaatcacctggaagtgtcaaggagtggggcggggtggcgggggagaagcagccgtgctgccaggtcacccagacctccagacagccggctagccccactgcccgttccttttacgcccaagttttgctccttgagagcagattggctgatgcccctgcaaccccagcccaagctctgcctcaaagaccgagtgacataagccattcccacccttttttttccatcttttgtcccctaaattaatgctgtttggattttcatcttattataaagatatcac

SEQ ID NO: 365153 - DNA, 3749 bp, Homo sapiens
accgctctgggctgcgctcctcgcttgccctcggactcggctcccgctgcgagcggccgccctgcccgcgcaccgcgctcagcgcccaccgccgggcttcccgcgccggacccagtacctcggctccccggggccggaccgaggccgcaagcagcgccgcggggtgtggggcggacccaggagatgaaatgacaacgtcaaccctccagaaagccattgatctggtgacgaaagccacagaggaggacaaagccaagaactacgaggaggcgctgcggctgtaccagcatgcggtggagtacttcctccacgctatcaagtatgaggcccacagcgacaaggccaaggagagcattcgagccaagtgcgtgcagtacctagaccgggccgagaagctgaaggattatttacgaagcaaagagaaacacggcaagaagccagtcaaagagaaccagagtgagggcaagggcagtgacagtgacagtgaaggggataatccggagaaaaagaaactgcaagaacagctgatgggtgccgtcgtgatggagaagcccaacatacggtggaacgacgtggccgggctggagggggccaaggaggccctcaaagaagctgtcattttgccaatcaaattcccacacttgttcacaggcaagcgcaccccctggcgggggattctgctgttcggaccccctggcacagggaaatcctacctggccaaagccgtggcaacagaggccaacaactccaccttcttctctgtgtcctcctcagatctgatgtccaagtggctgggggagagtgaaaagctggtcaagaacctgtttgagctggccaggcagcacaagccctccatcatcttcatcgatgaggtggattccctctgcgggtcccgaaatgaaaatgagagtgaggccgcccggaggatcaaaacggagttcttggtccagatgcagggggtggggaataacaatgatgggactctggttcttggagccacaaacatcccatgggtgttggattcggccatcaggaggaggtttgaaaaacgaatttatatccccttgccggaggaagctgcccgcgcccagatgttccggttgcatctcgggagcactccccacaacctcacggatgcaaacatccacgagctggcccggaagacggaaggctactcgggcgcggacatcagcatcatcgtgcgggactctctcatgcagcccgtgaggaaggtgcagtcggccacacacttcaaaaaggtgagtgcccgcggccactgctgagaaaaatctcatagtaagagcgggatgttcggttttttttttcccagctcctggtcctgctccccggctgctcaggtgacacagtctctgaggcctcctggagagccgagggccagtgccatgggggctgcacccactgtcccctccctgcagctcttctggagtgtggccatctcagggtgtgtgaaagcagaggacagggccactttactgtcttaaccctgctgcggcctcctccgtcagcactgtgtgctcttgtgcggggtggacaccaaatcagtgtttggaaagtgttggatataaaatgaccaggaagacctgtctattcattcagcagatctctgctgagtatttgctgtgggtcctcctgtgtgcccggccctgtcctaagtgctgggaagatatgagtgaccaacagacaaaaatcctagaccttccgttgttggtggggagacagtcaacacagtcagtgagtgtctcagaggatggagatggagcagggttaggagagaggtgtctcgggcatggagggaagggcagatggcactggggtgatgcctgagacaggaggtgaaggtgtgagggaatgagccttgtggacattgggggaatgttttgccaaggcagcggacttcagttggaaaaccactttgtgttaatctattttcatgctgctgataaagacatacccgagactgggaagaaaaagaggtttaattggccttacagttccacatggctagggaggcctcagaatcatggtaggagaccaaaggcacttcttacatgctggtggcaagagaaaatgaagaaacaaaagtggaaacccctgataaacccatcagatctcgtgagacttcaccatcacgagaatagcacgggaaagaccagcccccatgattcagttacctccccctgggtccctcccacaacatgtgggaattctgggagatagatacagttcaagttgaaatgtgggtgggggcacagctaaaccatatcacacttttaatgtcactgtattcctggtgagacgtgacagtgttaatgaggaagacatcaaggcattggggctacagattgccagagtcccatgcaaatcatgagtcgctcggaccacccagcccgagttctgaaggagcccgtcctcctcagatgctagggacccacagagcattctctttgggacttccttagagaccggaggggtcgagcccctctgacactgaggggcagctgccccagtcagatccatttggtttcaggtctgtggcccctctcgcaccaaccccagcatgatgattgatgacctcctgactccatgctcaccaggggacccaggagccatggagatgacttggatggatgtccctggggacaaactcttagagcctgtggtttgcatggtaagtgacttgacaggggagggaagagggctgcacagagcccagaaaattgagggtttgggtccagaataaaaacggtcttctccaggccaggcatggtagctcacgcctgtaatcccagcactttgggaggccagggtgggcagatcacaaggttaggagttcgagaccagcctagccaatatggagaaaccctgtctctactaaaaatacaaaaattagccgggtgtggtggtgtgcacttgtagtcccagctactcaggaggctgaggcagaaggatcgcctgaagccgggaggcagaggttgcagtgagcagagattgggccactgcactccagcctgggtgacagagtgagactccgtctcaaaaataaaaaatagtcttcttctatgtcctgggctgttgagaatggcctttgtagctcagggaagctggcattacactcactgggggcccagaatgcaggtggcagcattagcattttgtacatacagagaaaggctagatgcagtggtgcagtgatagctcactgcaggcttgacctcacgagctcacacaatcttctgacctcagcctcctgagtagcaacaggcacacaccatcatgcccagctaatttttccttttttttttagaaacggcctcacagtgttgcccaggccagtctgaaactgctgggctcaagtgatcctctcagcgtggcctcccaaagtgctgggattacaagcatgagctgagccaccacacctagcctgcattttatattctttagcaagtaaagtcaggtccagataatatgacgtcaatccatgggtttggctttgcggtgcagtgaggcagtgaatgtgtcaagactgtgacgcagttgcaaaggcagcgcctcacctgcatagcctggcccgtgccatcctggcaagggtctgcccttgtggctggtgttgggggtgtgcagctaagaaggctcctggccgggcgccgtggctcccgcctgtaatcccagcattttgtacatacagagaaaggctagatgcagtggtgcagtgatagctcactgcaggc

SEQ ID NO: 365154 - DNA, 1499 bp, Homo sapiens
  misc_feature (28)..(28): n is a, c, g, or t
  misc_feature (32)..(32): n is a, c, g, or t
  misc_feature (44)..(45): n is a, c, g, or t
  misc_feature (49)..(49): n is a, c, g, or t
  misc_feature (55)..(55): n is a, c, g, or t
  misc_feature (63)..(63): n is a, c, g, or t
gcagcacttatgtggctgacaccttaantagnaaaacaccgttnntggntatttnataataanaagcagcgtacggtcggaatctggatgagtgaggcgccgaggatcaaacggagtcttggtcagatgcaggggtggggaataacaatgatgggactctggttcttggagccacaaacatcccatgggtgttggattcggccatcaggaggaggtttgaaaaacgaatttatatccccttgccggaggaagctgcccgcgcccagatgttccggttgcatctcgggagcactccccacaacctcacggatgcaaacatccacgagctggcccggaagacggaaggctactcgggcgcggacatcagcatcatcgtgcgggactctctcatgcagcccgtgaggaaggtgcagtcggccacacacttcaaaaaggtctgtggcccctctcgcaccaaccccagcatgatgattgatgacctcctgactccatgctcaccaggggacccaggagccatggagatgacttggatggatgtccctggggacaaactcttagagcctgtggtttgcatgtcggacatgctgcggtctctggccaccacccggcccacggtgaatgcagacgacctcctgaaagtgaagaaattctcagaggactttgggcaagagagttaaaagctgcttcacttgggcaatggtgaaggtgggaggttgattggggcaaatccaggcactccccatgtcaacagccagacagggctccagggcttgtcccagtcaatacagagttccctctgctgtctggccgtctgccagggagccagaaggaagggccttgcagccacagagacactccactgccctggggcacacagtggacactgctcttcctacttcctcctctcctggatgctcatcagctccttctgcctcccccccttttttttccatcttttgttcccctaaattaatgctgcttggattttcatcttatttataaagataaaatcacctggaagtgtcaaggagtggggcggggtggcgggggagaagcagccgtgctgccaggtcacccagacctccagacagccggctagccccactgcccgttccttttacgcccaagttttgctccttgagagcagattggctgatgcccctgcaaccccagcccaagctctgcctcaaagaccgagtgacataagccattcccaccctcctaggttcacatccagggctgtgtcttccttgggggaggagatggtgtcgtttagatcagggtaaggcagtcaggcgggtgttcaccactgccttttcttcctctgagcgtgagaacactgaacccagccactgcccctgggtccctgtcctggaaatggtctaataaatccttttcccttcttgagctacccaagtgatctcatctttccttgactcttaactgagactctgaagggccacccttgcttccaattaaaagaccctctggttttcagt

SEQ ID NO: 365155 - DNA, 1184 bp, Homo sapiens
accgctctgggctgcgctcctcgcttgccctcggactcggctcccgctgcgagcggccgccctgcccgcgcaccgcgctcagcgcccaccgccgggcttcccgcgccggacccagtacctcggctccccggggccggaccgaggccgcaagcagcgccgcggggtgtggggcggacccaggagatgaaatgacaacgtcaaccctccagaaagccattgatctggtgacgaaagccacagaggaggacaaagccaagaactacgaggaggcgctgcggctgtaccagcatgcggtggagtacttcctccacgctatcaagtatgaggcccacagcgacaaggccaaggagagcattcgagccaagtgcgtgcagtacctagaccgggccgagaagctgaaggattatttacgaagcaaagagaaacacggcaagaagccagtcaaagagaaccagagtgagggcaagggcagtgacagtgacagtgaaggggataatccggagaaaaagaaactgcaagaacagctgatgggtgccgtcgtgatggagaagcccaacatacggtggaacgacgtggccgggctggagggggccaaggaggccctcaaagaagctgtcattttgccaatcaaattcccacacttgttcacaggcaagcgcaccccctggcgggggattctgctgttcggaccccctggcacagggaaatcctacctggccaaagccgtggcaacagaggccaacaactccaccttcttctctgtgtcctcctcagatctgatgtccaagtggctgggggagagtgaaaagctggtcaagaacctgtttgagctggccaggcagcacaagccctccatcatcttcatcgatgaggtggattccctctgcgggtcccgaaatgaaaatgagagtgaggccgcccggaggatcaaaacggagttcttggtccagatgcagggggtggggaataacaatgatgggactctggttcttggagccacaaacatcccatgggtgttggattcggccatcaggaggaggtgagtcttccccaggagaagccagggctggaggcttcctcccaccatggtcacggtccgcctgctgctggcagcccgggtgcagcctggccccttttccctggagtctttcccgtctgcctgccaagcagagccctttgtgagg

SEQ ID NO: 365156 - DNA, 762 bp, Homo sapiens
accgctctgggctgcgctcctcgcttgccctcggactcggctcccgctgcgagcggccgccctgcccgcgcaccgcgctcagcgcccaccgccgggcttcccgcgccggacccagtacctcggctccccggggccggaccgaggccgcaagcagcgccgcggggtgtggggcggacccaggagatgaaatgacaacgtcaaccctccagaaagccattgatctggtgacgaaagccacagaggaggacaaagccaagaactacgaggaggcgctgcggctgtaccagcatgcggtggagtacttcctccacgctatcaagtatgaggcccacagcgacaaggccaaggagagcattcgagccaagtgcgtgcagtacctagaccgggccgagaagctgaaggattatttacgaagcaaagagaaacacggcaagaagccagtcaaagagaaccagagtgagggcaagggcagtgacagtgacagtgaaggggataatccggagaaaaagaaactgcaagaacagctgatggctctgcctcaaagaccgagtgacataagccattcccaccctcctaggttcacatccagggctgtgtcttccttgggggaggagatggtgtcgtttagatcagggtaaggcagtcaggcgggtgttcaccactgccttttcttcctctgagcgtgagaacactgaacccagccactgcccctgggtccctgtcctggaaatggtctaataaatccttttcccttcttgagct

SEQ ID NO: 365157 - DNA, 2235 bp, Homo sapiens
accgctctgggctgcgctcctcgcttgccctcggactcggctcccgctgcgagcggccgccctgcccgcgcaccgcgctcagcgcccaccgccgggcttcccgcgccggacccagtacctcggctccccggggccggaccgaggccgcaagcagcgccgcggggtgtggggcggacccaggagatgaaatgacaacgtcaaccctccagaaagccattgatctggtgacgaaagccacagaggaggacaaagccaagaactacgaggaggcgctgcggctgtaccagcatgcggtggagtacttcctccacgctatcaagtatgaggcccacagcgacaaggccaaggagagcattcgagccaagtgcgtgcagtacctagaccgggccgagaagctgaaggattatttacgaagcaaagagaaacacggcaagaagccagtcaaagagaaccagagtgagggcaagggcagtgacagtgacagtgaaggggataatccggagaaaaagaaactgcaagaacagctgatgggtgccgtcgtgatggagaagcccaacatacggtggaacgacgtggccgggctggagggggccaaggaggccctcaaagaagctgtcattttgccaatcaaattcccacacttgttcacaggcaagcgcaccccctggcgggggattctgctgttcggaccccctggcacagggaaatcctacctggccaaagccgtggcaacagaggccaacaactccaccttcttctctgtgtcctcctcagatctgatgtccaagtggctgggggagagtgaaaagctggtcaagaacctgtttgagctggccaggcagcacaagccctccatcatcttcatcgatgaggtggattccctctgcgggtcccgaaatgaaaatgagagtgaggccgcccggaggatcaaaacggagttcttggtccagatgcagggggtggggaataacaatgatgggactctggttcttggagccacaaacatcccatgggtgttggattcggccatcaggaggaggtttgaaaaacgaatttatatccccttgccggaggaagctgcccgcgcccagatgttccggttgcatctcgggagcactccccacaacctcacggatgcaaacatccacgagctggcccggaagacggaaggctactcgggcgcggacatcagcatcatcgtgcgggactctctcatgcagcccgtgaggaaggtgcagtcggccacacacttcaaaaaggtctgtggcccctctcgcaccaaccccagcatgatgattgatgacctcctgactccatgctcaccaggggacccaggagccatggagatgacttggatggatgtccctggggacaaactcttagagcctgtggtttgcatgtcggacatgctgcggtctctggccaccacccggcccacggtgaatgcagacgacctcctgaaagtgaagaaattctcagaggactttgggcaagagagttaaaagctgcttcacttgggcaatggtgaaggtgggaggttgattggggcaaatccaggcactccccatgtcaacagccagacagggctccagggcttgtcccagtcaatacagagttccctctgctgtctggccgtctgccagggagccagaaggaagggccttgcagccacagagacactccactgccctggggcacacagtggacactgctcttcctacttcctcctctcctggatgctcatcagctccttctgcctcccccccttttttttccatcttttgttcccctaaattaatgctgcttggattttcatcttatttataaagataaaatcacctggaagtgtcaaggagtggggcggggtggcgggggagaagcagccgtgctgccaggtcacccagacctccagacagccggctagccccactgcccgttccttttacgcccaagttttgctccttgagagcagattggctgatgcccctgcaaccccagcccaagctctgcctcaaagaccgagtgacataagccattcccaccctcctaggttcacatccagggctgtgtcttccttgggggaggagatggtgtcgtttagatcagggtaaggcagtcaggcgggtgttcaccactgccttttcttcctctgagcgtgagaacactgaacccagccactgcccctgggtccctgtcctggaaatggtctaataaatccttttcccttcttgagct

SEQ ID NO: 365158 - DNA, 3613 bp, Homo sapiens
accgctctgggctgcgctcctcgcttgccctcggactcggctcccgctgcgagcggccgccctgcccgcgcaccgcgctcagcgcccaccgccgggcttcccgcgccggacccagtacctcggctccccggggccggaccgaggccgcaagcagcgccgcggggtgtggggcggacccaggagatgaaatgacaacgtcaaccctccagaaagccattgatctggtgacgaaagccacagaggaggacaaagccaagaactacgaggaggcgctgcggctgtaccagcatgcggtggagtacttcctccacgctatcaagtatgaggcccacagcgacaaggccaaggagagcattcgagccaagtgcgtgcagtacctagaccgggccgagaagctgaaggattatttacgaagcaaagagaaacacggcaagaagccagtcaaagagaaccagagtgagggcaagggcagtgacagtgacagtgaaggggataatccggagaaaaagaaactgcaagaacagctgatgggtgccgtcgtgatggagaagcccaacatacggtggaacgacgtggccgggctggagggggccaaggaggccctcaaagaagctgtcattttgccaatcaaattcccacacttgttcacaggcaagcgcaccccctggcgggggattctgctgttcggaccccctggcacagggaaatcctacctggccaaagccgtggcaacagaggccaacaactccaccttcttctctgtgtcctcctcagatctgatgtccaagtggctgggggagagtgaaaagctggtcaagaacctgtttgagctggccaggcagcacaagccctccatcatcttcatcgatgaggtggattccctctgcgggtcccgaaatgaaaatgagagtgaggccgcccggaggatcaaaacggagttcttggtccagatgcagggggtggggaataacaatgatgggactctggttcttggagccacaaacatcccatgggtgttggattcggccatcaggaggaggtttgaaaaacgaatttatatccccttgccggaggaagctgcccgcgcccagatgttccggttgcatctcgggagcactccccacaacctcacggatgcaaacatccacgagctggcccggaagacggaaggctactcgggcgcggacatcagcatcatcgtgcgggactctctcatgcagcccgtgaggaaggtgcagtcggccacacacttcaaaaaggtgagtgcccgcggccactgctgagaaaaatctcatagtaagagcgggatgttcggttttttttttcccagctcctggtcctgctccccggctgctcaggtgacacagtctctgaggcctcctggagagccgagggccagtgccatgggggctgcacccactgtcccctccctgcagctcttctggagtgtggccatctcagggtgtgtgaaagcagaggacagggccactttactgtcttaaccctgctgcggcctcctccgtcagcactgtgtgctcttgtgcggggtggacaccaaatcagtgtttggaaagtgttggatataaaatgaccaggaagacctgtctattcattcagcagatctctgctgagtatttgctgtgggtcctcctgtgtgcccggccctgtcctaagtgctgggaagatatgagtgaccaacagacaaaaatcctagaccttccgttgttggtggggagacagtcaacacagtcagtgagtgtctcagaggatggagatggagcagggttaggagagaggtgtctcgggcatggagggaagggcagatggcactggggtgatgcctgagacaggaggtgaaggtgtgagggaatgagccttgtggacattgggggaatgttttgccaaggcagcggacttcagttggaaaaccactttgtgttaatctattttcatgctgctgataaagacatacccgagactgggaagaaaaagaggtttaattggccttacagttccacatggctagggaggcctcagaatcatggtaggagaccaaaggcacttcttacatgctggtggcaagagaaaatgaagaaacaaaagtggaaacccctgataaacccatcagatctcgtgagacttcaccatcacgagaatagcacgggaaagaccagcccccatgattcagttacctccccctgggtccctcccacaacatgtgggaattctgggagatagatacagttcaagttgaaatgtgggtgggggcacagctaaaccatatcacacttttaatgtcactgtattcctggtgagacgtgacagtgttaatgaggaagacatcaaggcattggggctacagattgccagagtcccatgcaaatcatgagtcgctcggaccacccagcccgagttctgaaggagcccgtcctcctcagatgctagggacccacagagcattctctttgggacttccttagagaccggaggggtcgagcccctctgacactgaggggcagctgccccagtcagatccatttggtttcaggtctgtggcccctctcgcaccaaccccagcatgatgattgatgacctcctgactccatgctcaccaggggacccaggagccatggagatgacttggatggatgtccctggggacaaactcttagagcctgtggtttgcatgtcggacatgctgcggtctctggccaccacccggcccacggtgaatgcagacgacctcctgaaagtgaagaaattctcagaggactttgggcaagagagttaaaagctgcttcacttgggcaatggtgaaggtgggaggttgattggggcaaatccaggcactccccatgtcaacagccagacagggctccagggcttgtcccagtcaatacagagttccctctgctgtctggccgtctgccagggagccagaaggaagggccttgcagccacagagacactccactgccctggggcacacagtggacactgctcttcctacttcctcctctcctggatgctcatcagctccttctgcctcccccccttttttttccatcttttgttcccctaaattaatgctgcttggattttcatcttatttataaagataaaatcacctggaagtgtcaaggagtggggcggggtggcgggggagaagcagccgtgctgccaggtcacccagacctccagacagccggctagccccactgcccgttccttttacgcccaagttttgctccttgagagcagattggctgatgcccctgcaaccccagcccaagctctgcctcaaagaccgagtgacataagccattcccaccctcctaggttcacatccagggctgtgtcttccttgggggaggagatggtgtcgtttagatcagggtaaggcagtcaggcgggtgttcaccactgccttttcttcctctgagcgtgagaacactgaacccagccactgcccctgggtccctgtcctggaaatggtctaataaatccttttcccttcttgagctacccaagtgatctcatctttccttgactcttaactgagactctgaagggccacccttgcttccaattaaaagaccctctggttttcagt

SEQ ID NO: 365159 - DNA, 2530 bp, Homo sapiens
accgctctgggctgcgctcctcgcttgccctcggactcggctcccgctgcgagcggccgccctgcccgcgcaccgcgctcagcgcccaccgccgggcttcccgcgccggacccagtacctcggctccccggggccggaccgaggccgcaagcagcgccgcggggtgtggggcggacccaggagatgaaatgacaacgtcaaccctccagaaagccattgatctggtgacgaaagccacagaggaggacaaagccaagaactacgaggaggcgctgcggctgtaccagcatgcggtggagtacttcctccacgctatcaagtatgaggcccacagcgacaaggccaaggagagcattcgagccaagtgcgtgcagtacctagaccgggccgagaagctgaaggattatttacgaagcaaagagaaacacggcaagaagccagtcaaagagaaccagagtgagggcaagggcagtgacagtgacagtgaaggggataatccggagaaaaagaaactgcaagaacagctgatgggtgccgtcgtgatggagaagcccaacatacggtggaacgacgtggccgggctggagggggccaaggaggccctcaaagaagctgtcattttgccaatcaaattcccacacttgttcacaggcaagcgcaccccctggcgggggattctgctgttcggaccccctggcacagggaaatcctacctggccaaagccgtggcaacagaggccaacaactccaccttcttctctgtgtcctcctcagatctgatgtccaagtggctgggggagagtgaaaagctggtcaagaacctgtttgagctggccaggcagcacaagccctccatcatcttcatcgatgaggtggattccctctgcgggtcccgaaatgaaaatgagagtgaggccgcccggaggatcaaaacggagttcttggtccagatgcagggggtggggaataacaatgatgggactctggttcttggagccacaaacatcccatgggtgttggattcggccatcaggaggaggtttgaaaaacgaatttatatccccttgccggaggaagctgcccgcgcccagatgttccggttgcatctcgggagcactccccacaacctcacggatgcaaacatccacgagctggcccggaagacggaaggctactcgggcgcggacatcagcatcatcgtgcgggactctctcatgcagcccgtgaggaaggtgcagtcggccacacacttcaaaaaggtctgtggcccctctcgcaccaaccccagcatgatgattgatgacctcctgactccatgctcaccaggggacccaggagccatggagatgacttggatggatgtccctggggacaaactcttagagcctgtggtttgcatgtcggacatgctgcggtctctggccaccacccggcccacggtgaatgcagacgacctcctgaaagtgaagaaattctcagaggactttgggcaagagagttaaaagctgcttcacttgggcaatggtgaaggtgggaggttgattggggcaaatccaggcactccccatgtcaacagccagacagggctccagggcttgtcccagtcaatacagagttccctctgctgtctggccgtctgccagggagccagaaggaagggccttgcagccacagagacactccactgccctggggcacacagtggacactgctcttcctacttcctcctctcctggatgctcatcagctccttctgcctcccccccttttttttccatcttttgttcccctaaattaatgctgcttggattttcatcttatttataaagataaaatcacctggaagtgtcaaggagtggggcggggtggcgggggagaagcagccgtgctgccaggtcacccagacctccagacagccggctagccccactgcccgttccttttacgcccaagttttgctccttgagagcagattggctgatgcccctgcaaccccagcccaagctctgcctcaaagaccgagtgacataagccattcccaccctcctaggttcacatccagggctgtgtcttccttgggggaggagatggtgtcgtttagatcagggtaaggcagtcaggcgggtgttcaccactgccttttcttcctctgagcgtgagaacactgaacccagccactgcccctgggtccctgtcctggaaatggtctaataaatccttttcccttcttgagctaaaaaaaaaaaaaaaaaaaaaaaaaaaaaaaaaaaaaaaaaaaaaaaaaaaaaggggggggggggtaaaaatccccgggggggcgccacaatgtgacgggcgaccccacagttttgttgttcacacaggggcggccacaaataagaggagagcgttataaaacgacgagaacgggaggcccgtgtataaacaacgggggggacggagacaaaacgctacccggggccacagtgagagagacacccacacgcgggcggggcactacgggcaacagcaaccccgaaaagattaagcg

SEQ ID NO: 365160 - DNA, 2271 bp, Homo sapiens
accgctctgggctgcgctcctcgcttgccctcggactcggctcccgctgcgagcggccgccctgcccgcgcaccgcgctcagcgcccaccgccgggcttcccgcgccggacccagtacctcggctccccggggccggaccgaggccgcaagcagcgccgcggggtgtggggcggacccaggagatgaaatgacaacgtcaaccctccagaaagccattgatctggtgacgaaagccacagaggaggacaaagccaagaactacgaggaggcgctgcggctgtaccagcatgcggtggagtacttcctccacgctatcaagtatgaggcccacagcgacaaggccaaggagagcattcgagccaagtgcgtgcagtacctagaccgggccgagaagctgaaggattatttacgaagcaaagagaaacacggcaagaagccagtcaaagagaaccagagtgagggcaagggcagtgacagtgacagtgaaggggataatccggagaaaaagaaactgcaagaacagctgatgggtgccgtcgtgatggagaagcccaacatacggtggaacgacgtggccgggctggagggggccaaggaggccctcaaagaagctgtcattttgccaatcaaattcccacacttgttcacaggcaagcgcaccccctggcgggggattctgctgttcggaccccctggcacagggaaatcctacctggccaaagccgtggcaacagaggccaacaactccaccttcttctctgtgtcctcctcagatctgatgtccaagtggctgggggagagtgaaaagctggtcaagaacctgtttgagctggccaggcagcacaagccctccatcatcttcatcgatgaggtggattccctctgcgggtcccgaaatgaaaatgagagtgaggccgcccggaggatcaaaacggagttcttggtccagatgcagggggtggggaataacaatgatgggactctggttcttggagccacaaacatcccatgggtgttggattcggccatcaggaggaggtttgaaaaacgaatttatatccccttgccggaggaagctgcccgcgcccagatgttccggttgcatctcgggagcactccccacaacctcacggatgcaaacatccacgagctggcccggaagacggaaggctactcgggcgcggacatcagcatcatcgtgcgggactctctcatgcagcccgtgaggaaggtgcagtcggccacacacttcaaaaaggtctgtggcccctctcgcaccaaccccagcatgatgattgatgacctcctgactccatgctcaccaggggacccaggagccatggagatgacttggatggatgtccctggggacaaactcttagagcctgtggtttgcatgtcggacatgctgcggtctctggccaccacccggcccacggtgaatgcagacgacctcctgaaagtgaagaaattctcagaggactttgggcaagagagttaaaagcactccccatgtcaacagccagacagggctccagggcttgtcccagtcaatacagagttccctctgctgtctggccgtctgccagggagccagaaggaagggccttgcagccacagagacactccactgccctggggcacacagtggacactgctcttcctacttcctcctctcctggatgctcatcagctccttctgcctcccccccttttttttccatcttttgttcccctaaattaatgctgcttggattttcatcttatttataaagataaaatcacctggaagtgtcaaggagtggggcggggtggcgggggagaagcagccgtgctgccaggtcacccagacctccagacagccggctagccccactgcccgttccttttacgcccaagttttgctccttgagagcagattggctgatgcccctgcaaccccagcccaagctctgcctcaaagaccgagtgacataagccattcccaccctcctaggttcacatccagggctgtgtcttccttgggggaggagatggtgtcgtttagatcagggtaaggcagtcaggcgggtgttcaccactgccttttcttcctctgagcgtgagaacactgaacccagccactgcccctgggtccctgtcctggaaatggtctaataaatccttttcccttcttgagctacccaagtgatctcatctttccttgactcttaactgagactctgaagggccacccttgcttccaattaaaagaccctctggttttcagt

SEQ ID NO: 365161 - DNA, 3313 bp, Homo sapiens
accgctctgggctgcgctcctcgcttgccctcggactcggctcccgctgcgagcggccgccctgcccgcgcaccgcgctcagcgcccaccgccgggcttcccgcgccggacccagtacctcggctccccggggccggaccgaggccgcaagcagcgccgcggggtgtggggcggacccaggagatgaaatgacaacgtcaaccctccagaaagccattgatctggtgacgaaagccacagaggaggacaaagccaagaactacgaggaggcgctgcggctgtaccagcatgcggtggagtacttcctccacgctatcaagtatgaggcccacagcgacaaggccaaggagagcattcgagccaagtgcgtgcagtacctagaccgggccgagaagctgaaggattatttacgaagcaaagagaaacacggcaagaagccagtcaaagagaaccagagtgagggcaagggcagtgacagtgacagtgaaggggataatccggagaaaaagaaactgcaagaacagctgatgggtgccgtcgtgatggagaagcccaacatacggtggaacgacgtggccgggctggagggggccaaggaggccctcaaagaagctgtcattttgccaatcaaattcccacacttgttcacaggcaagcgcaccccctggcgggggattctgctgttcggaccccctggcacagggaaatcctacctggccaaagccgtggcaacagaggccaacaactccaccttcttctctgtgtcctcctcagatctgatgtccaagtggctgggggagagtgaaaagctggtcaagaacctgtttgagctggccaggcagcacaagccctccatcatcttcatcgatgaggtggattccctctgcgggtcccgaaatgaaaatgagagtgaggccgcccggaggatcaaaacggagttcttggtccagatgcagggggtggggaataacaatgatgggactctggttcttggagccacaaacatcccatgggtgttggattcggccatcaggaggaggtttgaaaaacgaatttatatccccttgccggaggaagctgcccgcgcccagatgttccggttgcatctcgggagcactccccacaacctcacggatgcaaacatccacgagctggcccggaagacggaaggctactcgggcgcggacatcagcatcatcgtgcgggactctctcatgcagcccgtgaggaaggtgcagtcggccacacacttcaaaaaggtgagtgcccgcggccactgctgagaaaaatctcatagtaagagcgggatgttcggttttttttttcccagctcctggtcctgctccccggctgctcaggtgacacagtctctgaggcctcctggagagccgagggccagtgccatgggggctgcacccactgtcccctccctgcagctcttctggagtgtggccatctcagggtgtgtgaaagcagaggacagggccactttactgtcttaaccctgctgcggcctcctccgtcagcactgtgtgctcttgtgcggggtggacaccaaatcagtgtttggaaagtgttggatataaaatgaccaggaagacctgtctattcattcagcagatctctgctgagtatttgctgtgggtcctcctgtgtgcccggccctgtcctaagtgctgggaagatatgagtgaccaacagacaaaaatcctagaccttccgttgttggtggggagacagtcaacacagtcagtgagtgtctcagaggatggagatggagcagggttaggagagaggtgtctcgggcatggagggaagggcagatggcactggggtgatgcctgagacaggaggtgaaggtgtgagggaatgagccttgtggacattgggggaatgttttgccaaggcagcggacttcagttggaaaaccactttgtgttaatctattttcatgctgctgataaagacatacccgagactgggaagaaaaagaggtttaattggccttacagttccacatggctagggaggcctcagaatcatggtaggagaccaaaggcacttcttacatgctggtggcaagagaaaatgaagaaacaaaagtggaaacccctgataaacccatcagatctcgtgagacttcaccatcacgagaatagcacgggaaagaccagcccccatgattcagttacctccccctgggtccctcccacaacatgtgggaattctgggagatagatacagttcaagttgaaatgtgggtgggggcacagctaaaccatatcacacttttaatgtcactgtattcctggtgagacgtgacagtgttaatgaggaagacatcaaggcattggggctacagattgccagagtcccatgcaaatcatgagtcgctcggaccacccagcccgagttctgaaggagcccgtcctcctcagatgctagggacccacagagcattctctttgggacttccttagagaccggaggggtcgagcccctctgacactgaggggcagctgccccagtcagatccatttggtttcaggtctgtggcccctctcgcaccaaccccagcatgatgattgatgacctcctgactccatgctcaccaggggacccaggagccatggagatgacttggatggatgtccctggggacaaactcttagagcctgtggtttgcatggtaagtgacttgacaggggagggaagagggctgcacagagcccagaaaattgagggtttgggtccagaataaaaacggtcttctccaggccaggcatggtagctcacgcctgtaatcccagcactttgggaggccagggtgggcagatcacaaggttaggagttcgagaccagcctagccaatatggagaaaccctgtctctactaaaaatacaaaaattagccgggtgtggtggtgtgcacttgtagtcccagctactcagcgtggcctcccaaagtgctgggattacaagcatgagctgagccaccacacctagcctgcattttatattctttagcaagtaaagtcaggtccagataatatgacgtcaatccatgggtttggctttgcggtgcagtgaggcagtgaatgtgtcaagactgtgacgcagttgcaaaggcagcgcctcacctgcatagcctggcccgtgccatcctggcaagggtctgcccttgtggctggtgttgggggtgtgcagctaagaaggctcctggccgggcgccgtggctcccgcctgtaatcccagcattttgtacatacagagaaaggctagatgcagtggtgcagtgatagctcactgcaggc

SEQ ID NO: 365162 - DNA, 1375 bp, Homo sapiens
accgctctgggctgcgctcctcgcttgccctcggactcggctcccgctgcgagcggccgccctgcccgcgcaccgcgctcagcgcccaccgccgggcttcccgcgccggacccagtacctcggctccccggggccggaccgaggccgcaagcagcgccgcggggtgtggggcggacccaggagatgaaatgacaacgtcaaccctccagaaagccattgatctggtgacgaaagccacagaggaggacaaagccaagaactacgaggaggcgctgcggctgtaccagcatgcggtggagtacttcctccacgctatcaagtatgaggcccacagcgacaaggccaaggagagcattcgagccaagtgcgtgcagtacctagaccgggccgagaagctgaaggattatttacgaagcaaagagaaacacggcaagaagccagtcaaagagaaccagagtgagggcaagggcagtgacagtgacagtgaaggggataatccggagaaaaagaaactgcaagaacagctgatgggtgccgtcgtgatggagaagcccaacatacggtggaacgacgtggccgggctggagggggccaaggaggccctcaaagaagctgtcattttgccaatcaaattcccacacttgttcacaggcaagcgcaccccctggcgggggattctgctgttcggaccccctggcacagggaaatcctacctggccaaagccgtggcaacagaggccaacaactccaccttcttctctgtgtcctcctcagatctgatgtccaagtggctgggggagagtgaaaagctggtcaagaacctgtttgagctggccaggcagcacaagccctccatcatcttcatcgatgaggtggattccctctgcgggtcccgaaatgaaaatgagagtgaggccgcccggaggatcaaaacggagttcttggtccagatgcagggggtggggaataacaatgatgggactctggttcttggagccacaaacatcccatgggtgttggattcggccatcaggaggaggtttgaaaaacgaatttatatccccttgccggaggaagctgcccgcgcccagatgttccggttgcatctcgggagcactccccacaacctcacggatgcaaacatccacgagctggcccggaagacggaaggctactcgggcgcggacatcagcatcatcgtgcgggactctctcatgcagcccgtgaggaaggtgcagtcggccacacacttcaaaaaggtctgtggcccctctcgcaccaaccccagcatgatgattgatgacctcctgactccatgtgcccctgggtccctgtcctggaaatggtctaataaatccttttcccttcttgagct

SEQ ID NO: 365163 - DNA, 1161 bp, Homo sapiens
accgctctgggctgcgctcctcgcttgccctcggactcggctcccgctgcgagcggccgccctgcccgcgcaccgcgctcagcgcccaccgccgggcttcccgcgccggacccagtacctcggctccccggggccggaccgaggccgcaagcagcgccgcggggtgtggggcggacccaggagatgaaatgacaacgtcaaccctccagaaagccattgatctggtgacgaaagccacagaggaggacaaagccaagaactacgaggaggcgctgcggctgtaccagcatgcggtggagtacttcctccacgctatcaagtatgaggcccacagcgacaaggccaaggagagcattcgagccaagtgcgtgcagtacctagaccgggccgagaagctgaaggattatttacgaagcaaagagaaacacggcaagaagccagtcaaagagaaccagagtgagggcaagggcagtgacagtgacagtgaaggggataatccggagaaaaagaaactgcaagaacagctgatgggtgccgtcgtgatggagaagcccaacatacggtggaacgacgtggccgggctggagggggccaaggaggccctcaaagaagctgtcattttgccaatcaaattcccacacttgttcacaggcaagcgcaccccctggcgggggattctgctgttcggaccccctggcacagggaaatcctacctggccaaagccgtggcaacagaggccaacaactccaccttcttctctgtgtcctcctcagatctgatgtccaagtggctgggggagagtgaaaagctggtcaagaacctgtttgagctggccaggcagcacaagccctccatcatcttcatcgatgaggtggattccctctgcgggtcccgaaatgaaaatgagagtgaggccgcccggaggatcaaaacggagttcttggtccagatgcagggggtggggaataacaatgatgggactctggttcttggagccacaaacatcccatgggtgttggattcggccatcaggaggaggtgagtcttccccaggagaagccatggtcacggtccgcctgctgctggcagcccgggtgcagcctggccccttttccctggagtctttcccgtctgcctgccaagcagagccctttgtgagg

SEQ ID NO: 365164 - DNA, 5548 bp, Homo sapiens
aagttttggagcgccggacaagctgaggtccgcgactcgtcgctaagattccccaaaactgagatttcaagaaaattcaccctttccgctttctttggcgcccttcaaccgtgaaggaaatgaaggttgagaacctggaacccgcttccaaagaccaagccctttctctgtgcctcacaacagtcttgcgctgtagctgtttttattacccctattttactactggggaggagatttgaggtcctgaaagtgaagtgacttgctggacgtcacttagcagaggagatggcgaaacctggattagaggcgatgccttctaactcccagcgtggacttgcctcctttcctgggggtgactgaatgcccagccagggacgcgacgtctctggccagcagaaatacggcctcctccccgccgactgggcaaagggggaccttgcggccaaggagggattcgcaggcgggccgggggtgggagcgggggccggagccggagccttggcccgcccccgggcggcgctgtgattggccggccgctccggcgggcgtcgcgattggccgtcctgcagccgttgagatttgaactcggtatttgtggctttgcccgcgcgttgccagactcagaggcggccctttgcctctgcctgccggggattggccggattctccgccgacttgaaaactgccttgctaattggtgcgtgttgtgcacgcgtgttttttccttttcatttcagcctgactgccggaatcagagccgcgggtgagatccccagccctgtgagcctgtaggagtagaatggctccccaaatgtatgagttccatctgccattatccccagaggagttgttgaaaagtggaggggtgaatcagtatgttgtgcaagaggtactgtccatcaaacatcttccaccacagcttagagcttttcaggctgcctttcgagctcaggggcccctggctatgctgcagcactttgatactatctacagcattttgcatcactttcgaagtatagatcctggcctcaaagaagatactctggaattcctgataaaagtggtatcccgccactcccaggagcttccagctatcctggatgatacaactttgagtggatcagatagaaacgcccatctaaatgccctcaaaatgaactgttatgctctgatacgtctcctggaatcctttgagaccatggccagccagacaaaccttgtggacctggaccttggtgggaagggtaagaaagctcggaccaaggcagcccatggctttgactgggaagaagagaggcaaccaattcttcagcttttaacacagctacttcagttggacatccgtcacctgtggaaccactcaataattgaagaagaatttgtcagtttggttactggctgttgctaccgccttctggagaatcccaccattaatcaccagaagaaccgccccactcgggaagccataacacacctgcttggtgtagccttgacccgttataaccatatgctcagtgctacagtgaagatcatccagatgctgcagcactttgaacacctggcacctgtactggttgcagccgtgagtctatgggcaactgactatggaatgaagagcatagtgggagagattgtaagagagattggacaaaagtgtccccaagagctgagtcgagacccttcagggacaaagggctttgcagcattcctgacagaactagcagaacgtgtcccagctatcctgatgtccagcatgtgcattttgctagatcacctggatggagaaaattacatgatgcgtaatgctgtgctggcagccatggcggagatggtgctgcaggttctcagtggcgatcaactggaagcagcagcccgagacaccagagaccagttcttggatactttacaagcccatggccatgatgtcaactcctttgtgcggagccgtgttttgcagctcttcacccgaattgtccagcagaaggctctccccctgacacgtttccaggcagtggtggctttagctgtgggacgtctggcagacaagtcagtgctagtatgtaaaaatgccatccagctgctggccagttttctagccaataatcctttctcctgcaagcttagtgatgctgaccttgccggaccactgcagaaggagacccagaaattacaagagatgagggcccagaggcgaactgcagcagcttctgcagtgctggacccagaggaggagtgggaagccatgctgccagagttgaagtctaccctgcagcagcttctacagcttccccagggagaggaggagattcctgagcaaattgccaatacagagacaactgaagatgtgaaaggacgcatctatcaactgcttgccaaagctagttacaaaaaggccatcattctcactcgagaagccacaggccacttccaggagtccgaacccttcagtcatatagacccagaggagtcagaggagaccaggctcttgaatatcttaggacttatcttcaaaggcccagcagcttccacacaagaaaagaatccccgggagtctacaggaaacatggtcacaggacagactgtctgtaaaaataaacccaatatgtcggatcctgaggaatccaggggaaatgatgaactagtgaagcaggagatgctggtacagtatctgcaggatgcctacagcttctcccggaagattacagaggccattggcataatcagcaagatgatgtatgaaaacacaactacagtggtgcaggaggtgattgaattctttgtgatggtcttccaatttggggtaccccaggccctgtttggggtgcgccgtatgctgcctctcatctggtctaaggagcctggtgtccgggaagccgtgcttaatgcctaccgccaactctacctcaaccccaaaggggactctgccagagccaaggcccaggctttgattcagaatctctctctgctgctagtggatgcctcggttgggaccattcagtgtcttgaggaaattctctgtgagtttgtgcagaaggatgagttgaaaccagcagtgacccagctgctgtgggagcgggccaccgagaaggtcgcctgctgtcctctggagcgctgttcctctgtcatgcttcttggcatgatggcacgaggaaagccagaaattgtgggaagcaatttagacacactggtgagcatagggctggatgagaagtttccacaggactacaggctggcccagcaggtgtgccatgccattgccaacatctcggacaggagaaagccttctctgggcaaacgtcacccccccttccggctgcctcaggaacacaggttgtttgagcgactgcgggagacagtcacaaaaggctttgtccacccagacccactctggatcccattcaaagaggtggcagtgaccctcatttaccaactggcagagggccccgaagtgatctgtgcccagatattgcagggctgtgcaaaacaggccctggagaagctagaagagaagagaaccagtcaggaggacccgaaggagtcccccgcaatgctccccactttcctgttgatgaacctgctgtccctggctggggatgtggctctgcagcagctggtccacttggagcaggcagtgagtggagagctctgccggcgccgagttctccgggaagaacaggagcacaagaccaaagatcccaaggagaagaatacgagctctgagaccaccatggaggaggagctggggctggttggggcaacagcagatgacacagaggcagaactaatccgtggcatctgcgagatggaactgttggatggcaaacagacactggctgcctttgttccactcttgcttaaagtctgtaacaacccaggcctctatagcaacccagacctctctgcagctgcttcacttgcccttggcaagttctgcatgatcagtgccactttctgcgactcccagcttcgtcttctgttcaccatgctggaaaagtctccacttcccattgtccggtctaacctcatggttgccactggggatctggccatccgctttcccaatctggtggacccctggactcctcatctgtatgctcgcctccgggaccctgctcagcaagtgcggaaaacagcggggctggtgatgacccacctgatcctcaaggacatggtgaaggtgaaggggcaggtcagcgagatggcggtgctgctcatcgaccccgagcctcagattgctgccctggccaagaacttcttcaatgagctctcccacaagggcaacgcaatctataatctccttccagatatcatcagccgcctgtcagaccccgagctgggggtggaggaagagcctttccacaccatcatgaaacagctcctctcctacatcaccaaggacaagcagacagagagcctggtggaaaagctgtgtcagcggttccgcacatcccgaactgagcggcagcagcgagacctggcctactgtgtgtcacagctgcccctcacagagcgaggcctccgtaagatgcttgacaattttgactgttttggagacaaactgtcagatgagtccatcttcagtgcttttttgtcagttgtgggcaagctgcgacgtggggccaagcctgagggcaaggctataatagatgaatttgagcagaagcttcgggcctgtcataccagaggtttggatggaatcaaggagcttgagattggccaagcaggtagccagagagcgccatcagccaagaaaccatccactggttctaggtaccagcctctggcttctacagcctcagacaatgactttgtcacaccagagccccgccgtactacccgtcggcatccaaacacccagcagcgagcttccaaaaagaaacccaaagttgtcttctcaagtgatgagtccagtgaggaagatctttcagcagagatgacagaagacgagacacccaagaaaacaactcccattctcagagcatcggctcgcaggcacagatcctaggaagtctgttcctgtcctccctgtgcagggtatcctgtagggtgacctggaattcgaattctgtttcccttgtaaaatatttgtctgtctctttttttaaaaaaaaaaaaaggccgggcactgtggctcacgcctgtaatcccagcactttgcgataccaaggcgggtggataacctgaggtagggagttcgagaccagcctgaccaacatggagaaaccccatctctactaaaaataaaaaattagccgggcgtattggcgtgcgcctgtaatcccagctactcaagaggctgaggcaggagaatcgcctgaacccagaggcggaggttgtagtgagccgaaatcacaccattgcactccagcttgggcaacaatagcgaacctccatctcaaattaaaaaaaaaatgcctacacgctctttaaaatgcaaggctttctcttaaattagcctaactgaactgcgttgagctgcttcaactttggaatatatgtttgccaatctccttgttttctaatgaataaatgtttttatatactttta

SEQ ID NO: 365165 - DNA, 429 bp, Homo sapiens
tgcaatctcggctcactgcaacctctgcctcccaggttcaagcgattctcctgcctcagccgaccaagtagctgggactacaggccctgaccaacatggagaaaccccatctctactaaaaataaaaaattagccgggcgtattggcgtgcgcctgtaatcccagctactcaagaggctgaggcaggagaatcgcctgaacccagaggcggaggttgtagtgagccgaaatcacaccattgcactccagcttgggcaacaatagcgaacctccatctcaaattaaaaaaaaaatgcctacacgctctttaaaatgcaaggctttctcttaaattagcctaactgaactgcgttgagctgcttcaactttggaatatatgtttgccaatctccttgttttctaatgaataaatgtttttatatactttta

SEQ ID NO: 365166 - DNA, 871 bp, Homo sapiens
tcttgtttgtttgtttttaatagtttttatttttcagagcagttttaggttcaaagcaaaattgagcagaaagtacagggagttcccttctaccccttgcccctacacatcacagccttccccaccttcaacatcctgcaccagggtggcacatttgttacagctgaacctacacttacacatcatctcctaaagtcatggtttaccttggagttcactgcacgtaatgacatgtacccaccattgcagtatcatacagaagagtttcactgccttacaaatcccctgcactccacctatttatccctctctccccacaacccctgatctttttactgttgccatcactttgtcttttccagaatgtatcattggaatgatccggtatggagccttctcaccttggcttcttagtaatgtgcgtttaaggcctccatgtcttccatggccttgtttctttttaatcagaagtaactgttttcaggcctgctctgaatctccttttctccctccaggctataatagatgaatttgagcagaagcttcgggcctgtcataccagaggtttggatggaatcaaggagcttgagattggccaagcaggtagccagagagcgccatcagccaagaaaccatccactggttctaggtaccagcctctggcttctacagcctcagacaatgactttgtcacaccagagccccgccgtactacccgtcggcatccaaacacccagcagcgagcttccaaaaagaaacccaaagttgtcttctcaagtgatgagtccagtgaggaagatctttcagctgagttcttaaagactgaagacaggctattctctggagaaaaataaaatggaaattgtcctta

SEQ ID NO: 365167 - DNA, 360 bp, Homo sapiens
agagtctggctctgttgcccaggctggagtgcagtggtgcaatcttggctcactgcaacctccgcctccctggttcaagcaattctcctgccccagctactcaagaggctgaggcaggagaatcgcctgaacccagaggcggaggttgtagtgagccgaaatcacaccattgcactccagcttgggcaacaatagcgaacctccatctcaaattaaaaaaaaaatgcctacacgctctttaaaatgcaaggctttctcttaaattagcctaactgaactgcgttgagctgcttcaactttggaatatatgtttgccaatctccttgttttctaatgaataaatgtttttatatactttta

SEQ ID NO: 365168 - DNA, 4936 bp, Homo sapiens
aagttttggagcgccggacaagctgaggtccgcgactcgtcgctaagattccccaaaactgagatttcaagaaaattcaccctttccgctttctttggcgcccttcaaccgtgaaggaaatgaagcctgactgccggaatcagagccgcgggtgagatccccagccctgtgagcctgtaggagtagaatggctccccaaatgtatgagttccatctgccattatccccagaggagttgttgaaaagtggaggggtgaatcagtatgttgtgcaagaggtactgtccatcaaacatcttccaccacagcttagagcttttcaggctgcctttcgagctcaggggcccctggctatgctgcagcactttgatactatctacagcattttgcatcactttcgaagtatagatcctggcctcaaagaagatactctggaattcctgataaaagtggtatcccgccactcccaggagcttccagctatcctggatgatacaactttgagtggatcagatagaaacgcccatctaaatgccctcaaaatgaactgttatgctctgatacgtctcctggaatcctttgagaccatggccagccagacaaaccttgtggacctggaccttggtgggaagggtaagaaagctcggaccaaggcagcccatggctttgactgggaagaagagaggcaaccaattcttcagcttttaacacagctacttcagttggacatccgtcacctgtggaaccactcaataattgaagaagaatttgtcagtttggttactggctgttgctaccgccttctggagaatcccaccattaatcaccagaagaaccgccccactcgggaagccataacacacctgcttggtgtagccttgacccgttataaccatatgctcagtgctacagtgaagatcatccagatgctgcagcactttgaacacctggcacctgtactggttgcagccgtgagtctatgggcaactgactatggaatgaagagcatagtgggagagattgtaagagagattggacaaaagtgtccccaagagctgagtcgagacccttcagggacaaagggctttgcagcattcctgacagaactagcagaacgtgtcccagctatcctgatgtccagcatgtgcattttgctagatcacctggatggagaaaattacatgatgcgtaatgctgtgctggcagccatggcggagatggtgctgcaggttctcagtggcgatcaactggaagcagcagcccgagacaccagagaccagttcttggatactttacaagcccatggccatgatgtcaactcctttgtgcggagccgtgttttgcagctcttcacccgaattgtccagcagaaggctctccccctgacacgtttccaggcagtggtggctttagctgtgggacgtctggcagacaagtcagtgctagtatgtaaaaatgccatccagctgctggccagttttctagccaataatcctttctcctgcaagcttagtgatgctgaccttgccggaccactgcagaaggagacccagaaattacaagagatgagggcccagaggcgaactgcagcagcttctgcagtgctggacccagaggaggagtgggaagccatgctgccagagttgaagtctaccctgcagcagcttctacagcttccccagggagaggaggagattcctgagcaaattgccaatacagagacaactgaagatgtgaaaggacgcatctatcaactgcttgccaaagctagttacaaaaaggccatcattctcactcgagaagccacaggccacttccaggagtccgaacccttcagtcatatagacccagaggagtcagaggagaccaggctcttgaatatcttaggacttatcttcaaaggcccagcagcttccacacaagaaaagaatccccgggagtctacaggaaacatggtcacaggacagactgtctgtaaaaataaacccaatatgtcggatcctgaggaatccaggggaaatgatgaactagtgaagcaggagatgctggtacagtatctgcaggatgcctacagcttctcccggaagattacagaggccattggcataatcagcaagatgatgtatgaaaacacaactacagtggtgcaggaggtgattgaattctttgtgatggtcttccaatttggggtaccccaggccctgtttggggtgcgccgtatgctgcctctcatctggtctaaggagcctggtgtccgggaagccgtgcttaatgcctaccgccaactctacctcaaccccaaaggggactctgccagagccaaggcccaggctttgattcagaatctctctctgctgctagtggatgcctcggttgggaccattcagtgtcttgaggaaattctctgtgagtttgtgcagaaggatgagttgaaaccagcagtgacccagctgctgtgggagcgggccaccgagaaggtcgcctgctgtcctctggagcgctgttcctctgtcatgcttcttggcatgatggcacgaggaaagccagaaattgtgggaagcaatttagacacactggtgagcatagggctggatgagaagtttccacaggactacaggctggcccagcaggtgtgccatgccattgccaacatctcggacaggagaaagccttctctgggcaaacgtcacccccccttccggctgcctcaggaacacaggttgtttgagcgactgcgggagacagtcacaaaaggctttgtccacccagacccactctggatcccattcaaagaggtggcagtgaccctcatttaccaactggcagagggccccgaagtgatctgtgcccagatattgcagggctgtgcaaaacaggccctggagaagctagaagagaagagaaccagtcaggaggacccgaaggagtcccccgcaatgctccccactttcctgttgatgaacctgctgtccctggctggggatgtggctctgcagcagctggtccacttggagcaggcagtgagtggagagctctgccggcgccgagttctccgggaagaacaggagcacaagaccaaagatcccaaggagaagaatacgagctctgagaccaccatggaggaggagctggggctggttggggcaacagcagatgacacagaggcagaactaatccgtggcatctgcgagatggaactgttggatggcaaacagacactggctgcctttgttccactcttgcttaaagtctgtaacaacccaggcctctatagcaacccagacctctctgcagctgcttcacttgcccttggcaagttctgcatgatcagtgccactttctgcgactcccagcttcgtcttctgttcaccatgctggaaaagtctccacttcccattgtccggtctaacctcatggttgccactggggatctggccatccgctttcccaatctggtggacccctggactcctcatctgtatgctcgcctccgggaccctgctcagcaagtgcggaaaacagcggggctggtgatgacccacctgatcctcaaggacatggtgaaggtgaaggggcaggtcagcgagatggcggtgctgctcatcgaccccgagcctcagattgctgccctggccaagaacttcttcaatgagctctcccacaagggcaacgcaatctataatctccttccagatatcatcagccgcctgtcagaccccgagctgggggtggaggaagagcctttccacaccatcatgaaacagctcctctcctacatcaccaaggacaagcagacagagagcctggtggaaaagctgtgtcagcggttccgcacatcccgaactgagcggcagcagcgagacctggcctactgtgtgtcacagctgcccctcacagagcgaggcctccgtaagatgcttgacaattttgactgttttggagacaaactgtcagatgagtccatcttcagtgcttttttgtcagttgtgggcaagctgcgacgtggggccaagcctgagggcaaggctataatagatgaatttgagcagaagcttcgggcctgtcataccagaggtttggatggaatcaaggagcttgagattggccaagcaggtagccagagagcgccatcagccaagaaaccatccactggttctaggtaccagcctctggcttctacagcctcagacaatgactttgtcacaccagagccccgccgtactacccgtcggcatccaaacacccagcagcgagcttccaaaaagaaacccaaagttgtcttctcaagtgatgagtccagtgaggaagatctttcagcagagatgacagaagacgagacacccaagaaaacaactcccattctcagagcatcggctcgcaggcacagatcctaggaagtctgttcctgtcctccctgtgcagggtatcctgtagggtgacctggaattcgaattctgtttcccttgtaaaatatttgtctgtctctttttttaaaaaaaaaaaaaggccgggcactgtggctcacgcctgtaatcccagcactttgcgataccaaggcgggtggataacctgaggtagggagttcgagaccagcctgaccaacatggagaaaccccatctctactaaaaataaaaaattagccgggcgtattggcgtgcgcctgtaatcccagctactcaagaggctgaggcaggagaatcgcctgaacccagaggcggaggttgtagtgagccgaaatcacaccattgcactccagcttgggcaacaatagcgaacctccatctcaaattaaaaaaaaaatgcctacacgctctttaaaatgcaaggctttctcttaaattagcctaactgaactgcgttgagctgcttcaactttggaatatatgtttgccaatctccttgttttctaatgaataaatgtttttatatactttta

SEQ ID NO: 365169 - DNA, 5469 bp, Homo sapiens
aagttttggagcgccggacaagctgaggtccgcgactcgtcgctaagattccccaaaactgagatttcaagaaaattcaccctttccgctttctttggcgcccttcaaccgtgaaggaaatgaaggttgagaacctggaacccgcttccaaagaccaagccctttctctgtgcctcacaacagtcttgcgctgtagctgtttttattacccctattttactactggggaggagatttgaggtcctgaaagtgaagtgacttgctggacgtcacttagcagaggagatggcgaaacctggattagaggcgatgccttctaactcccagcgtggacttgcctcctttcctgggggtgactgaatgcccagccagggacgcgacgtctctggccagcagaaatacggcctcctccccgccgactgggcaaagggggaccttgcggccaaggagggattcgcaggcgggccgggggtgggagcgggggccggagccggagccttggcccgcccccgggcggcgctgtgattggccggccgctccggcgggcgtcgcgattggccgtcctgcagccgttgagatttgaactcggtatttgtggctttgcccgcgcgttgccagactcagaggcggccctttgcctctgcctgccggggattggccggattctccgccgacttgaaaactgccttgctaattgccctgtgagcctgtaggagtagaatggctccccaaatgtatgagttccatctgccattatccccagaggagttgttgaaaagtggaggggtgaatcagtatgttgtgcaagaggtactgtccatcaaacatcttccaccacagcttagagcttttcaggctgcctttcgagctcaggggcccctggctatgctgcagcactttgatactatctacagcattttgcatcactttcgaagtatagatcctggcctcaaagaagatactctggaattcctgataaaagtggtatcccgccactcccaggagcttccagctatcctggatgatacaactttgagtggatcagatagaaacgcccatctaaatgccctcaaaatgaactgttatgctctgatacgtctcctggaatcctttgagaccatggccagccagacaaaccttgtggacctggaccttggtgggaagggtaagaaagctcggaccaaggcagcccatggctttgactgggaagaagagaggcaaccaattcttcagcttttaacacagctacttcagttggacatccgtcacctgtggaaccactcaataattgaagaagaatttgtcagtttggttactggctgttgctaccgccttctggagaatcccaccattaatcaccagaagaaccgccccactcgggaagccataacacacctgcttggtgtagccttgacccgttataaccatatgctcagtgctacagtgaagatcatccagatgctgcagcactttgaacacctggcacctgtactggttgcagccgtgagtctatgggcaactgactatggaatgaagagcatagtgggagagattgtaagagagattggacaaaagtgtccccaagagctgagtcgagacccttcagggacaaagggctttgcagcattcctgacagaactagcagaacgtgtcccagctatcctgatgtccagcatgtgcattttgctagatcacctggatggagaaaattacatgatgcgtaatgctgtgctggcagccatggcggagatggtgctgcaggttctcagtggcgatcaactggaagcagcagcccgagacaccagagaccagttcttggatactttacaagcccatggccatgatgtcaactcctttgtgcggagccgtgttttgcagctcttcacccgaattgtccagcagaaggctctccccctgacacgtttccaggcagtggtggctttagctgtgggacgtctggcagacaagtcagtgctagtatgtaaaaatgccatccagctgctggccagttttctagccaataatcctttctcctgcaagcttagtgatgctgaccttgccggaccactgcagaaggagacccagaaattacaagagatgagggcccagaggcgaactgcagcagcttctgcagtgctggacccagaggaggagtgggaagccatgctgccagagttgaagtctaccctgcagcagcttctacagcttccccagggagaggaggagattcctgagcaaattgccaatacagagacaactgaagatgtgaaaggacgcatctatcaactgcttgccaaagctagttacaaaaaggccatcattctcactcgagaagccacaggccacttccaggagtccgaacccttcagtcatatagacccagaggagtcagaggagaccaggctcttgaatatcttaggacttatcttcaaaggcccagcagcttccacacaagaaaagaatccccgggagtctacaggaaacatggtcacaggacagactgtctgtaaaaataaacccaatatgtcggatcctgaggaatccaggggaaatgatgaactagtgaagcaggagatgctggtacagtatctgcaggatgcctacagcttctcccggaagattacagaggccattggcataatcagcaagatgatgtatgaaaacacaactacagtggtgcaggaggtgattgaattctttgtgatggtcttccaatttggggtaccccaggccctgtttggggtgcgccgtatgctgcctctcatctggtctaaggagcctggtgtccgggaagccgtgcttaatgcctaccgccaactctacctcaaccccaaaggggactctgccagagccaaggcccaggctttgattcagaatctctctctgctgctagtggatgcctcggttgggaccattcagtgtcttgaggaaattctctgtgagtttgtgcagaaggatgagttgaaaccagcagtgacccagctgctgtgggagcgggccaccgagaaggtcgcctgctgtcctctggagcgctgttcctctgtcatgcttcttggcatgatggcacgaggaaagccagaaattgtgggaagcaatttagacacactggtgagcatagggctggatgagaagtttccacaggactacaggctggcccagcaggtgtgccatgccattgccaacatctcggacaggagaaagccttctctgggcaaacgtcacccccccttccggctgcctcaggaacacaggttgtttgagcgactgcgggagacagtcacaaaaggctttgtccacccagacccactctggatcccattcaaagaggtggcagtgaccctcatttaccaactggcagagggccccgaagtgatctgtgcccagatattgcagggctgtgcaaaacaggccctggagaagctagaagagaagagaaccagtcaggaggacccgaaggagtcccccgcaatgctccccactttcctgttgatgaacctgctgtccctggctggggatgtggctctgcagcagctggtccacttggagcaggcagtgagtggagagctctgccggcgccgagttctccgggaagaacaggagcacaagaccaaagatcccaaggagaagaatacgagctctgagaccaccatggaggaggagctggggctggttggggcaacagcagatgacacagaggcagaactaatccgtggcatctgcgagatggaactgttggatggcaaacagacactggctgcctttgttccactcttgcttaaagtctgtaacaacccaggcctctatagcaacccagacctctctgcagctgcttcacttgcccttggcaagttctgcatgatcagtgccactttctgcgactcccagcttcgtcttctgttcaccatgctggaaaagtctccacttcccattgtccggtctaacctcatggttgccactggggatctggccatccgctttcccaatctggtggacccctggactcctcatctgtatgctcgcctccgggaccctgctcagcaagtgcggaaaacagcggggctggtgatgacccacctgatcctcaaggacatggtgaaggtgaaggggcaggtcagcgagatggcggtgctgctcatcgaccccgagcctcagattgctgccctggccaagaacttcttcaatgagctctcccacaagggcaacgcaatctataatctccttccagatatcatcagccgcctgtcagaccccgagctgggggtggaggaagagcctttccacaccatcatgaaacagctcctctcctacatcaccaaggacaagcagacagagagcctggtggaaaagctgtgtcagcggttccgcacatcccgaactgagcggcagcagcgagacctggcctactgtgtgtcacagctgcccctcacagagcgaggcctccgtaagatgcttgacaattttgactgttttggagacaaactgtcagatgagtccatcttcagtgcttttttgtcagttgtgggcaagctgcgacgtggggccaagcctgagggcaaggctataatagatgaatttgagcagaagcttcgggcctgtcataccagaggtttggatggaatcaaggagcttgagattggccaagcaggtagccagagagcgccatcagccaagaaaccatccactggttctaggtaccagcctctggcttctacagcctcagacaatgactttgtcacaccagagccccgccgtactacccgtcggcatccaaacacccagcagcgagcttccaaaaagaaacccaaagttgtcttctcaagtgatgagtccagtgaggaagatctttcagcagagatgacagaagacgagacacccaagaaaacaactcccattctcagagcatcggctcgcaggcacagatcctaggaagtctgttcctgtcctccctgtgcagggtatcctgtagggtgacctggaattcgaattctgtttcccttgtaaaatatttgtctgtctctttttttaaaaaaaaaaaaaggccgggcactgtggctcacgcctgtaatcccagcactttgcgataccaaggcgggtggataacctgaggtagggagttcgagaccagcctgaccaacatggagaaaccccatctctactaaaaataaaaaattagccgggcgtattggcgtgcgcctgtaatcccagctactcaagaggctgaggcaggagaatcgcctgaacccagaggcggaggttgtagtgagccgaaatcacaccattgcactccagcttgggcaacaatagcgaacctccatctcaaattaaaaaaaaaatgcctacacgctctttaaaatgcaaggctttctcttaaattagcctaactgaactgcgttgagctgcttcaactttggaatatatgtttgccaatctccttgttttctaatgaataaatgtttttatatactttta

SEQ ID NO: 365170 - DNA, 5258 bp, Homo sapiens
aagttttggagcgccggacaagctgaggtccgcgactcgtcgctaagattccccaaaactgagatttcaagaaaattcaccctttccgctttctttggcgcccttcaaccgtgaaggaaatgaaggttgagaacctggaacccgcttccaaagaccaagccctttctctgtgcctcacaacagtcttgcgctgtagctgtttttattacccctattttactactggggaggagatttgaggtcctgaaagtgaagtgacttgctggacgtcacttagcagaggagatggcgaaacctggattagaggcgatgccttctaactcccagcgtggacttgcctcctttcctgggggtgactgaatgcccagccagggacgcgacgtctctggccagcagaaatacggcctcctccccgccgactgggcaaagggggaccttgcggccaaggagggattcgcaggcgggccgggggtgggagcgggggccggagccggagccttggcccgcccccgggcggcgctgtgattggccggccgctccggcgggcgtcgcgattggccgtcctgcagccgttgagatttgaactcggtatttgtggctttgcccgcgcgttgccagactcagaggcggccctttgcctctgcctgccggggattggccggattctccgccgacttgaaaactgccttgctaattggtgcgtgttgtgcacgcgtgttttttccttttcatttcagcctgactgccggaatcagagccgcgggtgagatccccagccctgtgagcctgtaggagtagaatggctccccaaatgtatgagttccatctgccattatccccagaggagttgttgaaaagtggaggggtgaatcagtatgttgtgcaagaggtactgtccatcaaacatcttccaccacagcttagagcttttcaggctgcctttcgagctcaggggcccctggctatgctgcagcactttgatactatctacagcattttgcatcactttcgaagtatagatcctggcctcaaagaagatactctggaattcctgataaaagtggtatcccgccactcccaggagcttccagctatcctggatgatacaactttgagtggatcagatagaaacgcccatctaaatgccctcaaaatgaactgttatgctctgatacgtctcctggaatcctttgagaccatggccagccagacaaaccttgtggacctggaccttggtgggaagggtaagaaagctcggaccaaggcagcccatggctttgactgggaagaagagaggcaaccaattcttcagcttttaacacagctacttcagttggacatccgtcacctgtggaaccactcaataattgaagaagaatttgtcagtttggttactggctgttgctaccgccttctggagaatcccaccattaatcaccagaagaaccgccccactcgggaagccataacacacctgcttggtgtagccttgacccgttataaccatatgctcagtgctacagtgaagatcatccagatgctgcagcactttgaacacctggcacctgtactggttgcagccgtgagtctatgggcaactgactatggaatgaagagcatagtgggagagattgtaagagagattggacaaaagtgtccccaagagctgagtcgagacccttcagggacaaagggctttgcagcattcctgacagaactagcagaacgtgtcccagctatcctgatgtccagcatgtgcattttgctagatcacctggatggagaaaattacatgatgcgtaatgctgtgctggcagccatggcggagatggtgctgcaggttctcagtggcgatcaactggaagcagcagcccgagacaccagagaccagttcttggatactttacaagcccatggccatgatgtcaactcctttgtgcggagccgtgttttgcagctcttcacccgaattgtccagcagaaggctctccccctgacacgtttccaggcagtggtggctttagctgtgggacgtctggcagacaagtcagtgctagtatgtaaaaatgccatccagctgctggccagttttctagccaataatcctttctcctgcaagcttagtgatgctgaccttgccggaccactgcagaaggagacccagaaattacaagagatgagggcccagaggcgaactgcagcagcttctgcagtgctggacccagaggaggagtgggaagccatgctgccagagttgaagtctaccctgcagcagcttctacagcttccccagggagaggaggagattcctgagcaaattgccaatacagagacaactgaagatgtgaaaggacgcatctatcaactgcttgccaaagctagttacaaaaaggccatcattctcactcgagaagccacaggccacttccaggagtccgaacccttcagtcatatagacccagaggagtcagaggagaccaggctcttgaatatcttaggacttatcttcaaaggcccagcagcttccacacaagaaaagaatccccgggagtctacaggaaacatggtcacaggacagactgtctgtaaaaataaacccaatatgtcggatcctgaggaatccaggggaaatgatgaactagtgaagcaggagatgctggtacagtatctgcaggatgcctacagcttctcccggaagattacagaggccattggcataatcagcaagatgatgtatgaaaacacaactacagtggtgcaggaggtgattgaattctttgtgatggtcttccaatttggggtaccccaggccctgtttggggtgcgccgtatgctgcctctcatctggtctaaggagcctggtgtccgggaagccgtgcttaatgcctaccgccaactctacctcaaccccaaaggggactctgccagagccaaggcccaggctttgattcagaatctctctctgctgctagtggatgcctcggttgggaccattcagtgtcttgaggaaattctctgtgagtttgtgcagaaggatgagttgaaaccagcagtgacccagctgctgtgggagcgggccaccgagaaggtcgcctgctgtcctctggagcgctgttcctctgtcatgcttcttggcatgatggcacgaggaaagccagaaattgtgggaagcaatttagacacactggtgagcatagggctggatgagaagtttccacaggactacaggctggcccagcaggtgtgccatgccattgccaacatctcggacaggagaaagccttctctgggcaaacgtcacccccccttccggctgcctcaggaacacaggttgtttgagcgactgcgggagacagtcacaaaaggctttgtccacccagacccactctggatcccattcaaagaggtggcagtgaccctcatttaccaactggcagagggccccgaagtgatctgtgcccagatattgcagggctgtgcaaaacaggccctggagaagctagaagagaagagaaccagtcaggaggacccgaaggagtcccccgcaatgctccccactttcctgttgatgaacctgctgtccctggctggggatgtggctctgcagcagctggtccacttggagcaggcagtgagtggagagctctgccggcgccgagttctccgggaagaacaggagcacaagaccaaagatcccaaggagaagaatacgagctctgagaccaccatggaggaggagctggggctggttggggcaacagcagatgacacagaggcagaactaatccgtggcatctgcgagatggaactgttggatggcaaacagacactggctgcctttgttccactcttgcttaaagtctgtaacaacccaggcctctatagcaacccagacctctctgcagctgcttcacttgcccttggcaagttctgcatgatcagtgccactttctgcgactcccagcttcgtcttctgttcaccatgctggaaaagtctccacttcccattgtccggtctaacctcatggttgccactggggatctggccatccgctttcccaatctggtggacccctggactcctcatctgtatgctcgcctccgggaccctgctcagcaagtgcggaaaacagcggggctggtgatgacccacctgatcctcaaggacatggtgaaggtgaaggggcaggtcagcgagatggcggtgctgctcatcgaccccgagcctcagattgctgccctggccaagaacttcttcaatgagctctcccacaagggcaacgcaatctataatctccttccagatatcatcagccgcctgtcagaccccgagctgggggtggaggaagagcctttccacaccatcatgaaacagctcctctcctacatcaccaaggacaagcagacagagagcctggtggaaaagctgtgtcagcggttccgcacatcccgaactgagcggcagcagcgagacctggcctactgtgtgtcacagctgcccctcacagagcgaggcctccgtaagatgcttgacaattttgactgttttggagacaaactgtcagatgagtccatcttcagtgcttttttgtcagttgtgggcaagctgcgacgtggggccaagcctgagggcaaggctataatagatgaatttgagcagaagcttcgggcctgtcataccagaggtttggatggaatcaaggagcttgagattggccaagcaggtagccagagagcgccatcagccaagaaaccatccactggttctaggtaccagcctctggcttctacagcctcagacaatgactttgtcacaccagagccccgccgtactacccgtcggcatccaaacacccagcagcgagcttccaaaaagaaacccaaagttgtcttctcaagtgatgagtccagtgaggaagatctttcagcagagatgacagaagacgagacacccaagaaaacaactcccattctcagagcatcggctcgcaggcacagatcctaggaagtctgttcctgtcctccctgtgcagggtatcctgtagggtgacctggaattcgaattctgtttcccttgtaaaatatttgtctgtctctttttttaaaaaaaaaaaaaggccgggcactgtggctcacgcctgtaatcccagcactttgcgataccaaggcgggtggataacctgaggtagggagttcgagaccagctattaccctgaacactgtctggggtatacaaattgtttaaagtataaagtagg

SEQ ID NO: 365171 - DNA, 5492 bp, Homo sapiens
aagttttggagcgccggacaagctgaggtccgcgactcgtcgctaagattccccaaaactgagatttcaagaaaattcaccctttccgctttctttggcgcccttcaaccgtgaaggaaatgaaggttgagaacctggaacccgcttccaaagaccaagccctttctctgtgcctcacaacagtcttgcgctgtagctgtttttattacccctattttactactggggaggagatttgaggtcctgaaagtgaagtgacttgctggacgtcacttagcagaggagatggcgaaacctggattagaggcgatgccttctaactcccagcgtggacttgcctcctttcctgggggtgactgaatgcccagccagggacgcgacgtctctggccagcagaaatacggcctcctccccgccgactgggcaaagggggaccttgcggccaaggagggattcgcaggcgggccgggggtgggagcgggggccggagccggagccttggcccgcccccgggcggcgctgtgattggccggccgctccggcgggcgtcgcgattggccgtcctgcagccgttgagatttgaactcggtatttgtggctttgcccgcgcgttgccagactcagaggcggccctttgcctctgcctgccggggattggccggattctccgccgacttgaaaactgccttgctaattggtgcgtgttgtgcacgcgtgttttttccttttcatttcagcctgactgccggaatcagagccgcgggtgagatccccagccctgtgagcctgtaggagtagaatggctccccaaatgtatgagttccatctgccattatccccagaggagttgttgaaaagtggaggggtgaatcagtatgttgtgcaagaggtactgtccatcaaacatcttccaccacagcttagagcttttcaggctgcctttcgagctcaggggcccctggctatgctgcagcactttgatactatctacagcattttgcatcactttcgaagtatagatcctggcctcaaagaagatactctggaattcctgataaaagtggtatcccgccactcccaggagcttccagctatcctggatgatacaactttgagtggatcagatagaaacgcccatctaaatgccctcaaaatgaactgttatgctctgatacgtctcctggaatcctttgagaccatggccagccagacaaaccttgtggacctggaccttggtgggaagggtaagaaagctcggaccaaggcagcccatggctttgactgggaagaagagaggcaaccaattcttcagcttttaacacagctacttcagttggacatccgtcacctgtggaaccactcaataattgaagaagaatttgtcagtttggttactggctgttgctaccgccttctggagaatcccaccattaatcaccagaagaaccgccccactcgggaagccataacacacctgcttggtgtagccttgacccgttataaccatatgctcagtgctacagtgaagatcatccagatgctgcagcactttgaacacctggcacctgtactggttgcagccgtgagtctatgggcaactgactatggaatgaagagcatagtgggagagattgtaagagagattggacaaaagtgtccccaagagctgagtcgagacccttcagggacaaagggctttgcagcattcctgacagaactagcagaacgtgtcccagctatcctgatgtccagcatgtgcattttgctagatcacctggatggagaaaattacatgatgcgtaatgctgtgctggcagccatggcggagatggtgctgcaggttctcagtggcgatcaactggaagcagcagcccgagacaccagagaccagttcttggatactttacaagcccatggccatgatgtcaactcctttgtgcggagccgtgttttgcagctcttcacccgaattgtccagcagaaggctctccccctgacacgtttccaggcagtggtggctttagctgtgggacgtctggcagacaagtcagtgctagtatgtaaaaatgccatccagctgctggccagttttctagccaataatcctttctcctgcaagcttagtgatgctgaccttgccggaccactgcagaaggagacccagaaattacaagagatgagggcccagaggcgaactgcagcagcttctgcagtgctggacccagaggaggagtgggaagccatgctgccagagttgaagtctaccctgcagcagcttctacagcttccccagggagaggaggagattcctgagcaaattgccaatacagagacaactgaagatgtgaaaggacgcatctatcaactgcttgccaaagctagttacaaaaaggccatcattctcactcgagaagccacaggccacttccaggagtccgaacccttcagtcatatagacccagaggagtcagaggagaccaggctcttgaatatcttaggacttatcttcaaaggcccagcagcttccacacaagaaaagaatccccgggagtctacaggaaacatggtcacaggacagactgtctgtaaaaataaacccaatatgtcggatcctgaggaatccaggggaaatgatgaactagtgaagcaggagatgctggtacagtatctgcaggatgcctacagcttctcccggaagattacagaggccattggcataatcagcaagatgatgtatgaaaacacaactacaggccctgtttggggtgcgccgtatgctgcctctcatctggtctaaggagcctggtgtccgggaagccgtgcttaatgcctaccgccaactctacctcaaccccaaaggggactctgccagagccaaggcccaggctttgattcagaatctctctctgctgctagtggatgcctcggttgggaccattcagtgtcttgaggaaattctctgtgagtttgtgcagaaggatgagttgaaaccagcagtgacccagctgctgtgggagcgggccaccgagaaggtcgcctgctgtcctctggagcgctgttcctctgtcatgcttcttggcatgatggcacgaggaaagccagaaattgtgggaagcaatttagacacactggtgagcatagggctggatgagaagtttccacaggactacaggctggcccagcaggtgtgccatgccattgccaacatctcggacaggagaaagccttctctgggcaaacgtcacccccccttccggctgcctcaggaacacaggttgtttgagcgactgcgggagacagtcacaaaaggctttgtccacccagacccactctggatcccattcaaagaggtggcagtgaccctcatttaccaactggcagagggccccgaagtgatctgtgcccagatattgcagggctgtgcaaaacaggccctggagaagctagaagagaagagaaccagtcaggaggacccgaaggagtcccccgcaatgctccccactttcctgttgatgaacctgctgtccctggctggggatgtggctctgcagcagctggtccacttggagcaggcagtgagtggagagctctgccggcgccgagttctccgggaagaacaggagcacaagaccaaagatcccaaggagaagaatacgagctctgagaccaccatggaggaggagctggggctggttggggcaacagcagatgacacagaggcagaactaatccgtggcatctgcgagatggaactgttggatggcaaacagacactggctgcctttgttccactcttgcttaaagtctgtaacaacccaggcctctatagcaacccagacctctctgcagctgcttcacttgcccttggcaagttctgcatgatcagtgccactttctgcgactcccagcttcgtcttctgttcaccatgctggaaaagtctccacttcccattgtccggtctaacctcatggttgccactggggatctggccatccgctttcccaatctggtggacccctggactcctcatctgtatgctcgcctccgggaccctgctcagcaagtgcggaaaacagcggggctggtgatgacccacctgatcctcaaggacatggtgaaggtgaaggggcaggtcagcgagatggcggtgctgctcatcgaccccgagcctcagattgctgccctggccaagaacttcttcaatgagctctcccacaagggcaacgcaatctataatctccttccagatatcatcagccgcctgtcagaccccgagctgggggtggaggaagagcctttccacaccatcatgaaacagctcctctcctacatcaccaaggacaagcagacagagagcctggtggaaaagctgtgtcagcggttccgcacatcccgaactgagcggcagcagcgagacctggcctactgtgtgtcacagctgcccctcacagagcgaggcctccgtaagatgcttgacaattttgactgttttggagacaaactgtcagatgagtccatcttcagtgcttttttgtcagttgtgggcaagctgcgacgtggggccaagcctgagggcaaggctataatagatgaatttgagcagaagcttcgggcctgtcataccagaggtttggatggaatcaaggagcttgagattggccaagcaggtagccagagagcgccatcagccaagaaaccatccactggttctaggtaccagcctctggcttctacagcctcagacaatgactttgtcacaccagagccccgccgtactacccgtcggcatccaaacacccagcagcgagcttccaaaaagaaacccaaagttgtcttctcaagtgatgagtccagtgaggaagatctttcagcagagatgacagaagacgagacacccaagaaaacaactcccattctcagagcatcggctcgcaggcacagatcctaggaagtctgttcctgtcctccctgtgcagggtatcctgtagggtgacctggaattcgaattctgtttcccttgtaaaatatttgtctgtctctttttttaaaaaaaaaaaaaggccgggcactgtggctcacgcctgtaatcccagcactttgcgataccaaggcgggtggataacctgaggtagggagttcgagaccagcctgaccaacatggagaaaccccatctctactaaaaataaaaaattagccgggcgtattggcgtgcgcctgtaatcccagctactcaagaggctgaggcaggagaatcgcctgaacccagaggcggaggttgtagtgagccgaaatcacaccattgcactccagcttgggcaacaatagcgaacctccatctcaaattaaaaaaaaaatgcctacacgctctttaaaatgcaaggctttctcttaaattagcctaactgaactgcgttgagctgcttcaactttggaatatatgtttgccaatctccttgttttctaatgaataaatgtttttatatactttta

SEQ ID NO: 365172 - DNA, 5651 bp, Homo sapiens
aagttttggagcgccggacaagctgaggtccgcgactcgtcgctaagattccccaaaactgagatttcaagaaaattcaccctttccgctttctttggcgcccttcaaccgtgaaggaaatgaaggttgagaacctggaacccgcttccaaagaccaagccctttctctgtgcctcacaacagtcttgcgctgtagctgtttttattacccctattttactactggggaggagatttgaggtcctgaaagtgaagtgacttgctggacgtcacttagcagaggagatggcgaaacctggattagaggcgatgccttctaactcccagcgtggacttgcctcctttcctgggggtgactgaatgcccagccagggacgcgacgtctctggccagcagaaatacggcctcctccccgccgactgggcaaagggggaccttgcggccaaggagggattcgcaggcgggccgggggtgggagcgggggccggagccggagccttggcccgcccccgggcggcgctgtgattggccggccgctccggcgggcgtcgcgattggccgtcctgcagccgttgagatttgaactcggtatttgtggctttgcccgcgcgttgccagactcagaggcggccctttgcctctgcctgccggggattggccggattctccgccgacttgaaaactgccttgctaattggtgcgtgttgtgcacgcgtgttttttccttttcatttcagcctgactgccggaatcagagccgcgggtgagatccccagccctgtgagcctgtaggagtagaatggctccccaaatgtatgagttccatctgccattatccccagaggagttgttgaaaagtggaggggtgaatcagtatgttgtgcaagaggtactgtccatcaaacatcttccaccacagcttagagcttttcaggctgcctttcgagctcaggggcccctggctatgctgcagcactttgatactatctacagcattttgcatcactttcgaagtatagatcctggcctcaaagaagatactctggaattcctgataaaagtggtatcccgccactcccaggagcttccagctatcctggatgatacaactttgagtggatcagatagaaacgcccatctaaatgccctcaaaatgaactgttatgctctgatacgtctcctggaatcctttgagaccatggccagccagacaaaccttgtggacctggaccttggtgggaagggtaagaaagctcggaccaaggcagcccatggctttgactgggaagaagagaggcaaccaattcttcagcttttaacacagctacttcagttggacatccgtcacctgtggaaccactcaataattgaagaagaatttgtcagtttggttactggctgttgctaccgccttctggagaatcccaccattaatcaccagaagaaccgccccactcgggaagccataacacacctgcttggtgtagccttgacccgttataaccatatgctcagtgctacagtgaagatcatccagatgctgcagcactttgaacacctggcacctgtactggttgcagccgtgagtctatgggcaactgactatggaatgaagagcatagtgggagagattgtaagagagattggacaaaagtgtccccaagagctgagtcgagacccttcagggacaaagggctttgcagcattcctgacagaactagcagaacgtgtcccagctatcctgatgtccagcatgtgcattttgctagatcacctggatggagaaaattacatgatgcgtaatgctgtgctggcagccatggcggagatggtgctgcaggttctcagtggcgatcaactggaagcagcagcccgagacaccagagaccagttcttggatactttacaagcccatggccatgatgtcaactcctttgtgcggagccgtgttttgcagctcttcacccgaattgtccagcagaaggctctccccctgacacgtttccaggcagtggtggctttagctgtgggacgtctggcagacaagtcagtgctagtatgtaaaaatgccatccagctgctggccagttttctagccaataatcctttctcctgcaagcttagtgatgctgaccttgccggaccactgcagaaggagacccagaaattacaagagatgagggcccagaggcgaactgcagcagcttctgcagtgctggacccagaggaggagtgggaagccatgctgccagagttgaagtctaccctgcagcagcttctacagcttccccagggagaggaggagattcctgagcaaattgccaatacagagacaactgaagatgtgaaaggacgcatctatcaactgcttgccaaagctagttacaaaaaggccatcattctcactcgagaagccacaggccacttccaggagtccgaacccttcagtcatatagacccagaggagtcagaggagaccaggctcttgaatatcttaggacttatcttcaaaggcccagcagcttccacacaagaaaagaatccccgggagtctacaggaaacatggtcacaggacagactgtctgtaaaaataaacccaatatgtcggatcctgaggaatccaggggaaatgatgaactagtgaagcaggagatgctggtacagtatctgcaggatgcctacagcttctcccggaagattacagaggccattggcataatcagcaagatgatgtatgaaaacacaactacagtggtgcaggaggtgattgaattctttgtgatggtcttccaatttggggtaccccaggccctgtttggggtgcgccgtatgctgcctctcatctggtctaaggagcctggtgtccgggaagccgtgcttaatgcctaccgccaactctacctcaaccccaaaggggactctgccagagccaaggcccaggctttgattcagaatctctctctgctgctagtggatgcctcggttgggaccattcagtgtcttgaggaaattctctgtgagtttgtgcagaaggatgagttgaaaccagcagtgacccagctgctgtgggagcgggccaccgagaaggtcgcctgctgtcctctggagcgctgttcctctgtcatgcttcttggcatgatggcacgaggaaagccagaaattgtgggaagcaatttagacacactggtgagcatagggctggatgagaagtttccacaggactacaggctggcccagcaggtgtgccatgccattgccaacatctcggacaggagaaagccttctctgggcaaacgtcacccccccttccggctgcctcaggaacacaggttgtttgagcgactgcgggagacagtcacaaaaggctttgtccacccagacccactctggatcccattcaaagaggtggcagtgaccctcatttaccaactggcagagggccccgaagtgatctgtgcccagatattgcagggctgtgcaaaacaggccctggagaagctagaagagaagagaaccagtcaggaggacccgaaggagtcccccgcaatgctccccactttcctgttgatgaacctgctgtccctggctggggatgtggctctgcagcagctggtccacttggagcaggcagtgagtggagagctctgccggcgccgagttctccgggaagaacaggagcacaagaccaaagatcccaaggagaagaatacgagctctgagaccaccatggaggaggagctggggctggttggggcaacagcagatgacacagaggcagaactaatccgtggcatctgcgagatggaactgttggatggcaaacagacactggctgcctttgttccactcttgcttaaagtctgtaacaacccaggcctctatagcaacccagacctctctgcagctgcttcacttgcccttggcaagttctgcatgatcagtgccactttctgcgactcccagcttcgtcttctgttcaccatgctggaaaagtctccacttcccattgtccggtctaacctcatggttgccactggggatctggccatccgctttcccaatctggtggacccctggactcctcatctgtatgctcgcctccgggaccctgctcagcaagtgcggaaaacagcggggctggtgatgacccacctgatcctcaaggacatggtgaaggtgaaggggcaggtcagcgagatggcggtgctgctcatcgaccccgagcctcagattgctgccctggccaagaacttcttcaatgagctctcccacaagggcaacgcaatctataatctccttccagatatcatcagccgcctgtcagaccccgagctgggggtggaggaagagcctttccacaccatcatgaaacagctcctctcctacatcaccaaggacaagcagacagagagcctggtggaaaagctgtgtcagcggttccgcacatcccgaactgagcggcagcagcgagacctggcctactgtgtgtcacagctgcccctcacagagcgaggcctccgtaagatgcttgacaattttgactgttttggagacaaactgtcagatgagtccatcttcagtgcttttttgtcagttgtgggcaagctgcgacgtggggccaagcctgagggcaaggctataatagatgaatttgagcagaagcttcgggcctgtcataccagaggtttggatggaatcaaggagcttgagattggccaagcaggtagccagagagcgccatcagccaagaaaccatccactggtacgtaaggcagcctgtgcgggcgagaccagactgggccctcccctcctgcagtgatttgtttcttcttcttttttaaatcacgttttcctgccttttctaggttctaggtaccagcctctggcttctacagcctcagacaatgactttgtcacaccagagccccgccgtactacccgtcggcatccaaacacccagcagcgagcttccaaaaagaaacccaaagttgtcttctcaagtgatgagtccagtgaggaagatctttcagcagagatgacagaagacgagacacccaagaaaacaactcccattctcagagcatcggctcgcaggcacagatcctaggaagtctgttcctgtcctccctgtgcagggtatcctgtagggtgacctggaattcgaattctgtttcccttgtaaaatatttgtctgtctctttttttaaaaaaaaaaaaaggccgggcactgtggctcacgcctgtaatcccagcactttgcgataccaaggcgggtggataacctgaggtagggagttcgagaccagcctgaccaacatggagaaaccccatctctactaaaaataaaaaattagccgggcgtattggcgtgcgcctgtaatcccagctactcaagaggctgaggcaggagaatcgcctgaacccagaggcggaggttgtagtgagccgaaatcacaccattgcactccagcttgggcaacaatagcgaacctccatctcaaattaaaaaaaaaatgcctacacgctctttaaaatgcaaggctttctcttaaattagcctaactgaactgcgttgagctgcttcaactttggaatatatgtttgccaatctccttgttttctaatgaataaatgtttttatatactttta

SEQ ID NO: 365173 - DNA, 4184 bp, Homo sapiens
aagttttggagcgccggacaagctgaggtccgcgactcgtcgctaagattccccaaaactgagatttcaagaaaattcaccctttccgctttctttggcgcccttcaaccgtgaaggaaatgaaggttgagaacctggaacccgcttccaaagaccaagccctttctctgtgcctcacaacagtcttgcgctgtagctgtttttattacccctattttactactggggaggagatttgaggtcctgaaagtgaagtgacttgctggacgtcacttagcagaggagatggcgaaacctggattagaggcgatgccttctaactcccagcgtggacttgcctcctttcctgggggtgactgaatgcccagccagggacgcgacgtctctggccagcagaaatacggcctcctccccgccgactgggcaaagggggaccttgcggccaaggagggattcgcaggcgggccgggggtgggagcgggggccggagccggagccttggcccgcccccgggcggcgctgtgattggccggccgctccggcgggcgtcgcgattggccgtcctgcagccgttgagatttgaactcggtatttgtggctttgcccgcgcgttgccagactcagaggcggccctttgcctctgcctgccggggattggccggattctccgccgacttgaaaactgccttgctaattggtgcgtgttgtgcacgcgtgttttttccttttcatttcagcctgactgccggaatcagagccgcgggtgagatccccagccctgtgagcctgtaggagtagaatggctccccaaatgtatgagttccatctgccattatccccagaggagttgttgaaaagtggaggggtgaatcagtatgttgtgcaagaggtactgtccatcaaacatcttccaccacagcttagagcttttcaggctgcctttcgagctcaggggcccctggctatgctgcagcactttgatactatctacagcattttgcatcactttcgaagtatagatcctggcctcaaagaagatactctggaattcctgataaaagtggtatcccgccactcccaggagcttccagctatcctggatgatacaactttgagtggatcagatagaaacgcccatctaaatgccctcaaaatgaactgttatgctctgatacgtctcctggaatcctttgagaccatggccagccagacaaaccttgtggacctggaccttggtgggaagggtaagaaagctcggaccaaggcagcccatggctttgactgggaagaagagaggcaaccaattcttcagcttttaacacagctacttcagttggacatccgtcacctgtggaaccactcaataattgaagaagaatttgtcagtttggttactggctgttgctaccgccttctggagaatcccaccattaatcaccagaagaaccgccccactcgggaagccataacacacctgcttggtgtagccttgacccgttataaccatatgctcagtgctacagtgaagatcatccagatgctgcagcactttgaacacctggcacctgtactggttgcagccgtgagtctatgggcaactgactatggaatgaagagcatagtgggagagattgtaagagagattggacaaaagtgtccccaagagctgagtcgagacccttcagggacaaagggctttgcagcattcctgacagaactagcagaacgtgtcccagctatcctgatgtccagcatgtgcattttgctagatcacctggatggagaaaattacatgatgcgtaatgctgtgctggcagccatggcggagatggtgctgcaggttctcagtggcgatcaactggaagcagcagcccgagacaccagagaccagttcttggatactttacaagcccatggccatgatgtcaactcctttgtgcggagccgtgttttgcagctcttcacccgaattgtccagcagaaggctctccccctgacacgtttccaggcagtggtggctttagctgtgggacgtctggcagacaagtcagtgctagtatgtaaaaatgccatccagctgctggccagttttctagccaataatcctttctcctgcaagcttagtgatgctgaccttgccggaccactgcagaaggagacccagaaattacaagagatgagggcccagaggcgaactgcagcagcttctgcagtgctggacccagaggaggagtgggaagccatgctgccagagttgaagtctaccctgcagcagcttctacagcttccccagggagaggaggagattcctgagcaaattgccaatacagagacaactgaagatgtgaaaggacgcatctatcaactgcttgccaaagctagttacaaaaaggccatcattctcactcgagaagccacaggccacttccaggagtccgaacccttcagtcatatagacccagaggagtcagaggagaccaggctcttgaatatcttaggacttatcttcaaaggcccagcagcttccacacaagaaaagaatccccgggagtctacaggaaacatggtcacaggacagactgtctgtaaaaataaacccaatatgtcggatcctgaggaatccaggggaaatgatgaactagtgaagcaggagatgctggtacagtatctgcaggatgcctacagcttctcccggaagattacagaggccattggcataatcagcaagatgatgtatgaaaacacaactacagtggtgcaggaggtgattgaattctttgtgatggtcttccaatttggggtaccccaggccctgtttggggtgcgccgtatgctgcctctcatctggtctaaggagcctggtgtccgggaagccgtgcttaatgcctaccgccaactctacctcaaccccaaaggggactctgccagagccaaggcccaggctttgattcagaatctctctctgctgctagtggatgcctcggttgggaccattcagtgtcttgaggaaattctctgtgagtttgtgcagaaggatgagttgaaaccagcagtgacccagctgctgtgggagcgggccaccgagaaggtcgcctgctgtcctctggagcgctgttcctctgtcatgcttcttggcatgatggcacgaggaaagccagaaattgtgggaagcaatttagacacactggtgagcatagggctggatgagaagtttccacaggactacaggctggcccagcaggtgtgccatgccattgccaacatctcggacaggagaaagccttctctgggcaaacgtcacccccccttccggctgcctcaggaacacaggttgtttgagcgactgcgggagacagtcacaaaaggctttgtccacccagacccactctggatcccattcaaagaggtggcagtgaccctcatttaccaactggcagagggccccgaagtgatctgtgcccagatattgcagggctgtgcaaaacaggccctggagaagctagaagagaagagaaccagtcaggaggacccgaaggagtcccccgcaatgctccccactttcctgttgatgaacctgctgtccctggctggggatgtggctctgcagcagctggtccacttggagcaggcagtgagtggagagctctgccggcgccgagttctccgggaagaacaggagcacaagaccaaagatcccaaggagaagaatacgagctctgagaccaccatggaggaggagctggggctggttggggcaacagcagatgacacagaggcagaactaatccgtggcatctgcgagatggaactgttggatggcaaacagacactggctgcctttgttccactcttgcttaaagtctgtaacaacccaggcctctatagcaacccagacctctctgcagctgcttcacttgcccttggcaagttctgcatgatcagtgccactttctgcgactcccagcttcgtcttctgttcaccatgctggaaaagtctccacttcccattgtccggtctaacctcatggttgccactggggatctggccatccgctttcccaatctggtggacccctggactcctcatctgtatgctcgcctccgggaccctgctcagcaagtgccactgtgttcttaagaggcttccagagaaaacggcacaccaatcaataaagaactgagca

SEQ ID NO: 365174 - DNA, 4015 bp, Homo sapiens
aagttttggagcgccggacaagctgaggtccgcgactcgtcgctaagattccccaaaactgagatttcaagaaaattcaccctttccgctttctttggcgcccttcaaccgtgaaggaaatgaaggttgagaacctggaacccgcttccaaagaccaagccctttctctgtgcctcacaacagtcttgcgctgtagctgtttttattacccctattttactactggggaggagatttgaggtcctgaaagtgaagtgacttgctggacgtcacttagcagaggagatggcgaaacctggattagaggcgatgccttctaactcccagcgtggacttgcctcctttcctgggggtgactgaatgcccagccagggacgcgacgtctctggccagcagaaatacggcctcctccccgccgactgggcaaagggggaccttgcggccaaggagggattcgcaggcgggccgggggtgggagcgggggccggagccggagccttggcccgcccccgggcggcgctgtgattggccggccgctccggcgggcgtcgcgattggccgtcctgcagccgttgagatttgaactcggtatttgtggctttgcccgcgcgttgccagactcagaggcggccctttgcctctgcctgccggggattggccggattctccgccgacttgaaaactgccttgctaattggtgcgtgttgtgcacgcgtgttttttccttttcatttcagcctgactgccggaatcagagccgcgggtgagatccccagccctgtgagcctgtaggagtagaatggctccccaaatgtatgagttccatctgccattatccccagaggagttgttgaaaagtggaggggtgaatcagtatgttgtgcaagaggtactgtccatcaaacatcttccaccacagcttagagcttttcaggctgcctttcgagctcaggggcccctggctatgctgcagcactttgatactatctacagcattttgcatcactttcgaagtatagatcctggcctcaaagaagatactctggaattcctgataaaagtggtatcccgccactcccaggagcttccagctatcctggatgatacaactttgagtggatcagatagaaacgcccatctaaatgccctcaaaatgaactgttatgctctgatacgtctcctggaatcctttgagaccatggccagccagacaaaccttgtggacctggaccttggtgggaagggtaagaaagctcggaccaaggcagcccatggctttgactgggaagaagagaggcaaccaattcttcagcttttaacacagctacttcagttggacatccgtcacctgtggaaccactcaataattgaagaagaatttgtcagtttggttactggctgttgctaccgccttctggagaatcccaccattaatcaccagaagaaccgccccactcgggaagccataacacacctgcttggtgtagccttgacccgttataaccatatgctcagtgctacagtgaagatcatccagatgctgcagcactttgaacacctggcacctgtactggttgcagccgtgagtctatgggcaactgactatggaatgaagagcatagtgggagagattgtaagagagattggacaaaagtgtccccaagagctgagtcgagacccttcagggacaaagggctttgcagcattcctgacagaactagcagaacgtgtcccagctatcctgatgtccagcatgtgcattttgctagatcacctggatggagaaaattacatgatgcgtaatgctgtgctggcagccatggcggagatggtgctgcaggttctcagtggcgatcaactggaagcagcagcccgagacaccagagaccagttcttggatactttacaagcccatggccatgatgtcaactcctttgtgcggagccgtgttttgcagctcttcacccgaattgtccagcagaaggctctccccctgacacgtttccaggcagtggtggctttagctgtgggacgtctggcagacaagtcagtgctagtatgtaaaaatgccatccagctgctggccagttttctagccaataatcctttctcctgcaagcttagtgatgctgaccttgccggaccactgcagaaggagacccagaaattacaagagatgagggcccagaggcgaactgcagcagcttctgcagtgctggacccagaggaggagtgggaagccatgctgccagagttgaagtctaccctgcagcagcttctacagcttccccagggagaggaggagattcctgagcaaattgccaatacagagacaactgaagatgtgaaaggacgcatctatcaactgcttgccaaagctagttacaaaaaggccatcattctcactcgagaagccacaggccacttccaggagtccgaacccttcagtcatatagacccagaggagtcagaggagaccaggctcttgaatatcttaggacttatcttcaaaggcccagcagcttccacacaagaaaagaatccccgggagtctacaggaaacatggtcacaggacagactgtctgtaaaaataaacccaatatgtcggatcctgaggaatccaggggaaatgatgaactagtgaagcaggagatgctggtacagtatctgcaggatgcctacagcttctcccggaagattacagaggccattggcataatcagcaagatgatgtatgaaaacacaactacagtggtgcaggaggtgattgaattctttgtgatggtcttccaatttggggtaccccaggccctgtttggggtgcgccgtatgctgcctctcatctggtctaaggagcctggtgtccgggaagccgtgcttaatgcctaccgccaactctacctcaaccccaaaggggactctgccagagccaaggcccaggctttgattcagaatctctctctgctgctagtggatgcctcggttgggaccattcagtgtcttgaggaaattctctgtgagtttgtgcagaaggatgagttgaaaccagcagtgacccagctgctgtgggagcgggccaccgagaaggtcgcctgctgtcctctggagcgctgttcctctgtcatgcttcttggcatgatggcacgcagaggtttggatggaatcaaggagcttgagattggccaagcaggtagccagagagcgccatcagccaagaaaccatccactggttctaggtaccagcctctggcttctacagcctcagacaatgactttgtcacaccagagccccgccgtactacccgtcggcatccaaacacccagcagcgagcttccaaaaagaaacccaaagttgtcttctcaagtgatgagtccagtgaggaagatctttcagcagagatgacagaagacgagacacccaagaaaacaactcccattctcagagcatcggctcgcaggcacagatcctaggaagtctgttcctgtcctccctgtgcagggtatcctgtagggtgacctggaattcgaattctgtttcccttgtaaaatatttgtctgtctctttttttaaaaaaaaaaaaaggccgggcactgtggctcacgcctgtaatcccagcactttgcgataccaaggcgggtggataacctgaggtagggagttcgagaccagcctgaccaacatggagaaaccccatctctactaaaaataaaaaattagccgggcgtattggcgtgcgcctgtaatcccagctactcaagaggctgaggcaggagaatcgcctgaacccagaggcggaggttgtagtgagccgaaatcacaccattgcactccagcttgggcaacaatagcgaacctccatctcaaattaaaaaaaaaatgcctacacgctctttaaaatgcaaggctttctcttaaattagcctaactgaactgcgttgagctgcttcaactttggaatatatgtttgccaatctccttgttttctaatgaataaatgtttttatatactttta

SEQ ID NO: 365175 - DNA, 3427 bp, Homo sapiens
aagttttggagcgccggacaagctgaggtccgcgactcgtcgctaagattccccaaaactgagatttcaagaaaattcaccctttccgctttctttggcgcccttcaaccgtgaaggaaatgaaggttgagaacctggaacccgcttccaaagaccaagccctttctctgtgcctcacaacagtcttgcgctgtagctgtttttattacccctattttactactggggaggagatttgaggtcctgaaagtgaagtgacttgctggacgtcacttagcagaggagatggcgaaacctggattagaggcgatgccttctaactcccagcgtggacttgcctcctttcctgggggtgactgaatgcccagccagggacgcgacgtctctggccagcagaaatacggcctcctccccgccgactgggcaaagggggaccttgcggccaaggagggattcgcaggcgggccgggggtgggagcgggggccggagccggagccttggcccgcccccgggcggcgctgtgattggccggccgctccggcgggcgtcgcgattggccgtcctgcagccgttgagatttgaactcggtatttgtggctttgcccgcgcgttgccagactcagaggcggccctttgcctctgcctgccggggattggccggattctccgccgacttgaaaactgccttgctaattggtgcgtgttgtgcacgcgtgttttttccttttcatttcagcctgactgccggaatcagagccgcgggtgagatccccagccctgtgagcctgtaggagtagaatggctccccaaatgtatgagttccatctgccattatccccagaggagttgttgaaaagtggaggggtgaatcagtatgttgtgcaagaggtactgtccatcaaacatcttccaccacagcttagagcttttcaggctgcctttcgagctcaggggcccctggctatgctgcagcactttgatactatctacagcattttgcatcactttcgaagtatagatcctggcctcaaagaagatactctggaattcctgataaaagtggtatcccgccactcccaggagcttccagctatcctggatgatacaactttgagtggatcagatagaaacgcccatctaaatgccctcaaaatgaactgttatgctctgatacgtctcctggaatcctttgagaccatggccagccagacaaaccttgtggacctggaccttggtgggaagggtaagaaagctcggaccaaggcagcccatggctttgactgggaagaagagaggcaaccaattcttcagcttttaacacagctacttcagttggacatccgtcacctgtggaaccactcaataattgaagaagaatttgtcagtttggttactggctgttgctaccgccttctggagaatcccaccattaatcaccagaagaaccgccccactcgggaagccataacacacctgcttggtgtagccttgacccgttataaccatatgctcagtgctacagtgaagatcatccagatgctgcagcactttgaacacctggcacctgtactggttgcagccgtgagtctatgggcaactgactatggaatgaagagcatagtgggagagattgtaagagagattggacaaaagtgtccccaagagctgagtcgagacccttcagggacaaagggctttgcagcattcctgacagaactagcagaacgtgtcccagctatcctgatgtccagcatgtgcattttgctagatcacctggatggagaaaattacatgatgcgtaatgctgtgctggcagccatggcggagatggtgctgcaggttctcagtggcgatcaactggaagcagcagcccgagacaccagagaccagttcttggatactttacaagcccatggccatgatgtcaactcctttgtgcggagccgtgttttgcagctcttcacccgaattgtccagcagaaggctctccccctgacacgtttccaggcagtggtggctttagctgtgggacgtctggcagacaagtcagtgctagtatgtaaaaatgccatccagctgctggccagttttctagccaataatcctttctcctgcaagcttagtgatgctgaccttgccggaccactgcagaaggagacccagaaattacaagagatgagggcccagaggcgaactgcagcagcttctgcagtgctggacccagaggaggagtgggaagccatgctgccagagttgaagtctaccctgcagcagcttctacagcttccccagggagaggaggagattcctgagcaaattgccaatacagagacaactgaagatgtgaaaggacgcatctatcaactgcttgccaaagctagttacaaaaaggccatcattctcactcgagaagccacaggccacttccaggagtccgaacccttcagtcatatagacccagaggagtcagaggagaccaggctcttgaatatcttaggacttatcttcaaaggcccagcagcttccacacaagaaaagaatccccgggagtctacaggaaacatggtcacaggacagactgtctgtaaaaataaacccaatatgtcggatcctgaggaatccaggggaaatgatgaactagtgaagcaggagatgctggtacagtatctgcaggatgcctacagcttctcccggaagattacagaggccattggcataatcagcaagatgatgtatgaaaacacaactacagtggtgcaggaggtgattgaattctttgtgatggtcttccaatttggggtaccccaggccctgtttggggtgcgccgtatgctgcctctcatctggtctaaggagcctggtgtccgggaagccgtgcttaatgcctaccgccaactctacctcaaccccaaaggggactctgccagagccaaggcccaggctttgattcagaatctctctctgctgctagtggatgcctcggttgggaccattcagtgtcttgaggaaattctctgtgagtttgtgcagaaggatgagttgaaaccagcagtgacccagctgctgtgggagcgggccaccgagaaggtcgcctgctgtcctctggagcgctgttcctctgtcatgcttcttggcatgatggcacgaggaaagccagaaattgtgggaagcaatttagacacactggtgagcatagggctggatgagaagtttccacaggactacaggctggcccagcaggtgtgccatgccattgccaacatctcggacaggagaaagccttctctgggcaaacgtcacccccccttccggctgcctcaggaacacaggttgtttgagcgactgcgggagacagtcacaaaaggcttttggtcccaaccccaagaacccaacttcttggaatccccaatttcaaaaggaaggttg

SEQ ID NO: 365176 - DNA, 1427 bp, Homo sapiens
tcttgtttgtttgtttttaatagtttttatttttcagagcagttttaggttcaaagcaaaattgagcagaaagtacagggagttcccttctaccccttgcccctacacatcacagccttccccaccttcaacatcctgcaccagggtggcacatttgttacagctgaacctacacttacacatcatctcctaaagtcatggtttaccttggagttcactgcacgtaatgacatgtacccaccattgcagtatcatacagaagagtttcactgccttacaaatcccctgcactccacctatttatccctctctccccacaacccctgatctttttactgttgccatcactttgtcttttccagaatgtatcattggaatgatccggtatggagccttctcaccttggcttcttagtaatgtgcgtttaaggcctccatgtcttccatggccttgtttctttttaatcagaagtaactgttttcaggcctgctctgaatctccttttctccctccaggctataatagatgaatttgagcagaagcttcgggcctgtcataccagaggtttggatggaatcaaggagcttgagattggccaagcaggtagccagagagcgccatcagccaagaaaccatccactggttctaggtaccagcctctggcttctacagcctcagacaatgactttgtcacaccagagccccgccgtactacccgtcggcatccaaacacccagcagcgagcttccaaaaagaaacccaaagttgtcttctcaagtgatgagtccagtgaggaagatctttcagcagagatgacagaagacgagacacccaagaaaacaactcccattctcagagcatcggctcgcaggcacagatcctaggaagtctgttcctgtcctccctgtgcagggtatcctgtagggtgacctggaattcgaattctgtttcccttgtaaaatatttgtctgtctctttttttaaaaaaaaaaaaaggccgggcactgtggctcacgcctgtaatcccagcactttgcgataccaaggcgggtggataacctgaggtagggagttcgagaccagcctgaccaacatggagaaaccccatctctactaaaaataaaaaattagccgggcgtattggcgtgcgcctgtaatcccagctactcaagaggctgaggcaggagaatcgcctgaacccagaggcggaggttgtagtgagccgaaatcacaccattgcactccagcttgggcaacaatagcgaacctccatctcaaattaaaaaaaaaatgcctacacgctctttaaaatgcaaggctttctcttaaattagcctaactgaactgcgttgagctgcttcaactttggaatatatgtttgccaatctccttgttttctaatgaataaatgtttttatatactttta

SEQ ID NO: 365177 - DNA, 1530 bp, Homo sapiens
tcttgtttgtttgtttttaatagtttttatttttcagagcagttttaggttcaaagcaaaattgagcagaaagtacagggagttcccttctaccccttgcccctacacatcacagccttccccaccttcaacatcctgcaccagggtggcacatttgttacagctgaacctacacttacacatcatctcctaaagtcatggtttaccttggagttcactgcacgtaatgacatgtacccaccattgcagtatcatacagaagagtttcactgccttacaaatcccctgcactccacctatttatccctctctccccacaacccctgatctttttactgttgccatcactttgtcttttccagaatgtatcattggaatgatccggtatggagccttctcaccttggcttcttagtaatgtgcgtttaaggcctccatgtcttccatggccttgtttctttttaatcagaagtaactgttttcaggcctgctctgaatctccttttctccctccaggctataatagatgaatttgagcagaagcttcgggcctgtcataccagaggtttggatggaatcaaggagcttgagattggccaagcaggtagccagagagcgccatcagccaagaaaccatccactggtacgtaaggcagcctgtgcgggcgagaccagactgggccctcccctcctgcagtgatttgtttcttcttcttttttaaatcacgttttcctgccttttctaggttctaggtaccagcctctggcttctacagcctcagacaatgactttgtcacaccagagccccgccgtactacccgtcggcatccaaacacccagcagcgagcttccaaaaagaaacccaaagttgtcttctcaagtgatgagtccagtgaggaagatctttcagcagagatgacagaagacgagacacccaagaaaacaactcccattctcagagcatcggctcgcaggcacagatcctaggaagtctgttcctgtcctccctgtgcagggtatcctgtagggtgacctggaattcgaattctgtttcccttgtaaaatatttgtctgtctctttttttaaaaaaaaaaaaaggccgggcactgtggctcacgcctgtaatcccagcactttgcgataccaaggcgggtggataacctgaggtagggagttcgagaccagcctgaccaacatggagaaaccccatctctactaaaaataaaaaattagccgggcgtattggcgtgcgcctgtaatcccagctactcaagaggctgaggcaggagaatcgcctgaacccagaggcggaggttgtagtgagccgaaatcacaccattgcactccagcttgggcaacaatagcgaacctccatctcaaattaaaaaaaaaatgcctacacgctctttaaaatgcaaggctttctcttaaattagcctaactgaactgcgttgagctgcttcaactttggaatatatgtttgccaatctccttgttttctaatgaataaatgtttttatatactttta

SEQ ID NO: 365178 - DNA, 1487 bp, Homo sapiens
  misc_feature (1381)..(1381): n is a, c, g, or t
  misc_feature (1441)..(1441): n is a, c, g, or t
  misc_feature (1476)..(1476): n is a, c, g, or t
aagttttggagcgccggacaagctgaggtccgcgactcgtcgctaagattccccaaaactgagatttcaagaaaattcaccctttccgctttctttggcgcccttcaaccgtgaaggaaatgaaggttgagaacctggaacccgcttccaaagaccaagccctttctctgtgcctcacaacagtcttgcgctgtagctgtttttattacccctattttactactggggaggagatttgaggtcctgaaagtgaagtgacttgctggacgtcacttagcagaggagatggcgaaacctggattagaggcgatgccttctaactcccagcgtggacttgcctcctttcctgggggtgactgaatgcccagccagggacgcgacgtctctggccagcagaaatacggcctcctccccgccgactgggcaaagggggaccttgcggccaaggagggattcgcaggcgggccgggggtgggagcgggggccggagccggagccttggcccgcccccgggcggcgctgtgattggccggccgctccggcgggcgtcgcgattggccgtcctgcagccgttgagatttgaactcggtatttgtggctttgcccgcgcgttgccagactcagaggcggccctttgcctctgcctgccggggattggccggattctccgccgacttgaaaactgccttgctaattggtgcgtgttgtgcacgcgtgttttttccttttcatttcagcctgactgccggaatcagagccgcgggtgagatccccagccctgtgagcctgtaggagtagaatggctccccaaatgtatgagttccatctgccattatccccagaggagttgttgaaaagtggaggggtgaatcagtatgttgtgcaagaggtactgtccatcaaacatcttccaccacagcttagagcttttcaggctgcctttcgagctcaggggcccctggctatgctgcagcactttgatactatctacagcattttgcatcactttcgaagtatagatcctggcctcaaagaagatactctggaattcctgataaaagtggtatcccgccactcccaggagcttccagctatcctggatgatacaactttgagtggatcagatagaaacgcccatctaaatgccctcaaaatgaactgttatgctctgatacgtctcctggaatcctttgagaccatggccagccagacaaaccttgtggacctggaccttggtgggaagggtaagaaagctcggaccaaggcagcccatggctttgactgggaagaagagaggcaaccaattcttcagcttttaacacagctacttcagttggacatccgtcacctgtggaaccactcaataaatttggaaagaaanaaatttgttcagtttgggttactggggctgtttggcttaacccggcccttccttgggaanaaatccccacccattttaaattcaccccagaaaanaaaaccggccc

SEQ ID NO: 365179 - DNA, 1120 bp, Homo sapiens
aagttttggagcgccggacaagctgaggtccgcgactcgtcgctaagattccccaaaactgagatttcaagaaaattcaccctttccgctttctttggcgcccttcaaccgtgaaggaaatgaaggttgagaacctggaacccgcttccaaagaccaagccctttctctgtgcctcacaacagtcttgcgctgtagctgtttttattacccctattttactactggggaggagatttgaggtcctgaaagtgaagtgacttgctggacgtcacttagcagaggagatggcgaaacctggattagaggcgatgccttctaactcccagcgtggacttgcctcctttcctgggggtgactgaatgcccagccagggacgcgacgtctctggccagcagaaatacggcctcctccccgccgactgggcaaagggggaccttgcggccaaggagggattcgcaggcgggccgggggtgggagcgggggccggagccggagccttggcccgcccccgggcggcgctgtgattggccggccgctccggcgggcgtcgcgattggccgtcctgcagccgttgagatttgaactcggtatttgtggctttgcccgcgcgttgccagactcagaggcggccctttgcctctgcctgccggggattggccggattctccgccgacttgaaaactgccttgctaattggtgcgtgttgtgcacgcgtgttttttccttttcatttcagcctgactgccggaatcagagccgcgggtgagatccccagcctgaccaacatggagaaaccccatctctactaaaaataaaaaattagccgggcgtattggcgtgcgcctgtaatcccagctactcaagaggctgaggcaggagaatcgcctgaacccagaggcggaggttgtagtgagccgaaatcacaccattgcactccagcttgggcaacaatagcgaacctccatctcaaattaaaaaaaaaatgcctacacgctctttaaaatgcaaggctttctcttaaattagcctaactgaactgcgttgagctgcttcaactttggaatatatgtttgccaatctccttgttttctaatgaataaatgtttttatatactttta

SEQ ID NO: 365180 - DNA, 420 bp, Homo sapiens
aaatcacgttttcctgccttttctaggttctaggtaccagcctctggcttctacagcctcagacaatgactttgtcacaccagagccccgccgtactacccgtcggcatccaaacacccagcagcgagcttccaaaaagaaacccaaagttgtcttctcaagtgatgagtccagtgaggaaggtatgatgctcccgcctgttcccggccgagaaggcacacagctagggtgcagagggctggtttccataggacctgctgcgggggcctgagtgtagatgctctgccccactgccgcagaagggcctctcctgtacagcttggattttatttcttctgtgcggtgtgggattgtctcacttgttctctgatatctattttttcaccatctttgtgactcagctttttcttattcctttaa

SEQ ID NO: 365181 - DNA, 306 bp, Homo sapiens
ggtaagctcccttacaaacggctgcagtgacattcttctgggtactgacaggctggtgttctttcagaaaggccatcattctcactcgagaagccacaggccacttccaggagtccgaacccttcagtcatatagacccagaggagtcagaggagaccaggctcttgaatatcttaggacttatcttcaaaggtaatcattttccttcttcagtcaataaataacacatgtcaactggtatttactgagcattaactttatgccatcattggcctggttaacagaacctggtgctgaagagcccag

SEQ ID NO: 365182 - DNA, 5475 bp, Homo sapiens
aagttttggagcgccggacaagctgaggtccgcgactcgtcgctaagattccccaaaactgagatttcaagaaaattcaccctttccgctttctttggcgcccttcaaccgtgaaggaaatgaaggttgagaacctggaacccgcttccaaagaccaagccctttctctgtgcctcacaacagtcttgcgctgtagctgtttttattacccctattttactactggggaggagatttgaggtcctgaaagtgaagtgacttgctggacgtcacttagcagaggagatggcgaaacctggattagaggcgatgccttctaactcccagcgtggacttgcctcctttcctgggggtgactgaatgcccagccagggacgcgacgtctctggccagcagaaatacggcctcctccccgccgactgggcaaagggggaccttgcggccaaggagggattcgcaggcgggccgggggtgggagcgggggccggagccggagccttggcccgcccccgggcggcgctgtgattggccggccgctccggcgggcgtcgcgattggccgtcctgcagccgttgagatttgaactcggtatttgtggctttgcccgcgcgttgccagactcagaggcggccctttgcctctgcctgccggggattggccggattctccgccgacttgaaaactgccttgctaattggtgcgtgttgtgcacgcgtgttttttccttttcatttcagcctgactgccggaatcagagccgcgggtgagatccccagccctgtgagcctgtaggagtagaatggctccccaaatgtatgagttccatctgccattatccccagaggagttgttgaaaagtggaggggtgaatcagtatgttgtgcaagaggtactgtccatcaaacatcttccaccacagcttagagcttttcaggctgcctttcgagctcaggggcccctggctatgctgcagcactttgatactatctacagcattttgcatcactttcgaagtatagatcctggcctcaaagaagatactctggaattcctgataaaagtggtatcccgccactcccaggagcttccagctatcctggatgatacaactttgagtggatcagatagaaacgcccatctaaatgccctcaaaatgaactgttatgctctgatacgtctcctggaatcctttgagaccatggccagccagacaaaccttgtggacctggaccttggtgggaagggtaagaaagctcggaccaaggcagcccatggctttgactgggaagaagagaggcaaccaattcttcagcttttaacacagctacttcagttggacatccgtcacctgtggaaccactcaataattgaagaagaatttgtcagtttggttactggctgttgctaccgccttctggagaatcccaccattaatcaccagaagaaccgccccactcgggaagccataacacacctgcttggtgtagccttgacccgttataaccatatgctcagtgctacagtgaagatcatccagatgctgcagcactttgaacacctggcacctgtactggttgcagccgtgagtctatgggcaactgactatggaatgaagagcatagtgggagagattgtaagagagattggacaaaagtgtccccaagagctgagtcgagacccttcagggacaaagggctttgcagcattcctgacagaactagcagaacgtgtcccagctatcctgatatggcggagatggtgctgcaggttctcagtggcgatcaactggaagcagcagcccgagacaccagagaccagttcttggatactttacaagcccatggccatgatgtcaactcctttgtgcggagccgtgttttgcagctcttcacccgaattgtccagcagaaggctctccccctgacacgtttccaggcagtggtggctttagctgtgggacgtctggcagacaagtcagtgctagtatgtaaaaatgccatccagctgctggccagttttctagccaataatcctttctcctgcaagcttagtgatgctgaccttgccggaccactgcagaaggagacccagaaattacaagagatgagggcccagaggcgaactgcagcagcttctgcagtgctggacccagaggaggagtgggaagccatgctgccagagttgaagtctaccctgcagcagcttctacagcttccccagggagaggaggagattcctgagcaaattgccaatacagagacaactgaagatgtgaaaggacgcatctatcaactgcttgccaaagctagttacaaaaaggccatcattctcactcgagaagccacaggccacttccaggagtccgaacccttcagtcatatagacccagaggagtcagaggagaccaggctcttgaatatcttaggacttatcttcaaaggcccagcagcttccacacaagaaaagaatccccgggagtctacaggaaacatggtcacaggacagactgtctgtaaaaataaacccaatatgtcggatcctgaggaatccaggggaaatgatgaactagtgaagcaggagatgctggtacagtatctgcaggatgcctacagcttctcccggaagattacagaggccattggcataatcagcaagatgatgtatgaaaacacaactacagtggtgcaggaggtgattgaattctttgtgatggtcttccaatttggggtaccccaggccctgtttggggtgcgccgtatgctgcctctcatctggtctaaggagcctggtgtccgggaagccgtgcttaatgcctaccgccaactctacctcaaccccaaaggggactctgccagagccaaggcccaggctttgattcagaatctctctctgctgctagtggatgcctcggttgggaccattcagtgtcttgaggaaattctctgtgagtttgtgcagaaggatgagttgaaaccagcagtgacccagctgctgtgggagcgggccaccgagaaggtcgcctgctgtcctctggagcgctgttcctctgtcatgcttcttggcatgatggcacgaggaaagccagaaattgtgggaagcaatttagacacactggtgagcatagggctggatgagaagtttccacaggactacaggctggcccagcaggtgtgccatgccattgccaacatctcggacaggagaaagccttctctgggcaaacgtcacccccccttccggctgcctcaggaacacaggttgtttgagcgactgcgggagacagtcacaaaaggctttgtccacccagacccactctggatcccattcaaagaggtggcagtgaccctcatttaccaactggcagagggccccgaagtgatctgtgcccagatattgcagggctgtgcaaaacaggccctggagaagctagaagagaagagaaccagtcaggaggacccgaaggagtcccccgcaatgctccccactttcctgttgatgaacctgctgtccctggctggggatgtggctctgcagcagctggtccacttggagcaggcagtgagtggagagctctgccggcgccgagttctccgggaagaacaggagcacaagaccaaagatcccaaggagaagaatacgagctctgagaccaccatggaggaggagctggggctggttggggcaacagcagatgacacagaggcagaactaatccgtggcatctgcgagatggaactgttggatggcaaacagacactggctgcctttgttccactcttgcttaaagtctgtaacaacccaggcctctatagcaacccagacctctctgcagctgcttcacttgcccttggcaagttctgcatgatcagtgccactttctgcgactcccagcttcgtcttctgttcaccatgctggaaaagtctccacttcccattgtccggtctaacctcatggttgccactggggatctggccatccgctttcccaatctggtggacccctggactcctcatctgtatgctcgcctccgggaccctgctcagcaagtgcggaaaacagcggggctggtgatgacccacctgatcctcaaggacatggtgaaggtgaaggggcaggtcagcgagatggcggtgctgctcatcgaccccgagcctcagattgctgccctggccaagaacttcttcaatgagctctcccacaagggcaacgcaatctataatctccttccagatatcatcagccgcctgtcagaccccgagctgggggtggaggaagagcctttccacaccatcatgaaacagctcctctcctacatcaccaaggacaagcagacagagagcctggtggaaaagctgtgtcagcggttccgcacatcccgaactgagcggcagcagcgagacctggcctactgtgtgtcacagctgcccctcacagagcgaggcctccgtaagatgcttgacaattttgactgttttggagacaaactgtcagatgagtccatcttcagtgcttttttgtcagttgtgggcaagctgcgacgtggggccaagcctgagggcaaggctataatagatgaatttgagcagaagcttcgggcctgtcataccagaggtttggatggaatcaaggagcttgagattggccaagcaggtagccagagagcgccatcagccaagaaaccatccactggttctaggtaccagcctctggcttctacagcctcagacaatgactttgtcacaccagagccccgccgtactacccgtcggcatccaaacacccagcagcgagcttccaaaaagaaacccaaagttgtcttctcaagtgatgagtccagtgaggaagatctttcagcagagatgacagaagacgagacacccaagaaaacaactcccattctcagagcatcggctcgcaggcacagatcctaggaagtctgttcctgtcctccctgtgcagggtatcctgtagggtgacctggaattcgaattctgtttcccttgtaaaatatttgtctgtctctttttttaaaaaaaaaaaaaggccgggcactgtggctcacgcctgtaatcccagcactttgcgataccaaggcgggtggataacctgaggtagggagttcgagaccagcctgaccaacatggagaaaccccatctctactaaaaataaaaaattagccgggcgtattggcgtgcgcctgtaatcccagctactcaagaggctgaggcaggagaatcgcctgaacccagaggcggaggttgtagtgagccgaaatcacaccattgcactccagcttgggcaacaatagcgaacctccatctcaaattaaaaaaaaaatgcctacacgctctttaaaatgcaaggctttctcttaaattagcctaactgaactgcgttgagctgcttcaactttggaatatatgtttgccaatctccttgttttctaatgaataaatgtttttatatactttta

SEQ ID NO: 365183 - DNA, 5503 bp, Homo sapiens
aagttttggagcgccggacaagctgaggtccgcgactcgtcgctaagattccccaaaactgagatttcaagaaaattcaccctttccgctttctttggcgcccttcaaccgtgaaggaaatgaaggttgagaacctggaacccgcttccaaagaccaagccctttctctgtgcctcacaacagtcttgcgctgtagctgtttttattacccctattttactactggggaggagatttgaggtcctgaaagtgaagtgacttgctggacgtcacttagcagaggagatggcgaaacctggattagaggcgatgccttctaactcccagcgtggacttgcctcctttcctgggggtgactgaatgcccagccagggacgcgacgtctctggccagcagaaatacggcctcctccccgccgactgggcaaagggggaccttgcggccaaggagggattcgcaggcgggccgggggtgggagcgggggccggagccggagccttggcccgcccccgggcggcgctgtgattggccggccgctccggcgggcgtcgcgattggccgtcctgcagccgttgagatttgaactcggtatttgtggctttgcccgcgcgttgccagactcagaggcggccctttgcctctgcctgccggggattggccggattctccgccgacttgaaaactgccttgctaattggtgcgtgttgtgcacgcgtgttttttccttttcatttcagcctgactgccggaatcagagccgcgggtgagatccccagccctgtgagcctgtaggagtagaatggctccccaaatgtatgagttccatctgccattatccccagaggagttgttgaaaagtggaggggtgaatcagtatgttgtgcaagaggtactgtccatcaaacatcttccaccacagcttagagcttttcaggctgcctttcgagctcaggggcccctggctatgctgcagcactttgatactatctacagcattttgcatcactttcgaagtatagatcctggcctcaaagaagatactctggaattcctgataaaagtggtatcccgccactcccaggagcttccagctatcctggatgatacaactttgagtggatcagatagaaacgcccatctaaatgccctcaaaatgaactgttatgctctgatacgtctcctggaatcctttgagaccatggccagccagacaaaccttgtggacctggaccttggtgggaagggtaagaaagctcggaccaaggcagcccatggctttgactgggaagaagagaggcaaccaattcttcagcttttaacacagctacttcagttggacatccgtcacctgtggaaccactcaataattgaagaagaatttgtcagtttggttactggctgttgctaccgccttctggagaatcccaccattaatcaccagaagaaccgccccactcgggaagccataacacacctgcttggtgtagccttgacccgttataaccatatgctcagtgctacagtgaagatcatccagatgctgcagcactttgaacacctggcacctgtactggttgcagccgtgagtctatgggcaactgactatggaatgaagagcatagtgggagagattgtaagagagattggacaaaagtgtccccaagagctgagtcgagacccttcagggacaaagggctttgcagcattcctgacagaactagcagaacgtgtcccagctatcctgatgtccagcatgtgcattttgctagatcacctggatggagaaaattacatgatgcgtaatgctgtgctggcagccatggcggagatggtgctgcaggttctcagtggcgatcaactggaagcagcagcccgagacaccagagaccagttcttggatactttacaagcccatggccatgatgtcaactcctttgtgcggagccgtgttttgcagctcttcacccgaattgtccagcagaaggctctccccctgacacgtttccaggcagtggtggctttagctgtgggacgtctggcagacaagtcagtgctagtatgtaaaaatgccatccagctgctggccagttttctagccaataatcctttctcctgcaagcttagtgatgctgaccttgccggaccactgcagaaggagacccagaaattacaagagatgagggcccagaggcgaactgcagcagcttctgcagtgctggacccagaggaggagtgggaagccatgctgccagagttgaagtctaccctgcagcagcttctacagcttccccagggagaggaggagattcctgagcaaattgccaatacagagacaactgaagatgtgaaaggacgcatctatcaactgcttgccaaagctagttacaaaaaggccatcattctcactcgagaagccacaggccacttccaggagtccgaacccttcagtcatatagacccagaggagtcagaggagaccaggctcttgaatatcttaggacttatcttcaaaggcccagcagcttccacacaagaaaagaatccccgggagtctacaggaaacatggtcacaggacagactgtctgtaaaaataaacccaatatgtcggatcctgaggaatccaggggaaatgatgaactagtgaagcaggagatgctggtacagtatctgcaggatgcctacagcttctcccggaagattacagaggccattggcataatcagcaagatgatgtatgaaaacacaactacagtggtgcaggaggtgattgaattctttgtgatggtcttccaatttggggtaccccaggccctgtttggggtgcgccgtatgctgcctctcatctggtctaaggagcctggtgtccgggaagccgtgcttaatgcctaccgccaactctacctcaaccccaaaggggactctgccagagccaaggcccaggctttgattcagaatctctctctgctgctagtggatgcctcggttgggaccattcagtgtcttgaggaaattctctgtgagtttgtgcagaaggatgagttgaaaccagcagtgacccagctgctgtgggagcgggccaccgagaaggtcgcctgctgtcctctggagcgctgttcctctgtcatgcttcttggcatgatggcacgaggaaagccagaaattgtgggaagcaatttagacacactggtgagcatagggctggatgagaagtttccacaggactacaggctggcccagcaggtgtgccatgccattgccaacatctcggacaggagaaagccttctctgggcaaacgtcacccccccttccggctgcctcaggaacacaggttgtttgagcgactgcgggagacagtcacaaaaggctttgtccacccagacccactctggatcccattcaaagaggtggcagtgaccctcatttaccaactggcagagggccccgaagtgatctgtgcccagatattgcagggctgtgcaaaacaggccctggagaagctagaagagaagagaaccagtcaggaggacccgaaggagtcccccgcaatgctccccactttcctgttgatgaacctgctgtccctggctggggatgtggctctgcagcagctggtccacttggagcaggcagtgagtggagagctctgccggcgccgagttctccgggaagaacaggagcacaagaccaaagatcccaaggagaagaatacgagctctgagaccaccatggaggaggagctggggctggttggggcaacagcagatgacacagaggcagaactaatccgtggcatctgcgagatggaactgttggatggcaaacagacactggctgcctttgttccactcttgcttaaagtctgtaacaacccaggcctctatagcaacccagacctctctgcagctgcttcacttgcccttggcaagttctgcatgatcagtgccactttctgcgactcccagcttcgtcttctgttcaccatgctggaaaagtctccacttcccattgtccgcaatctggtggacccctggactcctcatctgtatgctcgcctccgggaccctgctcagcaagtgcggaaaacagcggggctggtgatgacccacctgatcctcaaggacatggtgaaggtgaaggggcaggtcagcgagatggcggtgctgctcatcgaccccgagcctcagattgctgccctggccaagaacttcttcaatgagctctcccacaagggcaacgcaatctataatctccttccagatatcatcagccgcctgtcagaccccgagctgggggtggaggaagagcctttccacaccatcatgaaacagctcctctcctacatcaccaaggacaagcagacagagagcctggtggaaaagctgtgtcagcggttccgcacatcccgaactgagcggcagcagcgagacctggcctactgtgtgtcacagctgcccctcacagagcgaggcctccgtaagatgcttgacaattttgactgttttggagacaaactgtcagatgagtccatcttcagtgcttttttgtcagttgtgggcaagctgcgacgtggggccaagcctgagggcaaggctataatagatgaatttgagcagaagcttcgggcctgtcataccagaggtttggatggaatcaaggagcttgagattggccaagcaggtagccagagagcgccatcagccaagaaaccatccactggttctaggtaccagcctctggcttctacagcctcagacaatgactttgtcacaccagagccccgccgtactacccgtcggcatccaaacacccagcagcgagcttccaaaaagaaacccaaagttgtcttctcaagtgatgagtccagtgaggaagatctttcagcagagatgacagaagacgagacacccaagaaaacaactcccattctcagagcatcggctcgcaggcacagatcctaggaagtctgttcctgtcctccctgtgcagggtatcctgtagggtgacctggaattcgaattctgtttcccttgtaaaatatttgtctgtctctttttttaaaaaaaaaaaaaggccgggcactgtggctcacgcctgtaatcccagcactttgcgataccaaggcgggtggataacctgaggtagggagttcgagaccagcctgaccaacatggagaaaccccatctctactaaaaataaaaaattagccgggcgtattggcgtgcgcctgtaatcccagctactcaagaggctgaggcaggagaatcgcctgaacccagaggcggaggttgtagtgagccgaaatcacaccattgcactccagcttgggcaacaatagcgaacctccatctcaaattaaaaaaaaaatgcctacacgctctttaaaatgcaaggctttctcttaaattagcctaactgaactgcgttgagctgcttcaactttggaatatatgtttgccaatctccttgttttctaatgaataaatgtttttatatactttta

SEQ ID NO: 365184 - DNA, 5364 bp, Homo sapiens
aagttttggagcgccggacaagctgaggtccgcgactcgtcgctaagattccccaaaactgagatttcaagaaaattcaccctttccgctttctttggcgcccttcaaccgtgaaggaaatgaaggttgagaacctggaacccgcttccaaagaccaagccctttctctgtgcctcacaacagtcttgcgctgtagctgtttttattacccctattttactactggggaggagatttgaggtcctgaaagtgaagtgacttgctggacgtcacttagcagaggagatggcgaaacctggattagaggcgatgccttctaactcccagcgtggacttgcctcctttcctgggggtgactgaatgcccagccagggacgcgacgtctctggccagcagaaatacggcctcctccccgccgactgggcaaagggggaccttgcggccaaggagggattcgcaggcgggccgggggtgggagcgggggccggagccggagccttggcccgcccccgggcggcgctgtgattggccggccgctccggcgggcgtcgcgattggccgtcctgcagccgttgagatttgaactcggtatttgtggctttgcccgcgcgttgccagactcagaggcggccctttgcctctgcctgccggggattggccggattctccgccgacttgaaaactgccttgctaattggtgcgtgttgtgcacgcgtgttttttccttttcatttcagcctgactgccggaatcagagccgcgggtgagatccccagccctgtgagcctgtaggagtagaatggctccccaaatgtatgagttccatctgccattatccccagaggagttgttgaaaagtggaggggtgaatcagtatgttgtgcaagaggtactgtccatcaaacatcttccaccacagcttagagcttttcaggctgcctttcgagctcaggggcccctggctatgctgcagcactttgatactatctacagcattttgcatcactttcgaagtatagatcctggcctcaaagaagatactctggaattcctgataaaagtggtatcccgccactcccaggagcttccagctatcctggatgatacaactttgagtggatcagatagaaacgcccatctaaatgccctcaaaatgaactgttatgctctgatacgtctcctggaatcctttgagaccatggccagccagacaaaccttgtggacctggaccttggtgggaagggtaagaaagctcggaccaaggcagcccatggctttgactgggaagaagagaggcaaccaattcttcagcttttaacacagctacttcagttggacatccgtcacctgtggaaccactcaataattgaagaagaatttgtcagtttggttactggctgttgctaccgccttctggagaatcccaccattaatcaccagaagaaccgccccactcgggaagccataacacacctgcttggtgtagccttgacccgttataaccatatgctcagtgctacagtgaagatcatccagatgctgcagcactttgaacacctggcacctgtactggttgcagccgtgagtctatgggcaactgactatggaatgaagagcatagtgggagagattgtaagagagattggacaaaagtgtccccaagagctgagtcgagacccttcagggacaaagggctttgcagcattcctgacagaactagcagaacgtgtcccagctatcctgatgtccagcatgtgcattttgctagatcacctggatggagaaaattacatgatgcgtaatgctgtgctggcagccatggcggagatggtgctgcaggttctcagtggcgatcaactggaagcagcagcccgagacaccagagaccagttcttggatactttacaagcccatggccatgatgtcaactcctttgtgcggagccgtgttttgcagctcttcacccgaattgtccagcagaaggctctccccctgacacgtttccaggcagtggtggctttagctgtgggacgtctggcagacaagtcagtgctagtatgtaaaaatgccatccagctgctggccagttttctagccaataatcctttctcctgcaagcttagtgatgctgaccttgccggaccactgcagaaggagacccagaaattacaagagatgagggcccagaggcgaactgcagcagcttctgcagtgctggacccagaggaggagtgggaagccatgctgccagagttgaagtctaccctgcagcagcttctacagcttccccagggagaggaggagattcctgagcaaattgccaatacagagacaactgaagatgtgaaaggacgcatctatcaactgcttgccaaagctagttacaaaaaggccatcattctcactcgagaagccacaggccacttccaggagtccgaacccttcagtcatatagacccagaggagtcagaggagaccaggctcttgaatatcttaggacttatcttcaaaggcccagcagcttccacacaagaaaagaatccccgggagtctacaggaaacatggtcacaggacagactgtctgtaaaaataaacccaatatgtcggatcctgaggaatccaggggaaatgatgaactagtgaagcaggagatgctggtacagtatctgcaggatgcctacagcttctcccggaagattacagaggccattggcataatcagcaagatgatgtatgaaaacacaactacagtggtgcaggaggtgattgaattctttgtgatggtcttccaatttggggtaccccaggccctgtttggggtgcgccgtatgctgcctctcatctggtctaaggagcctggtgtccgggaagccgtgcttaatgcctaccgccaactctacctcaaccccaaaggggactctgccagagccaaggcccaggctttgattcagaatctctctctgctgctagtggatgcctcggttgggaccattcagtgtcttgaggaaattctctgtgagtttgtgcagaaggatgagttgaaaccagcagtgacccagctgctgtgggagcgggccaccgagaaggtcgcctgctgtcctctggagcgctgttcctctgtcatgcttcttggcatgatggcacgaggaaagccagaaattgtgggaagcaatttagacacactggtgagcatagggctggatgagaagtttccacaggactacaggctggcccagcaggtgtgccatgccattgccaacatctcggacaggagaaagccttctctgggcaaacgtcacccccccttccggctgcctcaggaacacaggttgtttgagcgactgcgggagacagtcacaaaaggctttgtccacccagacccactctggatcccattcaaagaggtggcagtgaccctcatttaccaactggcagagggccccgaagtgatctgtgcccagatattgcagggctgtgcaaaacaggccctggagaagctagaagagaagagaaccagtcaggaggacccgaaggagtcccccgcaatgctccccactttcctgttgatgaacctgctgtccctggctggggatgtggctctgcagcagctggtccacttggagcaggcagtgagtggagagctctgccggcgccgagttctccgggaagaacaggagcacaagaccaaagatcccaaggagaagaatacgagctctgagaccaccatggaggaggagctggggctggttggggcaacagcagatgacacagaggcagaactaatccgtggcatctgcgagatggaactgttggatggcaaacagacactggctgcctttgttccactcttgcttaaagtctgtaacaacccaggcctctatagcaacccagacctctctgcagctgcttcacttgcccttggcaagttctgcatgatcagtgccactttctgcgactcccagcttcgtcttctgttcaccatgctggaaaagtctccacttcccattgtccggtctaacctcatggttgccactggggatctggccatccgctttcccaatctggtggacccctggactcctcatctgtatgctcgcctccgggaccctgctcagcaagtgcggaaaacagcggggctggtgatgacccacctgatcctcaaggacatggtgaaggtgaaggggcaggtcagcgagatggcggtgctgctcatcgaccccgagcctcagattgctgccctggccaagaacttcttcaatgagctctcccacaagggcaacgcaatctataatctccttccagatatcatcagccgcctgtcagaccccgagctgggggtggaggaagagcctttccacaccatcatgaaacagctcctctcctacatcaccaaggacaagcagacagagagcctggtggaaaagctgtgtcagcggttccgcacatcccggctataatagatgaatttgagcagaagcttcgggcctgtcataccagaggtttggatggaatcaaggagcttgagattggccaagcaggtagccagagagcgccatcagccaagaaaccatccactggttctaggtaccagcctctggcttctacagcctcagacaatgactttgtcacaccagagccccgccgtactacccgtcggcatccaaacacccagcagcgagcttccaaaaagaaacccaaagttgtcttctcaagtgatgagtccagtgaggaagatctttcagcagagatgacagaagacgagacacccaagaaaacaactcccattctcagagcatcggctcgcaggcacagatcctaggaagtctgttcctgtcctccctgtgcagggtatcctgtagggtgacctggaattcgaattctgtttcccttgtaaaatatttgtctgtctctttttttaaaaaaaaaaaaaggccgggcactgtggctcacgcctgtaatcccagcactttgcgataccaaggcgggtggataacctgaggtagggagttcgagaccagcctgaccaacatggagaaaccccatctctactaaaaataaaaaattagccgggcgtattggcgtgcgcctgtaatcccagctactcaagaggctgaggcaggagaatcgcctgaacccagaggcggaggttgtagtgagccgaaatcacaccattgcactccagcttgggcaacaatagcgaacctccatctcaaattaaaaaaaaaatgcctacacgctctttaaaatgcaaggctttctcttaaattagcctaactgaactgcgttgagctgcttcaactttggaatatatgtttgccaatctccttgttttctaatgaataaatgtttttatatactttta

SEQ ID NO: 365185 - DNA, 4023 bp, Homo sapiens
  misc_feature (3971)..(3971): n is a, c, g, or t
  misc_feature (3984)..(3984): n is a, c, g, or t
  misc_feature (3997)..(3997): n is a, c, g, or t
aagttttggagcgccggacaagctgaggtccgcgactcgtcgctaagattccccaaaactgagatttcaagaaaattcaccctttccgctttctttggcgcccttcaaccgtgaaggaaatgaaggttgagaacctggaacccgcttccaaagaccaagccctttctctgtgcctcacaacagtcttgcgctgtagctgtttttattacccctattttactactggggaggagatttgaggtcctgaaagtgaagtgacttgctggacgtcacttagcagaggagatggcgaaacctggattagaggcgatgccttctaactcccagcgtggacttgcctcctttcctgggggtgactgaatgcccagccagggacgcgacgtctctggccagcagaaatacggcctcctccccgccgactgggcaaagggggaccttgcggccaaggagggattcgcaggcgggccgggggtgggagcgggggccggagccggagccttggcccgcccccgggcggcgctgtgattggccggccgctccggcgggcgtcgcgattggccgtcctgcagccgttgagatttgaactcggtatttgtggctttgcccgcgcgttgccagactcagaggcggccctttgcctctgcctgccggggattggccggattctccgccgacttgaaaactgccttgctaattggtgcgtgttgtgcacgcgtgttttttccttttcatttcagcctgactgccggaatcagagccgcgggtgagatccccagccctgtgagcctgtaggagtagaatggctccccaaatgtatgagttccatctgccattatccccagaggagttgttgaaaagtggaggggtgaatcagtatgttgtgcaagaggtactgtccatcaaacatcttccaccacagcttagagcttttcaggctgcctttcgagctcaggggcccctggctatgctgcagcactttgatactatctacagcattttgcatcactttcgaagtatagatcctggcctcaaagaagatactctggaattcctgataaaagtggtatcccgccactcccaggagcttccagctatcctggatgatacaactttgagtggatcagatagaaacgcccatctaaatgccctcaaaatgaactgttatgctctgatacgtctcctggaatcctttgagaccatggccagccagacaaaccttgtggacctggaccttggtgggaagggtaagaaagctcggaccaaggcagcccatggctttgactgggaagaagagaggcaaccaattcttcagcttttaacacagctacttcagttggacatccgtcacctgtggaaccactcaataattgaagaagaatttgtcagtttggttactggctgttgctaccgccttctggagaatcccaccattaatcaccagaagaaccgccccactcgggaagccataacacacctgcttggtgtagccttgacccgttataaccatatgctcagtgctacagtgaagatcatccagatgctgcagcactttgaacacctggcacctgtactggttgcagccgtgagtctatgggcaactgactatggaatgaagagcatagtgggagagattgtaagagagattggacaaaagtgtccccaagagctgagtcgagacccttcagggacaaagggctttgcagcattcctgacagaactagcagaacgtgtcccagctatcctgatgtccagcatgtgcattttgctagatcacctggatggagaaaattacatgatgcgtaatgctgtgctggcagccatggcggagatggtgctgcaggttctcagtggcgatcaactggaagcagcagcccgagacaccagagaccagttcttggatactttacaagcccatggccatgatgtcaactcctttgtgcggagccgtgttttgcagctcttcacccgaattgtccagcagaaggctctccccctgacacgtttccaggcagtggtggctttagctgtgggacgtctggcagacaagtcagtgctagtatgtaaaaatgccatccagctgctggccagttttctagccaataatcctttctcctgcaagcttagtgatgctgaccttgccggaccactgcagaaggagacccagaaattacaagagatgagggcccagaggcgaactgcagcagcttctgcagtgctggacccagaggaggagtgggaagccatgctgccagagttgaagtctaccctgcagcagcttctacagcttccccagggagaggaggagattcctgagcaaattgccaatacagagacaactgaagatgtgaaaggacgcatctatcaactgcttgccaaagctagttacaaaaaggccatcattctcactcgagaagccacaggccacttccaggagtccgaacccttcagtcatatagacccagaggagtcagaggagaccaggctcttgaatatcttaggacttatcttcaaaggcccagcagcttccacacaagaaaagaatccccgggagtctacaggaaacatggtcacaggacagactgtctgtaaaaataaacccaatatgtcggatcctgaggaatccaggggaaatgatgaactagtgaagcaggagatgctggtacagtatctgcaggatgcctacagcttctcccggaagattacagaggccattggcataatcagcaagatgatgtatgaaaacacaactacagtggtgcaggaggtgattgaattctttgtgatggtcttccaatttggggtaccccaggccctgtttggggtgcgccgtatgctgcctctcatctggtctaaggagcctggtgtccgggaagccgtgcttaatgcctaccgccaactctacctcaaccccaaaggggactctgccagagccaaggcccaggctttgattcagaatctctctctgctgctagtggatgcctcggttgggaccattcagtgtcttgaggaaattctctgtgagtttgtgcagaaggatgagttgaaaccagcagtgacccagctgctgtgggagcgggccaccgagaaggtcgcctgctgtcctctggagcgctgttcctctgtcatgcttcttggcatgatggcacgaggaaagccagaaattgtgggaagcaatttagacacactggtgagcatagggctggatgagaagtttccacaggactacaggctggcccagcaggtgtgccatgccattgccaacatctcggacaggagaaagccttctctgggcaaacgtcacccccccttccggctgcctcaggaacacaggttgtttgagcgactgcgggagacagtcacaaaaggctttgtccacccagacccactctggatcccattcaaagaggtggcagtgaccctcatttaccaactggcagagggccccgaagtgatctgtgcccagatattgcagggctgtgcaaaacaggccctggagaagctagaagagaagagaaccagtcaggaggacccgaaggagtcccccgcaatgctccccactttcctgttgatgaacctgctgtccctggctggggatgtggctctgcagcagctggtccacttggagcaggcagtgagtggagagctctgccggcgccgagttctccgggaagaacaggagcacaagaccaaagatcccaaggagaagaatacgagctctgagaccaccatggaggaggagctggggctggttggggcaacagcagatgacacagaggcagaactaatccgtggcatctgcgagatggaactgttggatggcaaacagacactggctgcctttgttccactcttgcttaaagtctgtaacaacccaggcctctatagcaacccagacctctctgcagctgcttcacttgcccttggcaagttctgcatgatcagtgcccttttttggggaattccaaattttngcctttttgtttnaccattgcctggnaaaaaggtcttccactttccatttgg

SEQ ID NO: 365186 - DNA, 4102 bp, Homo sapiens
aagttttggagcgccggacaagctgaggtccgcgactcgtcgctaagattccccaaaactgagatttcaagaaaattcaccctttccgctttctttggcgcccttcaaccgtgaaggaaatgaaggttgagaacctggaacccgcttccaaagaccaagccctttctctgtgcctcacaacagtcttgcgctgtagctgtttttattacccctattttactactggggaggagatttgaggtcctgaaagtgaagtgacttgctggacgtcacttagcagaggagatggcgaaacctggattagaggcgatgccttctaactcccagcgtggacttgcctcctttcctgggggtgactgaatgcccagccagggacgcgacgtctctggccagcagaaatacggcctcctccccgccgactgggcaaagggggaccttgcggccaaggagggattcgcaggcgggccgggggtgggagcgggggccggagccggagccttggcccgcccccgggcggcgctgtgattggccggccgctccggcgggcgtcgcgattggccgtcctgcagccgttgagatttgaactcggtatttgtggctttgcccgcgcgttgccagactcagaggcggccctttgcctctgcctgccggggattggccggattctccgccgacttgaaaactgccttgctaattggtgcgtgttgtgcacgcgtgttttttccttttcatttcagcctgactgccggaatcagagccgcgggtgagatccccagccctgtgagcctgtaggagtagaatggctccccaaatgtatgagttccatctgccattatccccagaggagttgttgaaaagtggaggggtgaatcagtatgttgtgcaagaggtactgtccatcaaacatcttccaccacagcttagagcttttcaggctgcctttcgagctcaggggcccctggctatgctgcagcactttgatactatctacagcattttgcatcactttcgaagtatagatcctggcctcaaagaagatactctggaattcctgataaaagtggtatcccgccactcccaggagcttccagctatcctggatgatacaactttgagtggatcagatagaaacgcccatctaaatgccctcaaaatgaactgttatgctctgatacgtctcctggaatcctttgagaccatggccagccagacaaaccttgtggacctggaccttggtgggaagggtaagaaagctcggaccaaggcagcccatggctttgactgggaagaagagaggcaaccaattcttcagcttttaacacagctacttcagttggacatccgtcacctgtggaaccactcaataattgaagaagaatttgtcagtttggttactggctgttgctaccgccttctggagaatcccaccattaatcaccagaagaaccgccccactcgggaagccataacacacctgcttggtgtagccttgacccgttataaccatatgctcagtgctacagtgaagatcatccagatgctgcagcactttgaacacctggcacctgtactggttgcagccgtgagtctatgggcaactgactatggaatgaagagcatagtgggagagattgtaagagagattggacaaaagtgtccccaagagctgagtcgagacccttcagggacaaagggctttgcagcattcctgacagaactagcagaacgtgtcccagctatcctgatgtccagcatgtgcattttgctagatcacctggatggagaaaattacatgatgcgtaatgctgtgctggcagccatggcggagatggtgctgcaggttctcagtggcgatcaactggaagcagcagcccgagacaccagagaccagttcttggatactttacaagcccatggccatgatgtcaactcctttgtgcggagccgtgttttgcagctcttcacccgaattgtccagcagaaggctctccccctgacacgtttccaggcagtggtggctttagctgtgggacgtctggcagacaagtcagtgctagtatgtaaaaatgccatccagctgctggccagttttctagccaataatcctttctcctgcaagcttagtgatgctgaccttgccggaccactgcagaaggagacccagaaattacaagagatgagggcccagaggcgaactgcagcagcttctgcagtgctggacccagaggaggagtgggaagccatgctgccagagttgaagtctaccctgcagcagcttctacagcttccccagggagaggaggagattcctgagcaaattgccaatacagagacaactgaagatgtgaaaggacgcatctatcaactgcttgccaaagctagttacaaaaaggccatcattctcactcgagaagccacaggccacttccaggagtccgaacccttcagtcatatagacccagaggagtcagaggagaccaggctcttgaatatcttaggacttatcttcaaaggcccagcagcttccacacaagaaaagaatccccgggagtctacaggaaacatggtcacaggacagactgtctgtaaaaataaacccaatatgtcggatcctgaggaatccaggggaaatgatgaactagtgaagcaggagatgctggtacagtatctgcaggatgcctacagcttctcccggaagattacagaggccattggcataatcagcaagatgatgtatgaaaacacaactacagtggtgcaggaggtgattgaattctttgtgatggtcttccaatttggggtaccccaggccctgtttggggtgcgccgtatgctgcctctcatctggtctaaggagcctggtgtccgggaagccgtgcttaatgcctaccgccaactctacctcaaccccaaaggggactctgccagagccaaggcccaggctttgattcagaatctctctctgctgctagtggatgcctcggttgggaccattcagtgtcttgaggaaattctctgtgagtttgtgcagaaggatgagttgaaaccagcagtgacccagctgctgtgggagcgggccaccgagaaggtcgcctgctgtcctctggagcgctgttcctctgtcatgcttcttggcatgatggcacgaggaaagccagaaattgtgggaagcaatttagacacactggtgagcatagggctggatgagaagtttccacaggactacaggctggcccagcaggtgtgccatgccattgccaacatctcggacaggagaaagccttctctgggcaaacgtcacccccccttccggctgcctcaggaacacaggttgtttgagcgactgcgggagacagtcacaaaaggctttgtccacccagacccactctggatcccattcaaagaggtggcagtgaccctcatttaccaactggcagagggccccgaagtgatctgtgcccagatattgcagggctgtgcaaaacaggccctggagaagctagaagagaagagaaccagtcaggaggacccgaaggagtcccccgcaatgctccccactttcctgttgatgaacctgctgtccctggctggggatgtggctctgcagcagctggtccacttggagcaggcagtgagtggagagctctgccggcgccgagttctccgggaagaacaggagcacaagaccaaagatcccaaggagaagaatacgagctctgagaccaccatggaggaggagctggggctggttggggcaacagcagatgacacagaggcagaactaatccgtggcatctgcgagatggaactgttggatggcaaacagatgttactttaagccaccgacgaaagagagacccacaaagtacccagtgtgttaaagcccaaatctcttcttgcgtttgtttgtttttgctgtgcgagttccacccctatgaaaaagaaattgatccaaagttccaggttttcttgggtctctagtcaattttcacattagtatagattttttggacaaaggcacttgttcccatgtacccaatcgctccacacatcatcaccaggctgtgctaataccgccaatatcccaggcgcacgggatact

SEQ ID NO: 365187 - DNA, 289 bp, Homo sapiens
agtgtacactgtgtcgtttttgtctaagttgaagttgggccagttcccacccccaactcttactacttcactagtttgaatagcacgtgagcaaggggaagatcagtaaaaatcggattcaggtttgatgggacttaaaaatgtctctttgccccaccttccctctccctctcctccagaggagtcccccgcaatgctccccactttcctgttgatgaacctgctgtccctggctggggatgtggctctgcagcagctggtccacttggagcaggcagtgagtggagag

SEQ ID NO: 365188 - DNA, 2519 bp, Homo sapiens
  misc_feature (24)..(24): n is a, c, g, or t
  misc_feature (58)..(58): n is a, c, g, or t
  misc_feature (368)..(368): n is a, c, g, or t
  misc_feature (1235)..(1235): n is a, c, g, or t
gcactgtggctactggtatgttcntcattgatttaacaacttcaaccttcatcccagntgatatccattttacaaatgagaaagcaggctcaatgctatcactgaagtttccaaactactaatagagtaaatgggacctgagtatgtgtgggactcaggatgctctggttcccctcctccaccctggacacagctgtttcctctggttccttagctgggggctgtacggagcattccagcgagcaagcaggagctgagggctgaaggaagatgatgaggagtggaaaaataaagacagctaaaccttcaagatcgtattgacaagggcgtgtgtgtttgtgagaatgtgggtgtgatcattcttgttngttgattgccatcccctcctttcctttcatagatctggacatctgtcccttacttagcatcctacgtcagtcccgtgttaaaagaaaacaaggcgattccgcagtccccccgttccctggaggtcctgtggaatggtaagtaatcagcacaaagggggttaatcttaggcctgaggtttggggccgggtgacaaggaagttaaactcgtcctccctgccagattctaccccctttcggagctgagctccagccaaacctgtggagttttctttgaccattttaggacatgttactgcttctgagttggctcccccagctgcttaaacaagacctttctcctgggttcctagtagtgaaaaggagcagcagagcaactgaggaggagggcgggtgggaggcatgggactggggcttggggaggtcaggcgagaccggggtgagagctcagagaagctcctgtgacttccatgctaagatcttgccagagaactctggtcagtcctcgggtgtctggatgaagtaaaggagttaggcatttcttcctttgattctctggcttacctaatagagagagtcagatgtggtctgctggggatggacagagggtttgtagaagtctcctaggctttagtgacccatcctctgcctccgcctccatggtggccagcatgaaccaggattgtctgaaggggttgtatcctctaagccagcgacctggttttatgttgagcgaagaggcggacgccctccctagaggagagtgcagctggatcaggatgcttgtgcagaggatgccctgtctgcacatttaccagcgttttccctacccccagctccttgggggattctttttcctggagtcattnactactttttgcaaaggaagtatgctatgcttagtgcccaaaccaaaactgtcttcactttttctgtcctcctagaaagtgatcaattgagagccatggcaggagaaggaatggccagagaaggttactcagaagggaggatgaggggtggcttccctcaggtgaaggtttcacagagaagaattgagttttctcctcctaaccacatccagcacttgcccaatttccctcaatgtggaatgaaacccctgggccagtcactgcatttcccataaaaggaatgttatcttggaaagggcataaagcgtcagccaagtcagagaagttcagaaacatttccaggaatgcagttcatttggaagcccctggctttgcacttgcgtgtcttagagatagtgtgccttcaactttaccttctatccagggctatttcctgttgcatctgtcaaatgagggcagtgacttaaaagagtaatatggtcttcccagcttcgtcatcctctgcttcctgctgaccaggggacgttgccacggaatgtctaccctaggcattgaggcatctggcaactgcttgcttgtcactaaaaagtaagagaaagaaggacagattgcctgggtggagaagagtgggaggtggcctagtggagaaagcaggattaagagaagggagggaaagatttagggagtttggctaatggagccctttacctgttggaagggcagcaagcaaaagttttaccagagttttccctacccccagctccttgggggattttttgttttgtttcatttttgtttttgtttttttgccttgagtaattttgacatgcagagttattcacaactttttgcaaagtactattttcattggcttttcagagccagtgaagttgccttctcctccaacatgaccacattttcctctgagcagacaaaaacagaacaaataagtttgtgggcttgcttggaggttgaaagaaataagtccagttaaaatgagagttgagccaggtgccctggctcatgcctgtaatcccagcactttgggaactttgggaggcagataacctgaggtcaggagtttgagaccaacctgaccaacatggtgataccccatctccactaaaaatacaaaattagctgggtgtggtggctcatgcctgtagtcccagctacttgggaggctgaggcaggagaacccgggaggcagaggttgcagtgagctgagatcgcaccattgcactccagcctgggcaagaagagggaaactccatctcaaaaaaa

SEQ ID NO: 365189 - DNA, 927 bp, Homo sapiens
gattcttatattgtgtcttgggtatgtgtcgtcttcccaactgcactcgaagctacgttgtaaacttgagagcagcagctccattccatttactagtataggcgaggtcccagttagggttgccgtagatgtttgtatgtggcttcagtgagcgtgtgtctttgtgtacgtgggggtgaagtgaaggcgtgtttgtgggctggtttcccagctgcccagcctgactttctacagtcagcaggatggacctggagatgtcagggctgaagaccctggagcatgtggcagtgacagtctccatcactcacccacggcgcggcagcttggagctgaagctgttctgccccagtggcatgatgtccctcatcggcgccccccgcagcatggactcgtatgtacacccgcccgaggcctgagcaaccttttcagcaagggcctttccagggaaaagaaatggaagaagtggatcctggcactgtcctaaactactgtggcactggctatccctggcggctggaagcctttcgtcacataccttcttcaagcgctaggccctgcacctcacatacatgttctctaatccttctaagaaccccctagattagactttgtaacctccttttacaaatgaggaaactggctgggtgtggtggctcacacctgtaatcccagcactttgggaggtcaaggcaggagaatcacttgaactcaggagttcaagaccagcctgggcaacaaagtgagaccctgtctctacaaaaaatttaaagattagctgagcatggtggtacatgcctgtagtcccagctactcaggagactgaggtgggaggatcacttgaacccaggaagtcaaggctgcagtgagctgtgatcatgccactgcactccagcttggataacagagtgagaccctgtctccaaaaaa

SEQ ID NO: 365190 - DNA, 338 bp, Homo sapiens
atttcagtgggttttggggcatagggattgtcctgagttgtctggtacctgcctgggggtgattagggcggggaaataaaagctctgtgtgtcagagtctgatagaggaggtggtgggggcatgggctctggattgctcagggaaatggccttcccgccggaggccagctatctgcctgacaggctgtgactcttctctcaaccttggccttctcccctcttctgagctagttggttgaattttttttaatgcttaagatttgtttttctcttttcacagcaacattttcttgaatttttttctgcacagcttttccaaaataaaaaccttccaaaca

SEQ ID NO: 365191 - DNA, 3470 bp, Homo sapiens
ccaggctggtaccggcccgggggttaagtgatgcggcggcagctgcggcggggccggtctgtagcctttgctgagtcaacactactcacagtgaaagtgatgccttttctccatttgcacaacatgagtgtgacgtggttagccagaccaggagctcaacctcatgtagaatccagtccactgctctgatgccgaaggggaggcagaaagtgccacacttggatgcccccctgggcctgcccacctgcctctggctggaattagccgggctcttcttactggttccctgggtcatgggcctggcagggacaggtgggcctgatggccagggcacaggggggccgagctgggctgtgcacctggaaagcctggaaggtgacggggaggaagagactctggagcagcaggcggatgccttggcccaggcagcagggctggtgaatgctggacgcatcggagagcttcaggggcactacctctttgtccagcctgctgggcacaggccggccctggaggtggaggccatccggcagcaggtggaggctgtgttggctgggcatgaagctgtgcgctggcactcagagcagaggctgctaaggcgggccaagcgcagcgtccacttcaacgaccccaagtacccgcagcaatggcacctgaataaccgacggagcccgggcagggacatcaacgtgacgggtgtgtgggaacgcaatgtgactgggcgaggggtgacggtggtggtagtggatgacggagtggaacacaccatccaggacattgcacccaactatagccctgagggtagctatgacctcaactctaatgaccctgaccccatgccccacccggatgtggagaatggcaaccaccatggcacgcgatgtgcaggagagatcgcggctgtgcccaacaacagcttctgtgccgtgggcgtggcctacgggagccgcatcgcaggtatccgggtactggatggacctctcacagacagcatggaggcagtggcgttcaacaagcactatcagatcaatgacatctacagctgcagctggggaccagatgacgatgggaagacagtggatggcccccatcagcttggaaaggctgccttacaacatggggtgattgctggtcgccagggctttgggagcatctttgtggtagccagtggcaacggaggccaacacaacgacaactgcaactacgatggctacgccaactccatctacaccgtcaccataggagctgtggatgaggagggacgcatgcctttctatgcagaagaatgtgcctccatgctggcagtcaccttcagtggtggggacaagatgcttcggagcattgtgaccactgactgggaccttcagaagggcactggctgcactgagggccacacagggacctcagctgcagcgcctctggcagctggcatgatagccttaatgctgcaggtgcggccctgcctcacgtggcgtgacgtccagcacatcattgtcttcacagccacccggtatgaggatcgccgtgcagagtgggtcaccaacgaggcaggcttcagccatagccaccagcacggtttcggcctcctcaacgcctggaggctcgtgaatgcagccaagatctggacatctgtcccttacttagcatcctacgtcagtcccgtgttaaaagaaaacaaggcgattccgcagtccccccgttccctggaggtcctgtggaatgtcagcaggatggacctggagatgtcagggctgaagaccctggagcatgtggcagtgacagtctccatcactcacccacggcgcggcagcttggagctgaagctgttctgccccagtggcatgatgtccctcatcggcgccccccgcagcatggactcggatcccaacggcttcaatgactggaccttctccactgtgcgatgctggggggagagagcccgagggacctacaggctggtcatcagggatgtcggggatgagtcattccaggtcggcatcctccggcaatggcagctgaccctatatggctctgtgtggagtgcagtagacatcagggacagacaaaggctgttagagagtgccatgagtggaaaatacctgcacgatgacttcgccctgccctgcccaccggggctgaaaattcctgaggaagatggttacaccatcacccccaacaccctcaagaccctggtgctggtaggctgtttcaccgtcttctggactgtttactacatgctggaagtatatttgagccagaggaatgtggcttccaatcaagtttgtaggagtggaccctgccactggccccatcggagccggaaagccaaggaggaagggacagagctagaatcagtgccactttgcagcagcaaggatccagacgaagtggaaacagagagcaggggccctcccaccacctctgacctccttgccccagacctgctggagcaaggggactggagcctgtcccagaacaagagcgccctggactgccctcatcagcacctagacgtaccgcacgggaaggaggagcagatctgctgacctcagggcctgacagtgtgggacaggctcttctttcccaaaattagggagctcttgacagaaagcagttctgatgcttacatctggaatctgaggcatcctctgactccactcaaagagggtgagggccttcttaagatacaaatggtggaggattgctgccagagaagtctggtcagagccacagggtctgcctccagccaaacgggagcttttggtgagaaggtgttggacaggggattggcgcccccctttggtttggcctccatcctcatctctcttgggccaagccagctgcctaggtcccccaagcatgggggaccccttcccacatataagttgagaaggtgcctgccatagccaggagcgcatctcaatggaaacatcactggggtcacttgggaagaggacttcggggtagaggctgggaggagcccctggacatgcctgtcctgaaagcggctgcctccattatccattcccaagatgcctgatcagaaaccaaccatgaatgaacccctggctccttcaccacccccacgattggtatgatgctgccggcacagctgggatacacacggctcccccaggcctgagctgcttcactagggaatcctgcggcaggactgcagagcagatggcagatgcacatgttggaggagagagccttgggagccactgccactccagtcctgccaccaccctgtcttcctctgcaagtgctcagggaaatggccttcccgccggaggccagctatctgcctgacaggctgtgactcttctctcaaccttggccttctcccctcttctgagctagttggttgaattttttttaatgcttaagatttgtttttctcttttcacagcaacattttcttgaatttttttctgcacagcttttccaaaataaaaaccttccaaaca

SEQ ID NO: 365192 - DNA, 4104 bp, Homo sapiens
agaggccgcggtggcgccgcgccgcccccgacggcgccctctggcggcgacagctggcgccgccggggcacggggatgctgcgggagacccctgagatacaagtggactctcccggggcgcggggaagaagggagagccgactgcgagaaggaaggcgacctgggtgggcaggatcccctctgggaagattacagggacagtcggggccatggcggtcagaaggagaagagcaacgagtggcttttaaaggtcggaaccgaaatgccctttacagaggacgccatgaaggagagccttctgaagagggaccatgtggaagatgccccgaggactcggggaggcggagcccgcgggttcagcccccagcgcccgcacggcccctgcctgcgtaggccgcccgcgggagccggaccccgggcgccggttgctgtggcccgcgggggtcgccgggccgcaggcgccgcgctgattggctgcgccgcgggcggaagtgatgctgctgtcactgctcctccggctcccgggaagccgcgagtttccgcagggaggcggcggcagctgcggcggggccggtctgtagcctttgctgagtcaacactactcacagtgaaagtgatgccttttctccatttgcacaacatgagtgtgacgtggttagccagaccaggagctcaacctcatgtagaatccagtccactgctctgatgccgaaggggaggcagaaagtgccacacttggatgcccccctgggcctgcccacctgcctctggctggaattagccgggctcttcttactggttccctgggtcatgggcctggcagggacaggtgggcctgatggccagggcacaggggggccgagctgggctgtgcacctggaaagcctggaaggtgacggggaggaagagactctggagcagcaggcggatgccttggcccaggcagcagggctggtgaatgctggacgcatcggagagcttcaggggcactacctctttgtccagcctgctgggcacaggccggccctggaggtggaggccatccggcagcaggtggaggctgtgttggctgggcatgaagctgtgcgctggcactcagagcagaggctgctaaggcgggccaagcgcagcgtccacttcaacgaccccaagtacccgcagcaatggcacctgaataaccgacggagcccgggcagggacatcaacgtgacgggtgtgtgggaacgcaatgtgactgggcgaggggtgacggtggtggtagtggatgacggagtggaacacaccatccaggacattgcacccaactatagccctgagggtagctatgacctcaactctaatgaccctgaccccatgccccacccggatgtggagaatggcaaccaccatggcacgcgatgtgcaggagagatcgcggctgtgcccaacaacagcttctgtgccgtgggcgtggcctacgggagccgcatcgcaggtatccgggtactggatggacctctcacagacagcatggaggcagtggcgttcaacaagcactatcagatcaatgacatctacagctgcagctggggaccagatgacgatgggaagacagtggatggcccccatcagcttggaaaggctgccttacaacatggggtgattgctggtcgccagggctttgggagcatctttgtggtagccagtggcaacggaggccaacacaacgacaactgcaactacgatggctacgccaactccatctacaccgtcaccatagataggactagccctgcttgcagaggaccttgggacttcttagatgtcagcataccctgggaacaccttcaagccatcatctggagatcaccgagctgcctccaccccaccacagctggagctgtggatgaggagggacgcatgcctttctatgcagaagaatgtgcctccatgctggcagtcaccttcagtggtggggacaagatgcttcggagcattgtgaccactgactgggaccttcagaagggcactggctgcactgagggccacacagggacctcagctgcagcgcctctggcagctggcatgatagccttaatgctgcaggtgcggccctgcctcacgtggcgtgacgtccagcacatcattgtcttcacagccacccggtatgaggatcgccgtgcagagtgggtcaccaacgaggcaggcttcagccatagccaccagcacggtttcggcctcctcaacgcctggaggctcgtgaatgcagccaagatctggacatctgtcccttacttagcatcctacgtcagtcccgtgttaaaagaaaacaaggcgattccgcagtccccccgttccctggaggtcctgtggaatgtcagcaggatggacctggagatgtcagggctgaagaccctggagcatgtggcagtgacagtctccatcactcacccacggcgcggcagcttggagctgaagctgttctgccccagtggcatgatgtccctcatcggcgccccccgcagcatggactcggatcccaacggcttcaatgactggaccttctccactgtgcgatgctggggggagagagcccgagggacctacaggctggtcatcagggatgtcggggatgagtcattccaggtcggcatcctccggcaatggcagctgaccctatatggctctgtgtggagtgcagtagacatcagggacagacaaaggctgttagagagtgccatgagtggaaaatacctgcacgatgacttcgccctgccctgcccaccggggctgaaaattcctgaggaagatggttacaccatcacccccaacaccctcaagaccctggtgctggtaggctgtttcaccgtcttctggactgtttactacatgctggaagtatatttgagccagaggaatgtggcttccaatcaagtttgtaggagtggaccctgccactggccccatcggagccggaaagccaaggaggaagggacagagctagaatcagtgccactttgcagcagcaaggatccagacgaagtggaaacagagagcaggggccctcccaccacctctgacctccttgccccagacctgctggagcaaggggactggagcctgtcccagaacaagagcgccctggactgccctcatcagcacctagacgtaccgcacgggaaggaggagcagatctgctgacctcagggcctgacagtgtgggacaggctcttctttcccaaaattagggagctcttgacagaaagcagttctgatgcttacatctggaatctgaggcatcctctgactccactcaaagagggtgagggccttcttaagatacaaatggtggaggattgctgccagagaagtctggtcagagccacagggtctgcctccagccaaacgggagcttttggtgagaaggtgttggacaggggattggcgcccccctttggtttggcctccatcctcatctctcttgggccaagccagctgcctaggtcccccaagcatgggggaccccttcccacatataagttgagaaggtgcctgccatagccaggagcgcatctcaatggaaacatcactggggtcacttgggaagaggacttcggggtagaggctgggaggagcccctggacatgcctgtcctgaaagcggctgcctccattatccattcccaagatgcctgatcagaaaccaaccatgaatgaacccctggctccttcaccacccccacgattggtatgatgctgccggcacagctgggatacacacggctcccccaggcctgagctgcttcactagggaatcctgcggcaggactgcagagcagatggcagatgcacatgttggaggagagagccttgggagccactgccactccagtcctgccaccaccctgtcttcctctgcaagtgctcagggaaatggccttcccgccggaggccagctatctgcctgacaggctgtgactcttctctcaaccttggccttctcccctcttctgagctagttggttgaattttttttaatgcttaagatttgtttttctcttttcacagcaacattttcttgaatttttttctgcacagcttttccaaaataaaaaccttccaaaca

SEQ ID NO: 365193 - DNA, 4215 bp, Homo sapiens
agaggccgcggtggcgccgcgccgcccccgacggcgccctctggcggcgacagctggcgccgccggggcacggggatgctgcgggagacccctgagatacaagtggactctcccggggcgcggggaagaagggagagccgactgcgagaaggaaggcgacctgggtgggcaggatcccctctgggaagattacagggacagtcggggccatggcggtcagaaggagaagagcaacgagtggcttttaaaggtcggaaccgaaatgccctttacagaggacgccatgaaggagagccttctgaagagggaccatgtggaagatgccccgaggactcggggaggcggagcccgcgggttcagcccccagcgcccgcacggcccctgcctgcgtaggccgcccgcgggagccggaccccgggcgccggttgctgtggcccgcgggggtcgccgggccgcaggcgccgcgctgattggctgcgccgcgggcggaagtgatgctgctgtcactgctcctccggctcccgggaagccgcgagtttccgcagggaggcggcggcagctgcggcggggccggtctgtagcctttgctgagtcaacactactcacagtgaaagtgatgccttttctccatttgcacaacatgagtgtgacgtggttagccagaccaggagctcaacctcatgtagaatccagtccactgctctgatgccgaaggggaggcagaaagtgccacacttggatgcccccctgggcctgcccacctgcctctggctggaattagccgggctcttcttactggttccctgggtcatgggcctggcagggacaggtgggcctgatggccagggcacaggggggccgagctgggctgtgcacctggaaagcctggaaggtgacggggaggaagagactctggagcagcaggcggatgccttggcccaggcagcagggctggtgaatgctggacgcatcggagagcttcaggggcactacctctttgtccagcctgctgggcacaggccggccctggaggtggaggccatccggcagcaggtggaggctgtgttggctgggcatgaagctgtgcgctggcactcagagcagaggctgctaaggcgggccaagcgcagcgtccacttcaacgaccccaagtacccgcagcaatggcacctgaataaccgacggagcccgggcagggacatcaacgtgacgggtgtgtgggaacgcaatgtgactgggcgaggggtgacggtggtggtagtggatgacggagtggaacacaccatccaggacattgcacccaactatagccctgagggtagctatgacctcaactctaatgaccctgaccccatgccccacccggatgtggagaatggcaaccaccatggcacgcgatgtgcaggagagatcgcggctgtgcccaacaacagcttctgtgccgtgggcgtggcctacgggagccgcatcgcaggtatccgggtactggatggacctctcacagacagcatggaggcagtggcgttcaacaagcactatcagatcaatgacatctacagctgcagctggggaccagatgacgatgggaagacagtggatggcccccatcagcttggaaaggctgccttacaacatggggtgattgctggtcgccagggctttgggagcatctttgtggtagccagtggcaacggaggccaacacaacgacaactgcaactacgatggctacgccaactccatctacaccgtcaccataggagctgtggatgaggagggacgcatgcctttctatgcagaagaatgtgcctccatgctggcagtcaccttcagtggtggggacaagatgcttcggagcattgtgaccactgactgggaccttcagaagggcactggctgcactgagggccacacagggacctcagctgcagcgcctctggcagctggcatgatagccttaatgctgcaggtgcggccctgcctcacgtggcgtgacgtccagcacatcattgtcttcacagccacccggtatgaggatcgccgtgcagagtgggtcaccaacgaggcaggcttcagccatagccaccagcacggtttcggcctcctcaacgcctggaggctcgtgaatgcagccaagatctggacatctgtcccttacttagcatcctacgtcagtcccgtgttaaaagaaaacaaggcgattccgcagtccccccgttccctggaggtcctgtggaatgtcagcaggatggacctggagatgtcagggctgaagaccctggagcatgtggcagtgacagtctccatcactcacccacggcgcggcagcttggagctgaagctgttctgccccagtggcatgatgtccctcatcggcgccccccgcagcatggactcggatcccaacggcttcaatgactggaccttctccactgtgcgatgctggggggagagagcccgagggacctacaggctggtcatcagggatgtcggggatgagtcattccaggtcggcatcctccggcaatggcagctgaccctatatggctctgtgtggagtgcagtagacatcagggacagacaaaggctgttagagagtgccatgagtggaaaatacctgcacgatgacttcgccctgccctgcccaccggggctgaaaattcctgaggaagatggttacaccatcacccccaacaccctcaagaccctggtgctggtaggctgtttcaccgtcttctggactgtttactacatgctggaagtatatttgagccagaggaatgtggcttccaatcaagtttgtaggagtggaccctgccactggccccatcggagccggaaagccaaggaggaagggacagagctagaatcagtgccactttgcagcagcaaggatccagacgaagtggaaacagagagcaggggccctcccaccacctctgacctccttgccccagacctgctggagcaaggggactggagcctgtcccagaacaagagcgccctggactgccctcatcagcacctagacgtaccgcacgggaaggaggagcagatctgctgacctcagggcctgacagtgtgggacaggctcttctttcccaaaattagggagctcttgacagaaagcagttctgatgcttacatctggaatctgaggcatcctctgactccactcaaagagggtgagggccttcttaagatacaaatggtggaggattgctgccagagaagtctggtcagagccacagggtctgcctccagccaaacgggagcttttggtgagaaggtgttggacaggggattggcgcccccctttggtttggcctccatcctcatctctcttgggccaagccagctgcctaggtcccccaagcatgggggaccccttcccacatataagttgagaaggtgcctgccatagccaggagcgcatctcaatggaaacatcactggggtcacttgggaagaggacttcggggtagaggctgggaggagcccctggacatgcctgtcctgaaagcggctgcctccattatccattcccaagatgcctgatcagaaaccaaccatgaatgaacccctggctccttcaccacccccacgattggtatgatgctgccggcacagctgggatacacacggctcccccaggcctgagctgcttcactagggaatcctgcggcaggactgcagagcagatggcagatgcacatgttggaggagagagccttgggagccactgccactccagtcctgccaccaccctgtcttcctctgcaagtgctcagggaaatggccttcccgccggaggccagctatctgcctgacaggctgtgactcttctctcaaccttggccttctcccctcttctgagctagttggttgaattttttttaatgcttaagatttgtttttctcttttcacagcaacattttcttgaatttttttctgcacagcttttccaaaataaaaaccttccaaacaattctgccactcgcaatctctcctttcctctgtctccccaaagccactgcatgctgctgagtggctcctttttcccttcggtccccaagattcactctcctgttctatggcctgtttcctctgaaagaatctgactgtcctggaatcttggcacatgaagggtccttcagaggacggcagccaggaacacatacaagcccgagatgcctgcctgtcccctgcgcagat

SEQ ID NO: 365194 - DNA, 2357 bp, Homo sapiens
agaggccgcggtggcgccgcgccgcccccgacggcgccctctggcggcgacagctggcgccgccggggcacggggatgctgcgggagacccctgagatacaagtggactctcccggggcgcggggaagaagggagagccgactgcgagaaggaaggcgacctgggtgggcaggatcccctctgggaagattacagggacagtcggggccatggcggtcagaaggagaagagcaacgagtggcttttaaaggtcggaaccgaaatgccctttacagaggacgccatgaaggagagccttctgaagagggaccatgtggaagatgccccgaggactcggggaggcggagcccgcgggttcagcccccagcgcccgcacggcccctgcctgcgtaggccgcccgcgggagccggaccccgggcgccggttgctgtggcccgcgggggtcgccgggccgcaggcgccgcgctgattggctgcgccgcgggcggaagtgatgctgctgtcactgctcctccggctcccgggaagccgcgagtttccgcagggaggcggcggcagctgcggcggggccggtctgtagcctttgctgagtcaacactactcacagtgaaagtgatgccttttctccatttgcacaacatgagtgtgacgtggttagccagaccaggagctcaacctcatgtagaatccagtccactgctctgatgccgaaggggaggcagaaagtgccacacttggatgcccccctgggcctgcccacctgcctctggctggaattagccgggctcttcttactggttccctgggtcatgggcctggcagggacaggtgggcctgatggccagggcacaggggggccgagctgggctgtgcacctggaaagcctggaaggtgacggggaggaagagactctggagcagcaggcggatgccttggcccaggcagcagggctggtgaatgctggacgcatcggagagcttcaggggcactacctctttgtccagcctgctgggcacaggccggccctggaggtggaggccatccggcagcaggtggaggctgtgttggctgggcatgaagctgtgcgctggcactcagagcagaggctgctaattactacatgctggaagtatatttgagccagaggaatgtggcttccaatcaagtttgtaggagtggaccctgccactggccccatcggagccggaaagccaaggaggaagggacagagctagaatcagtgccactttgcagcagcaaggatccagacgaagtggaaacagagagcaggggccctcccaccacctctgacctccttgccccagacctgctggagcaaggggactggagcctgtcccagaacaagagcgccctggactgccctcatcagcacctagacgtaccgcacgggaaggaggagcagatctgctgacctcagggcctgacagtgtgggacaggctcttctttcccaaaattagggagctcttgacagaaagcagttctgatgcttacatctggaatctgaggcatcctctgactccactcaaagagggtgagggccttcttaagatacaaatggtggaggattgctgccagagaagtctggtcagagccacagggtctgcctccagccaaacgggagcttttggtgagaaggtgttggacaggggattggcgcccccctttggtttggcctccatcctcatctctcttgggccaagccagctgcctaggtcccccaagcatgggggaccccttcccacatataagttgagaaggtgcctgccatagccaggagcgcatctcaatggaaacatcactggggtcacttgggaagaggacttcggggtagaggctgggaggagcccctggacatgcctgtcctgaaagcggctgcctccattatccattcccaagatgcctgatcagaaaccaaccatgaatgaacccctggctccttcaccacccccacgattggtatgatgctgccggcacagctgggatacacacggctcccccaggcctgagctgcttcactagggaatcctgcggcaggactgcagagcagatggcagatgcacatgttggaggagagagccttgggagccactgccactccagtcctgccaccaccctgtcttcctctgcaagtgctcagggaaatggccttcccgccggaggccagctatctgcctgacaggctgtgactcttctctcaaccttggccttctcccctcttctgagctagttggttgaattttttttaatgcttaagatttgtttttctcttttcacagcaacattttcttgaatttttttctgcacagcttttccaaaataaaaaccttccaaaca

SEQ ID NO: 365195 - DNA, 3879 bp, Homo sapiens
agaggccgcggtggcgccgcgccgcccccgacggcgccctctggcggcgacagctggcgccgccggggcacggggatgctgcgggagacccctgagatacaagtggactctcccggggcgcggggaagaagggagagccgactgcgagaaggaaggcgacctgggtgggcaggatcccctctgggaagattacagggacagtcggggccatggcggtcagaaggagaagagcaacgagtggcttttaaaggtcggaaccgaaatgccctttacagaggacgccatgaaggagagccttctgaagagggaccatgtggaagatgccccgaggactcggggaggcggagcccgcgggttcagcccccagcgcccgcacggcccctgcctgcgtaggccgcccgcgggagccggaccccgggcgccggttgctgtggcccgcgggggtcgccgggccgcaggcgccgcgctgattggctgcgccgcgggcggaagtgatgctgctgtcactgctcctccggctcccgggaagccgcgagtttccgcagggaggcggcggcagctgcggcggggccggtctgtagcctttgctgagtcaacactactcacagtgaaagtgatgccttttctccatttgcacaacatgagtgtgacgtggttagccagaccaggagctcaacctcatgtagaatccagtccactgctctgatgccgaaggggaggcagaaagtgccacacttggatgcccccctgggcctgcccacctgcctctggctggaattagccgggctcttcttactggttccctgggtcatgggcctggcagggacaggtgggcctgatggccagggcacaggggggccgagctgggctgtgcacctggaaagcctggaaggtgacggggaggaagagactctggagcagcaggcggatgccttggcccaggcagcagggctggtgaatgctggacgcatcggagagcttcaggggcactacctctttgtccagcctgctgggcacaggccggccctggaggtggaggccatccggcagcaggtggaggctgtgttggctgggcatgaagctgtgcgctggcactcagagcagaggctgctaaggcgggccaagcgcagcgtccacttcaacgaccccaagtacccgcagcaatggcacctgaataaccgacggagcccgggcagggacatcaacgtgacgggtgtgtgggaacgcaatgtgactgggcgaggggtgacggtggtggtagtggatgacggagtggaacacaccatccaggacattgcacccaactatagccctgagggtagctatgacctcaactctaatgaccctgaccccatgccccacccggatgtggagaatggcaaccaccatggcacgcgatgtgcaggagagatcgcggctgtgcccaacaacagcttctgtgccgtgggcgtggcctacgggagccgcatcgcaggtatccgggtactggatggacctctcacagacagcatggaggcagtggcgttcaacaagcactatcagatcaatgacatctacagctgcagctggggaccagatgacgatgggaagacagtggatggcccccatcagcttggaaaggctgccttacaacatggggtgattgctggtcgccagggctttgggagcatctttgtggtagccagtggcaacggaggccaacacaacgacaactgcaactacgatggctacgccaactccatctacaccgtcaccataggagctgtggatgaggagggacgcatgcctttctatgcagaagaatgtgcctccatgctggcagtcaccttcagtggtggggacaagatgcttcggagcattgtgaccactgactgggaccttcagaagggcactggctgcactgagggccacacagggacctcagctgcagcgcctctggcagctggcatgatagccttaatgctgcaggtgcggccctgcctcacgtggcgtgacgtccagcacatcattgtcttcacagccacccggtatgaggatcgccgtgcagagtgggtcaccaacgaggcaggcttcagccatagccaccagcacggtttcggcctcctcaacgcctggaggctcgtgaatgcagccaagatctggacatctgtcccttacttagcatcctacgtcagtcccgtgttaaaagaaaacaaggcgattccgcagtccccccgttccctggaggtcctgtggaatgtcagcaggatggacctggagatgtcagggctgaagaccctggagcatgtggcagtgacagtctccatcactcacccacggcgcggcagcttggagctgaagctgttctgccccagtggcatgatgtccctcatcggcgccccccgcagcatggactcggatcccaacggcttcaatgactggaccttctccactgtgcgatgctggggggagagagcccgagggacctacaggctggtcatcagggatgtcggggatgagtcattccaggtcggcatcctccggcaatggcagctgaccctatatggctctgtgtggagtgcagtagacatcagggacagacaaaggctgttagagagtgccatgagtggaaaatacctgcacgatgacttcgccctgccctgcccaccggggctgaaaattcctgaggaagatggttacaccatcacccccaacaccctcaagaccctggtgctggtaggctgtttcaccgtcttctggactgtttactacatgctggaagtatatttgagccagaggaatgtggcttccaatcaagtttgtaggagtggaccctgccactggccccatcggagccggaaagccaaggaggaagggacagagctagaatcagtgccactttgcagcagcaaggatccagacgaagtggaaacagagagcaggggccctcccaccacctctgacctccttgccccagacctgctggagcaaggggactggagcctgtcccagaacaagagcgccctggactgccctcatcagcacctagacgtaccgcacgggaaggaggagcagatctgctgacctcagggcctgacagtgtgggacaggctcttctttcccaaaattagggagctcttgacagaaagcagttctgatgcttacatctggaatctgaggcatcctctgactccactcaaagagggtgagggccttcttaagatacaaatggtggaggattgctgccagagaagtctggtcagagccacagggtctgcctccagccaaacgggagcttttggtgagaaggtgttggacaggggattggcgcccccctttggtttggcctccatcctcatctctcttgggccaagccagctgcctaggtcccccaagcatgggggaccccttcccacatataagttgagaaggtgcctgccatagccaggagcgcatctcaatggaaacatcactggggtcacttgggaagaggacttcggggtagaggctgggaggagcccctggacatgcctgtcctgaaagcggctgcctccattatccattcccaagatgcctgatcagaaaccaaccatgaatgaacccctggctccttcaccacccccacgattggtatgatgctgccggcacagctgggatacacacggctcccccaggcctcctgtcttcctctgcaagtgctcagggaaatggccttcccgccggaggccagctatctgcctgacaggctgtgactcttctctcaaccttggccttctcccctcttctgagctagttggttgaattttttttaatgcttaagatttgtttttctcttttcacagcaacattttcttgaatttttttctgcacagcttttccaaaataaaaaccttccaaaca

SEQ ID NO: 365196 - DNA, 2131 bp, Homo sapiens
agaggccgcggtggcgccgcgccgcccccgacggcgccctctggcggcgacagctggcgccgccggggcacggggatgctgcgggagacccctgagatacaagtggactctcccggggcgcggggaagaagggagagccgactgcgagaaggaaggcgacctgggtgggcaggatcccctctgggaagattacagggacagtcggggccatggcggtcagaaggagaagagcaacgagtggcttttaaaggtcggaaccgaaatgccctttacagaggacgccatgaaggagagccttctgaagagggaccatgtggaagatgccccgaggactcggggaggcggagcccgcgggttcagcccccagcgcccgcacggcccctgcctgcgtaggccgcccgcgggagccggaccccgggcgccggttgctgtggcccgcgggggtcgccgggccgcaggcgccgcgctgattggctgcgccgcgggcggaagtgatgctgctgtcactgctcctccggctcccgggaagccgcgagtttccgcagggaggcggcggcagctgcggcggggccggtctgtagcctttgctgagtcaacactactcacagtgaaagtgatgccttttctccatttgcacaacatgagtgtgacgtggttagccagaccaggagctcaacctcatgtagaatccagtccactgctctgatgccgaaggggaggcagaaagtgccacacttggatgcccccctgggcctgcccacctgcctctggctggaattagccgggctcttcttactggttccctgggtcatgggcctggcagggacaggtgggcctgatggccagggcacaggggggccgagctgggctgtgcacctggaaagcctggaaggtgacggggaggaagagactctggagcagcaggcggatgccttggcccaggcagcagggctggtgaatgctggacgcatcggagagcttcaggggcactacctctttgtccagcctgctgggcacaggccggccctggaggtggaggccatccggcagcaggtggaggctgtgttggctgggcatgaagctgtgcgctggcactcagagcagaggctgctaaggcgggccaagcgcagcgtccacttcaacgaccccaagtacccgcagcaatggcacctgaataaccgacggagcccgggcagggacatcaacgtgacgggtgtgtgggaacgcaatgtgactgggcgaggggtgacggtggtggtagtggatgacggagtggaacacaccatccaggacattgcacccaactatagccctgagggtagctatgacctcaactctaatgaccctgaccccatgccccacccggatgtggagaatggcaaccaccatggcacgcgatgtgcaggagagatcgcggctgtgcccaacaacagcttctgtgccgtgggcgtggcctacgggagccgcatcgcaggtatccgggtactggatggacctctcacagacagcatggaggcagtggcgttcaacaagcactatcagatcaatgacatctacagctgcagctggggaccagatgacgatgggaagacagtggatggcccccatcagcttggaaaggctgccttacaacatggggtgattgctggtcgccagggctttgggagcatctttgtggtagccagtggcaacggaggccaacacaacgacaactgcaactacgatggctacgccaactccatctacaccgtcaccataggtagtcacccaatgtttctgtgctcctgtgtgtgtgtcaccgaagggttagggcatcacacgtcttgtcctagcttctgtgtgtgtctaaatgtgtgagcacaataatctctttgggctcagataggactagccctgcttgcagaggaccttgggacttcttagatgtcagcataccctgggaacaccttcaagccatcatctggagatcaccgagctgcctccaccccaccacagctggttaggcctctgctctggcctgtctttctgtgggccaccttctgcctgctggaagcctcccctgactccccacaggcctaaattaagtgccctttgcctgtgctcccagttagcatgtgtttatttacttacc

SEQ ID NO: 365197 - DNA, 1873 bp, Homo sapiens
agaggccgcggtggcgccgcgccgcccccgacggcgccctctggcggcgacagctggcgccgccggggcacggggatgctgcgggagacccctgagatacaagtggactctcccggggcgcggggaagaagggagagccgactgcgagaaggaaggcgacctgggtgggcaggatcccctctgggaagattacagggacagtcggggccatggcggtcagaaggagaagagcaacgagtggcttttaaaggtcggaaccgaaatgccctttacagaggacgccatgaaggagagccttctgaagagggaccatgtggaagatgccccgaggactcggggaggcggagcccgcgggttcagcccccagcgcccgcacggcccctgcctgcgtaggccgcccgcgggagccggaccccgggcgccggttgctgtggcccgcgggggtcgccgggccgcaggcgccgcgctgattggctgcgccgcgggcggaagtgatgctgctgtcactgctcctccggctcccgggaagccgcgagtttccgcagggaggcggcggcagctgcggcggggccggtctgtagcctttgctgagtcaacactactcacagtgaaagtgatgccttttctccatttgcacaacatgagtgtgacgtggttagccagaccaggagctcaacctcatgtagaatccagtccactgctctgatgccgaaggggaggcagaaagtgccacacttggatgcccccctgggcctgcccacctgcctctggctggaattagccgggctcttcttactggttccctgggtcatgggcctggcagggacaggtgggcctgatggccagggcacaggggggccgagctgggctgtgcacctggaaagcctggaaggtgacggggaggaagagactctggagcagcaggcggatgccttggcccaggcagcagggctggtgaatgctggacgcatcggagagcttcaggggcactacctctttgtccagcctgctgggcacaggccggccctggaggtggaggccatccggcagcaggtggaggctgtgttggctgggcatgaagctgtgcgctggcactcagagcagaggctgctaaggcgggccaagcgcagcgtccacttcaacgaccccaagtacccgcagcaatggcacctgaataaccgacggagcccgggcagggacatcaacgtgacgggtgtgtgggaacgcaatgtgactgggcgaggggtgacggtggtggtagtggatgacggagtggaacacaccatccaggacattgcacccaactatagccctgagggtagctatgacctcaactctaatgaccctgaccccatgccccacccggatgtggagaatggcaaccaccatggcacgcgatgtgcaggagagatcgcggctgtgcccaacaacagcttctgtgccgtgggcgtggcctacgggagccgcatcgcaggtatccgggtactggatggacctctcacagacagcatggaggcagtggcgttcaacaagcactatcagatcaatgacatctacagctgcagccttctagctctgtgcaggatacccggccatcctagacacttgtcacagcactgcccatccaggccaggctcagcccctactccagacacctctctgaacttgaacaccaggaaagaggataccaggtctttggaggtctagagcaggggtcagtaaactgtttttgtaaaggataagacagaacatattttaggctttgcaggacacatggtctctgctgttgcagtgtgaaagcagccatagacaatatgtaacaaatgaacatggctttgttccaataaaactttacttacaaaagcagacagca

SEQ ID NO: 365198 - DNA, 1944 bp, Homo sapiens
gcccatgagctgtagtttgacaacccttggtctagaacattctttgccaagaccagctacagagccactggagagaccttccagaagccacattgcccccacagaatacagccagctggtgcctttgtccagctgcgggtgtgagggtttactgcctctgcctcaagcaaccattacctcccactctcacccagaagcaggccctggcctggaagcccgaactccagaactccagctcttttcaggtcagctcagcttctggtctgcagctgaagagactaaaactcgcccaccccaggcaagggcgacgaagccaccaaagcccaagagttcttggcaaagaagctgcatttcctcagagaaatcagagacacctggtctacccatcgacttcccctcatgcccttacgctctcgtaaggctacccttacggagtagcctgagtaaccaagaagtcagagtcccccagggatcttccagagccaagagtctgcctgccagggaatgggaagcctggccccatccagcaactgccaccctgagggcctgggcctggcactgctcaggagtcccactcatggagaggggtggcagcaggagtgggccaggcaggtaggtccctgggcagacagacaggggtggctgggaacaggaacaggaaactgacctgtccactgatgtcaccctagggtgctgtgccttctctccagtgtttgtctgaagagacttccaaaagaggtaccaaaggaagccgaacccatcccctggcctcagaggggtcagaggttgggagggacacgctggtctgaggatggacgcaggagcgcactcccccggctccctctctgggctatcgctgctgctcaggccctggggacccgccagagtgggacaccgtgctccaacacagatgaggaaactgaggccccgagtgcgtcttcctcaaggccacatggtgaatggaacagtccctaccagcctggaaaacagaccagcctctgtcactccagagataacccactctcatcttgctcgtacctggcttcagggatcctggggagagataagaggttaaaaaagggacatatcaaaactccctcctcttggagcctgcccagctttcatcaccctcctgcctcggcctgcacgctgagcggattataaacgccgcatcagggagcactgcttgggcctgtggcctgaaaacggaaatgcaaccatagcatggagacgctctgagaaaagatccagacccacctcatctcccagcccttcaagcagagctataaaaacaagtttgggagaaaaacacattcccatccccaaagcagaggccccgcctgagctcccccatcctcagcatctggggtggaccaggtatgtgtgtgcatgactaacacagaacttgcctgaagactggacggaaacttagaagccagccctgggtcctagagcgaggctaggactgggcacgtagagggaaacagcacatcccttcctgaagcccctttctaagtatccaggtcgtcatccagtgtcagcaacacctggggtgtggacgccagatcagccacagagaaggaggcagctgctaccttcacgtacccacccggctcggccgggaggcccgcttaccaggaaggacccgaacatggcgatggaggagaggaagtgccagatgtcgtggtcgtcaaagaagtcgaggaggatgcagtcccggttgtgctccctcgactctgcaggggttttcttggggagcaacaagaaaaactgccgaatgaccctgctctggcagggcaagggccagacccatctgccatcttgctcctgggcacccctctctccagccccaggcaggacagcagcaattctgacctgtcccttgtccttgtccctaccccttcccgatctaacaaatggcctttggttacaaacttaaaatga

SEQ ID NO: 365199 - DNA, 1205 bp, Homo sapiens
aggggtttgtggggacaaaccagccaccctctcctcctggggcttttagctctgatgggacatgggatccaacctttcctgaggacctactccacaccaggccctttgcagtgctctcattgaatactcacagctacagtgtgagggtgtaattacatccccattttatagatgaggaaactgaggccccgagtgcgtcttcctcaaggccacatggtgaatggaacagtccctaccagcctggaaaacagaccagcctctgtcactccagagataacccactctcatcttgctcgtacctggcttcagggatcctggggagagataagaggttaaaaaagggacatatcaaaactccctcctcttggagcctgcccagctttcatcaccctcctgcctcggcctgcacgctgagcggattataaacgccgcatcagggagcactgcttgggcctgtggcctgaaaacggaaatgcaaccatagcatggagacgctctgagaaaagatccagacccacctcatctcccagcccttcaagcagagctataaaaacaagtttgggagaaaaacacattcccatccccaaagcagaggccccgcctgagctcccccatcctcagcatctggggtggaccaggtatgtgtgtgcatgactaacacagaacttgcctgaagactggacggaaacttagaagccagccctgggtcctagagcgaggctaggactgggcacgtagagggaaacagcacatcccttcctgaagcccctttctaagtatccaggtcgtcatccagtgtcagcaacacctggggtgtggacgccagatcagccacagagaaggaggcagctgctaccttcacgtacccacccggctcggccgggaggcccgcttaccaggaaggacccgaacatggcgatggaggagaggaagtgccagatgtcgtggtcgtcaaagaagtcgaggaggatgcagtcccggttgtgctccctcgactctgcaggggttttcttggggagcaacaagaaaaactgccgaatgaccctgctctggcagggcaagggccagacccatctgccatcttgctcctgggcacccctctctccagccccaggcaggacagcagcaattctgacctgtcccttgtccttgtccctaccccttcccgatctaacaaatggcctttggttacaaacttaaaatga

SEQ ID NO: 365200 - DNA, 1215 bp, Homo sapiens
ggtgacctcccactgtcagacagtggaaggggctgcttgtcagaaggacaggccttccgtctccactctttgcccctgactggaatacaagagttctgtggcccttcacattgtcacagggctatcgctgctgctcaggccctggggacccgccagagtgggacaccgtgctccaacacagatgaggaaactgaggccccgagtgcgtcttcctcaaggccacatggtgaatggaacagtccctaccagcctggaaaacagaccagcctctgtcactccagagataacccactctcatcttgctcgtacctggcttcagggatcctggggagagataagaggttaaaaaagggacatatcaaaactccctcctcttggagcctgcccagctttcatcaccctcctgcctcggcctgcacgctgagcggattataaacgccgcatcagggagcactgcttgggcctgtggcctgaaaacggaaatgcaaccatagcatggagacgctctgagaaaagatccagacccacctcatctcccagcccttcaagcagagctataaaaacaagtttgggagaaaaacacattcccatccccaaagcagaggccccgcctgagctcccccatcctcagcatctggggtggaccaggtatgtgtgtgcatgactaacacagaacttgcctgaagactggacggaaacttagaagccagccctgggtcctagagcgaggctaggactgggcacgtagagggaaacagcacatcccttcctgaagcccctttctaagtatccaggtcgtcatccagtgtcagcaacacctggggtgtggacgccagatcagccacagagaaggaggcagctgctaccttcacgtacccacccggctcggccgggaggcccgcttaccaggaaggacccgaacatggcgatggaggagaggaagtgccagatgtcgtggtcgtcaaagaagtcgaggaggatgcagtcccggttgtgctccctcgactctgcaggggttttcttggggagcaacaagaaaaactgccgaatgaccctgctctggcagggcaagggccagacccatctgccatcttgctcctgggcacccctctctccagccccaggcaggacagcagcaattctgacctgtcccttgtccttgtccctaccccttcccgatctaacaaatggcctttggttacaaacttaaaatga

SEQ ID NO: 365201 - DNA, 1539 bp, Homo sapiens
gcccatgagctgtagtttgacaacccttggtctagaacattctttgccaagaccagctacagagccactggagagaccttccagaagccacattgcccccacagaatacagccagctggtgcctttgtccagctgcgggtgtgagggtttactgcctctgcctcaagcaaccattacctcccactctcacccagaagcaggccctggcctggaagcccgaactccagaactccagctcttttcaggtcagctcagcttctggtctgcagctgaagagactaaaactcgcccaccccaggcaagggcgacgaagccaccaaagcccaagagttcttggcaaagaagctgcatttcctcagagaaatcagagacacctggtctacccatcgacttcccctcatgcccttacgctctcgtaaggctacccttacggagtagcctgagtaaccaagaagtcagagtcccccagggatcttccagagccaagagtctgcctgccagggaatgggaagcctggccccatccagcaactgccaccctgagggcctgggcctggcactgctcaggagtcccactcatggagaggggtggcagcaggagtgggccaggcaggtaggtccctgggcagacagacaggggtggctgggaacaggaacaggaaactgacctgtccactgatgtcaccctagggtgctgtgccttctctccagtgtttgtctgaagagacttccaaaagaggtaccaaaggaagccgaacccatcccctggcctcagaggggtcagaggttgggagggacacgctggtctgaggatggacgcaggagcgcactcccccggctccctctctggtgagacccctccccactggcaccccacccgcgggaagcagagccaacactatcacaccccactggtcccaggccagctgcccagcccgatgccctgcccttcctttctcagggctgacaggctttctgggctggagttcctcatctgtgaagtgggggttatgttaccaacctcagagggctgtgaaaatgggacggtgtctgtgaactccctcacatactgcctggcccttagcagagctccctcgaaatgtcagttctttgctgcccggagccaggctcctggtaatgaccagggagagagcctgcccttgaccaaggagtgaaaaactgacctcaaaatgtcagttctttgctgcccactccagcctccacccgcttctcacaatcattccctgagcgcgcagcagctcacacggaacagagttcacacggactcatcgaagtgcccgtcattgggcatccctctcctccttgcgtctgtttccttatgtgtaaagtgggggcgggaccacttctgaggacccagttctctgagcactggggatgaggtgggctcctggcccagccacccctctccctgccagtgatgccagagaccccaaaggcagacaattctgacctgtcccttgtccttgtccctaccccttcccgatctaacaaatggcctttggttacaaacttaaaatga

SEQ ID NO: 365202 - DNA, 428 bp, Homo sapiens
tgagttatatgctttagttggggctgggatttgagggttcggcagaagctgagtccaactccggtccccatccagtgggcagtgtcaataagagggtctataaggcctggcagggcctgagacactaacgcaggagaaggaggctcaggaggctggtatcatcccttcctccctttaggaacagtccctaccagcctggaaaacagaccagcctctgtcactccagagataacccactctcatcttgctcgtacctggcttcagggatcctggggagagataagaggttaaaaaaggtgagactaacagtgggatccctggactgactgctgtggcactcccctgcaagggcacctggtagggaagacctaacactctccactacacacacactgccacacccggcaccacccctagccaaacaaggc

SEQ ID NO: 365203 - DNA, 273 bp, Homo sapiens
ctgtcttgctgtgggaggccatccgctggtgttagtgctggcccacactccacctgggggcttatccctgttggtcagggataaatgtgaacaaaaagagaagatcaaatgtttcacaatttaaaaggcatggcttagggacttccagggggaacacatggatggctcagcatctccctctcagattcctgcagttaccagctctttgatctcttccatatcctttttctttgtctgcagtccactgctctgatgccgaaggggaggcagaaa

SEQ ID NO: 365204 - DNA, 277 bp, Homo sapiens
cttcaggggcactacctctttgtccagcctgctgggcacaggccggccctggaggtggaggccatccggcagcaggtggaggctgtgttggctgggcatgaagctgtgcgctggcactcagagcagaggctgctaaggcgggccaagcgcagcgtccacttcaacgaccccaagtacccgcagcaatggcacctggtgagtccagtcctgcagtttgcagtttcaggtgggtaggttccagtccagttctttaatgggcttttgactatatcactct

SEQ ID NO: 365205 - DNA, 1962 bp, Homo sapiens
ccaggggcaaggggcacctgagaagccctcgtggcaccctcccaggttgtttccacggctactacagtaagaaagtgttgctgggggaaggtcagctctctggcccacgccttccacctgtttctgctgtgttctttcctcagggatcccaacggcttcaatgactggaccttctccactgtgcgatgctggggggagagagcccgagggacctacaggctggtcatcagggatgtcggggatgagtcattccaggtcggcatcctccggcaatggcagctgaccctatatggctctgtgtggagtgcagtagacatcagggacagacaaaggctgttagagagtgccatgagtggaaaatacctgcacgatgacttcgccctgccctgcccaccggggctgaaaattcctgaggaagatggttacaccatcacccccaacaccctcaagaccctggtgctggtaggctgtttcaccgtcttctggactgtttactacatgctggaagtatatttgagccagaggaatgtggcttccaatcaagtttgtaggagtggaccctgccactggccccatcggagccggaaagccaaggaggaagggacagagctagaatcagtgccactttgcagcagcaaggatccagacgaagtggaaacagagagcaggggccctcccaccacctctgacctccttgccccagacctgctggagcaaggggactggagcctgtcccagaacaagagcgccctggactgccctcatcagcacctagacgtaccgcacgggaaggaggagcagatctgctgacctcagggcctgacagtgtgggacaggctcttctttcccaaaattagggagctcttgacagaaagcagttctgatgcttacatctggaatctgaggcatcctctgactccactcaaagagggtgagggccttcttaagatacaaatggtggaggattgctgccagagaagtctggtcagagccacagggtctgcctccagccaaacgggagcttttggtgagaaggtgttggacaggggattggcgcccccctttggtttggcctccatcctcatctctcttgggccaagccagctgcctaggtcccccaagcatgggggaccccttcccacatataagttgagaaggtgcctgccatagccaggagcgcatctcaatggaaacatcactggggtcacttgggaagaggacttcggggtagaggctgggaggagcccctggacatgcctgtcctgaaagcggctgcctccattatccattcccaagatgcctgatcagaaaccaaccatgaatgaacccctggctccttcaccacccccacgattggtatgatgctgccggcacagctgggatacacacggctcccccaggcctgagctgcttcactagggaatcctgcggcaggactgcagagcagatggcagatgcacatgttggaggagagagccttgggagccactgccactccagtcctgccaccaccctgtcttcctctgcaagtgctcagggaaatggccttcccgccggaggccagctatctgcctgacaggctgtgactcttctctcaaccttggccttctcccctcttctgagctagttggttgaattttttttaatgcttaagatttgtttttctcttttcacagcaacattttcttgaatttttttctgcacagcttttccaaaataaaaaccttccaaacaattctgccactcgcaatctctcctttcctctgtctccccaaagccactgcatgctgctgagtggctcctttttcccttcggtccccaagattcactctcctgttctatggcctgtttcctctgaaagaatctgactgtcctggaatcttggcacatgaagggtccttcagaggacggcagccaggaacacatacaagcccgagatgcctgcctgtcccctgcgcagat

SEQ ID NO: 365206 - DNA, 3987 bp, Homo sapiens
agaggccgcggtggcgccgcgccgcccccgacggcgccctctggcggcgacagctggcgccgccggggcacggggatgctgcgggagacccctgagatacaagtggactctcccggggcgcggggaagaagggagagccgactgcgagaaggaaggcgacctgggtgggcaggatcccctctgggaagattacagggacagtcggggccatggcggtcagaaggagaagagcaacgagtggcttttaaaggtcggaaccgaaatgccctttacagaggacgccatgaaggagagccttctgaagagggaccatgtggaagatgccccgaggactcggggaggcggagcccgcgggttcagcccccagcgcccgcacggcccctgcctgcgtaggccgcccgcgggagccggaccccgggcgccggttgctgtggcccgcgggggtcgccgggccgcaggcgccgcgctgattggctgcgccgcgggcggaagtgatgctgctgtcactgctcctccggctcccgggaagccgcgagtttccgcagggaggcggcggcagctgcggcggggccggtctgtagcctttgctgagtcaacactactcacagtgaaagtgatgccttttctccatttgcacaacatgagtgtgacgtggttagccagaccaggagctcaacctcatgtagaatccagtccactgctctgatgccgaaggggaggcagaaagtgccacacttggatgcccccctgggcctgcccacctgcctctggctggaattagccgggctcttcttactggttccctgggtcatgggcctggcagggacaggtgggcctgatggccagggcacaggggggccgagctgggctgtgcacctggaaagcctggaaggtgacggggaggaagagactctggagcagcaggcggatgccttggcccaggcagcagggctggtgaatgctggacgcatcggagagcttcaggggcactacctctttgtccagcctgctgggcacaggccggccctggaggtggaggccatccggcagcaggtggaggctgtgttggctgggcatgaagctgtgcgctggcactcagagcagaggctgctaaggcgggccaagcgcagcgtccacttcaacgaccccaagtacccgcagcaatggcacctgaataaccgacggagcccgggcagggacatcaacgtgacgggtgtgtgggaacgcaatgtgactgggcgaggggtgacggtggtggtagtggatgacggagtggaacacaccatccaggacattgcacccaactatagccctgagggtagctatgacctcaactctaatgaccctgaccccatgccccacccggatgtggagaatggcaaccaccatggcacgcgatgtgcaggagagatcgcggctgtgcccaacaacagcttctgtgccgtgggcgtggcctacgggagccgcatcgcaggtatccgggtactggatggacctctcacagacagcatggaggcagtggcgttcaacaagcactatcagatcaatgacatctacagctgcagctggggaccagatgacgatgggaagacagtggatggcccccatcagcttggaaaggctgccttacaacatggggtgattgctggtcgccagggctttgggagcatctttgtggtagccagtggcaacggaggccaacacaacgacaactgcaactacgatggctacgccaactccatctacaccgtcaccataggagctgtggatgaggagggacgcatgcctttctatgcagaagaatgtgcctccatgctggcagtcaccttcagtggtggggacaagatgcttcggagcattgtgaccactgactgggaccttcagaagggcactggctgcactgagggccacacagggacctcagctgcagcgcctctggcagctggcatgatagccttaatgctgcaggtgcggccctgcctcacgtggcgtgacgtccagcacatcattgtcttcacagccacccggtatgaggatcgccgtgcagagtgggtcaccaacgaggcaggcttcagccatagccaccagcacggtttcggcctcctcaacgcctggaggctcgtgaatgcagccaagatctggacatctgtcccttacttagcatcctacgtcagtcccgtgttaaaagaaaacaaggcgattccgcagtccccccgttccctggaggtcctgtggaatgtcagcaggatggacctggagatgtcagggctgaagaccctggagcatgtggcagtgacagtctccatcactcacccacggcgcggcagcttggagctgaagctgttctgccccagtggcatgatgtccctcatcggcgccccccgcagcatggactcggatcccaacggcttcaatgactggaccttctccactgtgcgatgctggggggagagagcccgagggacctacaggctggtcatcagggatgtcggggatgagtcattccaggtcggcatcctccggcaatggcagctgaccctatatggctctgtgtggagtgcagtagacatcagggacagacaaaggctgttagagagtgccatgagtggaaaatacctgcacgatgacttcgccctgccctgcccaccggggctgaaaattcctgaggaagatggttacaccatcacccccaacaccctcaagaccctggtgctggtaggctgtttcaccgtcttctggactgtttactacatgctggaagtatatttgagccagaggaatgtggcttccaatcaagtttgtaggagtggaccctgccactggccccatcggagccggaaagccaaggaggaagggacagagctagaatcagtgccactttgcagcagcaaggatccagacgaagtggaaacagagagcaggggccctcccaccacctctgacctccttgccccagacctgctggagcaaggggactggagcctgtcccagaacaagagcgccctggactgccctcatcagcacctagacgtaccgcacgggaaggaggagcagatctgctgacctcagggcctgacagtgtgggacaggctcttctttcccaaaattagggagctcttgacagaaagcagttctgatgcttacatctggaatctgaggcatcctctgactccactcaaagagggtgagggccttcttaagatacaaatggtggaggattgctgccagagaagtctggtcagagccacagggtctgcctccagccaaacgggagcttttggtgagaaggtgttggacaggggattggcgcccccctttggtttggcctccatcctcatctctcttgggccaagccagctgcctaggtcccccaagcatgggggaccccttcccacatataagttgagaaggtgcctgccatagccaggagcgcatctcaatggaaacatcactggggtcacttgggaagaggacttcggggtagaggctgggaggagcccctggacatgcctgtcctgaaagcggctgcctccattatccattcccaagatgcctgatcagaaaccaaccatgaatgaacccctggctccttcaccacccccacgattggtatgatgctgccggcacagctgggatacacacggctcccccaggcctgagctgcttcactagggaatcctgcggcaggactgcagagcagatggcagatgcacatgttggaggagagagccttgggagccactgccactccagtcctgccaccaccctgtcttcctctgcaagtgctcagggaaatggccttcccgccggaggccagctatctgcctgacaggctgtgactcttctctcaaccttggccttctcccctcttctgagctagttggttgaattttttttaatgcttaagatttgtttttctcttttcacagcaacattttcttgaatttttttctgcacagcttttccaaaataaaaaccttccaaaca

SEQ ID NO: 365207 - DNA, 549 bp, Homo sapiens
caacacaacgacaactgcaactacgatggctacgccaacaagcactatcagatcaatgacatctacagctgcctggggaccagatgacgatgggaagacagtggatggcccccatcagcttggaaaggctgccttacaacatggggtgattgctggtcgccagggctttgggagcatctttgtggtagccagtggcaacggaggccaacacaacgacaagagctgcttcactagggaatcctgcggcaggactgcagagcagatggcagatgcacatgttggaggagagagccttgggagccactgccactccagtcctgccaccaccctgtcttcctctgcaagtgctcagggaaatggccttcccgccggaggccagctatctgcctgacaggctgtgactcttctctcaaccttggccttctcccctcttctgagctagttggttgaattttttttaatgcttaagatttgtttttctcttttcacagcaacattttcttgaatttttttctgcacagcttttccaaaataaaaaccttccaaaca

SEQ ID NO: 365208 - DNA, 4313 bp, Homo sapiens
agaggccgcggtggcgccgcgccgcccccgacggcgccctctggcggcgacagctggcgccgccggggcacggggatgctgcgggagacccctgagatacaagtggactctcccggggcgcggggaagaagggagagccgactgcgagaaggaaggcgacctgggtgggcaggatcccctctgggaagattacagggacagtcggggccatggcggtcagaaggagaagagcaacgagtggcttttaaaggtcggaaccgaaatgccctttacagaggacgccatgaaggagagccttctgaagagggaccatgtggaagatgccccgaggactcggggaggcggagcccgcgggttcagcccccagcgcccgcacggcccctgcctgcgtaggccgcccgcgggagccggaccccgggcgccggttgctgtggcccgcgggggtcgccgggccgcaggcgccgcgctgattggctgcgccgcgggcggaagtgatgctgctgtcactgctcctccggctcccgggaagccgcgagtttccgcagggaggcggcggcagctgcggcggggccggtctgtagcctttgctgagtcaacactactcacagtgaaagtgatgccttttctccatttgcacaacatgagtgtgacgtggttagccagaccaggagctcaacctcatgtagaatccagtccactgctctgatgccgaaggggaggcagaaagtgccacacttggatgcccccctgggcctgcccacctgcctctggctggaattagccgggctcttcttactggttccctgggtcatgggcctggcagggacaggtgggcctgatggccagggcacaggggggccgagctgggctgtgcacctggaaagcctggaaggtgacggggaggaagagactctggagcagcaggcggatgccttggcccaggcagcagggctggtgaatgctggacgcatcggagagcttcaggggcactacctctttgtccagcctgctgggcacaggccggccctggaggtggaggccatccggcagcaggtggaggctgtgttggctgggcatgaagctgtgcgctggcactcagagcagaggctgctaaggcgggccaagcgcagcgtccacttcaacgaccccaagtacccgcagcaatggcacctgaataaccgacggagcccgggcagggacatcaacgtgacgggtgtgtgggaacgcaatgtgactgggcgaggggtgacggtggtggtagtggatgacggagtggaacacaccatccaggacattgcacccaactatagccctgagggtagctatgacctcaactctaatgaccctgaccccatgccccacccggatgtggagaatggcaaccaccatggcacgcgatgtgcaggagagatcgcggctgtgcccaacaacagcttctgtgccgtgggcgtggcctacgggagccgcatcgcaggtatccgggtactggatggacctctcacagacagcatggaggcagtggcgttcaacaagcactatcagatcaatgacatctacagctgcagctggggaccagatgacgatgggaagacagtggatggcccccatcagcttggaaaggctgccttacaacatggggtgattgctggtcgccagggctttgggagcatctttgtggtagccagtggcaacggaggccaacacaacgacaactgcaactacgatggctacgccaactccatctacaccgtcaccataggagctgtggatgaggagggacgcatgcctttctatgcagaagaatgtgcctccatgctggcagtcaccttcagtggtggggacaagatgcttcggagcattgtgaccactgactgggaccttcagaagggcactggctgcactgagggccacacagggacctcagctgcagcgcctctggcagctggcatgatagccttaatgctgcaggtgcggccctgcctcacgtggcgtgacgtccagcacatcattgtcttcacagccacccggtatgaggatcgccgtgcagagtgggtcaccaacgaggcaggcttcagccatagccaccagcacggtttcggcctcctcaacgcctggaggctcgtgaatgcagccaagatctggacatctgtcccttacttagcatcctacgtcagtcccgtgttaaaagaaaacaaggcgattccgcagtccccccgttccctggaggtcctgtggaatgtcagcaggatggacctggagatgtcagggctgaagaccctggagcatgtggcagtgacagtctccatcactcacccacggcgcggcagcttggagctgaagctgttctgccccagtggcatgatgtccctcatcggcgccccccgcagcatggactcggatcccaacggcttcaatgactggaccttctccactgtgcgatgctggggggagagagcccgagggacctacaggctggtcatcagggatgtcggggatgagtcattccaggtcggcatcctccggcaatggcagctgaccctatatggctctgtgtggagtgcagtagacatcagggacagacaaaggctgttagagagtgccatgagtggaaaatacctgcacgatgacttcgccctgccctgcccaccggggctgaaaattcctgaggaagatggttacaccatcacccccaacaccctcaaggtactacggcccgaagactcaagctgcgggtagatgggactgtcctgtctgggggatggagttcttagtgtgtttctcagggtgacctgcggggtgaaggactgggaagacctgggtcccagcagtggtttcatagcattgctcctaccctgctagcctaactcttacaggacaggccttgtcgggggagggggcagagggaacagtttgggtgaaaaaggcagtccctagaaggaaaaagactttctgagctcattgtcctgggctgagaaaggctgtaggcttcgggaaacagtgcctcacgtaggtgcttgcctcggccccagaccctggtgctggtaggctgtttcaccgtcttctggactgtttactacatgctggaagtatatttgagccagaggaatgtggcttccaatcaagtttgtaggagtggaccctgccactggccccatcggagccggaaagccaaggaggaagggacagagctagaatcagtgccactttgcagcagcaaggatccagacgaagtggaaacagagagcaggggccctcccaccacctctgacctccttgccccagacctgctggagcaaggggactggagcctgtcccagaacaagagcgccctggactgccctcatcagcacctagacgtaccgcacgggaaggaggagcagatctgctgacctcagggcctgacagtgtgggacaggctcttctttcccaaaattagggagctcttgacagaaagcagttctgatgcttacatctggaatctgaggcatcctctgactccactcaaagagggtgagggccttcttaagatacaaatggtggaggattgctgccagagaagtctggtcagagccacagggtctgcctccagccaaacgggagcttttggtgagaaggtgttggacaggggattggcgcccccctttggtttggcctccatcctcatctctcttgggccaagccagctgcctaggtcccccaagcatgggggaccccttcccacatataagttgagaaggtgcctgccatagccaggagcgcatctcaatggaaacatcactggggtcacttgggaagaggacttcggggtagaggctgggaggagcccctggacatgcctgtcctgaaagcggctgcctccattatccattcccaagatgcctgatcagaaaccaaccatgaatgaacccctggctccttcaccacccccacgattggtatgatgctgccggcacagctgggatacacacggctcccccaggcctgagctgcttcactagggaatcctgcggcaggactgcagagcagatggcagatgcacatgttggaggagagagccttgggagccactgccactccagtcctgccaccaccctgtcttcctctgcaagtgctcagggaaatggccttcccgccggaggccagctatctgcctgacaggctgtgactcttctctcaaccttggccttctcccctcttctgagctagttggttgaattttttttaatgcttaagatttgtttttctcttttcacagcaacattttcttgaatttttttctgcacagcttttccaaaataaaaaccttccaaaca

SEQ ID NO: 365209 - DNA, 4226 bp, Homo sapiens
agaggccgcggtggcgccgcgccgcccccgacggcgccctctggcggcgacagctggcgccgccggggcacggggatgctgcgggagacccctgagatacaagtggactctcccggggcgcggggaagaagggagagccgactgcgagaaggaaggcgacctgggtgggcaggatcccctctgggaagattacagggacagtcggggccatggcggtcagaaggagaagagcaacgagtggcttttaaaggtcggaaccgaaatgccctttacagaggacgccatgaaggagagccttctgaagagggaccatgtggaagatgccccgaggactcggggaggcggagcccgcgggttcagcccccagcgcccgcacggcccctgcctgcgtaggccgcccgcgggagccggaccccgggcgccggttgctgtggcccgcgggggtcgccgggccgcaggcgccgcgctgattggctgcgccgcgggcggaagtgatgctgctgtcactgctcctccggctcccgggaagccgcgagtttccgcagggaggcggcggcagctgcggcggggccggtctgtagcctttgctgagtcaacactactcacagtgaaagtgatgccttttctccatttgcacaacatgagtgtgacgtggttagccagaccaggagctcaacctcatgtagaatccagtccactgctctgatgccgaaggggaggcagaaagtgccacacttggatgcccccctgggcctgcccacctgcctctggctggaattagccgggctcttcttactggttccctgggtcatgggcctggcagggacaggtgggcctgatggccagggcacaggggggccgagctgggctgtgcacctggaaagcctggaaggtgacggggaggaagagactctggagcagcaggcggatgccttggcccaggcagcagggctggtgaatgctggacgcatcggagagcttcaggggcactacctctttgtccagcctgctgggcacaggccggccctggaggtggaggccatccggcagcaggtggaggctgtgttggctgggcatgaagctgtgcgctggcactcagagcagaggctgctaaggcgggccaagcgcagcgtccacttcaacgaccccaagtacccgcagcaatggcacctgaataaccgacggagcccgggcagggacatcaacgtgacgggtgtgtgggaacgcaatgtgactgggcgaggggtgacggtggtggtagtggatgacggagtggaacacaccatccaggacattgcacccaactatagccctgagggtagctatgacctcaactctaatgaccctgaccccatgccccacccggatgtggagaatggcaaccaccatggcacgcgatgtgcaggagagatcgcggctgtgcccaacaacagcttctgtgccgtgggcgtggcctacgggagccgcatcgcaggtatccgggtactggatggacctctcacagacagcatggaggcagtggcgttcaacaagcactatcagatcaatgacatctacagctgcagctggggaccagatgacgatgggaagacagtggatggcccccatcagcttggaaaggctgccttacaacatggggtgattgctggtcgccagggctttgggagcatctttgtggtagccagtggcaacggaggccaacacaacgacaactgcaactacgatggctacgccaactccatctacaccgtcaccataggtagtcacccaatgtttctgtgctcctgtgtgtgtgtcaccgaagggttagggcatcacacgtcttgtcctagcttctgtgtgtgtctaaatgtgtgagcacaataatctctttgggctcagataggactagccctgcttgcagaggaccttgggacttcttagatgtcagcataccctgggaacaccttcaagccatcatctggagatcaccgagctgcctccaccccaccacagctggagctgtggatgaggagggacgcatgcctttctatgcagaagaatgtgcctccatgctggcagtcaccttcagtggtggggacaagatgcttcggagcattgtgaccactgactgggaccttcagaagggcactggctgcactgagggccacacagggacctcagctgcagcgcctctggcagctggcatgatagccttaatgctgcaggtgcggccctgcctcacgtggcgtgacgtccagcacatcattgtcttcacagccacccggtatgaggatcgccgtgcagagtgggtcaccaacgaggcaggcttcagccatagccaccagcacggtttcggcctcctcaacgcctggaggctcgtgaatgcagccaagatctggacatctgtcccttacttagcatcctacgtcagtcccgtgttaaaagaaaacaaggcgattccgcagtccccccgttccctggaggtcctgtggaatgtcagcaggatggacctggagatgtcagggctgaagaccctggagcatgtggcagtgacagtctccatcactcacccacggcgcggcagcttggagctgaagctgttctgccccagtggcatgatgtccctcatcggcgccccccgcagcatggactcggatcccaacggcttcaatgactggaccttctccactgtgcgatgctggggggagagagcccgagggacctacaggctggtcatcagggatgtcggggatgagtcattccaggtcggcatcctccggcaatggcagctgaccctatatggctctgtgtggagtgcagtagacatcagggacagacaaaggctgttagagagtgccatgagtggaaaatacctgcacgatgacttcgccctgccctgcccaccggggctgaaaattcctgaggaagatggttacaccatcacccccaacaccctcaagaccctggtgctggtaggctgtttcaccgtcttctggactgtttactacatgctggaagtatatttgagccagaggaatgtggcttccaatcaagtttgtaggagtggaccctgccactggccccatcggagccggaaagccaaggaggaagggacagagctagaatcagtgccactttgcagcagcaaggatccagacgaagtggaaacagagagcaggggccctcccaccacctctgacctccttgccccagacctgctggagcaaggggactggagcctgtcccagaacaagagcgccctggactgccctcatcagcacctagacgtaccgcacgggaaggaggagcagatctgctgacctcagggcctgacagtgtgggacaggctcttctttcccaaaattagggagctcttgacagaaagcagttctgatgcttacatctggaatctgaggcatcctctgactccactcaaagagggtgagggccttcttaagatacaaatggtggaggattgctgccagagaagtctggtcagagccacagggtctgcctccagccaaacgggagcttttggtgagaaggtgttggacaggggattggcgcccccctttggtttggcctccatcctcatctctcttgggccaagccagctgcctaggtcccccaagcatgggggaccccttcccacatataagttgagaaggtgcctgccatagccaggagcgcatctcaatggaaacatcactggggtcacttgggaagaggacttcggggtagaggctgggaggagcccctggacatgcctgtcctgaaagcggctgcctccattatccattcccaagatgcctgatcagaaaccaaccatgaatgaacccctggctccttcaccacccccacgattggtatgatgctgccggcacagctgggatacacacggctcccccaggcctgagctgcttcactagggaatcctgcggcaggactgcagagcagatggcagatgcacatgttggaggagagagccttgggagccactgccactccagtcctgccaccaccctgtcttcctctgcaagtgctcagggaaatggccttcccgccggaggccagctatctgcctgacaggctgtgactcttctctcaaccttggccttctcccctcttctgagctagttggttgaattttttttaatgcttaagatttgtttttctcttttcacagcaacattttcttgaatttttttctgcacagcttttccaaaataaaaaccttccaaaca

SEQ ID NO: 365210 - DNA, 1734 bp, Homo sapiens
ccaggggcaaggggcacctgagaagccctcgtggcaccctcccaggttgtttccacggctactacagtaagaaagtgttgctgggggaaggtcagctctctggcccacgccttccacctgtttctgctgtgttctttcctcagggatcccaacggcttcaatgactggaccttctccactgtgcgatgctggggggagagagcccgagggacctacaggctggtcatcagggatgtcggggatgagtcattccaggtcggcatcctccggcaatggcagctgaccctatatggctctgtgtggagtgcagtagacatcagggacagacaaaggctgttagagagtgccatgagtggaaaatacctgcacgatgacttcgccctgccctgcccaccggggctgaaaattcctgaggaagatggttacaccatcacccccaacaccctcaagaccctggtgctggtaggctgtttcaccgtcttctggactgtttactacatgctggaagtatatttgagccagaggaatgtggcttccaatcaagtttgtaggagtggaccctgccactggccccatcggagccggaaagccaaggaggaagggacagagctagaatcagtgccactttgcagcagcaaggatccagacgaagtggaaacagagagcaggggccctcccaccacctctgacctccttgccccagacctgctggagcaaggggactggagcctgtcccagaacaagagcgccctggactgccctcatcagcacctagacgtaccgcacgggaaggaggagcagatctgctgacctcagggcctgacagtgtgggacaggctcttctttcccaaaattagggagctcttgacagaaagcagttctgatgcttacatctggaatctgaggcatcctctgactccactcaaagagggtgagggccttcttaagatacaaatggtggaggattgctgccagagaagtctggtcagagccacagggtctgcctccagccaaacgggagcttttggtgagaaggtgttggacaggggattggcgcccccctttggtttggcctccatcctcatctctcttgggccaagccagctgcctaggtcccccaagcatgggggaccccttcccacatataagttgagaaggtgcctgccatagccaggagcgcatctcaatggaaacatcactggggtcacttgggaagaggacttcggggtagaggctgggaggagcccctggacatgcctgtcctgaaagcggctgcctccattatccattcccaagatgcctgatcagaaaccaaccatgaatgaacccctggctccttcaccacccccacgattggtatgatgctgccggcacagctgggatacacacggctcccccaggcctgagctgcttcactagggaatcctgcggcaggactgcagagcagatggcagatgcacatgttggaggagagagccttgggagccactgccactccagtcctgccaccaccctgtcttcctctgcaagtgctcagggaaatggccttcccgccggaggccagctatctgcctgacaggctgtgactcttctctcaaccttggccttctcccctcttctgagctagttggttgaattttttttaatgcttaagatttgtttttctcttttcacagcaacattttcttgaatttttttctgcacagcttttccaaaataaaaaccttccaaaca

SEQ ID NO: 365211 - DNA, 1669 bp, Homo sapiens
aaacgacccgaagaccttcgacataatcctcataggtgccccactcccgtcttcgggtcgtactacggcccgaagactcaagctgcgggtagatgggactgtcctgtctgggggatggagttcttagtgtgtttctcagggtgacctgcggggtgaaggactgggaagacctgggtcccagcagtggtttcatagcattgctcctaccctgctagcctaactcttacaggacaggccttgtcgggggagggggcagagggaacagtttgggtgaaaaaggcagtccctagaaggaaaaagactttctgagctcattgtcctgggctgagaaaggctgtaggcttcgggaaacagtgcctcacgtaggtgcttgcctcggccccagaccctggtgctggtaggctgtttcaccgtcttctggactgtttactacatgctggaagtatatttgagccagaggaatgtggcttccaatcaagtttgtaggagtggaccctgccactggccccatcggagccggaaagccaaggaggaagggacagagctagaatcagtgccactttgcagcagcaaggatccagacgaagtggaaacagagagcaggggccctcccaccacctctgacctccttgccccagacctgctggagcaaggggactggagcctgtcccagaacaagagcgccctggactgccctcatcagcacctagacgtaccgcacgggaaggaggagcagatctgctgacctcagggcctgacagtgtgggacaggctcttctttcccaaaattagggagctcttgacagaaagcagttctgatgcttacatctggaatctgaggcatcctctgactccactcaaagagggtgagggccttcttaagatacaaatggtggaggattgctgccagagaagtctggtcagagccacagggtctgcctccagccaaacgggagcttttggtgagaaggtgttggacaggggattggcgcccccctttggtttggcctccatcctcatctctcttgggccaagccagctgcctaggtcccccaagcatgggggaccccttcccacatataagttgagaaggtgcctgccatagccaggagcgcatctcaatggaaacatcactggggtcacttgggaagaggacttcggggtagaggctgggaggagcccctggacatgcctgtcctgaaagcggctgcctccattatccattcccaagatgcctgatcagaaaccaaccatgaatgaacccctggctccttcaccacccccacgattggtatgatgctgccggcacagctgggatacacacggctcccccaggcctgagctgcttcactagggaatcctgcggcaggactgcagagcagatggcagatgcacatgttggaggagagagccttgggagccactgccactccagtcctgccaccaccctgtcttcctctgcaagtgctcagggaaatggccttcccgccggaggccagctatctgcctgacaggctgtgactcttctctcaaccttggccttctcccctcttctgagctagttggttgaattttttttaatgcttaagatttgtttttctcttttcacagcaacattttcttgaatttttttctgcacagcttttccaaaataaaaaccttccaaaca

SEQ ID NO: 365212 - DNA, 1640 bp, Homo sapiens
ccaggggcaaggggcacctgagaagccctcgtggcaccctcccaggttgtttccacggctactacagtaagaaagtgttgctgggggaaggtcagctctctggcccacgccttccacctgtttctgctgtgttctttcctcagggatcccaacggcttcaatgactggaccttctccactgtgcgatgctggggggagagagcccgagggacctacaggctggtcatcagggatgtcggctgttagagagtgccatgagtggaaaatacctgcacgatgacttcgccctgccctgcccaccggggctgaaaattcctgaggaagatggttacaccatcacccccaacaccctcaagaccctggtgctggtaggctgtttcaccgtcttctggactgtttactacatgctggaagtatatttgagccagaggaatgtggcttccaatcaagtttgtaggagtggaccctgccactggccccatcggagccggaaagccaaggaggaagggacagagctagaatcagtgccactttgcagcagcaaggatccagacgaagtggaaacagagagcaggggccctcccaccacctctgacctccttgccccagacctgctggagcaaggggactggagcctgtcccagaacaagagcgccctggactgccctcatcagcacctagacgtaccgcacgggaaggaggagcagatctgctgacctcagggcctgacagtgtgggacaggctcttctttcccaaaattagggagctcttgacagaaagcagttctgatgcttacatctggaatctgaggcatcctctgactccactcaaagagggtgagggccttcttaagatacaaatggtggaggattgctgccagagaagtctggtcagagccacagggtctgcctccagccaaacgggagcttttggtgagaaggtgttggacaggggattggcgcccccctttggtttggcctccatcctcatctctcttgggccaagccagctgcctaggtcccccaagcatgggggaccccttcccacatataagttgagaaggtgcctgccatagccaggagcgcatctcaatggaaacatcactggggtcacttgggaagaggacttcggggtagaggctgggaggagcccctggacatgcctgtcctgaaagcggctgcctccattatccattcccaagatgcctgatcagaaaccaaccatgaatgaacccctggctccttcaccacccccacgattggtatgatgctgccggcacagctgggatacacacggctcccccaggcctgagctgcttcactagggaatcctgcggcaggactgcagagcagatggcagatgcacatgttggaggagagagccttgggagccactgccactccagtcctgccaccaccctgtcttcctctgcaagtgctcagggaaatggccttcccgccggaggccagctatctgcctgacaggctgtgactcttctctcaaccttggccttctcccctcttctgagctagttggttgaattttttttaatgcttaagatttgtttttctcttttcacagcaacattttcttgaatttttttctgcacagcttttccaaaataaaaaccttccaaaca

SEQ ID NO: 365213 - DNA, 4255 bp, Homo sapiens
  misc_feature (2971)..(2971): n is a, c, g, or t
agaggccgcggtggcgccgcgccgcccccgacggcgccctctggcggcgacagctggcgccgccggggcacggggatgctgcgggagacccctgagatacaagtggactctcccggggcgcggggaagaagggagagccgactgcgagaaggaaggcgacctgggtgggcaggatcccctctgggaagattacagggacagtcggggccatggcggtcagaaggagaagagcaacgagtggcttttaaaggtcggaaccgaaatgccctttacagaggacgccatgaaggagagccttctgaagagggaccatgtggaagatgccccgaggactcggggaggcggagcccgcgggttcagcccccagcgcccgcacggcccctgcctgcgtaggccgcccgcgggagccggaccccgggcgccggttgctgtggcccgcgggggtcgccgggccgcaggcgccgcgctgattggctgcgccgcgggcggaagtgatgctgctgtcactgctcctccggctcccgggaagccgcgagtttccgcagggaggcggcggcagctgcggcggggccggtctgtagcctttgctgagtcaacactactcacagtgaaagtgatgccttttctccatttgcacaacatgagtgtgacgtggttagccagaccaggagctcaacctcatgtagaatccagtccactgctctgatgccgaaggggaggcagaaagtgccacacttggatgcccccctgggcctgcccacctgcctctggctggaattagccgggctcttcttactggttccctgggtcatgggcctggcagggacaggtgggcctgatggccagggcacaggggggccgagctgggctgtgcacctggaaagcctggaaggtgacggggaggaagagactctggagcagcaggcggatgccttggcccaggcagcagggctggtgaatgctggacgcatcggagagcttcaggggcactacctctttgtccagcctgctgggcacaggccggccctggaggtggaggccatccggcagcaggtggaggctgtgttggctgggcatgaagctgtgcgctggcactcagagcagaggctgctaaggcgggccaagcgcagcgtccacttcaacgaccccaagtacccgcagcaatggcacctgaataaccgacggagcccgggcagggacatcaacgtgacgggtgtgtgggaacgcaatgtgactgggcgaggggtgacggtggtggtagtggatgacggagtggaacacaccatccaggacattgcacccaactatagccctgagggtagctatgacctcaactctaatgaccctgaccccatgccccacccggatgtggagaatggcaaccaccatggcacgcgatgtgcaggagagatcgcggctgtgcccaacaacagcttctgtgccgtgggcgtggcctacgggagccgcatcgcaggtatccgggtactggatggacctctcacagacagcatggaggcagtggcgttcaacaagcactatcagatcaatgacatctacagctgcagctggggaccagatgacgatgggaagacagtggatggcccccatcagcttggaaaggctgccttacaacatggggtgattgctggtcgccagggctttgggagcatctttgtggtagccagtggcaacggaggccaacacaacgacaactgcaactacgatggctacgccaactccatctacaccgtcaccataggagctgtggatgaggagggacgcatgcctttctatgcagaagaatgtgcctccatgctggcagtcaccttcagtggtggggacaagatgcttcggagcattgtgaccactgactgggaccttcagaagggcactggctgcactgagggccacacagggacctcagctgcagcgcctctggcagctggcatgatagccttaatgctgcaggtgcggccctgcctcacgtggcgtgacgtccagcacatcattgtcttcacagccacccggtatgaggatcgccgtgcagagtgggtcaccaacgaggcaggcttcagccatagccaccagcacggtttcggcctcctcaacgcctggaggctcgtgaatgcagccaagatctggacatctgtcccttacttagcatcctacgtcagtcccgtgttaaaagaaaacaaggcgattccgcagtccccccgttccctggaggtcctgtggaatggtaagtaatcagcacaaagggggttaatcttaggcctgaggtttggggccgggtgacaaggaagttaaactcgtcctccctgccagattctaccccctttcggagctgagctccagccaaacctgtggagttttctttgaccattttaggacatgttactgcttctgagttggctcccccagctgcttaaacaagacctttctcctgggttcctagtagtgaaaaggagcagcagagcaactgaggaggagggcgggtgggaggcatgggactggggcttggggaggtcaggcgagaccggggtgagagctcagagaagctcctgtgacttccatgctaagatcttgccagagaactctggtcagtcctcgggtgtctggatgaagtaaaggagttaggcatttcttcctttgattctctggcttacctaatagagagagtcagatgtggtctgctggggatggacagagggtttgtagaagtctcctaggctttagtgacccatcctctgcctccgcctccatggtggccagcatgaaccaggattgtctgaaggggttgtatcctctaagccagcgacctggttttatgttgagcgaagaggcggacgccctccctagaggagagtgcagctggatcaggatgcttgtgcagaggatgccctgtctgcacatttaccagcgttttccctacccccagctccttgggggattctttttcctggagtcattnactactttttgcaaaggaagtatgctatgcttagtgcccaaaccaaaactgtcttcactttttctgtcctcctagaaagtgatcaattgagagccatggcaggagaaggaatggccagagaaggttactcagaagggaggatgaggggtggcttccctcaggtgaaggtttcacagagaagaattgagttttctcctcctaaccacatccagcacttgcccaatttccctcaatgtggaatgaaacccctgggccagtcactgcatttcccataaaaggaatgttatcttggaaagggcataaagcgtcagccaagtcagagaagttcagaaacatttccaggaatgcagttcatttggaagcccctggctttgcacttgcgtgtcttagagatagtgtgccttcaactttaccttctatccagggctatttcctgttgcatctgtcaaatgagggcagtgacttaaaagagtaatatggtcttcccagcttcgtcatcctctgcttcctgctgaccaggggacgttgccacggaatgtctaccctaggcattgaggcatctggcaactgcttgcttgtcactaaaaagtaagagaaagaaggacagattgcctgggtggagaagagtgggaggtggcctagtggagaaagcaggattaagagaagggagggaaagatttagggagtttggctaatggagccctttacctgttggaagggcagcaagcaaaagttttaccagagttttccctacccccagctccttgggggattttttgttttgtttcatttttgtttttgtttttttgccttgagtaattttgacatgcagagttattcacaactttttgcaaagtactattttcattggcttttcagagccagtgaagttgccttctcctccaacatgaccacattttcctctgagcagacaaaaacagaacaaataagtttgtgggcttgcttggaggttgaaagaaataagtccagttaaaatgagagttgagccaggtgccctggctcatgcctgtaatcccagcactttgggaactttgggaggcagataacctgaggtcaggagtttgagaccaacctgaccaacatggtgataccccatctccactaaaaatacaaaattagctgggtgtggtggctcatgcctgtagtcccagctacttgggaggctgaggcaggagaacccgggaggcagaggttgcagtgagctgagatcgcaccattgcactccagcctgggcaagaagagggaaactccatctcaaaaaaa

SEQ ID NO: 365214 - DNA, 2067 bp, Homo sapiens
ggggcacagggaggagctgcccaggtgcagttaccattgcctcagtgacagagccctcaaagcttggccagggctgaaggtaccacacgggtgtgggtgaggcaggctaagcgggatggctgcagccaaggagctgggggagggccgggctcagggctagccctctccgctctaactgatgatctgccgaggtcgtccgtagcctgtcatgccggcctgggaggcccctctgttgctgcccatctgaaggccaatgacatgctttccctcctgcagctggctctctgtgaattccctcttatgctcctgcgctttcttcataaaccagttgggatctccacggtagtgcccatcattcttggtcactgccaagctgcccaaagccatcagggtcctctgcactgctgccatgtctttgccttcaaagaggtcaacagtctggaacatgtcagtcttgatgaccccatagtcctcagccgccttcaggaactgagccacctgctccatctgcttgaagaccatggagggtgggttctcgggcaccttcaccggcttggagccatcagggtacaggctgttcaccagcttgctcagaatcacgccattcttcagccagacctggaagcccaagcgcccacggtctgggcggcccacatcagggccacactgcaactatgatccactccaccagccgctcctccagctcctcgtcatacttcttctcgattttggactgcacttcgcggctcatgccataggaaggacccttgttggccatgtctggggaaagctgtccactgatgtcaccctagggtgctgtgccttctctccagtgtttgtctgaagagacttccaaaagaggtaccaaaggaagccgaacccatcccctggcctcagaggggtcagaggttgggagggacacgctggtctgaggatggacgcaggagcgcactcccccggctccctctctgggctatcgctgctgctcaggccctggggacccgccagagtgggacaccgtgctccaacacagatgaggaaactgaggccccgagtgcgtcttcctcaaggccacatggtgaatggaacagtccctaccagcctggaaaacagaccagcctctgtcactccagagataacccactctcatcttgctcgtacctggcttcagggatcctggggagagataagaggttaaaaaagggacatatcaaaactccctcctcttggagcctgcccagctttcatcaccctcctgcctcggcctgcacgctgagcggattataaacgccgcatcagggagcactgcttgggcctgtggcctgaaaacggaaatgcaaccatagcatggagacgctctgagaaaagatccagacccacctcatctcccagcccttcaagcagagctataaaaacaagtttgggagaaaaacacattcccatccccaaagcagaggccccgcctgagctcccccatcctcagcatctggggtggaccaggtatgtgtgtgcatgactaacacagaacttgcctgaagactggacggaaacttagaagccagccctgggtcctagagcgaggctaggactgggcacgtagagggaaacagcacatcccttcctgaagcccctttctaagtatccaggtcgtcatccagtgtcagcaacacctggggtgtggacgccagatcagccacagagaaggaggcagctgctaccttcacgtacccacccggctcggccgggaggcccgcttaccaggaaggacccgaacatggcgatggaggagaggaagtgccagatgtcgtggtcgtcaaagaagtcgaggaggatgcagtcccggttgtgctccctcgactctgcaggggttttcttggggagcaacaagaaaaactgccgaatgaccctgctctggcagggcaagggccagacccatctgccatcttgctcctgggcacccctctctccagccccaggcaggacagcagcaattctgacctgtcccttgtccttgtccctaccccttcccgatctaacaaatggcctttggttacaaacttaaaatga

SEQ ID NO: 365215 - DNA, 1119 bp, Homo sapiens
ggggcacagggaggagctgcccaggtgcagttaccattgcctcagtgacagagccctcaaagcttggccagggctgaaggtaccacacgggtgtgggtgaggcaggctaagcgggatggctgcagccaaggagctgggggagggccgggctcagggctagccctctccgctctaactgatgatctgccgaggtcgtccgtagcctgtcatgccggcctgggaggcccctctgttgctgcccatctgaaggccaatgacatgctttccctcctgcagctggctctctgtgaattccctcttatgctcctgcgctttcttcataaaccagttgggatctccacggtagtgcccatcattcttggtcactgccaagctgcccaaagccatcagggtcctctgcactgctgccatgtctttgccttcaaagaggtcaacagtctggaacatgtcagtcttgatgaccccatagtcctcagccgccttcaggaactgagccacctgctccatctgcttgaagaccatggagggtgggttctcgggcaccttcaccggcttggagccatcagggtacaggctgttcaccagcttgctcagaatcacgccattcttcagccagacctggaagcccaagcgcccacggtctgggcggcccacatcagggccacactgcaactatgatccactccaccagccgctcctccagctcctcgtcatacttcttctcgattttggactgcacttcgcggctcatgccataggaaggacccttgttggccatgtctggggaaagctaaagcaggccagggtggaggagggaggggcagagggtcagggagcagctctgctttcacccgtgccaggcagccttctagctctgtgcaggatacccggccatcctagacacttgtcacagcactgcccatccaggccaggctcagcccctactccagacacctctctgaacttgaacaccaggaaagaggataccaggtctttggaggtctagagcaggggtcagtaaactgtttttgtaaaggataagacagaacatattttaggctttgcaggacacatggtctctgctgttgcagtgtgcttccgggatcctctagacgaccc

SEQ ID NO: 365216 - DNA, 317 bp, Homo sapiens
aacaacttcgtccattctgatctgtgtggatcctcggcgtgtgcatgcacacgccgaggatctagcctcacgaaactggaataagccttcgaaaagaaattgtccttgaagcttgtatctgatatcagcactggattgtagaacttgttgctgattttgaccttgtattgaagttaactgttccccttggtatttgtttaataccctgtacatatctttgagttcaacctttagtacgtttggacactcggcgtgtgcagcaacaacttcgtccactccgagctgtaactcctcgtctggactgtcggcgtgtgaga

SEQ ID NO: 365217 - DNA, 1609 bp, Homo sapiens
  misc_feature (93)..(93): n is a, c, g, or t
agaagatctggcaccacaccttctacaacgagctgcgcgtggcccggaggagcacccagtgctgctgaccgaggccccctgaaccccaaggcnaacagagagaagatgactcagattatgtttgagaccttcaacaccccggccatgtacgtggccatccaggccgtgctgtccctctacgcctctgggcgcaccactggcattgtcatggactctggagacggggtcacccacacggtgcccatctacgagggctacgccctcccccacgccatcctgcgtctggacctggctggccgggacctgaccgactacctcatgaagatcctcactgagcgaggctacagcttcaccaccacggccgagcgggaaatcgtgcgcgacatcaaggagaagctgtgctacgtcgccctggacttcgagcaggagatggccacggccgcatcctcctcttctctggagaagagctacgagctgcccgatggccaggtcatcaccattggcaatgagcggttccggtgtccggaggcgctgttccagccttccttcctgggtatggaatcttgcggcatccacgagaccaccttcaactccatcatgaagtgtgacgtggacatccgcaaagacctgtacgccaacacggtgctgtccggcggcaccaccatgtatcccggcattgccgacaggatgcagaaggagatcaccgccctggcgtccagcaccatgaagatcaagactcatcgcacccccagagcgcaagtactcggtgtggatcggtggctccatcctggcctcactgtccaccttccagcagatgtggattagcaagcaggagtacgacgagtcgggcccctccatcgtccaccgcaaatgcttctaaacggactcagcagatgcgtagcatttgctgcatgggttaattgagaatagaaatttgcccctggcaaatgcacacacctcatgctagcctcacgaaactggaataagccttcgaaaagaaattgtccttgaagcttgtatctgatatcagcactggattgtagaacttgttgctgattttgaccttgtattgaagttaactgttccccttggtatttgtttaataccctgtacatatctttgagttcaacctttagtacgtgtggcttggtcacttcgtggctaaggtaagaacgtgcttgtggaagacaagttgcgacttggtgagtctgcatggccagcagtctccgatctttgcagggtattaacgtgtcagggctgagtgttctgggatttctctagaggctggcaagaaccagttgttttgtcttgcgggtctgtcagggttggaaagtccaagccgtaggacccagtttcctttcttagctgatgtctttgtgccagaacactgtgggctgtgacttgctttgagttggaagcagtttgcatttacacctgtaaatgtattcatccttttaatttatgtaaggtttttttttgtatgcaattctcgattctttaaggagatgagaacagattttggttttctactgttatgtgagaacattaggccccagcggcatgtcattgtgtaaggaaaaataaaagtgctgctgtaaccaaaaaaaag

SEQ ID NO: 365218 - DNA, 739 bp, Homo sapiens
atcctctagagcgggcgcctactactactaaattcgcggccgcgtcgacattgagaatagaaatttgcccctggcaaatgcacacacctcatgctagcctcacgaaactggaataagccttcgaaaagaaattgtccttgaagcttgtatctgatatcagcactggattgtagaacttgttgctgattttgaccttgtattgaagttaactgttccccttggtatttgtttaataccctgtacatatctttgagttcaacctttagtacgtgtggcttggtcacttcgtggctaaggtaagaacgtgcttgtggaagacaagttgcgacttggtgagtctgcatggccagcagtctccgatctttgcagggtattaacgtgtcagggctgagtgttctgggatttctctagaggctggcaagaaccagttgttttgtcttgcgggtctgtcagggttggaaagtccaagccgtaggacccagtttcctttcttagctgatgtctttgtgccagaacactgtgggctgtgacttgctttgagttggaagcagtttgcatttacacctgtaaatgtattcatccttttaatttatgtaaggtttttttttgtatgcaattctcgattctttaaggagatgagaacagattttggttttctactgttatgtgagaacattaggccccagcggcatgtcattgtgtaaggaaaaataaaagtgctgctgtaaccaaaaaaaag

SEQ ID NO: 365219 - DNA, 1250 bp, Homo sapiens
  misc_feature (93)..(93): n is a, c, g, or t
agaagatctggcaccacaccttctacaacgagctgcgcgtggcccggaggagcacccagtgctgctgaccgaggccccctgaaccccaaggcnaacagagagaagatgactcagattatgtttgagaccttcaacaccccggccatgtacgtggccatccaggccgtgctgtccctctacgcctctgggcgcaccactggcattgtcatggactctggagacggggtcacccacacggtgcccatctacgagggctacgccctcccccacgccatcctgcgtctggacctggctggccgggacctgaccgactacctcatgaagatcctcactgagcgaggctacagcttcaccaccacggccgagcgggaaatcgtgcgcgacatcaaggagaagctgtgctacgtcgccctggacttcgagcaggagatggccacggccgcatcctcctcttctctggagaagagctacgagctgcccgatggccaggtcatcaccattggcaatgagcggttccggtgtccggaggcgctgttccagccttccttcctgggtatggaatcttgcggcatccacgagaccaccttcaactccatcatgaagtgtgacgtggacatccgcaaagacctgtacgccaacacggtgctgtccggcggcaccaccatgtatcccggcattgccgacaggatgcagaaggagatcaccgccctggcgtccagcaccatgaagatcaagactcatcgcacccccagagcgcaagtactcggtgtggatcggtggctccatcctggcctcactgtccaccttccagcagatgtggattagcaagcaggagtacgacgagtcgggcccctccatcgtccaccgcaaatgcttctaaacggactcagcagatgcgtagcatttgctgcatgggttaattgagaatagaaatttgcccctggcaaatgcacacacctcatgctagcctcacgaaactggaataagccttcgaaaagaaattgtccttgaagcttgtatctgatatcagcactggattgtagaacttgttgctgattttgaccttgtattgaagttaactgttccccttggtatttgtttaataccctgtacatatccatggagctcgacctgtatacaagagttgatggattgggcacttcgtggctaacgagtaagcacggtgcttctggaatggcatagtctgtggctttcgtgagatctgtcatggtactaggtcctcagcgtgt

SEQ ID NO: 365220 - DNA, 1202 bp, Homo sapiens
  misc_feature (93)..(93): n is a, c, g, or t
agaagatctggcaccacaccttctacaacgagctgcgcgtggcccggaggagcacccagtgctgctgaccgaggccccctgaaccccaaggcnaacagagagaagatgactcagattatgtttgagaccttcaacaccccggccatgtacgtggccatccaggccgtgctgtccctctacgcctctgggcgcaccactggcattgtcatggactctggagacggggtcacccacacggtgcccatctacgagggctacgccctcccccacgccatcctgcgtctggacctggctggccgggacctgaccgactacctcatgaagatcctcactgagcgaggctacagcttcaccaccacggccgagcgggaaatcgtgcgcgacatcaaggagaagctgtgctacgtcgccctggacttcgagcaggagatggccacggccgcatcctcctcttctctggagaagagctacgagctgcccgatggccaggtcatcaccattggcaatgagcggttccggtgtccggaggcgctgttccagccttccttcctgggtatggaatcttgcggcatccacgagaccaccttcaactccatcatgaagtgtgacgtggacatccgcaaagacctgtacgccaacacggtgctgtccggcggcaccaccatgtatcccggcattgccgacaggatgcagaaggagatcaccgccctggcgtccagcaccatgaagatcaagactcatcgcacccccagagcgcaagtactcggtgtggatcggtggctccatcctggcctcactgtccaccttccagcagatgtggattagcaagcaggagtacgacgagtcgggcccctccatcgtccaccgcaaatgcttctaaacggactcagcagatgcgtagcatttgctgcatgggttaattgagaatagaaatttgcccctggcaaatgcacacacctcatgctagcctcacgaaactggaataagccttcgaaaagaaattgtccttgaagcttgtatctgatatcagcactggattgtagaacttgttgctgattttgaccttgtattgaagttaactgttccccttggtattaacgtgtcagggctgagtgttctgggatttctctagaggctggcaagaaccagttgttttgacttgcgggctgatcctctagagtcgaccgatcctctagagtcga

SEQ ID NO: 365221 - DNA, 678 bp, Homo sapiens
actctagaggatctcctgcacacgccgaggcactagcctcacgaaactggaataagccttcgaaaagaaattgtccttgaagcttgtatctgatatcagcactggattgtagaacttgttgctgattttgaccttgtattgaagttaactgttccccttggtatttgtttaataccctgtacatatctttgagttcaacctttagtacgtgtggcttggtcacttcgtggctaaggtaagaacgtgcttgtggaagacaagttgcgacttggtgagtctgcatggccagcagtctccgatctttgcagggtattaacgtgtcagggctgagtgttctgggatttctctagaggctggcaagaaccagttgttttgtcttgcgggtctgtcagggttggaaagtccaagccgtaggacccagtttcctttcttagctgatgtctttgtgccagaacactgtgggctgtgacttgctttgagttggaagcagtttgcatttacacctgtaaatgtattcatccttttaatttatgtaaggtttttttttgtatgcaattctcgattctttaaggagatgagaacagattttggttttctactgttatgtgagaacattaggccccagcggcatgtcattgtgtaaggaaaaataaaagtgctgctgtaaccaaaaaaaag

SEQ ID NO: 365222 - DNA, 748 bp, Homo sapiens
ttcaatttctatttgaaggcttattccagtttcgtgaggctagcatgaggtgtgtgcagtttgccagggagtagatttctagttctcaattaacccatgcagctagcctcacgaaactggaataagccttcgaaaagaaattgtccttgaagcttgtatctgatatcagcactggattgtagaacttgttgctgattttgaccttgtattgaagttaactgttccccttggtatttgtttaataccctgtacatatctttgagttcaacctttagtacgtgtggcttggtcacttcgtggctaaggtaagaacgtgcttgtggaagacaagttgcgacttggtgagtctgcatggccagcagtctccgatctttgcagggtattaacgtgtcagggctgagtgttctgggatttctctagaggctggcaagaaccagttgttttgtcttgcgggtctgtcagggttggaaagtccaagccgtaggacccagtttcctttcttagctgatgtctttgtgccagaacactgtgggctgtgacttgctttgagttggaagcagtttgcatttacacctgtaaatgtattcatccttttaatttatgtaaggtttttttttgtatgcaattctcgattctttaaggagatgagaacagattttggttttctactgttatgtgagaacattaggccccagcggcatgtcattgtgtaaggaaaaataaaagtgctgctgtaaccaaaaaaaag

SEQ ID NO: 365223 - DNA, 1461 bp, Homo sapiens
  misc_feature (93)..(93): n is a, c, g, or t
agaagatctggcaccacaccttctacaacgagctgcgcgtggcccggaggagcacccagtgctgctgaccgaggccccctgaaccccaaggcnaacagagagaagatgactcagattatgtttgagaccttcaacaccccggccatgtacgtggccatccaggccgtgctgtccctctacgcctctgggcgcaccactggcattgtcatggactctggagacggggtcacccacacggtgcccatctacgagggctacgccctcccccacgccatcctgcgtctggacctggctggccgggacctgaccgactacctcatgaagatcctcactgagcgaggctacagcttcaccaccacggccgagcgggaaatcgtgcgcgacatcaaggagaagctgtgctacgtcgccctggacttcgagcaggagatggccacggccgcatcctcctcttctctggagaagagctacgagctgcccgatggccaggtcatcaccattggcaatgagcggttccggtgtccggaggcgctgttccagccttccttcctgggtatggaatcttgcggcatccacgagaccaccttcaactccatcatgaagtgtgacgtggacatccgcaaagacctgtacgccaacacggtgctgtccggcggcaccaccatgtatcccggcattgccgacaggatgcagaaggagatcaccgccctggcgtccagcaccatgaagatcaagactcatcgcacccccagagcgcaagtactcggtgtggatcggtggctccatcctggcctcactgtccaccttccagcagatgtggattagcaagcaggagtacgacgagtcgggcccctccatcgtccaccgcaaatgcttctaaacggactcagcagatgcgtagcatttgctgcatgggttaattgagaatagaaatttgcccctggcaaatgcacacacctcatgctagcctcacgaaactggaataagccttcgaaaagaaattgtccttgaagcttgtatctgatatcagcactggattgtagaacttgttgctgattttgaccttgtattgaagttaactgttccccttgggtattaacgtgtcagggctgagtgttctgggatttctctagaggctggcaagaaccagttgttttgtcttgcgggtctgtcagggttggaaagtccaagccgtaggacccagtttcctttcttagctgatgtctttgtgccagaacactgtgggctgtgacttgctttgagttggaagcagtttgcatttacacctgtaaatgtattcatccttttaatttatgtaaggtttttttttgtatgcaattctcgattctttaaggagatgagaacagattttggttttctactgttatgtgagaacattaggccccagcggcatgtcattgtgtaaggaaaaataaaagtgctgctgtaaccaaaaaaaag

SEQ ID NO: 365224 - DNA, 1160 bp, Homo sapiens
  misc_feature (93)..(93): n is a, c, g, or t
agaagatctggcaccacaccttctacaacgagctgcgcgtggcccggaggagcacccagtgctgctgaccgaggccccctgaaccccaaggcnaacagagagaagatgactcagattatgtttgagaccttcaacaccccggccatgtacgtggccatccaggccgtgctgtccctctacgcctctgggcgcaccactggcattgtcatggactctggagacggggtcacccacacggtgcccatctacgagggctacgccctcccccacgccatcctgcgtctggacctggctggccgggacctgaccgactacctcatgaagatcctcactgagcgaggctacagcttcaccaccacggccgagcgggaaatcgtgcgcgacatcaaggagaagctgtgctacgtcgccctggacttcgagcaggagatggccacggccgcatcctcctcttctctggagaagagctacgagctgcccgatggccaggtcatcaccattggcaatgagcggttccggtgtccggaggcgctgttccagccttccttcctgggtatggaatcttgcggcatccacgagaccaccttcaactccatcatgaagtgtgacgtggacatccgcaaagacctgtacgccaacacggtgctgtccggcggcaccaccatgtatcccggcattgccgacaggatgcagaaggagatcaccgccctggcgtccagcaccatgaagatcaagactcatcgcacccccagagcgcaagtactcggtgtggatcggtggctccatcctggcctcactgtccaccttccagcagatgtggattagcaagcaggagtacgacgagtcgggcccctccatcgtccaccgcaaatgcttctaaacggactcagcagatgcgtagcatttgctgcatgggttaattgagaatagaaatttgcccctggcaaatgcacacacctcatgctagcctcacgaaactggaataagccttcgaaaagaaattgtccttgaagcttgtatctgatatcagcactggattgtagaacttgttgctgattttgaccttgtattgaagttaactgttccccttggtatttgtttaataccctgtacatatcctaggagtctcaacatgtacgaagagtgacgatggcgaactg

SEQ ID NO: 365225 - DNA, 1203 bp, Homo sapiens
gccggcgcgggaagcgcttcggggcaggggcggggcttccggcggcgcctcaggtcgcggggcgcctaggcctgggttgtcctttgcatctgcacgtgttcgcagtcgtttccgcgatgctgcctctgctgcgctgcgtgccccgtgtgctgggctcctccgtcgccggcctccgcgctgccgcgcccgcctcgcctttccggcagctcctgcagccggcaccccggctgtgcacccggcccttcgggctgctcagcgtgcgcgcaggttccgagcggcggccgggcctcctgcggcctcgcggaccctgcgcctgtggctgtggctgcggctcgctgcacaccgacggagacaaagcttttgttgatttcctgagtgatgaaattaaggaggaaagaaaaattcagaagcataaaaccctccctaagatgtctggaggttgggagctggaactgaatgggacagaagcgaaattagtgcggaaagttgccggggaaaaaatcacggtcactttcaacattaacaacagcatcccaccaacatttgatggtgaggaggaaccctcgcaagggcagaaggttgaagaacaggagcctgaactgacatcaactcccaatttcgtggttgaagttataaagaatgatgatggcaagaaggcccttgtgttggactgtcattatccagaggatgaggttggacaagaagacgaggctgagagtgacatcttctctatcagggaagttagctttcagtccactggcgagtctgaatggaaggatactaattatacactcaacacagattccttggactgggccttatatgaccacctaatggatttccttgccgaccgaggggtggacaacacttttgcagatgagctggtggagctcagcacagccctggagcaccaggagtacattacttttcttgaagacctcaagagttttgtcaagagccagtagagcagacagatgctgaaagccatagtttcatggcaggctttggccagtgaacaaatcctactctgaagctagacatgtgctttgaaatgattatcatcctaatatcatgggggaaaaaataccaaatttaaattatatgttttgtgttctcatttattatcatttttttctgtacaaatctattatttctagatttttgtataacatgatagacataaaattggtttatctcctccaa

SEQ ID NO: 365226 - DNA, 460 bp, Homo sapiens
tcaaggggagaaaaaagcattttaatgttcattacagatttttttttaactagtaaatattgttctttgcaggccttatatgaccacctaatggatttccttgccgaccgaggggtggacaacacttttgcagatgagctggtggagctcagcacagccctggagcaccaggagtacattacttttcttgaagacctcaagagttttgtcaagagccagtagagcagacagatgctgaaagccatagtttcatggcaggctttggccagtgaacaaatcctactctgaagctagacatgtgctttgaaatgattatcatcctaatatcatgggggaaaaaataccaaatttaaattatatgttttgtgttctcatttattatcatttttttctgtacaaatctattatttctagatttttgtataacatgatagacataaaattggtttatctcctccaa

SEQ ID NO: 365227 - DNA, 1074 bp, Homo sapiens
gggattacagacgtgagccaccgtgcccggtgaaactccatctcaaaaaaaaaaaaagaaggaaaggaaaggaaacagacctgtgtgctctagcagggtgttttcctctgcctgttctgctcagagccttggaagaaagtaaactgtgatgggggtggcacaggcctcaatcatctgcttttggggctcgagagggacacggaaaggccttcccactatttgtttctggtcctcctcttcgttctcttatgcaggtgattgtgatgtcagctacgatggatgtggacctgttctctcagtatttcaatggcgcccccgtcctctacctagagggtcggcagcatccgatccaggtgttttacaccaaacagcctcagaatgattacctgcacgccgcgcttgtctccgtcttccagatccaccaggaagccccttcttcacaggacatcctggtgttcctcactgggcaggaggagatcgaagccatgagcaagacgtgccgagacattgcaaagcacctcccagacggctgccctgcgatgctggtccttcctctgtacgcctccctgccctatgcacagcagctccgagtcttccaaggggccccaaagggtatcgcaagtgatcattcaaccaaatcgctgaactccaaaacattacgggaatacgatatgtgcatgaacacgagcgcgtgtaaagcaacagaagtatacccggacacagacataaggggtaaaccgagcaggggaacaaagaacaacggctggagacgccggagaggcagcaaaaaagacgcagggacactgaacgggaccacaggagggagaaattgaacacagggcacagaacggccaagcacacagggacaactgacagaaaggaagcagcaaacaacagaacacaagggagcatagagtgagaatcgacgcagaaaaaaaaaggaggagcacgagcacacggacgagcacaggaagaacgaaaagaaagaagagtaaacaagaacgaactacctaagaaaagaaagggaaccagagaaagaacgtagagaacagcgagagaacaagacacacagat

SEQ ID NO: 365228 - DNA, 1627 bp, Homo sapiens
  misc_feature (1213)..(1213): n is a, c, g, or t
  misc_feature (1627)..(1627): n is a, c, g, or t
gccggcgcgggaagcgcttcggggcaggggcggggcttccggcggcgcctcaggtcgcggggcgcctaggcctgggttgtcctttgcatctgcacgtgttcgcagtcgtttccgcgatgctgcctctgctgcgctgcgtgccccgtgtgctgggctcctccgtcgccggcctccgcgctgccgcgcccgcctcgcctttccggcagctcctgcagccggcaccccggctgtgcacccggcccttcgggctgctcagcgtgcgcgcaggttccgagcggcggccgggcctcctgcggcctcgcggaccctgcgcctgtggctgtggctgcggctcgctgcacaccgacggagacaaagcttttgttgatttcctgagtgatgaaattaaggaggaaagaaaaattcagaagcataaaaccctccctaagatgtctggaggttgggagctggaactgaatgggacagaagcgaaattagtgcggaaagttgccggggaaaaaatcacggtcactttcaacattaacaacagcatcccaccaacatttgatggtgaggaggaaccctcgcaagggcagaaggttgaagaacaggagcctgaactgacatcaactcccaatttcgtggttgaagttataaagaatgatgatggcaagaaggcccttgtgttggactgtcattatccagaggatgaggttggacaagaagacgaggctgagagtgacatcttctctatcagggaagttagctttcagtccactggcgagtctgaatggaaggatactaattatacactcaacacagattccttggactgggccttatatgaccacctaatggatttccttgccgaccgaggggtggacaacacttttgcagatgagctggtggagctcagcacagccctggagcaccaggagtacattacttttcttgaagacctcaagagttttgtcaagagccagtagagcagacagatgctgaaagccatagtttcatggcaggctttggccagtgaacaaatcctactctgaagctagacatgtgctttgaaatgattatcatcctaatatcatgggggaaaaaataccaaatttaaattatatgttttgtgttctcatttattatcatttttttctgtacaaatctattatttctagatttttgtataacatgatagacataaaattggtttatctcctccaaaaaaaacacnaaaaaacagaaacaacacaggggagaagcacacaaagttaccaccgaggcgcccaagataacacagacacaatttccggcacagcgggcccacaacgcgaccaccaaaaacacacaacagcgacggaaaacacgccgcgcggcacacctcgcactcgggacactgggttaagggaccaatactcgggggcgggacacgagcggcaccaccccccagaaaacgcgcacccggacaccacacccagaagcaacaggtgaaacacacaaagtaagcgggcgcaaactgacacagcaacaactaaaatcagcaaacgacacataaaagcacagacaagcaccagaaagacaaaaagaggcgcagcccgcaaaggatgcacaccaataacaccacaacacaagcaaaccaagacataan

SEQ ID NO: 365229 - DNA, 1790 bp, Homo sapiens
gccggcgcgggaagcgcttcggggcaggggcggggcttccggcggcgcctcaggtcgcggggcgcctaggcctgggttgtcctttgcatctgcacgtgttcgcagtcgtttccgcgatgctgcctctgctgcgctgcgtgccccgtgtgctgggctcctccgtcgccggcctccgcgctgccgcgcccgcctcgcctttccggcagctcctgcagccggcaccccggctgtgcacccggcccttcgggctgctcagcgtgcgcgcaggttccgagcggcggccgggcctcctgcggcctcgcggaccctgcgcctgtggctgtggctgcggctcgctgcacaccgacggagacaaagcttttgttgatttcctgagtgatgaaattaaggaggaaagaaaaattcagaagcataaaaccctccctaagatgtctggaggttgggagctggaactgaatgggacagaagcgaaattagtgcggaaagttgccggggaaaaaatcacggtcactttcaacattaacaacagcatcccaccaacatttgatggtgaggaggaaccctcgcaagggcagaaggttgaagaacaggagcctgaactgacatcaactcccaatttcgtggttgaagttataaagaatgatgatggcaagaaggcccttgtgttggactgtcattatccagaggatgaggttggacaagaagacgaggctgagagtgacatcttctctatcagggaagttagctttcagtccactggcgagtctgaatggaaggatactaattatacactcaacacagattccttggactgggccttatatgaccacctaatggatttccttgccgaccgaggggtggacaacacttttgcagatgagctggtggagctcagcacagccctggagcaccaggagtacattacttttcttgaagacctcaagagttttgtcaagagccagtagagcagacagatgctgaaagccatagtttcatggcaggctttggccagtgaacaaatcctactctgaagctagacatgtgctttgaaatgattatcatcctaatatcatgggggaaaaaataccaaatttaaattatatgttttgtgttctcatttattatcatttttttctgtacaaatctattatttctagatttttgtataacatgatagacataaaattggtttatctcctccaacaaggcagtttgtctttttctattcctcccccttcaacctgcgtcacaaaagaccaagaacagatgtcggaaaagtttttttttcttcagtattgtttaaaagtttcaatacaaaataagttataaataaaaggcttgtatgtacaaggctcctcagagggaatgagttgtcttcaaccccatagaatgatgtgagtccaagctggctctagaggatcacagcccaagtatcacaggcctaggtttaaacaggaaaataattagcttaaattgtattctagtcatgaaagatatctgataaaagttgtaatcaatgagaattctacacattagatgaggtctcctgagtccagtttcaattagttcagtagtgtagtttgtcatgatgaccgcccctctttggcattgctggacctctgtcctgcagccttcaaacaactgccctgggaaccatcagcatcaatagtcttcaagctaagatcaaatcctgtagatgaactaatcaaacatcctcaccatcaggaaaccactgaccagaaagattgtattcaaactcttgatagcctggagcttttagagcccagcag

SEQ ID NO: 365230 - DNA, 1645 bp, Homo sapiens
gccggcgcgggaagcgcttcggggcaggggcggggcttccggcggcgcctcaggtcgcggggcgcctaggcctgggttgtcctttgcatctgcacgtgttcgcagtcgtttccgcgatgctgcctctgctgcgctgcgtgccccgtgtgctgggctcctccgtcgccggcctccgcgctgccgcgcccgcctcgcctttccggcagctcctgcagccggcaccccggctgtgcacccggcccttcgggctgctcagcgtgcgcgcaggttccgagcggcggccgggcctcctgcggcctcgcggaccctgcgcctgtggctgtggctgcggctcgctgcacaccgacggagacaaagcttttgttgatttcctgagtgatgaaattaaggaggaaagaaaaattcagaagcataaaaccctccctaagatgtctggaggttgggagctggaactgaatgggacagaagcgaaattagtgcggaaagttgccggggaaaaaatcacggtcactttcaacattaacaacagcatcccaccaacatttgatggtgaggaggaaccctcgcaagggcagaaggttgaagaacaggagcctgaactgacatcaactcccaatttcgtggttgaagttataaagaatgatgatggcaagaaggcccttgtgttggactgtcattatccagaggatgaggttggacaagaagacgaggctgagagtgacatcttctctatcagggaagttagctttcagtccactggcgagtctgaatggaaggatactaattatacactcaacacagattccttggactgggccttatatgaccacctaatggatttccttgccgaccgaggggtggacaacacttttgcagatgagctggtggagctcagcacagccctggagcaccaggagtacattacttttcttgaagacctcaagagttttgtcaagagccagtagagcagacagatgctgaaagccatagtttcatggcaggctttggccagtgaacaaatcctactctgaagctagacatgtgctttgaaatgattatcatcctaatatcatgggggaaaaaataccaaatttaaattatatgttttgtgttctcatttattatcatttttttctgtacaaatctattatttctagatttttgtataacatgatagacataaaattggtttatctcctccaaaaaaagaaaaagaacaaacaaacccgggggggacacattggggggggggcaacaacgcgggtatcggaggggccactgggcccaaggggttccggaacccagttttttggtcccagggggtacatcggcggaccccccatagaggggggcgaacataaaattcgagaaggtccggggtaacccggcttaggaaccgcggcaaacgcaacgagcgacagaagatgcgacacagaaagacgccgggggagatcacatgcatgacacgcacgggggcgacacgggactgacagccataacagcacgcaccagcaactacaagcaccaagcaatatgagaaacacaacagagtcaggacgagagcacaaacagagagcgacggcaaccacaggcgacagcgaccggacgcatcagcgacgagggagggacacaaggaggaagaata

SEQ ID NO: 365231 - DNA, 1395 bp, Homo sapiens
gccggcgcgggaagcgcttcggggcaggggcggggcttccggcggcgcctcaggtcgcggggcgcctaggcctgggttgtcctttgcatctgcacgtgttcgcagtcgtttccgcgatgctgcctctgctgcgctgcgtgccccgtgtgctgggctcctccgtcgccggcctccgcgctgccgcgcccgcctcgcctttccggcagctcctgcagccggcaccccggctgtgcacccggcccttcgggctgctcagcgtgcgcgcaggttccgagcggcggccgggcctcctgcggcctcgcggaccctgcgcctgtggctgtggctgcggctcgctgcacaccgacggagacaaagcttttgttgatttcctgagtgatgaaattaaggaggaaagaaaaattcagaagcataaaaccctccctaagatgtctggaggttgggagctggaactgaatgggacagaagcgaaattagtgcggaaagttgccggggaaaaaatcacggtcactttcaacattaacaacagcatcccaccaacatttgatggtgaggaggaaccctcgcaagggcagaaggttgaagaacaggagcctgaactgacatcaactcccaatttcgtggttgaagttataaagaatgatgatggcaagaaggcccttgtgttggactgtcattatccagaggatgaggttggacaagaagacgaggctgagagtgacatcttctctatcagggaagttagctttcagtccactggcgagtctgaatggaaggatactaattatacactcaacacagattccttggactgggccttatatgaccacctaatggatttccttgccgaccgaggggtggacaacacttttgcagatgagctggtggagctcagcacagccctggagcaccaggagtacattacttttcttgaagacctcaagagttttgtcaagagccagtagagcagacagatgctgaaagccatagtttcatggcaggctttggccagtgaacaaatcctactctgaagctagacatgtgctttgaaatgattatcatcctaatatcatgggggaaaaaataccaaatttaaattatatgttttgtgttctcatttattatcatttttttctgtacaaatctattatttctagatttttgtataacatgatagacataaaattggtttatctcctccaaaaaaaaaaaaaaaaaaaaatttgtgagttaatggtacaagtgtgagtacttatccagagttttattatcctataactgtagtcccagctcctctggaagctgaggtggggaggacacttgaacccccatagtaaagtctgcagtgggctgccactgcactccagcctgggtgacagcaagactctgtctcaa

SEQ ID NO: 365232 - DNA, 1169 bp, Homo sapiens
cgaaacgcaacaacccaaagtaggcaggacgaggctgggttgtgaatcggcagaggcacacgtgttcgcagtcgtttccgcgatgctgcctctgctgcgctgcgtgccccgtgtgctgggctcctccgtcgccggcctccgcgctgccgcgcccgcctcgcctttccggcagctcctgcagccggcaccccggctgtgcacccggcccttcgggctgctcagcgtgcgcgcaggttccgagcggcggccgggcctcctgcggcctcgcggaccctgcgcctgtggctgtggctgcggctcgctgcacaccgacggagacaaagcttttgttgatttcctgagtgatgaaattaaggaggaaagaaaaattcagaagcataaaaccctccctaagatgtctggaggttgggagctggaactgaatgggacagaagcgaaattagtgcggaaagttgccggggaaaaaatcacggtcactttcaacattaacaacagcatcccaccaacatttgatggtgaggaggaaccctcgcaagggcagaaggttgaagaacaggagcctgaactgacatcaactcccaatttcgtggttgaagttataaagaatgatgatggcaagaaggcccttgtgttggactgtcattatccagaggatgaggttggacaagaagacgaggctgagagtgacatcttctctatcagggaagttagctttcagtccactggcgagtctgaatggaaggatactaattatacactcaacacagattccttggactgggccttatatgaccacctaatggatttccttgccgaccgaggggtggacaacacttttgcagatgagctggtggagctcagcacagccctggagcaccaggagtacattacttttcttgaagacctcaagagttttgtcaagagccagtagagcagacagatgctgaaagccatagtttcatggcaggctttggccagtgaacaaatcctactctgaagctagacatgtgctttgaaatgattatcatcctaatatcatgggggaaaaaataccaaatttaaattatatgttttgtgttctcatttattatcatttttttctgtacaaatctattatttctagatttttgtataacatgatagacataaaattggtttatctcctccaa

SEQ ID NO: 365233 - DNA, 1081 bp, Homo sapiens
  misc_feature (894)..(894): n is a, c, g, or t
  misc_feature (901)..(901): n is a, c, g, or t
gccggcgcgggaagcgcttcggggcaggggcggggcttccggcggcgcctcaggtcgcggggcgcctaggcctgggttgtcctttgcatctgcacgtgttcgcagtcgtttccgcgatgctgcctctgctgcgctgcgtgccccgtgtgctgggctcctccgtcgccggcctccgcgctgccgcgcccgcctcgcctttccggcagctcctgcagccggcaccccggctgtgcacccggcccttcgggctgctcagcgtgcgcgcaggttccgagcggcggccgggcctcctgcggcctcgcggaccctgcgcctgtggctgtggctgcggctcgctgcacaccgacggagacaaagcttttgttgatttcctgagtgatgaaattaaggaggaaagaaaaattcagaagcataaaaccctccctaagatgtctggaggttgggagctggaactgaatgggacagaagcgaaattagtgcggaaagttgccggggaaaaaatcacggtcactttcaacattaacaacagcatcccaccaacatttgatggtgaggaggaaccctcgcaagggcagaaggttgaagaacaggagcctgaactgacatcaactcccaatttcgtggttgaagttataaagaatgatgatggcaagaaggcccttgtgttggactgtcattatccagaggatgaggttggacaagaagacgaggctgagagtgacatcttctctatcagggaagttagctttcagtccactggcgagtctgaatggaaggatactaattatacactcaacacagattccttggactgggccttatatgaccacctaatggatttccttgccgaccgaggggtggacaacacttttgcagatgagctggtggagcggnccagagnctctttcttgagcctagagtttggcgacgcttacgacgtctaagctagtctgcggtgcgggcacacctcctcgctctgtctgggtttcccatcggggcaccctattttggccctaactgcgcctttatgtcgcacctctcctcaaaaaacttggtggggttcctctctctcttgccttct

SEQ ID NO: 365234 - DNA, 954 bp, Homo sapiens
gccggcgcgggaagcgcttcggggcaggggcggggcttccggcggcgcctcaggtcgcggggcgcctaggcctgggttgtcctttgcatctgcacgtgttcgcagtcgtttccgcgatgctgcctctgctgcgctgcgtgccccgtgtgctgggctcctccgtcgccggcctccgcgctgccgcgcccgcctcgcctttccggcagctcctgcagccggcaccccggctgtgcacccggcccttcgggctgctcagcgtgcgcgcaggttccgagcggcggccgggcctcctgcggcctcgcggaccctgcgcctgtggctgtggctgcggctcgctgcacaccgacggagacaaagcttttgttgatttcctgagtgatgaaattaaggaggaaagaaaaattcagaagcataaaaccctccctaagatgtctggaggttgggagctggaactgaatgggacagaagcgaaattagtgcggaaagttgccggggaaaaaatcacggtcactttcaacattaacaacagcatcccaccaacatttgatggtgaggaggaaccctcgcaagggcagaaggttgaagaacaggagcctgaactgacatcaactcccaatttcgtggttgaagttataaagaatgatgatggcaagaaggcccttgtgttggactgtcattatccagaggatgaggttggacaagaagacgaggctgagagtgacatcttctctatcagggaagttagctttcagtccactggcgagtctgaatggaaggatactaattatacactcaacacagattccttggactgggccttatatgaccacctaatggatttccttgccgaccgaggggtggacaacacttttgcagatgagctggtggagcgacgaagatgcgcgctcttcgtcccatcagcggatttctatacagtgacctcttgttggttat

SEQ ID NO: 365235 - DNA, 1178 bp, Homo sapiens
cggcgggggaccgcggtgctcgccggtgccaccatacggctcggcttgtcctttgtactctgctgattgtcctgactactgctacgtgatggctggtgtctgctgcactaccatgtgccgctctgtgggctcctccgtcgccggcctccgcgctgccgcgcccgcctcgcctttccggcagctcctgcagccggcaccccggctgtgcacccggcccttcgggctgctcagcgtgcgcgcaggttccgagcggcggccgggcctcctgcggcctcgcggaccctgcgcctgtggctgtggctgcggctcgctgcacaccgacggagacaaagcttttgttgatttcctgagtgatgaaattaaggaggaaagaaaaattcagaagcataaaaccctccctaagatgtctggaggttgggagctggaactgaatgggacagaagcgaaattagtgcggaaagttgccggggaaaaaatcacggtcactttcaacattaacaacagcatcccaccaacatttgatggtgaggaggaaccctcgcaagggcagaaggttgaagaacaggagcctgaactgacatcaactcccaatttcgtggttgaagttataaagaatgatgatggcaagaaggcccttgtgttggactgtcattatccagaggatgaggttggacaagaagacgaggctgagagtgacatcttctctatcagggaagttagctttcagtccactggcgagtctgaatggaaggatactaattatacactcaacacagattccttggactgggccttatatgaccacctaatggatttccttgccgaccgaggggtggacaacacttttgcagatgagctggtggagctcagcacagccctggagcaccaggagtacattacttttcttgaagacctcaagagttttgtcaagagccagtagagcagacagatgctgaaagccatagtttcatggcaggctttggccagtgaacaaatcctactctgaagctagacatgtgctttgaaatgattatcatcctaatatcatgggggaaaaaataccaaatttaaattatatgttttgtgttctcatttattatcatttttttctgtacaaatctattatttctagatttttgtataacatgatagacataaaattggtttatctcctccaa

SEQ ID NO: 365236 - DNA, 2564 bp, Homo sapiens
acatgccggaggaggcgggcttcccgccggccaagagattccggccaggctctggacctccgagccgcgctgggtccttccctcccgggaggcaagtggtgatgctgctgactgcgggcagcggcggcagaggaggaggaggaggccggaggcagcagccgcccctggcccagccctcggccagtccctaccctgaagctgtggagctgcagcgccggagtctgcccatcttccaagcgcgggggcaactgttggcccagctccgaaacctggacaacgcggtcctcatcggttggctatacagtgcgctttgatgatgtcacctcagaagacaccaggatcaagtttctgacagatggcatgcttctgcgtgaagcaatttcagactctttgcttcggaaatacagctgtgtcattttggatgaagctcacgaacggactatccacacagatgtgctctttggagtggtgaaagctgcacagaagaggagaaaggaactcgggaaacttcctctgaaagtgattgtgatgtcagctacgatggatgtggacctgttctctcagtatttcaatggcgcccccgtcctctacctagagggtcggcagcatccgatccaggtgttttacaccaaacagcctcagaatgattacctgcacgccgcgcttgtctccgtcttccagatccaccaggaagccccttcttcacaggacatcctggtgttcctcactgggcaggaggagatcgaagccatgagcaagacgtgccgagacattgcaaagcacctcccagacggctgccctgcgatgctggtccttcctctgtacgcctccctgccctatgcacagcagctccgagtcttccaaggggccccaaagggctatcgcaaagtgatcatttcaaccaacatcgctgaaacctccataaccattacaggaataaaatatgtagttgacacgggcatggttaaagcaaagaagtataaccctgacagtggtcttgaggtgttagcagtgcagcgggtatcgaagacgcaggcttggcagcgcacagggagggctggcagagaggacagtggcatctgctaccggctctacacggaggacgagtttgagaagtttgataagatgaccgtgccagagatccagaggtgtaacctggccagtgtgatgcttcagcttctagcaatgaaagtcccaaatgtgctcacctttgacttcatgtcgaagccatctccagatcacattcaggcggccattgcccaactggacctgttaggtgctcttgaacataaggatgaccagcttaccctgactccaatgggaagaaagatggcagcatttcctttagaacccaaatttgccaaaaccatcctcatgtcccccaaattccactgtacagaggagatcctgaccattgtctccctgctgtctgtggacagcgtcctccacaaccctccttcccggcgagaggaagtgcaaggggtccgcaagaagttcatatccagcgagggggatcacatgaccctgctcaatatctatcggaccttcaaaaacctaggcggaaataaggattggtgcaaagagaattttgtcaacagcaagaatatgacgctggtagcagaagtcagagcacagctgagggacatctgcttaaaggtatcgtctggtcctagtgttctgtgggtgacaaagctgtcactttgttcaaggagacaaagcttttgttgatttcctgagtgatgaaattaaggaggaaagaaaaattcagaagcataaaaccctccctaagatgtctggaggttgggagctggaactgaatgggacagaagcgaaattagtgcggaaagttgccggggaaaaaatcacggtcactttcaacattaacaacagcatcccaccaacatttgatggtgaggaggaaccctcgcaagggcagaaggttgaagaacaggagcctgaactgacatcaactcccaatttcgtggttgaagttataaagaatgatgatggcaagaaggcccttgtgttggactgtcattatccagaggatgaggttggacaagaagacgaggctgagagtgacatcttctctatcagggaagttagctttcagtccactggcgagtctgaatggaaggatactaattatacactcaacacagattccttggactgggccttatatgaccacctaatggatttccttgccgaccgaggggtggacaacacttttgcagatgagctggtggagctcagcacagccctggagcaccaggagtacattacttttcttgaagacctcaagagttttgtcaagagccagtagagcagacagatgctgaaagccatagtttcatggcaggctttggccagtgaacaaatcctactctgaagctagacatgtgctttgaaatgattatcatcctaatatcatgggggaaaaaataccaaatttaaattatatgttttgtgttctcatttattatcatttttttctgtacaaatctattatttctagatttttgtataacatgatagacataaaattggtttatctcctccaa

SEQ ID NO: 365237 - DNA, 1320 bp, Homo sapiens
gccggcgcgggaagcgcttcggggcaggggcggggcttccggcggcgcctcaggtcgcggggcgcctaggcctgggttgtcctttgcatctgcacgtgttcgcagtcgtttccgcgatgctgcctctgctgcgctgcgtgccccgtgtgctgggctcctccgtcgccggcctccgcgctgccgcgcccgcctcgcctttccggcagctcctgcagccggcaccccggctgtgcacccggcccttcgggctgctcagcgtgcgcgcaggttccgagcggcggccgggcctcctgcggcctcgcggaccctgcgcctgtggctgtggctgcggctcgctgcacaccgacggagacaaagcttttgttgatttcctgagtgatgaaattaaggaggaaagaaaaattcagaagcataaaaccctccctaagatgtctggaggttgggagctggaactgaatgggacagaagcgaaattagtgcggaaagttgccggggaaaaagtcttgctgtgtctccaggctggagagcagtggcgtgatctcggctcactgcaacctccacctcccaggttcaagcaattctcctgcctcagcctcctgagtagctgggattacagaatcacggtcactttcaacattaacaacagcatcccaccaacatttgatggtgaggaggaaccctcgcaagggcagaaggttgaagaacaggagcctgaactgacatcaactcccaatttcgtggttgaagttataaagaatgatgatggcaagaaggcccttgtgttggactgtcattatccagaggatgaggttggacaagaagacgaggctgagagtgacatcttctctatcagggaagttagctttcagtccactggcgagtctgaatggaaggatactaattatacactcaacacagattccttggactgggccttatatgaccacctaatggatttccttgccgaccgaggggtggacaacacttttgcagatgagctggtggagctcagcacagccctggagcaccaggagtacattacttttcttgaagacctcaagagttttgtcaagagccagtagagcagacagatgctgaaagccatagtttcatggcaggctttggccagtgaacaaatcctactctgaagctagacatgtgctttgaaatgattatcatcctaatatcatgggggaaaaaataccaaatttaaattatatgttttgtgttctcatttattatcatttttttctgtacaaatctattatttctagatttttgtataacatgatagacataaaattggtttatctcctccaa

SEQ ID NO: 365238 - DNA, 1252 bp, Homo sapiens
ctgcctaacccaaggttgtgaagatgtatgccttaattttttcaaagttttctagttttagctcttagtttaggtctgtgattcattttgaatatggtgtgaagtagggtcctgattctcttgcctgttgcatagtgtgtttttgccctacacaggtcaattgtgtcttctgtaatctcacctaaacaccatttgcgcaaggttttcatagctatttgggggccattaaaaataatgctctgatgaacgtcattcaatttctgtgcccaggagctcagcttagtcagcacagttggaattagacagattttgtcaacctcagactgcctctgttgccatggaaaggtggcttcctggcagagcagctagttagcacaagtggagggcggcacttcatgtactctttttttttttttttttttttctgacagagtcttgctgtgtctccaggctggagagcagtggcgtgatctcggctcactgcaacctccacctcccaggttcaagcaattctcctgcctcagcctcctgagtagctgggattacagaatcacggtcactttcaacattaacaacagcatcccaccaacatttgatggtgaggaggaaccctcgcaagggcagaaggttgaagaacaggagcctgaactgacatcaactcccaatttcgtggttgaagttataaagaatgatgatggcaagaaggcccttgtgttggactgtcattatccagaggatgaggttggacaagaagacgaggctgagagtgacatcttctctatcagggaagttagctttcagtccactggcgagtctgaatggaaggatactaattatacactcaacacagattccttggactgggccttatatgaccacctaatggatttccttgccgaccgaggggtggacaacacttttgcagatgagctggtggagctcagcacagccctggagcaccaggagtacattacttttcttgaagacctcaagagttttgtcaagagccagtagagcagacagatgctgaaagccatagtttcatggcaggctttggccagtgaacaaatcctactctgaagctagacatgtgctttgaaatgattatcatcctaatatcatgggggaaaaaataccaaatttaaattatatgttttgtgttctcatttattatcatttttttctgtacaaatctattatttctagatttttgtataacatgatagacataaaattggtttatctcctccaa

SEQ ID NO: 365239 - DNA, 5561 bp, Homo sapiens
acatgccggaggaggcgggcttcccgccggccaagagattccggccaggctctggacctccgagccgcgctgggtccttccctcccgggaggcaagtggtgatgctgctgactgcgggcagcggcggcagaggaggaggaggaggccggaggcagcagccgcccctggcccagccctcggccagtccctaccctgaagctgtggagctgcagcgccggagtctgcccatcttccaagcgcgggggcaactgttggcccagctccgaaacctggacaacgcggtcctcatcggttggctatacagtgcgctttgatgatgtcacctcagaagacaccaggatcaagtttctgacagatggcatgcttctgcgtgaagcaatttcagactctttgcttcggaaatacagctgtgtcattttggatgaagctcacgaacggactatccacacagatgtgctctttggagtggtgaaagctgcacagaagaggagaaaggaactcgggaaacttcctctgaaagtgattgtgatgtcagctacgatggatgtggacctgttctctcagtatttcaatggcgcccccgtcctctacctagagggtcggcagcatccgatccaggtgttttacaccaaacagcctcagaatgattacctgcacgccgcgcttgtctccgtcttccagatccaccaggaagccccttcttcacaggacatcctggtgttcctcactgggcaggaggagatcgaagccatgagcaagacgtgccgagacattgcaaagcacctcccagacggctgccctgcgatgctggtccttcctctgtacgcctccctgccctatgcacagcagctccgagtcttccaaggggccccaaagggctatcgcaaagtgatcatttcaaccaacatcgctgaaacctccataaccattacaggaataaaatatgtagttgacacgggcatggttaaagcaaagaagtataaccctgacagtggtcttgaggtgttagcagtgcagcgggtatcgaagacgcaggcttggcagcgcacagggagggctggcagagaggacagtggcatctgctaccggctctacacggaggacgagtttgagaagtttgataagatgaccgtgccagagatccagaggtgtaacctggccagtgtgatgcttcagcttctagcaatgaaagtcccaaatgtgctcacctttgacttcatgtcgaagccatctccagatcacattcaggcggccattgcccaactggacctgttaggtgctcttgaacataaggatgaccagcttaccctgactccaatgggaagaaagatggcagcatttcctttagaacccaaatttgccaaaaccatcctcatgtcccccaaattccactgtacagaggagatcctgaccattgtctccctgctgtctgtggacagcgtcctccacaaccctccttcccggcgagaggaagtgcaaggggtccgcaagaagttcatatccagcgagggggatcacatgaccctgctcaatatctatcggaccttcaaaaacctaggcggaaataaggattggtgcaaagagaattttgtcaacagcaagaatatgacgctggtagcagaagtcagagcacagctgagggacatctgcttaaagatgtcaatgccaatcgcatcatcccgaggagacgtggagagtgtccgccgctgcctggctcacagcctcttcatgagcaccgccgagcttcagccagatggcacctatgccaccacggacacccaccagccagtggccatccacccgtcgtctgtcctcttccactgcaagccggcctgcgtcgtgtacactgagctgctctacaccaacaagtgctacatgcgggacctctgcgtcatagatgcacagtggctgtacgaggctgcccctgagtactttaggaggaagctgagaaccgccagaaactgagccgccccaggatgccgccagaatcactggtccctgggagcttggactacagttgtccttacagcaggcttccaggttggcgcttagagaagccttggaatcagctgaaggtgcctgacttccaggagcgtgaaagcatctttgctcaactcctgggactgaaccatatagacatggacatatcatttgtacctggaaacctcaaaattatgcttttggttcttactgggtgactttgacttaatttaacacctgagcctcagttttctcatctgccaaatgggagtaataataataatccttataaaattgggttcataaagtttagagaaaaggaatggaaagtacccagaactatgcctggagcacgcacgacacacgtacagtgagttgggagccgttaggctgaatgttactgcttgccatatgatgtgaagtacagcaatatcccaagttcttgtgactgagggagattttctggaagggccacaggaggttgcggagcttggatgttgcccttagttcttgtttaatgtctctctgaatgcagttttaaaatagaaaacaaaactgacttctgtagaagtttccagagggaggtgctgttatctcgtacctcctgggatggcgatccctactgaacgcttgtgtctcagggtggaccactctgtgtctgtctccaagcagagaccagtaaaggagcctcctggtcctcagtgcgtgaccctgtcagtgctttcaggagacatgtaagcttcctgggtgaaggttgatttgtaccttctgaatcctgtcacgtgtagacatgggaaactgacctatcagtgttttgtgtgtgtaggtgactcccacatacacagttgccatttttctctctaactgggcaccagtgaacatgcgggcatgaggagtgactgtgtaccatttcagctgtttcttttcgggcagtcccctggtcagagggggtgggggtgggggaggggagaggggtacctagaacccagagaacattggcttatgccagataccacaccacatctgggcttacattcttgtatcttttttggtgtgtgggcggggggggtggggggcagttcagtgaagtctagaagacctgctggacaaattctaaaagagctagagctgtaacacttattcttgcatcttattaattttctatgatattttttccttcttcgtagggacttgggacaatctggctttgctgctttctaactgctaggcacctctctctaaccctcattgtcagagggaattggaggatatccacagtctgttcctgttctgatattctgagcagagaaaaggcactaacggttcctcttagctatttaattatcagaagcaagtaatctttccccagataatattttgccctagaagaagccgtgatttagctcttttattgtgcttacttggtccaaatacatctgtggggtgttttgtcatttcttaatgaatgaatcatagttataaccaggggccaagctgcccaagaggctcttcagagatcatggatgctctctttctggaagctgtggcctgatggagcagccccattccagggtcccatctgtccggagttgtgtatgtcaagtccggctcagtctttatttccaacactagccgtggtcctgtgcagtcaagctctcagctagtgtttagggctgtctgtcagaaatggttatacgtgggcaaaagaagatctgacagctcctatataccttatcttactgaattcttaaactttgaaccagttcttccacttactgacttgttaccactgctgactttctgaaaagttttccagtttttgttttttgttttttgttttccagtaggggattagaatgtttagtcctacttagtaagaaaaatattgtatttttaatcattcatagtgctggtaaaaaaaaaaaaaaaaaaaaaaaaattgggggggtggccgggcgcaggggcttcacacctgtaattcccagcactttgggaggccaagggggggggatcacctcatgcctgtaatcccagctttgggatgggaggctgaggtgggtggattgcttgaaaagttcaagaccagcctggccaacatggcaaaaccccgtctctactaaaaatagaaaacttagctgggcatggtggcacacgcctgtaatcccagctaccggggaggctgaggcacaagaattgcttgaacttgggaggcagagtttgtagtgagccaagatcacgccactgcattccagcctggccgacagtgtgagacggtctcagaaaaaaaaagaaagaaagaaagaaaaagaaaaaacttggggtaatttatgtccagcttaagtacctgaacagtttccggaaatgtatattttttttctgagaggcaaaggatgtaaacagcttctaagtagccttaatgtttctgtacagaaataagtttatccctgtaacattgtggtagagttttaatacagtatttagttttttattgggcttttttaaaaagttaacttttaacatagctgctcagggattaaatcagattggaaaacccattctgactccacatactgctacaaagaaatacatcgttgtttatattgagctgcaggagatagtacactttaaacttaagaaagttaaatgtttcacaataacattgcaatataatcttcagctactctctttccattggtaaaatctctgatggtgtgataactctttgccaacctacgaaacccatatctggaagaatcaccagctcccgtgagcagcttcatgtaaatagatgcactccaagcagattgcatgcctcaggtgtttgtcttctagtaatcatggagtgtgcaacacccagagtaacactacaaggggcaggactgcaaacagcaggtcctggctaaaaacccttaatgctgcattgctgccagttgtaaagagatgcctgaatggaggcaagttctgccctgtgggtgaaactgatgatgtactgtactgtcatatataaatccactaaatccagctaccgaaccctggaactgtggccatgcatttttttttttctttaaagaccagtgtgatagtaggccatgcatctgagatacgatattccttggtaactagagggagaaaaaaaaatcaagtaggttcaggcttatgttgtattttgagagtctggttttatttgaacagaaataactctacagaaagctcttgtaaataatgctcaaatttgcacccgacgatcaaatccattaaaaatgaatcttgtaaaaaaaaagtgtgtggcttgtttcttgcatctcttttccattattcatagaaaattatttagaaaatattaagtgttagtcttaccatgagttagtaagacataccttcttagtagcttatatgtcctgtatatcctgggaaggtaggattgttgatttttaataaatctgaaccctgtctttgggttatattaatttactggagaaactcacagaactcagggaaacacatttaccggtttcatacaaaagatatgaccaaggatacagataaggagatgagcagggtggggaatggggaagaagctc

SEQ ID NO: 365240 - DNA, 696 bp, Homo sapiens
gccatcagacactctgaacagagatccttgatccagccatccatctccttccagcagcagcatgtattgacttcttgtttccccagcctgaactgacatcaactcccaatttcgtggttgaagttataaagaatgatgatggcaagaaggcccttgtgttggactgtcattatccagaggatgaggttggacaagaagacgaggctgagagtgacatcttctctatcagggaagttagctttcagtccactggcgagtctgaatggaaggatactaattatacactcaacacagattccttggactgggccttatatgaccacctaatggatttccttgccgaccgaggggtggacaacacttttgcagatgagctggtggagctcagcacagccctggagcaccaggagtacattacttttcttgaagacctcaagagttttgtcaagagccagtagagcagacagatgctgaaagccatagtttcatggcaggctttggccagtgaacaaatcctactctgaagctagacatgtgctttgaaatgattatcatcctaatatcatgggggaaaaaataccaaatttaaattatatgttttgtgttctcatttattatcatttttttctgtacaaatctattatttctagatttttgtataacatgatagacataaaattggtttatctcctccaa

SEQ ID NO: 365241 - DNA, 1104 bp, Homo sapiens
gccggcgcgggaagcgcttcggggcaggggcggggcttccggcggcgcctcaggtcgcggggcgcctaggcctgggttgtcctttgcatctgcacgtgttcgcagtcgtttccgcgatgctgcctctgctgcgctgcgtgccccgtgtgctgggctcctccgtcgccggcctccgcgctgccgcgcccgcctcgcctttccggcagctcctgcagccggcaccccggctgtgcacccggcccttcgggctgctcagcgtgcgcgcaggttccgagcggcggccgggcctcctgcggcctcgcggaccctgcgcctgtggctgtggctgcggctcgctgcacaccgacggagacaaagcttttgttgatttcctgagtgatgaaattaaggaggaaagaaaaattcagaagcataaaaccctccctaagatgtctggaggttgggagctggaactgaatgggacagaagcgaaattagtgcggaaagttgccggggaaaaaatcacggtcactttcaacattaacaacagcatcccaccaacatttgatggtgaggaggaaccctcgcaagggcagaaggttgaagaacaggaggttggacaagaagacgaggctgagagtgacatcttctctatcagggaagttagctttcagtccactggcgagtctgaatggaaggatactaattatacactcaacacagattccttggactgggccttatatgaccacctaatggatttccttgccgaccgaggggtggacaacacttttgcagatgagctggtggagctcagcacagccctggagcaccaggagtacattacttttcttgaagacctcaagagttttgtcaagagccagtagagcagacagatgctgaaagccatagtttcatggcaggctttggccagtgaacaaatcctactctgaagctagacatgtgctttgaaatgattatcatcctaatatcatgggggaaaaaataccaaatttaaattatatgttttgtgttctcatttattatcatttttttctgtacaaatctattatttctagatttttgtataacatgatagacataaaattggtttatctcctccaa

SEQ ID NO: 365242 - DNA, 4557 bp, Homo sapiens
acatgccggaggaggcgggcttcccgccggccaagagattccggccaggctctggacctccgagccgcgctgggtccttccctcccgggaggcaagtggtgatgctgctgactgcgggcagcggcggcagaggaggaggaggaggccggaggcagcagccgcccctggcccagccctcggccagtccctaccctgaagctgtggagctgcagcgccggagtctgcccatcttccaagcgcgggggcaactgttggcccagctccgaaacctggacaacgcggtcctcatcggttggctatacagtgcgctttgatgatgtcacctcagaagacaccaggatcaagtttctgacagatggcatgcttctgcgtgaagcaatttcagactctttgcttcggaaatacagctgtgtcattttggatgaagctcacgaacggactatccacacagatgtgctctttggagtggtgaaagctgcacagaagaggagaaaggaactcgggaaacttcctctgaaagtgattgtgatgtcagctacgatggatgtggacctgttctctcagtatttcaatggcgcccccgtcctctacctagagggtcggcagcatccgatccaggtgttttacaccaaacagcctcagaatgattacctgcacgccgcgcttgtctccgtcttccagatccaccaggaagccccttcttcacaggacatcctggtgttcctcactgggcaggaggagatcgaagccatgagcaagacgtgccgagacattgcaaagcacctcccagacggctgccctgcgatgctggtccttcctctgtacgcctccctgccctatgcacagcagctccgagtcttccaaggggccccaaagggctatcgcaaagtgatcatttcaaccaacatcgctgaaacctccataaccattacaggaataaaatatgtagttgacacgggcatggttaaagcaaagaagtataaccctgacagtggtcttgaggtgttagcagtgcagcgggtatcgaagacgcaggcttggcagcgcacagggagggctggcagagaggacagtggcatctgctaccggctctacacggaggacgagtttgagaagtttgataagatgaccgtgccagagatccagaggtgtaacctggccagtgtgatgcttcagcttctagcaatgaaagtcccaaatgtgctcacctttgacttcatgtcgaagccatctccagatcacattcaggcggccattgcccaactggacctgttaggtgctcttgaacataaggatgaccagcttaccctgactccaatgggaagaaagatggcagcatttcctttagaacccaaatttgccaaaaccatcctcatgtcccccaaattccactgtacagaggagatcctgaccattgtctccctgctgtctgtggacagcgtcctccacaaccctccttcccggcgagaggaagtgcaaggggtccgcaagaagttcatatccagcgagggggatcacatgaccctgctcaatatctatcggaccttcaaaaacctaggcggaaataaggattggtgcaaagagaattttgtcaacagcaagaatatgacgctggtagcagaagtcagagcacagctgagggacatctgcttaaagatgtcaatgccaatcgcatcatcccgaggagacgtggagagtgtccgccgctgcctggctcacagcctcttcatgagcaccgccgagcttcagccagatggcacctatgccaccacggacacccaccagccagtggccatccacccgtcgtctgtcctcttccactgcaagccggcctgcgtcgtgtacactgagctgctctacaccaacaagtgctacatgcgggacctctgcgtcatagatgcacagtggctgtacgaggctgcccctgagtactttaggaggaagctgagaaccgccagaaactgagccgccccaggatgccgccagaatcactggtccctgggagcttggactacagttgtccttacagcaggcttccaggttggcgcttagagaagccttggaatcagctgaaggtgcctgacttccaggagcgtgaaagcatctttgctcaactcctgggactgaaccatatagacatggacatatcatttgtacctggaaacctcaaaattatgcttttggttcttactgggtgactttgacttaatttaacacctgagcctcagttttctcatctgccaaatgggagtaataataataatccttataaaattgggttcataaagtttagagaaaaggaatggaaagtacccagaactatgcctggagcacgcacgacacacgtacagtgagttgggagccgttaggctgaatgttactgcttgccatatgatgtgaagtacagcaatatcccaagttcttgtgactgagggagattttctggaagggccacaggaggttgcggagcttggatgttgcccttagttcttgtttaatgtctctctgaatgcagttttaaaatagaaaacaaaactgacttctgtagaagtttccagagggaggtgctgttatctcgtacctcctgggatggcgatccctactgaacgcttgtgtctcagggtggaccactctgtgtctgtctccaagcagagaccagtaaaggagcctcctggtcctcagtgcgtgaccctgtcagtgctttcaggagacatgtaagcttcctgggtgaaggttgatttgtaccttctgaatcctgtcacgtgtagacatgggaaactgacctatcagtgttttgtgtgtgtaggtgactcccacatacacagttgccatttttctctctaactgggcaccagtgaacatgcgggcatgaggagtgactgtgtaccatttcagctgtttcttttcgggcagtcccctggtcagagggggtgggggtgggggaggggagaggggtacctagaacccagagaacattggcttatgccagataccacaccacatctgggcttacattcttgtatcttttttggtgtgtgggcggggggggtggggggcagttcagtgaagtctagaagacctgctggacaaattctaaaagagctagagctgtaacacttattcttgcatcttattaattttctatgatattttttccttcttcgtagggacttgggacaatctggctttgctgctttctaactgctaggcacctctctctaaccctcattgtcagagggaattggaggatatccacagtctgttcctgttctgatattctgagcagagaaaaggcactaacggttcctcttagctatttaattatcagaagcaagtaatctttccccagataatattttgccctagaagaagccgtgatttagctcttttattgtgcttacttggtccaaatacatctgtggggtgttttgtcatttcttaatgaatgaatcatagttataaccaggggccaagctgcccaagaggctcttcagagatcatggatgctctctttctggaagctgtggcctgatggagcagccccattccagggtcccatctgtccggagttgtgtatgtcaagtccggctcagtctttatttccaacactagccgtggtcctgtgcagtcaagctctcagctagtgtttagggctgtctgtcagaaatggttatacgtgggcaaaagaagatctgacagctcctatataccttatcttactgaattcttaaactttgaaccagttcttccacttactgacttgttaccactgctgactttctgaaaagttttccagtttttgttttttgttttttgttttccagtaggggattagaatgtttagtcctacttagtaagaaaaatattgtatttttaatcattcatagtgctggtaaaaaaaaaaaaaaaaaaaaaaaaattgggggggtggccgggcgcaggggcttcacacctgtaattcccagcactttgggaggccaagggggggggatcacctcatgcctgtaatcccagctttgggatgggaggctgaggtgggtggattgcttgaaaagttcaagaaccaggtcctgggcaacaggggaaaacccgggttctattaaaattagacaattagctggggctggggggaacacgcttggtaatcccagttaccgggagcggtggcggcaagatttgctcgacttggggagggctaagttggttgtggaggcccaaggattatgcgcatgtggtttcacaggtgggcgacaatgttgaaaagggtctcgaaaaaacatggtagcgaagtagaaggaaaaggaacacacagtgtgggggcatattatcttccggttatactacttagaaggtccgggaaaggatattttttgtcttggagagcgaaaggggtttaaagtgcttctagagtagctttagggtgtcgtgccgacaaaatggttctccgtgacaaggggcggacgctaataacgatatggttgctagtggtggtttaaagagagttaaaaggccggggagacatagtgaaacgcgtctctttgtcgaaaacagattgtt

SEQ ID NO: 365243 - DNA, 2078 bp, Homo sapiens
acattcgactcggacccccaccacctgagtcctggaagctgtggcctgatggagcagccccattccagggtcccatctgtccggagttgtgtatgtcaagtccggctcagtctttatttccaacactagccgtggtcctgtgcagtcaagctctcagctagtgtttagggctgtctgtcagaaatggttatacgtgggcaaaagaagatctgacagctcctatataccttatcttactgaattcttaaactttgaaccagttcttccacttactgacttgttaccactgctgactttctgaaaagttttccagtttttgttttttgttttttgttttccagtaggggattagaatgtttagtcctacttagtaagaaaaatattgtatttttaatcattcatagtgctggtaaaaaaaaaaaaaaaaaaaaaaaaattgggggggtggccgggcgcaggggcttcacacctgtaattcccagcactttgggaggccaagggggggggatcacctcatgcctgtaatcccagctttgggatgggaggctgaggtgggtggattgcttgaaaagttcaagaccagcctggccaacatggcaaaaccccgtctctactaaaaatagaaaacttagctgggcatggtggcacacgcctgtaatcccagctaccggggaggctgaggcacaagaattgcttgaacttgggaggcagagtttgtagtgagccaagatcacgccactgcattccagcctggccgacagtgtgagacggtctcagaaaaaaaaagaaagaaagaaagaaaaagaaaaaacttggggtaatttatgtccagcttaagtacctgaacagtttccggaaatgtatattttttttctgagaggcaaaggatgtaaacagcttctaagtagccttaatgtttctgtacagaaataagtttatccctgtaacattgtggtagagttttaatacagtatttagttttttattgggcttttttaaaaagttaacttttaacatagctgctcagggattaaatcagattggaaaacccattctgactccacatactgctacaaagaaatacatcgttgtttatattgagctgcaggagatagtacactttaaacttaagaaagttaaatgtttcacaataacattgcaatataatcttcagctactctctttccattggtaaaatctctgatggtgtgataactctttgccaacctacgaaacccatatctggaagaatcaccagctcccgtgagcagcttcatgtaaatagatgcactccaagcagattgcatgcctcaggtgtttgtcttctagtaatcatggagtgtgcaacacccagagtaacactacaaggggcaggactgcaaacagcaggtcctggctaaaaacccttaatgctgcattgctgccagttgtaaagagatgcctgaatggaggcaagttctgccctgtgggtgaaactgatgatgtactgtactgtcatatataaatccactaaatccagctaccgaaccctggaactgtggccatgcatttttttttttctttaaagaccagtgtgatagtaggccatgcatctgagatacgatattccttggtaactagagggagaaaaaaaaatcaagtaggttcaggcttatgttgtattttgagagtctggttttatttgaacagaaataactctacagaaagctcttgtaaataatgctcaaatttgcacccgacgatcaaatccattaaaaatgaatcttgtaaaaaaaaagtgtgtggcttgtttcttgcatctcttttccattattcatagaaaattatttagaaaatattaagtgttagtcttaccatgagttagtaagacataccttcttagtagcttatatgtcctgtatatcctgggaaggtaggattgttgatttttaataaatctgaaccctgtctttgggttatattaatttactggagaaactcacagaactcagggaaacacatttaccggtttcatacaaaagatatgaccaaggatacagataaggagatgagcagggtggggaatggggaagaagctc

SEQ ID NO: 365244 - DNA, 1527 bp, Homo sapiens
gccggcgcgggaagcgcttcggggcaggggcggggcttccggcggcgcctcaggtcgcggggcgcctaggcctgggttgtcctttgcatctgcacgtgttcgcagtcgtttccgcgatgctgcctctgctgcgctgcgtgccccgtgtgctgggctcctccgtcgccggcctccgcgctgccgcgcccgcctcgcctttccggcagctcctgcagccggcaccccggctgtgcacccggcccttcgggctgctcagcgtgcgcgcaggttccgagcggcggccgggcctcctgcggcctcgcggaccctgcgcctgtggctgtggctgcggctcgctgcacaccgacggagacaaagcttttgttgatttcctgagtgatgaaattaaggaggaaagaaaaattcagaagcataaaaccctccctaagatgtctggaggttgggagctggaactgaatgggacagaagcgaaattagtgcggaaagttgccggggaaaaaatcacggtcactttcaacattaacaacagcatcccaccaacatttgatggtgaggaggaaccctcgcaagggcagaaggttgaagaacaggagcctgaactgacatcaactcccaatttcgtggttgaagttataaagaatgatgatggcaagaaggcccttgtgttggactgtcattatccagaggatgagtggacaagaagacgaggcgtgaagccgagaaagcaagtgtgtacgaagcgcgcacaccagaggaagaatcgaaccgtggttcaaccggcgaaacccctaaacacctcaacgaattaacgttggttcaaagaatgtgcacttgtgaaagaagtgctgatgtgccagaaaccagaaagggaacacacagtttgtgagcggcattgggaaggccagcttcaccaccttcactgtgaacgaaaatacgtggtttaaccgctgtgctgatctgcccatcattgtgggcatcccgaagtgggcacctcaactcgtggggcgccattttaacttttcggcgcattctcctcttcttattcactgtgcaacgatctcgtggcgacagtgtgtacgcaagtgcatttaaacgaagccttcccgtgaaatgaggaaaatttcaaggtgacactcagccgaatgctcatatcccatcataacgttacacagcaccagttacgtggtgaaacccaagttactttggaagagccttgatgagaggaaaaaaagttattcacagacaaagcgctcccggccaattcacactttgccaggcaacaggcaacgttataacactgcaccaatttctcaaggcgaattggaaaggatgataacgcgtggaagttacagtagaattcccgtttcaaacatctacacccgtggttggcccaaaattccaaaggttcccaaagctttgcttaatgtaccagggcacaccacaatgaaatggacatttgggaacttatctcctggccgttcgaacaattacacagcgtaccactttttcgtcaaggtcgcgacatta

SEQ ID NO: 365245 - DNA, 680 bp, Homo sapiens
  misc_feature (641)..(641): n is a, c, g, or t
gccggcgcgggaagcgcttcggggcaggggcggggcttccggcggcgcctcaggtcgcggggcgcctaggcctgggttgtcctttgcatctgcacgtgttcgcagtcgtttccgcgatgctgcctctgctgcgctgcgtgccccgtgtgctgggctcctccgtcgccggcctccgcgctgccgcgcccgcctcgcctttccggcagctcctgcagccggcaccccggctgtgcacccggcccttcgggctgctcagcgtgcgcgcaggttccgagcggcggccgggcctcctgcggcctcgcggaccctgcgcctgtggctgtggctgcggctcgctgcacaccgacggagacaaagcttttgttgatttcctgagtgatgaaattaaggaggaaagaaaaattcagaagcataaaaccctccctaagatgtctggaggttgggagctggaactgaatgggacagaagcgaaattagtgcggaaagttgccggggaaaagaggaaccctcgcaagggcagaaggttgaagaacaggagcctgaactgacatcaactcccaatttcgtggttgaagttataaagaatgatgatggcaagaaggcccttgtgttggactgtcattatccagaggatgagtggncaagaagacgactgcttggattacaaggaggggatcctc

SEQ ID NO: 365246 - DNA, 923 bp, Homo sapiens
gccggcgcgggaagcgcttcggggcaggggcggggcttccggcggcgcctcaggtcgcggggcgcctaggcctgggttgtcctttgcatctgtcagcacagccctggagcaccaggagtacattacttttcttgaagacctcaagagttttgtcaagagccagtagagcagacagatgctgaaagccatagtttcatggcaggctttggccagtgaacaaatcctactctgaagctagacatgtgctttgaaatgattatcatcctaatatcatgggggaaaaaataccaaatttaaattatatgttttgtgttctcatttattatcatttttttctgtacaaatctattatttctagatttttgtataacatgatagacataaaattggtttatctcctccaaaaaaaaaaaaaaggagaaaaacaacactccgggtgtttttttgttttatattcgttgttttattagaaatttccgcccaaagaactatcttttgtggggagaagccacaggtctggcagcgccttgtttttggtgcgcaagacgcttgtgggggccctctgatatatcccccaaagaaggggaggcgagcgttttttgcccccactgggcggtgggggggcctctttattgcacatcttgcgggcaggggggaccacttctgggaggacgagggaaagacggcgcccctctttttatagaaggccccggtgctttgttttcacggcgcttttggtgtccacacacacagtagaaaagctgctggttgctccggcccctctttttgcggcgggggcacaccatgggcgggcggcggcgtacgtgcggccggccccaaggtgtccacggggttatgctacgtgttctgcccccccgtcttttggtggggggccaccattcttcccgcggagcgacgaatgg

SEQ ID NO: 365247 - DNA, 288 bp, Homo sapiens
aatcacttttccagaatcaggctcagcttcctactactattatggtatttttaccgataaggaaacaggcttctagagtaaccgtaatagcagagagattagaaacagtccaggtttctggctgcaataacctgggtaatagttttatgttttagactaactggctttcctttttatgtatctggatttcttttctaggagacaaagcttttgttgatttcctgagtgatgaaattaaggaggaaagaaaaattcagaagcataaaaccctccctaagatgtctggag

SEQ ID NO: 365248 - DNA, 893 bp, Homo sapiens
gcagcagcatgtattgacttcttgtttccccagcctgaactgacatcaactcccaatttcgtggttgaagttataaagaatgatgatggcaagaaggcccttgtgttggactgtcattatccagaggatgaggtatgcaggatggagtgctagcctcttggcacccctggggaacagtgtgtcccttgggaacttcctgtccctattttagcagaaatttaaacacttttctagcttagaccagcccagcagggggagagaggtggggagtgagggaagagggttaaaacctgatgagtttcatgctgtcagtggccccctttcttcccctgagtctagcttgtcctggagaacccttcagtttcccaatattgtttcttctcaggttggacaagaagacgaggctgagagtgacatcttctctatcagggaagttagctttcagtccactggcgagtctgaatggaaggatactaattatacactcaacacagattccttggactgggtgagtgcttgataaggtgggggaaccttttgggccttggaaggaagggtcctagttcaaggggagaaaaaagcattttaatgttcattacagatttttttttaactagtaaatattgttctttgcaggccttatatgaccacctaatggatttccttgccgaccgaggggtggacaacacttttgcagatgagctggtggagctcagcacagccctggagcaccaggagtacattacttttcttgaagacctcaagagttttgtcaagagccagtagagcagacagatgctgaaagccatagtttcatggcaggctttggccagtgaacaaatcctactctgaagctagacatgtgctttgaaatgattatcatcctaatatca

SEQ ID NO: 365249 - DNA, 570 bp, Homo sapiens
acgatggatgtggacctgttctctcagtatttcaatggcgcccccgtcctctacctagagggtcggcagcatccgatccaggtgttttacaccaaacagcctcagaatgattacctgcacgccgcgcttgtctccgtcttccagatccaccaggtatggtgctgggggcaaattcctgaaaagttctcttttatcttgcagttggtagtgagaacattgagccttgaaaagaaaagctactgaataaaacaactttgtgagttgtgtcatcaagatgaataaggaggccaggtgcggtggctcacgcctgtaatccctgcactttgggaggccgaggcaggtggatcacctgaggtcaggagttcaagaccagcctggccaacatggtgaaaccccatctctactaaaaatacaaaaattagccaggcatgatggcgggtgcctgtaatcccagctactcgggatgctgaggtgggagaatcgcctgaatccgggaggtggaagttgcaatgaggcgagattgcaccactgcactccagcctaggtgacagagggagactccgtctgaaa

SEQ ID NO: 365250 - DNA, 1353 bp, Homo sapiens
gccggcgcgggaagcgcttcggggcaggggcggggcttccggcggcgcctcaggtcgcggggcgcctaggcctgggttgtcctttgcatctgcacgtgttcgcagtcgtttccgcgatgctgcctctgctgcgctgcgtgccccgtgtgctgggctcctccgtcgccggcctccgcgctgccgcgcccgcctcgcctttccggcagctcctgcagccggcaccccggctgtgcacccggcccttcgggctgctcagcgtgcgcgcaggttccgagcggcggccgggcctcctgcggcctcgcggaccctgcgcctgtggctgtggctgcggctcgctgcacaccgacggagacaaagcttttgttgatttcctgagtgatgaaattaaggaggaaagaaaaattcagaagcataaaaccctccctaagatgtctggaggttgggagctggaactgaatgggacagaagcgaaattagtgcggaaagttgccggggaaaaaatcacggtcactttcaacattaacaacagcatcccaccaacatttgatggtgaggaggaaccctcgcaagggcagaaggttgaagaacaggagcctgaactgacatcaactcccaatttcgtggttgaagttataaagaatgatgatggcaagaaggcccttgtgttggactgtcattatccagaggatgaggttggacaagaagacgaggctgagagtgacatcttctctatcagggaagttagctttcagtccactggcgagtctgaatggaaggatactaattatacactcaacacagattccttggactgggccttatatgaccacctaatggatttccttgccgaccgaggggtggacaacacttttgcagatgagctggtggagctcagcacagccctggagcaccaggagtacattacttttcttgaagacctcaagagttttgtcaagagccagtagagcagacagatgctgaaagccatagtttcatggcaggctttggccagtgaacaaatcctactctgaagctagacatgtgctttgaaatgattatcatcctaatatcatgggggaaaaaataccaaatttaaattatatgttttgtgttctcatttattatcatttttttctgtacaaatctattatttctagatttttgtataacatgatagacataaaattggtttatctcctccaagctgagtcttcctagaagtacctgctgggttctcagttccagttcccatcctttgattgatcactctccctgacatccacctgtatgactttgtcaccaaatgctgtcttctctttctccaatcaagaaataataatccctcgagtttac

SEQ ID NO: 365251 - DNA, 513 bp, Homo sapiens
actcaacacagattcgccagtggactgaaagctaacttccctgataggaagttagctttcagtccactggcgagtctgaatggaaggatactaattatacactcaacacagattccttggactgggccttatatgaccacctaatggatttccttgccgaccgaggggtggacaacacttttgcagatgagctggtggagctcagcacagccctggagcaccaggagtacattacttttcttgaagacctcaagagttttgtcaagagccagtagagcagacagatgctgaaagccatagtttcatggcaggctttggccagtgaacaaatcctactctgaagctagacatgtgctttgaaatgattatcatcctaatatcatgggggaaaaaataccaaatttaaattatatgttttgtgttctcatttattatcatttttttctgtacaaatctattatttctagatttttgtataacatgatagacataaaattggtttatctcctccaa

SEQ ID NO: 365252 - DNA, 2288 bp, Homo sapiens
gttcctcactgggcaggaggaacaccaggatgtcctgtgaagaaggggcatcctggtgttcctcactgggcaggaggagatcgaagccatgagcaagacgtgccgagacattgcaaagcacctcccagacggctgccctgcgatgctggtccttcctctgtacgcctccctgccctatgcacagcagctccgagtcttccaaggggccccaaagggctatcgcaaagtgatcatttcaaccaacatcgctgaaacctccataaccattacaggaataaaatatgtagttgacacgggcatggttaaagcaaagaagtataaccctgacagtggtcttgaggtgttagcagtgcagcgggtatcgaagacgcaggcttggcagcgcacagggagggctggcagagaggacagtggcatctgctaccggctctacacggaggacgagtttgagaagtttgataagatgaccgtgccagagatccagaggtgtaacctggccagtgtgatgcttcagcttctagcaatgaaagtcccaaatgtgctcacctttgacttcatgtcgaagccatctccagatcacattcaggcggccattgcccaactggacctgttaggtgctcttgaacataaggatgaccagcttaccctgactccaatgggaagaaagatggcagcatttcctttagaacccaaatttgccaaaaccatcctcatgtcccccaaattccactgtacagaggagatcctgaccattgtctccctgctgtctgtggacagcgtcctccacaaccctccttcccggcgagaggaagtgcaaggggtccgcaagaagttcatatccagcgagggggatcacatgaccctgctcaatatctatcggaccttcaaaaacctaggcggaaataaggattggtgcaaagagaattttgtcaacagcaagaatatgacgctggtagcagaagtcagagcacagctgagggacatctgcttaaagatgtcaatgccaatcgcatcatcccgaggagacgtggagagtgtccgccgctgcctggctcacagcctcttcatgagcaccgccgagcttcagccagatggcacctatgccaccacggacacccaccagccagtggccatccacccgtcgtctgtcctcttccactgcaagccggcctgcgtcgtgtacactgagctgctctacaccaacaagtgctacatgcgggacctctgcgtcatagatgcacagtggctgtacgaggctgcccctgagtactttaggaggaagctgagaaccgccagaaactgagccgccccaggatgccgccagaatcactggtccctgggagcttggactacagttgtccttacagcaggcttccaggttggcgcttagagaagccttggaatcagctgaaggtgcctgacttccaggagcgtgaaagcatctttgctcaactcctgggactgaaccatatagacatggacatatcatttgtacctggaaacctcaaaattatgcttttggttcttactgggtgactttgacttaatttaacacctgagcctcagttttctcatctgccaaatgggagtaataataataatccttataaaattgggttcataaagtttagagaaaaggaatggaaagtacccagaactatgcctggagcacgcacgacacacgtacagtgagttgggagccgttaggctgaatgttactgcttgccatatgatgtgaagtacagcaatatcccaagttcttgtgactgagggagattttctggaagggccacaggaggttgcggagcttggatgttgcccttagttcttgtttaatgtctctctgaatgcagttttaaaatagaaaacaaaactgacttctgtagaagtttccagagggaggtgctgttatctcgtacctcctgggatggcgatccctactgaacgcttgtgtctcagggtggaccactctgtgtctgtctccaagcagagaccagtaaaggagcctcctggtcctcagtgcgtgaccctgtcagtgctttcaggagacatgtaagcttcctgggtgaaggttgatttgtaccttctgaatcctgtcacgtgtagacatgggaaactgacctatcagtgttttgtgtgtgtaggtgactcccacatacacagttgccatttttctctctaactgggcaccagtgaacatgcgggcatgaggagtgactgtgtaccatttcagctgtttcttttcgggcagtcccctgccctctccctgaaataaagaacagcttgac

SEQ ID NO: 365253 - DNA, 2838 bp, Homo sapiens
acatgccggaggaggcgggcttcccgccggccaagagattccggccaggctctggacctccgagccgcgctgggtccttccctcccgggaggcaagtggtgatgctgctgactgcgggcagcggcggcagaggaggaggaggaggccggaggcagcagccgcccctggcccagccctcggccagtccctaccctgaagctgtggagctgcagcgccggagtctgcccatcttccaagcgcgggggcaactgttggcccagctccgaaacctggacaacgcggtcctcatcggggaaactggctctgggaagacaactcagatccctcagtacctgtatgaaggagggatcagccgccagggcatcattgctgtgacccagcctcgtcgagtagctgccatctctcttgctactagagtctcagatgagaagagaactgaacttgggaagctggttggctatacagtgcgctttgatgatgtcacctcagaagacaccaggatcaagtttctgacagatggcatgcttctgcgtgaagcaatttcagactctttgcttcggaaatacagctgtgtcattttggatgaagctcacgaacggactatccacacagatgtgctctttggagtggtgaaagctgcacagaagaggagaaaggaactcgggaaacttcctctgaaagtgattgtgatgtcagctacgatggatgtggacctgttctctcagtatttcaatggcgcccccgtcctctacctagagggtcggcagcatccgatccaggtgttttacaccaaacagcctcagaatgattacctgcacgccgcgcttgtctccgtcttccagatccaccaggaagccccttcttcacaggacatcctggtgttcctcactgggcaggaggagatcgaagccatgagcaagacgtgccgagacattgcaaagcacctcccagacggctgccctgcgatgctggtccttcctctgtacgcctccctgccctatgcacagcagctccgagtcttccaaggggccccaaagggctatcgcaaagtgatcatttcaaccaacatcgctgaaacctccataaccattacaggaataaaatatgtagttgacacgggcatggttaaagcaaagaagtataaccctgacagtggtcttgaggtgttagcagtgcagcgggtatcgaagacgcaggcttggcagcgcacagggagggctggcagagaggacagtggcatctgctaccggctctacacggaggacgagtttgagaagtttgataagatgaccgtgccagagatccagaggtgtaacctggccagtgtgatgcttcagcttctagcaatgaaagtcccaaatgtgctcacctttgacttcatgtcgaagccatctccagatcacattcaggcggccattgcccaactggacctgttaggtgctcttgaacataaggatgaccagcttaccctgactccaatgggaagaaagatggcagcatttcctttagaacccaaatttgccaaaaccatcctcatgtcccccaaattccactgtacagaggagatcctgaccattgtctccctgctgtctgtggacagcgtcctccacaaccctccttcccggcgagaggaagtgcaaggggtccgcaagaagttcatatccagcgagggggatcacatgaccctgctcaatatctatcggaccttcaaaaacctaggcggaaataaggattggtgcaaagagaattttgtcaacagcaagaatatgacgctggtagcagaagtcagagcacagctgagggacatctgcttaaagatgtcaatgccaatcgcatcatcccgaggagacgtggagagtgtccgccgctgcctggctcacagcctcttcatgagcaccgccgagcttcagccagatggcacctatgccaccacggacacccaccagccagtggccatccacccgtcgtctgtcctcttccactgcaagccggcctgcgtcgtgtacactgagctgctctacaccaacaagtgctacatgcgggacctctgcgtcatagatgcacagtggctgtacgaggctgcccctgagtactttaggaggaagctgagaaccgccagaaactgagccgccccaggatgccgccagaatcactggtccctgggagcttggactacagttgtccttacagcaggcttccaggttggcgcttagagaagccttggaatcagctgaaggtgcctgacttccaggagcgtgaaagcatctttgctcaactcctgggactgaaccatatagacatggacatatcatttgtacctggaaacctcaaaattatgcttttggttcttactgggtgactttgacttaatttaacacctgagcctcagttttctcatctgccaaatgggagtaataataataatccttataaaattgggttcataaagtttagagaaaaggaatggaaagtacccagaactatgcctggagcacgcacgacacacgtacagtgagttgggagccgttaggctgaatgttactgcttgccatatgatgtgaagtacagcaatatcccaagttcttgtgactgagggagattttctggaagggccacaggaggttgcggagcttggatgttgcccttagttcttgtttaatgtctctctgaatgcagttttaaaatagaaaacaaaactgacttctgtagaagtttccagagggaggtgctgttatctcgtacctcctgggatggcgatccctactgaacgcttgtgtctcagggtggaccactctgtgtctgtctccaagcagagaccagtaaaggagcctcctggtc

SEQ ID NO: 365254 - DNA, 444 bp, Homo sapiens
aaggaatctgtgttgagtgtataattagtatccttccattcagattcctggactgggccttatatgaccacctaatggatttccttgccgaccgaggggtggacaacacttttgcagatgagctggtggagctcagcacagccctggagcaccaggagtacattacttttcttgaagacctcaagagttttgtcaagagccagtagagcagacagatgctgaaagccatagtttcatggcaggctttggccagtgaacaaatcctactctgaagctagacatgtgctttgaaatgattatcatcctaatatcatgggggaaaaaataccaaatttaaattatatgttttgtgttctcatttattatcatttttttctgtacaaatctattatttctagatttttgtataacatgatagacataaaattggtttatctcctccaa

SEQ ID NO: 365255 - DNA, 359 bp, Homo sapiens
  misc_feature (165)..(165): n is a, c, g, or t
ccgcaagccggcgagccttcttcgctgctgggcagtcgttctgtcagctaaacaaacgaaaaaagacaccaccacccacccccaatatttcaacacgaatctttttttctttccacccacaatttgggtgggcccccaaaggggaacttattttccggcaccccnaagtgaacaaatcctactctgaagctagacatgtgctttgaaatgattatcatcctaatatcatgggggaaaaaataccaaatttaaattatatgttttgtgttctcatttattatcatttttttctgtacaaatctattatttctagatttttgtataacatgatagacataaaattggtttatctcctccaa

SEQ ID NO: 365256 - DNA, 1803 bp, Homo sapiens
gccggcgcgggaagcgcttcggggcaggggcggggcttccggcggcgcctcaggtcgcggggcgcctaggcctgggttgtcctttgcatctgcacgtgttcgcagtcgtttccgcgatgctgcctctgctgcgctgcgtgccccgtgtgctgggctcctccgtcgccggcctccgcgctgccgcgcccgcctcgcctttccggcagctcctgcagccggcaccccggctgtgcacccggcccttcgggctgctcagcgtgcgcgcaggttccgagcggcggccgggcctcctgcggcctcgcggaccctgcgcctgtggctgtggctgcggctcgctgcacaccgacggagacaaagcttttgttgatttcctgagtgatgaaattaaggaggaaagaaaaattcagaagcataaaaccctccctaagatgtctggaggttgggagctggaactgaatgggacagaagcgaaattagtgcggaaagttgccggggaaaaaatcacggtcactttcaacattaacaacagcatcccaccaacatttgatggtgaggaggaaccctcgcaagggcagaaggttgaagaacaggagcctgaactgacatcaactcccaatttcgtggttgaagttataaagaatgatgatggcaagaaggcccttgtgttggactgtcattatccagaggatgaggttggacaagaagacgaggctgagagtgacatcttctctatcagggaagttagctttcagtccactggcgagtctgaatggaaggatactaattatacactcaacacagattccttggactgggccttatatgaccacctaatggatttccttgccgaccgaggggtggacaacacttttgcagatgagctggtggagctcagcacagccctggagcaccaggagtacattacttttcttgaagacctcaagagttttgtcaagagccagtagagcagacagatgctgaaagccatagtttcatggcaggctttggccagtgaacaaatcctactctgaagctagacatgtgctttgaaatgattatcatcctaatatcatgggggaaaaaataccaaatttaaattatatgttttgtgttctcatttattatcatttttttctgtacaaatctattatttctagatttttgtataacatgatagacataaaattggtttatctcctccaacaaggcagtttgtctttttctattcctcccccttcaacctgcgtcacaaaagaccaagaacagatgtcggaaaagtttttttttcttcagtattgtttaaaagtttcaatacaaaataagttataaataaaaggcttgtatgtacaaggctcctcagagggaatgagttgtcttcaaccccatagaatgatgtgagtccaagctggctctagaggatcacagcccaagtatcacaggccttggttgatcagctcctgttgaatttcctccagcacagccatgtctatcagctcctccaactgagccaagtcttctggacaattctccactgactgcaaagcattccactcttcttccatcacctcttgaactagaaagctgttctgagaattccctggcccactgcttccagcctggcggtacctgtttaggagcctgtcccggctgtttctcattctctccaggcatctctgccggaaagcctctttccaaggcggcgagcccaccagtttgtacagggagcggcgcggagacctcaacgactccgccatctcctcttcgcgggagacaaagccacaagacccgttccctggaggcgcg

SEQ ID NO: 365257 - DNA, 1353 bp, Homo sapiens
gccggcgcgggaagcgcttcggggcaggggcggggcttccggcggcgcctcaggtcgcggggcgcctaggcctgggttgtcctttgcatctgcacgtgttcgcagtcgtttccgcgatgctgcctctgctgcgctgcgtgccccgtgtgctgggctcctccgtcgccggcctccgcgctgccgcgcccgcctcgcctttccggcagctcctgcagccggcaccccggctgtgcacccggcccttcgggctgctcagcgtgcgcgcaggttccgagcggcggccgggcctcctgcggcctcgcggaccctgcgcctgtggctgtggctgcggctcgctgcacaccgacggagacaaagcttttgttgatttcctgagtgatgaaattaaggaggaaagaaaaattcagaagcataaaaccctccctaagatgtctggaggttgggagctggaactgaatgggacagaagcgaaattagtgcggaaagttgccggggaaaaaatcacggtcactttcaacattaacaacagcatcccaccaacatttgatggtgaggaggaaccctcgcaagggcagaaggttgaagaacaggagcctgaactgacatcaactcccaatttcgtggttgaagttataaagaatgatgatggcaagaaggcccttgtgttggactgtcattatccagaggatgaggttggacaagaagacgaggctgagagtgacatcttctctatcagggaagttagctttcagtccactggcgagtctgaatggaaggatactaattatacactcaacacagattccttggactgggccttatatgaccacctaatggatttccttgccgaccgaggggtggacaacacttttgcagatgagctggtggagctcagcacagccctggagcaccaggagtacattacttttcttgaagacctcaagagttttgtcaagagccagtagagcagacagatgctgaaagccatagtttcatggcaggctttggccagtgaacaaatcctactctgaagctagacatgtgctttgaaatgattatcatcctaatatcatgggggaaaaaataccaaatttaaattatatgttttgtgttctcatttattatcatttttttctgtacaaatctattatttctagatttttgtataacatgatagacataaaattggtttatctcctccaacaaggcagtttgtctttttctattcctcccccttcaacctgcgtcacaaaagaccaagaacagatgtcggaaaagtttttttttcttcagtattgtttaaaagtttcaatacaaaataagttataaataaaaggcttgtatgtacaaggc

SEQ ID NO: 365258 - DNA, 1198 bp, Homo sapiens
gaggattacgaggcagttcccggttttaatttcgttaccgggcctggcgtacgttgacttagtggctcggttgttgcttcatcatgtcacgtgttcgcagtcgtttccgcgatgctgcctctgctgcgctgcgtgccccgtgtgctgggctcctccgtcgccggcctccgcgctgccgcgcccgcctcgcctttccggcagctcctgcagccggcaccccggctgtgcacccggcccttcgggctgctcagcgtgcgcgcaggttccgagcggcggccgggcctcctgcggcctcgcggaccctgcgcctgtggctgtggctgcggctcgctgcacaccgacggagacaaagcttttgttgatttcctgagtgatgaaattaaggaggaaagaaaaattcagaagcataaaaccctccctaagatgtctggaggttgggagctggaactgaatgggacagaagcgaaattagtgcggaaagttgccggggaaaaaatcacggtcactttcaacattaacaacagcatcccaccaacatttgatggtgaggaggaaccctcgcaagggcagaaggttgaagaacaggagcctgaactgacatcaactcccaatttcgtggttgaagttataaagaatgatgatggcaagaaggcccttgtgttggactgtcattatccagaggatgaggttggacaagaagacgaggctgagagtgacatcttctctatcagggaagttagctttcagtccactggcgagtctgaatggaaggatactaattatacactcaacacagattccttggactgggccttatatgaccacctaatggatttccttgccgaccgaggggtggacaacacttttgcagatgagctggtggagctcagcacagccctggagcaccaggagtacattacttttcttgaagacctcaagagttttgtcaagagccagtagagcagacagatgctgaaagccatagtttcatggcaggctttggccagtgaacaaatcctactctgaagctagacatgtgctttgaaatgattatcatcctaatatcatgggggaaaaaataccaaatttaaattatatgttttgtgttctcatttattatcatttttttctgtacaaatctattatttctagatttttgtataacatgatagacataaaattggtttatctcctccaa

SEQ ID NO: 365259 - DNA, 979 bp, Homo sapiens
gccggcgcgggaagcgcttcggggcaggggcggggcttccggcggcgcctcaggtcgcggggcgcctaggcctgggttgtcctttgcatctgcacgtgttcgcagtcgtttccgcgatgctgcctctgctgcgctgcgtgccccgtgtgctgggctcctccgtcgccggcctccgcgctgccgcgcccgcctcgcctttccggcagctcctgcagccggcaccccggctgtgcacccggcccttcgggctgctcagcgtgcgcgcaggttccgagcggcggccgggcctcctgcggcctcgcggaccctgcgcctgtggctgtggctgcggctcgctgcacaccgacggagacaaagcttttgttgatttcctgagtgatgaaattaaggaggaaagaaaaattcagaagcataaaaccctccctaagatgtctggaggttgggagctggaactgaatgggacagaagcgaaattagtgcggaaagttgccggggaaaaaatcacggtcactttcaacattaacaacagcatcccaccaacatttgatggtgaggaggaaccctcgcaagggcagaaggttgaagaacaggagcctgaactgacatcaactcccaatttcgtggttgaagttataaagaatgatgatggcaagaaggcccttgtgttggactgtcattatccagaggatgaggttggacaagaagacgaggctgagagtgacatcttctctatcagggaagttagctttcagtccactggcgagtctgaatggaaggatactaattatacactcaacacagattccttggactgggccttatatgaccacctaatggatttccttgccgaccgaggggtggacaacacttttgcagatgagctggtggagctcaagacggcactcttgctcccatcagtcttgctcccatcaactcttgtactgctgttcaatatagaatccgctgatggacgaagatg

SEQ ID NO: 365260 - DNA, 1148 bp, Homo sapiens
gccggcgcgggaagcgcttcggggcaggggcggggcttccggcggcgcctcaggtcgcggggcgcctaggcctgggttgtcctttgcatctgcacgtgttcgcagtcgtttccgcgatgctgcctctgctgcgctgcgtgccccgtgtgctgggctcctccgtcgccggcctccgcgctgccgcgcccgcctcgcctttccggcagctcctgcagccggcaccccggctgtgcacccggcccttcgggctgctcagcgtgcgcgcaggttccgagcggcggccgggcctcctgcggcctcgcggaccctgcgcctgtggctgtggctgcggctcgctgcacaccgacggagacaaagcttttgttgatttcctgagtgatgaaattaaggaggaaagaaaaattcagaagcataaaaccctccctaagatgtctggaggttgggagctggaactgaatgggacagaagcgaaattagtgcggaaagttgccggggaaaagaggaaccctcgcaagggcagaaggttgaagaacaggagcctgaactgacatcaactcccaatttcgtggttgaagttataaagaatgatgatggcaagaaggcccttgtgttggactgtcattatccagaggatgaggttggacaagaagacgaggctgagagtgacatcttctctatcagggaagttagctttcagtccactggcgagtctgaatggaaggatactaattatacactcaacacagattccttggactgggccttatatgaccacctaatggatttccttgccgaccgaggggtggacaacacttttgcagatgagctggtggagctcagcacagccctggagcaccaggagtacattacttttcttgaagacctcaagagttttgtcaagagccagtagagcagacagatgctgaaagccatagtttcatggcaggctttggccagtgaacaaatcctactctgaagctagacatgtgctttgaaatgattatcatcctaatatcatgggggaaaaaataccaaatttaaattatatgttttgtgttctcatttattatcatttttttctgtacaaatctattatttctagatttttgtataacatgatagacataaaattggtttatctcctccaa

SEQ ID NO: 365261 - DNA, 1703 bp, Homo sapiens
gccggcgcgggaagcgcttcggggcaggggcggggcttccggcggcgcctcaggtcgcggggcgcctaggcctgggttgtcctttgcatctgcacgtgttcgcagtcgtttccgcgatgctgcctctgctgcgctgcgtgccccgtgtgctgggctcctccgtcgccggcctccgcgctgccgcgcccgcctcgcctttccggcagctcctgcagccggcaccccggctgtgcacccggcccttcgggctgctcagcgtgcgcgcaggttccgagcggcggccgggcctcctgcggcctcgcggaccctgcgcctgtggctgtggctgcggctcgctgcacaccgacggagacaaagcttttgttgatttcctgagtgatgaaattaaggaggaaagaaaaattcagaagcataaaaccctccctaagatgtctggaggttgggagctggaactgaatgggacagaagcgaaattagtgcggaaagttgccggggaaaaaatcacggtcactttcaacattaacaacagcatcccaccaacatttgatggtgaggaggaaccctcgcaagggcagaaggttgaagaacaggagcctgaactgacatcaactcccaatttcgtggttgaagttataaagaatgatgatggcaagaaggcccttgtgttggactgtcattatccagaggatgaggttggacaagaagacgaggctgagagtgacatcttctctatcagggaagttagctttcagtccactggcgagtctgaatggaaggatactaattatacatcagcacagccctggagcaccaggagtacattacttttcttgaagacctcaagagttttgtcaagagccagtagagcagacagatgctgaaagccatagtttcatggcaggctttggccagtgaacaaatcctactctgaagctagacatgtgctttgaaatgattatcatcctaatatcatgggggaaaaaataccaaatttaaattatatgttttgtgttctcatttattatcatttttttctgtacaaatctattatttctagatttttgtataacatgatagacataaaattggtttatctcctccaacaaggcagtttgtctttttctattcctcccccttcaacctgcgtcacaaaagaccaagaacagatgtcggaaaagtttttttttcttcagtattgtttaaaagtttcaatacaaaataagttataaataaaaggcttgtatgtacaaggctcctcagagggaatgagttgtcttcaaccccatagaatgatgtgagtccaagctggctctagaggatcacagcccaagtatcacaggccttggttgatcagctcctgttgaatttcctccagcacagccatgtctatcagctcctccaactgagccaagtcttctggacaattctccactgactgcaaagcattccactcttcttccatcacctcttgaactagaaagctgttctgagaattccctggcccactgcttccagcctggcggtacctgtttaggagcctgtcccggctgtttctcattctctccaggcatctctgccggaaagcctctttccaaggcggcgagcccaccagtttgtacagggagcggcgcggagacctcaacgactccgccatctcctcttcgcgggagacaaagccacaagacccgttccctggaggcgcg

SEQ ID NO: 365262 - DNA, 588 bp, Homo sapiens
  misc_feature (10)..(10): n is a, c, g, or t
  misc_feature (23)..(23): n is a, c, g, or t
  misc_feature (32)..(32): n is a, c, g, or t
cccgcccgcncgatacgggcganaagacgacngaagggaaagcccttgtgttggactgtcattatccagaggatgaggttggacaagaagacgaggctgagagtgacatcttctctatcagggaagttagctttcagtccactggcgagtctgaatggaaggatactaattatacactcaacacagattccttggactgggccttatatgaccacctaatggatttccttgccgaccgaggggtggacaacacttttgcagatgagctggtggagctcagcacagccctggagcaccaggagtacattacttttcttgaagacctcaagagttttgtcaagagccagtagagcagacagatgctgaaagccatagtttcatggcaggctttggccagtgaacaaatcctactctgaagctagacatgtgctttgaaatgattatcatcctaatatcatgggggaaaaaataccaaatttaaattatatgttttgtgttctcatttattatcatttttttctgtacaaatctattatttctagatttttgtataacatgatagacataaaattggtttatctcctccaa

SEQ ID NO: 365263 - DNA, 784 bp, Homo sapiens
gccggcgcgggaagcgcttcggggcaggggcggggcttccggcggcgcctcaggtcgcggggcgcctaggcctgggttgtcctttgcatctgcacgtgttcgcagtcgtttccgcgatgctgcctctgctgcgctgcgtgccccgtgtgctgggctcctccgtcgccggcctccgcgctgccgcgcccgcctcgcctttccggcagctcctgcagccggcaccccggctgtgcacccggcccttcgggctgctcagcgtgcgcgcaggttccgagcggcggccgggcctcctgcggcctcgcggaccctgcgcctgtggctgtggctgcggctcgctgcacaccgacggagacaaagcttttgttgatttcctgagtgatgaaattaaggaggaaagaaaaattcagaagcataaaaccctccctaagatgtctggaggttgggagctggaactgaatgggacagaagcgaaattagtgcggaaagttgccggggaaaaaatcacggtcactttcaacattaacaacagcatcccaccaacatttgatggtgaggaggaaccctcgcaagggcagaaggttgaagaacaggagccttaaaatattcactgaaccctgctgtaaacagtgttgtcattcacgcttttttgttcaatttctaaagcacaggcagagtagacttagcataattcctagcggccctaggatatttagaatgttaagtgaccactggttgcaactcaaagtccccatctgtattagcccctgagggggtttgtgggtga

SEQ ID NO: 365264 - DNA, 1047 bp, Homo sapiens
acatgccggaggaggcgggcttcccgccggccaagagattccggccaggctctggacctccgagccgcgctgggtccttccctcccgggaggcaagtggtgatgctgctgactgcgggcagcggcggcagaggaggaggaggaggccggaggcagcagccgcccctggcccagccctcggccagtccctaccctgaagctgtggagctgcagcgccggagtctgcccatcttccaagcgcgggggcaactgttggcccagctccgaaacctggacaacgcggtcctcatcggggaaactggctctgggaagacaactcagatccctcagtacctgtatgaaggagggatcagccgccagggcatcattgctgtgacccagcctcgtcgagtagctgccatctctcttgctactagagtctcagatgagaagagaactgaacttgggaagctggttggctatacagtgcgctttgatgatgtcacctcagaagacaccaggatcaagtttctgacagatggcatgcttctgcgtgaagcaatttcagactctttgcttcggaaatacagctgtgtcattttggatgaagctcacgaacggactatccacacagatgtgctctttggagtggtgaaagctgcacagaagaggagaaaggaactcgggaaacttcctctgaaagtatgagggaaacttcccctgaaagtatgagggaaacttcccctgaaagtatgcgtaacacacagaaggaaacaggcctggctgggcgcggtggctcacgcctgtaatcccagcactttgggaggccaaggccggtggatcacctgaggtcaggagttcgagaccagcctggccaacgtggtgaaaccccgtctctactaaaaatataaaaattagctgggtgtggtggcacacatctgtaatcccagctacttgggtggctgaggcatgagaatcgcctgaacccaggaggcggaggttgcggtgagctgagatcacaccactgcactccagcctgggtgacagagcgagactctgtctcaaaaaa

SEQ ID NO: 365265 - DNA, 635 bp, Homo sapiens
gaattgtacttatttttcttcataaaacactttctcttttcatgtttcttataataggtgttggtgccagaaatacttagtattgaagtgttttttttcctaggaagcgctaggctgtttatagacattgttttgaagaggagagcaagttcagcttaagtgttgagtgcaagtctaaaaactgcaaccaaaggaacttccagccagggctgaggaaggtgcaaccagtgggcaagaagatggaccaagaagcgcattggctagagcacagatacctgggctctggttgctactctgtaatagcagagtgaagtcattttatatcaggccagtggctctccaagtggggttcccagaccagcagcctcagcatcacctgggaacttgatagacatgcacattcttagattccccacccagatctacagaatctgaaactctggaatgaggccaagagttaaatccagtttgacaggccttctggatgattctggtgcacactaaagattgagagctaatgtactatgcttttagtctccttggagtttctccttctcaatccaaggggcctttcaactttgagatgcagtgaatccaacactcttcccaggacctatcctacttccttgtagtga

SEQ ID NO: 365266 - DNA, 481 bp, Homo sapiens
atttaaattataatttatacttttagttaactttttttgcttattgcattgctattatagtgtttatccattagtatggaagtatttcaacattttggcagttgtgtgcatttggatgaatatatcaactttaacctttgttattgaaagtatcattcatccctcatacagtactgatcacttagcaaatatgaggcattatgaggtactgtatgaggtgacaaatatgtgtaaggcccaaaatgcatcctcagagagcttgtaatctattacatacctatacaaggaaatagaatatatggaagaaagtactaagtactagagaagaattgttaatattacatacaagttgtattcatgtagagagattaatcttgtttgggaaatttcattgtcaaagtttaggaataaccatatacattttttccttataagaatcatacattctcattgtgaaaattcataaactctagagagtcac

SEQ ID NO: 365267 - DNA, 513 bp, Homo sapiens
agtcctgagcgggaggtgggtagagaaggtgctccctggccgggagggctcagaagagaagtagggcatggcatcgtcctctgctgaccacctgcactcggctcccccgtgcgctgcaggtccctgttccagcagcttctctacggcctcatctaccacagctggttccaagcaggtaggtagggctttggaggcgcctcctcaagtccgggtccccaatctgagctaagacgactccatggggagggtggggtctacgactgagggaggccggagaccttgccagggtctgtgggcggagctgaggcgctctgggccctcgcagaccccgcggaggccgaggggagccccgagacgcgcgagagcagctgcgtcatgaaacagacccagtactacttcggctcggtaaacgcctcctacaacgccatcatcgactgcggaaactgctccaggtgctggcagtggggcgggaccagaggccaagggcggaacctgtgagcggggcgagacgct

SEQ ID NO: 365268 - DNA, 5753 bp, Homo sapiens
  misc_feature (24)..(24): n is a, c, g, or t
gccagcgctgcagggagatagcgngcagcgcagcccgcagaggcgctgcggcccgtgcagccccggaggcccctcgcggagaaggcggcggcggaggagaggccgagttaccgcccgccgcccgcgcccccccaaccccgccgccgccgccgccgccgccactgccccccctccccgcggcgccgcatcttgaatggaaacatggcggtgccggctcggacctgcggcgcctctcggcccggcccagcgcggactgcgcgcccctggcccggctgcggcccccaccctggccccggcacccggcgcccgacgtccgggcccccgcgcccgctgtggctgctgctgccgcttctaccgctgctcgccgcccccggcgcctctgcctacagcttcccccagcagcacacgatgcagcactgggcccggcgtctggagcaggaggtcgacggcgtgatgcggatttttggaggcgtccagcagctccgtgagatttacaaggacaaccggaacctgttcgaggtacaggagaatgagcctcagaagttggtggagaaggtggcaggggacattgagagccttctggacaggaaggtgcaggccctgaagagactggctgatgctgcagagaacttccagaaagcacaccgctggcaggacaacatcaaggaggaagacatcgtgtactatgacgccaaggctgacgctgagctggacgaccctgagagtgaggatgtggaaagggggtctaaggccagcaccctaaggctggacttcatcgaggacccaaacttcaagaacaaggtcaactattcatacgcggctgtacagatccctacggacatctacaaaggctccactgtcatcctcaatgagctcaactggacagaggccctggagaatgtgttcatggaaaaccgcagacaagaccccacactgctgtggcaggtcttcggcagcgccacaggagtcactcgctactacccggccaccccgtggcgagcccccaagaagatcgacctgtacgatgtccgaaggagaccctggtatatccagggggcctcgtcacccaaagacatggtcatcatcgtggatgtgagtggcagtgtgagcggcctgaccctgaagctgatgaagacatctgtctgcgagatgctggacacgctgtctgatgatgactatgtgaatgtggcctcgttcaacgagaaggcacagcctgtgtcatgcttcacacacctggtgcaggccaatgtgcgcaacaagaaggtgttcaaggaagctgtgcagggcatggtggccaagggcaccacaggctacaaggccggctttgagtatgcctttgaccagctgcagaactccaacatcactcgggccaactgcaacaagatgatcatgatgttcacggatggtggtgaggaccgcgtgcaggacgtctttgagaagtacaattggccaaaccggacggtgcgcgtgtttactttctccgtggggcagcataactatgacgtcacaccgctgcagtggatggcctgtgccaacaaaggctactattttgagatcccttccatcggagccatccgcatcaacacacaggaatatctagatgtgttgggcaggcccatggtgctggcaggcaaggaggccaagcaggtgcagtggaccaacgtgtatgaggatgcactgggactggggttggtggtaacagggaccctccctgttttcaacctgacacaggatggccctggggaaaagaagaaccagctgatcctgggcgtgatgggcattgacgtggctctgaatgacatcaagaggctgacccccaactacacgcttggagccaacggctatgtgtttgccattgacctgaacggctacgtgttgctgcaccccaatctcaagccccagaccaccaacttccgggagcctgtgactctggacttcctggatgcggagctagaggatgagaacaaggaagagatccgtcggagcatgattgatggcaacaagggccacaagcagatcagaacgttggtcaagtccctggatgagaggtacatagatgaggtgacacggaactacacctgggtgcctataaggagcactaactacagcctggggctggtgctcccaccctacagcaccttctacctccaagccaatctcagtgaccagatcctgcaggtcaagtattttgagttcctgctccccagcagctttgagtctgaaggacacgttttcattgctcccagagagtactgcaaggacctgaatgcctcagacaacaacaccgagttcctgaaaaactttattgagctcatggagaaagtgactccagactccaagcagtgcaacaacttccttctgcacaacctgatcttggacacgggcatcacgcagcagctggtagagcgtgtgtggagggaccaggatctcaacacgtacagcctactggccgtgttcgctgccacagacggtggcatcacccgagtcttccccaacaaggcagctgaggactggacagagaaccctgagcccttcaatgccagcttctaccgccgcagcctggataaccacggttatgtcttcaagcccccacaccaggatgccctgttaaggccgctggagctggagaatgacactgtgggcatcctcgtcagcacagctgtggagctcagcctaggcaggcgcacactgaggccagcagtggtgggcgtcaagctggacctagaggcttgggctgagaagttcaaggtgctagccagcaaccgtacccaccaagaccagcctcagaagtgcggccccaacagccactgtgagatggactgcgaggttaacaatgaggacttactctgtgtcctcattgatgatggaggattcctggtgctgtcaaaccagaaccatcagtgggaccaggtgggcaggttcttcagtgaggtggatgccaacctgatgctggcactctacaataactccttctacacccgcaaggagtcctatgactatcaggcagcctgtgcccctcagccccctggcaacctgggtgctgcaccccggggtgtctttgtgcccaccgttgcagatttccttaacctggcctggtggacctctgctgccgcctggtccctgttccagcagcttctctacggcctcatctaccacagctggttccaagcagaccccgcggaggccgaggggagccccgagacgcgcgagagcagctgcgtcatgaaacagacccagtactacttcggctcggtaaacgcctcctacaacgccatcatcgactgcggaaactgctccaggctgttccacgcgcagagactgaccaacaccaatcttctctttgtggtggccgagaagccgctgtgcagccagtgcgaggctggccggctgctgcagaaggagacgcactgcccagcggacggcccggagcagtgtgagctagtgcagagaccgcgataccggagaggcccgcacatctgcttcgactacaacgcgacagaagatacctcagactgtggccgcggggcctccttcccgccgtcgctgggcgtcctggtctccctgcaactgctgctcctcctgggcctgccgccccggccgcagcctcaagtcctcgtccacgcctctcgccgcctctgagcaccctgccccaccccacctccactcccacctcacccggcctcttcgcctttcccaccctcctgccccacactccccgccttagagcctcgtccctccctcactgaaggacctgagctggccaggccctgagagtctggtctgcgccttgggatggggagtcccaaagcgggacgccgcaggtgtttggcacccaaatcacatctcacctccgaactgttcaagtgtccccagacccttcttgcctgctgggctccccccagtgggatgggacagggaggccacacgcactggtgccaaaaccaggcctctgctgccgcccttcctggaggctgcctatgttgggggggaccctgcctcagctgacccggcctctctgccccacccaagcccaaacttggtttctgtgagaatagtggaggaaggtgagatggccagtttgaagcctgtgcctcccagcttaaatcctagcaggagagaggctctggggcagcccccatgggctcctgcccctttcaggcctacagccacatccccaagcccaccaggtgtcaggatagtcacagtgataccagttcagacactaccccatatacacctggaacattgaggatggaaactggactcacattcgacataccccactgggcacacgcacaaacacacacactatggggtggggtgggtgtaggggcttacaaagccttacacagggcgaggggttggtgggagggttggcacctgcacactccatctcctgctcaccacctgcctctaatctgagctgcagcctggctggtcctcccatttctaaagctgaatgtcaaacagtgccaaatgctggggcagggggtgaagaaccctctgtcccacccctagccaccagtgtcctccaagtgccccctcacctctccaggtgctcattgtaaccatttctcactagtgtcaggcccccagtgggaccacatgccactgcctgcacctttcggcagaggaacccccaccagacatcaccctttgccttagcaggggtgactttgtctctcctggctgggccatccttccgccaatctggcccttacacactcaggcctgtgcccactccctatctccttcccacccctacacacacactccctgcttgcaggaggccaaactgtccctcccttgctgaacacacacacacacacacacacacaggtggggactgggcacagctcttcacaccattcattctggtcatttcccccaaaggcatcccagcctgggggccagtggggaactgagggcaaggggatatagtgatggggctcagatggactgggaggagggggagggtgatgcattaattaatggcttcgttaattaatgtcatgttgcttgtcgctttctcagtgtgtgtgtgtggtccatgcccactgctggtgccagggtgggtgtccatgtgcacccggcctggatgccagctgtgtccttcgggggcgtgcgtgtaactgtagtgtagtcaggtgctcaatggagaatataaacatatacagaaaaatatatattttaagtttaaaaaacagaaaaacagacaaaacaatccccatcaggtagctgtctaacccccagctgggtctaatccttctcattacccacccgacctggctgcccctcaccttgggctgggggactggggggccatttccttttctctgccctttttttgttgttctattttgtacagacaagttggaaaaacaacagcgacaaaaaagtcaagaaactttgtaaaatatcgtgtgtgtgattccttgtaaaatattttcaaatggtttattacagaagatcagttattaaataatgttcatattttcacttcaaatggttcccatccactgtatcagcttgggggtgaggactgggtagctatgaagacagttggccaagacctcagagtcccacttagtgctctgcagggggtgaagaccatggtagcccaggtccctgtcaaccacagggcatggcacttgcttccaccagttataataggtgccaggcccttgacatacattgtctcataacatctcaaaaagctgtcttttaaaaacaagcaagacaggctgggtgcg

SEQ ID NO: 365269 - DNA, 5528 bp, Homo sapiens
  misc_feature (2)..(3): n is a, c, g, or t
  misc_feature (5)..(6): n is a, c, g, or t
anngnngcgaagcgagtggctgcagagggctgcatcctgccgtccccagccccccacaaccgtacagccgtgcccaggtttccgcttagggaaccaggaggtccaggccctttctgccagcagccgggcgtgcaagcccccgacagagagaaatcttaaagatagctagagccacgggggctgatgcagcactgggcccggcgtctggagcaggaggtcgacggcgtgatgcggatttttggaggcgtccagcagctccgtgagatttacaaggacaaccggaacctgttcgaggtacaggagaatgagcctcagaagttggtggagaaggtggcaggggacattgagagccttctggacaggaaggtgcaggccctgaagagactggctgatgctgcagagaacttccagaaagcacaccgctggcaggacaacatcaaggaggaagacatcgtgtactatgacgccaaggctgacgctgagctggacgaccctgagagtgaggatgtggaaagggggtctaaggccagcaccctaaggctggacttcatcgaggacccaaacttcaagaacaaggtcaactattcatacgcggctgtacagatccctacggacatctacaaaggctccactgtcatcctcaatgagctcaactggacagaggccctggagaatgtgttcatggaaaaccgcagacaagaccccacactgctgtggcaggtcttcggcagcgccacaggagtcactcgctactacccggccaccccgtggcgagcccccaagaagatcgacctgtacgatgtccgaaggagaccctggtatatccagggggcctcgtcacccaaagacatggtcatcatcgtggatgtgagtggcagtgtgagcggcctgaccctgaagctgatgaagacatctgtctgcgagatgctggacacgctgtctgatgatgactatgtgaatgtggcctcgttcaacgagaaggcacagcctgtgtcatgcttcacacacctggtgcaggccaatgtgcgcaacaagaaggtgttcaaggaagctgtgcagggcatggtggccaagggcaccacaggctacaaggccggctttgagtatgcctttgaccagctgcagaactccaacatcactcgggccaactgcaacaagatgatcatgatgttcacggatggtggtgaggaccgcgtgcaggacgtctttgagaagtacaattggccaaaccggacggtgcgcgtgtttactttctccgtggggcagcataactatgacgtcacaccgctgcagtggatggcctgtgccaacaaaggctactattttgagatcccttccatcggagccatccgcatcaacacacaggaatatctagatgtgttgggcaggcccatggtgctggcaggcaaggaggccaagcaggtgcagtggaccaacgtgtatgaggatgcactgggactggggttggtggtaacagggaccctccctgttttcaacctgacacaggatggccctggggaaaagaagaaccagctgatcctgggcgtgatgggcattgacgtggctctgaatgacatcaagaggctgacccccaactacacgcttggagccaacggctatgtgtttgccattgacctgaacggctacgtgttgctgcaccccaatctcaagccccagaccaccaacttccgggagcctgtgactctggacttcctggatgcggagctagaggatgagaacaaggaagagatccgtcggagcatgattgatggcaacaagggccacaagcagatcagaacgttggtcaagtccctggatgagaggtacatagatgaggtgacacggaactacacctgggtgcctataaggagcactaactacagcctggggctggtgctcccaccctacagcaccttctacctccaagccaatctcagtgaccagatcctgcaggtcaagtattttgagttcctgctccccagcagctttgagtctgaaggacacgttttcattgctcccagagagtactgcaaggacctgaatgcctcagacaacaacaccgagttcctgaaaaactttattgagctcatggagaaagtgactccagactccaagcagtgcaacaacttccttctgcacaacctgatcttggacacgggcatcacgcagcagctggtagagcgtgtgtggagggaccaggatctcaacacgtacagcctactggccgtgttcgctgccacagacggtggcatcacccgagtcttccccaacaaggcagctgaggactggacagagaaccctgagcccttcaatgccagcttctaccgccgcagcctggataaccacggttatgtcttcaagcccccacaccaggatgccctgttaaggccgctggagctggagaatgacactgtgggcatcctcgtcagcacagctgtggagctcagcctaggcaggcgcacactgaggccagcagtggtgggcgtcaagctggacctagaggcttgggctgagaagttcaaggtgctagccagcaaccgtacccaccaagaccagcctcagaagtgcggccccaacagccactgtgagatggactgcgaggttaacaatgaggacttactctgtgtcctcattgatgatggaggattcctggtgctgtcaaaccagaaccatcagtgggaccaggtgggcaggttcttcagtgaggtggatgccaacctgatgctggcactctacaataactccttctacacccgcaaggagtcctatgactatcaggcagcctgtgcccctcagccccctggcaacctgggtgctgcaccccggggtgtctttgtgcccaccgttgcagatttccttaacctggcctggtggacctctgctgccgcctggtccctgttccagcagcttctctacggcctcatctaccacagctggttccaagcagaccccgcggaggccgaggggagccccgagacgcgcgagagcagctgcgtcatgaaacagacccagtactacttcggctcggtaaacgcctcctacaacgccatcatcgactgcggaaactgctccaggctgttccacgcgcagagactgaccaacaccaatcttctctttgtggtggccgagaagccgctgtgcagccagtgcgaggctggccggctgctgcagaaggagacgcactgcccagcggacggcccggagcagtgtgagctagtgcagagaccgcgataccggagaggcccgcacatctgcttcgactacaacgcgacagaagatacctcagactgtggccgcggggcctccttcccgccgtcgctgggcgtcctggtctccctgcaactgctgctcctcctgggcctgccgccccggccgcagcctcaagtcctcgtccacgcctctcgccgcctctgagcaccctgccccaccccacctccactcccacctcacccggcctcttcgcctttcccaccctcctgccccacactccccgccttagagcctcgtccctccctcactgaaggacctgagctggccaggccctgagagtctggtctgcgccttgggatggggagtcccaaagcgggacgccgcaggtgtttggcacccaaatcacatctcacctccgaactgttcaagtgtccccagacccttcttgcctgctgggctccccccagtgggatgggacagggaggccacacgcactggtgccaaaaccaggcctctgctgccgcccttcctggaggctgcctatgttgggggggaccctgcctcagctgacccggcctctctgccccacccaagcccaaacttggtttctgtgagaatagtggaggaaggtgagatggccagtttgaagcctgtgcctcccagcttaaatcctagcaggagagaggctctggggcagcccccatgggctcctgcccctttcaggcctacagccacatccccaagcccaccaggtgtcaggatagtcacagtgataccagttcagacactaccccatatacacctggaacattgaggatggaaactggactcacattcgacataccccactgggcacacgcacaaacacacacactatggggtggggtgggtgtaggggcttacaaagccttacacagggcgaggggttggtgggagggttggcacctgcacactccatctcctgctcaccacctgcctctaatctgagctgcagcctggctggtcctcccatttctaaagctgaatgtcaaacagtgccaaatgctggggcagggggtgaagaaccctctgtcccacccctagccaccagtgtcctccaagtgccccctcacctctccaggtgctcattgtaaccatttctcactagtgtcaggcccccagtgggaccacatgccactgcctgcacctttcggcagaggaacccccaccagacatcaccctttgccttagcaggggtgactttgtctctcctggctgggccatccttccgccaatctggcccttacacactcaggcctgtgcccactccctatctccttcccacccctacacacacactccctgcttgcaggaggccaaactgtccctcccttgctgaacacacacacacacacacacacacaggtggggactgggcacagctcttcacaccattcattctggtcatttcccccaaaggcatcccagcctgggggccagtggggaactgagggcaaggggatatagtgatggggctcagatggactgggaggagggggagggtgatgcattaattaatggcttcgttaattaatgtcatgttgcttgtcgctttctcagtgtgtgtgtgtggtccatgcccactgctggtgccagggtgggtgtccatgtgcacccggcctggatgccagctgtgtccttcgggggcgtgcgtgtaactgtagtgtagtcaggtgctcaatggagaatataaacatatacagaaaaatatatattttaagtttaaaaaacagaaaaacagacaaaacaatccccatcaggtagctgtctaacccccagctgggtctaatccttctcattacccacccgacctggctgcccctcaccttgggctgggggactggggggccatttccttttctctgccctttttttgttgttctattttgtacagacaagttggaaaaacaacagcgacaaaaaagtcaagaaactttgtaaaatatcgtgtgtgtgattccttgtaaaatattttcaaatggtttattacagaagatcagttattaaataatgttcatattttcacttcaaatggttcccatccactgtatcagcttgggggtgaggactgggtagctatgaagacagttggccaagacctcagagtcccacttagtgctctgcagggggtgaagaccatggtagcccaggtccctgtcaaccacagggcatggcacttgcttccaccagttataataggtgccaggcccttgacatacattgtctcataacatctcaaaaagctgtcttttaaaaacaagcaagacaggctgggtgcg

SEQ ID NO: 365270 - DNA, 5724 bp, Homo sapiens
  misc_feature (2)..(3): n is a, c, g, or t
  misc_feature (5)..(6): n is a, c, g, or t
anngnngcgaagcgagtggctgcagagggctgcatcctgccgtccccagccccccacaaccgtacagccgtgcccaggtttccgcttagggaaccaggaggtccaggccctttctgccagcagccgggcgtgcaagcccccgacagagagaaatcttaaagatagctagagccacgggggctgatgcagcactgggcccggcgtctggagcaggaggtcgacggcgtgatgcggatttttggaggcgtccagcagctccgtgagatttacaaggacaaccggaacctgttcgaggtacaggagaatgagcctcagaagttggtggagaaggtggcaggggacattgagagccttctggacaggaaggtgcaggccctgaagagactggctgatgctgcagagaacttccagaaagcacaccgctggcaggacaacatcaaggaggaagacatcgtgtactatgacgccaaggctgacgctgagctggacgaccctgagagtgaggatgtggaaagggggtctaaggccagcaccctaaggctggacttcatcgaggacccaaacttcaagaacaaggtcaactattcatacgcggctgtacagatccctacggacatctacaaaggctccactgtcatcctcaatgagctcaactggacagaggccctggagaatgtgttcatggaaaaccgcagacaagaccccacactgctgtggcaggtcttcggcagcgccacaggagtcactcgctactacccggccaccccgtggcgagcccccaagaagatcgacctgtacgatgtccgaaggagaccctggtatatccagggggcctcgtcacccaaagacatggtcatcatcgtggatgtgagtggcagtgtgagcggcctgaccctgaagctgatgaagacatctgtctgcgagatgctggacacgctgtctgatgatgactatgtgaatgtggcctcgttcaacgagaaggcacagcctgtgtcatgcttcacacacctggtgcaggccaatgtgcgcaacaagaaggtgttcaaggaagctgtgcagggcatggtggccaagggcaccacaggctacaaggccggctttgagtatgcctttgaccagctgcagaactccaacatcactcgggccaactgcaacaagatgatcatgatgttcacggatggtggtgaggaccgcgtgcaggacgtctttgagaagtacaattggccaaaccggacggtgcgcgtgtttactttctccgtggggcagcataactatgacgtcacaccgctgcagtggatggcctgtgccaacaaaggctactattttgagatcccttccatcggagccatccgcatcaacacacaggaatatctagatgtgttgggcaggcccatggtgctggcaggcaaggaggccaagcaggtgcagtggaccaacgtgtatgaggatgcactgggactggggttggtggtaacagggaccctccctgttttcaacctgacacaggatggccctggggaaaagaagaaccagctgatcctgggcgtgatgggcattgacgtggctctgaatgacatcaagaggctgacccccaactacacgcttggagccaacggctatgtgtttgccattgacctgaacggctacgtgttgctgcaccccaatctcaagccccagaccaccaacttccgggagcctgtgactctggacttcctggatgcggagctagaggatgagaacaaggaagagatccgtcggagcatgattgatggcaacaagggccacaagcagatcagaacgttggtcaagtccctggatgagaggtacatagatgaggtgacacggaactacacctgggtgcctataaggagcactaactacagcctggggctggtgctcccaccctacagcaccttctacctccaagccaatctcagtgaccagatcctgcaggtcaagtattttgagttcctgctccccagcagctttgagtctgaaggacacgttttcattgctcccagagagtactgcaaggacctgaatgcctcagacaacaacaccgagttcctgaaaaactttattgagctcatggagaaagtgactccagactccaagcagtgtgagtgcctggcagggcagctggctctgggcagtgcccaggcagcatggggccagcccagaggaacccagaggccgggcaggtgtggaaataagcaggcacaagctaagggctgggcctgggccagggccaggtcatggaggaggctcctggtggagccttaagggtgggggtgagggtgggcaaggagctgcaagaagatgcccccacccccacccctcccctcctgttccaggcaacaacttccttctgcacaacctgatcttggacacgggcatcacgcagcagctggtagagcgtgtgtggagggaccaggatctcaacaccagtctgcctcttgggtgctccagggcagctgaggactggacagagaaccctgagcccttcaatgccagcttctaccgccgcagcctggataaccacggttatgtcttcaagcccccacaccaggatgccctgttaaggccgctggagctggagaatgacactgtgggcatcctcgtcagcacagctgtggagctcagcctaggcaggcgcacactgaggccagcagtggtgggcgtcaagctggacctagaggcttgggctgagaagttcaaggtgctagccagcaaccgtacccaccaagaccagcctcagaagtgcggccccaacagccactgtgagatggactgcgaggttaacaatgaggacttactctgtgtcctcattgatgatggaggattcctggtgctgtcaaaccagaaccatcagtgggaccaggtgggcaggttcttcagtgaggtggatgccaacctgatgctggcactctacaataactccttctacacccgcaaggagtcctatgactatcaggcagcctgtgcccctcagccccctggcaacctgggtgctgcaccccggggtgtctttgtgcccaccgttgcagatttccttaacctggcctggtggacctctgctgccgcctggtccctgttccagcagcttctctacggcctcatctaccacagctggttccaagcagaccccgcggaggccgaggggagccccgagacgcgcgagagcagctgcgtcatgaaacagacccagtactacttcggctcggtaaacgcctcctacaacgccatcatcgactgcggaaactgctccaggctgttccacgcgcagagactgaccaacaccaatcttctctttgtggtggccgagaagccgctgtgcagccagtgcgaggctggccggctgctgcagaaggagacgcactgcccagcggacggcccggagcagtgtgagctagtgcagagaccgcgataccggagaggcccgcacatctgcttcgactacaacgcgacagaagatacctcagactgtggccgcggggcctccttcccgccgtcgctgggcgtcctggtctccctgcaactgctgctcctcctgggcctgccgccccggccgcagcctcaagtcctcgtccacgcctctcgccgcctctgagcaccctgccccaccccacctccactcccacctcacccggcctcttcgcctttcccaccctcctgccccacactccccgccttagagcctcgtccctccctcactgaaggacctgagctggccaggccctgagagtctggtctgcgccttgggatggggagtcccaaagcgggacgccgcaggtgtttggcacccaaatcacatctcacctccgaactgttcaagtgtccccagacccttcttgcctgctgggctccccccagtgggatgggacagggaggccacacgcactggtgccaaaaccaggcctctgctgccgcccttcctggaggctgcctatgttgggggggaccctgcctcagctgacccggcctctctgccccacccaagcccaaacttggtttctgtgagaatagtggaggaaggtgagatggccagtttgaagcctgtgcctcccagcttaaatcctagcaggagagaggctctggggcagcccccatgggctcctgcccctttcaggcctacagccacatccccaagcccaccaggtgtcaggatagtcacagtgataccagttcagacactaccccatatacacctggaacattgaggatggaaactggactcacattcgacataccccactgggcacacgcacaaacacacacactatggggtggggtgggtgtaggggcttacaaagccttacacagggcgaggggttggtgggagggttggcacctgcacactccatctcctgctcaccacctgcctctaatctgagctgcagcctggctggtcctcccatttctaaagctgaatgtcaaacagtgccaaatgctggggcagggggtgaagaaccctctgtcccacccctagccaccagtgtcctccaagtgccccctcacctctccaggtgctcattgtaaccatttctcactagtgtcaggcccccagtgggaccacatgccactgcctgcacctttcggcagaggaacccccaccagacatcaccctttgccttagcaggggtgactttgtctctcctggctgggccatccttccgccaatctggcccttacacactcaggcctgtgcccactccctatctccttcccacccctacacacacactccctgcttgcaggaggccaaactgtccctcccttgctgaacacacacacacacacacacacacaggtggggactgggcacagctcttcacaccattcattctggtcatttcccccaaaggcatcccagcctgggggccagtggggaactgagggcaaggggatatagtgatggggctcagatggactgggaggagggggagggtgatgcattaattaatggcttcgttaattaatgtcatgttgcttgtcgctttctcagtgtgtgtgtgtggtccatgcccactgctggtgccagggtgggtgtccatgtgcacccggcctggatgccagctgtgtccttcgggggcgtgcgtgtaactgtagtgtagtcaggtgctcaatggagaatataaacatatacagaaaaatatatattttaagtttaaaaaacagaaaaacagacaaaacaatccccatcaggtagctgtctaacccccagctgggtctaatccttctcattacccacccgacctggctgcccctcaccttgggctgggggactggggggccatttccttttctctgccctttttttgttgttctattttgtacagacaagttggaaaaacaacagcgacaaaaaagtcaagaaactttgtaaaatatcgtgtgtgtgattccttgtaaaatattttcaaatggtttattacagaagatcagttattaaataatgttcatattttcacttcaaatggttcccatccactgtatcagcttgggggtgaggactgggtagctatgaagacagttggccaagacctcagagtcccacttagtgctctgcagggggtgaagaccatggtagcccaggtccctgtcaaccacagggcatggcacttgcttccaccagttataataggtgccaggcccttgacatacattgtctcataacatctcaaaaagctgtcttttaaaaacaagcaagacaggctgggtgcg

SEQ ID NO: 365271 - DNA, 5874 bp, Homo sapiens
  misc_feature (2)..(3): n is a, c, g, or t
  misc_feature (5)..(6): n is a, c, g, or t
anngnngcgaagcgagtggctgcagagggctgcatcctgccgtccccagccccccacaaccgtacagccgtgcccaggtttccgcttagggaaccaggaggtccaggccctttctgccagcagccgggcgtgcaagcccccgacagagagaaatcttaaagatagctagagccacgggggctgatgcagcactgggcccggcgtctggagcaggaggtcgacggcgtgatgcggatttttggaggcgtccagcagctccgtgagatttacaaggacaaccggaacctgttcgaggtacaggagaatgagcctcagaagttggtggagaaggtggcaggggacattgagagccttctggacaggaaggtgcaggccctgaagagactggctgatgctgcagagaacttccagaaagcacaccgctggcaggacaacatcaaggaggaagacatcgtgtactatgacgccaaggctgacgctgagctggacgaccctgagagtgaggatgtggaaagggggtctaaggccagcaccctaaggctggacttcatcgaggacccaaacttcaagaacaaggtcaactattcatacgcggctgtacagatccctacggacatctacaaaggctccactgtcatcctcaatgagctcaactggacagaggccctggagaatgtgttcatggaaaaccgcagacaagaccccacactgctgtggcaggtcttcggcagcgccacaggagtcactcgctactacccggccaccccgtggcgagcccccaagaagatcgacctgtacgatgtccgaaggagaccctggtatatccagggggcctcgtcacccaaagacatggtcatcatcgtggatgtgagtggcagtgtgagcggcctgaccctgaagctgatgaagacatctgtctgcgagatgctggacacgctgtctgatgatgactatgtgaatgtggcctcgttcaacgagaaggcacagcctgtgtcatgcttcacacacctggtgcaggccaatgtgcgcaacaagaaggtgttcaaggaagctgtgcagggcatggtggccaagggcaccacaggctacaaggccggctttgagtatgcctttgaccagctgcagaactccaacatcactcgggccaactgcaacaagatgatcatgatgttcacggatggtggtgaggaccgcgtgcaggacgtctttgagaagtacaattggccaaaccggacggtgcgcgtgtttactttctccgtggggcagcataactatgacgtcacaccgctgcagtggatggcctgtgccaacaaaggctactattttgagatcccttccatcggagccatccgcatcaacacacaggaatatctagatgtgttgggcaggcccatggtgctggcaggcaaggaggccaagcaggtgcagtggaccaacgtgtatgaggatgcactgggactggggttggtggtaacagggaccctccctgttttcaacctgacacaggatggccctggggaaaagaagaaccagctgatcctgggcgtgatgggcattgacgtggctctgaatgacatcaagaggctgacccccaactacacgcttggagccaacggctatgtgtttgccattgacctgaacggctacgtgttgctgcaccccaatctcaagccccagaccaccaacttccgggagcctgtgactctggacttcctggatgcggagctagaggatgagaacaaggaagagatccgtcggagcatgattgatggcaacaagggccacaagcagatcagaacgttggtcaagtccctggatgagaggtacatagatgaggtgacacggaactacacctgggtgcctataaggagcactaactacagcctggggctggtgctcccaccctacagcaccttctacctccaagccaatctcagtgaccagatcctgcaggtcaagtattttgagttcctgctccccagcagctttgagtctgaaggacacgttttcattgctcccagagagtactgcaaggacctgaatgcctcagacaacaacaccgagttcctgaaaaactttattgagctcatggagaaagtgactccagactccaagcagtgtgagtgcctggcagggcagctggctctgggcagtgcccaggcagcatggggccagcccagaggaacccagaggccgggcaggtgtggaaataagcaggcacaagctaagggctgggcctgggccagggccaggtcatggaggaggctcctggtggagccttaagggtgggggtgagggtgggcaaggagctgcaagaagatgcccccacccccacccctcccctcctgttccaggcaacaacttccttctgcacaacctgatcttggacacgggcatcacgcagcagctggtagagcgtgtgtggagggaccaggatctcaacaccagtctgcctcttgggtgctccagggcagctgaggactggacagagaaccctgagcccttcaatgccagcttctaccgccgcagcctggataaccacggttatgtcttcaagcccccacaccaggatgccctgttaaggccgctggagctggagaatgacactgtgggcatcctcgtcagcacagctgtggagctcagcctaggcaggcgcacactgaggccagcagtggtgggcgtcaagctggacctagaggcttgggctgagaagttcaaggtgctagccagcaaccgtacccaccaagaccagcctcagaagtgcggccccaacagccactgtgagatggactgcgaggttaacaatgaggacttactctgtgtcctcattgatgatggaggattcctggtgctgtcaaaccagaaccatcagtgggaccaggtgggcaggttcttcagtgaggtggatgccaacctgatgctggcactctacaataactccttctacacccgcaaggagtcctatgactatcaggcagcctgtgcccctcagccccctggcaacctgggtgctgcaccccggggtgtctttgtgcccaccgttgcagatttccttaacctggcctggtggacctctgctgccgcctggtccctgttccagcagcttctctacggcctcatctaccacagctggttccaagcaggtaggtagggctttggaggcgcctcctcaagtccgggtccccaatctgagctaagacgactccatggggagggtggggtctacgactgagggaggccggagaccttgccagggtctgtgggcggagctgaggcgctctgggccctcgcagaccccgcggaggccgaggggagccccgagacgcgcgagagcagctgcgtcatgaaacagacccagtactacttcggctcggtaaacgcctcctacaacgccatcatcgactgcggaaactgctccaggctgttccacgcgcagagactgaccaacaccaatcttctctttgtggtggccgagaagccgctgtgcagccagtgcgaggctggccggctgctgcagaaggagacgcactgcccagcggacggcccggagcagtgtgagctagtgcagagaccgcgataccggagaggcccgcacatctgcttcgactacaacgcgacagaagatacctcagactgtggccgcggggcctccttcccgccgtcgctgggcgtcctggtctccctgcaactgctgctcctcctgggcctgccgccccggccgcagcctcaagtcctcgtccacgcctctcgccgcctctgagcaccctgccccaccccacctccactcccacctcacccggcctcttcgcctttcccaccctcctgccccacactccccgccttagagcctcgtccctccctcactgaaggacctgagctggccaggccctgagagtctggtctgcgccttgggatggggagtcccaaagcgggacgccgcaggtgtttggcacccaaatcacatctcacctccgaactgttcaagtgtccccagacccttcttgcctgctgggctccccccagtgggatgggacagggaggccacacgcactggtgccaaaaccaggcctctgctgccgcccttcctggaggctgcctatgttgggggggaccctgcctcagctgacccggcctctctgccccacccaagcccaaacttggtttctgtgagaatagtggaggaaggtgagatggccagtttgaagcctgtgcctcccagcttaaatcctagcaggagagaggctctggggcagcccccatgggctcctgcccctttcaggcctacagccacatccccaagcccaccaggtgtcaggatagtcacagtgataccagttcagacactaccccatatacacctggaacattgaggatggaaactggactcacattcgacataccccactgggcacacgcacaaacacacacactatggggtggggtgggtgtaggggcttacaaagccttacacagggcgaggggttggtgggagggttggcacctgcacactccatctcctgctcaccacctgcctctaatctgagctgcagcctggctggtcctcccatttctaaagctgaatgtcaaacagtgccaaatgctggggcagggggtgaagaaccctctgtcccacccctagccaccagtgtcctccaagtgccccctcacctctccaggtgctcattgtaaccatttctcactagtgtcaggcccccagtgggaccacatgccactgcctgcacctttcggcagaggaacccccaccagacatcaccctttgccttagcaggggtgactttgtctctcctggctgggccatccttccgccaatctggcccttacacactcaggcctgtgcccactccctatctccttcccacccctacacacacactccctgcttgcaggaggccaaactgtccctcccttgctgaacacacacacacacacacacacacaggtggggactgggcacagctcttcacaccattcattctggtcatttcccccaaaggcatcccagcctgggggccagtggggaactgagggcaaggggatatagtgatggggctcagatggactgggaggagggggagggtgatgcattaattaatggcttcgttaattaatgtcatgttgcttgtcgctttctcagtgtgtgtgtgtggtccatgcccactgctggtgccagggtgggtgtccatgtgcacccggcctggatgccagctgtgtccttcgggggcgtgcgtgtaactgtagtgtagtcaggtgctcaatggagaatataaacatatacagaaaaatatatattttaagtttaaaaaacagaaaaacagacaaaacaatccccatcaggtagctgtctaacccccagctgggtctaatccttctcattacccacccgacctggctgcccctcaccttgggctgggggactggggggccatttccttttctctgccctttttttgttgttctattttgtacagacaagttggaaaaacaacagcgacaaaaaagtcaagaaactttgtaaaatatcgtgtgtgtgattccttgtaaaatattttcaaatggtttattacagaagatcagttattaaataatgttcatattttcacttcaaatggttcccatccactgtatcagcttgggggtgaggactgggtagctatgaagacagttggccaagacctcagagtcccacttagtgctctgcagggggtgaagaccatggtagcccaggtccctgtcaaccacagggcatggcacttgcttccaccagttataataggtgccaggcccttgacatacattgtctcataacatctcaaaaagctgtcttttaaaaacaagcaagacaggctgggtgcg

SEQ ID NO: 365272 - DNA, 2906 bp, Homo sapiens
agtcctgagcgggaggtgggtagagaaggtgctccctggccgggagggctcagaagagaagtagggcatggcatcgtcctctgctgaccacctgcactcggctcccccgtgcgctgcaggtccctgttccagcagcttctctacggcctcatctaccacagctggttccaagcaggtaggtagggctttggaggcgcctcctcaagtccgggtccccaatctgagctaagacgactccatggggagggtggggtctacgactgagggaggccggagaccttgccagggtctgtgggcggagctgaggcgctctgggccctcgcagaccccgcggaggccgaggggagccccgagacgcgcgagagcagctgcgtcatgaaacagacccagtactacttcggctcggtaaacgcctcctacaacgccatcatcgactgcggaaactgctccaggctgttccacgcgcagagactgaccaacaccaatcttctctttgtggtggccgagaagccgctgtgcagccagtgcgaggctggccggctgctgcagaaggagacgcactgcccagcggacggcccggagcagtgtgagctagtgcagagaccgcgataccggagaggcccgcacatctgcttcgactacaacgcgacagaagatacctcagactgtggccgcggggcctccttcccgccgtcgctgggcgtcctggtctccctgcaactgctgctcctcctgggcctgccgccccggccgcagcctcaagtcctcgtccacgcctctcgccgcctctgagcaccctgccccaccccacctccactcccacctcacccggcctcttcgcctttcccaccctcctgccccacactccccgccttagagcctcgtccctccctcactgaaggacctgagctggccaggccctgagagtctggtctgcgccttgggatggggagtcccaaagcgggacgccgcaggtgtttggcacccaaatcacatctcacctccgaactgttcaagtgtccccagacccttcttgcctgctgggctccccccagtgggatgggacagggaggccacacgcactggtgccaaaaccaggcctctgctgccgcccttcctggaggctgcctatgttgggggggaccctgcctcagctgacccggcctctctgccccacccaagcccaaacttggtttctgtgagaatagtggaggaaggtgagatggccagtttgaagcctgtgcctcccagcttaaatcctagcaggagagaggctctggggcagcccccatgggctcctgcccctttcaggcctacagccacatccccaagcccaccaggtgtcaggatagtcacagtgataccagttcagacactaccccatatacacctggaacattgaggatggaaactggactcacattcgacataccccactgggcacacgcacaaacacacacactatggggtggggtgggtgtaggggcttacaaagccttacacagggcgaggggttggtgggagggttggcacctgcacactccatctcctgctcaccacctgcctctaatctgagctgcagcctggctggtcctcccatttctaaagctgaatgtcaaacagtgccaaatgctggggcagggggtgaagaaccctctgtcccacccctagccaccagtgtcctccaagtgccccctcacctctccaggtgctcattgtaaccatttctcactagtgtcaggcccccagtgggaccacatgccactgcctgcacctttcggcagaggaacccccaccagacatcaccctttgccttagcaggggtgactttgtctctcctggctgggccatccttccgccaatctggcccttacacactcaggcctgtgcccactccctatctccttcccacccctacacacacactccctgcttgcaggaggccaaactgtccctcccttgctgaacacacacacacacacacacacacaggtggggactgggcacagctcttcacaccattcattctggtcatttcccccaaaggcatcccagcctgggggccagtggggaactgagggcaaggggatatagtgatggggctcagatggactgggaggagggggagggtgatgcattaattaatggcttcgttaattaatgtcatgttgcttgtcgctttctcagtgtgtgtgtgtggtccatgcccactgctggtgccagggtgggtgtccatgtgcacccggcctggatgccagctgtgtccttcgggggcgtgcgtgtaactgtagtgtagtcaggtgctcaatggagaatataaacatatacagaaaaatatatattttaagtttaaaaaacagaaaaacagacaaaacaatccccatcaggtagctgtctaacccccagctgggtctaatccttctcattacccacccgacctggctgcccctcaccttgggctgggggactggggggccatttccttttctctgccctttttttgttgttctattttgtacagacaagttggaaaaacaacagcgacaaaaaagtcaagaaactttgtaaaatatcgtgtgtgtgattccttgtaaaatattttcaaatggtttattacagaagatcagttattaaataatgttcatattttcacttcaaatggttcccatccactgtatcagcttgggggtgaggactgggtagctatgaagacagttggccaagacctcagagtcccacttagtgctctgcagggggtgaagaccatggtagcccaggtccctgtcaaccacagggcatggcacttgcttccaccagttataataggtgccaggcccttgacatacattgtctcataacatctcaaaaagctgtcttttaaaaacaagcaagacaggctgggtgcg

SEQ ID NO: 365273 - DNA, 2949 bp, Homo sapiens
  misc_feature (2)..(3): n is a, c, g, or t
  misc_feature (5)..(6): n is a, c, g, or t
anngnngcgaagcgagtggctgcagagggctgcatcctgccgtccccagccccccacaaccgtacagccgtgcccaggtttccgcttagggaaccaggaggtccaggccctttctgccagcagccgggcgtgcaagcccccgacagagagaaatcttaaagatagctagagccacgggggctgatgcagcactgggcccggcgtctggagcaggaggtcgacggcgtgatgcggatttttggaggcgtccagcagctccgtgagatttacaaggacaaccggaacctgttcgaggtacaggagaatgagcctcagaagttggtggagaaggtggcaggggacattgagagccttctggacaggaaggtgcaggccctgaagagactggctgatgctgcagagaacttccagaaagcacaccgctggcaggacaacatcaaggaggaagacatcgtgtactatgacgccaaggctgacgctgagctggacgaccctgagagtgaggatgtggaaagggggtctaaggccagcaccctaaggctggacttcatcgaggacccaaacttcaagaacaaggtcaactattcatacgcggctgtacagatccctacggacatctacaaaggctccactgtcatcctcaatgagctcaactggacagaggccctggagaatgtgttcatggaaaaccgcagacaagaccccacactgctgtggcaggtcttcggcagcgccacaggagtcactcgctactacccggccaccccgtggcgagcccccaagaagatcgacctgtacgatgtccgaaggagaccctggtatatccagggggcctcgtcacccaaagacatggtcatcatcgtggatgtgagtggcagtgtgagcggcctgaccctgaagctgatgaagacatctgtctgcgagatgctggacacgctgtctgatgatgactatgtgaatgtggcctcgttcaacgagaaggcacagcctgtgtcatgcttcacacacctggtgcaggccaatgtgcgcaacaagaaggtgttcaaggaagctgtgcagggcatggtggccaagggcaccacaggctacaaggccggctttgagtatgcctttgaccagctgcagaactccaacatcactcgggccaactgcaacaagatgatcatgatgttcacggatggtggtgaggaccgcgtgcaggacgtctttgagaagtacaattggccaaaccggacggtgcgcgtgtttactttctccgtggggcagcataactatgacgtcacaccgctgcagtggatggcctgtgccaacaaaggctactattttgagatcccttccatcggagccatccgcatcaacacacaggaatatctagatgtgttgggcaggcccatggtgctggcaggcaaggaggccaagcaggtgcagtggaccaacgtgtatgaggatgcactgggactggggttggtggtaacagggaccctccctgttttcaacctgacacaggatggccctggggaaaagaagaaccagctgatcctgggcgtgatgggcattgacgtggctctgaatgacatcaagaggctgacccccaactacacgcttggagccaacggctatgtgtttgccattgacctgaacggctacgtgttgctgcaccccaatctcaagccccagaccaccaacttccgggagcctgtgactctggacttcctggatgcggagctagaggatgagaacaaggaagagatccgtcggagcatgattgatggcaacaagggccacaagcagatcagaacgttggtcaagtccctggatgagaggtacatagatgaggtgacacggaactacacctgggtgcctataaggagcactaactacagcctggggctggtgctcccaccctacagcaccttctacctccaagccaatctcagtgaccagatcctgcaggtcaagtattttgagttcctgctccccagcagctttgagtctgaaggacacgttttcattgctcccagagagtactgcaaggacctgaatgcctcagacaacaacaccgagttcctgaaaaactttattgagctcatggagaaagtgactccagactccaagcagtgtgagtgcctggcagggcagctggctctgggcagtgcccaggcagcatggggccagcccagaggaacccagaggccgggcaggtgtggaaataagcaggcacaagctaagggctgggcctgggccagggccaggtcatggaggaggctcctggtggagccttaagggtgggggtgagggtgggcaaggagctgcaagaagatgcccccacccccacccctcccctcctgttccaggcaacaacttccttctgcacaacctgatcttggacacgggcatcacgcagcagctggtagagcgtgtgtggagggaccaggatctcaacaccagtctgcctcttgggtgctccagggcagctgaggactggacagagaaccctgagcccttcaatgccagcttctaccgccgcagcctggataaccacggttatgtcttcaagcccccacaccaggatgccctgttaaggccgctggagctggagaatgacactgtgggcatcctcgtcagcacagctgtggagctcagcctaggcaggcgcacactgaggccagcagtggtgggcgtcaagctggacctagaggcttgggctgagaagttcaaggtgctagccagcaaccgtacccaccaagaccagcctcagaagtgcggccccaacagccactgtgagatggactgcgaggttaacaatgaggacttactctgtgtcctcattgatgatggaggattcctggtgctgtcaaaccagaaccatcagtgggaccaggtgggcagctatggtgcaagcctgccagggaccttggggaaaaggggtaggaccacctgagggtaagg

SEQ ID NO: 365274 - DNA, 812 bp, Homo sapiens
gcacgagggtccaaggctggtcccacacttatcagcagcaacaactgtcagttcatcctgcatgggaaaaatgttggaatgggagtctgaaatggggctactgtttcagtcctaacgtgctgtgtgacattgggacaacactttccctctctggacctcagtttccctctgtatacaaggatcagattcttgctgtgacccaagaactcctgaaatcatatagaaaggctggggtgggccctgtcattcgtggttgatttcaatacactcaagtgccattcatcctttaagaaaaacatctggatatcaaggtggaaatggcccatttaatgattgattatatcattttgtggatatagttataatcaatcattaaatgggccatttccttttctctgccctttttttgttgttctattttgtacagacaagttggaaaaacaacagcgacaaaaaagtcaagaaactttgtaaaatatcgtgtgtgtgattccttgtaaaatattttcaaatggtttattacagaagatcagttattaaataatgttcatattttcacttcaaatggttcccatccactgtatcagcttgggggtgaggactgggtagctatgaagacagttggccaagacctcagagtcccacttagtgctctgcagggggtgaagaccatggtagcccaggtccctgtcaaccacagggcatggcacttgcttccaccagttataataggtgccaggcccttgacatacattgtctcataacatctcaaaaagctgtcttttaaaaacaagcaagacaggctgggtgcg

SEQ ID NO: 365275 - DNA, 479 bp, Homo sapiens
  misc_feature (2)..(3): n is a, c, g, or t
  misc_feature (5)..(6): n is a, c, g, or t
anngnngcgaagcgagtggctgcagagggctgcatcctgccgtccccagccccccacaaccgtacagccgtgcccaggtttccgcttagggaaccaggaggtccaggccctttctgccagcagccgggcgtgcaagcccccgacagagagaaatcttaaagatagctagagccacgggggctgatgcagcactgggcccggcgtctggagcaggaggtcgacggcgtgatgcggatttttggaggcgtccagcagctccgtgagatttacaaggacaaccggaacctgttcgaggtacaggagaatgagcctcagaagttggtggagaaggtggcaggggacattgagagccttctggacaggaaggtgcaggccctgaaggtagagactggcggaaggcactgctgtccttctgctctgttcctttttttttttttttgggggggggggtcggggggggtttttttgttttttagggt

SEQ ID NO: 365276 - DNA, 189 bp, Homo sapiens
catctgcttcgactacaacgcgacagtgaggagagggggcggtggacccgaaatcccgcggccttgcgcccgcccaggccgaccagctccttgtctctccccgcagggaagatacctcagactgtggccgcggggcctccttcccgccgtcgctgggcgtcctggtctccctgcaactgctgctcctcc

SEQ ID NO: 365277 - DNA, 5716 bp, Homo sapiens
  misc_feature (24)..(24): n is a, c, g, or t
gccagcgctgcagggagatagcgngcagcgcagcccgcagaggcgctgcggcccgtgcagccccggaggcccctcgcggagaaggcggcggcggaggagaggccgagttaccgcccgccgcccgctgccccccctccccgcggcgccgcatcttgaatggaaacatggcggtgccggctcggacctgcggcgcctctcggcccggcccagcgcggactgcgcgcccctggcccggctgcggcccccaccctggccccggcacccggcgcccgacgtccgggcccccgcgcccgctgtggctgctgctgccgcttctaccgctgctcgccgcccccggcgcctctgcctacagcttcccccagcagcacacgatgcagcactgggcccggcgtctggagcaggaggtcgacggcgtgatgcggatttttggaggcgtccagcagctccgtgagatttacaaggacaaccggaacctgttcgaggtacaggagaatgagcctcagaagttggtggagaaggtggcaggggacattgagagccttctggacaggaaggtgcaggccctgaagagactggctgatgctgcagagaacttccagaaagcacaccgctggcaggacaacatcaaggaggaagacatcgtgtactatgacgccaaggctgacgctgagctggacgaccctgagagtgaggatgtggaaagggggtctaaggccagcaccctaaggctggacttcatcgaggacccaaacttcaagaacaaggtcaactattcatacgcggctgtacagatccctacggacatctacaaaggctccactgtcatcctcaatgagctcaactggacagaggccctggagaatgtgttcatggaaaaccgcagacaagaccccacactgctgtggcaggtcttcggcagcgccacaggagtcactcgctactacccggccaccccgtggcgagcccccaagaagatcgacctgtacgatgtccgaaggagaccctggtatatccagggggcctcgtcacccaaagacatggtcatcatcgtggatgtgagtggcagtgtgagcggcctgaccctgaagctgatgaagacatctgtctgcgagatgctggacacgctgtctgatgatgactatgtgaatgtggcctcgttcaacgagaaggcacagcctgtgtcatgcttcacacacctggtgcaggccaatgtgcgcaacaagaaggtgttcaaggaagctgtgcagggcatggtggccaagggcaccacaggctacaaggccggctttgagtatgcctttgaccagctgcagaactccaacatcactcgggccaactgcaacaagatgatcatgatgttcacggatggtggtgaggaccgcgtgcaggacgtctttgagaagtacaattggccaaaccggacggtgcgcgtgtttactttctccgtggggcagcataactatgacgtcacaccgctgcagtggatggcctgtgccaacaaaggctactattttgagatcccttccatcggagccatccgcatcaacacacaggaatatctagatgtgttgggcaggcccatggtgctggcaggcaaggaggccaagcaggtgcagtggaccaacgtgtatgaggatgcactgggactggggttggtggtaacagggaccctccctgttttcaacctgacacaggatggccctggggaaaagaagaaccagctgatcctgggcgtgatgggcattgacgtggctctgaatgacatcaagaggctgacccccaactacacgcttggagccaacggctatgtgtttgccattgacctgaacggctacgtgttgctgcaccccaatctcaagccccagaccaccaacttccgggagcctgtgactctggacttcctggatgcggagctagaggatgagaacaaggaagagatccgtcggagcatgattgatggcaacaagggccacaagcagatcagaacgttggtcaagtccctggatgagaggtacatagatgaggtgacacggaactacacctgggtgcctataaggagcactaactacagcctggggctggtgctcccaccctacagcaccttctacctccaagccaatctcagtgaccagatcctgcaggtcaagtattttgagttcctgctccccagcagctttgagtctgaaggacacgttttcattgctcccagagagtactgcaaggacctgaatgcctcagacaacaacaccgagttcctgaaaaactttattgagctcatggagaaagtgactccagactccaagcagtgcaacaacttccttctgcacaacctgatcttggacacgggcatcacgcagcagctggtagagcgtgtgtggagggaccaggatctcaacacgtacagcctactggccgtgttcgctgccacagacggtggcatcacccgagtcttccccaacaaggcagctgaggactggacagagaaccctgagcccttcaatgccagcttctaccgccgcagcctggataaccacggttatgtcttcaagcccccacaccaggatgccctgttaaggccgctggagctggagaatgacactgtgggcatcctcgtcagcacagctgtggagctcagcctaggcaggcgcacactgaggccagcagtggtgggcgtcaagctggacctagaggcttgggctgagaagttcaaggtgctagccagcaaccgtacccaccaagaccagcctcagaagtgcggccccaacagccactgtgagatggactgcgaggttaacaatgaggacttactctgtgtcctcattgatgatggaggattcctggtgctgtcaaaccagaaccatcagtgggaccaggtgggcaggttcttcagtgaggtggatgccaacctgatgctggcactctacaataactccttctacacccgcaaggagtcctatgactatcaggcagcctgtgcccctcagccccctggcaacctgggtgctgcaccccggggtgtctttgtgcccaccgttgcagatttccttaacctggcctggtggacctctgctgccgcctggtccctgttccagcagcttctctacggcctcatctaccacagctggttccaagcagaccccgcggaggccgaggggagccccgagacgcgcgagagcagctgcgtcatgaaacagacccagtactacttcggctcggtaaacgcctcctacaacgccatcatcgactgcggaaactgctccaggctgttccacgcgcagagactgaccaacaccaatcttctctttgtggtggccgagaagccgctgtgcagccagtgcgaggctggccggctgctgcagaaggagacgcactgcccagcggacggcccggagcagtgtgagctagtgcagagaccgcgataccggagaggcccgcacatctgcttcgactacaacgcgacagaagatacctcagactgtggccgcggggcctccttcccgccgtcgctgggcgtcctggtctccctgcaactgctgctcctcctgggcctgccgccccggccgcagcctcaagtcctcgtccacgcctctcgccgcctctgagcaccctgccccaccccacctccactcccacctcacccggcctcttcgcctttcccaccctcctgccccacactccccgccttagagcctcgtccctccctcactgaaggacctgagctggccaggccctgagagtctggtctgcgccttgggatggggagtcccaaagcgggacgccgcaggtgtttggcacccaaatcacatctcacctccgaactgttcaagtgtccccagacccttcttgcctgctgggctccccccagtgggatgggacagggaggccacacgcactggtgccaaaaccaggcctctgctgccgcccttcctggaggctgcctatgttgggggggaccctgcctcagctgacccggcctctctgccccacccaagcccaaacttggtttctgtgagaatagtggaggaaggtgagatggccagtttgaagcctgtgcctcccagcttaaatcctagcaggagagaggctctggggcagcccccatgggctcctgcccctttcaggcctacagccacatccccaagcccaccaggtgtcaggatagtcacagtgataccagttcagacactaccccatatacacctggaacattgaggatggaaactggactcacattcgacataccccactgggcacacgcacaaacacacacactatggggtggggtgggtgtaggggcttacaaagccttacacagggcgaggggttggtgggagggttggcacctgcacactccatctcctgctcaccacctgcctctaatctgagctgcagcctggctggtcctcccatttctaaagctgaatgtcaaacagtgccaaatgctggggcagggggtgaagaaccctctgtcccacccctagccaccagtgtcctccaagtgccccctcacctctccaggtgctcattgtaaccatttctcactagtgtcaggcccccagtgggaccacatgccactgcctgcacctttcggcagaggaacccccaccagacatcaccctttgccttagcaggggtgactttgtctctcctggctgggccatccttccgccaatctggcccttacacactcaggcctgtgcccactccctatctccttcccacccctacacacacactccctgcttgcaggaggccaaactgtccctcccttgctgaacacacacacacacacacacacacaggtggggactgggcacagctcttcacaccattcattctggtcatttcccccaaaggcatcccagcctgggggccagtggggaactgagggcaaggggatatagtgatggggctcagatggactgggaggagggggagggtgatgcattaattaatggcttcgttaattaatgtcatgttgcttgtcgctttctcagtgtgtgtgtgtggtccatgcccactgctggtgccagggtgggtgtccatgtgcacccggcctggatgccagctgtgtccttcgggggcgtgcgtgtaactgtagtgtagtcaggtgctcaatggagaatataaacatatacagaaaaatatatattttaagtttaaaaaacagaaaaacagacaaaacaatccccatcaggtagctgtctaacccccagctgggtctaatccttctcattacccacccgacctggctgcccctcaccttgggctgggggactggggggccatttccttttctctgccctttttttgttgttctattttgtacagacaagttggaaaaacaacagcgacaaaaaagtcaagaaactttgtaaaatatcgtgtgtgtgattccttgtaaaatattttcaaatggtttattacagaagatcagttattaaataatgttcatattttcacttcaaatggttcccatccactgtatcagcttgggggtgaggactgggtagctatgaagacagttggccaagacctcagagtcccacttagtgctctgcagggggtgaagaccatggtagcccaggtccctgtcaaccacagggcatggcacttgcttccaccagttataataggtgccaggcccttgacatacattgtctcataacatctcaaaaagctgtcttttaaaaacaagcaagacaggctgggtgcg

SEQ ID NO: 365278 - DNA, 5774 bp, Homo sapiens
  misc_feature (24)..(24): n is a, c, g, or t
  misc_feature (2189)..(2189): n is a, c, g, or t
gccagcgctgcagggagatagcgngcagcgcagcccgcagaggcgctgcggcccgtgcagccccggaggcccctcgcggagaaggcggcggcggaggagaggccgagttaccgcccgccgcccgcgcccccccaaccccgccgccgccgccgccgccgccactgccccccctccccgcggcgccgcatcttgaatggaaacatggcggtgccggctcggacctgcggcgcctctcggcccggcccagcgcggactgcgcgcccctggcccggctgcggcccccaccctggccccggcacccggcgcccgacgtccgggcccccgcgcccgctgtggctgctgctgccgcttctaccgctgctcgccgcccccggcgcctctgcctacagcttcccccagcagcacacgatgcagcactgggcccggcgtctggagcaggaggtcgacggcgtgatgcggatttttggaggcgtccagcagctccgtgagatttacaaggacaaccggaacctgttcgaggtacaggagaatgagcctcagaagttggtggagaaggtggcaggggacattgagagccttctggacaggaaggtgcaggccctgaagagactggctgatgctgcagagaacttccagaaagcacaccgctggcaggacaacatcaaggaggaagacatcgtgtactatgacgccaaggctgacgctgagctggacgaccctgagagtgaggatgtggaaagggggtctaaggccagcaccctaaggctggacttcatcgaggacccaaacttcaagaacaaggtcaactattcatacgcggctgtacagatccctacggacatctacaaaggctccactgtcatcctcaatgagctcaactggacagaggccctggagaatgtgttcatggaaaaccgcagacaagaccccacactgctgtggcaggtcttcggcagcgccacaggagtcactcgctactacccggccaccccgtggcgagcccccaagaagatcgacctgtacgatgtccgaaggagaccctggtatatccagggggcctcgtcacccaaagacatggtcatcatcgtggatgtgagtggcagtgtgagcggcctgaccctgaagctgatgaagacatctgtctgcgagatgctggacacgctgtctgatgatgactatgtgaatgtggcctcgttcaacgagaaggcacagcctgtgtcatgcttcacacacctggtgcaggccaatgtgcgcaacaagaaggtgttcaaggaagctgtgcagggcatggtggccaagggcaccacaggctacaaggccggctttgagtatgcctttgaccagctgcagaactccaacatcactcgggccaactgcaacaagatgatcatgatgttcacggatggtggtgaggaccgcgtgcaggacgtctttgagaagtacaattggccaaaccggacggtgcgcgtgtttactttctccgtggggcagcataactatgacgtcacaccgctgcagtggatggcctgtgccaacaaaggctactattttgagatcccttccatcggagccatccgcatcaacacacaggaatatctagatgtgttgggcaggcccatggtgctggcaggcaaggaggccaagcaggtgcagtggaccaacgtgtatgaggatgcactgggactggggttggtggtaacagggaccctccctgttttcaacctgacacaggatggccctggggaaaagaagaaccagctgatcctgggcgtgatgggcattgacgtggctctgaatgacatcaagaggctgacccccaactacacgcttggagccaacggctatgtgtttgccattgacctgaacggctacgtgttgctgcaccccaatctcaagccccagaccaccaacttccgggagcctgtgactctggacttcctggatgcggagctagaggatgagaacaaggaagagatccgtcggagcatgattgatggcaacaagggccacaagcagatcagaacgttggtcaagtccctggatgagaggtacatagatgaggtgacacggaactacacctgggtgcctataaggagcactaactacagcctggggctggtgctcccaccctacagcaccttctacctccaagccaatctcagtgaccagatcctgcaggtcaagttgcnaatcagcaaactgaaggattttgagttcctgctccccagcagctttgagtctgaaggacacgttttcattgctcccagagagtactgcaaggacctgaatgcctcagacaacaacaccgagttcctgaaaaactttattgagctcatggagaaagtgactccagactccaagcagtgcaacaacttccttctgcacaacctgatcttggacacgggcatcacgcagcagctggtagagcgtgtgtggagggaccaggatctcaacacgtacagcctactggccgtgttcgctgccacagacggtggcatcacccgagtcttccccaacaaggcagctgaggactggacagagaaccctgagcccttcaatgccagcttctaccgccgcagcctggataaccacggttatgtcttcaagcccccacaccaggatgccctgttaaggccgctggagctggagaatgacactgtgggcatcctcgtcagcacagctgtggagctcagcctaggcaggcgcacactgaggccagcagtggtgggcgtcaagctggacctagaggcttgggctgagaagttcaaggtgctagccagcaaccgtacccaccaagaccagcctcagaagtgcggccccaacagccactgtgagatggactgcgaggttaacaatgaggacttactctgtgtcctcattgatgatggaggattcctggtgctgtcaaaccagaaccatcagtgggaccaggtgggcaggttcttcagtgaggtggatgccaacctgatgctggcactctacaataactccttctacacccgcaaggagtcctatgactatcaggcagcctgtgcccctcagccccctggcaacctgggtgctgcaccccggggtgtctttgtgcccaccgttgcagatttccttaacctggcctggtggacctctgctgccgcctggtccctgttccagcagcttctctacggcctcatctaccacagctggttccaagcagaccccgcggaggccgaggggagccccgagacgcgcgagagcagctgcgtcatgaaacagacccagtactacttcggctcggtaaacgcctcctacaacgccatcatcgactgcggaaactgctccaggctgttccacgcgcagagactgaccaacaccaatcttctctttgtggtggccgagaagccgctgtgcagccagtgcgaggctggccggctgctgcagaaggagacgcactgcccagcggacggcccggagcagtgtgagctagtgcagagaccgcgataccggagaggcccgcacatctgcttcgactacaacgcgacagaagatacctcagactgtggccgcggggcctccttcccgccgtcgctgggcgtcctggtctccctgcaactgctgctcctcctgggcctgccgccccggccgcagcctcaagtcctcgtccacgcctctcgccgcctctgagcaccctgccccaccccacctccactcccacctcacccggcctcttcgcctttcccaccctcctgccccacactccccgccttagagcctcgtccctccctcactgaaggacctgagctggccaggccctgagagtctggtctgcgccttgggatggggagtcccaaagcgggacgccgcaggtgtttggcacccaaatcacatctcacctccgaactgttcaagtgtccccagacccttcttgcctgctgggctccccccagtgggatgggacagggaggccacacgcactggtgccaaaaccaggcctctgctgccgcccttcctggaggctgcctatgttgggggggaccctgcctcagctgacccggcctctctgccccacccaagcccaaacttggtttctgtgagaatagtggaggaaggtgagatggccagtttgaagcctgtgcctcccagcttaaatcctagcaggagagaggctctggggcagcccccatgggctcctgcccctttcaggcctacagccacatccccaagcccaccaggtgtcaggatagtcacagtgataccagttcagacactaccccatatacacctggaacattgaggatggaaactggactcacattcgacataccccactgggcacacgcacaaacacacacactatggggtggggtgggtgtaggggcttacaaagccttacacagggcgaggggttggtgggagggttggcacctgcacactccatctcctgctcaccacctgcctctaatctgagctgcagcctggctggtcctcccatttctaaagctgaatgtcaaacagtgccaaatgctggggcagggggtgaagaaccctctgtcccacccctagccaccagtgtcctccaagtgccccctcacctctccaggtgctcattgtaaccatttctcactagtgtcaggcccccagtgggaccacatgccactgcctgcacctttcggcagaggaacccccaccagacatcaccctttgccttagcaggggtgactttgtctctcctggctgggccatccttccgccaatctggcccttacacactcaggcctgtgcccactccctatctccttcccacccctacacacacactccctgcttgcaggaggccaaactgtccctcccttgctgaacacacacacacacacacacacacaggtggggactgggcacagctcttcacaccattcattctggtcatttcccccaaaggcatcccagcctgggggccagtggggaactgagggcaaggggatatagtgatggggctcagatggactgggaggagggggagggtgatgcattaattaatggcttcgttaattaatgtcatgttgcttgtcgctttctcagtgtgtgtgtgtggtccatgcccactgctggtgccagggtgggtgtccatgtgcacccggcctggatgccagctgtgtccttcgggggcgtgcgtgtaactgtagtgtagtcaggtgctcaatggagaatataaacatatacagaaaaatatatattttaagtttaaaaaacagaaaaacagacaaaacaatccccatcaggtagctgtctaacccccagctgggtctaatccttctcattacccacccgacctggctgcccctcaccttgggctgggggactggggggccatttccttttctctgccctttttttgttgttctattttgtacagacaagttggaaaaacaacagcgacaaaaaagtcaagaaactttgtaaaatatcgtgtgtgtgattccttgtaaaatattttcaaatggtttattacagaagatcagttattaaataatgttcatattttcacttcaaatggttcccatccactgtatcagcttgggggtgaggactgggtagctatgaagacagttggccaagacctcagagtcccacttagtgctctgcagggggtgaagaccatggtagcccaggtccctgtcaaccacagggcatggcacttgcttccaccagttataataggtgccaggcccttgacatacattgtctcataacatctcaaaaagctgtcttttaaaaacaagcaagacaggctgggtgcg

SEQ ID NO: 365279 - DNA, 2405 bp, Homo sapiens
gatgggggtgggtcagggcggggcaaactcaacgccccgcctttccgggctgcccgcaggctgttccacgcgcagagactgaccaacaccaatcttctctttgtggtggccgagaagccgctgtgcagccagtgcgaggctggccggctggaagatacctcagactgtggccgcggggcctccttcccgccgtcgctgggcgtcctggtctccctgcaactgctgctcctcctgggcctgccgccccggccgcagcctcaagtcctcgtccacgcctctcgccgcctctgagcaccctgccccaccccacctccactcccacctcacccggcctcttcgcctttcccaccctcctgccccacactccccgccttagagcctcgtccctccctcactgaaggacctgagctggccaggccctgagagtctggtctgcgccttgggatggggagtcccaaagcgggacgccgcaggtgtttggcacccaaatcacatctcacctccgaactgttcaagtgtccccagacccttcttgcctgctgggctccccccagtgggatgggacagggaggccacacgcactggtgccaaaaccaggcctctgctgccgcccttcctggaggctgcctatgttgggggggaccctgcctcagctgacccggcctctctgccccacccaagcccaaacttggtttctgtgagaatagtggaggaaggtgagatggccagtttgaagcctgtgcctcccagcttaaatcctagcaggagagaggctctggggcagcccccatgggctcctgcccctttcaggcctacagccacatccccaagcccaccaggtgtcaggatagtcacagtgataccagttcagacactaccccatatacacctggaacattgaggatggaaactggactcacattcgacataccccactgggcacacgcacaaacacacacactatggggtggggtgggtgtaggggcttacaaagccttacacagggcgaggggttggtgggagggttggcacctgcacactccatctcctgctcaccacctgcctctaatctgagctgcagcctggctggtcctcccatttctaaagctgaatgtcaaacagtgccaaatgctggggcagggggtgaagaaccctctgtcccacccctagccaccagtgtcctccaagtgccccctcacctctccaggtgctcattgtaaccatttctcactagtgtcaggcccccagtgggaccacatgccactgcctgcacctttcggcagaggaacccccaccagacatcaccctttgccttagcaggggtgactttgtctctcctggctgggccatccttccgccaatctggcccttacacactcaggcctgtgcccactccctatctccttcccacccctacacacacactccctgcttgcaggaggccaaactgtccctcccttgctgaacacacacacacacacacacacacaggtggggactgggcacagctcttcacaccattcattctggtcatttcccccaaaggcatcccagcctgggggccagtggggaactgagggcaaggggatatagtgatggggctcagatggactgggaggagggggagggtgatgcattaattaatggcttcgttaattaatgtcatgttgcttgtcgctttctcagtgtgtgtgtgtggtccatgcccactgctggtgccagggtgggtgtccatgtgcacccggcctggatgccagctgtgtccttcgggggcgtgcgtgtaactgtagtgtagtcaggtgctcaatggagaatataaacatatacagaaaaatatatattttaagtttaaaaaacagaaaaacagacaaaacaatccccatcaggtagctgtctaacccccagctgggtctaatccttctcattacccacccgacctggctgcccctcaccttgggctgggggactggggggccatttccttttctctgccctttttttgttgttctattttgtacagacaagttggaaaaacaacagcgacaaaaaagtcaagaaactttgtaaaatatcgtgtgtgtgattccttgtaaaatattttcaaatggtttattacagaagatcagttattaaataatgttcatattttcacttcaaatggttcccatccactgtatcagcttgggggtgaggactgggtagctatgaagacagttggccaagacctcagagtcccacttagtgctctgcagggggtgaagaccatggtagcccaggtccctgtcaaccacagggcatggcacttgcttccaccagttataataggtgccaggcccttgacatacattgtctcataacatctcaaaaagctgtcttttaaaaacaagcaagacaggctgggtgcg

SEQ ID NO: 365280 - DNA, 2561 bp, Homo sapiens
  misc_feature (2)..(3): n is a, c, g, or t
  misc_feature (5)..(6): n is a, c, g, or t
anngnngcgaagcgagtggctgcagagggctgcatcctgccgtccccagccccccacaaccgtacagccgtgcccaggtttccgcttagggaaccaggaggtccaggccctttctgccagcagccgggcgtgcaagcccccgacagagagaaatcttaaagatagctagagccacgggggctgatgcagcactgggcccggcgtctggagcaggaggtcgacggcgtgatgcggatttttggaggcgtccagcagctccgtgagatttacaaggacaaccggaacctgttcgaggtacaggagaatgagcctcagaagttggtggagaaggtggcaggggacattgagagccttctggacaggaaggtgcaggccctgaagagactggctgatgctgcagagaacttccagaaagcacaccgctggcaggacaacatcaaggaggaagacatcgtgtactatgacgccaaggctgacgctgagctggacgaccctgagagtgaggatgtggaaagggggtctaaggccagcaccctaaggctggacttcatcgaggacccaaacttcaagaacaaggtcaactattcatacgcggctgtacagatccctacggacatctacaaaggctccactgtcatcctcaatgagctcaactggacagaggccctggagaatgtgttcatggaaaaccgcagacaagaccccacactgctgtggcaggtcttcggcagcgccacaggagtcactcgctactacccggccaccccgtggcgagcccccaagaagatcgacctgtacgatgtccgaaggagaccctggtatatccagggggcctcgtcacccaaagacatggtcatcatcgtggatgtgagtggcagtgtgagcggcctgaccctgaagctgatgaagacatctgtctgcgagatgctggacacgctgtctgatgatgactatgtgaatgtggcctcgttcaacgagaaggcacagcctgtgtcatgcttcacacacctggtgcaggccaatgtgcgcaacaagaaggtgttcaaggaagctgtgcagggcatggtggccaagggcaccacaggctacaaggccggctttgagtatgcctttgaccagctgcagaactccaacatcactcgggccaactgcaacaagatgatcatgatgttcacggatggtggtgaggaccgcgtgcaggacgtctttgagaagtacaattggccaaaccggacggtgcgcgtgtttactttctccgtggggcagcataactatgacgtcacaccgctgcagtggatggcctgtgccaacaaaggctactattttgagatcccttccatcggagccatccgcatcaacacacaggaatatctagatgtgttgggcaggcccatggtgctggcaggcaaggaggccaagcaggtgcagtggaccaacgtgtatgaggatgcactgggactggggttggtggtaacagggaccctccctgttttcaacctgacacaggatggccctggggaaaagaagaaccagctgatcctgggcgtgatgggcattgacgtggctctgaatgacatcaagaggctgacccccaactacacgcttggagccaacggctatgtgtttgccattgacctgaacggctacgtgttgctgcaccccaatctcaagccccagaccaccaacttccgggagcctgtgactctggacttcctggatgcggagctagaggatgagaacaaggaagagatccgtcggagcatgattgatggcaacaagggccacaagcagatcagaacgttggtcaagtccctggatgagaggtacatagatgaggtgacacggaactacacctgggtgcctataaggagcactaactacagcctggggctggtgctcccaccctacagcaccttctacctccaagccaatctcagtgaccagatcctgcaggtcaagtattttgagttcctgctccccagcagctttgagtctgaaggacacgttttcattgctcccagagagtactgcaaggacctgaatgcctcagacaacaacaccgagttcctgaaaaactttattgagctcatggagaaagtgactccagactccaagcagtgtgagtgcctggcagggcagctggctctgggcagtgcccaggcagcatggggccagcccagaggaacccagaggccgggcaggtgtggaaataagcaggcacaagctaagggctgggcctgggccagggccaggtcatggaggaggctcctggtggagccttaagggtgggggtgagggtgggcaaggagctgcaagaagatgcccccacccccacccctcccctcctgttccaggcaacaacttccttctgcacaacctgatcttggacacgggcatcacgcagcagctggtagagcgtgtgtggagggaccaggatctcaacacgacttactctgtgtcctcattgatgatggaggattcctggtgctgtcaaaccagaaccatcagtgggaccaggtgaggatcaggaagagagtgaaagaagagagtagggatttgag

SEQ ID NO: 365281 - DNA, 831 bp, Homo sapiens
ttcgttccgctcaagttcctccgccgcgacctcaggacaggccgaagaggcgcgcactactcacgtgtcttccaagtgctgctccaaggtcgcctccatcccacccaccgaccactccggctcagaacccagcggcacggcacgtccttctccaccacaggcctcagtcacttgacgcgagcggggcgtggaccgtaacggcgcctccaaagggacaaaattgatcacggtgcaacgtccgcgttctttactggaaaacatcactgcgcttccgtcgcacagagcctgacgaaggcttgggctccccgcgcggtgaccgtcgaggtgacctgcacctggctccatggcggaaccggccggcacggattattcccctctcgggagaggtctgcagccgggcctcagtgcttcagttcgtggcctggcattttgtgaagagtgtcttcatctctgcatccctagtgcaacagagcatgacaaaaattcaacaaatatttattgaagagtcttgatgtcttttgggaaaggaactctatggttacctttactctaagattagatgggtgttactgattcttacctcagagaagagaatgtcatggagacaaaatgacctgcttagagttctgcaccccccagcatggagagcagagcgcaaagatttcttccggactcccacattccccttggaatccaagaactggtctactgtcacaacactttagtaccctcttgtaagcctgtggacaaatcctctgatgccttgatacctcggttttcccccactataaatgggaagataaattcactagaaacagtaaaaccttgcag

SEQ ID NO: 365282 - DNA, 905 bp, Homo sapiens
ttcgttccgctcaagttcctccgccgcgacctcaggacaggccgaagaggcgcgcactactcacgtgtcttccaagtgctgctccaaggtcgcctccatcccacccaccgaccactccggctcagaacccagcggcacggcacgtccttctccaccacaggcctcagtcacttgacgcgagcggggcgtggaccgtaacggcgcctccaaagggacaaaattgatcacggtgcaacgtccgcgttctttactggaaaacatcactgcgcttccgtcgcacagagcctgacgaaggcttgggctccccgcgcggtgaccgtcgaggtgacctgcacctggctccatggcggaaccggccggcacggattattcccctctcgggagaggtctgcagccgggcctcagtgcttcagttcgtggcctggcattttgtagatggagtctcagtgtgtagcccagtctcaagtgaccctccctcgttggcttcccaaagcgctgagattgcaggaagagtgtcttcatctctgcatccctagtgcaacagagcatgacaaaaattcaacaaatatttattgaagagtcttgatgtcttttgggaaaggaactctatggttacctttactctaagattagatgggtgttactgattcttacctcagagaagagaatgtcatggagacaaaatgacctgcttagagttctgcaccccccagcatggagagcagagcgcaaagatttcttccggactcccacattccccttggaatccaagaactggtctactgtcacaacactttagtaccctcttgtaagcctgtggacaaatcctctgatgccttgatacctcggttttcccccactataaatgggaagataaattcactagaaacagtaaaaccttgcag

SEQ ID NO: 365283 - DNA, 911 bp, Homo sapiens
ttcgttccgctcaagttcctccgccgcgacctcaggacaggccgaagaggcgcgcactactcacgtgtcttccaagtgctgctccaaggtcgcctccatcccacccaccgaccactccggctcagaacccagcggcacggcacgtccttctccaccacaggcctcagtcacttgacgcgagcggggcgtggaccgtaacggcgcctccaaagggacaaaattgatcacggtgcaacgtccgcgttctttactggaaaacatcactgcgcttccgtcgcacagagcctgacgaaggcttgggctccccgcgcggtgaccgtcgaggtgacctgcacctggctccatggcggaaccggccggcacggattattcccctctcgggagaggtctgcagccgggcctcagtgcttcagttcgtggcctggcattttgtgaagagtgtcttcatctctgcatccctagtgcaacagagcatgacaaaaattcaacaaatatttattgaagagtcttgatgtcttttgggaaaggaactctatggttacctttactctaagttaaaaacaacaacaacaacaacaacaacacaaaaccctgaggctcagaagataaatatttgctgaagatcactgtgcttattagatgggtgttactgattcttacctcagagaagagaatgtcatggagacaaaatgacctgcttagagttctgcaccccccagcatggagagcagagcgcaaagatttcttccggactcccacattccccttggaatccaagaactggtctactgtcacaacactttagtaccctcttgtaagcctgtggacaaatcctctgatgccttgatacctcggttttcccccactataaatgggaagataaattcactagaaacagtaaaaccttgcag

SEQ ID NO: 365284 - DNA, 1176 bp, Homo sapiens
ttcgttccgctcaagttcctccgccgcgacctcaggacaggccgaagaggcgcgcactactcacgtgtcttccaagtgctgctccaaggtcgcctccatcccacccaccgaccactccggctcagaacccagcggcacggcacgtccttctccaccacaggcctcagtcacttgacgcgagcggggcgtggaccgtaacggcgcctccaaagggacaaaattgatcacggtgcaacgtccgcgttctttactggaaaacatcactgcgcttccgtcgcacagagcctgacgaaggcttgggctccccgcgcggtgaccgtcgaggtgacctgcacctggctccatggcggaaccggccggcacggattattcccctctcgggagaggtctgcagccgggcctcagtgcttcagttcgtggcctggcattttgtgaagagtgtcttcatctctgcatccctagtgcaacagagcatgacaaaaattcaacaaatatttattgaagagtcttgatgtcttttgggaaaggaactctatggttacctttactctaagattagatgggtgttactgattcttacctcagagaagagaatgtcatggagacaaaatgacctgcttagagttctgcaccccccagcatggagagcagagcgcaaagatttcttccggactcccacattccccttggaatccaagaactggtctactgtcacaacactttagtaccctcttctcccaaggaggcagcagaaactggggtaatcacaacggtcaacagcagcaaaggcagcactttctgatttacttgactgctatggatgccacctctctccacgcctcagtttaatatctgtaagacctgaaagcctctgaagttcactccttcggccccactcccttcctgctgcctttgggctctcctcatgtgactctgcctgttgaaactgtctgctagctggcccagcatctccaggcatggcctcactcatccacctctcccttgctgaaggtctcctcatgtaacacacgatttcctttagatggtccttcatcaccagcaagatgaaacctaaattcattggcatggtagacaaaactctagccttgcctcccagaggccagtctctgtctccgccactccccaggtggactgcattgtgtttctgctgccata

SEQ ID NO: 365285 - DNA, 1200 bp, Homo sapiens
ttcgttccgctcaagttcctccgccgcgacctcaggacaggccgaagaggcgcgcactactcacgtgtcttccaagtgctgctccaaggtcgcctccatcccacccaccgaccactccggctcagaacccagcggcacggcacgtccttctccaccacaggcctcagtcacttgacgcgagcggggcgtggaccgtaacggcgcctccaaagggacaaaattgatcacggtgcaacgtccgcgttctttactggaaaacatcactgcgcttccgtcgcacagagcctgacgaaggcttgggctccccgcgcggtgaccgtcgaggtgacctgcacctggctccatggcggaaccggccggcacggattattcccctctcgggagaggtctgcagccgggcctcagtgcttcagttcgtggcctggcattttgtgaagagtgtcttcatctctgcatccctagtgcaacagagcatgacaaaaattcaacaaatatttattgaagagtcttgatgtcttttgggaaaggaactctatggttacctttactctaagattagatgggtgttactgattcttacctcagagaagagaatgtcatggagacaaaatgacctgcttagagttctgcaccccccagcatggagagcagagcgcaaagatttcttccggactcccacattccccttggaatccaagaactggtctactgtcacaacactttagtaccctcttctcccaaggaggcagcagaaactggggtaatcacaacggtcaacagcagcaaaggcagcactttctgatttacttgactgctatggatgccacctctctccacgcctcagtttaatatctgtaaggcagtactgctgtcagtgaatcagctttatctgtgcagtgggcaagaaggacccactgggtgactacaatatggcactttggtatgttggttattttaagttagaggcctttgatgctggaagaagctttactctgatatctccttatctaccacaagactggatctgccaaagagaacacaattgcgttccattcccttcctgaaatctcattatctatggcagaaaagaagactggggaatgtaatacacagtattacacagtaatgtaacatactacacagtatttacacaaaacatgtaacacagaatgtactacacagtattttcacaaaacaaaa

SEQ ID NO: 365286 - DNA, 663 bp, Homo sapiens
agcctgacgaaggcttgggctccccgcgcggtgaccgtcgaggtgacctgcacctggctccatggcggaaccggccggcacggattattcccctctcgggagaggtctgcagccgggcctcagtgcttcagttcgtggcctggcattttgtgtcagtgttttttaacctttggaccctagttcaaccgactccgagacctaggggacagatcttaagttttacaataacccaggggtcagacagggtctgatctagcctgtggggcaagtacggggaagacacgggacctcttggagggggtcagtaggcttgtagggggaaagacgcacacagagactaaaggacgagatggagcaaggttcaaccccctagctgagtgttggcagtgtcgggattttaacgaagacattggtgcttattatggtgaggggactcaggacagtttaggggaagagagtggcatttgagtcctaactcgtaaggaagactgggtaggactacttgaaaataacttttaaaaattaattataaagctggtaaaaataggaaaacatctatggccccactgtccaaagacgacttttaacttcttggagaatatcctttcagatagttgtctttgtaaatgtatacttttaatgttttttcgtttgcctttttaa

SEQ ID NO: 365287 - DNA, 448 bp, Homo sapiens
gcataagctacagcacccagcccttacgtttacttttcattgacaggaagagtgtcttcatctctgcatccctagtgcaacagagcatgacaaaaattcaacaaatatttattgaagagtcttgatgtcttttgggaaaggaactctatggttacctttactctaaggtaaagaaatttaggtcctgaactttaaccaccttctcctcttctttcttccctctttcataaatgagctcttggaaaattaaaatgccaggagggtccagcagagaatacccaagcccacatgtcctgatgggaagtgggggataagtagagagggaaacacagaccctgtaggccatctcactgctgctggcccaggggaccctaactccttttgttgactcatcagaagtagaatcctcctgagggtctgtttaagaagcacagctctggtagaaagg

SEQ ID NO: 365288 - DNA, 985 bp, Homo sapiens
ttcgttccgctcaagttcctccgccgcgacctcaggacaggccgaagaggcgcgcactactcacgtgtcttccaagtgctgctccaaggtcgcctccatcccacccaccgaccactccggctcagaacccagcggcacggcacgtccttctccaccacaggcctcagtcacttgacgcgagcggggcgtggaccgtaacggcgcctccaaagggacaaaattgatcacggtgcaacgtccgcgttctttactggaaaacatcactgcgcttccgtcgcacagagcctgacgaaggcttgggctccccgcgcggtgaccgtcgaggtgacctgcacctggctccatggcggaaccggccggcacggattattcccctctcgggagaggtctgcagccgggcctcagtgcttcagttcgtggcctggcattttgtagatggagtctcagtgtgtagcccagtctcaagtgaccctccctcgttggcttcccaaagcgctgagattgcaggaagagtgtcttcatctctgcatccctagtgcaacagagcatgacaaaaattcaacaaatatttattgaagagtcttgatgtcttttgggaaaggaactctatggttacctttactctaagttaaaaacaacaacaacaacaacaacaacacaaaaccctgaggctcagaagataaatatttgctgaagatcactgtgcttattagatgggtgttactgattcttacctcagagaagagaatgtcatggagacaaaatgacctgcttagagttctgcaccccccagcatggagagcagagcgcaaagatttcttccggactcccacattccccttggaatccaagaactggtctactgtcacaacactttagtaccctcttgtaagcctgtggacaaatcctctgatgccttgatacctcggttttcccccactataaatgggaagataaattcactagaaacagtaaaaccttgcag

SEQ ID NO: 365289 - DNA, 846 bp, Homo sapiens
ttcgttccgctcaagttcctccgccgcgacctcaggacaggccgaagaggcgcgcactactcacgtgtcttccaagtgctgctccaaggtcgcctccatcccacccaccgaccactccggctcagaacccagcggcacggcacgtccttctccaccacaggcctcagtcacttgacgcgagcggggcgtggaccgtaacggcgcctccaaagggacaaaattgatcacggtgcaacgtccgcgttctttactggaaaacatcactgcgcttccgtcgcacagagcctgacgaaggcttgggctccccgcgcggtgaccgtcgaggtgacctgcacctggctccatggcggaaccggccggcacggattattcccctctcgggagaggtctgcagccgggcctcagtgcttcagttcgtggcctggcattttgtgaagagtgtcttcatctctgcatccctagtgcaacagagcatgacaaaaattcaacaaatatttattgaagagtcttgatgtcttttgggaaaggaactctatggttacctttactctaaggcattgtgaagaccctgtttctctagctgtgcagctgcaaggtcactaggcagataaactcaagccataaaacatgtttttccttgaaaagtaagaaataatgtaatgcatgtgtcaaatgaataactatttctcgcttctgtaatatgcttcccttcgcacagatctccccctgccccatgaaatgctttaaaggtaacttaactctttgttcggggctcagtcctttggatgttaatctgactggcttggtgcacctaaataataaataacatatatcctcctcaacccc

SEQ ID NO: 365290 - DNA, 1149 bp, Homo sapiens
ttctattgattgaaataatattcctaactcatttctgcttttatccaccctggttctaactgataattcctggaccactggagcatttaaattgctctttgcacttctagtttttgttcataatagtgtagcctccatgccactcctagatcacttactaaaaaaaataccagttggattatgttactttgttgctgaaaaatctagaattaaggaatgatattgaaatactaacattagacttctgtggtgaacctttttgtgtcattcatcaaagtgtttttgcaagtctggatttttataccctgctttttcttaaagcaagagaaacttttttctgtggtcactgacatatacagattttcataaaacttgagttactcttaagcaatttttagatagagttggacctgttaggaaaagagtcttgatgtcatctttatcatcttataagtgagcaccttccctgagactctttaacttcttgaaaaaagttgatgctgttttatttgaaaaatcgtcaagactattaaaaggcaaataggggaaactgttaagaaattgaaatacagttgcaaaaacatactgataacagtgacttttagttctgtatcatttgagttcttgtgccttttttctgtgcacattgtacttctatttttgtccagtaaaactttaagaaaacccagaagttgctacaaatgataaagataaggttttgtttctctcaaaaaggttgttatatgctgctgttccaggacatatcaggatgacaactatgtataatatttaaagccacatctttagtaggttcacagatactttatatactataaaaagtatgactgtgtatatattcctaatgcttatgtaagatgttcgtttagagatataaaataatatctagtatgatagaaaacagtttagattaaacatgaaatacagtttacttgtaattcactttgttctttatttttttaagggaccagttactctccacaagaaaattcacacaaccacagtgctcttcatagttcaaattcacattcttctaatccaagcaataacccaagcaaaacttcagatgcaagtaagtattataaacatgtccaatatggtttctttggaattttttgcaaaaaaaaaaaa

SEQ ID NO: 365291 - DNA, 855 bp, Homo sapiens
  misc_feature (16)..(16): n is a, c, g, or t
  misc_feature (29)..(30): n is a, c, g, or t
aacgttaggctaggtncgaggctgggtgnnggtatgtatgcgaggaaacagcagagactcagtgatggctgtcacgaccggaggggggactcgcagccttaccaggcacttaagtattcatcgaagagtcaccccagtagcggtgatcacagacatgaaaagatgcgagacgccggagatccttcaccaccaaataaaatgttgcggagatctgatagtcctgaaaacaaatacagtgacagcacaggtcacagtaaggccaaaaatgtgcatactcacagagttagagagagggatggtgggaccagttactctccacaagaaaattcacacaaccacagtgctcttcatagttcaaattcacattcttctaatccaagcaataacccaagcaaaacttcagatgcaccttatgattctgcagatgactggtctgagcatattagctcttctgggaaaaagtactactacaattgtcgaacagaagtttcacaatgggaaaaaccaaaagagtggcttgaaagagaacagagacaaaaagaagcaaacaagatggcagtcaacagcttcccaaaagatagggattacagaagagaggtgatgcaagcaacagccactagtgggtttgccagtggaaaatctacatcaggagacaaacccgtatcacattcttgcacaactccttccacgtcttctgcctctggactgaaccccacatctgcacctccaacatctgcttcagcggtccctgtttctcctgttccacagttaccccctttttttggcccttttttacctggcccgtttgggcccgggtaaattacagggtttaacagtccagcgcgggaaccccgg

SEQ ID NO: 365292 - DNA, 741 bp, Homo sapiens
agtactgaatagcctctagggaacttgagtggcctttccctccccctgcccccccccccccccccccgttttaaaagatcagtagtctctattcaaacttttaaaatgtcgtggtattgtaacaatatatttgatgaaagaaggttacagactcccctgaagaaccagctttcctacgctttttatttttctaacttgtctaacctgattttaaaatgactgcaattccagactaaaaacatgcttcagccctgtttcaagacattatgcttcttttaacagtccaaattagtagttttatttttcttctaaatctttgtttcacacttgtaaaatcttgggaaggaggttcttaaaactttgccaggaattgttacccatttccaaaaacagtttattatgttcaaaaaccaccatatctttgagggactgtttgaaaggggagagggcaacgcgggaaataattcactctgcgcaccggaactattgtagttcaggacttccagctactgtatttagatgttgggtttgaatatacagatttcttttcaatacctgtaaatatggctatattcttgtatttgtacgggagtgtacaaaatgacactgaaaagtaataaatatgttttgactatattgtgcagttatttcagaactgtgttttgaaagtcttagaatgcataatttgcatttgagtaaggaaatttaaaatacagattactgctgagattttaatcagtc

SEQ ID NO: 365293 - DNA, 1564 bp, Homo sapiens
acatatttatggggtacatagtgatgtttcgatacatacagtatatttttataatgttcaaaagagtaatttgcatatcatctcatttatttgtgttgggaacactcaaaatcctcttttctagctatttgacaaaatataatcaatgttatttcagtaagctcctttgaaaaaataaggaattcaaccaggatagttgagattctaccagatttcctgggggcaattagatacttaactaatctttgtgagattcgtttcgtggaaactagacctttcagatctttctaatttcattatgttacgttgtctataaaactacctggaagagactgtacctgagaatttttgaaagaccatttttagttatgggaaaaagagtgatactgctaatcctgtatattacatgagaacaagattctggtttatgtgtacttgatccatcttgttgattttgaaggtgaaacaaacttacagcttttaattagctttctgtttatgtttacatattttggttccttttctcactgagtaacagttaatacaggcaagattgttctcttttataccatatataattagtattgtgccttagaatttagaactgatgatttcatgccatcatctagtcgagagtgcattccccacccccatgttactggatttcaacaattaaaattgtggtgggagattttgtcatgctttctaaaatcaaggtgatgttaatttcacagttttctttctgtgcctaacaatctaatttttattctgcttaattttgatattttataaagttctgttgtctttgaagattttcataaactaaggtcttataaatacttacacagataattgcattctagttcagagtacctttatctcataagtgttttcctgtatgtgtgctttgatgttgttgatatttcatgtgattaaatagtattaacattttctaattgtaaaaaatatatttttaagccttatgattctgcagatgactggtctgagcatattagctcttctgggaaaaagtactactacaattgtcgaacagaagtttcacaatgggaaaaaccaaaagagtggcttgaaaggtaattagcttttaatctaattaaacattatttctctagcttggttctactggttaacatcttacagcattaaacattctaatttagcttttttatagtgctgcccatctacactttttagttgcggtggttggttgccccttcgtgttttccatagtttgtctttacttttaaaaacaaaaaacctggctgggtgcagtggctcatgcctgtaatcccagaactttgggaggccaagacgggaggatcacttgagcccaggagtttgaggccagccctggcaacatagtgagaccctgcctctacaaaaagttagctgtgagtggtagcatgcacttgtagtcctagctactaagaggctgaggtgggaggatggcttgagcctaagaggccaaagctgcagtgagccatcatggtgccactacactctagcctgagcaacagagcaagatgctatctcaaaaaaaaaa

SEQ ID NO: 365294 - DNA, 1173 bp, Homo sapiens
ggaaactcatgcccttaatgtaatttttatatgtttatctttttttttatttttagagaacagagacaaaaagaagcaaacaagatggcagtcaacagcttcccaaaagatagggattacagaagagaggtgatgcaagcaacagccactagtgggtttgccagtggaagtaagtattaattttttttctttgaaatgtatgtttgacttattcgtatttatttttcaaatctgtatccattgccatctacatatgtaaattaaaataaatagaaacatacggagattcttttatgttggatttattataccctccaccattttggtccctgaaaagggaaaagatacacggtcgagtagtacaggtatgtgtttcccactacacattatggctataatggagttgaattgcaaacagtaaaattttgttttggattggtttcccctgatccccccagacaggagcttcctctcccaccctacctgcctgcccttaagttgtgtcctattaaactggacacaaatctcaccggcttttagtctaataattgaatcatagctacacacagtgacaccagaatagctacttgtttttttatgttaccagtgagtaacttgtttatccttgtatgtagaaactaatttcaccatgatcacagatctgtgtaacatctctagtttgaatttccacacaattttaaaatgtctactagaaaacttacacctttttgttccaaggtgctcttcatctataaaaccgtgggcatacttcagtgttcttctgaggccaaattttgtgctcgtgggacaattttgtataacatacatttattttgtaattcattctccaaatttgaagctttattaaaggtattctatttccactggcttcccttaacttgaataaaatttactcccagtgccgtggctcatgcctgctgcaatcccagccctttgggaggccgaggcaggaggatggcttgaggccaagagtttgagaccggcctgtgcaacatggcgagacccagtgtccacagaattaaaaattaaccacgcagctgtaatcccagccacttgggaggctgaggcaagaagatgacttgagccctggcatttggctatgatcttgccactgcactctagcctggcaacagagtcagactctgtctcaaa

SEQ ID NO: 365295 - DNA, 4068 bp, Homo sapiens
agggccggtggcgcgcggcgtccggtgaggggcagcggcccgggctcggttccggcttccagcagcggcccgaaggcgccggagcacgctccccgctccccagaacgcagcttccgcggctgcagcccaggcagctcttcgggaagcgtccgcccgtggtctcgccagggggtttccgacctccccgcccgacagcgcaggggcgggggccgcggccggagagctcgcccgagagcaccccctcccgctgcgcctctgggcgcacgcgcagccgctgcagcctcccttatttagtccgcgatggcttccctcgcgccccaccgtcctcttccggaaggcggctccctccctgcgcagcccggagcccctgagatcagcctcgagcaggcgcccgagcgagactatccctaaacgggaacggcggtggccgactcgcgagtgaggaaaagaaggaaagggcagactggtcgcgaagagaagatccaggcctcagaggaggagaaaggccggagccagccgaggtttgccgagggcggtgttccggacccgcgcggtgcggggaggaaggccgagggtgggagaggaggggcccggcggaaactgccgaggtttcccgaaggcggcagcgtccgagttgcccggatgtagttggtggagcggcagccgccgcctgcgcgcccgcccgcctttcgcggccgctctcccccctccccgacacacactcacaggccgggcattgatggtaatgtatgcgaggaaacagcagagactcagtgatggctgtcacgaccggaggggggactcgcagccttaccaggcacttaagtattcatcgaagagtcaccccagtagcggtgatcacagacatgaaaagatgcgagacgccggagatccttcaccaccaaataaaatgttgcggagatctgatagtcctgaaaacaaatacagtgacagcacaggtcacagtaaggccaaaaatgtgcatactcacagagttagagagagggatggtgggaccagttactctccacaagaaaattcacacaaccacagtgctcttcatagttcaaattcacattcttctaatccaagcaataacccaagcaaaacttcagatgcaccttatgattctgcagatgactggtctgagcatattagctcttctgggaaaaagtactactacaattgtcgaacagaagtttcacaatgggaaaaaccaaaagagtggcttgaaagagaacagagacaaaaagaagcaaacaagatggcagtcaacagcttcccaaaagatagggattacagaagagaggtgatgcaagcaacagccactagtgggtttgccagtggaatggaagacaagcattccagtgatgccagtagtttgctcccacagaatattttgtctcaaacaagcagacacaatgacagagactacagactgccaagagcagagactcacagtagttctacgccagtacagcaccccatcaaaccagtggttcatccaactgctaccccaagcactgttccttctagtccatttacgctacagtctgatcaccagccaaagaaatcatttgatgctaatggagcatctactttatcaaaactgcctacacccacatcttctgtccctgcacagaaaacagaaagaaaagaatctacatcaggagacaaacccgtatcacattcttgcacaactccttccacgtcttctgcctctggactgaaccccacatctgcacctccaacatctgcttcagcggtccctgtttctcctgttccacagtcgccaatacctcccttacttcaggacccaaatcttcttagacaattgcttcctgctttgcaagccacgctgcagcttaataattctaatgtggacatatctaaaataaatgaagttcttacagcagctgtgacacaagcctcactgcagtctataattcataagtttcttactgctggaccatctgctttcaacataacgtctctgatttctcaagctgctcagctctctacacaagcccagccatctaatcagtctccgatgtctttaacatctgatgcgtcatccccaagatcatatgtttctccaagaataagcacacctcaaactaacacagtccctatcaaacctttgatcagtactcctcctgtttcatcacagccaaaggttagtactccagtagttaagcaaggaccagtgtcacagtcagccacacagcagcctgtaactgctgacaagcagcaaggtcatgaacctgtctctcctcgaagtcttcagcgctcaagtagccagagaagtccatcacctggtcccaatcatacttctaatagtagtaatgcatcaaatgcaacagttgtaccacagaattcttctgcccgatccacgtgttcattaacgcctgcactagcagcacacttcagtgaaaatctcataaaacacgttcaaggatggcctgcagatcatgcagagaagcaggcatcaagattacgcgaagaagcgcataacatgggaactattcacatgtccgaaatttgtactgaattaaaaaatttaagatctttagtccgagtatgtgaaattcaagcaactttgcgagagcaaaggatactatttttgagacaacaaattaaggaacttgaaaagctaaaaaatcagaattccttcatggtgtgaagatgtgaataattgcacatggttttgagaacaggaactgtaaatctgttgcccaatcttaacatttttgagctgcatttaagtagactttggaccgttaagctgggcaaaggaaatgacaaggggacggggtctgtgagagtcaattcaggggaaagatacaagattgatttgtaaaacccttgaaatgtagatttcttgtagatgtatccttcacgttgtaaatatgttttgtagagtgaagccatgggaagccatgtgtaacagagcttagacatccaaaactaatcaatgctgaggtggctaaatacctagccttttacatgtaaacctgtctgcaaaattagcttttttaaaaaaaaaaaaaaaaaaattgggggggttaatttatcattcagaaatcttgcattttcaaaaattcagtgcaagcgccaggcgatttgtgtctaaggatacgattttgaaccatatgggcagtgtacaaaatatgaaacaactgtttccacacttgcacctgatcaagagcagtgcttctccatttgttttgcagagaaatgtttttcatttcccgtgtgtttccatttccttctgaaattctgattttatccatttttttaaggctcctctttatctcctttcttaaggcactgttgctatggcacttttctataaccttttcattcctgtgtacagtagcttaaaattgcagtgattgagcataacctacttgtttgtataaattattgaaatccatttgcaccctgtaagaatggacttaaaagtactgctggacaggcatgtgtgctcaaagtacattgattgctcaaatataaggaaatggcccaatgaacgtggttgtgggaggggaaagaggaaacagagctagtcagatgtgaattgtatctgttgtaataaacatgttaaaacaaacaaaaattgttatttttcttttccttcggtcagtgcacattagcatttgaactacctggggattctttatcagaactgttcttgttgaatatttatacttaattgaaataattccttaagggaggttttgtttaaaacgtattaacaggaaattgtgtatgagatatttaatgaaataagaaattcaacaagaatgattaagtcacttcccaagtggttgtcatttgttaaaccctggtttacctgtcttgctattatgacatttcatttggaaggatgtttgtgttgtagctaactgttcaagtctggtgctgactgctgttcttagccatcacaaaacgctaaatttgtgtaattggagcttcctgctgttatctggaaatagcaggaaagcgcagctttgtatattgtttcctaaagtatattaaaataaaaaaagaaactattgctactat

SEQ ID NO: 365296 - DNA, 3410 bp, Homo sapiens
tggcgaattcggcacgagggaggaggagaagaaggaccaggcgccgccgcctgcgcgcccgcccgcctttcgcggccgctctcccccctccccgacacacactcacaggccgggcattgatgctgtcacgaccggaggggggactcgcagccttaccaggcacttaagtattcatcgaagagtcaccccagtagcggtgatcacagacatgaaaagatgcgagacgccggagatccttcaccaccaaataaaatgttgcggagatctgatagtcctgaaaacaaatacagtgacagcacaggtcacagtaaggccaaaaatgtgcatactcacagagttagagagagggatggtgggaccagttactctccacaagaaaattcacacaaccacagtgctcttcatagttcaaattcacattcttctaatccaagcaataacccaagcaaaacttcagatgcaccttatgattctgcagatgactggtctgagcatattagctcttctgggaaaaagtactactacaattgtcgaacagaagtttcacaatgggaaaaaccaaaagagtggcttgaaagagaacagagacaaaaagaagcaaacaagatggcagtcaacagcttcccaaaagatagggattacagaagagaggtgatgcaagcaacagccactagtgggtttgccagtggaatggaagacaagcattccagtgatgccagtagtttgctcccacagaatattttgtctcaaacaagcagacacaatgacagagactacagactgccaagagcagagactcacagtagttctacgccagtacagcaccccatcaaaccagtggttcatccaactgctaccccaagcactgttccttctagtccatttacgctacagtctgatcaccagccaaagaaatcatttgatgctaatggagcatctactttatcaaaactgcctacacccacatcttctgtccctgcacagaaaacagaaagaaaagaatctacatcaggagacaaacccgtatcacattcttgcacaactccttccacgtcttctgcctctggactgaaccccacatctgcacctccaacatctgcttcagcggtccctgtttctcctgttccacagtcgccaatacctcccttacttcaggacccaaatcttcttagacaattgcttcctgctttgcaagccacgctgcagcttaataattctaatgtggacatatctaaaataaatgaagttcttacagcagctgtgacacaagcctcactgcagtctataattcataagtttcttactgctggaccatctgctttcaacataacgtctctgatttctcaagctgctcagctctctacacaagcccagccatctaatcagtctccgatgtctttaacatctgatgcgtcatccccaagatcatatgtttctccaagaataagcacacctcaaactaacacagtccctatcaaacctttgatcagtactcctcctgtttcatcacagccaaaggttagtactccagtagttaagcaaggaccagtgtcacagtcagccacacagcagcctgtaactgctgacaagcagcaaggtcatgaacctgtctctcctcgaagtcttcagcgctcaagtagccagagaagtccatcacctggtcccaatcatacttctaatagtagtaatgcatcaaatgcaacagttgtaccacagaattcttctgcccgatccacgtgttcattaacgcctgcactagcagcacacttcagtgaaaatctcataaaacacgttcaaggatggcctgcagatcatgcagagaagcaggcatcaagattacgcgaagaagcgcataacatgggaactattcacatgtccgaaatttgtactgaattaaaaaatttaagatctttagtccgagtatgtgaaattcaagcaactttgcgagagcaaaggatactatttttgagacaacaaattaaggaacttgaaaagctaaaaaatcagaattccttcatggtgtgaagatgtgaataattgcacatggttttgagaacaggaactgtaaatctgttgcccaatcttaacatttttgagctgcatttaagtagactttggaccgttaagctgggcaaaggaaatgacaaggggacggggtctgtgagagtcaattcaggggaaagatacaagattgatttgtaaaacccttgaaatgtagatttcttgtagatgtatccttcacgttgtaaatatgttttgtagagtgaagccatgggaagccatgtgtaacagagcttagacatccaaaactaatcaatgctgaggtggctaaatacctagccttttacatgtaaacctgtctgcaaaattagcttttttaaaaaaaaaaaaaaaaaaattgggggggttaatttatcattcagaaatcttgcattttcaaaaattcagtgcaagcgccaggcgatttgtgtctaaggatacgattttgaaccatatgggcagtgtacaaaatatgaaacaactgtttccacacttgcacctgatcaagagcagtgcttctccatttgttttgcagagaaatgtttttcatttcccgtgtgtttccatttccttctgaaattctgattttatccatttttttaaggctcctctttatctcctttcttaaggcactgttgctatggcacttttctataaccttttcattcctgtgtacagtagcttaaaattgcagtgattgagcataacctacttgtttgtataaattattgaaatccatttgcaccctgtaagaatggacttaaaagtactgctggacaggcatgtgtgctcaaagtacattgattgctcaaatataaggaaatggcccaatgaacgtggttgtgggaggggaaagaggaaacagagctagtcagatgtgaattgtatctgttgtaataaacatgttaaaacaaacaaaaattgttatttttcttttccttcggtcagtgcacattagcatttgaactacctggggattctttatcagaactgttcttgttgaatatttatacttaattgaaataattccttaagggaggttttgtttaaaacgtattaacaggaaattgtgtatgagatatttaatgaaataagaaattcaacaagaatgattaagtcacttcccaagtggttgtcatttgttaaaccctggtttacctgtcttgctattatgacatttcatttggaaggatgtttgtgttgtagctaactgttcaagtctggtgctgactgctgttcttagccatcacaaaacgctaaatttgtgtaattggagcttcctgctgttatctggaaatagcaggaaagcgcagctttgtatattgtttcctaaagtatattaaaataaaaaaagaaactattgctactat

SEQ ID NO: 365297 - DNA, 4106 bp, Homo sapiens
agggccggtggcgcgcggcgtccggtgaggggcagcggcccgggctcggttccggcttccagcagcggcccgaaggcgccggagcacgctccccgctccccagaacgcagcttccgcggctgcagcccaggcagctcttcgggaagcgtccgcccgtggtctcgccagggggtttccgacctccccgcccgacagcgcaggggcgggggccgcggccggagagctcgcccgagagcaccccctcccgctgcgcctctgggcgcacgcgcagccgctgcagcctcccttatttagtccgcgatggcttccctcgcgccccaccgtcctcttccggaaggcggctccctccctgcgcagcccggagcccctgagatcagcctcgagcaggcgcccgagcgagactatccctaaacgggaacggcggtggccgactcgcgagtgaggaaaagaaggaaagggcagactggtcgcgaagagaagatccaggcctcagaggaggagaaaggccggagccagccgaggtttgccgagggcggtgttccggacccgcgcggtgcggggaggaaggccgagggtgggagaggaggggcccggcggaaactgccgaggtttcccgaaggcggcagcgtccgagttgcccggatgtagttggtggagcggcagccgccgcctgcgcgcccgcccgcctttcgcggccgctctcccccctccccgacacacactcacaggccgggcattgatggtaatgtatgcgaggaaacagcagagactcagtgatggctgtcacgaccggaggggggactcgcagccttaccaggcacttaagtattcatcgaagagtcaccccagtagcggtgatcacagacatgaaaagatgcgagacgccggagatccttcaccaccaaataaaatgttgcggagatctgatagtcctgaaaacaaatacagtgacagcacaggtcacagtaaggccaaaaatgtgcatactcacagagttagagagagggatggtgggaccagttactctccacaagaaaattcacacaaccacagtgctcttcatagttcaaattcacattcttctaatccaagcaataacccaagcaaaacttcagatgcaccttatgattctgcagatgactggtctgagcatattagctcttctgggaaaaagtactactacaattgtcgaacagaagtttcacaatgggaaaaaccaaaagagtggcttgaaagagaacagagacaaaaagaagcaaacaagatggcagtcaacagcttcccaaaagatagggattacagaagagaggtgatgcaagcaacagccactagtgggtttgccagtggaatcattccaacatctgttttttcgaactgtgaactaaagtggaagacaagcattccagtgatgccagtagtttgctcccacagaatattttgtctcaaacaagcagacacaatgacagagactacagactgccaagagcagagactcacagtagttctacgccagtacagcaccccatcaaaccagtggttcatccaactgctaccccaagcactgttccttctagtccatttacgctacagtctgatcaccagccaaagaaatcatttgatgctaatggagcatctactttatcaaaactgcctacacccacatcttctgtccctgcacagaaaacagaaagaaaagaatctacatcaggagacaaacccgtatcacattcttgcacaactccttccacgtcttctgcctctggactgaaccccacatctgcacctccaacatctgcttcagcggtccctgtttctcctgttccacagtcgccaatacctcccttacttcaggacccaaatcttcttagacaattgcttcctgctttgcaagccacgctgcagcttaataattctaatgtggacatatctaaaataaatgaagttcttacagcagctgtgacacaagcctcactgcagtctataattcataagtttcttactgctggaccatctgctttcaacataacgtctctgatttctcaagctgctcagctctctacacaagcccagccatctaatcagtctccgatgtctttaacatctgatgcgtcatccccaagatcatatgtttctccaagaataagcacacctcaaactaacacagtccctatcaaacctttgatcagtactcctcctgtttcatcacagccaaaggttagtactccagtagttaagcaaggaccagtgtcacagtcagccacacagcagcctgtaactgctgacaagcagcaaggtcatgaacctgtctctcctcgaagtcttcagcgctcaagtagccagagaagtccatcacctggtcccaatcatacttctaatagtagtaatgcatcaaatgcaacagttgtaccacagaattcttctgcccgatccacgtgttcattaacgcctgcactagcagcacacttcagtgaaaatctcataaaacacgttcaaggatggcctgcagatcatgcagagaagcaggcatcaagattacgcgaagaagcgcataacatgggaactattcacatgtccgaaatttgtactgaattaaaaaatttaagatctttagtccgagtatgtgaaattcaagcaactttgcgagagcaaaggatactatttttgagacaacaaattaaggaacttgaaaagctaaaaaatcagaattccttcatggtgtgaagatgtgaataattgcacatggttttgagaacaggaactgtaaatctgttgcccaatcttaacatttttgagctgcatttaagtagactttggaccgttaagctgggcaaaggaaatgacaaggggacggggtctgtgagagtcaattcaggggaaagatacaagattgatttgtaaaacccttgaaatgtagatttcttgtagatgtatccttcacgttgtaaatatgttttgtagagtgaagccatgggaagccatgtgtaacagagcttagacatccaaaactaatcaatgctgaggtggctaaatacctagccttttacatgtaaacctgtctgcaaaattagcttttttaaaaaaaaaaaaaaaaaaattgggggggttaatttatcattcagaaatcttgcattttcaaaaattcagtgcaagcgccaggcgatttgtgtctaaggatacgattttgaaccatatgggcagtgtacaaaatatgaaacaactgtttccacacttgcacctgatcaagagcagtgcttctccatttgttttgcagagaaatgtttttcatttcccgtgtgtttccatttccttctgaaattctgattttatccatttttttaaggctcctctttatctcctttcttaaggcactgttgctatggcacttttctataaccttttcattcctgtgtacagtagcttaaaattgcagtgattgagcataacctacttgtttgtataaattattgaaatccatttgcaccctgtaagaatggacttaaaagtactgctggacaggcatgtgtgctcaaagtacattgattgctcaaatataaggaaatggcccaatgaacgtggttgtgggaggggaaagaggaaacagagctagtcagatgtgaattgtatctgttgtaataaacatgttaaaacaaacaaaaattgttatttttcttttccttcggtcagtgcacattagcatttgaactacctggggattctttatcagaactgttcttgttgaatatttatacttaattgaaataattccttaagggaggttttgtttaaaacgtattaacaggaaattgtgtatgagatatttaatgaaataagaaattcaacaagaatgattaagtcacttcccaagtggttgtcatttgttaaaccctggtttacctgtcttgctattatgacatttcatttggaaggatgtttgtgttgtagctaactgttcaagtctggtgctgactgctgttcttagccatcacaaaacgctaaatttgtgtaattggagcttcctgctgttatctggaaatagcaggaaagcgcagctttgtatattgtttcctaaagtatattaaaataaaaaaagaaactattgctactat

SEQ ID NO: 365298 - DNA, 3608 bp, Homo sapiens
agggccggtggcgcgcggcgtccggtgaggggcagcggcccgggctcggttccggcttccagcagcggcccgaaggcgccggagcacgctccccgctccccagaacgcagcttccgcggctgcagcccaggcagctcttcgggaagcgtccgcccgtggtctcgccagggggtttccgacctccccgcccgacagcgcaggggcgggggccgcggccggagagctcgcccgagagcaccccctcccgctgcgcctctgggcgcacgcgcagccgctgcagcctcccttatttagtccgcgatggcttccctcgcgccccaccgtcctcttccggaaggcggctccctccctgcgcagcccggagcccctgagatcagcctcgagcaggcgcccgagcgagactatccctaaacgggaacggcggtggccgactcgcgagtgaggaaaagaaggaaagggcagactggtcgcgaagagaagatccaggcctcagaggaggagaaaggccggagccagccgaggtttgccgagggcggtgttccggacccgcgcggtgcggggaggaaggccgagggtgggagaggaggggcccggcggaaactgccgaggtttcccgaaggcggcagcgtccgagttgcccggatgtagttggtggagcggcagccgccgcctgcgcgcccgcccgcctttcgcggccgctctcccccctccccgacacacactcacaggccgggcattgatggtaatgtatgcgaggaaacagcagagactcagtgatggctgtcacgaccggaggggggactcgcagccttaccaggcacttaagtattcatcgaagagtcaccccagtagcggtgatcacagacatgaaaagatgcgagacgccggagatccttcaccaccaaataaaatgttgcggagatctgatagtcctgaaaacaaatacagtgacagcacaggtcacagtaaggccaaaaatgtgcatactcacagagttagagagagggatggtgggaccagttactctccacaagaaaattcacacaaccacagtgctcttcatagttcaaattcacattcttctaatccaagcaataacccaagcaaaacttcagatgcaccttatgattctgcagatgactggtctgagcatattagctcttctgggaaaaagtactactacaattgtcgaacagaagtttcacaatgggaaaaaccaaaagagtggcttgaaagagaacagagacaaaaagaagcaaacaagatggcagtcaacagcttcccaaaagatagggattacagaagagaggtgatgcaagcaacagccactagtgggtttgccagtggaatggaagacaagcattccagtgatgccagtagtttgctcccacagaatattttgtctcaaacaagcagacacaatgacagagactacagactgccaagagcagagactcacagtagttctacgccagtacagcaccccatcaaaccagtggttcatccaactgctaccccaagcactgttccttctagtccatttacgctacagtctgatcaccagccaaagaaatcatttgatgctaatggagcatctactttatcaaaactgcctacacccacatcttctgtccctgcacagaaaacagaaagaaaagaatctacatcaggagacaaacccgtatcacattcttgcacaactccttccacgtcttctgcctctggactgaaccccacatctgcacctccaacatctgcttcagcggtccctgtttctcctgttccacagtcgccaatacctcccttacttcaggacccaaatcttcttagacaattgcttcctgctttgcaagccacgctgcagcttaataattctaatgtggacatatctaaaataaatgaagttcttacagcagctgtgacacaagcctcactgcagtctataattcataagtttcttactgctggaccatctgctttcaacataacgtctctgatttctcaagctgctcagctctctacacaagcccagccatctaatcagtctccgatgtctttaacatctgatgcgtcatccccaagatcatatgtttctccaagaataagcacacctcaaactaacacagtccctatcaaacctttgatcagtactcctcctgtttcatcacagccaaaggttagtactccagtagttaagcaaggaccagtgtcacagtcagccacacagcagcctgtaactgctgacaagcagcaaggtcatgaacctgtctctcctcgaagtcttcagcgctcaagtagccagagaagtccatcacctggtcccaatcatacttctaatagtagtaatgcatcaaatgcaacagttgtaccacagaattcttctgcccgatccacgtgttcattaacgcctgcactagcagcacacttcagtgaaaatctcataaaacacgttcaaggatggcctgcagatcatgcagagaagcaggcatcaagattacgcgaagaagcgcataacatgggaactattcacatgtccgaaatttgtactgaattaaaaaatttaagatctttagtccgagtatgtgaaattcaagcaactttgcgagagcaaaggatactatttttgagacaacaaattaaggaacttgaaaagctaaaaaatcagaattccttcatggtgtgaagatgtgaataattgcacatggttttgagaacaggaactgtaaatctgttgcccaatcttaacatttttgagctgcatttaagtagactttggaccgttaagctgggcaaaggaaatgacaaggggacggggtctgtgagagtcaattcaggggaaagatacaagattgatttgtaaaacccttgaaatgtagatttcttgtagatgtatccttcacgttgtaaatatgttttgtagagtgaagccatgggaagccatgtgtaacagagcttagacatccaaaactaatcaatgctgaggtggctaaatacctagccttttacatgtaaacctgtctgcaaaattagcttttttaaaaaaaaaaaaaaaaaaattgggggggttaatttatcattcagaaatcttgcattttcaaaaattcagtgcaagcgccaggcgatttgtgtctaaggatacgattttgaaccatatgggcagtgtacaaaatatgaaacaactgtttccacacttgcacctgatcaagagcagtgcttctccatttgttttgcagagaaatgtttttcatttcccgtgtgtttccatttccttctgaaattctgattttatccatttttttaaggctcctctttatctcctttcttaaggcactgttgctatggcacttttctataaccttttcattcctgtgtacagtagcttaaaattgcagtgattgagcataacctacttgtttgtataaattattgaaatccatttgcaccctgtaagaatggacttaaaagtactgctggacaggcatgtgtgctcaaagtacattgattgctcaaatataaggaaatggcccaatgaacgtggttgtgggaggggaaagaggaaacagagctagtcagatgtgaattgtatctgttgtaataaacatgttaaa

SEQ ID NO: 365299 - DNA, 3759 bp, Homo sapiens
agggccggtggcgcgcggcgtccggtgaggggcagcggcccgggctcggttccggcttccagcagcggcccgaaggcgccggagcacgctccccgctccccagaacgcagcttccgcggctgcagcccaggcagctcttcgggaagcgtccgcccgtggtctcgccagggggtttccgacctccccgcccgacagcgcaggggcgggggccgcggccggagagctcgcccgagagcaccccctcccgctgcgcctctgggcgcacgcgcagccgctgcagcctcccttatttagtccgcgatggcttccctcgcgccccaccgtcctcttccggaaggcggctccctccctgcgcagcccggagcccctgagatcagcctcgagcaggcgcccgagcgagactatccctaaacgggaacggcggtggccgactcgcgagtgaggaaaagaaggaaagggcagactggtcgcgaagagaagatccaggcctcagaggaggagaaaggccggagccagccgaggtttgccgagggcggtgttccggacccgcgcggtgcggggaggaaggccgagggtgggagaggaggggcccggcggaaactgccgaggtttcccgaaggcggcagcgtccgagttgcccggatgtagttggtggagcggcagccgccgcctgcgcgcccgcccgcctttcgcggccgctctcccccctccccgacacacactcacaggccgggcattgatggtaatgtatgcgaggaaacagcagagactcagtgatggctgtcacgaccggaggggggactcgcagccttaccaggcacttaagtattcatcgaagagtcaccccagtagcggtgatcacagacatgaaaagatgcgagacgccggagatccttcaccaccaaataaaatgttgcggagatctgatagtcctgaaaacaaatacagtgacagcacaggtcacagtaaggccaaaaatgtgcatactcacagagttagagagagggatggtgggaccagttactctccacaagaaaattcacacaaccacagtgctcttcatagttcaaattcacattcttctaatccaagcaataacccaagcaaaacttcagatgcaccttatgattctgcagatgactggtctgagcatattagctcttctgggaaaaagtactactacaattgtcgaacagaagtttcacaatgggaaaaaccaaaagagtggcttgaaagagaacagagacaaaaagaagcaaacaagatggcagtcaacagcttcccaaaagatagggattacagaagagaggtgatgcaagcaacagccactagtgggtttgccagtggaaaatctacatcaggagacaaacccgtatcacattcttgcacaactccttccacgtcttctgcctctggactgaaccccacatctgcacctccaacatctgcttcagcggtccctgtttctcctgttccacagtcgccaatacctcccttacttcaggacccaaatcttcttagacaattgcttcctgctttgcaagccacgctgcagcttaataattctaatgtggacatatctaaaataaatgaagttcttacagcagctgtgacacaagcctcactgcagtctataattcataagtttcttactgctggaccatctgctttcaacataacgtctctgatttctcaagctgctcagctctctacacaagcccagccatctaatcagtctccgatgtctttaacatctgatgcgtcatccccaagatcatatgtttctccaagaataagcacacctcaaactaacacagtccctatcaaacctttgatcagtactcctcctgtttcatcacagccaaaggttagtactccagtagttaagcaaggaccagtgtcacagtcagccacacagcagcctgtaactgctgacaagcagcaaggtcatgaacctgtctctcctcgaagtcttcagcgctcaagtagccagagaagtccatcacctggtcccaatcatacttctaatagtagtaatgcatcaaatgcaacagttgtaccacagaattcttctgcccgatccacgtgttcattaacgcctgcactagcagcacacttcagtgaaaatctcataaaacacgttcaaggatggcctgcagatcatgcagagaagcaggcatcaagattacgcgaagaagcgcataacatgggaactattcacatgtccgaaatttgtactgaattaaaaaatttaagatctttagtccgagtatgtgaaattcaagcaactttgcgagagcaaaggatactatttttgagacaacaaattaaggaacttgaaaagctaaaaaatcagaattccttcatggtgtgaagatgtgaataattgcacatggttttgagaacaggaactgtaaatctgttgcccaatcttaacatttttgagctgcatttaagtagactttggaccgttaagctgggcaaaggaaatgacaaggggacggggtctgtgagagtcaattcaggggaaagatacaagattgatttgtaaaacccttgaaatgtagatttcttgtagatgtatccttcacgttgtaaatatgttttgtagagtgaagccatgggaagccatgtgtaacagagcttagacatccaaaactaatcaatgctgaggtggctaaatacctagccttttacatgtaaacctgtctgcaaaattagcttttttaaaaaaaaaaaaaaaaaaattgggggggttaatttatcattcagaaatcttgcattttcaaaaattcagtgcaagcgccaggcgatttgtgtctaaggatacgattttgaaccatatgggcagtgtacaaaatatgaaacaactgtttccacacttgcacctgatcaagagcagtgcttctccatttgttttgcagagaaatgtttttcatttcccgtgtgtttccatttccttctgaaattctgattttatccatttttttaaggctcctctttatctcctttcttaaggcactgttgctatggcacttttctataaccttttcattcctgtgtacagtagcttaaaattgcagtgattgagcataacctacttgtttgtataaattattgaaatccatttgcaccctgtaagaatggacttaaaagtactgctggacaggcatgtgtgctcaaagtacattgattgctcaaatataaggaaatggcccaatgaacgtggttgtgggaggggaaagaggaaacagagctagtcagatgtgaattgtatctgttgtaataaacatgttaaaacaaacaaaaattgttatttttcttttccttcggtcagtgcacattagcatttgaactacctggggattctttatcagaactgttcttgttgaatatttatacttaattgaaataattccttaagggaggttttgtttaaaacgtattaacaggaaattgtgtatgagatatttaatgaaataagaaattcaacaagaatgattaagtcacttcccaagtggttgtcatttgttaaaccctggtttacctgtcttgctattatgacatttcatttggaaggatgtttgtgttgtagctaactgttcaagtctggtgctgactgctgttcttagccatcacaaaacgctaaatttgtgtaattggagcttcctgctgttatctggaaatagcaggaaagcgcagctttgtatattgtttcctaaagtatattaaaataaaaaaagaaactattgctactat

SEQ ID NO: 365300 - DNA, 3101 bp, Homo sapiens
tggcgaattcggcacgagggaggaggagaagaaggaccaggcgccgccgcctgcgcgcccgcccgcctttcgcggccgctctcccccctccccgacacacactcacaggccgggcattgatgctgtcacgaccggaggggggactcgcagccttaccaggcacttaagtattcatcgaagagtcaccccagtagcggtgatcacagacatgaaaagatgcgagacgccggagatccttcaccaccaaataaaatgttgcggagatctgatagtcctgaaaacaaatacagtgacagcacaggtcacagtaaggccaaaaatgtgcatactcacagagttagagagagggatggtgggaccagttactctccacaagaaaattcacacaaccacagtgctcttcatagttcaaattcacattcttctaatccaagcaataacccaagcaaaacttcagatgcaccttatgattctgcagatgactggtctgagcatattagctcttctgggaaaaagtactactacaattgtcgaacagaagtttcacaatgggaaaaaccaaaagagtggcttgaaagagaacagagacaaaaagaagcaaacaagatggcagtcaacagcttcccaaaagatagggattacagaagagaggtgatgcaagcaacagccactagtgggtttgccagtggaaaatctacatcaggagacaaacccgtatcacattcttgcacaactccttccacgtcttctgcctctggactgaaccccacatctgcacctccaacatctgcttcagcggtccctgtttctcctgttccacagtcgccaatacctcccttacttcaggacccaaatcttcttagacaattgcttcctgctttgcaagccacgctgcagcttaataattctaatgtggacatatctaaaataaatgaagttcttacagcagctgtgacacaagcctcactgcagtctataattcataagtttcttactgctggaccatctgctttcaacataacgtctctgatttctcaagctgctcagctctctacacaagcccagccatctaatcagtctccgatgtctttaacatctgatgcgtcatccccaagatcatatgtttctccaagaataagcacacctcaaactaacacagtccctatcaaacctttgatcagtactcctcctgtttcatcacagccaaaggttagtactccagtagttaagcaaggaccagtgtcacagtcagccacacagcagcctgtaactgctgacaagcagcaaggtcatgaacctgtctctcctcgaagtcttcagcgctcaagtagccagagaagtccatcacctggtcccaatcatacttctaatagtagtaatgcatcaaatgcaacagttgtaccacagaattcttctgcccgatccacgtgttcattaacgcctgcactagcagcacacttcagtgaaaatctcataaaacacgttcaaggatggcctgcagatcatgcagagaagcaggcatcaagattacgcgaagaagcgcataacatgggaactattcacatgtccgaaatttgtactgaattaaaaaatttaagatctttagtccgagtatgtgaaattcaagcaactttgcgagagcaaaggatactatttttgagacaacaaattaaggaacttgaaaagctaaaaaatcagaattccttcatggtgtgaagatgtgaataattgcacatggttttgagaacaggaactgtaaatctgttgcccaatcttaacatttttgagctgcatttaagtagactttggaccgttaagctgggcaaaggaaatgacaaggggacggggtctgtgagagtcaattcaggggaaagatacaagattgatttgtaaaacccttgaaatgtagatttcttgtagatgtatccttcacgttgtaaatatgttttgtagagtgaagccatgggaagccatgtgtaacagagcttagacatccaaaactaatcaatgctgaggtggctaaatacctagccttttacatgtaaacctgtctgcaaaattagcttttttaaaaaaaaaaaaaaaaaaattgggggggttaatttatcattcagaaatcttgcattttcaaaaattcagtgcaagcgccaggcgatttgtgtctaaggatacgattttgaaccatatgggcagtgtacaaaatatgaaacaactgtttccacacttgcacctgatcaagagcagtgcttctccatttgttttgcagagaaatgtttttcatttcccgtgtgtttccatttccttctgaaattctgattttatccatttttttaaggctcctctttatctcctttcttaaggcactgttgctatggcacttttctataaccttttcattcctgtgtacagtagcttaaaattgcagtgattgagcataacctacttgtttgtataaattattgaaatccatttgcaccctgtaagaatggacttaaaagtactgctggacaggcatgtgtgctcaaagtacattgattgctcaaatataaggaaatggcccaatgaacgtggttgtgggaggggaaagaggaaacagagctagtcagatgtgaattgtatctgttgtaataaacatgttaaaacaaacaaaaattgttatttttcttttccttcggtcagtgcacattagcatttgaactacctggggattctttatcagaactgttcttgttgaatatttatacttaattgaaataattccttaagggaggttttgtttaaaacgtattaacaggaaattgtgtatgagatatttaatgaaataagaaattcaacaagaatgattaagtcacttcccaagtggttgtcatttgttaaaccctggtttacctgtcttgctattatgacatttcatttggaaggatgtttgtgttgtagctaactgttcaagtctggtgctgactgctgttcttagccatcacaaaacgctaaatttgtgtaattggagcttcctgctgttatctggaaatagcaggaaagcgcagctttgtatattgtttcctaaagtatattaaaataaaaaaagaaactattgctactat

SEQ ID NO: 365301 - DNA, 3750 bp, Homo sapiens
agggccggtggcgcgcggcgtccggtgaggggcagcggcccgggctcggttccggcttccagcagcggcccgaaggcgccggagcacgctccccgctccccagaacgcagcttccgcggctgcagcccaggcagctcttcgggaagcgtccgcccgtggtctcgccagggggtttccgacctccccgcccgacagcgcaggggcgggggccgcggccggagagctcgcccgagagcaccccctcccgctgcgcctctgggcgcacgcgcagccgctgcagcctcccttatttagtccgcgatggcttccctcgcgccccaccgtcctcttccggaaggcggctccctccctgcgcagcccggagcccctgagatcagcctcgagcaggcgcccgagcgagactatccctaaacgggaacggcggtggccgactcgcgagtgaggaaaagaaggaaagggcagactggtcgcgaagagaagatccaggcctcagaggaggagaaaggccggagccagccgaggtttgccgagggcggtgttccggacccgcgcggtgcggggaggaaggccgagggtgggagaggaggggcccggcggaaactgccgaggtttcccgaaggcggcagcgtccgagttgcccggatgtagttggtggagcggcagccgccgcctgcgcgcccgcccgcctttcgcggccgctctcccccctccccgacacacactcacaggccgggcattgatggtaatgtatgcgaggaaacagcagagactcagtgatggctgtcacgaccggaggggggactcgcagccttaccaggcacttaagtattcatcgaagagtcaccccagtagcggtgatcacagacatgaaaagatgcgagacgccggagatccttcaccaccaaataaaatgttgcggagatctgatagtcctgaaaacaaatacagtgacagcacaggtcacagtaaggccaaaaatgtgcatactcacagagttagagagagggatggtgggaccagttactctccacaagaaaattcacacaaccacagtgctcttcatagttcaaattcacattcttctaatccaagcaataacccaagcaaaacttcagatgcaccttatgattctgcagatgactggtctgagcatattagctcttctgggaaaaagtactactacaattgtcgaacagaagtttcacaatgggaaaaaccaaaagagtggcttgaaagagaacagagacaaaaagaagcaaacaagatggcagtcaacagcttcccaaaagatagggattacagaagagaggtgatgcaagcaacagccactagtgggtttgccagtggaatggaagacaagcattccagtgatgccagtagtttgctcccacagaatattttgtctcaaacaagcagacacaatgacagagactacagactgccaagagcagagactcacagtagttctacgccagtacagcaccccatcaaaccagtggttcatccaactgctaccccaagcactgttccttctagtccatttacgctacagtctgatcaccagccaaagaaatcatttgatgctaatggagcatctactttatcaaaactgcctacacccacatcttctgtccctgcacagaaaacagaaagaaaagaatctacatcaggagacaaacccgtatcacattcttgcacaactccttccacgtcttctgcctctggactgaaccccacatctgcacctccaacatctgcttcagcggtccctgtttctcctgttccacagtcgccaatacctcccttacttcaggacccaaatcttcttagacaattgcttcctgctttgcaagccacgctgcagcttaataattctaatgtggacatatctaaaataaatgaagttcttacagcagctgtgacacaagcctcactgcagtctataattcataagtttcttactgctggaccatctgctttcaacataacgtctctgatttctcaagctgctcagctctctacacaagcccagccatctaatcagtctccgatgtctttaacatctgatgcgtcatccccaagatcatatgtttctccaagaataagcacacctcaaactaacacagtccctatcaaacctttgatcagtactcctcctgtttcatcacagccaaaggttagtactccagtagttaagcaaggaccagtgtcacagtcagccacacagcagcctgtaactgctgacaagcagcaaggtcatgaacctgtctctcctcgaagtcttcagcgctcaagtagccagagaagtccatcacctggtcccaatcatacttctaatagtagtaatgcatcaaatgcaacagttgtaccacagaattcttctgcccgatccacgtgttcattaacgcctgcactagcagcacacttcagtgaaaatctcataaaacacgttcaaggatggcctgcagatcatgcagagaagcaggcatcaagattacgcgaagaagcgcataacatgggaactattcacatgtccgaaatttgtactgaattaaaaaatttaagatctttagtccgagtatgtgaaattcaagcaactttgcgagagcaaaggatactatttttgagacaacaaattaaggaacttgaaaagctaaaaaatcagaattccttcatggtgtgaagatgtgaataattgcacatggttttgagaacaggaactgtaaatctgttgcccaatcttaacatttttgagctgcatttaagtagactttggaccgttaagctgggcaaaggaaatgacaaggggacggggtctgtgagagtcaattcaggggaaagatacaagattgatttgtaaaacccttgaaatgtagatttcttgtagatgtatccttcacgttgtaaatatgttttgtagagtgaagccatgggaagccatgtgtaacagagcttagacatccaaaactaatcaatgctgaggtggctaaatacctagccttttacatgtaaacctgtctgcaaaattagcttttttaaaaaaaaaaaaaaaaaaattgggggggatcccggaagcgcgagcaaggccgccagatgtgcaggcacgcggaggaggagaaagagatggacctcccggactcggcctcgagggtcttctgcggccgcaatcctgagcttggtgaacacagatgatgtcaacgccataatcctggcccagaagaacatgctggaccgcttggagaaagaccatctgagatgctgctcaagttcaacaaccttgtccagtgcccgcctgacagacagattgagagaagggttttccgtgcacacacacgaggaccctagtagaagattgaacggggacctggacagcatcttccgccgttatcaggacgctgaaaggggaaactgggccaggaaagcacccaagaggacccttacagcatatattcccaggaggaatcctttcccgtggacggaacagacggtattgaaagacccccaattcccaagccacgagataatcatagaggacacaaccaatttgcctactcttcagaaacacagaagcaactggggctctcgtgttgaacacccaagcccccgggaaaccggttgctcgcccctaccaattaagcccccggttgtgcagaggaaccggtcccaattgtccaggacgtggtttccccaagaccaataaatgggcggaggccagacagatgacgagggaatgacgggagaaataccagg

SEQ ID NO: 365302 - DNA, 3330 bp, Homo sapiens
agggccggtggcgcgcggcgtccggtgaggggcagcggcccgggctcggttccggcttccagcagcggcccgaaggcgccggagcacgctccccgctccccagaacgcagcttccgcggctgcagcccaggcagctcttcgggaagcgtccgcccgtggtctcgccagggggtttccgacctccccgcccgacagcgcaggggcgggggccgcggccggagagctcgcccgagagcaccccctcccgctgcgcctctgggcgcacgcgcagccgctgcagcctcccttatttagtccgcgatggcttccctcgcgccccaccgtcctcttccggaaggcggctccctccctgcgcagcccggagcccctgagatcagcctcgagcaggcgcccgagcgagactatccctaaacgggaacggcggtggccgactcgcgagtgaggaaaagaaggaaagggcagactggtcgcgaagagaagatccaggcctcagaggaggagaaaggccggagccagccgaggtttgccgagggcggtgttccggacccgcgcggtgcggggaggaaggccgagggtgggagaggaggggcccggcggaaactgccgaggtttcccgaaggcggcagcgtccgagttgcccggatgtagttggtggagcggcagccgccgcctgcgcgcccgcccgcctttcgcggccgctctcccccctccccgacacacactcacaggccgggcattgatggtaatgtatgcgaggaaacagcagagactcagtgatggctgtcacgaccggaggggggactcgcagccttaccaggcacttaagtattcatcgaagagtcaccccagtagcggtgatcacagacatgaaaagatgcgagacgccggagatccttcaccaccaaataaaatgttgcggagatctgatagtcctgaaaacaaatacagtgacagcacaggtcacagtaaggccaaaaatgtgcatactcacagagttagagagagggatggtgggaccagttactctccacaagaaaattcacacaaccacacgccaatacctcccttacttcaggacccaaatcttcttagacaattgcttcctgctttgcaagccacgctgcagcttaataattctaatgtggacatatctaaaataaatgaagttcttacagcagctgtgacacaagcctcactgcagtctataattcataagtttcttactgctggaccatctgctttcaacataacgtctctgatttctcaagctgctcagctctctacacaagcccagccatctaatcagtctccgatgtctttaacatctgatgcgtcatccccaagatcatatgtttctccaagaataagcacacctcaaactaacacagtccctatcaaacctttgatcagtactcctcctgtttcatcacagccaaaggttagtactccagtagttaagcaaggaccagtgtcacagtcagccacacagcagcctgtaactgctgacaagcagcaaggtcatgaacctgtctctcctcgaagtcttcagcgctcaagtagccagagaagtccatcacctggtcccaatcatacttctaatagtagtaatgcatcaaatgcaacagttgtaccacagaattcttctgcccgatccacgtgttcattaacgcctgcactagcagcacacttcagtgaaaatctcataaaacacgttcaaggatggcctgcagatcatgcagagaagcaggcatcaagattacgcgaagaagcgcataacatgggaactattcacatgtccgaaatttgtactgaattaaaaaatttaagatctttagtccgagtatgtgaaattcaagcaactttgcgagagcaaaggatactatttttgagacaacaaattaaggaacttgaaaagctaaaaaatcagaattccttcatggtgtgaagatgtgaataattgcacatggttttgagaacaggaactgtaaatctgttgcccaatcttaacatttttgagctgcatttaagtagactttggaccgttaagctgggcaaaggaaatgacaaggggacggggtctgtgagagtcaattcaggggaaagatacaagattgatttgtaaaacccttgaaatgtagatttcttgtagatgtatccttcacgttgtaaatatgttttgtagagtgaagccatgggaagccatgtgtaacagagcttagacatccaaaactaatcaatgctgaggtggctaaatacctagccttttacatgtaaacctgtctgcaaaattagcttttttaaaaaaaaaaaaaaaaaaattgggggggttaatttatcattcagaaatcttgcattttcaaaaattcagtgcaagcgccaggcgatttgtgtctaaggatacgattttgaaccatatgggcagtgtacaaaatatgaaacaactgtttccacacttgcacctgatcaagagcagtgcttctccatttgttttgcagagaaatgtttttcatttcccgtgtgtttccatttccttctgaaattctgattttatccatttttttaaggctcctctttatctcctttcttaaggcactgttgctatggcacttttctataaccttttcattcctgtgtacagtagcttaaaattgcagtgattgagcataacctacttgtttgtataaattattgaaatccatttgcaccctgtaagaatggacttaaaagtactgctggacaggcatgtgtgctcaaagtacattgattgctcaaatataaggaaatggcccaatgaacgtggttgtgggaggggaaagaggaaacagagctagtcagatgtgaattgtatctgttgtaataaacatgttaaaacaaacaaaaattgttatttttcttttccttcggtcagtgcacattagcatttgaactacctggggattctttatcagaactgttcttgttgaatatttatacttaattgaaataattccttaagggaggttttgtttaaaacgtattaacaggaaattgtgtatgagatatttaatgaaataagaaattcaacaagaatgattaagtcacttcccaagtggttgtcatttgttaaaccctggtttacctgtcttgctattatgacatttcatttggaaggatgtttgtgttgtagctaactgttcaagtctggtgctgactgctgttcttagccatcacaaaacgctaaatttgtgtaattggagcttcctgctgttatctggaaatagcaggaaagcgcagctttgtatattgtttcctaaagtatattaaaataaaaaaagaaactattgctactat

SEQ ID NO: 365303 - DNA, 5500 bp, Homo sapiens
agggccggtggcgcgcggcgtccggtgaggggcagcggcccgggctcggttccggcttccagcagcggcccgaaggcgccggagcacgctccccgctccccagaacgcagcttccgcggctgcagcccaggcagctcttcgggaagcgtccgcccgtggtctcgccagggggtttccgacctccccgcccgacagcgcaggggcgggggccgcggccggagagctcgcccgagagcaccccctcccgctgcgcctctgggcgcacgcgcagccgctgcagcctcccttatttagtccgcgatggcttccctcgcgccccaccgtcctcttccggaaggcggctccctccctgcgcagcccggagcccctgagatcagcctcgagcaggcgcccgagcgagactatccctaaacgggaacggcggtggccgactcgcgagtgaggaaaagaaggaaagggcagactggtcgcgaagagaagatccaggcctcagaggaggagaaaggccggagccagccgaggtttgccgagggcggtgttccggacccgcgcggtgcggggaggaaggccgagggtgggagaggaggggcccggcggaaactgccgaggtttcccgaaggcggcagcgtccgagttgcccggatgtagttggtggagcggcagccgccgcctgcgcgcccgcccgcctttcgcggccgctctcccccctccccgacacacactcacaggccgggcattgatggtaatgtatgcgaggaaacagcagagactcagtgatggctgtcacgaccggaggggggactcgcagccttaccaggcacttaagtattcatcgaagagtcaccccagtagcggtgatcacagacatgaaaagatgcgagacgccggagatccttcaccaccaaataaaatgttgcggagatctgatagtcctgaaaacaaatacagtgacagcacaggtcacagtaaggccaaaaatgtgcatactcacagagttagagagagggatggtgggaccagttactctccacaagaaaattcacacaaccacagtgctcttcatagttcaaattcacattcttctaatccaagcaataacccaagcaaaacttcagatgcaccttatgattctgcagatgactggtctgagcatattagctcttctgggaaaaagtactactacaattgtcgaacagaagtttcacaatgggaaaaaccaaaagagtggcttgaaagagaacagagacaaaaagaagcaaacaagatggcagtcaacagcttcccaaaagatagggattacagaagagaggtgatgcaagcaacagccactagtgggtttgccagtggaatggaagacaagcattccagtgatgccagtagtttgctcccacagaatattttgtctcaaacaagcagacacaatgacagagactacagactgccaagagcagagactcacagtagttctacgccagtacagcaccccatcaaaccagtggttcatccaactgctaccccaagcactgttccttctagtccatttacgctacagtctgatcaccagccaaagaaatcatttgatgctaatggagcatctactttatcaaaactgcctacacccacatcttctgtccctgcacagaaaacagaaagaaaagaatctacatcaggagacaaacccgtatcacattcttgcacaactccttccacgtcttctgcctctggactgaaccccacatctgcacctccaacatctgcttcagcggtccctgtttctcctgttccacagtcgccaatacctcccttacttcaggacccaaatcttcttagacaattgcttcctgctttgcaagccacgctgcagcttaataattctaatgtggacatatctaaaataaatgaagttcttacagcagctgtgacacaagcctcactgcagtctataattcataagtttcttactgctggaccatctgctttcaacataacgtctctgatttctcaagctgctcagctctctacacaagcccagccatctaatcagtctccgatgtctttaacatctgatgcgtcatccccaagatcatatgtttctccaagaataagcacacctcaaactaacacagtccctatcaaacctttgatcagtactcctcctgtttcatcacagccaaaggttagtactccagtagttaagcaaggaccagtgtcacagtcagccacacagcagcctgtaactgctgacaagcagcaaggtcatgaacctgtctctcctcgaagtcttcagcgctcaaggtaggttgatattgtatattgagaccacattgttttatttaatgatggtacactgcattgtttgaatattatatctgtaaaatagaacttaacctttaaactccatgaataccctaaagtaggcttacatgttgtaaaatttacaaagacaaacctgtatacaagaggtaggttattgtctctagtagtgaagcccgggttattttgaagaaagtggctctttaaaattttacacagtggaatatgacggggctaaagatttgtgatacttgtaccagaaaggcacacgattttacaatatttgttggaattaccttactttttaacctcctcatagcagttttggtttgagtatattgatgaaagccaaagtctggtatctaaaacttgggccaatgtttcccaactggtatatgtcaggctttcccaatagcttaactgtgaccctatacggatggctttttagatagttctatactgctgtattgtgttagcacttttctttgttcattaacaacacaactttaaatgacatttgttgaatgaatggttttcatttgattgattttcctgttttttatttcatgctatgaggtagcaaaataattcaactgttgtttttattgttgttttctaaacaagcatttcagaacttacacctccaaatgagagttgttcccttcaaaataatgaccttgggaagctgtctacttactccagcaatgttgccattgctctgaacatttttgggaaattcttcttttaaattgtttttagaggctgcagtattattttaaatatcctcagtgatgaaaactcttcatcctttgggagatttagtttttggaaataactgaaattcattcagagccaagtctggtgaagcaggtaggagatcaacttgggtgattaaattttttggttctcaccaccatatccccaaccctggcccaaaccattcagttttaaaagaagataaagaatctcagagtgttatttttttggttttgttttgccactgtgcttgttcagtgctatccaataaaatgtctgtattttgcttcacattatttcaccctctgattcagcagttctgacgttgaacaaaggcaatatatattttccccttatctagatgtgtatgagcagtcttcagatgtgcatctacagctgttaaaatgtgactttttttagttatattattagtgtttgtggtacacaaagttaacaggttctgctctcagatttggagagtagtttacatttgactctgacagtagtgttaaaagggttttttccccctaaagtgttttgaggaatcatatactttggattattaattctctttatttgacattaaaataacaaatttttcttaggaatttggatatctttaagttaataaaaggtattaacatgcagtttctaggataaggatacccagaaactacttttaaacatactacacattcaattctgttttctagtagccagagaagtccatcacctggtcccaatcatacttctaatagtagtaatgcatcaaatgcaacagttgtaccacagaattcttctgcccgatccacgtgttcattaacgcctgcactagcagcacacttcagtgaaaatctcataaaacacgttcaaggatggcctgcagatcatgcagagaagcaggcatcaagattacgcgaagaagcgcataacatgggaactattcacatgtccgaaatttgtactgaattaaaaaatttaagatctttagtccgagtatgtgaaattcaagcaactttgcgagagcaaaggatactatttttgagacaacaaattaaggaacttgaaaagctaaaaaatcagaattccttcatggtgtgaagatgtgaataattgcacatggttttgagaacaggaactgtaaatctgttgcccaatcttaacatttttgagctgcatttaagtagactttggaccgttaagctgggcaaaggaaatgacaaggggacggggtctgtgagagtcaattcaggggaaagatacaagattgatttgttttgtagagtgaagccatgggaagccatgtgtaacagagcttagacatccaaaactaatcaatgctgaggtggctaaatacctagccttttacatgtaaacctgtctgcaaaattagcttttttaaaaaaaaaaaaaaaaaaattgggggggttaatttatcattcagaaatcttgcattttcaaaaattcagtgcaagcgccaggcgatttgtgtctaaggatacgattttgaaccatatgggcagtgtacaaaatatgaaacaactgtttccacacttgcacctgatcaagagcagtgcttctccatttgttttgcagagaaatgtttttcatttcccgtgtgtttccatttccttctgaaattctgattttatccatttttttaaggctcctctttatctcctttcttaaggcactgttgctatggcacttttctataaccttttcattcctgtgtacagtagcttaaaattgcagtgattgagcataacctacttgtttgtataaattattgaaatccatttgcaccctgtaagaatggacttaaaagtactgctggacaggcatgtgtgctcaaagtacattgattgctcaaatataaggaaatggcccaatgaacgtggttgtgggaggggaaagaggaaacagagctagtcagatgtgaattgtatctgttgtaataaacatgttaaaacaaacaaaaattgttatttttcttttccttcggtcagtgcacattagcatttgaactacctggggattctttatcagaactgttcttgttgaatatttatacttaattgaaataattccttaagggaggttttgtttaaaacgtattaacaggaaattgtgtatgagatatttaatgaaataagaaattcaacaagaatgattaagtcacttcccaagtggttgtcatttgttaaaccctggtttacctgtcttgctattatgacatttcatttggaaggatgtttgtgttgtagctaactgttcaagtctggtgctgactgctgttcttagccatcacaaaacgctaaatttgtgtaattggagcttcctgctgttatctggaaatagcaggaaagcgcagctttgtatattgtttcctaaagtatattaaaataaaaaaagaaactattgctactat

SEQ ID NO: 365304 - DNA, 2760 bp, Homo sapiens
agggccggtggcgcgcggcgtccggtgaggggcagcggcccgggctcggttccggcttccagcagcggcccgaaggcgccggagcacgctccccgctccccagaacgcagcttccgcggctgcagcccaggcagctcttcgggaagcgtccgcccgtggtctcgccagggggtttccgacctccccgcccgacagcgcaggggcgggggccgcggccggagagctcgcccgagagcaccccctcccgctgcgcctctgggcgcacgcgcagccgctgcagcctcccttatttagtccgcgatggcttccctcgcgccccaccgtcctcttccggaaggcggctccctccctgcgcagcccggagcccctgagatcagcctcgagcaggcgcccgagcgagactatccctaaacgggaacggcggtggccgactcgcgagtgaggaaaagaaggaaagggcagactggtcgcgaagagaagatccaggcctcagaggaggagaaaggccggagccagccgaggtttgccgagggcggtgttccggacccgcgcggtgcggggaggaaggccgagggtgggagaggaggggcccggcggaaactgccgaggtttcccgaaggcggcagcgtccgagttgcccggatgtagttggtggagcggcagccgccgcctgcgcgcccgcccgcctttcgcggccgctctcccccctccccgacacacactcacaggccgggcattgatggtaatgtatgcgaggaaacagcagagactcagtgatggctgtcacgaccggaggggggactcgcagccttaccaggcacttaagtattcatcgaagagtcaccccagtagcggtgatcacagacatgaaaagatgcgagacgccggagatccttcaccaccaaataaaatgttgcggagatctgatagtcctgaaaacaaatacagtgacagcacaggtcacagtaaggccaaaaatgtgcatactcacagagttagagagagggatggtgggaccagttactctccacaagaaaattcacacaaccacagtgctcttcatagttcaaattcacattcttctaatccaagcaataacccaagcaaaacttcagatgcaccttatgattctgcagatgactggtctgagcatattagctcttctgggaaaaagtactactacaattgtcgaacagaagtttcacaatgggaaaaaccaaaagagtggcttgaaagagaacagagacaaaaagaagcaaacaagatggcagtcaacagcttcccaaaagatagggattacagaagagaggtgatgcaagcaacagccactagtgggtttgccagtggaatggaagacaagcattccagtgatgccagtagtttgctcccacagaatattttgtctcaaacaagcagacacaatgacagagactacagactgccaagagcagagactcacagtagttctacgccagtacagcaccccatcaaaccagtggttcatccaactgctaccccaagcactgttccttctagtccatttacgctacagtctgatcaccagccaaagaaatcatttgatgctaatggagcatctactttatcaaaactgcctacacccacatcttctgtccctgcacagaaaacagaaagaaaagaatctacatcaggagacaaacccgtatcacattcttgcacaactccttccacgtcttctgcctctggactgaaccccacatctgcacctccaacatctgcttcagcggtccctgtttctcctgttccacagtcgccaatacctcccttacttcaggacccaaatcttcttagacaattgcttcctgctttgcaagccacgctgcagcttaataattctaatgtggacatatctaaaataaatgaagttcttacagcagctgtgacacaagcctcactgcagtctataattcataagtttcttactgctggaccatctgctttcaacataacgtctctgatttctcaagctgctcagctctctacacaagcccagccatctaatcagtctccgatgtctttaacatctgatgcgtcatccccaagatcatatgtttctccaagaataagcacacctcaaattttaaaatgtcgtggtattgtaacaatatatttgatgaaagaaggttacagactcccctgaagaaccagctttcctacgctttttatttttctaacttgtctaacctgattttaaaatgactgcaattccagactaaaaacatgcttcagccctgtttcaagacattatgcttcttttaacagtccaaattagtagttttatttttcttctaaatctttgtttcacacttgtaaaatcttgggaaggaggttcttaaaactttgccaggaattgttacccatttccaaaaacagtttattatgttcaaaaaccaccatatctttgagggactgtttgaaaggggagagggcaacgcgggaaataattcactctgcgcaccggaactattgtagttcaggacttccagctactgtatttagatgttgggtttgaatatacagatttcttttcaatacctgtaaatatggctatattcttgtatttgtacgggagtgtacaaaatgacactgaaaagtaataaatatgttttgactatattgtgcagttatttcagaactgtgttttgaaagtcttagaatgcataatttgcatttgagtaaggaaatttaaaatacagattactgctgagattttaatcagtc

SEQ ID NO: 365305 - DNA, 2231 bp, Homo sapiens
agggccggtggcgcgcggcgtccggtgaggggcagcggcccgggctcggttccggcttccagcagcggcccgaaggcgccggagcacgctccccgctccccagaacgcagcttccgcggctgcagcccaggcagctcttcgggaagcgtccgcccgtggtctcgccagggggtttccgacctccccgcccgacagcgcaggggcgggggccgcggccggagagctcgcccgagagcaccccctcccgctgcgcctctgggcgcacgcgcagccgctgcagcctcccttatttagtccgcgatggcttccctcgcgccccaccgtcctcttccggaaggcggctccctccctgcgcagcccggagcccctgagatcagcctcgagcaggcgcccgagcgagactatccctaaacgggaacggcggtggccgactcgcgagtgaggaaaagaaggaaagggcagactggtcgcgaagagaagatccaggcctcagaggaggagaaaggccggagccagccgaggtttgccgagggcggtgttccggacccgcgcggtgcggggaggaaggccgagggtgggagaggaggggcccggcggaaactgccgaggtttcccgaaggcggcagcgtccgagttgcccggatgtagttggtggagcggcagccgccgcctgcgcgcccgcccgcctttcgcggccgctctcccccctccccgacacacactcacaggccgggcattgatggtaatgtatgcgaggaaacagcagagactcagtgatggctgtcacgaccggaggggggactcgcagccttaccaggcacttaagtattcatcgaagagtcaccccagtagcggtgatcacagacatgaaaagatgcgagacgccggagatccttcaccaccaaataaaatgttgcggagatctgatagtcctgaaaacaaatacagtgacagcacaggtcacagtaaggccaaaaatgtgcatactcacagagttagagagagggatggtgggaccagttactctccacaagaaaattcacacaaccacagtgctcttcatagttcaaattcacattcttctaatccaagcaataacccaagcaaaacttcagatgcaccttatgattctgcagatgactggtctgagcatattagctcttctgggaaaaagtactactacaattgtcgaacagaagtttcacaatgggaaaaaccaaaagagtggcttgaaagagaacagagacaaaaagaagcaaacaagatggcagtcaacagcttcccaaaagatagggattacagaagagaggtgatgcaagcaacagccactagtgggtttgccagtggaatggaagacaagcattccagtgatgccagtagtttgctcccacagaatattttgtctcaaacaagcagacacaatgacagagactacagactgccaagagcagagactcacagtagttctacgccagtacagcaccccatcaaaccagtggttcatccaactgctaccccaagcactgttccttctagtccatttacgctacagtctgatcaccagccaaagaaatcatttgatgctaatggagcatctactttatcaaaactgcctacacccacatcttctgtccctgcacagaaaacagaaagaaaagaatctacatcaggagacaaacccgtatcacattcttgcacaactccttccacgtcttctgcctctggactgaaccccacatctgcacctccaacatctgcttcagcggtccctgtttctcctgttccacagtcgccaatacctcccttacttcaggacccaaatcttcttagacaattgcttcctgctttgcaagccacgctgcagcttaataattctaatgtggacatatctaaaataaatgaagttcttacagcagctgtgacacaagcctcactgcagtctataattcataagtttcttactgctggaccatctgctttcaacataacgtctctgatttctcaagctgctcagctctctacacaagcccagccatctaatcagtctccgatgtctttaacatctgatgcgtcatccccaagatcatatgtttctccaagaataagcacacctcaaactaacacagtccctatcaaacctttgatcagtactcctcctgtttcatcacagccaaagagtactccagcctgggtgacacagtgagaccccatctcaaaaaaaaaaaaaaaac

SEQ ID NO: 365306 - DNA, 2210 bp, Homo sapiens
agggccggtggcgcgcggcgtccggtgaggggcagcggcccgggctcggttccggcttccagcagcggcccgaaggcgccggagcacgctccccgctccccagaacgcagcttccgcggctgcagcccaggcagctcttcgggaagcgtccgcccgtggtctcgccagggggtttccgacctccccgcccgacagcgcaggggcgggggccgcggccggagagctcgcccgagagcaccccctcccgctgcgcctctgggcgcacgcgcagccgctgcagcctcccttatttagtccgcgatggcttccctcgcgccccaccgtcctcttccggaaggcggctccctccctgcgcagcccggagcccctgagatcagcctcgagcaggcgcccgagcgagactatccctaaacgggaacggcggtggccgactcgcgagtgaggaaaagaaggaaagggcagactggtcgcgaagagaagatccaggcctcagaggaggagaaaggccggagccagccgaggtttgccgagggcggtgttccggacccgcgcggtgcggggaggaaggccgagggtgggagaggaggggcccggcggaaactgccgaggtttcccgaaggcggcagcgtccgagttgcccggatgtagttggtggagcggcagccgccgcctgcgcgcccgcccgcctttcgcggccgctctcccccctccccgacacacactcacaggccgggcattgatggtaatgtatgcgaggaaacagcagagactcagtgatggctgtcacgaccggaggggggactcgcagccttaccaggcacttaagtattcatcgaagagtcaccccagtagcggtgatcacagacatgaaaagatgcgagacgccggagatccttcaccaccaaataaaatgttgcggagatctgatagtcctgaaaacaaatacagtgacagcacaggtcacagtaaggccaaaaatgtgcatactcacagagttagagagagggatggtgggaccagttactctccacaagaaaattcacacaaccacagtgctcttcatagttcaaattcacattcttctaatccaagcaataacccaagcaaaacttcagatgcaccttatgattctgcagatgactggtctgagcatattagctcttctgggaaaaagtactactacaattgtcgaacagaagtttcacaatgggaaaaaccaaaagagtggcttgaaagagaacagagacaaaaagaagcaaacaagatggcagtcaacagcttcccaaaagatagggattacagaagagaggtgatgcaagcaacagccactagtgggtttgccagtggaatggaagacaagcattccagtgatgccagtagtttgctcccacagaatattttgtctcaaacaagcagacacaatgacagagactacagactgccaagagcagagactcacagtagttctacgccagtacagcaccccatcaaaccagtggttcatccaactgctaccccaagcactgttccttctagtccatttacgctacagtctgatcaccagccaaagaaatcatttgatgctaatggagcatctactttatcaaaactgcctacacccacatcttctgtccctgcacagaaaacagaaagaaaagaatctacatcaggagacaaacccgtatcacattcttgcacaactccttccacgtcttctgcctctggactgaaccccacatctgcacctccaacatctgcttcagcggtccctgtttctcctgttccacagtcgccaatacctcccttacttcaggacccaaatcttcttagacaattgcttcctgctttgcaagccacgctgcagcttaataattctaatgtggacatatctaaaataaatgaagaaggtaaatcttcataacagttttttaaaaatttatttgcattgtgcaaagttatgtaagtagtaaaatccccagtttaggaatggtctttgttttcttttgaaatttatagttgaacacttttttttgttttgttttttgtttttggagtttggaaatttatatccactgtagtttaagaccattggtagtataattgagttagtggtgcttggatcttgtgtatatttttcaatacttgttatgtgcagtatttgtttttgttgtcttgttgagaaatatccactgtgcaacccacccttggtt

SEQ ID NO: 365307 - DNA, 2301 bp, Homo sapiens
agggccggtggcgcgcggcgtccggtgaggggcagcggcccgggctcggttccggcttccagcagcggcccgaaggcgccggagcacgctccccgctccccagaacgcagcttccgcggctgcagcccaggcagctcttcgggaagcgtccgcccgtggtctcgccagggggtttccgacctccccgcccgacagcgcaggggcgggggccgcggccggagagctcgcccgagagcaccccctcccgctgcgcctctgggcgcacgcgcagccgctgcagcctcccttatttagtccgcgatggcttccctcgcgccccaccgtcctcttccggaaggcggctccctccctgcgcagcccggagcccctgagatcagcctcgagcaggcgcccgagcgagactatccctaaacgggaacggcggtggccgactcgcgagtgaggaaaagaaggaaagggcagactggtcgcgaagagaagatccaggcctcagaggaggagaaaggccggagccagccgaggtttgccgagggcggtgttccggacccgcgcggtgcggggaggaaggccgagggtgggagaggaggggcccggcggaaactgccgaggtttcccgaaggcggcagcgtccgagttgcccggatgtagttggtggagcggcagccgccgcctgcgcgcccgcccgcctttcgcggccgctctcccccctccccgacacacactcacaggccgggcattgatggtaatgtatgcgaggaaacagcagagactcagtgatggctgtcacgaccggaggggggactcgcagccttaccaggcacttaagtattcatcgaagagtcaccccagtagcggtgatcacagacatgaaaagatgcgagacgccggagatccttcaccaccaaataaaatgttgcggagatctgatagtcctgaaaacaaatacagtgacagcacaggtcacagtaaggccaaaaatgtgcatactcacagagttagagagagggatggtgggaccagttactctccacaagaaaattcacacaaccacagtgctcttcatagttcaaattcacattcttctaatccaagcaataacccaagcaaaacttcagatgcaatgtatccttcacgttgtaaatatgttttgtagagtgaagccatgggaagccatgtgtaacagagcttagacatccaaaactaatcaatgctgaggtggctaaatacctagccttttacatgtaaacctgtctgcaaaattagcttttttaaaaaaaaaaaaaaaaaaattgggggggttaatttatcattcagaaatcttgcattttcaaaaattcagtgcaagcgccaggcgatttgtgtctaaggatacgattttgaaccatatgggcagtgtacaaaatatgaaacaactgtttccacacttgcacctgatcaagagcagtgcttctccatttgttttgcagagaaatgtttttcatttcccgtgtgtttccatttccttctgaaattctgattttatccatttttttaaggctcctctttatctcctttcttaaggcactgttgctatggcacttttctataaccttttcattcctgtgtacagtagcttaaaattgcagtgattgagcataacctacttgtttgtataaattattgaaatccatttgcaccctgtaagaatggacttaaaagtactgctggacaggcatgtgtgctcaaagtacattgattgctcaaatataaggaaatggcccaatgaacgtggttgtgggaggggaaagaggaaacagagctagtcagatgtgaattgtatctgttgtaataaacatgttaaaacaaacaaaaattgttatttttcttttccttcggtcagtgcacattagcatttgaactacctggggattctttatcagaactgttcttgttgaatatttatacttaattgaaataattccttaagggaggttttgtttaaaacgtattaacaggaaattgtgtatgagatatttaatgaaataagaaattcaacaagaatgattaagtcacttcccaagtggttgtcatttgttaaaccctggtttacctgtcttgctattatgacatttcatttggaaggatgtttgtgttgtagctaactgttcaagtctggtgctgactgctgttcttagccatcacaaaacgctaaatttgtgtaattggagcttcctgctgttatctggaaatagcaggaaagcgcagctttgtatattgtttcctaaagtatattaaaataaaaaaagaaactattgctactat

SEQ ID NO: 365308 - DNA, 1643 bp, Homo sapiens
agggccggtggcgcgcggcgtccggtgaggggcagcggcccgggctcggttccggcttccagcagcggcccgaaggcgccggagcacgctccccgctccccagaacgcagcttccgcggctgcagcccaggcagctcttcgggaagcgtccgcccgtggtctcgccagggggtttccgacctccccgcccgacagcgcaggggcgggggccgcggccggagagctcgcccgagagcaccccctcccgctgcgcctctgggcgcacgcgcagccgctgcagcctcccttatttagtccgcgatggcttccctcgcgccccaccgtcctcttccggaaggcggctccctccctgcgcagcccggagcccctgagatcagcctcgagcaggcgcccgagcgagactatccctaaacgggaacggcggtggccgactcgcgagtgaggaaaagaaggaaagggcagactggtcgcgaagagaagatccaggcctcagaggaggagaaaggccggagccagccgaggtttgccgagggcggtgttccggacccgcgcggtgcggggaggaaggccgagggtgggagaggaggggcccggcggaaactgccgaggtttcccgaaggcggcagcgtccgagttgcccggatgtagttggtggagcggcagccgccgcctgcgcgcccgcccgcctttcgcggccgctctcccccctccccgacacacactcacaggccgggcattgatggtaatgtatgcgaggaaacagcagagactcagtgatggctgtcacgaccggaggggggactcgcagccttaccaggcacttaagtattcatcgaagagtcaccccagtagcggtgatcacagacatgaaaagatgcgagacgccggagatccttcaccaccaaataaaatgttgcggagatctgatagtcctgaaaacaaatacagtgacagcacaggtcacagtaaggccaaaaatgtgcatactcacagagttagagagagggatggtgggaccagttactctccacaagaaaattcacacaaccacagtgctcttcatagttcaaattcacattcttctaatccaagcaataacccaagcaaaacttcagatgcaccttatgattctgcagatgactggtctgagcatattagctcttctgggaaaaagtactactacaattgtcgaacagaagtttcacaatgggaaaaaccaaaagagtggcttgaaagagaacagagacaaaaagaagcaaacaagatggcagtcaacagcttcccaaaagatagggattacagaagagaggtgatgcaagcaacagccactagtgggtttgccagtggaatggaagacaagcattccagtgatgccagtagtttgctcccacagaatattttgtctcaaacaagcagacacaatgacagagactacagactgccaagagcagagactcacagtagttctacgccagtacagcaccccatcaaaccagtggttcatccaactgctaccccaatacaggagcacccagtccttagagacctacaaagagacttagactgccacacaataataatgggacattccactgtcaacattagacacatcaacgagacagataggtaacaacgctatccag

SEQ ID NO: 365309 - DNA, 2353 bp, Homo sapiens
agggccggtggcgcgcggcgtccggtgaggggcagcggcccgggctcggttccggcttccagcagcggcccgaaggcgccggagcacgctccccgctccccagaacgcagcttccgcggctgcagcccaggcagctcttcgggaagcgtccgcccgtggtctcgccagggggtttccgacctccccgcccgacagcgcaggggcgggggccgcggccggagagctcgcccgagagcaccccctcccgctgcgcctctgggcgcacgcgcagccgctgcagcctcccttatttagtccgcgatggcttccctcgcgccccaccgtcctcttccggaaggcggctccctccctgcgcagcccggagcccctgagatcagcctcgagcaggcgcccgagcgagactatccctaaacgggaacggcggtggccgactcgcgagtgaggaaaagaaggaaagggcagactggtcgcgaagagaagatccaggcctcagaggaggagaaaggccggagccagccgaggtttgccgagggcggtgttccggacccgcgcggtgcggggaggaaggccgagggtgggagaggaggggcccggcggaaactgccgaggtttcccgaaggcggcagcgtccgagttgcccggatgtagttggtggagcggcagccgccgcctgcgcgcccgcccgcctttcgcggccgctctcccccctccccgacacacactcacaggccgggcattgatggtaatgtatgcgaggaaacagcagagactcagtgatggctgtcacgaccggaggggggactcgcagccttaccaggcacttaagtattcatcgaagagtcaccccagtagcggtgatcacagacatgaaaagatgcgagacgccggagatccttcaccaccaaataaaatgttgcggagatctgatagtcctgaaaacaaatacagtgacagcacaggtcacagtaaggccaaaaatgtgcatactcacagagttagagagagggatggtgggaccagttactctccacaagaaaattcacacaaccacagtgctcttcatagttcaaattcacattcttctaatccaagcaataacccaagcaaaacttcagatgcaccttatgattctgcagatgactggtctgagcatattagctcttctgggaaaaagtactactacaattgtcgaacagaagtttcacaatgggaaaaaccaaaagagtggcttgaaagagaacagagacaaaaagaagcaaacaagatggcagtcaacagcttcccaaaagatagggattacagaagagaggtgatgcaagcaacagccactagtgggtttgccagtggaagtaagtattaattttttttctttgaaatgtatgtttgacttattcgtatttatttttcaaatctgtatccattgccatctacatatgtaaattaaaataaatagaaacatacggagattcttttatgttggatttattataccctccaccattttggtccctgaaaagggaaaagatacacggtcgagtagtacaggtatgtgtttcccactacacattatggctataatggagttgaattgcaaacagtaaaattttgttttggattggtttcccctgatccccccagacaggagcttcctctcccaccctacctgcctgcccttaagttgtgtcctattaaactggacacaaatctcaccggcttttagtctaataattgaatcatagctacacacagtgacaccagaatagctacttgtttttttatgttaccagtgagtaacttgtttatccttgtatgtagaaactaatttcaccatgatcacagatctgtgtaacatctctagtttgaatttccacacaattttaaaatgtctactagaaaacttacacctttttgttccaaggtgctcttcatctataaaaccgtgggcatacttcagtgttcttctgaggccaaattttgtgctcgtgggacaattttgtataacatacatttattttgtaattcattctccaaatttgaagctttattaaaggtattctatttccactggcttcccttaacttgaataaaatttactcccagtgccgtggctcatgcctgctgcaatcccagccctttgggaggccgaggcaggaggatggcttgaggccaagagtttgagaccggcctgtgcaacatggcgagacccagtgtccacagaattaaaaattaaccacgcagctgtaatcccagccacttgggaggctgaggcaagaagatgacttgagccctggcatttggctatgatcttgccactgcactctagcctggcaacagagtcagactctgtctcaaa

SEQ ID NO: 365310 - DNA, 1180 bp, Homo sapiens
agggccggtggcgcgcggcgtccggtgaggggcagcggcccgggctcggttccggcttccagcagcggcccgaaggcgccggagcacgctccccgctccccagaacgcagcttccgcggctgcagcccaggcagctcttcgggaagcgtccgcccgtggtctcgccagggggtttccgacctccccgcccgacagcgcaggggcgggggccgcggccggagagctcgcccgagagcaccccctcccgctgcgcctctgggcgcacgcgcagccgctgcagcctcccttatttagtccgcgatggcttccctcgcgccccaccgtcctcttccggaaggcggctccctccctgcgcagcccggagcccctgagatcagcctcgagcaggcgcccgagcgagactatccctaaacgggaacggcggtggccgactcgcgagtgaggaaaagaaggaaagggcagactggtcgcgaagagaagatccaggcctcagaggaggagaaaggccggagccagccgaggtttgccgagggcggtgttccggacccgcgcggtgcggggaggaaggccgagggtgggagaggaggggcccggcggaaactgccgaggtttcccgaaggcggcagcgtccgagttgcccggatgtagttggtggagcggcagccgccgcctgcgcgcccgcccgcctttcgcggccgctctcccccctccccgacacacactcacaggccgggcattgatggtaatgtatgcgaggaaacagcagagactcagtgatggctgtcacgaccggaggggggactcgcagccttaccaggcacttaagtattcatcgaagagtcaccccagtagcggtgatcacagacatgaaaagatgcgagacgccggagatccttcaccaccaaataaaatgttgcggagatctgatagtcctgaaaacaaatacagtgacagcacaggtcacagtaaggccaaaaatgtgcatactcacagagttagagagagggatggtgggaccagttactctccacaagaaaattcacacaaccacagtgctcttcatagttcaaattcacattcttctaatccaagcaataacccaagcaaaacttcagatgcaagtaagtattataaacatgtccaatatggtttctttggaattttttgcaaaaaaaaaaaa

SEQ ID NO: 365311 - DNA, 296 bp, Homo sapiens
tcatgtgaatgtttactgagcatcttctgtgtgctccagtgtgtaagggttaaatgagattacttacgttaggtgcctggcacatgagaggtgttcctttgatgtttgttccaattttctctattcaggtaatttttcaggctgattatctttttatttagaatctacatcaggagacaaacccgtatcacattcttgcacaactccttccacgtcttctgcctctggactgaaccccacatctgcacctccaacatctgcttcagcggtccctgtttctcctgttccacagtcgc

SEQ ID NO: 365312 - DNA, 4181 bp, Homo sapiens
agggccggtggcgcgcggcgtccggtgaggggcagcggcccgggctcggttccggcttccagcagcggcccgaaggcgccggagcacgctccccgctccccagaacgcagcttccgcggctgcagcccaggcagctcttcgggaagcgtccgcccgtggtctcgccagggggtttccgacctccccgcccgacagcgcaggggcgggggccgcggccggagagctcgcccgagagcaccccctcccgctgcgcctctgggcgcacgcgcagccgctgcagcctcccttatttagtccgcgatggcttccctcgcgccccaccgtcctcttccggaaggcggctccctccctgcgcagcccggagcccctgagatcagcctcgagcaggcgcccgagcgagactatccctaaacgggaacggcggtggccgactcgcgagtgaggaaaagaaggaaagggcagactggtcgcgaagagaagatccaggcctcagaggaggagaaaggccggagccagccgaggtttgccgagggcggtgttccggacccgcgcggtgcggggaggaaggccgagggtgggagaggaggggcccggcggaaactgccgaggtttcccgaaggcggcagcgtccgagttgcccggatgtagttggtggagcggcagccgccgcctgcgcgcccgcccgcctttcgcggccgctctcccccctccccgacacacactcacaggccgggcattgatggtaatgtatgcgaggaaacagcagagactcagtgatggctgtcacgaccggaggggggactcgcagccttaccaggtgactggagggagttcgctgatttaggaaaaaagaatcatttgcagccagaaagacctgactcgattatttgattatttgcgagtgaaggaatcgatgggatgagatgataggcacttaagtattcatcgaagagtcaccccagtagcggtgatcacagacatgaaaagatgcgagacgccggagatccttcaccaccaaataaaatgttgcggagatctgatagtcctgaaaacaaatacagtgacagcacaggtcacagtaaggccaaaaatgtgcatactcacagagttagagagagggatggtgggaccagttactctccacaagaaaattcacacaaccacagtgctcttcatagttcaaattcacattcttctaatccaagcaataacccaagcaaaacttcagatgcaccttatgattctgcagatgactggtctgagcatattagctcttctgggaaaaagtactactacaattgtcgaacagaagtttcacaatgggaaaaaccaaaagagtggcttgaaagagaacagagacaaaaagaagcaaacaagatggcagtcaacagcttcccaaaagatagggattacagaagagaggtgatgcaagcaacagccactagtgggtttgccagtggaatggaagacaagcattccagtgatgccagtagtttgctcccacagaatattttgtctcaaacaagcagacacaatgacagagactacagactgccaagagcagagactcacagtagttctacgccagtacagcaccccatcaaaccagtggttcatccaactgctaccccaagcactgttccttctagtccatttacgctacagtctgatcaccagccaaagaaatcatttgatgctaatggagcatctactttatcaaaactgcctacacccacatcttctgtccctgcacagaaaacagaaagaaaagaatctacatcaggagacaaacccgtatcacattcttgcacaactccttccacgtcttctgcctctggactgaaccccacatctgcacctccaacatctgcttcagcggtccctgtttctcctgttccacagtcgccaatacctcccttacttcaggacccaaatcttcttagacaattgcttcctgctttgcaagccacgctgcagcttaataattctaatgtggacatatctaaaataaatgaagttcttacagcagctgtgacacaagcctcactgcagtctataattcataagtttcttactgctggaccatctgctttcaacataacgtctctgatttctcaagctgctcagctctctacacaagcccagccatctaatcagtctccgatgtctttaacatctgatgcgtcatccccaagatcatatgtttctccaagaataagcacacctcaaactaacacagtccctatcaaacctttgatcagtactcctcctgtttcatcacagccaaaggttagtactccagtagttaagcaaggaccagtgtcacagtcagccacacagcagcctgtaactgctgacaagcagcaaggtcatgaacctgtctctcctcgaagtcttcagcgctcaagtagccagagaagtccatcacctggtcccaatcatacttctaatagtagtaatgcatcaaatgcaacagttgtaccacagaattcttctgcccgatccacgtgttcattaacgcctgcactagcagcacacttcagtgaaaatctcataaaacacgttcaaggatggcctgcagatcatgcagagaagcaggcatcaagattacgcgaagaagcgcataacatgggaactattcacatgtccgaaatttgtactgaattaaaaaatttaagatctttagtccgagtatgtgaaattcaagcaactttgcgagagcaaaggatactatttttgagacaacaaattaaggaacttgaaaagctaaaaaatcagaattccttcatggtgtgaagatgtgaataattgcacatggttttgagaacaggaactgtaaatctgttgcccaatcttaacatttttgagctgcatttaagtagactttggaccgttaagctgggcaaaggaaatgacaaggggacggggtctgtgagagtcaattcaggggaaagatacaagattgatttgtaaaacccttgaaatgtagatttcttgtagatgtatccttcacgttgtaaatatgttttgtagagtgaagccatgggaagccatgtgtaacagagcttagacatccaaaactaatcaatgctgaggtggctaaatacctagccttttacatgtaaacctgtctgcaaaattagcttttttaaaaaaaaaaaaaaaaaaattgggggggttaatttatcattcagaaatcttgcattttcaaaaattcagtgcaagcgccaggcgatttgtgtctaaggatacgattttgaaccatatgggcagtgtacaaaatatgaaacaactgtttccacacttgcacctgatcaagagcagtgcttctccatttgttttgcagagaaatgtttttcatttcccgtgtgtttccatttccttctgaaattctgattttatccatttttttaaggctcctctttatctcctttcttaaggcactgttgctatggcacttttctataaccttttcattcctgtgtacagtagcttaaaattgcagtgattgagcataacctacttgtttgtataaattattgaaatccatttgcaccctgtaagaatggacttaaaagtactgctggacaggcatgtgtgctcaaagtacattgattgctcaaatataaggaaatggcccaatgaacgtggttgtgggaggggaaagaggaaacagagctagtcagatgtgaattgtatctgttgtaataaacatgttaaaacaaacaaaaattgttatttttcttttccttcggtcagtgcacattagcatttgaactacctggggattctttatcagaactgttcttgttgaatatttatacttaattgaaataattccttaagggaggttttgtttaaaacgtattaacaggaaattgtgtatgagatatttaatgaaataagaaattcaacaagaatgattaagtcacttcccaagtggttgtcatttgttaaaccctggtttacctgtcttgctattatgacatttcatttggaaggatgtttgtgttgtagctaactgttcaagtctggtgctgactgctgttcttagccatcacaaaacgctaaatttgtgtaattggagcttcctgctgttatctggaaatagcaggaaagcgcagctttgtatattgtttcctaaagtatattaaaataaaaaaagaaactattgctactat

SEQ ID NO: 365313 - DNA, 4177 bp, Homo sapiens
agggccggtggcgcgcggcgtccggtgaggggcagcggcccgggctcggttccggcttccagcagcggcccgaaggcgccggagcacgctccccgctccccagaacgcagcttccgcggctgcagcccaggcagctcttcgggaagcgtccgcccgtggtctcgccagggggtttccgacctccccgcccgacagcgcaggggcgggggccgcggccggagagctcgcccgagagcaccccctcccgctgcgcctctgggcgcacgcgcagccgctgcagcctcccttatttagtccgcgatggcttccctcgcgccccaccgtcctcttccggaaggcggctccctccctgcgcagcccggagcccctgagatcagcctcgagcaggcgcccgagcgagactatccctaaacgggaacggcggtggccgactcgcgagtgaggaaaagaaggaaagggcagactggtcgcgaagagaagatccaggcctcagaggaggagaaaggccggagccagccgaggtttgccgagggcggtgttccggacccgcgcggtgcggggaggaaggccgagggtgggagaggaggggcccggcggaaactgccgaggtttcccgaaggcggcagcgtccgagttgcccggatgtagttggtggagcggcagccgccgcctgcgcgcccgcccgcctttcgcggccgctctcccccctccccgacacacactcacaggccgggcattgatggtaatgtatgcgaggaaacagcagagactcagtgatggctgtcacgaccggaggggggactcgcagccttaccaggcacttaagtattcatcgaagagtcaccccagtagcggtgatcacagacatgaaaagatgcgagacgccggagatccttcaccaccaaataaaatgttgcggagatctgatagtcctgaaaacaaatacagtgacagcacaggtcacagtaaggccaaaaatgtgcatactcacagagttagagagagggatggtgggaccagttactctccacaagaaaattcacacaaccacagtgctcttcatagttcaaattcacattcttctaatccaagcaataacccaagcaaaacttcagatgcaccttatgattctgcagatgactggtctgagcatattagctcttctgggaaaaagtactactacaattgtcgaacagaagtttcacaatgggaaaaaccaaaagagtggcttgaaagagaacagagacaaaaagaagcaaacaagatggcagtcaacagcttcccaaaagatagggattacagaagagaggtgatgcaagcaacagccactagtgggtttgccagtggaatggaagacaagcattccagtgatgccagtagtttgctcccacagaatattttgtctcaaacaagcagacacaatgacagagactacagactgccaagagcagagactcacagtagttctacgccagtacagcaccccatcaaaccagtggttcatccaactgctaccccaagcactgttccttctagtccatttacgctacagtctgatcaccagccaaagaaatcatttgatgctaatggagcatctactttatcaaaactgcctacacccacatcttctgtccctgcacagaaaacagaaagaaaagaatctacatcaggagacaaacccgtatcacattcttgcacaactccttccacgtcttctgcctctggactgaaccccacatctgcacctccaacatctgcttcagcggtccctgtttctcctgttccacagtcgccaatacctcccttacttcaggacccaaatcttcttagacaattgcttcctgctttgcaagccacgctgcagcttaataattctaatgtggacatatctaaaataaatgaagttcttacagcagctgtgacacaagcctcactgcagtctataattcataagtttcttactgctggaccatctgctttcaacataacgtctctgatttctcaagctgctcagctctctacacaagcccagccatctaatcagtctccgatgtctttaacatctgatgcgtcatccccaagatcatatgtttctccaagaataagcacacctcaaactaacacagtccctatcaaacctttgatcagtactcctcctgtttcatcacagccaaaggttagtactccagtagttaagcaaggaccagtgtcacagtcagccacacagcagcctgtaactgctgacaagcagcaaggtcatgaacctgtctctcctcgaagtcttcagcgctcaagtagccagagaagtccatcacctggtcccaatcatacttctaatagtagtaatgcatcaaatgcaacagttgtaccacagaattcttctgcccgatccacgtgttcattaacgcctgcactagcagcacacttcagtgaaaatctcataaaacacgttcaaggatggcctgcagatcatgcagagaagcaggcatcaagattacgcgaagaagcgcataacatgggaactattcacatgtccgaaatttgtactgaattaaaaaatttaagatctttagtccgagtatgtgaaattcaagcaactttgcgagagcaaaggatactatttttgagacaacaaattaaggaacttgaaaagctaaaaaatcagaattccttcatggtgtgaagatgtgaataattgcacatggttttgagaacaggaactgtaaatctgttgcccaatcttaacatttttgagctgcatttaagtagactttggaccgttaagctgggcaaaggaaatgacaaggggacggggtctgtgagagtcaattcaggggaaagatacaagattgatttgtaaaacccttgaaatgtagatttcttgtagatgtatccttcacgttgtaaatatgttttgtagagtgaagccatgggaagccatgtgtaacagagcttagacatccaaaactaatcaatgctgaggtggctaaatacctagccttttacatgtaaacctgtctgcaaaattagcttttttaaaaaaaaaaaaaaaaaaattgggggggttaatttatcattcagaaatcttgcattttcaaaaattcagtgcaagcgccaggcgatttgtgtctaaggatacgattttgaaccatatgggcagtgtacaaaatatgaaacaactgtttccacacttgcacctgatcaagagcagtgcttctccatttgttttgcagagaaatgtttttcatttcccgtgtgtttccatttccttctgaaattctgattttatccatttttttaaggctcctctttatctcctttcttaaggcactgttgctatggcacttttctataaccttttcattcctgtgtacagtagcttaaaattgcagtgattgagcataacctacttgtttgtataaattattgaaatccatttgcaccctgtaagaatggacttaaaagtactgctggacaggcatgtgtgctcaaagtacattgattgctcaaatataaggaaatggcccaatgaacgtggttgtgggaggggaaagaggaaacagagctagtcagatgtgaattgtatctgttgtaataaacatgttaaaacaaacaaaaattgttatttttcttttccttcggtcagtgcacattagcatttgaactacctggggattctttatcagaactgttcttgttgaatatttatacttaattgaaataattccttaagggaggttttgtttaaaacgtattaacaggaaattgtgtatgagatatttaatgaaataagaaattcaacaagaatgattaagtcacttcccaagtggttgtcatttgttaaaccctggtttacctgtcttgctattatgacatttcatttggaaggatgtttgtgttgtagctaactgttcaagtctggtgctgactgctgttcttagccatcacaaaacgctaaatttgtgtaattggagcttcctgctgttatctggaaatagcaggaaagcgcagctttgtatattgtttcctaaagtatattaaaataaaaaaagaaactattgctactataaaattaccttgactttttttttcctttgctgaaatattagtcacatagccttagcttcacactgccagtaatgtatcaaatcacaagggtttccgcatgaaaaaaatc

SEQ ID NO: 365314 - DNA, 4086 bp, Homo sapiens
agggccggtggcgcgcggcgtccggtgaggggcagcggcccgggctcggttccggcttccagcagcggcccgaaggcgccggagcacgctccccgctccccagaacgcagcttccgcggctgcagcccaggcagctcttcgggaagcgtccgcccgtggtctcgccagggggtttccgacctccccgcccgacagcgcaggggcgggggccgcggccggagagctcgcccgagagcaccccctcccgctgcgcctctgggcgcacgcgcagccgctgcagcctcccttatttagtccgcgatggcttccctcgcgccccaccgtcctcttccggaaggcggctccctccctgcgcagcccggagcccctgagatcagcctcgagcaggcgcccgagcgagactatccctaaacgggaacggcggtggccgactcgcgagtgaggaaaagaaggaaagggcagactggtcgcgaagagaagatccaggcctcagaggaggagaaaggccggagccagccgaggtttgccgagggcggtgttccggacccgcgcggtgcggggaggaaggccgagggtgggagaggaggggcccggcggaaactgccgaggtttcccgaaggcggcagcgtccgagttgcccggatgtagttggtggagcggcagccgccgcctgcgcgcccgcccgcctttcgcggccgctctcccccctccccgacacacactcacaggccgggcattgatggtaatgtatgcgaggaaacagcagagactcagtgatggctgtcacgaccggaggggggactcgcagccttaccaggggggtgatgttttacaggcacttaagtattcatcgaagagtcaccccagtagcggtgatcacagacatgaaaagatgcgagacgccggagatccttcaccaccaaataaaatgttgcggagatctgatagtcctgaaaacaaatacagtgacagcacaggtcacagtaaggccaaaaatgtgcatactcacagagttagagagagggatggtgggaccagttactctccacaagaaaattcacacaaccacagtgctcttcatagttcaaattcacattcttctaatccaagcaataacccaagcaaaacttcagatgcaccttatgattctgcagatgactggtctgagcatattagctcttctgggaaaaagtactactacaattgtcgaacagaagtttcacaatgggaaaaaccaaaagagtggcttgaaagagaacagagacaaaaagaagcaaacaagatggcagtcaacagcttcccaaaagatagggattacagaagagaggtgatgcaagcaacagccactagtgggtttgccagtggaatggaagacaagcattccagtgatgccagtagtttgctcccacagaatattttgtctcaaacaagcagacacaatgacagagactacagactgccaagagcagagactcacagtagttctacgccagtacagcaccccatcaaaccagtggttcatccaactgctaccccaagcactgttccttctagtccatttacgctacagtctgatcaccagccaaagaaatcatttgatgctaatggagcatctactttatcaaaactgcctacacccacatcttctgtccctgcacagaaaacagaaagaaaagaatctacatcaggagacaaacccgtatcacattcttgcacaactccttccacgtcttctgcctctggactgaaccccacatctgcacctccaacatctgcttcagcggtccctgtttctcctgttccacagtcgccaatacctcccttacttcaggacccaaatcttcttagacaattgcttcctgctttgcaagccacgctgcagcttaataattctaatgtggacatatctaaaataaatgaagttcttacagcagctgtgacacaagcctcactgcagtctataattcataagtttcttactgctggaccatctgctttcaacataacgtctctgatttctcaagctgctcagctctctacacaagcccagccatctaatcagtctccgatgtctttaacatctgatgcgtcatccccaagatcatatgtttctccaagaataagcacacctcaaactaacacagtccctatcaaacctttgatcagtactcctcctgtttcatcacagccaaaggttagtactccagtagttaagcaaggaccagtgtcacagtcagccacacagcagcctgtaactgctgacaagcagcaaggtcatgaacctgtctctcctcgaagtcttcagcgctcaagtagccagagaagtccatcacctggtcccaatcatacttctaatagtagtaatgcatcaaatgcaacagttgtaccacagaattcttctgcccgatccacgtgttcattaacgcctgcactagcagcacacttcagtgaaaatctcataaaacacgttcaaggatggcctgcagatcatgcagagaagcaggcatcaagattacgcgaagaagcgcataacatgggaactattcacatgtccgaaatttgtactgaattaaaaaatttaagatctttagtccgagtatgtgaaattcaagcaactttgcgagagcaaaggatactatttttgagacaacaaattaaggaacttgaaaagctaaaaaatcagaattccttcatggtgtgaagatgtgaataattgcacatggttttgagaacaggaactgtaaatctgttgcccaatcttaacatttttgagctgcatttaagtagactttggaccgttaagctgggcaaaggaaatgacaaggggacggggtctgtgagagtcaattcaggggaaagatacaagattgatttgtaaaacccttgaaatgtagatttcttgtagatgtatccttcacgttgtaaatatgttttgtagagtgaagccatgggaagccatgtgtaacagagcttagacatccaaaactaatcaatgctgaggtggctaaatacctagccttttacatgtaaacctgtctgcaaaattagcttttttaaaaaaaaaaaaaaaaaaattgggggggttaatttatcattcagaaatcttgcattttcaaaaattcagtgcaagcgccaggcgatttgtgtctaaggatacgattttgaaccatatgggcagtgtacaaaatatgaaacaactgtttccacacttgcacctgatcaagagcagtgcttctccatttgttttgcagagaaatgtttttcatttcccgtgtgtttccatttccttctgaaattctgattttatccatttttttaaggctcctctttatctcctttcttaaggcactgttgctatggcacttttctataaccttttcattcctgtgtacagtagcttaaaattgcagtgattgagcataacctacttgtttgtataaattattgaaatccatttgcaccctgtaagaatggacttaaaagtactgctggacaggcatgtgtgctcaaagtacattgattgctcaaatataaggaaatggcccaatgaacgtggttgtgggaggggaaagaggaaacagagctagtcagatgtgaattgtatctgttgtaataaacatgttaaaacaaacaaaaattgttatttttcttttccttcggtcagtgcacattagcatttgaactacctggggattctttatcagaactgttcttgttgaatatttatacttaattgaaataattccttaagggaggttttgtttaaaacgtattaacaggaaattgtgtatgagatatttaatgaaataagaaattcaacaagaatgattaagtcacttcccaagtggttgtcatttgttaaaccctggtttacctgtcttgctattatgacatttcatttggaaggatgtttgtgttgtagctaactgttcaagtctggtgctgactgctgttcttagccatcacaaaacgctaaatttgtgtaattggagcttcctgctgttatctggaaatagcaggaaagcgcagctttgtatattgtttcctaaagtatattaaaataaaaaaagaaactattgctactat

SEQ ID NO: 365315 - DNA, 3428 bp, Homo sapiens
tggcgaattcggcacgagggaggaggagaagaaggaccaggcgccgccgcctgcgcgcccgcccgcctttcgcggccgctctcccccctccccgacacacactcacaggccgggcattgatgctgtcacgaccggaggggggactcgcagccttaccaggggggtgatgttttacaggcacttaagtattcatcgaagagtcaccccagtagcggtgatcacagacatgaaaagatgcgagacgccggagatccttcaccaccaaataaaatgttgcggagatctgatagtcctgaaaacaaatacagtgacagcacaggtcacagtaaggccaaaaatgtgcatactcacagagttagagagagggatggtgggaccagttactctccacaagaaaattcacacaaccacagtgctcttcatagttcaaattcacattcttctaatccaagcaataacccaagcaaaacttcagatgcaccttatgattctgcagatgactggtctgagcatattagctcttctgggaaaaagtactactacaattgtcgaacagaagtttcacaatgggaaaaaccaaaagagtggcttgaaagagaacagagacaaaaagaagcaaacaagatggcagtcaacagcttcccaaaagatagggattacagaagagaggtgatgcaagcaacagccactagtgggtttgccagtggaatggaagacaagcattccagtgatgccagtagtttgctcccacagaatattttgtctcaaacaagcagacacaatgacagagactacagactgccaagagcagagactcacagtagttctacgccagtacagcaccccatcaaaccagtggttcatccaactgctaccccaagcactgttccttctagtccatttacgctacagtctgatcaccagccaaagaaatcatttgatgctaatggagcatctactttatcaaaactgcctacacccacatcttctgtccctgcacagaaaacagaaagaaaagaatctacatcaggagacaaacccgtatcacattcttgcacaactccttccacgtcttctgcctctggactgaaccccacatctgcacctccaacatctgcttcagcggtccctgtttctcctgttccacagtcgccaatacctcccttacttcaggacccaaatcttcttagacaattgcttcctgctttgcaagccacgctgcagcttaataattctaatgtggacatatctaaaataaatgaagttcttacagcagctgtgacacaagcctcactgcagtctataattcataagtttcttactgctggaccatctgctttcaacataacgtctctgatttctcaagctgctcagctctctacacaagcccagccatctaatcagtctccgatgtctttaacatctgatgcgtcatccccaagatcatatgtttctccaagaataagcacacctcaaactaacacagtccctatcaaacctttgatcagtactcctcctgtttcatcacagccaaaggttagtactccagtagttaagcaaggaccagtgtcacagtcagccacacagcagcctgtaactgctgacaagcagcaaggtcatgaacctgtctctcctcgaagtcttcagcgctcaagtagccagagaagtccatcacctggtcccaatcatacttctaatagtagtaatgcatcaaatgcaacagttgtaccacagaattcttctgcccgatccacgtgttcattaacgcctgcactagcagcacacttcagtgaaaatctcataaaacacgttcaaggatggcctgcagatcatgcagagaagcaggcatcaagattacgcgaagaagcgcataacatgggaactattcacatgtccgaaatttgtactgaattaaaaaatttaagatctttagtccgagtatgtgaaattcaagcaactttgcgagagcaaaggatactatttttgagacaacaaattaaggaacttgaaaagctaaaaaatcagaattccttcatggtgtgaagatgtgaataattgcacatggttttgagaacaggaactgtaaatctgttgcccaatcttaacatttttgagctgcatttaagtagactttggaccgttaagctgggcaaaggaaatgacaaggggacggggtctgtgagagtcaattcaggggaaagatacaagattgatttgtaaaacccttgaaatgtagatttcttgtagatgtatccttcacgttgtaaatatgttttgtagagtgaagccatgggaagccatgtgtaacagagcttagacatccaaaactaatcaatgctgaggtggctaaatacctagccttttacatgtaaacctgtctgcaaaattagcttttttaaaaaaaaaaaaaaaaaaattgggggggttaatttatcattcagaaatcttgcattttcaaaaattcagtgcaagcgccaggcgatttgtgtctaaggatacgattttgaaccatatgggcagtgtacaaaatatgaaacaactgtttccacacttgcacctgatcaagagcagtgcttctccatttgttttgcagagaaatgtttttcatttcccgtgtgtttccatttccttctgaaattctgattttatccatttttttaaggctcctctttatctcctttcttaaggcactgttgctatggcacttttctataaccttttcattcctgtgtacagtagcttaaaattgcagtgattgagcataacctacttgtttgtataaattattgaaatccatttgcaccctgtaagaatggacttaaaagtactgctggacaggcatgtgtgctcaaagtacattgattgctcaaatataaggaaatggcccaatgaacgtggttgtgggaggggaaagaggaaacagagctagtcagatgtgaattgtatctgttgtaataaacatgttaaaacaaacaaaaattgttatttttcttttccttcggtcagtgcacattagcatttgaactacctggggattctttatcagaactgttcttgttgaatatttatacttaattgaaataattccttaagggaggttttgtttaaaacgtattaacaggaaattgtgtatgagatatttaatgaaataagaaattcaacaagaatgattaagtcacttcccaagtggttgtcatttgttaaaccctggtttacctgtcttgctattatgacatttcatttggaaggatgtttgtgttgtagctaactgttcaagtctggtgctgactgctgttcttagccatcacaaaacgctaaatttgtgtaattggagcttcctgctgttatctggaaatagcaggaaagcgcagctttgtatattgtttcctaaagtatattaaaataaaaaaagaaactattgctactat

SEQ ID NO: 365316 - DNA, 3264 bp, Homo sapiens
acaagatggcagtcaacagcttcccaaaagatagggattacagaagagaggtgatcacagacatgaaaagatgcgagacgccggagatccttcaccaccaaataaaatgttgcggagatctgatagtcctgaaaacaaatacagtgacagcacaggtcacagtaaggccaaaaatgtgcatactcacagagttagagagagggatggtgggaccagttactctccacaagaaaattcacacaaccacagtgctcttcatagttcaaattcacattcttctaatccaagcaataacccaagcaaaacttcagatgcaccttatgattctgcagatgactggtctgagcatattagctcttctgggaaaaagtactactacaattgtcgaacagaagtttcacaatgggaaaaaccaaaagagtggcttgaaagagaacagagacaaaaagaagcaaacaagatggcagtcaacagcttcccaaaagatagggattacagaagagaggtgatgcaagcaacagccactagtgggtttgccagtggaatggaagacaagcattccagtgatgccagtagtttgctcccacagaatattttgtctcaaacaagcagacacaatgacagagactacagactgccaagagcagagactcacagtagttctacgccagtacagcaccccatcaaaccagtggttcatccaactgctaccccaagcactgttccttctagtccatttacgctacagtctgatcaccagccaaagaaatcatttgatgctaatggagcatctactttatcaaaactgcctacacccacatcttctgtccctgcacagaaaacagaaagaaaagaatctacatcaggagacaaacccgtatcacattcttgcacaactccttccacgtcttctgcctctggactgaaccccacatctgcacctccaacatctgcttcagcggtccctgtttctcctgttccacagtcgccaatacctcccttacttcaggacccaaatcttcttagacaattgcttcctgctttgcaagccacgctgcagcttaataattctaatgtggacatatctaaaataaatgaagttcttacagcagctgtgacacaagcctcactgcagtctataattcataagtttcttactgctggaccatctgctttcaacataacgtctctgatttctcaagctgctcagctctctacacaagcccagccatctaatcagtctccgatgtctttaacatctgatgcgtcatccccaagatcatatgtttctccaagaataagcacacctcaaactaacacagtccctatcaaacctttgatcagtactcctcctgtttcatcacagccaaaggttagtactccagtagttaagcaaggaccagtgtcacagtcagccacacagcagcctgtaactgctgacaagcagcaaggtcatgaacctgtctctcctcgaagtcttcagcgctcaagtagccagagaagtccatcacctggtcccaatcatacttctaatagtagtaatgcatcaaatgcaacagttgtaccacagaattcttctgcccgatccacgtgttcattaacgcctgcactagcagcacacttcagtgaaaatctcataaaacacgttcaaggatggcctgcagatcatgcagagaagcaggcatcaagattacgcgaagaagcgcataacatgggaactattcacatgtccgaaatttgtactgaattaaaaaatttaagatctttagtccgagtatgtgaaattcaagcaactttgcgagagcaaaggatactatttttgagacaacaaattaaggaacttgaaaagctaaaaaatcagaattccttcatggtgtgaagatgtgaataattgcacatggttttgagaacaggaactgtaaatctgttgcccaatcttaacatttttgagctgcatttaagtagactttggaccgttaagctgggcaaaggaaatgacaaggggacggggtctgtgagagtcaattcaggggaaagatacaagattgatttgtaaaacccttgaaatgtagatttcttgtagatgtatccttcacgttgtaaatatgttttgtagagtgaagccatgggaagccatgtgtaacagagcttagacatccaaaactaatcaatgctgaggtggctaaatacctagccttttacatgtaaacctgtctgcaaaattagcttttttaaaaaaaaaaaaaaaaaaattgggggggttaatttatcattcagaaatcttgcattttcaaaaattcagtgcaagcgccaggcgatttgtgtctaaggatacgattttgaaccatatgggcagtgtacaaaatatgaaacaactgtttccacacttgcacctgatcaagagcagtgcttctccatttgttttgcagagaaatgtttttcatttcccgtgtgtttccatttccttctgaaattctgattttatccatttttttaaggctcctctttatctcctttcttaaggcactgttgctatggcacttttctataaccttttcattcctgtgtacagtagcttaaaattgcagtgattgagcataacctacttgtttgtataaattattgaaatccatttgcaccctgtaagaatggacttaaaagtactgctggacaggcatgtgtgctcaaagtacattgattgctcaaatataaggaaatggcccaatgaacgtggttgtgggaggggaaagaggaaacagagctagtcagatgtgaattgtatctgttgtaataaacatgttaaaacaaacaaaaattgttatttttcttttccttcggtcagtgcacattagcatttgaactacctggggattctttatcagaactgttcttgttgaatatttatacttaattgaaataattccttaagggaggttttgtttaaaacgtattaacaggaaattgtgtatgagatatttaatgaaataagaaattcaacaagaatgattaagtcacttcccaagtggttgtcatttgttaaaccctggtttacctgtcttgctattatgacatttcatttggaaggatgtttgtgttgtagctaactgttcaagtctggtgctgactgctgttcttagccatcacaaaacgctaaatttgtgtaattggagcttcctgctgttatctggaaatagcaggaaagcgcagctttgtatattgtttcctaaagtatattaaaataaaaaaagaaactattgctactat

SEQ ID NO: 365317 - DNA, 6507 bp, Homo sapiens
agggccggtggcgcgcggcgtccggtgaggggcagcggcccgggctcggttccggcttccagcagcggcccgaaggcgccggagcacgctccccgctccccagaacgcagcttccgcggctgcagcccaggcagctcttcgggaagcgtccgcccgtggtctcgccagggggtttccgacctccccgcccgacagcgcaggggcgggggccgcggccggagagctcgcccgagagcaccccctcccgctgcgcctctgggcgcacgcgcagccgctgcagcctcccttatttagtccgcgatggcttccctcgcgccccaccgtcctcttccggaaggcggctccctccctgcgcagcccggagcccctgagatcagcctcgagcaggcgcccgagcgagactatccctaaacgggaacggcggtggccgactcgcgagtgaggaaaagaaggaaagggcagactggtcgcgaagagaagatccaggcctcagaggaggagaaaggccggagccagccgaggtttgccgagggcggtgttccggacccgcgcggtgcggggaggaaggccgagggtgggagaggaggggcccggcggaaactgccgaggtttcccgaaggcggcagcgtccgagttgcccggatgtagttggtggagcggcagccgccgcctgcgcgcccgcccgcctttcgcggccgctctcccccctccccgacacacactcacaggccgggcattgatggtaatgtatgcgaggaaacagcagagactcagtgatggctgtcacgaccggaggggggactcgcagccttaccaggcacttaagtattcatcgaagagtcaccccagtagcggtgatcacagacatgaaaagatgcgagacgccggagatccttcaccaccaaataaaatgttgcggagatctgatagtcctgaaaacaaatacagtgacagcacaggtcacagtaaggccaaaaatgtgcatactcacagagttagagagagggatggtgggaccagttactctccacaagaaaattcacacaaccacagtgctcttcatagttcaaattcacattcttctaatccaagcaataacccaagcaaaacttcagatgcaccttatgattctgcagatgactggtctgagcatattagctcttctgggaaaaagtactactacaattgtcgaacagaagtttcacaatgggaaaaaccaaaagagtggcttgaaagagaacagagacaaaaagaagcaaacaagatggcagtcaacagcttcccaaaagatagggattacagaagagaggtgatgcaagcaacagccactagtgggtttgccagtggaatggaagacaagcattccagtgatgccagtagtttgctcccacagaatattttgtctcaaacaagcagacacaatgacagagactacagactgccaagagcagagactcacagtagttctacgccagtacagcaccccatcaaaccagtggttcatccaactgctaccccaagcactgttccttctagtccatttacgctacagtctgatcaccagccaaagaaatcatttgatgctaatggagcatctactttatcaaaactgcctacacccacatcttctgtccctgcacagaaaacagaaagaaaagaatctacatcaggagacaaacccgtatcacattcttgcacaactccttccacgtcttctgcctctggactgaaccccacatctgcacctccaacatctgcttcagcggtccctgtttctcctgttccacagtcgccaatacctcccttacttcaggacccaaatcttcttagacaattgcttcctgctttgcaagccacgctgcagcttaataattctaatgtggacatatctaaaataaatgaagttcttacagcagctgtgacacaagcctcactgcagtctataattcataagtttcttactgctggaccatctgctttcaacataacgtctctgatttctcaagctgctcagctctctacacaaggtattcttactcatcttagatatctctagaatggcatcttgattttgttttggaattaatagcccttttttgtatttagttttttctttcatttttttttttagttttttaagagattagctacaataattttgttttttttgtaacactggcatatacagtagtatttttatttcctttctttttagatgaagcaagctttgacatttgtcttaaggtattgccatcaaatctgtaattatttaagacagtatttaattcagactttgttattaatgagtttttttatgccaaagctgaaagtaaactatgatgtgccatatatctttgtgaaacattgcatgtatttgaagagttgaagtttggttcagattgacgttagatgttttttgactggataatatggaaatgctcattttctgccttgaattagatatccctcttcatgaaggtatccaaatggagagagatacacataggagcaaatgggaagtgaaagggtcactttgtcagaaagctgataaacagcaggaatgccttgtctggaatggaagtataatggtgcaaagactcttgcaaccctctggctagcctcatgagcaggagactgcgtgggatacctgggcctaaatgtagaataagaaagaagaaataaggatggtgaggaggccttccatgtgagattaggttcaggcctagcttcctgttccagccacataaaggagagtgggccacactgggtgtgcttacctctgaacacacagctcacttagtcagtgtggcccagtgagaaggtcagattctgatttattccaataagtgttctctgggtaatatgggggtgggggggtttagagtaatacaaatatctttgccacatatattacaaaggactttagttttttgttttgttttgtttttctttaaaattaattgcttccctcttttacagcccagccatctaatcagtctccgatgtctttaacatctgatgcgtcatccccaagatcatatgtttctccaagaataagcacacctcaaactaacacagtccctatcaaacctttgatcagtactcctcctgtttcatcacagccaaaggttagtactccagtagttaagcaaggaccagtgtcacagtcagccacacagcagcctgtaactgctgacaagcagcaaggtcatgaacctgtctctcctcgaagtcttcagcgctcaaggtaggttgatattgtatattgagaccacattgttttatttaatgatggtacactgcattgtttgaatattatatctgtaaaatagaacttaacctttaaactccatgaataccctaaagtaggcttacatgttgtaaaatttacaaagacaaacctgtatacaagaggtaggttattgtctctagtagtgaagcccgggttattttgaagaaagtggctctttaaaattttacacagtggaatatgacggggctaaagatttgtgatacttgtaccagaaaggcacacgattttacaatatttgttggaattaccttactttttaacctcctcatagcagttttggtttgagtatattgatgaaagccaaagtctggtatctaaaacttgggccaatgtttcccaactggtatatgtcaggctttcccaatagcttaactgtgaccctatacggatggctttttagatagttctatactgctgtattgtgttagcacttttctttgttcattaacaacacaactttaaatgacatttgttgaatgaatggttttcatttgattgattttcctgttttttatttcatgctatgaggtagcaaaataattcaactgttgtttttattgttgttttctaaacaagcatttcagaacttacacctccaaatgagagttgttcccttcaaaataatgaccttgggaagctgtctacttactccagcaatgttgccattgctctgaacatttttgggaaattcttcttttaaattgtttttagaggctgcagtattattttaaatatcctcagtgatgaaaactcttcatcctttgggagatttagtttttggaaataactgaaattcattcagagccaagtctggtgaagcaggtaggagatcaacttgggtgattaaattttttggttctcaccaccatatccccaaccctggcccaaaccattcagttttaaaagaagataaagaatctcagagtgttatttttttggttttgttttgccactgtgcttgttcagtgctatccaataaaatgtctgtattttgcttcacattatttcaccctctgattcagcagttctgacgttgaacaaaggcaatatatattttccccttatctagatgtgtatgagcagtcttcagatgtgcatctacagctgttaaaatgtgactttttttagttatattattagtgtttgtggtacacaaagttaacaggttctgctctcagatttggagagtagtttacatttgactctgacagtagtgttaaaagggttttttccccctaaagtgttttgaggaatcatatactttggattattaattctctttatttgacattaaaataacaaatttttcttaggaatttggatatctttaagttaataaaaggtattaacatgcagtttctaggataaggatacccagaaactacttttaaacatactacacattcaattctgttttctagtagccagagaagtccatcacctggtcccaatcatacttctaatagtagtaatgcatcaaatgcaacagttgtaccacagaattcttctgcccgatccacgtgttcattaacgcctgcactagcagcacacttcagtgaaaatctcataaaacacgttcaaggatggcctgcagatcatgcagagaagcaggcatcaagattacgcgaagaagcgcataacatgggaactattcacatgtccgaaatttgtactgaattaaaaaatttaagatctttagtccgagtatgtgaaattcaagcaactttgcgagagcaaaggatactatttttgagacaacaaattaaggaacttgaaaagctaaaaaatcagaattccttcatggtgtgaagatgtgaataattgcacatggttttgagaacaggaactgtaaatctgttgcccaatcttaacatttttgagctgcatttaagtagactttggaccgttaagctgggcaaaggaaatgacaaggggacggggtctgtgagagtcaattcaggggaaagatacaagattgatttgtaaaacccttgaaatgtagatttcttgtagatgtatccttcacgttgtaaatatgttttgtagagtgaagccatgggaagccatgtgtaacagagcttagacatccaaaactaatcaatgctgaggtggctaaatacctagccttttacatgtaaacctgtctgcaaaattagcttttttaaaaaaaaaaaaaaaaaaattgggggggttaatttatcattcagaaatcttgcattttcaaaaattcagtgcaagcgccaggcgatttgtgtctaaggatacgattttgaaccatatgggcagtgtacaaaatatgaaacaactgtttccacacttgcacctgatcaagagcagtgcttctccatttgttttgcagagaaatgtttttcatttcccgtgtgtttccatttccttctgaaattctgattttatccatttttttaaggctcctctttatctcctttcttaaggcactgttgctatggcacttttctataaccttttcattcctgtgtacagtagcttaaaattgcagtgattgagcataacctacttgtttgtataaattattgaaatccatttgcaccctgtaagaatggacttaaaagtactgctggacaggcatgtgtgctcaaagtacattgattgctcaaatataaggaaatggcccaatgaacgtggttgtgggaggggaaagaggaaacagagctagtcagatgtgaattgtatctgttgtaataaacatgttaaaacaaacaaaaattgttatttttcttttccttcggtcagtgcacattagcatttgaactacctggggattctttatcagaactgttcttgttgaatatttatacttaattgaaataattccttaagggaggttttgtttaaaacgtattaacaggaaattgtgtatgagatatttaatgaaataagaaattcaacaagaatgattaagtcacttcccaagtggttgtcatttgttaaaccctggtttacctgtcttgctattatgacatttcatttggaaggatgtttgtgttgtagctaactgttcaagtctggtgctgactgctgttcttagccatcacaaaacgctaaatttgtgtaattggagcttcctgctgttatctggaaatagcaggaaagcgcagctttgtatattgtttcctaaagtatattaaaataaaaaaagaaactattgctactat

SEQ ID NO: 365318 - DNA, 2959 bp, Homo sapiens
tggcgaattcggcacgagggaggaggagaagaaggaccaggcgccgccgcctgcgcgcccgcccgcctttcgcggccgctctcccccctccccgacacacactcacaggccgggcattgatggtaatgtatgcgaggaaacagcagagactcagtgatggagtcaacagcttcccaaaagatagggattacagaagagaggtgatgcaagcaacagccactagtgggtttgccagtggaatggaagacaagcattccagtgatgccagtagtttgctcccacagaatattttgtctcaaacaagcagacacaatgacagagactacagactgccaagagcagagactcacagtagttctacgccagtacagcaccccatcaaaccagtggttcatccaactgctaccccaagcactgttccttctagtccatttacgctacagtctgatcaccagccaaagaaatcatttgatgctaatggagcatctactttatcaaaactgcctacacccacatcttctgtccctgcacagaaaacagaaagaaaagaatctacatcaggagacaaacccgtatcacattcttgcacaactccttccacgtcttctgcctctggactgaaccccacatctgcacctccaacatctgcttcagcggtccctgtttctcctgttccacagtcgccaatacctcccttacttcaggacccaaatcttcttagacaattgcttcctgctttgcaagccacgctgcagcttaataattctaatgtggacatatctaaaataaatgaagttcttacagcagctgtgacacaagcctcactgcagtctataattcataagtttcttactgctggaccatctgctttcaacataacgtctctgatttctcaagctgctcagctctctacacaagcccagccatctaatcagtctccgatgtctttaacatctgatgcgtcatccccaagatcatatgtttctccaagaataagcacacctcaaactaacacagtccctatcaaacctttgatcagtactcctcctgtttcatcacagccaaaggttagtactccagtagttaagcaaggaccagtgtcacagtcagccacacagcagcctgtaactgctgacaagcagcaaggtcatgaacctgtctctcctcgaagtcttcagcgctcaagtagccagagaagtccatcacctggtcccaatcatacttctaatagtagtaatgcatcaaatgcaacagttgtaccacagaattcttctgcccgatccacgtgttcattaacgcctgcactagcagcacacttcagtgaaaatctcataaaacacgttcaaggatggcctgcagatcatgcagagaagcaggcatcaagattacgcgaagaagcgcataacatgggaactattcacatgtccgaaatttgtactgaattaaaaaatttaagatctttagtccgagtatgtgaaattcaagcaactttgcgagagcaaaggatactatttttgagacaacaaattaaggaacttgaaaagctaaaaaatcagaattccttcatggtgtgaagatgtgaataattgcacatggttttgagaacaggaactgtaaatctgttgcccaatcttaacatttttgagctgcatttaagtagactttggaccgttaagctgggcaaaggaaatgacaaggggacggggtctgtgagagtcaattcaggggaaagatacaagattgatttgtaaaacccttgaaatgtagatttcttgtagatgtatccttcacgttgtaaatatgttttgtagagtgaagccatgggaagccatgtgtaacagagcttagacatccaaaactaatcaatgctgaggtggctaaatacctagccttttacatgtaaacctgtctgcaaaattagcttttttaaaaaaaaaaaaaaaaaaattgggggggttaatttatcattcagaaatcttgcattttcaaaaattcagtgcaagcgccaggcgatttgtgtctaaggatacgattttgaaccatatgggcagtgtacaaaatatgaaacaactgtttccacacttgcacctgatcaagagcagtgcttctccatttgttttgcagagaaatgtttttcatttcccgtgtgtttccatttccttctgaaattctgattttatccatttttttaaggctcctctttatctcctttcttaaggcactgttgctatggcacttttctataaccttttcattcctgtgtacagtagcttaaaattgcagtgattgagcataacctacttgtttgtataaattattgaaatccatttgcaccctgtaagaatggacttaaaagtactgctggacaggcatgtgtgctcaaagtacattgattgctcaaatataaggaaatggcccaatgaacgtggttgtgggaggggaaagaggaaacagagctagtcagatgtgaattgtatctgttgtaataaacatgttaaaacaaacaaaaattgttatttttcttttccttcggtcagtgcacattagcatttgaactacctggggattctttatcagaactgttcttgttgaatatttatacttaattgaaataattccttaagggaggttttgtttaaaacgtattaacaggaaattgtgtatgagatatttaatgaaataagaaattcaacaagaatgattaagtcacttcccaagtggttgtcatttgttaaaccctggtttacctgtcttgctattatgacatttcatttggaaggatgtttgtgttgtagctaactgttcaagtctggtgctgactgctgttcttagccatcacaaaacgctaaatttgtgtaattggagcttcctgctgttatctggaaatagcaggaaagcgcagctttgtatattgtttcctaaagtatattaaaataaaaaaagaaactattgctactat

SEQ ID NO: 365319 - DNA, 3047 bp, Homo sapiens
  misc_feature (16)..(16): n is a, c, g, or t
  misc_feature (29)..(30): n is a, c, g, or t
aacgttaggctaggtncgaggctgggtgnnggtatgtatgcgaggaaacagcagagactcagtgatggctgtcacgaccggaggggggactcgcagccttaccaggcacttaagtattcatcgaagagtcaccccagtagcggtgatcacagacatgaaaagatgcgagacgccggagatccttcaccaccaaataaaatgttgcggagatctgatagtcctgaaaacaaatacagtgacagcacaggtcacagtaaggccaaaaatgtgcatactcacagagttagagagagggatggtgggaccagttactctccacaagaaaattcacacaaccacagtgctcttcatagttcaaattcacattcttctaatccaagcaataacccaagcaaaacttcagatgcaccttatgattctgcagatgactggtctgagcatattagctcttctgggaaaaagtactactacaattgtcgaacagaagtttcacaatgggaaaaaccaaaagagtggcttgaaagagaacagagacaaaaagaagcaaacaagatggcagtcaacagcttcccaaaagatagggattacagaagagaggtgatgcaagcaacagccactagtgggtttgccagtggaaaatctacatcaggagacaaacccgtatcacattcttgcacaactccttccacgtcttctgcctctggactgaaccccacatctgcacctccaacatctgcttcagcggtccctgtttctcctgttccacagtcgccaatacctcccttacttcaggacccaaatcttcttagacaattgcttcctgctttgcaagccacgctgcagcttaataattctaatgtggacatatctaaaataaatgaagttcttacagcagctgtgacacaagcctcactgcagtctataattcataagtttcttactgctggaccatctgctttcaacataacgtctctgatttctcaagctgctcagctctctacacaagcccagccatctaatcagtctccgatgtctttaacatctgatgcgtcatccccaagatcatatgtttctccaagaataagcacacctcaaactaacacagtccctatcaaacctttgatcagtactcctcctgtttcatcacagccaaaggttagtactccagtagttaagcaaggaccagtgtcacagtcagccacacagcagcctgtaactgctgacaagcagcaaggtcatgaacctgtctctcctcgaagtcttcagcgctcaagtagccagagaagtccatcacctggtcccaatcatacttctaatagtagtaatgcatcaaatgcaacagttgtaccacagaattcttctgcccgatccacgtgttcattaacgcctgcactagcagcacacttcagtgaaaatctcataaaacacgttcaaggatggcctgcagatcatgcagagaagcaggcatcaagattacgcgaagaagcgcataacatgggaactattcacatgtccgaaatttgtactgaattaaaaaatttaagatctttagtccgagtatgtgaaattcaagcaactttgcgagagcaaaggatactatttttgagacaacaaattaaggaacttgaaaagctaaaaaatcagaattccttcatggtgtgaagatgtgaataattgcacatggttttgagaacaggaactgtaaatctgttgcccaatcttaacatttttgagctgcatttaagtagactttggaccgttaagctgggcaaaggaaatgacaaggggacggggtctgtgagagtcaattcaggggaaagatacaagattgatttgtaaaacccttgaaatgtagatttcttgtagatgtatccttcacgttgtaaatatgttttgtagagtgaagccatgggaagccatgtgtaacagagcttagacatccaaaactaatcaatgctgaggtggctaaatacctagccttttacatgtaaacctgtctgcaaaattagcttttttaaaaaaaaaaaaaaaaaaattgggggggttaatttatcattcagaaatcttgcattttcaaaaattcagtgcaagcgccaggcgatttgtgtctaaggatacgattttgaaccatatgggcagtgtacaaaatatgaaacaactgtttccacacttgcacctgatcaagagcagtgcttctccatttgttttgcagagaaatgtttttcatttcccgtgtgtttccatttccttctgaaattctgattttatccatttttttaaggctcctctttatctcctttcttaaggcactgttgctatggcacttttctataaccttttcattcctgtgtacagtagcttaaaattgcagtgattgagcataacctacttgtttgtataaattattgaaatccatttgcaccctgtaagaatggacttaaaagtactgctggacaggcatgtgtgctcaaagtacattgattgctcaaatataaggaaatggcccaatgaacgtggttgtgggaggggaaagaggaaacagagctagtcagatgtgaattgtatctgttgtaataaacatgttaaaacaaacaaaaattgttatttttcttttccttcggtcagtgcacattagcatttgaactacctggggattctttatcagaactgttcttgttgaatatttatacttaattgaaataattccttaagggaggttttgtttaaaacgtattaacaggaaattgtgtatgagatatttaatgaaataagaaattcaacaagaatgattaagtcacttcccaagtggttgtcatttgttaaaccctggtttacctgtcttgctattatgacatttcatttggaaggatgtttgtgttgtagctaactgttcaagtctggtgctgactgctgttcttagccatcacaaaacgctaaatttgtgtaattggagcttcctgctgttatctggaaatagcaggaaagcgcagctttgtatattgtttcctaaagtatattaaaataaaaaaagaaactattgctactat

SEQ ID NO: 365320 - DNA, 3299 bp, Homo sapiens
agggccggtggcgcgcggcgtccggtgaggggcagcggcccgggctcggttccggcttccagcagcggcccgaaggcgccggagcacgctccccgctccccagaacgcagcttccgcggctgcagcccaggcagctcttcgggaagcgtccgcccgtggtctcgccagggggtttccgacctccccgcccgacagcgcaggggcgggggccgcggccggagagctcgcccgagagcaccccctcccgctgcgcctctgggcgcacgcgcagccgctgcagcctcccttatttagtccgcgatggcttccctcgcgccccaccgtcctcttccggaaggcggctccctccctgcgcagcccggagcccctgagatcagcctcgagcaggcgcccgagcgagactatccctaaacgggaacggcggtggccgactcgcgagtgaggaaaagaaggaaagggcagactggtcgcgaagagaagatccaggcctcagaggaggagaaaggccggagccagccgaggtttgccgagggcggtgttccggacccgcgcggtgcggggaggaaggccgagggtgggagaggaggggcccggcggaaactgccgaggtttcccgaaggcggcagcgtccgagttgcccggatgtagttggtggagcggcagccgccgcctgcgcgcccgcccgcctttcgcggccgctctcccccctccccgacacacactcacaggccgggcattgatggtaatgtatgcgaggaaacagcagagactcagtgatggctgtcacgaccggaggggggactcgcagccttaccaggcacttaagtattcatcgaagagtcaccccagtagcggtgatcacagacatgaaaagatgcgagacgccggagatccttcaccaccaaataaaatgttgcggagatctgatagtcctgaaaacaaatacagtgacagcacaggtcacagtaaggccaaaaatgtgcatactcacagagttagagagagggatggtgggaccagttactctccacaagaaaattcacacaaccacagtgctcttcatagttcaaattcacattcttctaatccaagcaataacccaagcaaaacttcagatgcaccttatgattctgcagatgactggtctgagcatattagctcttctgggaaaaagtactactacaattgtcgaacagaagtttcacaatgggaaaaaccaaaagagtggcttgaaagagaacagagacaaaaagaagcaaacaagatggcagtcaacagcttcccaaaagatagggattacagaagagaggtgatgcaagcaacagccactagtgggtttgccagtggaaaatctacatcaggagacaaacccgtatcacattcttgcacaactccttccacgtcttctgcctctggactgaaccccacatctgcacctccaacatctgcttcagcggtccctgtttctcctgttccacagtcgccaatacctcccttacttcaggacccaaatcttcttagacaattgcttcctgctttgcaagccacgctgcagcttaataattctaatgtggacatatctaaaataaatgaagttcttacagcagctgtgacacaagcctcactgcagtctataattcataagtttcttactgctggaccatctgctttcaacataacgtctctgatttctcaagctgctcagctctctacacaagcccagccatctaatcagtctccgatgtctttaacatctgatgcgtcatccccaagatcatatgtttctccaagaataagcacacctcaaactaacacagtccctatcaaacctttgatcagtactcctcctgtttcatcacagccaaaggttagtactccagtagttaagcaaggaccagtgtcacagtcagccacacagcagcctgtaactgctgacaagcagcaaggtcatgaacctgtctctcctcgaagtcttcagcgctcaagtagccagagaagtccatcacctggtcccaatcatacttctaatagtagtaatgcatcaaatgcaacagttgtaccacagaattcttctgcccgatccacgtgttcattaacgcctgcactagcagcacacttcagtgaaaatctcataaaacacgttcaaggatggcctgcagatcatgcagagaagcaggcatcaagattacgcgaagaagcgcataacatgggaactattcacatgtccgaaatttgtactgaattaaaaaatttaagatctttagtccgagtatgtgaaattcaagcaactttgcgagagcaaaggatactatttttgagacaacaaattaaggaacttgaaaagctaaaaaatcagaattccttcatggtgtgaagatgtgaataattgcacatggttttgagaacaggaactgtaaatctgttgcccaatcttaacatttttgagctgcatttaagtagactttggaccgttaagctgggcaaaggaaatgacaaggggacggggtctgtgagagtcaattcaggggaaagatacaagattgatttgtaaaacccttgaaatgtagatttcttgtagatgtatccttcacgttgtaaatatgttttgtagagtgaagccatgggaagccatgtgtaacagagcttagacatccaaaactaatcaatgctgaggtggctaaatacctagccttttacatgtaaacctgtctgcaaaattagcttttttaaaaaaaaaaaaaaaaaaattgggggggttaatttatcattcagaaatcttgcattttcaaaaattcagtgcaagcgccaggcgatttgtgtctaaggatacgattttgaaccatatgggcagtgtacaaaatatgaaacaactgtttccacacttgcacctgatcaagagcagtgcttctccatttgttttgcagagaaatgtttttcatttcccgtgtgtttccatttccttctgaaattctgattttatccatttttttaaggctcctctttatctcctttcttaaggcactgttgctatggcacttttctataaccttttcattcctgtgtacagtagcttaaaattgcagtgattgagcataacctacttgtttgtataaattattgaaatccatttgcaccctgtaagaatggacttaaaagtactgctggacaggcatgtgtgctcaaagtacattgattgctcaaatataaggaaatggcccaatgaacgtggttgtgggaggggaaagaggaaacagagctagtcagatgtgaattgtatctgttgtaataaacatgttaaa

SEQ ID NO: 365321 - DNA, 4014 bp, Homo sapiens
agggccggtggcgcgcggcgtccggtgaggggcagcggcccgggctcggttccggcttccagcagcggcccgaaggcgccggagcacgctccccgctccccagaacgcagcttccgcggctgcagcccaggcagctcttcgggaagcgtccgcccgtggtctcgccagggggtttccgacctccccgcccgacagcgcaggggcgggggccgcggccggagagctcgcccgagagcaccccctcccgctgcgcctctgggcgcacgcgcagccgctgcagcctcccttatttagtccgcgatggcttccctcgcgccccaccgtcctcttccggaaggcggctccctccctgcgcagcccggagcccctgagatcagcctcgagcaggcgcccgagcgagactatccctaaacgggaacggcggtggccgactcgcgagtgaggaaaagaaggaaagggcagactggtcgcgaagagaagatccaggcctcagaggaggagaaaggccggagccagccgaggtttgccgagggcggtgttccggacccgcgcggtgcggggaggaaggccgagggtgggagaggaggggcccggcggaaactgccgaggtttcccgaaggcggcagcgtccgagttgcccggatgtagttggtggagcggcagccgccgcctgcgcgcccgcccgcctttcgcggccgctctcccccctccccgacacacactcacaggccgggcattgatggtaatgtatgcgaggaaacagcagagactcagtgatggctgtcacgaccggaggggggactcgcagccttaccaggcacttaagtattcatcgaagagtcaccccagtagcggtgatcacagacatgaaaagatgcgagacgccggagatccttcaccaccaaataaaatgttgcggagatctgatagtcctgaaaacaaatacagtgacagcacaggtcacagtaaggccaaaaatgtgcatactcacagagttagagagagggatggtgggaccagttactctccacaagaaaattcacacaaccacagtgctcttcatagttcaaattcacattcttctaatccaagcaataacccaagcaaaacttcagatgcaccttatgattctgcagatgactggtctgagcatattagctcttctgggaaaaagtactactacaattgtcgaacagaagtttcacaatgggaaaaaccaaaagagtggcttgaaagagaacagagacaaaaagaagcaaacaagatggcagtcaacagcttcccaaaagatagggattacagaagagaggtgatgcaagcaacagccactagtgggtttgccagtggaatggaagacaagcattccagtgatgccagtagtttgctcccacagaatattttgtctcaaacaagcagacacaatgacagagactacagactgccaagagcagagactcacagtagttctacgccagtacagcaccccatcaaaccagtggttcatccaactgctaccccaagcactgttccttctagtccatttacgctacagtctgatcaccagccaaagaaatcatttgatgctaatggagcatctactttatcaaaactgcctacacccacatcttctgtccctgcacagaaaacagaaagaaaagaatctacatcaggagacaaacccgtatcacattcttgcacaactccttccacgtcttctgcctctggactgaaccccacatctgcacctccaacatctgcttcagcggtccctgtttctcctgttccacagtcgccaatacctcccttacttcaggacccaaatcttcttagacaattgcttcctgctttgcaagccacgctgcagcttaataattctaatgtggacatatctaaaataaatgaagttcttacagcagctgtgacacaagcctcactgcagtctataattcataagtttcttactgctggaccatctgctttcaacataacgtctctgatttctcaagctgctcagctctctacacaagcccagccatctaatcagtctccgatgtctttaacatctgatgcgtcatccccaagatcatatgtttctccaagaataagcacacctcaaactaacacagtccctatcaaacctttgatcagtactcctcctgtttcatcacagccaaaggttagtactccagtagttaagcaaggaccagtgtcacagtcagccacacagcagcctgtaactgctgacaagcagcaaggtcatgaacctgtctctcctcgaagtcttcagcgctcaagtagccagagaagtccatcacctggtcccaatcatacttctaatagtagtaatgcatcaaatgcaacagttgtaccacagaattcttctgcccgatccacgtgttcattaacgcctgcactagcagcacacttcagtgaaaatctcataaaacacgttcaaggatggcctgcagatcatgcagagaagcaggcatcaagattacgcgaagaagcgcataacatgggaactattcacatgtccgaaatttgtactgaattaaaaaatttaagatctttagtccgagtatgtgaaattcaagcaactttgcgagagcaaaggatactatttttgagacaacaaattaaggaacttgaaaagctaaaaacaggaactgtaaatctgttgcccaatcttaacatttttgagctgcatttaagtagactttggaccgttaagctgggcaaaggaaatgacaaggggacggggtctgtgagagtcaattcaggggaaagatacaagattgatttgtaaaacccttgaaatgtagatttcttgtagatgtatccttcacgttgtaaatatgttttgtagagtgaagccatgggaagccatgtgtaacagagcttagacatccaaaactaatcaatgctgaggtggctaaatacctagccttttacatgtaaacctgtctgcaaaattagcttttttaaaaaaaaaaaaaaaaaaattgggggggttaatttatcattcagaaatcttgcattttcaaaaattcagtgcaagcgccaggcgatttgtgtctaaggatacgattttgaaccatatgggcagtgtacaaaatatgaaacaactgtttccacacttgcacctgatcaagagcagtgcttctccatttgttttgcagagaaatgtttttcatttcccgtgtgtttccatttccttctgaaattctgattttatccatttttttaaggctcctctttatctcctttcttaaggcactgttgctatggcacttttctataaccttttcattcctgtgtacagtagcttaaaattgcagtgattgagcataacctacttgtttgtataaattattgaaatccatttgcaccctgtaagaatggacttaaaagtactgctggacaggcatgtgtgctcaaagtacattgattgctcaaatataaggaaatggcccaatgaacgtggttgtgggaggggaaagaggaaacagagctagtcagatgtgaattgtatctgttgtaataaacatgttaaaacaaacaaaaattgttatttttcttttccttcggtcagtgcacattagcatttgaactacctggggattctttatcagaactgttcttgttgaatatttatacttaattgaaataattccttaagggaggttttgtttaaaacgtattaacaggaaattgtgtatgagatatttaatgaaataagaaattcaacaagaatgattaagtcacttcccaagtggttgtcatttgttaaaccctggtttacctgtcttgctattatgacatttcatttggaaggatgtttgtgttgtagctaactgttcaagtctggtgctgactgctgttcttagccatcacaaaacgctaaatttgtgtaattggagcttcctgctgttatctggaaatagcaggaaagcgcagctttgtatattgtttcctaaagtatattaaaataaaaaaagaaactattgctactat

SEQ ID NO: 365322 - DNA, 2866 bp, Homo sapiens
agggccggtggcgcgcggcgtccggtgaggggcagcggcccgggctcggttccggcttccagcagcggcccgaaggcgccggagcacgctccccgctccccagaacgcagcttccgcggctgcagcccaggcagctcttcgggaagcgtccgcccgtggtctcgccagggggtttccgacctccccgcccgacagcgcaggggcgggggccgcggccggagagctcgcccgagagcaccccctcccgctgcgcctctgggcgcacgcgcagccgctgcagcctcccttatttagtccgcgatggcttccctcgcgccccaccgtcctcttccggaaggcggctccctccctgcgcagcccggagcccctgagatcagcctcgagcaggcgcccgagcgagactatccctaaacgggaacggcggtggccgactcgcgagtgaggaaaagaaggaaagggcagactggtcgcgaagagaagatccaggcctcagaggaggagaaaggccggagccagccgaggtttgccgagggcggtgttccggacccgcgcggtgcggggaggaaggccgagggtgggagaggaggggcccggcggaaactgccgaggtttcccgaaggcggcagcgtccgagttgcccggatgtagttggtggagcggcagccgccgcctgcgcgcccgcccgcctttcgcggccgctctcccccctccccgacacacactcacaggccgggcattgatggtaatgtatgcgaggaaacagcagagactcagtgatggctgtcacgaccggaggggggactcgcagccttaccaggcacttaagtattcatcgaagagtcaccccagtagcggtgatcacagacatgaaaagatgcgagacgccggagatccttcaccaccaaataaaatgttgcggagatctgatagtcctgaaaacaaatacagtgacagcacaggtcacagtaaggccaaaaatgtgcatactcacagagttagagagagggatggtgggaccagttactctccacaagaaaattcacacaaccacagtgctcttcatagttcaaattcacattcttctaatccaagcaataacccaagcaaaacttcagatgcaccttatgattctgcagatgactggtctgagcatattagctcttctgggaaaaagtactactacaattgtcgaacagaagtttcacaatgggaaaaaccaaaagagtggcttgaaagagaacagagacaaaaagaagcaaacaagatggcagtcaacagcttcccaaaagatagggattacagaagagaggtgatgcaagcaacagccactagtgggtttgccagtggaatggaagacaagcattccagtgatgccagtagtttgctcccacagaatattttgtctcaaacaagcagacacaatgacagagactacagactgccaagagcagagactcacagtagttctacgccagtacagcaccccatcaaaccagtggttcatccaactgctaccccaagcactgttccttctagtccatttacgctacagtctgatcaccagccaaagaaatcatttgatgctaatggagcatctactttatcaaaactgcctacacccacatcttctgtccctgcacagaaaacagaaagaaaagaatctacatcaggagacaaacccgtatcacattcttgcacaactccttccacgtcttctgcctctggactgaaccccacatctgcacctccaacatctgcttcagcggtccctgtttctcctgttccacagtcgccaatacctcccttacttcaggacccaaatcttcttagacaattgcttcctgctttgcaagccacgctgcagcttaataattctaatgtggacatatctaaaataaatgaagttcttacagcagctgtgacacaagcctcactgcagtctataattcataagtttcttactgctggaccatctgctttcaacataacgtctctgatttctcaagctgctcagctctctacacaagcccagccatctaatcagtctccgatgtctttaacatctgatgcgtcatccccaagatcatatgtttctccaagaataagcacacctcaaactaacacagtccctatcaaacctttgatcagtactcctcctgtttcatcacagccaaaggttagtactccagtagttaagcaaggaccagtgtcacagtcagccacacagcagcctgtaactgctgacaagcagcaaggtcatgaacctgtctctcctcgaagtcttcagcgctcaagtagccagagaagtccatcacctggtcccaatcatacttctaatagtagtaatgcatcaaatgcaacagttgtaccacagaattcttctgcccgatccacgtgttcattaacgcctgcactagcagcacacttcagtgaaaatctcataaaacacgttcaaggatggcctgcagatcatgcagagaagcaggcatcaagattacgcgaagaagcgcataacatgggaactattcacatgtccgaaatttgtactgaattaaaaaatttaagatctttagtccgagtatgtgaaattcaagcaactttgcgagagcaaaggtaagtctttcactgaaatatatttttatgtttctcaggattatgattcttaaatcgaactaaagaatgtaaatcacattttatttatgaaatgtaaagttctcttcgatacattgatcacattctatcactgcattttcataagttaatatttctcgtgaaggataaagcctgtcgattttctcttaacccatgatgaatgcttcattagacttttctcataactccataagctgcaataatatattactga

SEQ ID NO: 365323 - DNA, 2238 bp, Homo sapiens
agggccggtggcgcgcggcgtccggtgaggggcagcggcccgggctcggttccggcttccagcagcggcccgaaggcgccggagcacgctccccgctccccagaacgcagcttccgcggctgcagcccaggcagctcttcgggaagcgtccgcccgtggtctcgccagggggtttccgacctccccgcccgacagcgcaggggcgggggccgcggccggagagctcgcccgagagcaccccctcccgctgcgcctctgggcgcacgcgcagccgctgcagcctcccttatttagtccgcgatggcttccctcgcgccccaccgtcctcttccggaaggcggctccctccctgcgcagcccggagcccctgagatcagcctcgagcaggcgcccgagcgagactatccctaaacgggaacggcggtggccgactcgcgagtgaggaaaagaaggaaagggcagactggtcgcgaagagaagatccaggcctcagaggaggagaaaggccggagccagccgaggtttgccgagggcggtgttccggacccgcgcggtgcggggaggaaggccgagggtgggagaggaggggcccggcggaaactgccgaggtttcccgaaggcggcagcgtccgagttgcccggatgtagttggtggagcggcagccgccgcctgcgcgcccgcccgcctttcgcggccgctctcccccctccccgacacacactcacaggccgggcattgatggtaatgtatgcgaggaaacagcagagactcagtgatggctgtcacgaccggaggggggactcgcagccttaccaggcacttaagtattcatcgaagagtcaccccagtagcggtgatcacagacatgaaaagatgcgagacgccggagatccttcaccaccaaataaaatgttgcggagatctgatagtcctgaaaacaaatacagtgacagcacaggtcacagtaaggccaaaaatgtgcatactcacagagttagagagagggatggtgggaccagttactctccacaagaaaattcacacaaccacagtgctcttcatagttcaaattcacattcttctaatccaagcaataacccaagcaaaacttcagatgcaccttatgattctgcagatgactggtctgagcatattagctcttctgggaaaaagtactactacaattgtcgaacagaagtttcacaatgggaaaaaccaaaagagtggcttgaaagagaacagagacaaaaagaagcaaacaagatggcagtcaacagcttcccaaaagatagggattacagaagagaggtgatgcaagcaacagccactagtgggtttgccagtggaatggaagacaagcattccagtgatgccagtagtttgctcccacagaatattttgtctcaaacaagcagacacaatgacagagactacagactgccaagagcagagactcacagtagttctacgccagtacagcaccccatcaaaccagtggttcatccaactgctaccccaagcactgttccttctagtccatttacgctacagtctgatcaccagccaaagaaatcatttgatgctaatggagcatctactttatcaaaactgcctacacccacatcttctgtccctgcacagaaaacagaaagaaaagaatctacatcaggagacaaacccgtatcacattcttgcacaactccttccacgtcttctgcctctggactgaaccccacatctgcacctccaacatctgcttcagcggtccctgtttctcctgttccacagtcgccaatacctcccttacttcaggacccaaatcttcttagacaattgcttcctgctttgcaagccacgctgcagcttaataattctaatgtggacatatctaaaataaatgaagaaggtaaatcttcataacagttttttaaaaatttatttgcattgtgcaaagttatgtaagtagtaaaatccccagtttaggaatggtctttgttttcttttgaaatttatagttgaacacttttttttgttttgttttttgtttttggagtttggaaatttatatccactgtagtttaagaccattggtagtataattgagttagtggtgcttggatcttgtgtatatttttcaatacttgttatgtgtctggtagttactggaggtaagccattctatatacataatgtgtatggtgaaattttacattaaaacaatcgagcgtttgttgaaa

SEQ ID NO: 365324 - DNA, 2288 bp, Homo sapiens
agggccggtggcgcgcggcgtccggtgaggggcagcggcccgggctcggttccggcttccagcagcggcccgaaggcgccggagcacgctccccgctccccagaacgcagcttccgcggctgcagcccaggcagctcttcgggaagcgtccgcccgtggtctcgccagggggtttccgacctccccgcccgacagcgcaggggcgggggccgcggccggagagctcgcccgagagcaccccctcccgctgcgcctctgggcgcacgcgcagccgctgcagcctcccttatttagtccgcgatggcttccctcgcgccccaccgtcctcttccggaaggcggctccctccctgcgcagcccggagcccctgagatcagcctcgagcaggcgcccgagcgagactatccctaaacgggaacggcggtggccgactcgcgagtgaggaaaagaaggaaagggcagactggtcgcgaagagaagatccaggcctcagaggaggagaaaggccggagccagccgaggtttgccgagggcggtgttccggacccgcgcggtgcggggaggaaggccgagggtgggagaggaggggcccggcggaaactgccgaggtttcccgaaggcggcagcgtccgagttgcccggatgtagttggtggagcggcagccgccgcctgcgcgcccgcccgcctttcgcggccgctctcccccctccccgacacacactcacaggccgggcattgatggtaatgtatgcgaggaaacagcagagactcagtgatggctgtcacgaccggaggggggactcgcagccttaccaggcacttaagtattcatcgaagagtcaccccagtagcggtgatcacagacatgaaaagatgcgagacgccggagatccttcaccaccaaataaaatgttgcggagatctgatagtcctgaaaacaaatacagtgacagcacaggtcacagtaaggccaaaaatgtgcatactcacagagttagagagagggatggtgggaccagttactctccacaagaaaattcacacaaccacagtgctcttcatagttcaaattcacattcttctaatccaagcaataacccaagcaaaacttcagatgcaccttatgattctgcagatgactggtctgagcatattagctcttctgggaaaaagtactactacaattgtcgaacagaagtttcacaatgggaaaaaccaaaagagtggcttgaaagagaacagagacaaaaagaagcaaacaagatggcagtcaacagcttcccaaaagatagggattacagaagagaggtgatgcaagcaacagccactagtgggtttgccagtggaatggaagacaagcattccagtgatgccagtagtttgctcccacagaatattttgtctcaaacaagcagacacaatgacagagactacagactgccaagagcagagactcacagtagttctacgccagtacagcaccccatcaaaccagtggttcatccaactgctaccccaagcactgttccttctagtccatttacgctacagtctgatcaccagccaaagaaatcatttgatgctaatggagcatctactttatcaaaactgcctacacccacatcttctgtccctgcacagaaaacagaaagaaaagaatctacatcaggagacaaacccgtatcacattcttgcacaactccttccacgtcttctgcctctggactgaaccccacatctgcacctccaacatctgcttcagcggtccctgtttctcctgttccacagtcgccaatacctcccttacttcaggacccaaatcttcttagacaattgcttcctgctttgcaagccacgctgcagcttaataattctaatgtggacatatctaaaataaatgaagattcataagtttcttactgctggaccatctgctttcaacataacgtctctgatttctcaagctgctcagctctctacacaagcccagccatctaatcagtctccgatgtctttaacatctgatgcgtcatccccaagatcatatgtttctccaagaataagcacacctcaaactaacacagtccctatcaaacctttgatcagtactcctcctgtttcatcacagccaaaggtacttcaagaggtaaaccaggaccaatggcacaagtaggcacacaagaagcctggtactgtgtgccaggcgcgaaggcatgaaacctggttttcttgaagccttagcgttcaaccccagaggtcaataactggttccatcatacttttaaat

SEQ ID NO: 365325 - DNA, 1922 bp, Homo sapiens
agggccggtggcgcgcggcgtccggtgaggggcagcggcccgggctcggttccggcttccagcagcggcccgaaggcgccggagcacgctccccgctccccagaacgcagcttccgcggctgcagcccaggcagctcttcgggaagcgtccgcccgtggtctcgccagggggtttccgacctccccgcccgacagcgcaggggcgggggccgcggccggagagctcgcccgagagcaccccctcccgctgcgcctctgggcgcacgcgcagccgctgcagcctcccttatttagtccgcgatggcttccctcgcgccccaccgtcctcttccggaaggcggctccctccctgcgcagcccggagcccctgagatcagcctcgagcaggcgcccgagcgagactatccctaaacgggaacggcggtggccgactcgcgagtgaggaaaagaaggaaagggcagactggtcgcgaagagaagatccaggcctcagaggaggagaaaggccggagccagccgaggtttgccgagggcggtgttccggacccgcgcggtgcggggaggaaggccgagggtgggagaggaggggcccggcggaaactgccgaggtttcccgaaggcggcagcgtccgagttgcccggatgtagttggtggagcggcagccgccgcctgcgcgcccgcccgcctttcgcggccgctctcccccctccccgacacacactcacaggccgggcattgatggtaatgtatgcgaggaaacagcagagactcagtgatggctgtcacgaccggaggggggactcgcagccttaccaggcacttaagtattcatcgaagagtcaccccagtagcggtgatcacagacatgaaaagatgcgagacgccggagatccttcaccaccaaataaaatgttgcggagatctgatagtcctgaaaacaaatacagtgacagcacaggtcacagtaaggccaaaaatgtgcatactcacagagttagagagagggatggtgggaccagttactctccacaagaaaattcacacaaccacagtgctcttcatagttcaaattcacattcttctaatccaagcaataacccaagcaaaacttcagatgcaccttatgattctgcagatgactggtctgagcatattagctcttctgggaaaaagtactactacaattgtcgaacagaagtttcacaatgggaaaaaccaaaagagtggcttgaaagagaacagagacaaaaagaagcaaacaagatggcagtcaacagcttcccaaaagatagggattacagaagagaggtgatgcaagcaacagccactagtgggtttgccagtggaaaatctacatcaggagacaaacccgtatcacattcttgcacaactccttccacgtcttctgcctctggactgaaccccacatctgcacctccaacatctgcttcagcggtccctgtttctcctgttccacagtcgccaatacctcccttacttcaggacccaaatcttcttagacaattgcttcctgctttgcaagccacgctgcagcttaataattctaatgtggacatatctaaaataaatgaagttcttacagcagctgtgacacaagcctcactgcagtctataattcataagtttcttactgctggaccatctgctttcaacataacgtctctgatttctcaagctgctcagctctctacacaagcccagccatctaatcagtctccgatgtctttaacatctgatgcgtcatccccaagatcatatgtttctccaagaataagcacacctcaaactaacacagtccctatcaaacctttgatcagtactcctcctgtttcatcacagccaaagagtactccagcctgggtgacacagtgagaccccatctcaaaaaaaaaaaaaaaac

SEQ ID NO: 365326 - DNA, 1706 bp, Homo sapiens
agggccggtggcgcgcggcgtccggtgaggggcagcggcccgggctcggttccggcttccagcagcggcccgaaggcgccggagcacgctccccgctccccagaacgcagcttccgcggctgcagcccaggcagctcttcgggaagcgtccgcccgtggtctcgccagggggtttccgacctccccgcccgacagcgcaggggcgggggccgcggccggagagctcgcccgagagcaccccctcccgctgcgcctctgggcgcacgcgcagccgctgcagcctcccttatttagtccgcgatggcttccctcgcgccccaccgtcctcttccggaaggcggctccctccctgcgcagcccggagcccctgagatcagcctcgagcaggcgcccgagcgagactatccctaaacgggaacggcggtggccgactcgcgagtgaggaaaagaaggaaagggcagactggtcgcgaagagaagatccaggcctcagaggaggagaaaggccggagccagccgaggtttgccgagggcggtgttccggacccgcgcggtgcggggaggaaggccgagggtgggagaggaggggcccggcggaaactgccgaggtttcccgaaggcggcagcgtccgagttgcccggatgtagttggtggagcggcagccgccgcctgcgcgcccgcccgcctttcgcggccgctctcccccctccccgacacacactcacaggccgggcattgatggtaatgtatgcgaggaaacagcagagactcagtgatggctgtcacgaccggaggggggactcgcagccttaccaggcacttaagtattcatcgaagagtcaccccagtagcggtgatcacagacatgaaaagatgcgagacgccggagatccttcaccaccaaataaaatgttgcggagatctgatagtcctgaaaacaaatacagtgacagcacaggtcacagtaaggccaaaaatgtgcatactcacagagttagagagagggatggtgggaccagttactctccacaagaaaattcacacaaccacagtgctcttcatagttcaaattcacattcttctaatccaagcaataacccaagcaaaacttcagatgcaccttatgattctgcagatgactggtctgagcatattagctcttctgggaaaaagtactactacaattgtcgaacagaagtttcacaatgggaaaaaccaaaagagtggcttgaaaggtaattagcttttaatctaattaaacattatttctctagcttggttctactggttaacatcttacagcattaaacattctaatttagcttttttatagtgctgcccatctacactttttagttgcggtggttggttgccccttcgtgttttccatagtttgtctttacttttaaaaacaaaaaacctggctgggtgcagtggctcatgcctgtaatcccagaactttgggaggccaagacgggaggatcacttgagcccaggagtttgaggccagccctggcaacatagtgagaccctgcctctacaaaaagttagctgtgagtggtagcatgcacttgtagtcctagctactaagaggctgaggtgggaggatggcttgagcctaagaggccaaagctgcagtgagccatcatggtgccactacactctagcctgagcaacagagcaagatgctatctcaaaaaaaaaa

SEQ ID NO: 365327 - DNA, 480 bp, Homo sapiens
gcggccgcgcgggcgggcgggcgggaacgcagtgtggcggggagcgggggcccggcttcgcggcatttcgccctctccggcccttccggaggctccgggtttgtgccgtgtgcgtgcggggctcggcgctggggcgctcggtaggtctcccgcggggaggggcggcgggggccccgttttcttcctccccggccccccacccgcgccgtgtcttatgtcgctgccttctcttcctgtttttcagctgtcacgaccggaggggggactcgcagccttaccaggtaccagccgaggccggggtggagggattggaaggggccggagggggaagggagggactgctactcgagcgcaggcctcagaagtcgatacaggcccttcggtgcaacacatctgaaactagcaccgcggatccccttaaaattccaggtttggttcctttagcgctctccagcaaggtttagtgacttattttgacag

SEQ ID NO: 365328 - DNA, 700 bp, Homo sapiens
tgttactttagtttcagtaatcattgtgaatgagactgtgagaaacttggcttgttcagaagatactgtgcataagacatgagataacaagagtaatccacagacttaaaacatgagctcagatgccagccaaggcgtgattaccactcctcctcctcccagcatgcctcacaaagagagatattttgaccgcatcaatgaaaatgacccagaatacattagggagaggaacatgtctcctgatctacgacaagacttcaacatgatggagcagaggaaacgagttactcagatcctgcaaagtcctgcctttcgggaagacttggaatgccttattcaagaacagatgaagaaaggccacaacccaactggattactagcattacagcagattgcagattacatcatggccaattctttctcgggtttttcttcacctcctctcagtcttggcatggtcacacctatcaatgaccttcctggtgcagatacatcctcatatgtgaagggagaaaaacttactcgctgtaaacttgccagcctgtacagacttgtagacttgtttggatgggcacacctggcaaatacctatatctcagtaagaataagtaaggagcaagaccacattataataattcccagaggcctatctttttctgaagctacagcctccaatttggtataattttccattcctgtg

SEQ ID NO: 365329 - DNA, 747 bp, Homo sapiens
agcggaatcccagcacttcggaaggcagaggtgggcggatcacctgaggtcggcagttcaagaccagcctgaccaacatagagaaaccctgtctctactaaaaatacaaaattagccgggtggtggcgcatgcctgtaatcccagctactcaggaggctgaggcaggagaatcgcttcaacccgggaggcggaggttgcggcctttcgggaagacttggaatgccttattcaagaacagatgaagaaaggccacaacccaactggattactagcattacagcagattgcagattacatcatggccaattctttctcgggtttttcttcacctcctctcagtcttggcatggtcacacctatcaatgaccttcctggtgcagatacatcctcatatgtgaagggagaaaaacttactcgctgtaaacttgccagcctgtacagacttgtagacttgtttggatgggcacacctggcaaatacctatatctcagtaagaataagtaaggagcaagaccacattataataattcccagaggcctatctttttctgaagctacagcctccaatttggtgaaagtcaatataataggagaagtggttgaccagggaagtagatgctttactatctgcttttcaaaatcatatttgatacaataatctgcatacccagaaagcaaaaggcctttgggaccaaatgctaccattctaggaaacaactggagaaataacatttggattctaaaac

SEQ ID NO: 365330 - DNA, 971 bp, Homo sapiens
aatatgttaagaggtatggctctaatgtgttttccatcagggaggatcagagtcttggaaggtttctttttcagataggtggaaaagatacttcagctgtctgctggcacaagagtgtcatcttgtctttgttgttagtagcctgagcaagtattatagatatttgccaaattgaaattgtgcctttttgaaagtaaaatactcattacagtctttatagttttgtgtctctgtatattttaccattgattacaggtgcaggccctagcaggtgcaggtggagtagacaatctccatgtactggactttcagaagtataaagctttcacttacactgtagcagcgtctggtggaggaggtgtgaatatgggttcccatcaaaaatggaaggttggcgaaattgagtttgaagggcttatgaggactctggacaacttggtaggttgcaaaattgaagtaaaacttggatttaatgtcttcagattcaagagcagatgcttccatttttgtagaacatgctccatactcttccagaagctgagtttggccctaggaaagcatttcattgttatttaaccacacctttgagaattaaacagaacttacaaatgtcgtgttttttttttaagattacaatatatgttattaactgtagtcaccatagtacaatatatctcttgaactttttcctcctaactgaaattttgtatcctttgatcaacatctccccacccccacctccttgtaaccactattctactctacttttatgagttcaacttttttttttttcttggaggcaggatcttgcttggagtgccgtgacacaatcagggctcacttgcagtctcaacctgctgggctcaaaccattcttccacctcagcctcctgtgtatctgggacataacgtgtgtgccaccgtgcctggctaatttatttttttttttttactttttgtagagatagggtt

SEQ ID NO: 365331 - DNA, 514 bp, Homo sapiens
tcctggagaaaccaggcccagcttcatttggaggatttgacaggatcttagtaccaagtggaattgttgcctgcttaattttaattatgcttcccagcaggaggcctaaacacatgatgaagaactaattcagtacttgttggaatgcatgggaaaagagaaacctgaagaagttgttgagccttatgttaaaaacagccgagtagtggtgaaattaaattaagtggtaaagaaaattattttaatgagagcagtctttcaatagcaggtctggttggttattgatggctcctgcagacaataatgatgttaaaatctgcttgggcttagaatcagcaaacaaatcatttgcctaactggaggtaagggttttaagaatacttgaatacttcgattgtttttttctcctgccctttttgtctcattttgtaaggcaatgattcctacttgagtgaattcactgtttcaaagtagattttgttgttgttttggtgtatggtagtggtttcctggt

SEQ ID NO: 365332 - DNA, 4330 bp, Homo sapiens
agcgtagtcccgccagagcgcgagccgccagcccgtaacggtcgccagtgtgaggggcgggagggaaagaagaggggtttaaattagattttttaaaacacagagcaagcgccagaggcgtcggcatcccaggtgtcgccgcttcctgctgcacagggctcggcgtacaggtccctccctcctcaagccccctccccttctcccgccctaccctctggggctctgcggcgcttaagaggcggccgcagcggcggatccggcggctgctgcagcccgggcggctgccgagaaggagggaggggaaacacaaagccggctacgcgctgcgagataacaagagtaatccacagacttaaaacatgagctcagatgccagccaaggcgtgattaccactcctcctcctcccagcatgcctcacaaagagagatattttgaccgcatcaatgaaaatgacccagaatacattagggagaggaacatgtctcctgatctacgacaagacttcaacatgatggagcagaggaaacgagttactcagatcctgcaaagtcctgcctttcgggaagacttggaatgccttattcaagaacagatgaagaaaggccacaacccaactggattactagcattacagcagattgcagattacatcatggccaattctttctcgggtttttcttcacctcctctcagtcttggcatggtcacacctatcaatgaccttcctggtgcagatacatcctcatatgtgaagggagaaaaacttactcgctgtaaacttgccagcctgtacagacttgtagacttgtttggatgggcacacctggcaaatacctatatctcagtaagaataagtaaggagcaagaccacattataataattcccagaggcctatctttttctgaagctacagcctccaatttggtgaaagtcaatataataggagaagtggttgaccagggaagtaccaatttgaaaattgaccatacaggattcagtccccatgctgcaatctattcaacacgtcctgatgttaagtgtgtgatacacatccatacccttgcaacagcagctgtatcctccatgaaatgtgggatccttccaatttctcaagagtctcttcttctgggagatgttgcctattatgactaccaagggtcacttgaagaacaggaggagagaattcaactgcagaaggttctgggaccaagttgtaaggtgctggtactcaggaatcatggtgtggttgcacttggagaaacattagaggaggcttttcattatatttttaatgtgcaactagcctgtgagattcaggtgcaggccctagcaggtgcaggtggagtagacaatctccatgtactggactttcagaagtataaagctttcacttacactgtagcagcgtctggtggaggaggtgtgaatatgggttcccatcaaaaatggaaggttggcgaaattgagtttgaagggcttatgaggactctggacaacttggggtatagaacaggctatgcttacaggcatcctctcattcgagagaagcctaggcacaagagtgatgtggaaatcccagcaactgtgactgctttttcctttgaagacgatacagtgccactctctcctctcaaatacatggcacagaggcaacagcgtgaaaaaacaagatggctgaactcaccaaatacttacatgaaagtgaatgtgcctgaggagtctcggaacggagaaaccagtccccgaaccaaaatcacgtggatgaaagcagaagactcatctaaagttagtggtggaacacctatcaaaattgaagatccaaatcagtttgttcctttaaacacaaacccgaatgaggtactagaaaagagaaataagattcgggaacaaaatcgatatgacttgaaaacagcaggaccacaatctcagttgcttgctggaattgttgtggataagccaccttctactatgcaatttgaagatgatgatcatggcccaccagctcctcctaacccatttagtcatctcacagaaggagaacttgaagagtataagaggacaatcgaacgtaaacaacaaggcctagaagaaaaccatgagctgttttccaagagcttcatctccatggaagtgcctgtcatggtagtaaatggcaaggatgatatgcatgatgttgaagatgagcttgctaagcgagtgagtaggttaagcacaagtacaaccatagaaaacatcgagattactattaagtctccagagaaaatcgaagaagtcctgtcacctgaaggctccccttcaaaatcgccatccaagaaaaagaagaaattccgcactccttcttttctgaaaaagaacaaaaaaaaggagaaagttgaggcctaaataaagtctttttataattattattataacaatgtgacattgcacatctaaataccacatttaagttgatcattaatatgcaatggtagatcagattgggggatgtagcaaactggactttaagaactggaaagaggttttacaaaagaaaaactttcagattcatctctcattttatatgtccagaaatggctttgaattttaagcaattactagttttaattagctctgccctcatgaagtattattataattcaccataaacagctatctgtctgaattacttcaggccttctccataatatctgttagaaagaaattgccagtgagcaagtgagaatttttatttctcaatacctgcttcacttgataatcatattataattttttatcatgattattgactatatttttggagtcccattgtttcagtgggcattaacagaatgctttaaaaacttctaagacaagaatctatagcattagtatacactggcacataattttttaaaaagttttaagaaaagattcatttggaattttattcacagtataaaatttcctcacctgaagtaactttgtttgccaaaaaagttgttttaataaactataatttttgaaaacttccttttttattagtttagaaagccccttatttttcaacaaaggggattttgtacacataacatgggttatttagtttaactctggcaaaaaaaaaaaaaaaattttgtatgttgatgtttgtataccgttcagtataaaagtgtcctaagcatattagccaatcttttcacagtagagcatacttaaggctgcttggtactgagtatacttaaatataactccagaatccagggacttggtgttaaaacaggattagagcatgtaaaggtacatctagattcatatttgaatcttaaactgtatttttctcttagtattgctaatgagtaaagaaaagtctcataaggtagccaaatgaaaaagaatgaaagggaaagtgaaaaattaaggggacaaaagatgggatgtgaaaagaagaattctagtttgatggtgactcatattcacgataggatacaaagtgtgatttgttggaaacatgtcccaaatttctaaaattctgcttctctgccaaaagcaatgtctttcttggttgatatttgagttttaaaagggtcaaatctttctaattttttgtatctttagagggcagcactagaagaaatcagcaggtctaatcccaccagtaagaaaactaccacttcttgatttttacagatttaaaaaaatcttttcagtgacctttctttttaatgtaaatacaaatttaaacctaggcttaatataggcgtttcccctttcacccaagtgatgtcacagttcgatgcaaaatcaatgatccagaatgatcgtgggtaaaaataactcaaagtgtttcttaagggtgagttggcatgcaaaaaattacattgattacagtgtgttttggagctggctctgtttgtgtgcatatgataatgcagagttgagccagagcctggaaatgtcattctagatctcactaactactggaatcagtgttttaatctcttggtggaaactttcagttgcttaactctctattggaagatttttttaatgttctacatcatttatgttgtattacaatgtatgtagaaatagtaacctgtgaactatgcttttccataactttttaaaaatatatatatctaaatgaatgcaatgtgcataaatattttttaaacataacagtgaactattgcaccttttgctaatgcctctatttacttgctttggcataaagaatgagccaatgaacctctgtgtcctgtggaaaaatgtataaatgttatctgatattgctcttagatgtaatgctaattaatgttaaatcacaaataaacagtattttaaatata

SEQ ID NO: 365333 - DNA, 4426 bp, Homo sapiens
agcgtagtcccgccagagcgcgagccgccagcccgtaacggtcgccagtgtgaggggcgggagggaaagaagaggggtttaaattagattttttaaaacacagagcaagcgccagaggcgtcggcatcccaggtgtcgccgcttcctgctgcacagggctcggcgtacaggtccctccctcctcaagccccctccccttctcccgccctaccctctggggctctgcggcgcttaagaggcggccgcagcggcggatccggcggctgctgcagcccgggcggctgccgagaaggagggaggggaaacacaaagccggctacgcgctgcgagataacaagagtaatccacagacttaaaacatgagctcagatgccagccaaggcgtgattaccactcctcctcctcccagcatgcctcacaaagagagatattttgaccgcatcaatgaaaatgacccagaatacattagggagaggaacatgtctcctgatctacgacaagacttcaacatgatggagcagaggaaacgagttactcagatcctgcaaagtcctgcctttcgggaagacttggaatgccttattcaagaacagatgaagaaaggccacaacccaactggattactagcattacagcagattgcagattacatcatggccaattctttctcgggtttttcttcacctcctctcagtcttggcatggtcacacctatcaatgaccttcctggtgcagatacatcctcatatgtgaagggagaaaaacttactcgctgtaaacttgccagcctgtacagacttgtagacttgtttggatgggcacacctggcaaatacctatatctcagtaagaataagtaaggagcaagaccacattataataattcccagaggcctatctttttctgaagctacagcctccaatttggtgaaagtcaatataataggagaagtggttgaccagggaagtaccaatttgaaaattgaccatacaggattcagtccccatgctgcaatctattcaacacgtcctgatgttaagtgtgtgatacacatccatacccttgcaacagcagctgtatcctccatgaaatgtgggatccttccaatttctcaagagtctcttcttctgggagatgttgcctattatgactaccaagggtcacttgaagaacaggaggagagaattcaactgcagaaggttctgggaccaagttgtaaggtgctggtactcaggaatcatggtgtggttgcacttggagaaacattagaggaggcttttcattatatttttaatgtgcaactagcctgtgagattcaggtgcaggccctagcaggtgcaggtggagtagacaatctccatgtactggactttcagaagtataaagctttcacttacactgtagcagcgtctggtggaggaggtgtgaatatgggttcccatcaaaaatggaaggttggcgaaattgagtttgaagggcttatgaggactctggacaacttggggtatagaacaggctatgcttacaggcatcctctcattcgagagaagcctaggcacaagagtgatgtggaaatcccagcaactgtgactgctttttcctttgaagacgatacagtgccactctctcctctcaaatacatggcacagaggcaacagcgtgaaaaaacaagatggctgaactcaccaaatacttacatgaaagtgaatgtgcctgaggagtctcggaacggagaaaccagtccccgaaccaaaatcacgtggatgaaagcagaagactcatctaaagttagtggtggaacacctatcaaaattgaagatccaaatcagtttgttcctttaaacacaaacccgaatgaggtactagaaaagagaaataagattcgggaacaaaatcgatatgacttgaaaacagcaggaccacaatctcagttgcttgctggaattgttgtggataagccaccttctactatgcaatttgaagatgatgatcatggcccaccagctcctcctaacccatttagtcatctcacagaaggagaacttgaagagtataagaggacaatcgaacgtaaacaacaaggcctagaagatgctgagcaggaattactctcagatgacgcttcatctgtttcacaaattcagtctcaaactcagtcaccgcaaaatgtccctgaaaaattagaagaaaaccatgagctgttttccaagagcttcatctccatggaagtgcctgtcatggtagtaaatggcaaggatgatatgcatgatgttgaagatgagcttgctaagcgagtgagtaggttaagcacaagtacaaccatagaaaacatcgagattactattaagtctccagagaaaatcgaagaagtcctgtcacctgaaggctccccttcaaaatcgccatccaagaaaaagaagaaattccgcactccttcttttctgaaaaagaacaaaaaaaaggagaaagttgaggcctaaataaagtctttttataattattattataacaatgtgacattgcacatctaaataccacatttaagttgatcattaatatgcaatggtagatcagattgggggatgtagcaaactggactttaagaactggaaagaggttttacaaaagaaaaactttcagattcatctctcattttatatgtccagaaatggctttgaattttaagcaattactagttttaattagctctgccctcatgaagtattattataattcaccataaacagctatctgtctgaattacttcaggccttctccataatatctgttagaaagaaattgccagtgagcaagtgagaatttttatttctcaatacctgcttcacttgataatcatattataattttttatcatgattattgactatatttttggagtcccattgtttcagtgggcattaacagaatgctttaaaaacttctaagacaagaatctatagcattagtatacactggcacataattttttaaaaagttttaagaaaagattcatttggaattttattcacagtataaaatttcctcacctgaagtaactttgtttgccaaaaaagttgttttaataaactataatttttgaaaacttccttttttattagtttagaaagccccttatttttcaacaaaggggattttgtacacataacatgggttatttagtttaactctggcaaaaaaaaaaaaaaaattttgtatgttgatgtttgtataccgttcagtataaaagtgtcctaagcatattagccaatcttttcacagtagagcatacttaaggctgcttggtactgagtatacttaaatataactccagaatccagggacttggtgttaaaacaggattagagcatgtaaaggtacatctagattcatatttgaatcttaaactgtatttttctcttagtattgctaatgagtaaagaaaagtctcataaggtagccaaatgaaaaagaatgaaagggaaagtgaaaaattaaggggacaaaagatgggatgtgaaaagaagaattctagtttgatggtgactcatattcacgataggatacaaagtgtgatttgttggaaacatgtcccaaatttctaaaattctgcttctctgccaaaagcaatgtctttcttggttgatatttgagttttaaaagggtcaaatctttctaattttttgtatctttagagggcagcactagaagaaatcagcaggtctaatcccaccagtaagaaaactaccacttcttgatttttacagatttaaaaaaatcttttcagtgacctttctttttaatgtaaatacaaatttaaacctaggcttaatataggcgtttcccctttcacccaagtgatgtcacagttcgatgcaaaatcaatgatccagaatgatcgtgggtaaaaataactcaaagtgtttcttaagggtgagttggcatgcaaaaaattacattgattacagtgtgttttggagctggctctgtttgtgtgcatatgataatgcagagttgagccagagcctggaaatgtcattctagatctcactaactactggaatcagtgttttaatctcttggtggaaactttcagttgcttaactctctattggaagatttttttaatgttctacatcatttatgttgtattacaatgtatgtagaaatagtaacctgtgaactatgcttttccataactttttaaaaatatatatatctaaatgaatgcaatgtgcataaatattttttaaacataacagtgaactattgcaccttttgctaatgcctctatttacttgctttggcataaagaatgagccaatgaacctctgtgtcctgtggaaaaatgtataaatgttatctgatattgctcttagatgtaatgctaattaatgttaaatcacaaataaacagtattttaaatata

SEQ ID NO: 365334 - DNA, 4384 bp, Homo sapiens
agcgtagtcccgccagagcgcgagccgccagcccgtaacggtcgccagtgtgaggggcgggagggaaagaagaggggtttaaattagattttttaaaacacagagcaagcgccagaggcgtcggcatcccaggtgtcgccgcttcctgctgcacagggctcggcgtacaggtccctccctcctcaagccccctccccttctcccgccctaccctctggggctctgcggcgcttaagaggcggccgcagcggcggatccggcggctgctgcagcccgggcggctgccgagaaggagggaggggaaacacaaagccggctacgcgctgcgagataacaagagtaatccacagacttaaaacatgagctcagatgccagccaaggcgtgattaccactcctcctcctcccagcatgcctcacaaagagagatattttgaccgcatcaatgaaaatgacccagaatacattagggagaggaacatgtctcctgatctacgacaagacttcaacatgatggagcagaggaaacgagttactcagatcctgcaaagtcctggccagtggtattctatttccaaatgagtacatttcttaatggagaaattctaagcctttcgggaagacttggaatgccttattcaagaacagatgaagaaaggccacaacccaactggattactagcattacagcagattgcagattacatcatggccaattctttctcgggtttttcttcacctcctctcagtcttggcatggtcacacctatcaatgaccttcctggtgcagatacatcctcatatgtgaagggagaaaaacttactcgctgtaaacttgccagcctgtacagacttgtagacttgtttggatgggcacacctggcaaatacctatatctcagtaagaataagtaaggagcaagaccacattataataattcccagaggcctatctttttctgaagctacagcctccaatttggtgaaagtcaatataataggagaagtggttgaccagggaagtaccaatttgaaaattgaccatacaggattcagtccccatgctgcaatctattcaacacgtcctgatgttaagtgtgtgatacacatccatacccttgcaacagcagctgtatcctccatgaaatgtgggatccttccaatttctcaagagtctcttcttctgggagatgttgcctattatgactaccaagggtcacttgaagaacaggaggagagaattcaactgcagaaggttctgggaccaagttgtaaggtgctggtactcaggaatcatggtgtggttgcacttggagaaacattagaggaggcttttcattatatttttaatgtgcaactagcctgtgagattcaggtgcaggccctagcaggtgcaggtggagtagacaatctccatgtactggactttcagaagtataaagctttcacttacactgtagcagcgtctggtggaggaggtgtgaatatgggttcccatcaaaaatggaaggttggcgaaattgagtttgaagggcttatgaggactctggacaacttggggtatagaacaggctatgcttacaggcatcctctcattcgagagaagcctaggcacaagagtgatgtggaaatcccagcaactgtgactgctttttcctttgaagacgatacagtgccactctctcctctcaaatacatggcacagaggcaacagcgtgaaaaaacaagatggctgaactcaccaaatacttacatgaaagtgaatgtgcctgaggagtctcggaacggagaaaccagtccccgaaccaaaatcacgtggatgaaagcagaagactcatctaaagttagtggtggaacacctatcaaaattgaagatccaaatcagtttgttcctttaaacacaaacccgaatgaggtactagaaaagagaaataagattcgggaacaaaatcgatatgacttgaaaacagcaggaccacaatctcagttgcttgctggaattgttgtggataagccaccttctactatgcaatttgaagatgatgatcatggcccaccagctcctcctaacccatttagtcatctcacagaaggagaacttgaagagtataagaggacaatcgaacgtaaacaacaaggcctagaagaaaaccatgagctgttttccaagagcttcatctccatggaagtgcctgtcatggtagtaaatggcaaggatgatatgcatgatgttgaagatgagcttgctaagcgagtgagtaggttaagcacaagtacaaccatagaaaacatcgagattactattaagtctccagagaaaatcgaagaagtcctgtcacctgaaggctccccttcaaaatcgccatccaagaaaaagaagaaattccgcactccttcttttctgaaaaagaacaaaaaaaaggagaaagttgaggcctaaataaagtctttttataattattattataacaatgtgacattgcacatctaaataccacatttaagttgatcattaatatgcaatggtagatcagattgggggatgtagcaaactggactttaagaactggaaagaggttttacaaaagaaaaactttcagattcatctctcattttatatgtccagaaatggctttgaattttaagcaattactagttttaattagctctgccctcatgaagtattattataattcaccataaacagctatctgtctgaattacttcaggccttctccataatatctgttagaaagaaattgccagtgagcaagtgagaatttttatttctcaatacctgcttcacttgataatcatattataattttttatcatgattattgactatatttttggagtcccattgtttcagtgggcattaacagaatgctttaaaaacttctaagacaagaatctatagcattagtatacactggcacataattttttaaaaagttttaagaaaagattcatttggaattttattcacagtataaaatttcctcacctgaagtaactttgtttgccaaaaaagttgttttaataaactataatttttgaaaacttccttttttattagtttagaaagccccttatttttcaacaaaggggattttgtacacataacatgggttatttagtttaactctggcaaaaaaaaaaaaaaaattttgtatgttgatgtttgtataccgttcagtataaaagtgtcctaagcatattagccaatcttttcacagtagagcatacttaaggctgcttggtactgagtatacttaaatataactccagaatccagggacttggtgttaaaacaggattagagcatgtaaaggtacatctagattcatatttgaatcttaaactgtatttttctcttagtattgctaatgagtaaagaaaagtctcataaggtagccaaatgaaaaagaatgaaagggaaagtgaaaaattaaggggacaaaagatgggatgtgaaaagaagaattctagtttgatggtgactcatattcacgataggatacaaagtgtgatttgttggaaacatgtcccaaatttctaaaattctgcttctctgccaaaagcaatgtctttcttggttgatatttgagttttaaaagggtcaaatctttctaattttttgtatctttagagggcagcactagaagaaatcagcaggtctaatcccaccagtaagaaaactaccacttcttgatttttacagatttaaaaaaatcttttcagtgacctttctttttaatgtaaatacaaatttaaacctaggcttaatataggcgtttcccctttcacccaagtgatgtcacagttcgatgcaaaatcaatgatccagaatgatcgtgggtaaaaataactcaaagtgtttcttaagggtgagttggcatgcaaaaaattacattgattacagtgtgttttggagctggctctgtttgtgtgcatatgataatgcagagttgagccagagcctggaaatgtcattctagatctcactaactactggaatcagtgttttaatctcttggtggaaactttcagttgcttaactctctattggaagatttttttaatgttctacatcatttatgttgtattacaatgtatgtagaaatagtaacctgtgaactatgcttttccataactttttaaaaatatatatatctaaatgaatgcaatgtgcataaatattttttaaacataacagtgaactattgcaccttttgctaatgcctctatttacttgctttggcataaagaatgagccaatgaacctctgtgtcctgtggaaaaatgtataaatgttatctgatattgctcttagatgtaatgctaattaatgttaaatcacaaataaacagtattttaaatata

SEQ ID NO: 365335 - DNA, 4299 bp, Homo sapiens
agcgtagtcccgccagagcgcgagccgccagcccgtaacggtcgccagtgtgaggggcgggagggaaagaagaggggtttaaattagattttttaaaacacagagcaagcgccagaggcgtcggcatcccaggtgtcgccgcttcctgctgcacagggctcggcgtacaggtccctccctcctcaagccccctccccttctcccgccctaccctctggggctctgcggcgcttaagaggcggccgcagcggcggatccggcggctgctgcagcccgggcggctgccgagaaggagggaggggaaacacaaagccggctacgcgctgcgagataacaagagtaatccacagacttaaaacatgagctcagatgccagcccatgcctcacaaagagagatattttgaccgcatcaatgaaaatgacccagaatacattagggagaggaacatgtctcctgatctacgacaagacttcaacatgatggagcagaggaaacgagttactcagatcctgcaaagtcctgcctttcgggaagacttggaatgccttattcaagaacagatgaagaaaggccacaacccaactggattactagcattacagcagattgcagattacatcatggccaattctttctcgggtttttcttcacctcctctcagtcttggcatggtcacacctatcaatgaccttcctggtgcagatacatcctcatatgtgaagggagaaaaacttactcgctgtaaacttgccagcctgtacagacttgtagacttgtttggatgggcacacctggcaaatacctatatctcagtaagaataagtaaggagcaagaccacattataataattcccagaggcctatctttttctgaagctacagcctccaatttggtgaaagtcaatataataggagaagtggttgaccagggaagtaccaatttgaaaattgaccatacaggattcagtccccatgctgcaatctattcaacacgtcctgatgttaagtgtgtgatacacatccatacccttgcaacagcagctgtatcctccatgaaatgtgggatccttccaatttctcaagagtctcttcttctgggagatgttgcctattatgactaccaagggtcacttgaagaacaggaggagagaattcaactgcagaaggttctgggaccaagttgtaaggtgctggtactcaggaatcatggtgtggttgcacttggagaaacattagaggaggcttttcattatatttttaatgtgcaactagcctgtgagattcaggtgcaggccctagcaggtgcaggtggagtagacaatctccatgtactggactttcagaagtataaagctttcacttacactgtagcagcgtctggtggaggaggtgtgaatatgggttcccatcaaaaatggaaggttggcgaaattgagtttgaagggcttatgaggactctggacaacttggggtatagaacaggctatgcttacaggcatcctctcattcgagagaagcctaggcacaagagtgatgtggaaatcccagcaactgtgactgctttttcctttgaagacgatacagtgccactctctcctctcaaatacatggcacagaggcaacagcgtgaaaaaacaagatggctgaactcaccaaatacttacatgaaagtgaatgtgcctgaggagtctcggaacggagaaaccagtccccgaaccaaaatcacgtggatgaaagcagaagactcatctaaagttagtggtggaacacctatcaaaattgaagatccaaatcagtttgttcctttaaacacaaacccgaatgaggtactagaaaagagaaataagattcgggaacaaaatcgatatgacttgaaaacagcaggaccacaatctcagttgcttgctggaattgttgtggataagccaccttctactatgcaatttgaagatgatgatcatggcccaccagctcctcctaacccatttagtcatctcacagaaggagaacttgaagagtataagaggacaatcgaacgtaaacaacaaggcctagaagaaaaccatgagctgttttccaagagcttcatctccatggaagtgcctgtcatggtagtaaatggcaaggatgatatgcatgatgttgaagatgagcttgctaagcgagtgagtaggttaagcacaagtacaaccatagaaaacatcgagattactattaagtctccagagaaaatcgaagaagtcctgtcacctgaaggctccccttcaaaatcgccatccaagaaaaagaagaaattccgcactccttcttttctgaaaaagaacaaaaaaaaggagaaagttgaggcctaaataaagtctttttataattattattataacaatgtgacattgcacatctaaataccacatttaagttgatcattaatatgcaatggtagatcagattgggggatgtagcaaactggactttaagaactggaaagaggttttacaaaagaaaaactttcagattcatctctcattttatatgtccagaaatggctttgaattttaagcaattactagttttaattagctctgccctcatgaagtattattataattcaccataaacagctatctgtctgaattacttcaggccttctccataatatctgttagaaagaaattgccagtgagcaagtgagaatttttatttctcaatacctgcttcacttgataatcatattataattttttatcatgattattgactatatttttggagtcccattgtttcagtgggcattaacagaatgctttaaaaacttctaagacaagaatctatagcattagtatacactggcacataattttttaaaaagttttaagaaaagattcatttggaattttattcacagtataaaatttcctcacctgaagtaactttgtttgccaaaaaagttgttttaataaactataatttttgaaaacttccttttttattagtttagaaagccccttatttttcaacaaaggggattttgtacacataacatgggttatttagtttaactctggcaaaaaaaaaaaaaaaattttgtatgttgatgtttgtataccgttcagtataaaagtgtcctaagcatattagccaatcttttcacagtagagcatacttaaggctgcttggtactgagtatacttaaatataactccagaatccagggacttggtgttaaaacaggattagagcatgtaaaggtacatctagattcatatttgaatcttaaactgtatttttctcttagtattgctaatgagtaaagaaaagtctcataaggtagccaaatgaaaaagaatgaaagggaaagtgaaaaattaaggggacaaaagatgggatgtgaaaagaagaattctagtttgatggtgactcatattcacgataggatacaaagtgtgatttgttggaaacatgtcccaaatttctaaaattctgcttctctgccaaaagcaatgtctttcttggttgatatttgagttttaaaagggtcaaatctttctaattttttgtatctttagagggcagcactagaagaaatcagcaggtctaatcccaccagtaagaaaactaccacttcttgatttttacagatttaaaaaaatcttttcagtgacctttctttttaatgtaaatacaaatttaaacctaggcttaatataggcgtttcccctttcacccaagtgatgtcacagttcgatgcaaaatcaatgatccagaatgatcgtgggtaaaaataactcaaagtgtttcttaagggtgagttggcatgcaaaaaattacattgattacagtgtgttttggagctggctctgtttgtgtgcatatgataatgcagagttgagccagagcctggaaatgtcattctagatctcactaactactggaatcagtgttttaatctcttggtggaaactttcagttgcttaactctctattggaagatttttttaatgttctacatcatttatgttgtattacaatgtatgtagaaatagtaacctgtgaactatgcttttccataactttttaaaaatatatatatctaaatgaatgcaatgtgcataaatattttttaaacataacagtgaactattgcaccttttgctaatgcctctatttacttgctttggcataaagaatgagccaatgaacctctgtgtcctgtggaaaaatgtataaatgttatctgatattgctcttagatgtaatgctaattaatgttaaatcacaaataaacagtattttaaatata

SEQ ID NO: 365336 - DNA, 4309 bp, Homo sapiens
agcgtagtcccgccagagcgcgagccgccagcccgtaacggtcgccagtgtgaggggcgggagggaaagaagaggggtttaaattagattttttaaaacacagagcaagcgccagaggcgtcggcatcccaggtgtcgccgcttcctgctgcacagggctcggcgtacaggtccctccctcctcaagccccctccccttctcccgccctaccctctggggctctgcggcgcttaagaggcggccgcagcggcggatccggcggctgctgcagcccgggcggctgccgagaaggagggaggggaaacacaaagccggctacgcgctgcgagataacaagagtaatccacagacttaaaacatgagctcagatgccagccaaggcgtgattaccactcctcctcctcccagcatgcctcacaaagagagatattttgaccgcatcaatgaaaatgacccagaatacattagggagaggaacatgtctcctgatctacgacaagacttcaacatgatggagcagaggaaacgagttactcagatcctgcaaagtcctgcctttcgggaagacttggaatgccttattcaagaacagatgaagaaaggccacaacccaactggattactagcattacagcagattgcagattacatcatggccaattctttctcgggtttttcttcacctcctctcagtcttggcatggtcacacctatcaatgaccttcctggtgcagatacatcctcatatgtgaagggagaaaaacttactcgctgtaaacttgccagcctgtacagacttgtagacttgtttggatgggcacacctggcaaatacctatatctcagtaagaataagtaaggagcaagaccacattataataattcccagaggcctatctttttctgaagctacagcctccaatttggtgaaagtcaatataataggagaagtggttgaccagggaagtaccaatttgaaaattgaccatacaggattcagtccccatgctgcaatctattcaacacgtcctgatgttaagtgtgtgatacacatccatacccttgcaacagcagctgtatcctccatgaaatgtgggatccttccaatttctcaagagtctcttcttctgggagatgttgcctattatgactaccaagggtcacttgaagaacaggaggagagaattcaactgcagaaggttctgggaccaagttgtaaggtgctggtactcaggaatcatggtgtggttgcacttggagaaacattagaggaggcttttcattatatttttaatgtgcaactagcctgtgagattcaggtgcaggccctagcaggtgcaggtggagtagacaatctccatgtactggactttcagaagtataaagctttcacttacactgtagcagcgtctggtggaggaggtgtgaatatgggttcccatcaaaaatggaaggttggcgaaattgagtttgaagggcttatgaggactctggacaacttggggtatagaacaggctatgcttacaggcatcctctcattcgagagaagcctaggcacaagagtgatgtggaaatcccagcaactgtgactgctttttcctttgaagacgatacagtgccactctctcctctcaaatacatggcacagaggcaacagcgtgaaaaaacaagatggctgaactcaccaaatacttacatgaaagtgaatgtgcctgaggagtctcggaacggagaaaccagtccccgaaccaaaatcacgtggatgaaagcagaagactcatctaaagttagtggtggaacacctatcaaaattgaagatccaaatcagtttgttcctttaaacacaaacccgaatgagattcgggaacaaaatcgatatgacttgaaaacagcaggaccacaatctcagttgcttgctggaattgttgtggataagccaccttctactatgcaatttgaagatgatgatcatggcccaccagctcctcctaacccatttagtcatctcacagaaggagaacttgaagagtataagaggacaatcgaacgtaaacaacaaggcctagaagaaaaccatgagctgttttccaagagcttcatctccatggaagtgcctgtcatggtagtaaatggcaaggatgatatgcatgatgttgaagatgagcttgctaagcgagtgagtaggttaagcacaagtacaaccatagaaaacatcgagattactattaagtctccagagaaaatcgaagaagtcctgtcacctgaaggctccccttcaaaatcgccatccaagaaaaagaagaaattccgcactccttcttttctgaaaaagaacaaaaaaaaggagaaagttgaggcctaaataaagtctttttataattattattataacaatgtgacattgcacatctaaataccacatttaagttgatcattaatatgcaatggtagatcagattgggggatgtagcaaactggactttaagaactggaaagaggttttacaaaagaaaaactttcagattcatctctcattttatatgtccagaaatggctttgaattttaagcaattactagttttaattagctctgccctcatgaagtattattataattcaccataaacagctatctgtctgaattacttcaggccttctccataatatctgttagaaagaaattgccagtgagcaagtgagaatttttatttctcaatacctgcttcacttgataatcatattataattttttatcatgattattgactatatttttggagtcccattgtttcagtgggcattaacagaatgctttaaaaacttctaagacaagaatctatagcattagtatacactggcacataattttttaaaaagttttaagaaaagattcatttggaattttattcacagtataaaatttcctcacctgaagtaactttgtttgccaaaaaagttgttttaataaactataatttttgaaaacttccttttttattagtttagaaagccccttatttttcaacaaaggggattttgtacacataacatgggttatttagtttaactctggcaaaaaaaaaaaaaaaattttgtatgttgatgtttgtataccgttcagtataaaagtgtcctaagcatattagccaatcttttcacagtagagcatacttaaggctgcttggtactgagtatacttaaatataactccagaatccagggacttggtgttaaaacaggattagagcatgtaaaggtacatctagattcatatttgaatcttaaactgtatttttctcttagtattgctaatgagtaaagaaaagtctcataaggtagccaaatgaaaaagaatgaaagggaaagtgaaaaattaaggggacaaaagatgggatgtgaaaagaagaattctagtttgatggtgactcatattcacgataggatacaaagtgtgatttgttggaaacatgtcccaaatttctaaaattctgcttctctgccaaaagcaatgtctttcttggttgatatttgagttttaaaagggtcaaatctttctaattttttgtatctttagagggcagcactagaagaaatcagcaggtctaatcccaccagtaagaaaactaccacttcttgatttttacagatttaaaaaaatcttttcagtgacctttctttttaatgtaaatacaaatttaaacctaggcttaatataggcgtttcccctttcacccaagtgatgtcacagttcgatgcaaaatcaatgatccagaatgatcgtgggtaaaaataactcaaagtgtttcttaagggtgagttggcatgcaaaaaattacattgattacagtgtgttttggagctggctctgtttgtgtgcatatgataatgcagagttgagccagagcctggaaatgtcattctagatctcactaactactggaatcagtgttttaatctcttggtggaaactttcagttgcttaactctctattggaagatttttttaatgttctacatcatttatgttgtattacaatgtatgtagaaatagtaacctgtgaactatgcttttccataactttttaaaaatatatatatctaaatgaatgcaatgtgcataaatattttttaaacataacagtgaactattgcaccttttgctaatgcctctatttacttgctttggcataaagaatgagccaatgaacctctgtgtcctgtggaaaaatgtataaatgttatctgatattgctcttagatgtaatgctaattaatgttaaatcacaaataaacagtattttaaatata

SEQ ID NO: 365337 - DNA, 4599 bp, Homo sapiens
agcgtagtcccgccagagcgcgagccgccagcccgtaacggtcgccagtgtgaggggcgggagggaaagaagaggggtttaaattagattttttaaaacacagagcaagcgccagaggcgtcggcatcccaggtgtcgccgcttcctgctgcacagggctcggcgtacaggtccctccctcctcaagccccctccccttctcccgccctaccctctggggctctgcggcgcttaagaggcggccgcagcggcggatccggcggctgctgcagcccgggcggctgccgagaaggagggaggggaaacacaaagccggctacgcgctgcgagataacaagagtaatccacagacttaaaacatgagctcagatgccagccaaggcgtgattaccactcctcctcctcccagcatgcctcacaaagagagatattttgaccgcatcaatgaaaatgacccagaatacattagggagaggaacatgtctcctgatctacgacaagacttcaacatgatggagcagaggaaacgagttactcagatcctgcaaagtcctggccagtggtattctatttccaaatgagtacatttcttaatggagaaattctaaatggagtttcgctcttgttgcccaggctggagtgcaatggcatgatctcggctcaccacatcctcctcctcccgagttcaagctattctcctgcctcagcctcctgagtagctgggattacaggcatgcaccaccacgctgggctaattttgtatttttagtaaagacgaggattctccatgttggtcaagctggtctccaactccccacctcaggcctttcgggaagacttggaatgccttattcaagaacagatgaagaaaggccacaacccaactggattactagcattacagcagattgcagattacatcatggccaattctttctcgggtttttcttcacctcctctcagtcttggcatggtcacacctatcaatgaccttcctggtgcagatacatcctcatatgtgaagggagaaaaacttactcgctgtaaacttgccagcctgtacagacttgtagacttgtttggatgggcacacctggcaaatacctatatctcagtaagaataagtaaggagcaagaccacattataataattcccagaggcctatctttttctgaagctacagcctccaatttggtgaaagtcaatataataggagaagtggttgaccagggaagtaccaatttgaaaattgaccatacaggattcagtccccatgctgcaatctattcaacacgtcctgatgttaagtgtgtgatacacatccatacccttgcaacagcagctgtatcctccatgaaatgtgggatccttccaatttctcaagagtctcttcttctgggagatgttgcctattatgactaccaagggtcacttgaagaacaggaggagagaattcaactgcagaaggttctgggaccaagttgtaaggtgctggtactcaggaatcatggtgtggttgcacttggagaaacattagaggaggcttttcattatatttttaatgtgcaactagcctgtgagattcaggtgcaggccctagcaggtgcaggtggagtagacaatctccatgtactggactttcagaagtataaagctttcacttacactgtagcagcgtctggtggaggaggtgtgaatatgggttcccatcaaaaatggaaggttggcgaaattgagtttgaagggcttatgaggactctggacaacttggggtatagaacaggctatgcttacaggcatcctctcattcgagagaagcctaggcacaagagtgatgtggaaatcccagcaactgtgactgctttttcctttgaagacgatacagtgccactctctcctctcaaatacatggcacagaggcaacagcgtgaaaaaacaagatggctgaactcaccaaatacttacatgaaagtgaatgtgcctgaggagtctcggaacggagaaaccagtccccgaaccaaaatcacgtggatgaaagcagaagactcatctaaagttagtggtggaacacctatcaaaattgaagatccaaatcagtttgttcctttaaacacaaacccgaatgaggtactagaaaagagaaataagattcgggaacaaaatcgatatgacttgaaaacagcaggaccacaatctcagttgcttgctggaattgttgtggataagccaccttctactatgcaatttgaagatgatgatcatggcccaccagctcctcctaacccatttagtcatctcacagaaggagaacttgaagagtataagaggacaatcgaacgtaaacaacaaggcctagaagaaaaccatgagctgttttccaagagcttcatctccatggaagtgcctgtcatggtagtaaatggcaaggatgatatgcatgatgttgaagatgagcttgctaagcgagtgagtaggttaagcacaagtacaaccatagaaaacatcgagattactattaagtctccagagaaaatcgaagaagtcctgtcacctgaaggctccccttcaaaatcgccatccaagaaaaagaagaaattccgcactccttcttttctgaaaaagaacaaaaaaaaggagaaagttgaggcctaaataaagtctttttataattattattataacaatgtgacattgcacatctaaataccacatttaagttgatcattaatatgcaatggtagatcagattgggggatgtagcaaactggactttaagaactggaaagaggttttacaaaagaaaaactttcagattcatctctcattttatatgtccagaaatggctttgaattttaagcaattactagttttaattagctctgccctcatgaagtattattataattcaccataaacagctatctgtctgaattacttcaggccttctccataatatctgttagaaagaaattgccagtgagcaagtgagaatttttatttctcaatacctgcttcacttgataatcatattataattttttatcatgattattgactatatttttggagtcccattgtttcagtgggcattaacagaatgctttaaaaacttctaagacaagaatctatagcattagtatacactggcacataattttttaaaaagttttaagaaaagattcatttggaattttattcacagtataaaatttcctcacctgaagtaactttgtttgccaaaaaagttgttttaataaactataatttttgaaaacttccttttttattagtttagaaagccccttatttttcaacaaaggggattttgtacacataacatgggttatttagtttaactctggcaaaaaaaaaaaaaaaattttgtatgttgatgtttgtataccgttcagtataaaagtgtcctaagcatattagccaatcttttcacagtagagcatacttaaggctgcttggtactgagtatacttaaatataactccagaatccagggacttggtgttaaaacaggattagagcatgtaaaggtacatctagattcatatttgaatcttaaactgtatttttctcttagtattgctaatgagtaaagaaaagtctcataaggtagccaaatgaaaaagaatgaaagggaaagtgaaaaattaaggggacaaaagatgggatgtgaaaagaagaattctagtttgatggtgactcatattcacgataggatacaaagtgtgatttgttggaaacatgtcccaaatttctaaaattctgcttctctgccaaaagcaatgtctttcttggttgatatttgagttttaaaagggtcaaatctttctaattttttgtatctttagagggcagcactagaagaaatcagcaggtctaatcccaccagtaagaaaactaccacttcttgatttttacagatttaaaaaaatcttttcagtgacctttctttttaatgtaaatacaaatttaaacctaggcttaatataggcgtttcccctttcacccaagtgatgtcacagttcgatgcaaaatcaatgatccagaatgatcgtgggtaaaaataactcaaagtgtttcttaagggtgagttggcatgcaaaaaattacattgattacagtgtgttttggagctggctctgtttgtgtgcatatgataatgcagagttgagccagagcctggaaatgtcattctagatctcactaactactggaatcagtgttttaatctcttggtggaaactttcagttgcttaactctctattggaagatttttttaatgttctacatcatttatgttgtattacaatgtatgtagaaatagtaacctgtgaactatgcttttccataactttttaaaaatatatatatctaaatgaatgcaatgtgcataaatattttttaaacataacagtgaactattgcaccttttgctaatgcctctatttacttgctttggcataaagaatgagccaatgaacctctgtgtcctgtggaaaaatgtataaatgttatctgatattgctcttagatgtaatgctaattaatgttaaatcacaaataaacagtattttaaatata

SEQ ID NO: 365338 - DNA, 4106 bp, Homo sapiens
agcgtagtcccgccagagcgcgagccgccagcccgtaacggtcgccagtgtgaggggcgggagggaaagaagaggggtttaaattagattttttaaaacacagagcaagcgccagaggcgtcggcatcccaggtgtcgccgcttcctgctgcacagggctcggcgtacaggtccctccctcctcaagccccctccccttctcccgccctaccctctggggctctgcggcgcttaagaggcggccgcagcggcggatccggcggctgctgcagcccgggcggctgccgagaaggagggaggggaaacacaaagccggctacgcgctgcgaggcctttcgggaagacttggaatgccttattcaagaacagatgaagaaaggccacaacccaactggattactagcattacagcagattgcagattacatcatggccaattctttctcgggtttttcttcacctcctctcagtcttggcatggtcacacctatcaatgaccttcctggtgcagatacatcctcatatgtgaagggagaaaaacttactcgctgtaaacttgccagcctgtacagacttgtagacttgtttggatgggcacacctggcaaatacctatatctcagtaagaataagtaaggagcaagaccacattataataattcccagaggcctatctttttctgaagctacagcctccaatttggtgaaagtcaatataataggagaagtggttgaccagggaagtaccaatttgaaaattgaccatacaggattcagtccccatgctgcaatctattcaacacgtcctgatgttaagtgtgtgatacacatccatacccttgcaacagcagctgtatcctccatgaaatgtgggatccttccaatttctcaagagtctcttcttctgggagatgttgcctattatgactaccaagggtcacttgaagaacaggaggagagaattcaactgcagaaggttctgggaccaagttgtaaggtgctggtactcaggaatcatggtgtggttgcacttggagaaacattagaggaggcttttcattatatttttaatgtgcaactagcctgtgagattcaggtgcaggccctagcaggtgcaggtggagtagacaatctccatgtactggactttcagaagtataaagctttcacttacactgtagcagcgtctggtggaggaggtgtgaatatgggttcccatcaaaaatggaaggttggcgaaattgagtttgaagggcttatgaggactctggacaacttggggtatagaacaggctatgcttacaggcatcctctcattcgagagaagcctaggcacaagagtgatgtggaaatcccagcaactgtgactgctttttcctttgaagacgatacagtgccactctctcctctcaaatacatggcacagaggcaacagcgtgaaaaaacaagatggctgaactcaccaaatacttacatgaaagtgaatgtgcctgaggagtctcggaacggagaaaccagtccccgaaccaaaatcacgtggatgaaagcagaagactcatctaaagttagtggtggaacacctatcaaaattgaagatccaaatcagtttgttcctttaaacacaaacccgaatgaggtactagaaaagagaaataagattcgggaacaaaatcgatatgacttgaaaacagcaggaccacaatctcagttgcttgctggaattgttgtggataagccaccttctactatgcaatttgaagatgatgatcatggcccaccagctcctcctaacccatttagtcatctcacagaaggagaacttgaagagtataagaggacaatcgaacgtaaacaacaaggcctagaagaaaaccatgagctgttttccaagagcttcatctccatggaagtgcctgtcatggtagtaaatggcaaggatgatatgcatgatgttgaagatgagcttgctaagcgagtgagtaggttaagcacaagtacaaccatagaaaacatcgagattactattaagtctccagagaaaatcgaagaagtcctgtcacctgaaggctccccttcaaaatcgccatccaagaaaaagaagaaattccgcactccttcttttctgaaaaagaacaaaaaaaaggagaaagttgaggcctaaataaagtctttttataattattattataacaatgtgacattgcacatctaaataccacatttaagttgatcattaatatgcaatggtagatcagattgggggatgtagcaaactggactttaagaactggaaagaggttttacaaaagaaaaactttcagattcatctctcattttatatgtccagaaatggctttgaattttaagcaattactagttttaattagctctgccctcatgaagtattattataattcaccataaacagctatctgtctgaattacttcaggccttctccataatatctgttagaaagaaattgccagtgagcaagtgagaatttttatttctcaatacctgcttcacttgataatcatattataattttttatcatgattattgactatatttttggagtcccattgtttcagtgggcattaacagaatgctttaaaaacttctaagacaagaatctatagcattagtatacactggcacataattttttaaaaagttttaagaaaagattcatttggaattttattcacagtataaaatttcctcacctgaagtaactttgtttgccaaaaaagttgttttaataaactataatttttgaaaacttccttttttattagtttagaaagccccttatttttcaacaaaggggattttgtacacataacatgggttatttagtttaactctggcaaaaaaaaaaaaaaaattttgtatgttgatgtttgtataccgttcagtataaaagtgtcctaagcatattagccaatcttttcacagtagagcatacttaaggctgcttggtactgagtatacttaaatataactccagaatccagggacttggtgttaaaacaggattagagcatgtaaaggtacatctagattcatatttgaatcttaaactgtatttttctcttagtattgctaatgagtaaagaaaagtctcataaggtagccaaatgaaaaagaatgaaagggaaagtgaaaaattaaggggacaaaagatgggatgtgaaaagaagaattctagtttgatggtgactcatattcacgataggatacaaagtgtgatttgttggaaacatgtcccaaatttctaaaattctgcttctctgccaaaagcaatgtctttcttggttgatatttgagttttaaaagggtcaaatctttctaattttttgtatctttagagggcagcactagaagaaatcagcaggtctaatcccaccagtaagaaaactaccacttcttgatttttacagatttaaaaaaatcttttcagtgacctttctttttaatgtaaatacaaatttaaacctaggcttaatataggcgtttcccctttcacccaagtgatgtcacagttcgatgcaaaatcaatgatccagaatgatcgtgggtaaaaataactcaaagtgtttcttaagggtgagttggcatgcaaaaaattacattgattacagtgtgttttggagctggctctgtttgtgtgcatatgataatgcagagttgagccagagcctggaaatgtcattctagatctcactaactactggaatcagtgttttaatctcttggtggaaactttcagttgcttaactctctattggaagatttttttaatgttctacatcatttatgttgtattacaatgtatgtagaaatagtaacctgtgaactatgcttttccataactttttaaaaatatatatatctaaatgaatgcaatgtgcataaatattttttaaacataacagtgaactattgcaccttttgctaatgcctctatttacttgctttggcataaagaatgagccaatgaacctctgtgtcctgtggaaaaatgtataaatgttatctgatattgctcttagatgtaatgctaattaatgttaaatcacaaataaacagtattttaaatata

SEQ ID NO: 365339 - DNA, 4178 bp, Homo sapiens
agcgtagtcccgccagagcgcgagccgccagcccgtaacggtcgccagtgtgaggggcgggagggaaagaagaggggtttaaattagattttttaaaacacagagcaagcgccagaggcgtcggcatcccaggtgtcgccgcttcctgctgcacagggctcggcgtacaggtccctccctcctcaagccccctccccttctcccgccctaccctctggggctctgcggcgcttaagaggcggccgcagcggcggatccggcggctgctgcagcccgggcggctgccgagaaggagggaggggaaacacaaagccggctacgcgctgcgagataacaagagtaatccacagacttaaaacatgagctcagatgccagccaaggcgtgattaccactcctcctcctcccagcatgcctcacaaagagagatattttgaccgcatcaatgaaaatgacccagaatacattagggagaggaacatgtctcctgatctacgacaagacttcaacatgatggagcagaggaaacgagttactcagatcctgcaaagtcctgcctttcgggaagacttggaatgccttattcaagaacagatgaagaaaggccacaacccaactggattactagcattacagcagattgcagattacatcatggccaattctttctcgggtttttcttcacctcctctcagtaagaataagtaaggagcaagaccacattataataattcccagaggcctatctttttctgaagctacagcctccaatttggtgaaagtcaatataataggagaagtggttgaccagggaagtaccaatttgaaaattgaccatacaggattcagtccccatgctgcaatctattcaacacgtcctgatgttaagtgtgtgatacacatccatacccttgcaacagcagctgtatcctccatgaaatgtgggatccttccaatttctcaagagtctcttcttctgggagatgttgcctattatgactaccaagggtcacttgaagaacaggaggagagaattcaactgcagaaggttctgggaccaagttgtaaggtgctggtactcaggaatcatggtgtggttgcacttggagaaacattagaggaggcttttcattatatttttaatgtgcaactagcctgtgagattcaggtgcaggccctagcaggtgcaggtggagtagacaatctccatgtactggactttcagaagtataaagctttcacttacactgtagcagcgtctggtggaggaggtgtgaatatgggttcccatcaaaaatggaaggttggcgaaattgagtttgaagggcttatgaggactctggacaacttggggtatagaacaggctatgcttacaggcatcctctcattcgagagaagcctaggcacaagagtgatgtggaaatcccagcaactgtgactgctttttcctttgaagacgatacagtgccactctctcctctcaaatacatggcacagaggcaacagcgtgaaaaaacaagatggctgaactcaccaaatacttacatgaaagtgaatgtgcctgaggagtctcggaacggagaaaccagtccccgaaccaaaatcacgtggatgaaagcagaagactcatctaaagttagtggtggaacacctatcaaaattgaagatccaaatcagtttgttcctttaaacacaaacccgaatgaggtactagaaaagagaaataagattcgggaacaaaatcgatatgacttgaaaacagcaggaccacaatctcagttgcttgctggaattgttgtggataagccaccttctactatgcaatttgaagatgatgatcatggcccaccagctcctcctaacccatttagtcatctcacagaaggagaacttgaagagtataagaggacaatcgaacgtaaacaacaaggcctagaagaaaaccatgagctgttttccaagagcttcatctccatggaagtgcctgtcatggtagtaaatggcaaggatgatatgcatgatgttgaagatgagcttgctaagcgagtgagtaggttaagcacaagtacaaccatagaaaacatcgagattactattaagtctccagagaaaatcgaagaagtcctgtcacctgaaggctccccttcaaaatcgccatccaagaaaaagaagaaattccgcactccttcttttctgaaaaagaacaaaaaaaaggagaaagttgaggcctaaataaagtctttttataattattattataacaatgtgacattgcacatctaaataccacatttaagttgatcattaatatgcaatggtagatcagattgggggatgtagcaaactggactttaagaactggaaagaggttttacaaaagaaaaactttcagattcatctctcattttatatgtccagaaatggctttgaattttaagcaattactagttttaattagctctgccctcatgaagtattattataattcaccataaacagctatctgtctgaattacttcaggccttctccataatatctgttagaaagaaattgccagtgagcaagtgagaatttttatttctcaatacctgcttcacttgataatcatattataattttttatcatgattattgactatatttttggagtcccattgtttcagtgggcattaacagaatgctttaaaaacttctaagacaagaatctatagcattagtatacactggcacataattttttaaaaagttttaagaaaagattcatttggaattttattcacagtataaaatttcctcacctgaagtaactttgtttgccaaaaaagttgttttaataaactataatttttgaaaacttccttttttattagtttagaaagccccttatttttcaacaaaggggattttgtacacataacatgggttatttagtttaactctggcaaaaaaaaaaaaaaaattttgtatgttgatgtttgtataccgttcagtataaaagtgtcctaagcatattagccaatcttttcacagtagagcatacttaaggctgcttggtactgagtatacttaaatataactccagaatccagggacttggtgttaaaacaggattagagcatgtaaaggtacatctagattcatatttgaatcttaaactgtatttttctcttagtattgctaatgagtaaagaaaagtctcataaggtagccaaatgaaaaagaatgaaagggaaagtgaaaaattaaggggacaaaagatgggatgtgaaaagaagaattctagtttgatggtgactcatattcacgataggatacaaagtgtgatttgttggaaacatgtcccaaatttctaaaattctgcttctctgccaaaagcaatgtctttcttggttgatatttgagttttaaaagggtcaaatctttctaattttttgtatctttagagggcagcactagaagaaatcagcaggtctaatcccaccagtaagaaaactaccacttcttgatttttacagatttaaaaaaatcttttcagtgacctttctttttaatgtaaatacaaatttaaacctaggcttaatataggcgtttcccctttcacccaagtgatgtcacagttcgatgcaaaatcaatgatccagaatgatcgtgggtaaaaataactcaaagtgtttcttaagggtgagttggcatgcaaaaaattacattgattacagtgtgttttggagctggctctgtttgtgtgcatatgataatgcagagttgagccagagcctggaaatgtcattctagatctcactaactactggaatcagtgttttaatctcttggtggaaactttcagttgcttaactctctattggaagatttttttaatgttctacatcatttatgttgtattacaatgtatgtagaaatagtaacctgtgaactatgcttttccataactttttaaaaatatatatatctaaatgaatgcaatgtgcataaatattttttaaacataacagtgaactattgcaccttttgctaatgcctctatttacttgctttggcataaagaatgagccaatgaacctctgtgtcctgtggaaaaatgtataaatgttatctgatattgctcttagatgtaatgctaattaatgttaaatcacaaataaacagtattttaaatata

SEQ ID NO: 365340 - DNA, 3976 bp, Homo sapiens
agcggaatcccagcacttcggaaggcagaggtgggcggatcacctgaggtcggcagttcaagaccagcctgaccaacatagagaaaccctgtctctactaaaaatacaaaattagccgggtggtggcgcatgcctgtaatcccagctactcaggaggctgaggcaggagaatcgcttcaacccgggaggcggaggttgcggcctttcgggaagacttggaatgccttattcaagaacagatgaagaaaggccacaacccaactggattactagcattacagcagattgcagattacatcatggccaattctttctcgggtttttcttcacctcctctcagtcttggcatggtcacacctatcaatgaccttcctggtgcagatacatcctcatatgtgaagggagaaaaacttactcgctgtaaacttgccagcctgtacagacttgtagacttgtttggatgggcacacctggcaaatacctatatctcagtaagaataagtaaggagcaagaccacattataataattcccagaggcctatctttttctgaagctacagcctccaatttggtgaaagtcaatataataggagaagtggttgaccagggaagtaccaatttgaaaattgaccatacaggattcagtccccatgctgcaatctattcaacacgtcctgatgttaagtgtgtgatacacatccatacccttgcaacagcagctgtatcctccatgaaatgtgggatccttccaatttctcaagagtctcttcttctgggagatgttgcctattatgactaccaagggtcacttgaagaacaggaggagagaattcaactgcagaaggttctgggaccaagttgtaaggtgctggtactcaggaatcatggtgtggttgcacttggagaaacattagaggaggcttttcattatatttttaatgtgcaactagcctgtgagattcaggtgcaggccctagcaggtgcaggtggagtagacaatctccatgtactggactttcagaagtataaagctttcacttacactgtagcagcgtctggtggaggaggtgtgaatatgggttcccatcaaaaatggaaggttggcgaaattgagtttgaagggcttatgaggactctggacaacttggggtatagaacaggctatgcttacaggcatcctctcattcgagagaagcctaggcacaagagtgatgtggaaatcccagcaactgtgactgctttttcctttgaagacgatacagtgccactctctcctctcaaatacatggcacagaggcaacagcgtgaaaaaacaagatggctgaactcaccaaatacttacatgaaagtgaatgtgcctgaggagtctcggaacggagaaaccagtccccgaaccaaaatcacgtggatgaaagcagaagactcatctaaagttagtggtggaacacctatcaaaattgaagatccaaatcagtttgttcctttaaacacaaacccgaatgaggtactagaaaagagaaataagattcgggaacaaaatcgatatgacttgaaaacagcaggaccacaatctcagttgcttgctggaattgttgtggataagccaccttctactatgcaatttgaagatgatgatcatggcccaccagctcctcctaacccatttagtcatctcacagaaggagaacttgaagagtataagaggacaatcgaacgtaaacaacaaggcctagaagaaaaccatgagctgttttccaagagcttcatctccatggaagtgcctgtcatggtagtaaatggcaaggatgatatgcatgatgttgaagatgagcttgctaagcgagtgagtaggttaagcacaagtacaaccatagaaaacatcgagattactattaagtctccagagaaaatcgaagaagtcctgtcacctgaaggctccccttcaaaatcgccatccaagaaaaagaagaaattccgcactccttcttttctgaaaaagaacaaaaaaaaggagaaagttgaggcctaaataaagtctttttataattattattataacaatgtgacattgcacatctaaataccacatttaagttgatcattaatatgcaatggtagatcagattgggggatgtagcaaactggactttaagaactggaaagaggttttacaaaagaaaaactttcagattcatctctcattttatatgtccagaaatggctttgaattttaagcaattactagttttaattagctctgccctcatgaagtattattataattcaccataaacagctatctgtctgaattacttcaggccttctccataatatctgttagaaagaaattgccagtgagcaagtgagaatttttatttctcaatacctgcttcacttgataatcatattataattttttatcatgattattgactatatttttggagtcccattgtttcagtgggcattaacagaatgctttaaaaacttctaagacaagaatctatagcattagtatacactggcacataattttttaaaaagttttaagaaaagattcatttggaattttattcacagtataaaatttcctcacctgaagtaactttgtttgccaaaaaagttgttttaataaactataatttttgaaaacttccttttttattagtttagaaagccccttatttttcaacaaaggggattttgtacacataacatgggttatttagtttaactctggcaaaaaaaaaaaaaaaattttgtatgttgatgtttgtataccgttcagtataaaagtgtcctaagcatattagccaatcttttcacagtagagcatacttaaggctgcttggtactgagtatacttaaatataactccagaatccagggacttggtgttaaaacaggattagagcatgtaaaggtacatctagattcatatttgaatcttaaactgtatttttctcttagtattgctaatgagtaaagaaaagtctcataaggtagccaaatgaaaaagaatgaaagggaaagtgaaaaattaaggggacaaaagatgggatgtgaaaagaagaattctagtttgatggtgactcatattcacgataggatacaaagtgtgatttgttggaaacatgtcccaaatttctaaaattctgcttctctgccaaaagcaatgtctttcttggttgatatttgagttttaaaagggtcaaatctttctaattttttgtatctttagagggcagcactagaagaaatcagcaggtctaatcccaccagtaagaaaactaccacttcttgatttttacagatttaaaaaaatcttttcagtgacctttctttttaatgtaaatacaaatttaaacctaggcttaatataggcgtttcccctttcacccaagtgatgtcacagttcgatgcaaaatcaatgatccagaatgatcgtgggtaaaaataactcaaagtgtttcttaagggtgagttggcatgcaaaaaattacattgattacagtgtgttttggagctggctctgtttgtgtgcatatgataatgcagagttgagccagagcctggaaatgtcattctagatctcactaactactggaatcagtgttttaatctcttggtggaaactttcagttgcttaactctctattggaagatttttttaatgttctacatcatttatgttgtattacaatgtatgtagaaatagtaacctgtgaactatgcttttccataactttttaaaaatatatatatctaaatgaatgcaatgtgcataaatattttttaaacataacagtgaactattgcaccttttgctaatgcctctatttacttgctttggcataaagaatgagccaatgaacctctgtgtcctgtggaaaaatgtataaatgttatctgatattgctcttagatgtaatgctaattaatgttaaatcacaaataaacagtattttaaatata

SEQ ID NO: 365341 - DNA, 3266 bp, Homo sapiens
aatatgttaagaggtatggctctaatgtgttttccatcagggaggatcagagtcttggaaggtttctttttcagataggtggaaaagatacttcagctgtctgctggcacaagagtgtcatcttgtctttgttgttagtagcctgagcaagtattatagatatttgccaaattgaaattgtgcctttttgaaagtaaaatactcattacagtctttatagttttgtgtctctgtatattttaccattgattacaggtgcaggccctagcaggtgcaggtggagtagacaatctccatgtactggactttcagaagtataaagctttcacttacactgtagcagcgtctggtggaggaggtgtgaatatgggttcccatcaaaaatggaaggttggcgaaattgagtttgaagggcttatgaggactctggacaacttggggtatagaacaggctatgcttacaggcatcctctcattcgagagaagcctaggcacaagagtgatgtggaaatcccagcaactgtgactgctttttcctttgaagacgatacagtgccactctctcctctcaaatacatggcacagaggcaacagcgtgaaaaaacaagatggctgaactcaccaaatacttacatgaaagtgaatgtgcctgaggagtctcggaacggagaaaccagtccccgaaccaaaatcacgtggatgaaagcagaagactcatctaaagttagtggtggaacacctatcaaaattgaagatccaaatcagtttgttcctttaaacacaaacccgaatgaggtactagaaaagagaaataagattcgggaacaaaatcgatatgacttgaaaacagcaggaccacaatctcagttgcttgctggaattgttgtggataagccaccttctactatgcaatttgaagatgatgatcatggcccaccagctcctcctaacccatttagtcatctcacagaaggagaacttgaagagtataagaggacaatcgaacgtaaacaacaaggcctagaagaaaaccatgagctgttttccaagagcttcatctccatggaagtgcctgtcatggtagtaaatggcaaggatgatatgcatgatgttgaagatgagcttgctaagcgagtgagtaggttaagcacaagtacaaccatagaaaacatcgagattactattaagtctccagagaaaatcgaagaagtcctgtcacctgaaggctccccttcaaaatcgccatccaagaaaaagaagaaattccgcactccttcttttctgaaaaagaacaaaaaaaaggagaaagttgaggcctaaataaagtctttttataattattattataacaatgtgacattgcacatctaaataccacatttaagttgatcattaatatgcaatggtagatcagattgggggatgtagcaaactggactttaagaactggaaagaggttttacaaaagaaaaactttcagattcatctctcattttatatgtccagaaatggctttgaattttaagcaattactagttttaattagctctgccctcatgaagtattattataattcaccataaacagctatctgtctgaattacttcaggccttctccataatatctgttagaaagaaattgccagtgagcaagtgagaatttttatttctcaatacctgcttcacttgataatcatattataattttttatcatgattattgactatatttttggagtcccattgtttcagtgggcattaacagaatgctttaaaaacttctaagacaagaatctatagcattagtatacactggcacataattttttaaaaagttttaagaaaagattcatttggaattttattcacagtataaaatttcctcacctgaagtaactttgtttgccaaaaaagttgttttaataaactataatttttgaaaacttccttttttattagtttagaaagccccttatttttcaacaaaggggattttgtacacataacatgggttatttagtttaactctggcaaaaaaaaaaaaaaaattttgtatgttgatgtttgtataccgttcagtataaaagtgtcctaagcatattagccaatcttttcacagtagagcatacttaaggctgcttggtactgagtatacttaaatataactccagaatccagggacttggtgttaaaacaggattagagcatgtaaaggtacatctagattcatatttgaatcttaaactgtatttttctcttagtattgctaatgagtaaagaaaagtctcataaggtagccaaatgaaaaagaatgaaagggaaagtgaaaaattaaggggacaaaagatgggatgtgaaaagaagaattctagtttgatggtgactcatattcacgataggatacaaagtgtgatttgttggaaacatgtcccaaatttctaaaattctgcttctctgccaaaagcaatgtctttcttggttgatatttgagttttaaaagggtcaaatctttctaattttttgtatctttagagggcagcactagaagaaatcagcaggtctaatcccaccagtaagaaaactaccacttcttgatttttacagatttaaaaaaatcttttcagtgacctttctttttaatgtaaatacaaatttaaacctaggcttaatataggcgtttcccctttcacccaagtgatgtcacagttcgatgcaaaatcaatgatccagaatgatcgtgggtaaaaataactcaaagtgtttcttaagggtgagttggcatgcaaaaaattacattgattacagtgtgttttggagctggctctgtttgtgtgcatatgataatgcagagttgagccagagcctggaaatgtcattctagatctcactaactactggaatcagtgttttaatctcttggtggaaactttcagttgcttaactctctattggaagatttttttaatgttctacatcatttatgttgtattacaatgtatgtagaaatagtaacctgtgaactatgcttttccataactttttaaaaatatatatatctaaatgaatgcaatgtgcataaatattttttaaacataacagtgaactattgcaccttttgctaatgcctctatttacttgctttggcataaagaatgagccaatgaacctctgtgtcctgtggaaaaatgtataaatgttatctgatattgctcttagatgtaatgctaattaatgttaaatcacaaataaacagtattttaaatata

SEQ ID NO: 365342 - DNA, 2641 bp, Homo sapiens
gcagttatctaacaatctactaatattttcttaacacaaagcttcattttagaaaatttttgattctttagtggatgaaagcagaagactcatctaaagttagtggtggaacacctatcaaaattgaagatccaaatcagtttgttcctttaaacacaaacccgaatgaggtactagaaaagagaaataagattcgggaacaaaatcgatatgacttgaaaacagcaggaccacaatctcagttgcttgctggaattgttgtggataagccaccttctactatgcaatttgaagatgatgatcatggcccaccagctcctcctaacccatttagtcatctcacagaaggagaacttgaagagtataagaggacaatcgaacgtaaacaacaaggcctagaagaaaaccatgagctgttttccaagagcttcatctccatggaagtgcctgtcatggtagtaaatggcaaggatgatatgcatgatgttgaagatgagcttgctaagcgagtgagtaggttaagcacaagtacaaccatagaaaacatcgagattactattaagtctccagagaaaatcgaagaagtcctgtcacctgaaggctccccttcaaaatcgccatccaagaaaaagaagaaattccgcactccttcttttctgaaaaagaacaaaaaaaaggagaaagttgaggcctaaataaagtctttttataattattattataacaatgtgacattgcacatctaaataccacatttaagttgatcattaatatgcaatggtagatcagattgggggatgtagcaaactggactttaagaactggaaagaggttttacaaaagaaaaactttcagattcatctctcattttatatgtccagaaatggctttgaattttaagcaattactagttttaattagctctgccctcatgaagtattattataattcaccataaacagctatctgtctgaattacttcaggccttctccataatatctgttagaaagaaattgccagtgagcaagtgagaatttttatttctcaatacctgcttcacttgataatcatattataattttttatcatgattattgactatatttttggagtcccattgtttcagtgggcattaacagaatgctttaaaaacttctaagacaagaatctatagcattagtatacactggcacataattttttaaaaagttttaagaaaagattcatttggaattttattcacagtataaaatttcctcacctgaagtaactttgtttgccaaaaaagttgttttaataaactataatttttgaaaacttccttttttattagtttagaaagccccttatttttcaacaaaggggattttgtacacataacatgggttatttagtttaactctggcaaaaaaaaaaaaaaaattttgtatgttgatgtttgtataccgttcagtataaaagtgtcctaagcatattagccaatcttttcacagtagagcatacttaaggctgcttggtactgagtatacttaaatataactccagaatccagggacttggtgttaaaacaggattagagcatgtaaaggtacatctagattcatatttgaatcttaaactgtatttttctcttagtattgctaatgagtaaagaaaagtctcataaggtagccaaatgaaaaagaatgaaagggaaagtgaaaaattaaggggacaaaagatgggatgtgaaaagaagaattctagtttgatggtgactcatattcacgataggatacaaagtgtgatttgttggaaacatgtcccaaatttctaaaattctgcttctctgccaaaagcaatgtctttcttggttgatatttgagttttaaaagggtcaaatctttctaattttttgtatctttagagggcagcactagaagaaatcagcaggtctaatcccaccagtaagaaaactaccacttcttgatttttacagatttaaaaaaatcttttcagtgacctttctttttaatgtaaatacaaatttaaacctaggcttaatataggcgtttcccctttcacccaagtgatgtcacagttcgatgcaaaatcaatgatccagaatgatcgtgggtaaaaataactcaaagtgtttcttaagggtgagttggcatgcaaaaaattacattgattacagtgtgttttggagctggctctgtttgtgtgcatatgataatgcagagttgagccagagcctggaaatgtcattctagatctcactaactactggaatcagtgttttaatctcttggtggaaactttcagttgcttaactctctattggaagatttttttaatgttctacatcatttatgttgtattacaatgtatgtagaaatagtaacctgtgaactatgcttttccataactttttaaaaatatatatatctaaatgaatgcaatgtgcataaatattttttaaacataacagtgaactattgcaccttttgctaatgcctctatttacttgctttggcataaagaatgagccaatgaacctctgtgtcctgtggaaaaatgtataaatgttatctgatattgctcttagatgtaatgctaattaatgttaaatcacaaataaacagtattttaaatata

SEQ ID NO: 365343 - DNA, 2366 bp, Homo sapiens
catggcttttaactaaactcttatccaacagatgctgagcaggaattactctcagatgacgcttcatctgtttcacaaattcagtctcaaactcagtcaccgcaaaatgtccctgaaaaattagaagaaaaccatgagctgttttccaagagcttcatctccatggaagtgcctgtcatggtagtaaatggcaaggatgatatgcatgatgttgaagatgagcttgctaagcgagtgagtaggttaagcacaagtacaaccatagaaaacatcgagattactattaagtctccagagaaaatcgaagaagtcctgtcacctgaaggctccccttcaaaatcgccatccaagaaaaagaagaaattccgcactccttcttttctgaaaaagaacaaaaaaaaggagaaagttgaggcctaaataaagtctttttataattattattataacaatgtgacattgcacatctaaataccacatttaagttgatcattaatatgcaatggtagatcagattgggggatgtagcaaactggactttaagaactggaaagaggttttacaaaagaaaaactttcagattcatctctcattttatatgtccagaaatggctttgaattttaagcaattactagttttaattagctctgccctcatgaagtattattataattcaccataaacagctatctgtctgaattacttcaggccttctccataatatctgttagaaagaaattgccagtgagcaagtgagaatttttatttctcaatacctgcttcacttgataatcatattataattttttatcatgattattgactatatttttggagtcccattgtttcagtgggcattaacagaatgctttaaaaacttctaagacaagaatctatagcattagtatacactggcacataattttttaaaaagttttaagaaaagattcatttggaattttattcacagtataaaatttcctcacctgaagtaactttgtttgccaaaaaagttgttttaataaactataatttttgaaaacttccttttttattagtttagaaagccccttatttttcaacaaaggggattttgtacacataacatgggttatttagtttaactctggcaaaaaaaaaaaaaaaattttgtatgttgatgtttgtataccgttcagtataaaagtgtcctaagcatattagccaatcttttcacagtagagcatacttaaggctgcttggtactgagtatacttaaatataactccagaatccagggacttggtgttaaaacaggattagagcatgtaaaggtacatctagattcatatttgaatcttaaactgtatttttctcttagtattgctaatgagtaaagaaaagtctcataaggtagccaaatgaaaaagaatgaaagggaaagtgaaaaattaaggggacaaaagatgggatgtgaaaagaagaattctagtttgatggtgactcatattcacgataggatacaaagtgtgatttgttggaaacatgtcccaaatttctaaaattctgcttctctgccaaaagcaatgtctttcttggttgatatttgagttttaaaagggtcaaatctttctaattttttgtatctttagagggcagcactagaagaaatcagcaggtctaatcccaccagtaagaaaactaccacttcttgatttttacagatttaaaaaaatcttttcagtgacctttctttttaatgtaaatacaaatttaaacctaggcttaatataggcgtttcccctttcacccaagtgatgtcacagttcgatgcaaaatcaatgatccagaatgatcgtgggtaaaaataactcaaagtgtttcttaagggtgagttggcatgcaaaaaattacattgattacagtgtgttttggagctggctctgtttgtgtgcatatgataatgcagagttgagccagagcctggaaatgtcattctagatctcactaactactggaatcagtgttttaatctcttggtggaaactttcagttgcttaactctctattggaagatttttttaatgttctacatcatttatgttgtattacaatgtatgtagaaatagtaacctgtgaactatgcttttccataactttttaaaaatatatatatctaaatgaatgcaatgtgcataaatattttttaaacataacagtgaactattgcaccttttgctaatgcctctatttacttgctttggcataaagaatgagccaatgaacctctgtgtcctgtggaaaaatgtataaatgttatctgatattgctcttagatgtaatgctaattaatgttaaatcacaaataaacagtattttaaatata

SEQ ID NO: 365344 - DNA, 2884 bp, Homo sapiens
tttcaccgtgttagccaggatggtctcgatctcctgacctcgtgataccatcctggctaacacggtgaaaccctgtctctactaaaaatacaaaaaattagctgggtgtggtggcgggcgcctgtagtcccagctactcgggaggctgaggcaggagaatggcatgaacacgggaggtggagctggcagtgagccaagactgccactgcactccggcctgggcgacagagtgagactccgcctcaaaaaaaaaaaaaaaaaaaaaagaatttgtggaattaaacatctcccaatcagcagcatgaaatctttttcagtattgattgccaaatgatcccaaaactagagaaaaatatgttgtcttcctcatttatacttaattgatttacaatgaaactgttatttcatcaaactgggattatctagcttttgctctttggtttaacaactttgttcctttcccctttatatcattaaagaaaattagcttcttgctaatagatcacagtttattaaaataatgatctgtcttcattggaatcaaagtaatgccttattacattgctaaaacatttcagttttgtaaagtagagcaaaaatgttaagtatgtaaaataacccccaaaaaaccctcccctttcgtagaaaaccatgagctgttttccaagagcttcatctccatggaagtgcctgtcatggtagtaaatggcaaggatgatatgcatgatgttgaagatgagcttgctaagcgagtgagtaggttaagcacaagtacaaccatagaaaacatcgagattactattaagtctccagagaaaatcgaagaagtcctgtcacctgaaggctccccttcaaaatcgccatccaagaaaaagaagaaattccgcactccttcttttctgaaaaagaacaaaaaaaaggagaaagttgaggcctaaataaagtctttttataattattattataacaatgtgacattgcacatctaaataccacatttaagttgatcattaatatgcaatggtagatcagattgggggatgtagcaaactggactttaagaactggaaagaggttttacaaaagaaaaactttcagattcatctctcattttatatgtccagaaatggctttgaattttaagcaattactagttttaattagctctgccctcatgaagtattattataattcaccataaacagctatctgtctgaattacttcaggccttctccataatatctgttagaaagaaattgccagtgagcaagtgagaatttttatttctcaatacctgcttcacttgataatcatattataattttttatcatgattattgactatatttttggagtcccattgtttcagtgggcattaacagaatgctttaaaaacttctaagacaagaatctatagcattagtatacactggcacataattttttaaaaagttttaagaaaagattcatttggaattttattcacagtataaaatttcctcacctgaagtaactttgtttgccaaaaaagttgttttaataaactataatttttgaaaacttccttttttattagtttagaaagccccttatttttcaacaaaggggattttgtacacataacatgggttatttagtttaactctggcaaaaaaaaaaaaaaaattttgtatgttgatgtttgtataccgttcagtataaaagtgtcctaagcatattagccaatcttttcacagtagagcatacttaaggctgcttggtactgagtatacttaaatataactccagaatccagggacttggtgttaaaacaggattagagcatgtaaaggtacatctagattcatatttgaatcttaaactgtatttttctcttagtattgctaatgagtaaagaaaagtctcataaggtagccaaatgaaaaagaatgaaagggaaagtgaaaaattaaggggacaaaagatgggatgtgaaaagaagaattctagtttgatggtgactcatattcacgataggatacaaagtgtgatttgttggaaacatgtcccaaatttctaaaattctgcttctctgccaaaagcaatgtctttcttggttgatatttgagttttaaaagggtcaaatctttctaattttttgtatctttagagggcagcactagaagaaatcagcaggtctaatcccaccagtaagaaaactaccacttcttgatttttacagatttaaaaaaatcttttcagtgacctttctttttaatgtaaatacaaatttaaacctaggcttaatataggcgtttcccctttcacccaagtgatgtcacagttcgatgcaaaatcaatgatccagaatgatcgtgggtaaaaataactcaaagtgtttcttaagggtgagttggcatgcaaaaaattacattgattacagtgtgttttggagctggctctgtttgtgtgcatatgataatgcagagttgagccagagcctggaaatgtcattctagatctcactaactactggaatcagtgttttaatctcttggtggaaactttcagttgcttaactctctattggaagatttttttaatgttctacatcatttatgttgtattacaatgtatgtagaaatagtaacctgtgaactatgcttttccataactttttaaaaatatatatatctaaatgaatgcaatgtgcataaatattttttaaacataacagtgaactattgcaccttttgctaatgcctctatttacttgctttggcataaagaatgagccaatgaacctctgtgtcctgtggaaaaatgtataaatgttatctgatattgctcttagatgtaatgctaattaatgttaaatcacaaataaacagtattttaaatata

SEQ ID NO: 365345 - DNA, 1717 bp, Homo sapiens
agcgtagtcccgccagagcgcgagccgccagcccgtaacggtcgccagtgtgaggggcgggagggaaagaagaggggtttaaattagattttttaaaacacagagcaagcgccagaggcgtcggcatcccaggtgtcgccgcttcctgctgcacagggctcggcgtacaggtccctccctcctcaagccccctccccttctcccgccctaccctctggggctctgcggcgcttaagaggcggccgcagcggcggatccggcggctgctgcagcccgggcggctgccgagaaggagggaggggaaacacaaagccggctacgcgctgcgagataacaagagtaatccacagacttaaaacatgagctcagatgccagccaaggcgtgattaccactcctcctcctcccagcatgcctcacaaagagagatattttgaccgcatcaatgaaaatgacccagaatacattagggagaggaacatgtctcctgatctacgacaagacttcaacatgatggagcagaggaaacgagttactcagatcctgcaaagtcctgcctttcgggaagacttggaatgccttattcaagaacagatgaagaaaggccacaacccaactggattactagcattacagcagattgcagattacatcatggccaattctttctcgggtttttcttcacctcctctcagtcttggcatggtcacacctatcaatgaccttcctggtgcagatacatcctcatatgtgaagggagaaaaacttactcgctgtaaacttgccagcctgtacagacttgtagacttgtttggatgggcacacctggcaaatacctatatctcagtaagaataagtaaggagcaagaccacattataataattcccagaggcctatctttttctgaagctacagcctccaatttggtgaaagtcaatataataggagaagtggttgaccagggaagtaccaatttgaaaattgaccatacaggattcagtccccatgctgcaatctattcaacacgtcctgatgttaagtgtgtgatacacatccatacccttgcaacagcagctgtatcctccatgaaatgtgggatccttccaatttctcaagagtctcttcttctgggagatgttgcctattatgactaccaagggtcacttgaagaacaggaggagagaattcaactgcagaaggttctgggaccaagttgtaaggtgctggtactcaggaatcatggtgtggttgcacttggagaaacattagaggaggcttttcattatatttttaatgtgcaactagcctgtgagattcaggtgcaggccctagcaggtgcaggtggagtagacaatctccatgtactggactttcagaagtataaagctttcacttacactgtagcagcgtctggtggaggaggtgtgaatatgggttcccatcaaaaatggaaggttggcgaaattgagtttgaagggcttatgaggactctggacaacttggggtatagaacaggctatgcttacaggcatcctctcattcgagagaagcctaggcacaagagtgatgtggaaatcccagcaactgtgactgcttttcttgaggcgtcagtccactcttctctaatcatgccagggcacacgtgaaaacagtgctactccaatcttcatgagtattgcctggggctggcggaaccgccccccaatttgttttccaa

SEQ ID NO: 365346 - DNA, 1418 bp, Homo sapiens
agcgtagtcccgccagagcgcgagccgccagcccgtaacggtcgccagtgtgaggggcgggagggaaagaagaggggtttaaattagattttttaaaacacagagcaagcgccagaggcgtcggcatcccaggtgtcgccgcttcctgctgcacagggctcggcgtacaggtccctccctcctcaagccccctccccttctcccgccctaccctctggggctctgcggcgcttaagaggcggccgcagcggcggatccggcggctgctgcagcccgggcggctgccgagaaggagggaggggaaacacaaagccggctacgcgctgcgagataacaagagtaatccacagacttaaaacatgagctcagatgccagccaaggcgtgattaccactcctcctcctcccagcatgcctcacaaagagagatattttgaccgcatcaatgaaaatgacccagaatacattagggagaggaacatgtctcctgatctacgacaagacttcaacatgatggagcagaggaaacgagttactcagatcctgcaaagtcctgcctttcgggaagacttggaatgccttattcaagaacagatgaagaaaggccacaacccaactggattactagcattacagcagattgcagattacatcatggccaattctttctcgggtttttcttcacctcctctcagtcttggcatggtcacacctatcaatgaccttcctggtgcagatacatcctcatatgtgaagggagaaaaacttactcgctgtaaacttgccagcctgtacagacttgtagacttgtttggatgggcacacctggcaaatacctatatctcagtaagaataagtaaggagcaagaccacattataataattcccagaggcctatctttttctgaagctacagcctccaatttggtgaaagtcaatataataggagaagtggttgaccagggaagtaccaatttgaaaattgaccatacaggattcagtccccatgctgcaatctattcaacacgtcctgatgttaagtgtgtgatacacatccatacccttgcaacagcagctgtatcctccatgaaatgtgggatccttccaatttctcaagagtctcttcttctgggagatgttgcctattatgactaccaagggtcacttgaagaacaggaggagagaattcaactgcagaaggttctgggaccaagttgtaaggtgctggtactcaggaatcatggtgtggttgcacttggagaaacattagaggaggcttttcattatatttttaatgtgcaactagcctgtgagattcaggtgcaggccctagcaggtgcaggtggagtcctgtatcagccctttatcctcacacgcttttctacaatggcattcaataaagtgcacgtgtttctggta

SEQ ID NO: 365347 - DNA, 878 bp, Homo sapiens
agcgtagtcccgccagagcgcgagccgccagcccgtaacggtcgccagtgtgaggggcgggagggaaagaagaggggtttaaattagattttttaaaacacagagcaagcgccagaggcgtcggcatcccaggtgtcgccgcttcctgctgcacagggctcggcgtacaggtccctccctcctcaagccccctccccttctcccgccctaccctctggggctctgcggcgcttaagaggcggccgcagcggcggatccggcggctgctgcagcccgggcggctgccgagaaggagggaggggaaacacaaagccggctacgcgctgcgagataacaagagtaatccacagacttaaaacatgagctcagatgccagccaaggcgtgattaccactcctcctcctcccagcatgcctcacaaagagagatattttgaccgcatcaatgaaaatgacccagaatacattagggagaggaacatgtctcctgatctacgacaagacttcaacatgatggagcagaggaaacgagttactcagatcctgcaaagtcctgcctttcgggaagacttggaatgccttattcaagaacagatgaagaaaggccacaacccaactgtaatcctagcactttgggaggccaaggcaggaggatcactggaggccaggagttcaagaccagcctgggcaacatagtaagaccccatctccactaaacaaattaaaaaattagccaggtgtggcagcatgccctgtagtcctagctactcaggaggctgaggtggaaggattgcctgagcctaggagttcgaggctgcagtgagccatgatcacaccactgcattgcagcctgggtgacagagtgatacccctgcctct

SEQ ID NO: 365348 - DNA, 556 bp, Homo sapiens
gaacaaaatcgatatgacttgaaaacagcaggaccacaatctcagttgcttgctggaattgttgtggataagccaccttctgtaagtttatgaagtagtatgatctttgttttttatttaccacattaatttcattgatttttaaatatgaatatttatttttactaaggttaatataagcacaagttaaaaagtcaactcacaagatttaaaatgtcacccacaattcccagtttccaggtgcagcaactttctgttcttttcattgcttctaatgtttactttggtgtttctggttagttagttgagatgaggtctcactctgttgcccaggatagtcgtgaacacctgatctcaggtgatcctccagccttgacctcctgaagtattgggattacaggtataaaccactgctcctcgtcctcctttgatgtttctaaagagcatcttctgctttttcttggtctatcagttttagaccttgactatttttcatcaaatctgtgttatccgttataagaagtaccattgttttatatgtcactaaaagagaaaa

SEQ ID NO: 365349 - DNA, 497 bp, Homo sapiens
aatcagtgttttaatctcttggtggaaactttcagttgcttaactctctattggaagatttttttaatgttctacatcatttatgttgtattacaatgtatgtagaaatagtaacctgtgaactatgcttttccataactttttaaaaatatatatatctaaatgaatgcaatgtgcataaatattttttaaacataacagtgaactattgcaccttttgctaatgcctctatttacttgctttggcataaagaatgagccaatgaacctctgtgtcctgtggaaaaatgtataaatgttatctgatattgctcttagatgtaatgctaattaatgttaaatcacaaataaacagtattttaaatatacggacttgtatcatgaggtttccattcacaggtggttacttagcctattcatggtctgttgagttttatacttcagtgaaacttggtaagttattgatgcttctgaataaagaatgtcctgataaatat

SEQ ID NO: 365350 - DNA, 1145 bp, Homo sapiens
tcctggagaaaccaggcccagcttcatttggaggatttgacaggatcttagtaccaagtggaattgttgcctgcttaattttaattatgcttcccagcaggaggcctaaacacatgatgaagaactaattcagtacttgttggaatgcatgggaaaagagaaacctgaagaagttgttgagccttatgttaaaaacagccgagtagtggtgaaattaaattaagtggtaaagaaaattattttaatgagagcagtctttcaatagcaggtctggttggttattgatggctcctgcagacaataatgatgttaaaatctgcttgggcttagaatcagcaaacaaatcatttgcctaactggagataacaagagtaatccacagacttaaaacatgagctcagatgccagccaaggcgtgattaccactcctcctcctcccagcatgcctcacaaagagagatattttgaccgcatcaatgaaaatgacccagaatacattagggagaggaacatgtctcctgatctacgacaagacttcaacatgatggagcagaggaaacgagttactcagatcctgcaaagtcctgcctttcgggaagacttggaatgccttattcaagaacagatgaagaaaggccacaacccaactggattactagcattacagcagattgcagattacatcatggccaattctttctcgggtttttcttcacctcctctcagtcttggcatggtcacacctatcaatgaccttcctggtgcagatacatcctcatatgtgaagggagaaaaacttactcgctgtaaacttgccagcctgtacagacttgtagacttgtttggatgggcacacctggcaaatacctatatctcaaaggaatcacgtcacggaccaagacccaccttattattaattccccagagggctattcttttttctgtaaggcttaccagctcccaagttggctgaaagtcacctattcatacggcgcagctgtgttggacccgggagttctccatcttgaacaacttgcgccctccgggatgtctaggccccctgtctgcaatcttttcgcccgggcctggatggtacgcgtggtggttgaccatccctatgcctttgcgcacaggggtattcctca

SEQ ID NO: 365351 - DNA, 4189 bp, Homo sapiens
agcgggggagaagctgctgctgctaatgctgctgctgctgctgccgccgccgccgctgctgctgctgctgttggtctgaggctgcagtaggtttctgtgcagcattgcagaatccacacctagagaacagaagacacagacacgtacgtctactacccttgttagaaggaagctttggatcttcggtggataacaagagtaatccacagacttaaaacatgagctcagatgccagccaaggcgtgattaccactcctcctcctcccagcatgcctcacaaagagagatattttgaccgcatcaatgaaaatgacccagaatacattagggagaggaacatgtctcctgatctacgacaagacttcaacatgatggagcagaggaaacgagttactcagatcctgcaaagtcctgcctttcgggaagacttggaatgccttattcaagaacagatgaagaaaggccacaacccaactggattactagcattacagcagattgcagattacatcatggccaattctttctcgggtttttcttcacctcctctcagtcttggcatggtcacacctatcaatgaccttcctggtgcagatacatcctcatatgtgaagggagaaaaacttactcgctgtaaacttgccagcctgtacagacttgtagacttgtttggatgggcacacctggcaaatacctatatctcagtaagaataagtaaggagcaagaccacattataataattcccagaggcctatctttttctgaagctacagcctccaatttggtgaaagtcaatataataggagaagtggttgaccagggaagtaccaatttgaaaattgaccatacaggattcagtccccatgctgcaatctattcaacacgtcctgatgttaagtgtgtgatacacatccatacccttgcaacagcagctgtatcctccatgaaatgtgggatccttccaatttctcaagagtctcttcttctgggagatgttgcctattatgactaccaagggtcacttgaagaacaggaggagagaattcaactgcagaaggttctgggaccaagttgtaaggtgctggtactcaggaatcatggtgtggttgcacttggagaaacattagaggaggcttttcattatatttttaatgtgcaactagcctgtgagattcaggtgcaggccctagcaggtgcaggtggagtagacaatctccatgtactggactttcagaagtataaagctttcacttacactgtagcagcgtctggtggaggaggtgtgaatatgggttcccatcaaaaatggaaggttggcgaaattgagtttgaagggcttatgaggactctggacaacttggggtatagaacaggctatgcttacaggcatcctctcattcgagagaagcctaggcacaagagtgatgtggaaatcccagcaactgtgactgctttttcctttgaagacgatacagtgccactctctcctctcaaatacatggcacagaggcaacagcgtgaaaaaacaagatggctgaactcaccaaatacttacatgaaagtgaatgtgcctgaggagtctcggaacggagaaaccagtccccgaaccaaaatcacgtggatgaaagcagaagactcatctaaagttagtggtggaacacctatcaaaattgaagatccaaatcagtttgttcctttaaacacaaacccgaatgaggtactagaaaagagaaataagattcgggaacaaaatcgatatgacttgaaaacagcaggaccacaatctcagttgcttgctggaattgttgtggataagccaccttctactatgcaatttgaagatgatgatcatggcccaccagctcctcctaacccatttagtcatctcacagaaggagaacttgaagagtataagaggacaatcgaacgtaaacaacaaggcctagaagaaaaccatgagctgttttccaagagcttcatctccatggaagtgcctgtcatggtagtaaatggcaaggatgatatgcatgatgttgaagatgagcttgctaagcgagtgagtaggttaagcacaagtacaaccatagaaaacatcgagattactattaagtctccagagaaaatcgaagaagtcctgtcacctgaaggctccccttcaaaatcgccatccaagaaaaagaagaaattccgcactccttcttttctgaaaaagaacaaaaaaaaggagaaagttgaggcctaaataaagtctttttataattattattataacaatgtgacattgcacatctaaataccacatttaagttgatcattaatatgcaatggtagatcagattgggggatgtagcaaactggactttaagaactggaaagaggttttacaaaagaaaaactttcagattcatctctcattttatatgtccagaaatggctttgaattttaagcaattactagttttaattagctctgccctcatgaagtattattataattcaccataaacagctatctgtctgaattacttcaggccttctccataatatctgttagaaagaaattgccagtgagcaagtgagaatttttatttctcaatacctgcttcacttgataatcatattataattttttatcatgattattgactatatttttggagtcccattgtttcagtgggcattaacagaatgctttaaaaacttctaagacaagaatctatagcattagtatacactggcacataattttttaaaaagttttaagaaaagattcatttggaattttattcacagtataaaatttcctcacctgaagtaactttgtttgccaaaaaagttgttttaataaactataatttttgaaaacttccttttttattagtttagaaagccccttatttttcaacaaaggggattttgtacacataacatgggttatttagtttaactctggcaaaaaaaaaaaaaaaattttgtatgttgatgtttgtataccgttcagtataaaagtgtcctaagcatattagccaatcttttcacagtagagcatacttaaggctgcttggtactgagtatacttaaatataactccagaatccagggacttggtgttaaaacaggattagagcatgtaaaggtacatctagattcatatttgaatcttaaactgtatttttctcttagtattgctaatgagtaaagaaaagtctcataaggtagccaaatgaaaaagaatgaaagggaaagtgaaaaattaaggggacaaaagatgggatgtgaaaagaagaattctagtttgatggtgactcatattcacgataggatacaaagtgtgatttgttggaaacatgtcccaaatttctaaaattctgcttctctgccaaaagcaatgtctttcttggttgatatttgagttttaaaagggtcaaatctttctaattttttgtatctttagagggcagcactagaagaaatcagcaggtctaatcccaccagtaagaaaactaccacttcttgatttttacagatttaaaaaaatcttttcagtgacctttctttttaatgtaaatacaaatttaaacctaggcttaatataggcgtttcccctttcacccaagtgatgtcacagttcgatgcaaaatcaatgatccagaatgatcgtgggtaaaaataactcaaagtgtttcttaagggtgagttggcatgcaaaaaattacattgattacagtgtgttttggagctggctctgtttgtgtgcatatgataatgcagagttgagccagagcctggaaatgtcattctagatctcactaactactggaatcagtgttttaatctcttggtggaaactttcagttgcttaactctctattggaagatttttttaatgttctacatcatttatgttgtattacaatgtatgtagaaatagtaacctgtgaactatgcttttccataactttttaaaaatatatatatctaaatgaatgcaatgtgcataaatattttttaaacataacagtgaactattgcaccttttgctaatgcctctatttacttgctttggcataaagaatgagccaatgaacctctgtgtcctgtggaaaaatgtataaatgttatctgatattgctcttagatgtaatgctaattaatgttaaatcacaaataaacagtattttaaatata

SEQ ID NO: 365352 - DNA, 4137 bp, Homo sapiens
agcgggggagaagctgctgctgctaatgctgctgctgctgctgccgccgccgccgctgctgctgctgctgttggtctgaggctgcagtaggtttctgtgcagcattgcagaatccacacctagagaacagaagacacagacacgtacgtctactacccttgttagaaggaagctttggatcttcggtggataacaagagtaatccacagacttaaaacatgagctcagatgccagccaaggcgtgattaccactcctcctcctcccagcatgcctcacaaagagagatattttgaccgcatcaatgaaaatgacccagaatacattagggagaggaacatgtctcctgatctacgacaagacttcaacatgatggagcagaggaaacgagttactcagatcctgcaaagtcctgcctttcgggaagacttggaatgccttattcaagaacagatgaagaaaggccacaacccaactggattactagcattacagcagattgcagattacatcatggccaattctttctcgggtttttcttcacctcctctcagtcttggcatggtcacacctatcaatgaccttcctggtgcagatacatcctcatatgtgaagggagaaaaacttactcgctgtaaacttgccagcctgtacagacttgtagacttgtttggatgggcacacctggcaaatacctatatctcagtaagaataagtaaggagcaagaccacattataataattcccagaggcctatctttttctgaagctacagcctccaatttggtgaaagtcaatataataggagaagtggttgaccagggaagtaccaatttgaaaattgaccatacaggattcagtccccatgctgcaatctattcaacacgtcctgatgttaagtgtgtgatacacatccatacccttgcaacagcagctgtatcctccatgaaatgtgggatccttccaatttctcaagagtctcttcttctgggagatgttgcctattatgactaccaagggtcacttgaagaacaggaggagagaattcaactgcagaaggttctgggaccaagttgtaaggtgctggtactcaggaatcatggtgtggttgcacttggagaaacattagaggaggcttttcattatatttttaatgtgcaactagcctgtgagattcaggtgcaggccctagcaggtgcaggtggagtagacaatctccatgtactggactttcagaagtataaagctttcacttacactgtagcagcgtctggtggaggaggtgtgaatatgggttcccatcaaaaatggaaggttggcgaaattgagtttgaagggcttatgaggactctggacaacttggggtatagaacaggctatgcttacaggcatcctctcattcgagagaagcctaggcacaagagtgatgtggaaatcccagcaactgtgactgctttttcctttgaagacgatacagtgccactctctcctctcaaatacatggcacagaggcaacagcgtgaaaaaacaagatggctgaactcaccaaatacttacatgaaagtgaatgtgcctgaggagtctcggaacggagaaaccagtccccgaaccaaaatcacgtggatgaaagcagaagactcatctaaagttagtggtggaacacctatcaaaattgaagatccaaatcagtttgttcctttaaacacaaacccgaatgaggtactagaaaagagaaataagattcgggaacaaaatcgatatgacttgaaaacagcaggaccacaatctcagttgcttgctggaattgttgtggataagccaccttctactatgcaatttgaagatgatgatcatggcccaccagctcctcctaacccatttagtcatctcacagaaggagaacttgaagagtataagaggacaatcgaacgtaaacaacaaggcctagaagaaaaccatgagctgttttccaagagcttcatctccatggaagtgcctgtcatggtagtaaatggcaaggatgatatgcatgatgttgaagatgagcttgctaagcgagtgagtaggttaagcacaagtacaaccatagaaaacatcgagattactattaagtctccagagaaaatcgaagaagtcctgtcacctgaaggctccccttcaaaatcgccatccaagaaaaagaagaaattccgcactccttcttttctgaaaaagaacaaaaaaaaggagaaagttgaggcctaaataaagtctttttataattattattataacaatgtgacattgcacatctaaataccacatttaagttgatcattaatatgcaatggtagatcagattgggggatgtagcaaactggactttaagaactggaaagaggttttacaaaagaaaaactttcagattcatctctcattttatatgtccagaaatggctttgaattttaagcaattactagttttaattagctctgccctcatgaagtattattataattcaccataaacagctatctgtctgaattacttcaggccttctccataatatctgttagaaagaaattgccagtgagcaagtgagaatttttatttctcaatacctgcttcacttgataatcatattataattttttatcatgattattgactatatttttggagtcccattgtttcagtgggcattaacagaatgctttaaaaacttctaagacaagaatctatagcattagtatacactggcacataattttttaaaaagttttaagaaaagattcatttggaattttattcacagtataaaatttcctcacctgaagtaactttgtttgccaaaaaagttgttttaataaactataatttttgaaaacttccttttttattagtttagaaagccccttatttttcaacaaaggggattttgtacacataacatgggttatttagtttaactctggcaaaaaaaaaaaaaaaattttgtatgttgatgtttgtataccgttcagtataaaagtgtcctaagcatattagccaatcttttcacagtagagcatacttaaggctgcttggtactgagtatacttaaatataactccagaatccagggacttggtgttaaaacaggattagagcatgtaaaggtacatctagattcatatttgaatcttaaactgtatttttctcttagtattgctaatgagtaaagaaaagtctcataaggtagccaaatgaaaaagaatgaaagggaaagtgaaaaattaaggggacaaaagatgggatgtgaaaagaagaattctagtttgatggtgactcatattcacgataggatacaaagtgtgatttgttggaaacatgtcccaaatttctaaaattctgcttctctgccaaaagcaatgtctttcttggttgatatttgagttttaaaagggtcaaatctttctaattttttgtatctttagagggcagcactagaagaaatcagcaggtctaatcccaccagtaagaaaactaccacttcttgatttttacagatttaaaaaaatcttttcagtgacctttctttttaatgtaaatacaaatttaaacctaggcttaatataggcgtttcccctttcacccaagtgatgtcacagttcgatgcaaaatcaatgatccagaatgatcgtggcattgattacagtgtgttttggagctggctctgtttgtgtgcatatgataatgcagagttgagccagagcctggaaatgtcattctagatctcactaactactggaatcagtgttttaatctcttggtggaaactttcagttgcttaactctctattggaagatttttttaatgttctacatcatttatgttgtattacaatgtatgtagaaatagtaacctgtgaactatgcttttccataactttttaaaaatatatatatctaaatgaatgcaatgtgcataaatattttttaaacataacagtgaactattgcaccttttgctaatgcctctatttacttgctttggcataaagaatgagccaatgaacctctgtgtcctgtggaaaaatgtataaatgttatctgatattgctcttagatgtaatgctaattaatgttaaatcacaaataaacagtattttaaatata

SEQ ID NO: 365353 - DNA, 4268 bp, Homo sapiens
agcgtagtcccgccagagcgcgagccgccagcccgtaacggtcgccagtgtgaggggcgggagggaaagaagaggggtttaaattagattttttaaaacacagagcaagcgccagaggcgtcggcatcccaggtgtcgccgcttcctgctgcacagggctcggcgtacaggtccctccctcctcaagccccctccccttctcccgccctaccctctggggctctgcggcgcttaagaggcggccgcagcggcggatccggcggctgctgcagcccgggcggctgccgagaaggagggaggggaaacacaaagccggctacgcgctgcgagataacaagagtaatccacagacttaaaacatgagctcagatgccagccaaggcgtgattaccactcctcctcctcccagcatgcctcacaaagagagatattttgaccgcatcaatgaaaatgacccagaatacattagggagaggaacatgtctcctgatctacgacaagacttcaacatgatggagcagaggaaacgagttactcagatcctgcaaagtcctgcctttcgggaagacttggaatgccttattcaagaacagatgaagaaaggccacaacccaactggattactagcattacagcagattgcagattacatcatggccaattctttctcgggtttttcttcacctcctctcagtcttggcatggtcacacctatcaatgaccttcctggtgcagatacatcctcatatgtgaagggagaaaaacttactcgctgtaaacttgccagcctgtacagacttgtagacttgtttggatgggcacacctggcaaatacctatatctcagtaagaataagtaaggagcaagaccacattataataattcccagaggcctatctttttctgaagctacagcctccaatttggtgaaagtcaatataataggagaagtggttgaccagggaagtagatgttaagtgtgtgatacacatccatacccttgcaacagcagctgtatcctccatgaaatgtgggatccttccaatttctcaagagtctcttcttctgggagatgttgcctattatgactaccaagggtcacttgaagaacaggaggagagaattcaactgcagaaggttctgggaccaagttgtaaggtgctggtactcaggaatcatggtgtggttgcacttggagaaacattagaggaggcttttcattatatttttaatgtgcaactagcctgtgagattcaggtgcaggccctagcaggtgcaggtggagtagacaatctccatgtactggactttcagaagtataaagctttcacttacactgtagcagcgtctggtggaggaggtgtgaatatgggttcccatcaaaaatggaaggttggcgaaattgagtttgaagggcttatgaggactctggacaacttggggtatagaacaggctatgcttacaggcatcctctcattcgagagaagcctaggcacaagagtgatgtggaaatcccagcaactgtgactgctttttcctttgaagacgatacagtgccactctctcctctcaaatacatggcacagaggcaacagcgtgaaaaaacaagatggctgaactcaccaaatacttacatgaaagtgaatgtgcctgaggagtctcggaacggagaaaccagtccccgaaccaaaatcacgtggatgaaagcagaagactcatctaaagttagtggtggaacacctatcaaaattgaagatccaaatcagtttgttcctttaaacacaaacccgaatgaggtactagaaaagagaaataagattcgggaacaaaatcgatatgacttgaaaacagcaggaccacaatctcagttgcttgctggaattgttgtggataagccaccttctactatgcaatttgaagatgatgatcatggcccaccagctcctcctaacccatttagtcatctcacagaaggagaacttgaagagtataagaggacaatcgaacgtaaacaacaaggcctagaagaaaaccatgagctgttttccaagagcttcatctccatggaagtgcctgtcatggtagtaaatggcaaggatgatatgcatgatgttgaagatgagcttgctaagcgagtgagtaggttaagcacaagtacaaccatagaaaacatcgagattactattaagtctccagagaaaatcgaagaagtcctgtcacctgaaggctccccttcaaaatcgccatccaagaaaaagaagaaattccgcactccttcttttctgaaaaagaacaaaaaaaaggagaaagttgaggcctaaataaagtctttttataattattattataacaatgtgacattgcacatctaaataccacatttaagttgatcattaatatgcaatggtagatcagattgggggatgtagcaaactggactttaagaactggaaagaggttttacaaaagaaaaactttcagattcatctctcattttatatgtccagaaatggctttgaattttaagcaattactagttttaattagctctgccctcatgaagtattattataattcaccataaacagctatctgtctgaattacttcaggccttctccataatatctgttagaaagaaattgccagtgagcaagtgagaatttttatttctcaatacctgcttcacttgataatcatattataattttttatcatgattattgactatatttttggagtcccattgtttcagtgggcattaacagaatgctttaaaaacttctaagacaagaatctatagcattagtatacactggcacataattttttaaaaagttttaagaaaagattcatttggaattttattcacagtataaaatttcctcacctgaagtaactttgtttgccaaaaaagttgttttaataaactataatttttgaaaacttccttttttattagtttagaaagccccttatttttcaacaaaggggattttgtacacataacatgggttatttagtttaactctggcaaaaaaaaaaaaaaaattttgtatgttgatgtttgtataccgttcagtataaaagtgtcctaagcatattagccaatcttttcacagtagagcatacttaaggctgcttggtactgagtatacttaaatataactccagaatccagggacttggtgttaaaacaggattagagcatgtaaaggtacatctagattcatatttgaatcttaaactgtatttttctcttagtattgctaatgagtaaagaaaagtctcataaggtagccaaatgaaaaagaatgaaagggaaagtgaaaaattaaggggacaaaagatgggatgtgaaaagaagaattctagtttgatggtgactcatattcacgataggatacaaagtgtgatttgttggaaacatgtcccaaatttctaaaattctgcttctctgccaaaagcaatgtctttcttggttgatatttgagttttaaaagggtcaaatctttctaattttttgtatctttagagggcagcactagaagaaatcagcaggtctaatcccaccagtaagaaaactaccacttcttgatttttacagatttaaaaaaatcttttcagtgacctttctttttaatgtaaatacaaatttaaacctaggcttaatataggcgtttcccctttcacccaagtgatgtcacagttcgatgcaaaatcaatgatccagaatgatcgtgggtaaaaataactcaaagtgtttcttaagggtgagttggcatgcaaaaaattacattgattacagtgtgttttggagctggctctgtttgtgtgcatatgataatgcagagttgagccagagcctggaaatgtcattctagatctcactaactactggaatcagtgttttaatctcttggtggaaactttcagttgcttaactctctattggaagatttttttaatgttctacatcatttatgttgtattacaatgtatgtagaaatagtaacctgtgaactatgcttttccataactttttaaaaatatatatatctaaatgaatgcaatgtgcataaatattttttaaacataacagtgaactattgcaccttttgctaatgcctctatttacttgctttggcataaagaatgagccaatgaacctctgtgtcctgtggaaaaatgtataaatgttatctgatattgctcttagatgtaatgctaattaatgttaaatcacaaataaacagtattttaaatata

SEQ ID NO: 365354 - DNA, 4397 bp, Homo sapiens
  misc_feature (3746)..(3746): n is a, c, g, or t
agcgggggagaagctgctgctgctaatgctgctgctgctgctgccgccgccgccgctgctgctgctgctgttggtctgaggctgcagtaggtttctgtgcagcattgcagaatccacacctagagaacagaagacacagacacgtacgtctactacccttgttagaaggaagctttggatcttcggtggataacaagagtaatccacagacttaaaacatgagctcagatgccagccaaggcgtgattaccactcctcctcctcccagcatgcctcacaaagagagatattttgaccgcatcaatgaaaatgacccagaatacattagggagaggaacatgtctcctgatctacgacaagacttcaacatgatggagcagaggaaacgagttactcagatcctgcaaagtcctgcctttcgggaagacttggaatgccttattcaagaacagatgaagaaaggccacaacccaactggattactagcattacagcagattgcagattacatcatggccaattctttctcgggtttttcttcacctcctctcagtcttggcatggtcacacctatcaatgaccttcctggtgcagatacatcctcatatgtgaagggagaaaaacttactcgctgtaaacttgccagcctgtacagacttgtagacttgtttggatgggcacacctggcaaatacctatatctcagtaagaataagtaaggagcaagaccacattataataattcccagaggcctatctttttctgaagctacagcctccaatttggtgaaagtcaatataataggagaagtggttgaccagggaagtaccaatttgaaaattgaccatacaggattcagtccccatgctgcaatctattcaacacgtcctgatgttaagtgtgtgatacacatccatacccttgcaacagcagctgtatcctccatgaaatgtgggatccttccaatttctcaagagtctcttcttctgggagatgttgcctattatgactaccaagggtcacttgaagaacaggaggagagaattcaactgcagaaggttctgggaccaagttgtaaggtgctggtactcaggaatcatggtgtggttgcacttggagaaacattagaggaggcttttcattatatttttaatgtgcaactagcctgtgagattcaggtgcaggccctagcaggtgcaggtggagtagacaatctccatgtactggactttcagaagtataaagctttcacttacactgtagcagcgtctggtggaggaggtgtgaatatgggttcccatcaaaaatggaaggttggcgaaattgagtttgaagggcttatgaggactctggacaacttggggtatagaacaggctatgcttacaggcatcctctcattcgagagaagcctaggcacaagagtgatgtggaaatcccagcaactgtgactgctttttcctttgaagacgatacagtgccactctctcctctcaaatacatggcacagaggcaacagcgtgaaaaaacaagatggctgaactcaccaaatacttacatgaaagtgaatgtgcctgaggagtctcggaacggagaaaccagtccccgaaccaaaatcacgtggatgaaagcagaagactcatctaaagttagtggtggaacacctatcaaaattgaagatccaaatcagtttgttcctttaaacacaaacccgaatgaggtactagaaaagagaaataagattcgggaacaaaatcgatatgacttgaaaacagcaggaccacaatctcagttgcttgctggaattgttgtggataagccaccttctactatgcaatttgaagatgatgatcatggcccaccagctcctcctaacccatttagtcatctcacagaaggagaacttgaagagtataagaggacaatcgaacgtaaacaacaaggcctagaagaaaaccatgagctgttttccaagagcttcatctccatggaagtgcctgtcatggtagtaaatggcaaggatgatatgcatgatgttgaagatgagcttgctaagcgagtgagtaggttaagcacaagtacaaccatagaaaacatcgagattactattaagtctccagagaaaatcgaagaagtcctgtcacctgaaggctccccttcaaaatcgccatccaagaaaaagaagaaattccgcactccttcttttctgaaaaagaacaaaaaaaaggagaaagttgaggcctaaataaagtctttttataattattattataacaatgtgacattgcacatctaaataccacatttaagttgatcattaatatgcaatggtagatcagattgggggatgtagcaaactggactttaagaactggaaagaggttttacaaaagaaaaactttcagattcatctctcattttatatgtccagaaatggctttgaattttaagcaattactagttttaattagctctgccctcatgaagtattattataattcaccataaacagctatctgtctgaattacttcaggccttctccataatatctgttagaaagaaattgccagtgagcaagtgagaatttttatttctcaatacctgcttcacttgataatcatattataattttttatcatgattattgactatatttttggagtcccattgtttcagtgggcattaacagaatgctttaaaaacttctaagacaagaatctatagcattagtatacactggcacataattttttaaaaagttttaagaaaagattcatttggaattttattcacagtataaaatttcctcacctgaagtaactttgtttgccaaaaaagttgttttaataaactataatttttgaaaacttccttttttattagtttagaaagccccttatttttcaacaaaggggattttgtacacataacatgggttatttagtttaactctggcaaaaaaaaaaaaaaaattttgtatgttgatgtttgtataccgttcagtataaaagtgtcctaagcatattagccaatcttttcacagtagagcatacttaaggctgcttggtactgagtatacttaaatataactccagaatccagggacttggtgttaaaacaggattagagcatgtaaaggtacatctagattcatatttgaatcttaaactgtatttttctcttagtattgctaatgagtaaagaaaagtctcataaggtagccaaatgaaaaagaatgaaagggaaagtgaaaaattaaggggacaaaagatgggatgtgaaaagaagaattctagtttgatggtgactcatattcacgataggatacaaagtgtgatttgttggaaacatgtcccaaatttctaaaattctgcttctctgccaaaagcaatgtctttcttggttgatatttgagttttaaaagggtcaaatctttctaattttttgtatctttagagggcagcactagaagaaatcagcaggtctaatcccaccagtaagaaaactaccacttcttgatttttacagatttaaaaaaatcttttcagtgacctttctttttaatgtaaatacaaatttaaacctaggcttaatataggcgtttcccctttcacccaagtgatgtcacagttcgatgcaaaatcaatgatccagaatgatcgtgggtaaaaataactcaaagtgtttcttaagggtgagttggcatgcaaaaaattagtaacacaatatttttaaaacgaatgattnttggggagaaacgtttttttgtgttttaaaagaccacgaaaataggggaggttctgtgtgtgcgttcttctgtgggtagtattacatataatatatcagactcgtggggacggcgggacaaaaaactaggggggcacctgttttgggggtggcggtgcccgcattttcccttattgtgggggattttttattgggggtttgggattggggcccaaatttaatggaataatgcagagttgagccagagcctggaaatgtcattctagatctcactaactactggaatcagtgttttaatctcttggtggaaactttcagttgcttaactctctattggaagatttttttaatgttctacatcatttatgttgtattacaatgtatgtagaaatagtaacctgtgaactatgcttttccataactttttaaaaatatatatatctaaatgaatgcaatgtgcataaatattttttaaacataacagtgaactattgcaccttttgctaatgcctctatttacttgctttggcataaagaatgagccaatgaacctctgtgtcctgtggaaaaatgtataaatgttatctgatattgctcttagatgtaatgctaattaatgttaaatcacaaataaacagtattttaaatata

SEQ ID NO: 365355 - DNA, 4388 bp, Homo sapiens
agcgtagtcccgccagagcgcgagccgccagcccgtaacggtcgccagtgtgaggggcgggagggaaagaagaggggtttaaattagattttttaaaacacagagcaagcgccagaggcgtcggcatcccaggtgtcgccgcttcctgctgcacagggctcggcgtacaggtccctccctcctcaagccccctccccttctcccgccctaccctctggggctctgcggcgcttaagaggcggccgcagcggcggatccggcggctgctgcagcccgggcggctgccgagaaggagggaggggaaacacaaagccggctacgcgctgcgagagttgtctcccagagctccgtggaatttcctttctctgctttaacgtacttttaaaagataacaagagtaatccacagacttaaaacatgagctcagatgccagccaaggcgtgattaccactcctcctcctcccagcatgcctcacaaagagagatattttgaccgcatcaatgaaaatgacccagaatacattagggagaggaacatgtctcctgatctacgacaagacttcaacatgatggagcagaggaaacgagttactcagatcctgcaaagtcctgcctttcgggaagacttggaatgccttattcaagaacagatgaagaaaggccacaacccaactggattactagcattacagcagattgcagattacatcatggccaattctttctcgggtttttcttcacctcctctcagtcttggcatggtcacacctatcaatgaccttcctggtgcagatacatcctcatatgtgaagggagaaaaacttactcgctgtaaacttgccagcctgtacagacttgtagacttgtttggatgggcacacctggcaaatacctatatctcagtaagaataagtaaggagcaagaccacattataataattcccagaggcctatctttttctgaagctacagcctccaatttggtgaaagtcaatataataggagaagtggttgaccagggaagtaccaatttgaaaattgaccatacaggattcagtccccatgctgcaatctattcaacacgtcctgatgttaagtgtgtgatacacatccatacccttgcaacagcagctgtatcctccatgaaatgtgggatccttccaatttctcaagagtctcttcttctgggagatgttgcctattatgactaccaagggtcacttgaagaacaggaggagagaattcaactgcagaaggttctgggaccaagttgtaaggtgctggtactcaggaatcatggtgtggttgcacttggagaaacattagaggaggcttttcattatatttttaatgtgcaactagcctgtgagattcaggtgcaggccctagcaggtgcaggtggagtagacaatctccatgtactggactttcagaagtataaagctttcacttacactgtagcagcgtctggtggaggaggtgtgaatatgggttcccatcaaaaatggaaggttggcgaaattgagtttgaagggcttatgaggactctggacaacttggggtatagaacaggctatgcttacaggcatcctctcattcgagagaagcctaggcacaagagtgatgtggaaatcccagcaactgtgactgctttttcctttgaagacgatacagtgccactctctcctctcaaatacatggcacagaggcaacagcgtgaaaaaacaagatggctgaactcaccaaatacttacatgaaagtgaatgtgcctgaggagtctcggaacggagaaaccagtccccgaaccaaaatcacgtggatgaaagcagaagactcatctaaagttagtggtggaacacctatcaaaattgaagatccaaatcagtttgttcctttaaacacaaacccgaatgaggtactagaaaagagaaataagattcgggaacaaaatcgatatgacttgaaaacagcaggaccacaatctcagttgcttgctggaattgttgtggataagccaccttctactatgcaatttgaagatgatgatcatggcccaccagctcctcctaacccatttagtcatctcacagaaggagaacttgaagagtataagaggacaatcgaacgtaaacaacaaggcctagaagaaaaccatgagctgttttccaagagcttcatctccatggaagtgcctgtcatggtagtaaatggcaaggatgatatgcatgatgttgaagatgagcttgctaagcgagtgagtaggttaagcacaagtacaaccatagaaaacatcgagattactattaagtctccagagaaaatcgaagaagtcctgtcacctgaaggctccccttcaaaatcgccatccaagaaaaagaagaaattccgcactccttcttttctgaaaaagaacaaaaaaaaggagaaagttgaggcctaaataaagtctttttataattattattataacaatgtgacattgcacatctaaataccacatttaagttgatcattaatatgcaatggtagatcagattgggggatgtagcaaactggactttaagaactggaaagaggttttacaaaagaaaaactttcagattcatctctcattttatatgtccagaaatggctttgaattttaagcaattactagttttaattagctctgccctcatgaagtattattataattcaccataaacagctatctgtctgaattacttcaggccttctccataatatctgttagaaagaaattgccagtgagcaagtgagaatttttatttctcaatacctgcttcacttgataatcatattataattttttatcatgattattgactatatttttggagtcccattgtttcagtgggcattaacagaatgctttaaaaacttctaagacaagaatctatagcattagtatacactggcacataattttttaaaaagttttaagaaaagattcatttggaattttattcacagtataaaatttcctcacctgaagtaactttgtttgccaaaaaagttgttttaataaactataatttttgaaaacttccttttttattagtttagaaagccccttatttttcaacaaaggggattttgtacacataacatgggttatttagtttaactctggcaaaaaaaaaaaaaaaattttgtatgttgatgtttgtataccgttcagtataaaagtgtcctaagcatattagccaatcttttcacagtagagcatacttaaggctgcttggtactgagtatacttaaatataactccagaatccagggacttggtgttaaaacaggattagagcatgtaaaggtacatctagattcatatttgaatcttaaactgtatttttctcttagtattgctaatgagtaaagaaaagtctcataaggtagccaaatgaaaaagaatgaaagggaaagtgaaaaattaaggggacaaaagatgggatgtgaaaagaagaattctagtttgatggtgactcatattcacgataggatacaaagtgtgatttgttggaaacatgtcccaaatttctaaaattctgcttctctgccaaaagcaatgtctttcttggttgatatttgagttttaaaagggtcaaatctttctaattttttgtatctttagagggcagcactagaagaaatcagcaggtctaatcccaccagtaagaaaactaccacttcttgatttttacagatttaaaaaaatcttttcagtgacctttctttttaatgtaaatacaaatttaaacctaggcttaatataggcgtttcccctttcacccaagtgatgtcacagttcgatgcaaaatcaatgatccagaatgatcgtgggtaaaaataactcaaagtgtttcttaagggtgagttggcatgcaaaaaattacattgattacagtgtgttttggagctggctctgtttgtgtgcatatgataatgcagagttgagccagagcctggaaatgtcattctagatctcactaactactggaatcagtgttttaatctcttggtggaaactttcagttgcttaactctctattggaagatttttttaatgttctacatcatttatgttgtattacaatgtatgtagaaatagtaacctgtgaactatgcttttccataactttttaaaaatatatatatctaaatgaatgcaatgtgcataaatattttttaaacataacagtgaactattgcaccttttgctaatgcctctatttacttgctttggcataaagaatgagccaatgaacctctgtgtcctgtggaaaaatgtataaatgttatctgatattgctcttagatgtaatgctaattaatgttaaatcacaaataaacagtattttaaatata

SEQ ID NO: 365356 - DNA, 4115 bp, Homo sapiens
cacattgagtgtggatatcttgctctttaaaacaaagttcattgttagggcagtattgcaacagaattgccacacaaaaaccagcttaagaaatgtacagcacttcaatttttttataacaagagtaatccacagacttaaaacatgagctcagatgccagccaaggcgtgattaccactcctcctcctcccagcatgcctcacaaagagagatattttgaccgcatcaatgaaaatgacccagaatacattagggagaggaacatgtctcctgatctacgacaagacttcaacatgatggagcagaggaaacgagttactcagatcctgcaaagtcctgcctttcgggaagacttggaatgccttattcaagaacagatgaagaaaggccacaacccaactggattactagcattacagcagattgcagattacatcatggccaattctttctcgggtttttcttcacctcctctcagtcttggcatggtcacacctatcaatgaccttcctggtgcagatacatcctcatatgtgaagggagaaaaacttactcgctgtaaacttgccagcctgtacagacttgtagacttgtttggatgggcacacctggcaaatacctatatctcagtaagaataagtaaggagcaagaccacattataataattcccagaggcctatctttttctgaagctacagcctccaatttggtgaaagtcaatataataggagaagtggttgaccagggaagtaccaatttgaaaattgaccatacaggattcagtccccatgctgcaatctattcaacacgtcctgatgttaagtgtgtgatacacatccatacccttgcaacagcagctgtatcctccatgaaatgtgggatccttccaatttctcaagagtctcttcttctgggagatgttgcctattatgactaccaagggtcacttgaagaacaggaggagagaattcaactgcagaaggttctgggaccaagttgtaaggtgctggtactcaggaatcatggtgtggttgcacttggagaaacattagaggaggcttttcattatatttttaatgtgcaactagcctgtgagattcaggtgcaggccctagcaggtgcaggtggagtagacaatctccatgtactggactttcagaagtataaagctttcacttacactgtagcagcgtctggtggaggaggtgtgaatatgggttcccatcaaaaatggaaggttggcgaaattgagtttgaagggcttatgaggactctggacaacttggggtatagaacaggctatgcttacaggcatcctctcattcgagagaagcctaggcacaagagtgatgtggaaatcccagcaactgtgactgctttttcctttgaagacgatacagtgccactctctcctctcaaatacatggcacagaggcaacagcgtgaaaaaacaagatggctgaactcaccaaatacttacatgaaagtgaatgtgcctgaggagtctcggaacggagaaaccagtccccgaaccaaaatcacgtggatgaaagcagaagactcatctaaagttagtggtggaacacctatcaaaattgaagatccaaatcagtttgttcctttaaacacaaacccgaatgaggtactagaaaagagaaataagattcgggaacaaaatcgatatgacttgaaaacagcaggaccacaatctcagttgcttgctggaattgttgtggataagccaccttctactatgcaatttgaagatgatgatcatggcccaccagctcctcctaacccatttagtcatctcacagaaggagaacttgaagagtataagaggacaatcgaacgtaaacaacaaggcctagaagaaaaccatgagctgttttccaagagcttcatctccatggaagtgcctgtcatggtagtaaatggcaaggatgatatgcatgatgttgaagatgagcttgctaagcgagtgagtaggttaagcacaagtacaaccatagaaaacatcgagattactattaagtctccagagaaaatcgaagaagtcctgtcacctgaaggctccccttcaaaatcgccatccaagaaaaagaagaaattccgcactccttcttttctgaaaaagaacaaaaaaaaggagaaagttgaggcctaaataaagtctttttataattattattataacaatgtgacattgcacatctaaataccacatttaagttgatcattaatatgcaatggtagatcagattgggggatgtagcaaactggactttaagaactggaaagaggttttacaaaagaaaaactttcagattcatctctcattttatatgtccagaaatggctttgaattttaagcaattactagttttaattagctctgccctcatgaagtattattataattcaccataaacagctatctgtctgaattacttcaggccttctccataatatctgttagaaagaaattgccagtgagcaagtgagaatttttatttctcaatacctgcttcacttgataatcatattataattttttatcatgattattgactatatttttggagtcccattgtttcagtgggcattaacagaatgctttaaaaacttctaagacaagaatctatagcattagtatacactggcacataattttttaaaaagttttaagaaaagattcatttggaattttattcacagtataaaatttcctcacctgaagtaactttgtttgccaaaaaagttgttttaataaactataatttttgaaaacttccttttttattagtttagaaagccccttatttttcaacaaaggggattttgtacacataacatgggttatttagtttaactctggcaaaaaaaaaaaaaaaattttgtatgttgatgtttgtataccgttcagtataaaagtgtcctaagcatattagccaatcttttcacagtagagcatacttaaggctgcttggtactgagtatacttaaatataactccagaatccagggacttggtgttaaaacaggattagagcatgtaaaggtacatctagattcatatttgaatcttaaactgtatttttctcttagtattgctaatgagtaaagaaaagtctcataaggtagccaaatgaaaaagaatgaaagggaaagtgaaaaattaaggggacaaaagatgggatgtgaaaagaagaattctagtttgatggtgactcatattcacgataggatacaaagtgtgatttgttggaaacatgtcccaaatttctaaaattctgcttctctgccaaaagcaatgtctttcttggttgatatttgagttttaaaagggtcaaatctttctaattttttgtatctttagagggcagcactagaagaaatcagcaggtctaatcccaccagtaagaaaactaccacttcttgatttttacagatttaaaaaaatcttttcagtgacctttctttttaatgtaaatacaaatttaaacctaggcttaatataggcgtttcccctttcacccaagtgatgtcacagttcgatgcaaaatcaatgatccagaatgatcgtgggtaaaaataactcaaagtgtttcttaagggtgagttggcatgcaaaaaattacattgattacagtgtgttttggagctggctctgtttgtgtgcatatgataatgcagagttgagccagagcctggaaatgtcattctagatctcactaactactggaatcagtgttttaatctcttggtggaaactttcagttgcttaactctctattggaagatttttttaatgttctacatcatttatgttgtattacaatgtatgtagaaatagtaacctgtgaactatgcttttccataactttttaaaaatatatatatctaaatgaatgcaatgtgcataaatattttttaaacataacagtgaactattgcaccttttgctaatgcctctatttacttgctttggcataaagaatgagccaatgaacctctgtgtcctgtggaaaaatgtataaatgttatctgatattgctcttagatgtaatgctaattaatgttaaatcacaaataaacagtattttaaatata

SEQ ID NO: 365357 - DNA, 5351 bp, Homo sapiens
agcgtagtcccgccagagcgcgagccgccagcccgtaacggtcgccagtgtgaggggcgggagggaaagaagaggggtttaaattagattttttaaaacacagagcaagcgccagaggcgtcggcatcccaggtgtcgccgcttcctgctgcacagggctcggcgtacaggtccctccctcctcaagccccctccccttctcccgccctaccctctggggctctgcggcgcttaagaggcggccgcagcggcggatccggcggctgctgcagcccgggcggctgccgagaaggagggaggggaaacacaaagccggctacgcgctgcgagataacaagagtaatccacagacttaaaacatgagctcagatgccagccaaggcgtgattaccactcctcctcctcccagcatgcctcacaaagagagatattttgaccgcatcaatgaaaatgacccagaatacattagggagaggaacatgtctcctgatctacgacaagacttcaacatgatggagcagaggaaacgagttactcagatcctgcaaagtcctgcctttcgggaagacttggaatgccttattcaagaacagatgaagaaaggccacaacccaactggattactagcattacagcagattgcagattacatcatggccaattctttctcgggtttttcttcacctcctctcagtcttggcatggtcacacctatcaatgaccttcctggtgcagatacatcctcatatgtgaagggagaaaaacttactcgctgtaaacttgccagcctgtacagacttgtagacttgtttggatgggcacacctggcaaatacctatatctcagtaagaataagtaaggagcaagaccacattataataattcccagaggcctatctttttctgaagctacagcctccaatttggtgaaagtcaatataataggagaagtggttgaccagggaagtaccaatttgaaaattgaccatacaggattcagtccccatgctgcaatctattcaacacgtcctgatgttaagtgtgtgatacacatccatacccttgcaacagcagctgtatcctccatgaaatgtgggatccttccaatttctcaagagtctcttcttctgggagatgttgcctattatgactaccaagggtcacttgaagaacaggaggagagaattcaactgcagaaggttctgggaccaagttgtaaggtgctggtactcaggaatcatggtgtggttgcacttggagaaacattagaggaggcttttcattatatttttaatgtgcaactagcctgtgagattcaggtgcaggccctagcaggtgcaggtggagtagacaatctccatgtactggactttcagaagtataaagctttcacttacactgtagcagcgtctggtggaggaggtgtgaatatgggttcccatcaaaaatggaaggttggcgaaattgagtttgaagggcttatgaggactctggacaacttggggtatagaacaggctatgcttacaggcatcctctcattcgagagaagcctaggcacaagagtgatgtggaaatcccagcaactgtgactgctttttcctttgaagacgatacagtgccactctctcctctcaaatacatggcacagaggcaacagcgtgaaaaaacaagatggctgaactcaccaaatacttacatgaaagtgaatgtgcctgaggagtctcggaacggagaaaccagtccccgaaccaaaatcacgtggatgaaagcagaagactcatctaaagttagtggtggaacacctatcaaaattgaagatccaaatcagtttgttcctttaaacacaaacccgaatgaggtactagaaaagagaaataagattcgggaacaaaatcgatatgacttgaaaacagcaggaccacaatctcagttgcttgctggaattgttgtggataagccaccttctactatgcaatttgaagatgatgatcatggcccaccagctcctcctaacccatttagtcatctcacagaaggagaacttgaagagtataagaggacaatcgaacgtaaacaacaaggcctagaagatgctgagcaggaattactctcagatgacgcttcatctgtttcacaaattcagtctcaaactcagtcaccgcaaaatgtccctgaaaaattagaaggtactcaatgtaatttcccacatagcattcactgagttagtcttgagtctgtccctctgtgttttgttttcacgtgaggaagttgaatacctcatcacagtaagttttccatattttacttatatctcccaataattacatattttatatcattaaaaatggggcgctacttttgttcagcatttatattgatttaccttaatctgaattttggcaacccgcagttcttaagaatttgtggaattggctgggcgcggtggctcacacctgtaatcccagcactttgggaggctgaggcaggtggatcacgaggtcaggagatcaagaccatcctggctaacacggtgaaaccctgtctctactaaaaatacaaaaaattagctgggtgtggtggcgggcgcctgtagtcccagctactcgggaggctgaggcaggagaatggcatgaacacgggaggtggagctggcagtgagccaagactgccactgcactccggcctgggcgacagagtgagactccgcctcaaaaaaaaaaaaaaaaaaaaaagaatttgtggaattaaacatctcccaatcagcagcatgaaatctttttcagtattgattgccaaatgatcccaaaactagagaaaaatatgttgtcttcctcatttatacttaattgatttacaatgaaactgttatttcatcaaactgggattatctagcttttgctctttggtttaacaactttgttcctttcccctttatatcattaaagaaaattagcttcttgctaatagatcacagtttattaaaataatgatctgtcttcattggaatcaaagtaatgccttattacattgctaaaacatttcagttttgtaaagtagagcaaaaatgttaagtatgtaaaataacccccaaaaaaccctcccctttcgtagaaaaccatgagctgttttccaagagcttcatctccatggaagtgcctgtcatggtagtaaatggcaaggatgatatgcatgatgttgaagatgagcttgctaagcgagtgagtaggttaagcacaagtacaaccatagaaaacatcgagattactattaagtctccagagaaaatcgaagaagtcctgtcacctgaaggctccccttcaaaatcgccatccaagaaaaagaagaaattccgcactccttcttttctgaaaaagaacaaaaaaaaggagaaagttgaggcctaaataaagtctttttataattattattataacaatgtgacattgcacatctaaataccacatttaagttgatcattaatatgcaatggtagatcagattgggggatgtagcaaactggactttaagaactggaaagaggttttacaaaagaaaaactttcagattcatctctcattttatatgtccagaaatggctttgaattttaagcaattactagttttaattagctctgccctcatgaagtattattataattcaccataaacagctatctgtctgaattacttcaggccttctccataatatctgttagaaagaaattgccagtgagcaagtgagaatttttatttctcaatacctgcttcacttgataatcatattataattttttatcatgattattgactatatttttggagtcccattgtttcagtgggcattaacagaatgctttaaaaacttctaagacaagaatctatagcattagtatacactggcacataattttttaaaaagttttaagaaaagattcatttggaattttattcacagtataaaatttcctcacctgaagtaactttgtttgccaaaaaagttgttttaataaactataatttttgaaaacttccttttttattagtttagaaagccccttatttttcaacaaaggggattttgtacacataacatgggttatttagtttaactctggcaaaaaaaaaaaaaaaattttgtatgttgatgtttgtataccgttcagtataaaagtgtcctaagcatattagccaatcttttcacagtagagcatacttaaggctgcttggtactgagtatacttaaatataactccagaatccagggacttggtgttaaaacaggattagagcatgtaaaggtacatctagattcatatttgaatcttaaactgtatttttctcttagtattgctaatgagtaaagaaaagtctcataaggtagccaaatgaaaaagaatgaaagggaaagtgaaaaattaaggggacaaaagatgggatgtgaaaagaagaattctagtttgatggtgactcatattcacgataggatacaaagtgtgatttgttggaaacatgtcccaaatttctaaaattctgcttctctgccaaaagcaatgtctttcttggttgatatttgagttttaaaagggtcaaatctttctaattttttgtatctttagagggcagcactagaagaaatcagcaggtctaatcccaccagtaagaaaactaccacttcttgatttttacagatttaaaaaaatcttttcagtgacctttctttttaatgtaaatacaaatttaaacctaggcttaatataggcgtttcccctttcacccaagtgatgtcacagttcgatgcaaaatcaatgatccagaatgatcgtgggtaaaaataactcaaagtgtttcttaagggtgagttggcatgcaaaaaattacattgattacagtgtgttttggagctggctctgtttgtgtgcatatgataatgcagagttgagccagagcctggaaatgtcattctagatctcactaactactggaatcagtgttttaatctcttggtggaaactttcagttgcttaactctctattggaagatttttttaatgttctacatcatttatgttgtattacaatgtatgtagaaatagtaacctgtgaactatgcttttccataactttttaaaaatatatatatctaaatgaatgcaatgtgcataaatattttttaaacataacagtgaactattgcaccttttgctaatgcctctatttacttgctttggcataaagaatgagccaatgaacctctgtgtcctgtggaaaaatgtataaatgttatctgatattgctcttagatgtaatgctaattaatgttaaatcacaaataaacagtattttaaatata

SEQ ID NO: 365358 - DNA, 5313 bp, Homo sapiens
agcgtagtcccgccagagcgcgagccgccagcccgtaacggtcgccagtgtgaggggcgggagggaaagaagaggggtttaaattagattttttaaaacacagagcaagcgccagaggcgtcggcatcccaggtgtcgccgcttcctgctgcacagggctcggcgtacaggtccctccctcctcaagccccctccccttctcccgccctaccctctggggctctgcggcgcttaagaggcggccgcagcggcggatccggcggctgctgcagcccgggcggctgccgagaaggagggaggggaaacacaaagccggctacgcgctgcgagataacaagagtaatccacagacttaaaacatgagctcagatgccagccaaggcgtgattaccactcctcctcctcccagcatgcctcacaaagagagatattttgaccgcatcaatgaaaatgacccagaatacattagggagaggaacatgtctcctgatctacgacaagacttcaacatgatggagcagaggaaacgagttactcagatcctgcaaagtcctgcctttcgggaagacttggaatgccttattcaagaacagatgaagaaaggccacaacccaactggattactagcattacagcagattgcagattacatcatggccaattctttctcgggtttttcttcacctcctctcagtcttggcatggtcacacctatcaatgaccttcctggtgcagatacatcctcatatgtgaagggagaaaaacttactcgctgtaaacttgccagcctgtacagacttgtagacttgtttggatgggcacacctggcaaatacctatatctcagtaagaataagtaaggagcaagaccacattataataattcccagaggcctatctttttctgaagctacagcctccaatttggtgaaagtcaatataataggagaagtggttgaccagggaagtaccaatttgaaaattgaccatacaggattcagtccccatgctgcaatctattcaacacgtcctgatgttaagtgtgtgatacacatccatacccttgcaacagcagctgtatcctccatgaaatgtgggatccttccaatttctcaagagtctcttcttctgggagatgttgcctattatgactaccaagggtcacttgaagaacaggaggagagaattcaactgcagaaggttctgggaccaagttgtaaggtgctggtactcaggaatcatggtgtggttgcacttggagaaacattagaggaggcttttcattatatttttaatgtgcaactagcctgtgagattcaggtgcaggccctagcaggtgcaggtggagtagacaatctccatgtactggactttcagaagtataaagctttcacttacactgtagcagcgtctggtggaggaggtgtgaatatgggttcccatcaaaaatggaaggttggcgaaattgagtttgaagggcttatgaggactctggacaacttggggtatagaacaggctatgcttacaggcatcctctcattcgagagaagcctaggcacaagagtgatgtggaaatcccagcaactgtgactgctttttcctttgaagacgatacagtgccactctctcctctcaaatacatggcacagaggcaacagcgtgaaaaaacaagatggctgaactcaccaaatacttacatgaaagtgaatgtgcctgaggagtctcggaacggagaaaccagtccccgaaccaaaatcacgtggatgaaagcagaagactcatctaaagttagtggtggaacacctatcaaaattgaagatccaaatcagtttgttcctttaaacacaaacccgaatgaggtactagaaaagagaaataagattcgggaacaaaatcgatatgacttgaaaacagcaggaccacaatctcagttgcttgctggaattgttgtggataagccaccttctactatgcaatttgaagatgatgatcatggcccaccagctcctcctaacccatttagtcatctcacagaaggagaacttgaagagtataagaggacaatcgaacgtaaacaacaaggcctagaagatgctgagcaggaattactctcagatgacgcttcatctgtttcacaaattcagtctcaaactcagtcaccgcaaaatgtccctgaaaaattagaaggtactcaatgtaatttcccacatagcattcactgagttagtcttgagtctgtccctctgtgttttgttttcacgtgaggaagttgaatacctcatcacagtaagttttccatattttacttatatctcccaataattacatattttatatcattaaaaatggggcgctacttttgttcagcatttatattgatttaccttaatctgaattttggcaacccgcagttcttaagaatttgtggaattggctgggcgcggtggctcacacctgtaatcccagcactttgggaggctgaggcaggtggatcacgaggtcaggagatcaagaccatcctggctaacacggtgaaaccctgtctctactaaaaatacaaaaaattagctgggtgtggtggcgggcgcctgtagtcccagctactcgggaggctgaggcaggagaatggcatgaacacgggaggtggagctggcagtgagccaagactgccactgcactccggcctgggcgacagagtgagactccgcctcaaaaaaaaaaaaaaaaaaaaaagaatttgtggaattaaacatctcccaatcagcagcatgaaatctttttcagtattgattgccaaatgatcccaaaactagagaaaaatatgttgtcttcctcatttatacttaattgatttacaatgaaactgttatttcatcaaactgggattatctagcttttgctctttggtttaacaactttgttcctttcccctttatatcattaaagaaaattagcttcttgctaatagatcacagtttattaaaataatgatctgtcttcattggaatcaaagtaatgccttattacattgctaaaacatttcagttttgtaaagtagagcaaaaatgttaagtatgtaaaataacccccaaaaaaccctcccctttcgtagaaaaccatgagctgttttccaagagcttcatctccatggaagtgcctgtcatggtagtaaatggcaaggatgatatgcatgatgttgaagatgagcttgctaagcgagtgagtaggttaagcacaagtacaaccatagaaaacatcgagattactattaagctccccttcaaaatcgccatccaagaaaaagaagaaattccgcactccttcttttctgaaaaagaacaaaaaaaaggagaaagttgaggcctaaataaagtctttttataattattattataacaatgtgacattgcacatctaaataccacatttaagttgatcattaatatgcaatggtagatcagattgggggatgtagcaaactggactttaagaactggaaagaggttttacaaaagaaaaactttcagattcatctctcattttatatgtccagaaatggctttgaattttaagcaattactagttttaattagctctgccctcatgaagtattattataattcaccataaacagctatctgtctgaattacttcaggccttctccataatatctgttagaaagaaattgccagtgagcaagtgagaatttttatttctcaatacctgcttcacttgataatcatattataattttttatcatgattattgactatatttttggagtcccattgtttcagtgggcattaacagaatgctttaaaaacttctaagacaagaatctatagcattagtatacactggcacataattttttaaaaagttttaagaaaagattcatttggaattttattcacagtataaaatttcctcacctgaagtaactttgtttgccaaaaaagttgttttaataaactataatttttgaaaacttccttttttattagtttagaaagccccttatttttcaacaaaggggattttgtacacataacatgggttatttagtttaactctggcaaaaaaaaaaaaaaaattttgtatgttgatgtttgtataccgttcagtataaaagtgtcctaagcatattagccaatcttttcacagtagagcatacttaaggctgcttggtactgagtatacttaaatataactccagaatccagggacttggtgttaaaacaggattagagcatgtaaaggtacatctagattcatatttgaatcttaaactgtatttttctcttagtattgctaatgagtaaagaaaagtctcataaggtagccaaatgaaaaagaatgaaagggaaagtgaaaaattaaggggacaaaagatgggatgtgaaaagaagaattctagtttgatggtgactcatattcacgataggatacaaagtgtgatttgttggaaacatgtcccaaatttctaaaattctgcttctctgccaaaagcaatgtctttcttggttgatatttgagttttaaaagggtcaaatctttctaattttttgtatctttagagggcagcactagaagaaatcagcaggtctaatcccaccagtaagaaaactaccacttcttgatttttacagatttaaaaaaatcttttcagtgacctttctttttaatgtaaatacaaatttaaacctaggcttaatataggcgtttcccctttcacccaagtgatgtcacagttcgatgcaaaatcaatgatccagaatgatcgtgggtaaaaataactcaaagtgtttcttaagggtgagttggcatgcaaaaaattacattgattacagtgtgttttggagctggctctgtttgtgtgcatatgataatgcagagttgagccagagcctggaaatgtcattctagatctcactaactactggaatcagtgttttaatctcttggtggaaactttcagttgcttaactctctattggaagatttttttaatgttctacatcatttatgttgtattacaatgtatgtagaaatagtaacctgtgaactatgcttttccataactttttaaaaatatatatatctaaatgaatgcaatgtgcataaatattttttaaacataacagtgaactattgcaccttttgctaatgcctctatttacttgctttggcataaagaatgagccaatgaacctctgtgtcctgtggaaaaatgtataaatgttatctgatattgctcttagatgtaatgctaattaatgttaaatcacaaataaacagtattttaaatata

SEQ ID NO: 365359 - DNA, 3495 bp, Homo sapiens
agcgtagtcccgccagagcgcgagccgccagcccgtaacggtcgccagtgtgaggggcgggagggaaagaagaggggtttaaattagattttttaaaacacagagcaagcgccagaggcgtcggcatcccaggtgtcgccgcttcctgctgcacagggctcggcgtacaggtccctccctcctcaagccccctccccttctcccgccctaccctctggggctctgcggcgcttaagaggcggccgcagcggcggatccggcggctgctgcagcccgggcggctgccgagaaggagggaggggaaacacaaagccggctacgcgctgcgagctgtgaaagtgaagtttggcttgaaaacacattctgccagtgcaaatccaaaaagtatcaagacaggattcttctactataataaccaactggtaactttgaattgttagtttgaggggggagatgaggaagagccaagagatagcagcagagttgtctcccagagctccgtggaatttcctttctctgctttaacgtacttttaaaagataacaagagtaatccacagacttaaaacatgagctcagatgccagccgtgtgaatatgggttcccatcaaaaatggaaggttggcgaaattgagtttgaagggcttatgaggactctggacaacttggggtatagaacaggctatgcttacaggcatcctctcattcgagagaagcctaggcacaagagtgatgtggaaatcccagcaactgtgactgctttttcctttgaagacgatacagtgccactctctcctctcaaatacatggcacagaggcaacagcgtgaaaaaacaagatggctgaactcaccaaatacttacatgaaagtgaatgtgcctgaggagtctcggaacggagaaaccagtccccgaaccaaaatcacgtggatgaaagcagaagactcatctaaagttagtggtggaacacctatcaaaattgaagatccaaatcagtttgttcctttaaacacaaacccgaatgaggtactagaaaagagaaataagattcgggaacaaaatcgatatgacttgaaaacagcaggaccacaatctcagttgcttgctggaattgttgtggataagccaccttctactatgcaatttgaagatgatgatcatggcccaccagctcctcctaacccatttagtcatctcacagaaggagaacttgaagagtataagaggacaatcgaacgtaaacaacaaggcctagaagaaaaccatgagctgttttccaagagcttcatctccatggaagtgcctgtcatggtagtaaatggcaaggatgatatgcatgatgttgaagatgagcttgctaagcgagtgagtaggttaagcacaagtacaaccatagaaaacatcgagattactattaagtctccagagaaaatcgaagaagtcctgtcacctgaaggctccccttcaaaatcgccatccaagaaaaagaagaaattccgcactccttcttttctgaaaaagaacaaaaaaaaggagaaagttgaggcctaaataaagtctttttataattattattataacaatgtgacattgcacatctaaataccacatttaagttgatcattaatatgcaatggtagatcagattgggggatgtagcaaactggactttaagaactggaaagaggttttacaaaagaaaaactttcagattcatctctcattttatatgtccagaaatggctttgaattttaagcaattactagttttaattagctctgccctcatgaagtattattataattcaccataaacagctatctgtctgaattacttcaggccttctccataatatctgttagaaagaaattgccagtgagcaagtgagaatttttatttctcaatacctgcttcacttgataatcatattataattttttatcatgattattgactatatttttggagtcccattgtttcagtgggcattaacagaatgctttaaaaacttctaagacaagaatctatagcattagtatacactggcacataattttttaaaaagttttaagaaaagattcatttggaattttattcacagtataaaatttcctcacctgaagtaactttgtttgccaaaaaagttgttttaataaactataatttttgaaaacttccttttttattagtttagaaagccccttatttttcaacaaaggggattttgtacacataacatgggttatttagtttaactctggcaaaaaaaaaaaaaaaattttgtatgttgatgtttgtataccgttcagtataaaagtgtcctaagcatattagccaatcttttcacagtagagcatacttaaggctgcttggtactgagtatacttaaatataactccagaatccagggacttggtgttaaaacaggattagagcatgtaaaggtacatctagattcatatttgaatcttaaactgtatttttctcttagtattgctaatgagtaaagaaaagtctcataaggtagccaaatgaaaaagaatgaaagggaaagtgaaaaattaaggggacaaaagatgggatgtgaaaagaagaattctagtttgatggtgactcatattcacgataggatacaaagtgtgatttgttggaaacatgtcccaaatttctaaaattctgcttctctgccaaaagcaatgtctttcttggttgatatttgagttttaaaagggtcaaatctttctaattttttgtatctttagagggcagcactagaagaaatcagcaggtctaatcccaccagtaagaaaactaccacttcttgatttttacagatttaaaaaaatcttttcagtgacctttctttttaatgtaaatacaaatttaaacctaggcttaatataggcgtttcccctttcacccaagtgatgtcacagttcgatgcaaaatcaatgatccagaatgatcgtgggtaaaaataactcaaagtgtttcttaagggtgagttggcatgcaaaaaattacattgattacagtgtgttttggagctggctctgtttgtgtgcatatgataatgcagagttgagccagagcctggaaatgtcattctagatctcactaactactggaatcagtgttttaatctcttggtggaaactttcagttgcttaactctctattggaagatttttttaatgttctacatcatttatgttgtattacaatgtatgtagaaatagtaacctgtgaactatgcttttccataactttttaaaaatatatatatctaaatgaatgcaatgtgcataaatattttttaaacataacagtgaactattgcaccttttgctaatgcctctatttacttgctttggcataaagaatgagccaatgaacctctgtgtcctgtggaaaaatgtataaatgttatctgatattgctcttagatgtaatgctaattaatgttaaatcacaaataaacagtattttaaatata

SEQ ID NO: 365360 - DNA, 3568 bp, Homo sapiens
tatgaggaacctccatactgttttccacaatggctatactaatttacattgctaccaacagtgtgcaaagggtccctttctccctacattctaacacttgttgtctttcatcttttttataatagcgattctaacaggacatgccatctcgtgctttaatttgcattttcttgattagtgatgttttaatacacttgttgaccatttgtatgtcttcttttgagaaatgtttattcagatcctttgcctattttttaattgggttcttctcttgttattttttgagtcccctatatattttggatagtaaccccttaaaagatgtatggtttggcaaatgttattttagattttaccctcttctgtgaaggctcagaaggctgactgccttcagacccaggaacagagacttaaatgagcactgagatttgcttccccagaacagttttatagatagaaaagcacttctggtcagcaacttagaactgttcgtttgtcgggaacagttgtgtgagtggaaattgcaatatcagctgttatcagctctaactaggtcttgaaatttgcataatttcagctccagtgttacatgaaagttatgtggtgtttggaaggatgcctttttctttgttttttagcaaaggagtcttttaaatcatttgtatacaaaaggaattaggatccaaatgctgttattgatacaggtttgatgcttcaaatgtggcttttccctcccttaggggtatagaacaggctatgcttacaggcatcctctcattcgagagaagcctaggcacaagagtgatgtggaaatcccagcaactgtgactgctttttcctttgaagacgatacagtgccactctctcctctcaaatacatggcacagaggcaacagcgtgaaaaaacaagatggctgaactcaccaaatacttacatgaaagtgaatgtgcctgaggagtctcggaacggagaaaccagtccccgaaccaaaatcacgtggatgaaagcagaagactcatctaaagttagtggtggaacacctatcaaaattgaagatccaaatcagtttgttcctttaaacacaaacccgaatgaggtactagaaaagagaaataagattcgggaacaaaatcgatatgacttgaaaacagcaggaccacaatctcagttgcttgctggaattgttgtggataagccaccttctactatgcaatttgaagatgatgatcatggcccaccagctcctcctaacccatttagtcatctcacagaaggagaacttgaagagtataagaggacaatcgaacgtaaacaacaaggcctagaagaaaaccatgagctgttttccaagagcttcatctccatggaagtgcctgtcatggtagtaaatggcaaggatgatatgcatgatgttgaagatgagcttgctaagcgagtgagtaggttaagcacaagtacaaccatagaaaacatcgagattactattaagtctccagagaaaatcgaagaagtcctgtcacctgaaggctccccttcaaaatcgccatccaagaaaaagaagaaattccgcactccttcttttctgaaaaagaacaaaaaaaaggagaaagttgaggcctaaataaagtctttttataattattattataacaatgtgacattgcacatctaaataccacatttaagttgatcattaatatgcaatggtagatcagattgggggatgtagcaaactggactttaagaactggaaagaggttttacaaaagaaaaactttcagattcatctctcattttatatgtccagaaatggctttgaattttaagcaattactagttttaattagctctgccctcatgaagtattattataattcaccataaacagctatctgtctgaattacttcaggccttctccataatatctgttagaaagaaattgccagtgagcaagtgagaatttttatttctcaatacctgcttcacttgataatcatattataattttttatcatgattattgactatatttttggagtcccattgtttcagtgggcattaacagaatgctttaaaaacttctaagacaagaatctatagcattagtatacactggcacataattttttaaaaagttttaagaaaagattcatttggaattttattcacagtataaaatttcctcacctgaagtaactttgtttgccaaaaaagttgttttaataaactataatttttgaaaacttccttttttattagtttagaaagccccttatttttcaacaaaggggattttgtacacataacatgggttatttagtttaactctggcaaaaaaaaaaaaaaaattttgtatgttgatgtttgtataccgttcagtataaaagtgtcctaagcatattagccaatcttttcacagtagagcatacttaaggctgcttggtactgagtatacttaaatataactccagaatccagggacttggtgttaaaacaggattagagcatgtaaaggtacatctagattcatatttgaatcttaaactgtatttttctcttagtattgctaatgagtaaagaaaagtctcataaggtagccaaatgaaaaagaatgaaagggaaagtgaaaaattaaggggacaaaagatgggatgtgaaaagaagaattctagtttgatggtgactcatattcacgataggatacaaagtgtgatttgttggaaacatgtcccaaatttctaaaattctgcttctctgccaaaagcaatgtctttcttggttgatatttgagttttaaaagggtcaaatctttctaattttttgtatctttagagggcagcactagaagaaatcagcaggtctaatcccaccagtaagaaaactaccacttcttgatttttacagatttaaaaaaatcttttcagtgacctttctttttaatgtaaatacaaatttaaacctaggcttaatataggcgtttcccctttcacccaagtgatgtcacagttcgatgcaaaatcaatgatccagaatgatcgtgggtaaaaataactcaaagtgtttcttaagggtgagttggcatgcaaaaaattacattgattacagtgtgttttggagctggctctgtttgtgtgcatatgataatgcagagttgagccagagcctggaaatgtcattctagatctcactaactactggaatcagtgttttaatctcttggtggaaactttcagttgcttaactctctattggaagatttttttaatgttctacatcatttatgttgtattacaatgtatgtagaaatagtaacctgtgaactatgcttttccataactttttaaaaatatatatatctaaatgaatgcaatgtgcataaatattttttaaacataacagtgaactattgcaccttttgctaatgcctctatttacttgctttggcataaagaatgagccaatgaacctctgtgtcctgtggaaaaatgtataaatgttatctgatattgctcttagatgtaatgctaattaatgttaaatcacaaataaacagtattttaaatata

SEQ ID NO: 365361 - DNA, 2363 bp, Homo sapiens
agcgtagtcccgccagagcgcgagccgccagcccgtaacggtcgccagtgtgaggggcgggagggaaagaagaggggtttaaattagattttttaaaacacagagcaagcgccagaggcgtcggcatcccaggtgtcgccgcttcctgctgcacagggctcggcgtacaggtccctccctcctcaagccccctccccttctcccgccctaccctctggggctctgcggcgcttaagaggcggccgcagcggcggatccggcggctgctgcagcccgggcggctgccgagaaggagggaggggaaacacaaagccggctacgcgctgcgagataacaagagtaatccacagacttaaaacatgagctcagatgccagccaaggcgtgattaccactcctcctcctcccagcatgcctcacaaagagagatattttgaccgcatcaatgaaaatgacccagaatacattagggagaggaacatgtctcctgatctacgacaagacttcaacatgatggagcagaggaaacgagttactcagatcctgcaaagtcctgcctttcgggaagacttggaatgccttattcaagaacagatgaagaaaggccacaacccaactggattactagcattacagcagattgcagattacatcatggccaattctttctcgggtttttcttcacctcctctcagtcttggcatggtcacacctatcaatgaccttcctggtgcagatacatcctcatatgtgaagggagaaaaacttactcgctgtaaacttgccagcctgtacagacttgtagacttgtttggatgggcacacctggcaaatacctatatctcagtaagaataagtaaggagcaagaccacattataataattcccagaggcctatctttttctgaagctacagcctccaatttggtgaaagtcaatataataggagaagtggttgaccagggaagtaccaatttgaaaattgaccatacaggattcagtccccatgctgcaatctattcaacacgtcctgatgttaagtgtgtgatacacatccatacccttgcaacagcagctgtatcctccatgaaatgtgggatccttccaatttctcaagagtctcttcttctgggagatgttgcctattatgactaccaagggtcacttgaagaacaggaggagagaattcaactgcagaaggttctgggaccaagttgtaaggtgctggtactcaggaatcatggtgtggttgcacttggagaaacattagaggaggcttttcattatatttttaatgtgcaactagcctgtgagattcaggtgcaggccctagcaggtgcaggtggagtagacaatctccatgtactggactttcagaagtataaagctttcacttacactgtagcagcgtctggtggaggaggtgtgaatatgggttcccatcaaaaatggaaggttggcgaaattgagtttgaagggcttatgaggactctggacaacttggggtatagaacaggctatgcttacaggcatcctctcattcgagagaagcctaggcacaagagtgatgtggaaatcccagcaactgtgactgctttttcctttgaagacgatacagtgccactctctcctctcaaatacatggcacagaggcaacagcgtgaaaaaacaagatggctgaactcaccaaatacttacatgaaagtgaatgtgcctgaggagtctcggaacggagaaaccagtccccgaaccaaaatcacgtggatgaaagcagaagactcatctaaagttagtggtggaacacctatcaaaattgaagatccaaatcagtttgttcctttaaacacaaacccgaatgaggtactagaaaagagaaataagattcgggaacaaaatcgatatgacttgaaaacagcaggaccacaatctcagttgcttgctggaattgttgtggataagccaccttctactatgcaatttgaagatgatgatcatggcccaccagctcctcctaacccatttagtcatctcacagaaggagaacttgaagagtataagaggacaatcgaacgtaaacaacaaggcctagaagaaaaccatgagctgttttccaagagcttcatctccatggaagtgcctgtcatggtagtaaatggcaaggatgatatgcatgatgttgaagatgagcttgctaagcgagtgagtaggttaagcacaagtacaaccatagaaaacatcgagattactattaaccctgtcatggtagtaaatggcaaggatgatatgcatgatgttgaagatgagcttgctaagcgagtgagtaggttaagcacaagtacaaccatagtaatctcgatgttttct

SEQ ID NO: 365362 - DNA, 2035 bp, Homo sapiens
agcgtagtcccgccagagcgcgagccgccagcccgtaacggtcgccagtgtgaggggcgggagggaaagaagaggggtttaaattagattttttaaaacacagagcaagcgccagaggcgtcggcatcccaggtgtcgccgcttcctgctgcacagggctcggcgtacaggtccctccctcctcaagccccctccccttctcccgccctaccctctggggctctgcggcgcttaagaggcggccgcagcggcggatccggcggctgctgcagcccgggcggctgccgagaaggagggaggggaaacacaaagccggctacgcgctgcgagataacaagagtaatccacagacttaaaacatgagctcagatgccagccaaggcgtgattaccactcctcctcctcccagcatgcctcacaaagagagatattttgaccgcatcaatgaaaatgacccagaatacattagggagaggaacatgtctcctgatctacgacaagacttcaacatgatggagcagaggaaacgagttactcagatcctgcaaagtcctgcctttcgggaagacttggaatgccttattcaagaacagatgaagaaaggccacaacccaactggattactagcattacagcagattgcagattacatcatggccaattctttctcgggtttttcttcacctcctctcagtcttggcatggtcacacctatcaatgaccttcctggtgcagatacatcctcatatgtgaagggagaaaaacttactcgctgtaaacttgccagcctgtacagacttgtagacttgtttggatgggcacacctggcaaatacctatatctcagtaagaataagtaaggagcaagaccacattataataattcccagaggcctatctttttctgaagctacagcctccaatttggtgaaagtcaatataataggagaagtggttgaccagggaagtaccaatttgaaaattgaccatacaggattcagtccccatgctgcaatctattcaacacgtcctgatgttaagtgtgtgatacacatccatacccttgcaacagcagctgtatcctccatgaaatgtgggatccttccaatttctcaagagtctcttcttctgggagatgttgcctattatgactaccaagggtcacttgaagaacaggaggagagaattcaactgcagaaggttctgggaccaagttgtaaggtgctggtactcaggaatcatggtgtggttgcacttggagaaacattagaggaggcttttcattatatttttaatgtgcaactagcctgtgagattcaggtgcaggccctagcaggtgcaggtggagtagacaatctccatgtactggactttcagaagtataaagctttcacttacactgtagcagcgtctggtggaggaggtgtgaatatgggttcccatcaaaaatggaaggttggcgaaattgagtttgaagggcttatgaggactctggacaacttggtaggttgcaaaattgaagtaaaacttggatttaatgtcttcagattcaagagcagatgcttccatttttgtagaacatgctccatactcttccagaagctgagtttggccctaggaaagcatttcattgttatttaaccacacctttgagaattaaacagaacttacaaatgtcgtgttttttttttaagattacaatatatgttattaactgtagtcaccatagtacaatatatctcttgaactttttcctcctaactgaaattttgtatcctttgatcaacatctccccacccccacctccttgtaaccactattctactctacttttatgagttcaacttttttttttttcttggaggcaggatcttgcttggagtgccgtgacacaatcagggctcacttgcagtctcaacctgctgggctcaaaccattcttccacctcagcctcctgtgtatctgggacataacgtgtgtgccaccgtgcctggctaatttatttttttttttttactttttgtagagatagggtt

SEQ ID NO: 365363 - DNA, 1445 bp, Homo sapiens
agcgtagtcccgccagagcgcgagccgccagcccgtaacggtcgccagtgtgaggggcgggagggaaagaagaggggtttaaattagattttttaaaacacagagcaagcgccagaggcgtcggcatcccaggtgtcgccgcttcctgctgcacagggctcggcgtacaggtccctccctcctcaagccccctccccttctcccgccctaccctctggggctctgcggcgcttaagaggcggccgcagcggcggatccggcggctgctgcagcccgggcggctgccgagaaggagggaggggaaacacaaagccggctacgcgctgcgagataacaagagtaatccacagacttaaaacatgagctcagatgccagccaaggcgtgattaccactcctcctcctcccagcatgcctcacaaagagagatattttgaccgcatcaatgaaaatgacccagaatacattagggagaggaacatgtctcctgatctacgacaagacttcaacatgatggagcagaggaaacgagttactcagatcctgcaaagtcctgcctttcgggaagacttggaatgccttattcaagaacagatgaagaaaggccacaacccaactggattactagcattacagcagattgcagattacatcatggccaattctttctcgggtttttcttcacctcctctcagtcttggcatggtcacacctatcaatgaccttcctggtgcagatacatcctcatatgtgaagggagaaaaacttactcgctgtaaacttgccagcctgtacagacttgtagacttgtttggatgggcacacctggcaaatacctatatctcagtaagaataagtaaggagcaagaccacattataataattcccagaggcctatctttttctgaagctacagcctccaatttggtgaaagtcaatataataggagaagtggttgaccagggaagtaccaatttgaaaattgaccatacaggattcagtccccatgctgcaatctattcaacacgtcctgatgttaagtgtgtgatacacatccatacccttgcaacagcagctgtatcctccatgaaatgtgggatccttccaatttctcaagagtctcttcttctgggagatgttgcctattatgactaccaagggtcacttgaagaacaggaggagagaattcaactgcagaaggttctgggaccaagttgtaaggtgctggtactcaggaatcatggtgtggttgcacttggagaaacattagaggaggcttttcattatatttttaatgtgcaactagcctgtgagattcaggtaggaaacattattccccttttttaattgctttgttatttgctcgtttagttggattttgtgtacttatttgcaaatacatattagttagtggctttttgtcttttaagagaagttctgctctac

SEQ ID NO: 365364 - DNA, 3798 bp, Homo sapiens
agctgctgcacatagcgacccagtccgttgtggagaacgctggccaagaagcggctcggagtcccgcgcgccgtcatagctacagcttggaggccgcggagcctaagcagcgaggagaggggggcgggactaaacctcgaggcttccggttccgggacgaccgctcccggagttttgcttccgaggtcaaggcgagtagcatgtgcgggagactcacgttgccggcgaagtgggagagagaaaagtggtaacctggggctgggggccggcgcggcggagctcggagtagtagagcggagtgaagacacgggggaggatagagactggcattcctttgggccgggggattggcgggagtcgtgctgggtgctctcgccgtgttgaggtcccagtgaggggaaggagaagcggaagagggtctctagtcggggcctagggcaaagggactacaaaaaggatgcagatgactatagaaatgaggacgacgaggagatgctgtggaggagcagtagaggtgagaagatgatgcaaagaaactgtgtcagtgaggaactgtatagagggtcatagaggtgaggtggcggagagaaactaactaacggaccatagaggtgggggagccattgtagaaggacgtggacgcgaaagggtcgtgtagatgggcatatgtgtgaagcagcaacgtagaggggctgaagaggagaaattcatggagagaaagaatgcacctagagtgagctctgcagagtgctgcgtgggatatccctagagtttggtctagtgaaggcacgctaaccaggcacctaaggcatttcaagtagtgacttcccacatttggctaggaatgtgggtcctcctccgaagtgggtaccccctccgtatcttgttacccctgcgtggggagtggatgggtcggaggggcctgccccgaaacttggccccaggccctcctcgcagacgttacaggaaggagactctccaagccttggatatgccagtgttgcctgtaactgcaactgaaatccgccagtatttgcgggggcatgggatccccttccaggatggtcacagttgcctgcgggcactgagcccctttgcagagtcttcacagctcaaaggccagactggtgttaccacttccttcagcctcttcattgacaagaccacaggccactttctctgcatgaccagcctagcagaagggagctgggaagacttccaggccagcgtggaggggcgaggggatggggccagggaggggtttctgcttagcaaggcaccagaatttgaggacagcgaggaggtccggaggatctggaaccgagcaatacctctctgggagctgcctgatcaggaggaggttcagctggctgatacaatgtttggccttaccaaggttacagatgacacactcaagcgtttcagtgtgcgatatctgcgacctgctcgcagtcttgtcttcccttggttctcccctgggggctcaggattacgaggcctgaagctcctagaggctaaatgccagggggatggagtgagctacgaggaaaccactattccccgacccagcgcctaccacaatctgtttggattaccactgattagtcgtcgagatgctgaggtggtactgacgagtcgtgagcttgacagcctggccttgaaccagtccacggggctgcctacccttactctaccccgaggaacgacctgcttaccccctgccttactcccttacctggaacagttccggcggattgtattctggttgggggatgaccttcggtcctgggaagccgccaagttgtttgcacgaaaactgaaccccaaacgatgcttcttggtgcgaccaggagaccagcaaccccgtcccctggaggccctgaacggaggcttcaatctttctcgtattcttcgtaccgccctgcctgcctggcacaagtccatcgtatctttccggcagcttcgggaggaggtgctaggagaactgtcaaatgtggagcaagcagctggcctccgctggagccgctttccagacctcaatcgtatcttgaagggacatcgaaagggcgagctgacggtcttcacagggccaacaggcagtggaaagacgacattcatcagtgagtatgccctggatttgtgttcccagggggtgaacacactgtggggtagcttcgagatcagcaatgtgagactagcccgggtcatgctgacacagtttgccgaggggcggctggaagatcaactggacaaatatgatcactgggctgaccgctttgaggacctgcccctctatttcatgactttccatggacagcaaagcatcaggactgtaatagatacaatgcaacatgcagtctacgtctatgacatttgtcatgtgatcatcgacaacctgcagttcatgatgggtcacgagcagctgtccacagacaggatcgcagctcaagactacatcatcggggtctttcggaagtttgcaacagacaataactgccatgtgacactggtcattcacccccggaaagaggatgatgacaaggaactgcagacagcgtccatttttggctcagccaaagcaagccaggaagcagacaatgttctgatcctgcaggacaggaagctggtaaccgggccagggaaacggtatctgcaggtgtccaagaaccgctttgatggagatgtaggtgtcttcccgcttgagttcaacaagaactccctcaccttctccattccaccaaagaacaaggcccggctcaagaagatcaaggatgacactggaccagtggccaaaaagccctcttctggcaaaaagggggctacgacacagaactctgagatttgctcaggccaggcccccactcccgaccagccagacacctccaagcgttcaaagtgaaggccgtgcagagctggtcactgaaatgagcctgataggataggctggagcataaaactctgcaagggctcctctatcctgtggtcctgagctgtgtgcccttctcagtctgaggggcctaacctagagcaggtttccatagtgagaaaattcaatgtagcagactactgagaaactactgtgttgctcaggctttgtttgaggtcctgtatatacagcactgaaaagagagataaagtccctgcctgcatgcattctggcggaagagacaagcaagcaatgaacaaattagcagaaaacctagttttagtgaaaaatgctgtaaagaaaatagaaatgcgatagagtgctggcaggctagtgtagataagtggtctgaaaaggtgtctctgagccgagggcatgtgagctggggcctaaacaactagaaggagagagccacgtgaacatccggcgaaggggacccaggcagagagaaaaggaaatccaagccctgaggtaggaatgagcaggtcagattcaaggcagtgaggtcaggccgcatgaacctggaggggaatcggggacttcatgcgaaactccagcctaggctttcaaagtcaaagggtgatacagtgggtaccaagctcctctgctccccactttgtagagcctagcatgaggtggcatgtactagaattggatcctaggtgcttagccctgcaatatcagggcctcactggtgggagctgcctcgggctgggttgcttggtcatagagccatagaaggaagctgtcagcccggagtgcctgccacctagacactgatgccattgtgtgctgcctcaagactgctggagtcaggacattttatagagccttttccagttttactaaaaaatttttccattgcaaaaaaa

SEQ ID NO: 365365 - DNA, 4123 bp, Homo sapiens
agctgctgcacatagcgacccagtccgttgtggagaacgctggccaagaagcggctcggagtcccgcgcgccgtcatagctacagcttggaggccgcggagcctaagcagcgaggagaggggggcgggactaaacctcgaggcttccggttccgggacgaccgctcccggagttttgcttccgaggtcaaggcgagtagcatgtgcgggagactcacgttgccggcgaagtgggagagagaaaagtggtaacctggggctgggggccggcgcggcggagctcggagtagtagagcggagtgaagacacgggggaggatagagactggcattcctttgggccgggggattggcgggagtcgtgctgggtgctctcgccgtgttgaggtcccagtgaggggaaggagaagcggaagagggtctctagtcggggcctagggcaaagggactacaaaaaggatgcagatgactatagaaatgaggacgacgaggagatgctgtggaggagcagtagaggtgagaagatgatgcaaagaaactgtgtcagtgaggaactgtatagagggtcatagaggtgaggtggcggagagaaactaactaacggaccatagaggtgggggagccattgtagaaggacgtggacgcgaaagggtcgtgtagatgggcatatgtgtgaagcagcaacgtagaggggctgaagaggagaaattcatggagagaaagaatgcacctagagtgagctctgcagagtgctgcgtgggatatccctagagtttggtctagtgaaggcacgctaaccaggcacctaaggcatttcaagtagtgacttcccacatttggctaggaatgtgggtcctcctccgaagtgggtaccccctccgtatcttgttacccctgcgtggggagtggatgggtcggaggggcctgccccgaaacttggccccaggccctcctcgcagacgttacaggaaggagactctccaagccttggatatgccagtgttgcctgtaactgcaactgaaatccgccagtatttgcgggggcatgggatccccttccaggatggtcacagttgcctgcgggcactgagcccctttgcagagtcttcacagctcaaaggccagactggtgttaccacttccttcagcctcttcattgacaagaccacaggccactttctctgcatgaccagcctagcagaagggagctgggaagacttccaggccagcgtggaggggcgaggggatggggccagggaggggtttctgcttagcaaggcaccagaatttgaggacagcgaggaggtccggaggatctggaaccgagcaatacctctctgggagctgcctgatcaggaggaggttcagctggctgatacaatgtttggccttaccaaggttacagatgacacactcaagcgtttcagtgtgcgatatctgcgacctgctcgcagtcttgtcttcccttggttctcccctgggggctcaggattacgaggcctgaagctcctagaggctaaatgccagggggatggagtgagctacgaggaaaccactattccccgacccagcgcctaccacaatctgtttggattaccactgattagtcgtcgagatgctgaggtggtactgacgagtcgtgagcttgacagcctggccttgaaccagtccacggggctgcctacccttactctaccccgaggaacgacctgcttaccccctgccttactcccttacctggaacagttccggcggattgtattctggttgggggatgaccttcggtcctgggaagccgccaagttgtttgcacgaaaactgaaccccaaacgatgcttcttggtgcgaccaggagaccagcaaccccgtcccctggaggccctgaacggaggcttcaatctttctcgtattcttcgtaccgccctgcctgcctggcacaagtccatcgtatctttccggcagcttcgggaggaggtgctaggagaactgtcaaatgtggagcaagcagctggcctccgctggagccgctttccagacctcaatcgtatcttgaagggacatcgaaagggcgagctgacggtcttcacagggccaacaggcagtggaaagacgacattcatcagtgagtatgccctggatttgtgttcccagggggtgaacacactgtggggtagcttcgagatcagcaatgtgagactagcccgggtcatgctgacacagtttgccgaggggcggctggaagatcaactggacaaatatgatcactgggctgaccgctttgaggacctgcccctctatttcatgactttccatggacagcaaagcatcaggactgtaatagatacaatgcaacatgcagtctacgtctatgacatttgtcatgtgatcatcgacaacctgcagttcatgatgggtcacgagcagctgtccacagacaggtgacggtgacatcctctcttgtctagcttgagcccgcttggacatacaacacacacttctcaggcagctggcctctaggcacacatgctgtgctctcctattttctgagatgtgtgcaggcacgtaccacccccatgtgtatcatatggaggtgtggggtatggcagcaggatgtatggacagggatctgagtgtgagtccttgggtagagggaggtagagtgggttgtggtagtttgtggggagatgtgaatggatcaagagtatgtgtatgttcttgtccttctgtgtctgataagctctttgtgttgttgggatggcgtaggatcgcagctcaagactacatcatcggggtctttcggaagtttgcaacagacaataactgccatgtgacactggtcattcacccccggaaagaggatgatgacaaggaactgcagacagcgtccatttttggctcagccaaagcaagccaggaagcagacaatgttctgatcctgcaggacaggaagctggtaaccgggccagggaaacggtatctgcaggtgtccaagaaccgctttgatggagatgtaggtgtcttcccgcttgagttcaacaagaactccctcaccttctccattccaccaaagaacaaggcccggctcaagaagatcaaggatgacactggaccagtggccaaaaagccctcttctggcaaaaagggggctacgacacagaactctgagatttgctcaggccaggcccccactcccgaccagccagacacctccaagcgttcaaagtgaaggccgtgcagagctggtcactgaaatgagcctgataggataggctggagcataaaactctgcaagggctcctctatcctgtggtcctgagctgtgtgcccttctcagtctgaggggcctaacctagagcaggtttccatagtgagaaaattcaatgtagcagactactgagaaactactgtgttgctcaggctttgtttgaggtcctgtatatacagcactgaaaagagagataaagtccctgcctgcatgcattctggcggaagagacaagcaagcaatgaacaaattagcagaaaacctagttttagtgaaaaatgctgtaaagaaaatagaaatgcgatagagtgctggcaggctagtgtagataagtggtctgaaaaggtgtctctgagccgagggcatgtgagctggggcctaaacaactagaaggagagagccacgtgaacatccggcgaaggggacccaggcagagagaaaaggaaatccaagccctgaggtaggaatgagcaggtcagattcaaggcagtgaggtcaggccgcatgaacctggaggggaatcggggacttcatgcgaaactccagcctaggctttcaaagtcaaagggtgatacagtgggtaccaagctcctctgctccccactttgtagagcctagcatgaggtggcatgtactagaattggatcctaggtgcttagccctgcaatatcagggcctcactggtgggagctgcctcgggctgggttgcttggtcatagagccatagaaggaagctgtcagcccggagtgcctgccacctagacactgatgccattgtgtgctgcctcaagactgctggagtcaggacattttatagagccttttccagttttactaaaaaatttttccattgcaaaaaaa

SEQ ID NO: 365366 - DNA, 1958 bp, Homo sapiens
agctgctgcacatagcgacccagtccgttgtggagaacgctggccaagaagcggctcggagtcccgcgcgccgtcatagctacagcttggaggccgcggagcctaagcagcgaggagaggggggcgggactaaacctcgaggcttccggttccgggacgaccgctcccggagttttgcttccgaggtcaaggcgagtagcatgtgcgggagactcacgttgccggcgaagtgggagagagaaaagtgggccaacaggcagtggaaagacgacattcatcagtgagtatgccctggatttgtgttcccagggggtgaacacactgtggggtagcttcgagatcagcaatgtgagactagcccgggtcatgctgacacagtttgccgaggggcggctggaagatcaactggacaaatatgatcactgggctgaccgctttgaggacctgcccctctatttcatgactttccatggacagcaaagcatcaggactgtaatagatacaatgcaacatgcagtctacgtctatgacatttgtcatgtgatcatcgacaacctgcagttcatgatgggtcacgagcagctgtccacagacaggatcgcagctcaagactacatcatcggggtctttcggaagtttgcaacagacaataactgccatgtgacactggtcattcacccccggaaagaggatgatgacaaggaactgcagacagcgtccatttttggctcagccaaagcaagccaggaagcagacaatgttctgatcctgcaggacaggaagctggtaaccgggccagggaaacggtatctgcaggtgtccaagaaccgctttgatggagatgtaggtgtcttcccgcttgagttcaacaagaactccctcaccttctccattccaccaaagaacaaggcccggctcaagaagatcaaggatgacactggaccagtggccaaaaagccctcttctggcaaaaagggggctacgacacagaactctgagatttgctcaggccaggcccccactcccgaccagccagacacctccaagcgttcaaagtgaaggccgtgcagagctggtcactgaaatgagcctgataggataggctggagcataaaactctgcaagggctcctctatcctgtggtcctgagctgtgtgcccttctcagtctgaggggcctaacctagagcaggtttccatagtgagaaaattcaatgtagcagactactgagaaactactgtgttgctcaggctttgtttgaggtcctgtatatacagcactgaaaagagagataaagtccctgcctgcatgcattctggcggaagagacaagcaagcaatgaacaaattagcagaaaacctagttttagtgaaaaatgctgtaaagaaaatagaaatgcgatagagtgctggcaggctagtgtagataagtggtctgaaaaggtgtctctgagccgagggcatgtgagctggggcctaaacaactagaaggagagagccacgtgaacatccggcgaaggggacccaggcagagagaaaaggaaatccaagccctgaggtaggaatgagcaggtcagattcaaggcagtgaggtcaggccgcatgaacctggaggggaatcggggacttcatgcgaaactccagcctaggctttcaaagtcaaagggtgatacagtgggtaccaagctcctctgctccccactttgtagagcctagcatgaggtggcatgtactagaattggatcctaggtgcttagccctgcaatatcagggcctcactggtgggagctgcctcgggctgggttgcttggtcatagagccatagaaggaagctgtcagcccggagtgcctgccacctagacactgatgccattgtgtgctgcctcaagactgctggagtcaggacattttatagagccttttccagttttactaaaaaatttttccattgcaaaaaaa

SEQ ID NO: 365367 - DNA, 2764 bp, Homo sapiens
agctgctgcacatagcgacccagtccgttgtggagaacgctggccaagaagcggctcggagtcccgcgcgccgtcatagctacagcttggaggccgcggagcctaagcagcgaggagaggggggcgggactaaacctcgaggcttccggttccgggacgaccgctcccggagttttgcttccgaggtcaaggcgagtagcatgtgcgggagactcacgttgccggcgaagtgggagagagaaaagtggtaacctggggctgggggccggcgcggcggagctcggagtagtagagcggagtgaagacacgggggaggatagagactggcattcctttgggccgggggattggcgggagtcgtgctgggtgctctcgccgtgttgaggtcccagtgaggggaaggagaagcggaagagggtctctagtcggggcctagggcaaagggactacaaaaaggatgcagatgactatagaaatgaggacgacgaggagatgctgtggaggagcagtagaggtgagaagatgatgcaaagaaactgtgtcagtgaggaactgtatagagggtcatagaggtgaggtggcggagagaaactaactaacggaccatagaggtgggggagccattgtagaaggacgtggacgcgaaagggtcgtgtagatgggcatatgtgtgaagcagcaacgtagaggggctgaagaggagaaattcatggagagaaagaatgcacctagagtgagctctgcagagtgctgcgtgggatatccctagagtttggtctagtgaaggcacgctaaccaggcacctaaggcatttcaagtagtgacttcccacatttggctaggaatgtgggtcctcctccgaagtgggtaccccctccgtatcttgttacccctgcgtggggagtggatgggtcggaggggcctgccccgaaacttggccccaggccctcctcgcagacgttacaggaaggagactctccaagccttggatatgccagtgttgcctgtaactgcaactgaaatccgccagtatttgcgggggcatgggatccccttccaggatggtcacagttgcctgcgggcactgagcccctttgcagagtcttcacagctcaaaggccagactggtgttaccacttccttcagcctcttcattgacaagaccacaggccactttctctgcatgaccagcctagcagaagggagctgggaagacttccaggccagcgtggaggggcgaggggatggggccagggaggggtttctgcttagcaaggcaccagaatttgaggacagcgaggaggtccggaggatctggaaccgagcaatacctctctgggagctgcctgatcaggaggaggttcagctggctgatacaatgtttggccttaccaaggttacagatgacacactcaagcgtttcagtgtgcgatatctgcgacctgctcgcagtcttgtcttcccttggttctcccctgggggctcaggattacgaggcctgaagctcctagaggctaaatgccagggggatggagtgagctacgaggaaaccactattccccgacccagcgcctaccacaatctgtttggattaccactgattagtcgtcgagatgctgaggtggtactgacgagtcgtgagcttgacagcctggccttgaaccagtccacggggctgcctacccttactctaccccgaggaacgacctgcttaccccctgccttactcccttacctggaacagttccggcggattgtattctggttgggggatgaccttcggtcctgggaagccgccaagttgtttgcacgaaaactgaaccccaaacgatgcttcttggtgcgaccaggagaccagcaaccccgtcccctggaggccctgaacggaggcttcaatctttctcgtattcttcgtaccgccctgcctgcctggcacaagtccatcgtatctttccggcagcttcgggaggaggtgctaggagaactgtcaaatgtggagcaagcagctggcctccgctggagccgctttccagacctcaatcgtatcttgaagggacatcgaaagggcgagctgacggtcttcacagggccaacaggcagtggaaagacgacattcatcagtgagtatgccctggatttgtgttcccagggggtgaacacactgtggggtagcttcgagatcagcaatgtgagactagcccgggtcatgctgacacagtttgccgaggggcggctggaagatcaactggacaaatatgatcactgggctgaccgctttgaggacctgcccctctatttcatgactttccatggacagcaaagcatcaggactgtaatagatacaatgcaacatgcagtctacgtctatgacatttgtcatgtgatcatcgacaacctgcagttcatgatgggtcacgagcagctgtccacagacaggatcgcagctcaagactacatcatcggggtctttcggaagtttgcaacagacaataactgccatgtgacactggtcattcacccccggaaagaggatgatgacaaggaactgcagacagcgtccatttttggctcagccaaagtgagtggcctttagcggagctcaagctttggaaaatagagtgggtaggtgtgaccagggacagccctcattcagccttaatcgtcttgactgtccatccgaacaggcaggaggcaatgcctctggggccatgacatgaggaatatatgtgctggaaatacaaaggctgatagttggttcttatgc

SEQ ID NO: 365368 - DNA, 2002 bp, Homo sapiens
agctgctgcacatagcgacccagtccgttgtggagaacgctggccaagaagcggctcggagtcccgcgcgccgtcatagctacagcttggaggccgcggagcctaagcagcgaggagaggggggcgggactaaacctcgaggcttccggttccgggacgaccgctcccggagttttgcttccgaggtcaaggcgagtagcatgtgcgggagactcacgttgccggcgaagtgggagagagaaaagtgggccaacaggcagtggaaagacgacattcatcagtgagtatgccctggatttgtgttcccagggggtgaacacactgtggggtagcttcgagatcagcaatgtgagactagcccgggtcatgctgacacagtttgccgaggggcggctggaagatcaactggacaaatatgatcactgggctgaccgctttgaggacctgcccctctatttcatgactttccatggacagcaaagcatcaggactgtaatagatacaatgcaacatgcagtctacgtctatgacatttgtcatgtgatcatcgacaacctgcagttcatgatgggtcacgagcagctgtccacagacaggatcgcagctcaagactacatcatcggggtctttcggaagtttgcaacagacaataactgccatgtgacactggtcattcacccccggaaagaggatgatgacaaggaactgcagacagcgtccatttttggctcagccaaagtgagtggcctttagcggagctcaagctttggaaaatagagtgggcaagccaggaagcagacaatgttctgatcctgcaggacaggaagctggtaaccgggccagggaaacggtatctgcaggtgtccaagaaccgctttgatggagatgtaggtgtcttcccgcttgagttcaacaagaactccctcaccttctccattccaccaaagaacaaggcccggctcaagaagatcaaggatgacactggaccagtggccaaaaagccctcttctggcaaaaagggggctacgacacagaactctgagatttgctcaggccaggcccccactcccgaccagccagacacctccaagcgttcaaagtgaaggccgtgcagagctggtcactgaaatgagcctgataggataggctggagcataaaactctgcaagggctcctctatcctgtggtcctgagctgtgtgcccttctcagtctgaggggcctaacctagagcaggtttccatagtgagaaaattcaatgtagcagactactgagaaactactgtgttgctcaggctttgtttgaggtcctgtatatacagcactgaaaagagagataaagtccctgcctgcatgcattctggcggaagagacaagcaagcaatgaacaaattagcagaaaacctagttttagtgaaaaatgctgtaaagaaaatagaaatgcgatagagtgctggcaggctagtgtagataagtggtctgaaaaggtgtctctgagccgagggcatgtgagctggggcctaaacaactagaaggagagagccacgtgaacatccggcgaaggggacccaggcagagagaaaaggaaatccaagccctgaggtaggaatgagcaggtcagattcaaggcagtgaggtcaggccgcatgaacctggaggggaatcggggacttcatgcgaaactccagcctaggctttcaaagtcaaagggtgatacagtgggtaccaagctcctctgctccccactttgtagagcctagcatgaggtggcatgtactagaattggatcctaggtgcttagccctgcaatatcagggcctcactggtgggagctgcctcgggctgggttgcttggtcatagagccatagaaggaagctgtcagcccggagtgcctgccacctagacactgatgccattgtgtgctgcctcaagactgctggagtcaggacattttatagagccttttccagttttactaaaaaatttttccattgcaaaaaaa

SEQ ID NO: 365369 - DNA, 1884 bp, Homo sapiens
agctgctgcacatagcgacccagtccgttgtggagaacgctggccaagaagcggctcggagtcccgcgcgccgtcatagctacagcttggaggccgcggagcctaagcagcgaggagaggggggcgggactaaacctcgaggcttccggttccgggacgaccgctcccggagttttgcttccgaggtcaagggggtgaacacactgtggggtagcttcgagatcagcaatgtgagactagcccgggtcatgctgacacagtttgccgaggggcggctggaagatcaactggacaaatatgatcactgggctgaccgctttgaggacctgcccctctatttcatgactttccatggacagcaaagcatcaggactgtaatagatacaatgcaacatgcagtctacgtctatgacatttgtcatgtgatcatcgacaacctgcagttcatgatgggtcacgagcagctgtccacagacaggatcgcagctcaagactacatcatcggggtctttcggaagtttgcaacagacaataactgccatgtgacactggtcattcacccccggaaagaggatgatgacaaggaactgcagacagcgtccatttttggctcagccaaagtgagtggcctttagcggagctcaagctttggaaaatagagtgggcaagccaggaagcagacaatgttctgatcctgcaggacaggaagctggtaaccgggccagggaaacggtatctgcaggtgtccaagaaccgctttgatggagatgtaggtgtcttcccgcttgagttcaacaagaactccctcaccttctccattccaccaaagaacaaggcccggctcaagaagatcaaggatgacactggaccagtggccaaaaagccctcttctggcaaaaagggggctacgacacagaactctgagatttgctcaggccaggcccccactcccgaccagccagacacctccaagcgttcaaagtgaaggccgtgcagagctggtcactgaaatgagcctgataggataggctggagcataaaactctgcaagggctcctctatcctgtggtcctgagctgtgtgcccttctcagtctgaggggcctaacctagagcaggtttccatagtgagaaaattcaatgtagcagactactgagaaactactgtgttgctcaggctttgtttgaggtcctgtatatacagcactgaaaagagagataaagtccctgcctgcatgcattctggcggaagagacaagcaagcaatgaacaaattagcagaaaacctagttttagtgaaaaatgctgtaaagaaaatagaaatgcgatagagtgctggcaggctagtgtagataagtggtctgaaaaggtgtctctgagccgagggcatgtgagctggggcctaaacaactagaaggagagagccacgtgaacatccggcgaaggggacccaggcagagagaaaaggaaatccaagccctgaggtaggaatgagcaggtcagattcaaggcagtgaggtcaggccgcatgaacctggaggggaatcggggacttcatgcgaaactccagcctaggctttcaaagtcaaagggtgatacagtgggtaccaagctcctctgctccccactttgtagagcctagcatgaggtggcatgtactagaattggatcctaggtgcttagccctgcaatatcagggcctcactggtgggagctgcctcgggctgggttgcttggtcatagagccatagaaggaagctgtcagcccggagtgcctgccacctagacactgatgccattgtgtgctgcctcaagactgctggagtcaggacattttatagagccttttccagttttactaaaaaatttttccattgcaaaaaaa

SEQ ID NO: 365370 - DNA, 1533 bp, Homo sapiens
cccggattcaagcgattctcctgcctcagcctcccaagaagctgggactataggtgcatgccaccatgcccagctaattttttgtatttttagtagagatggggtttcaccgtgttagccaggatggtcttgatttcctgacatcgtgatccactcgactcggcctcccaaagttctgggattacaggcgtgagccattgtacccagcccctctccccattcttatcactcctccctgccctgtcagcccccctttctgctttgctcatgtcctcttactcctgctttcctccttctgccccctgttccccaggcaagccaggaagcagacaatgttctgatcctgcaggacaggaagctggtaaccgggccagggaaacggtatctgcaggtgtccaagaaccgctttgatggagatgtaggtgtcttcccgcttgagttcaacaagaactccctcaccttctccattccaccaaagaacaaggcccggctcaagaagatcaaggatgacactggaccagtggccaaaaagccctcttctggcaaaaagggggctacgacacagaactctgagatttgctcaggccaggcccccactcccgaccagccagacacctccaagcgttcaaagtgaaggccgtgcagagctggtcactgaaatgagcctgataggataggctggagcataaaactctgcaagggctcctctatcctgtggtcctgagctgtgtgcccttctcagtctgaggggcctaacctagagcaggtttccatagtgagaaaattcaatgtagcagactactgagaaactactgtgttgctcaggctttgtttgaggtcctgtatatacagcactgaaaagagagataaagtccctgcctgcatgcattctggcggaagagacaagcaagcaatgaacaaattagcagaaaacctagttttagtgaaaaatgctgtaaagaaaatagaaatgcgatagagtgctggcaggctagtgtagataagtggtctgaaaaggtgtctctgagccgagggcatgtgagctggggcctaaacaactagaaggagagagccacgtgaacatccggcgaaggggacccaggcagagagaaaaggaaatccaagccctgaggtaggaatgagcaggtcagattcaaggcagtgaggtcaggccgcatgaacctggaggggaatcggggacttcatgcgaaactccagcctaggctttcaaagtcaaagggtgatacagtgggtaccaagctcctctgctccccactttgtagagcctagcatgaggtggcatgtactagaattggatcctaggtgcttagccctgcaatatcagggcctcactggtgggagctgcctcgggctgggttgcttggtcatagagccatagaaggaagctgtcagcccggagtgcctgccacctagacactgatgccattgtgtgctgcctcaagactgctggagtcaggacattttatagagccttttccagttttactaaaaaatttttccattgcaaaaaaa

SEQ ID NO: 365371 - DNA, 981 bp, Homo sapiens
agctgctgcacatagcgacccagtccgttgtggagaacgctggccaagaagcggctcggagtcccgcgcgccgtcatagctacagcttggaggccgcggagcctaagcagcgaggagaggggggcgggactaaacctcgaggcttccggttccgggacgaccgctcccggagttttgcttccgaggtcaaggcgagtagcatgtgcgggagactcacgttgccggcgaagtgggagagagaaaagtggtaacctggggctgggggccggcgcggcggagctcggagtagtagagcggagtgaagacacgggggaggatagagactggcattccgttatgtgtgcctgtgggtgattgtgctgtggagtcagtgcttgtgtgctgctcatcgcctgatgtttgatgtgtcccagatgatgtgtggaatgtgatgaatgctgtgaatgatgtgtgtctactatgtctgtgtggtgccctagtgtgcacaatgtgtgacattacaaacaagtgattgcagactgcactcatatgaaattgatggacaggacagcagggaggattgcgtcgtgtgatgtgatgcaatagtcagaagtgttggagcaatggattgcattgcggaaaatgaaaaacttggtgtcaaggttggagggaaactagtaatagcacgtggttcataagaagtgtcgcagtgttgttgactgggaagaagagaaaaacttcaaactataaactgtggaacccagatcagacagtggttgtggtgagaggaatgacccaatattggttagagaaaatagtgaaccaggtttgggggaacaagccagaaaagaacggggaggtccagatttgagtaagaccttggtgggcaaatttaaattagtatggataggaaaagggcaaaaggcaaaaacgtgttataggaacggggggggcgttagaaaaagacaagagagggaaaaaattccaatgggggatgacgga

SEQ ID NO: 365372 - DNA, 3842 bp, Homo sapiens
agctgctgcacatagcgacccagtccgttgtggagaacgctggccaagaagcggctcggagtcccgcgcgccgtcatagctacagcttggaggccgcggagcctaagcagcgaggagaggggggcgggactaaacctcgaggcttccggttccgggacgaccgctcccggagttttgcttccgaggtcaaggcgagtagcatgtgcgggagactcacgttgccggcgaagtgggagagagaaaagtggtaacctggggctgggggccggcgcggcggagctcggagtagtagagcggagtgaagacacgggggaggatagagactggcattcctttgggccgggggattggcgggagtcgtgctgggtgctctcgccgtgttgaggtcccagtgaggggaaggagaagcggaagagggtctctagtcggggcctagggcaaagggactacaaaaaggatgcagatgactatagaaatgaggacgacgaggagatgctgtggaggagcagtagaggtgagaagatgatgcaaagaaactgtgtcagtgaggaactgtatagagggtcatagaggtgaggtggcggagagaaactaactaacggaccatagaggtgggggagccattgtagaaggacgtggacgcgaaagggtcgtgtagatgggcatatgtgtgaagcagcaacgtagaggggctgaagaggagaaattcatggagagaaagaatgcacctagagtgagctctgcagagtgctgcgtgggatatccctagagtttggtctagtgaaggcacgctaaccaggcacctaaggcatttcaagtagtgacttcccacatttggctaggaatgtgggtcctcctccgaagtgggtaccccctccgtatcttgttacccctgcgtggggagtggatgggtcggaggggcctgccccgaaacttggccccaggccctcctcgcagacgttacaggaaggagactctccaagccttggatatgccagtgttgcctgtaactgcaactgaaatccgccagtatttgcgggggcatgggatccccttccaggatggtcacagttgcctgcgggcactgagcccctttgcagagtcttcacagctcaaaggccagactggtgttaccacttccttcagcctcttcattgacaagaccacaggccactttctctgcatgaccagcctagcagaagggagctgggaagacttccaggccagcgtggaggggcgaggggatggggccagggaggggtttctgcttagcaaggcaccagaatttgaggacagcgaggaggtccggaggatctggaaccgagcaatacctctctgggagctgcctgatcaggaggaggttcagctggctgatacaatgtttggccttaccaaggttacagatgacacactcaagcgtttcagtgtgcgatatctgcgacctgctcgcagtcttgtcttcccttggttctcccctgggggctcaggattacgaggcctgaagctcctagaggctaaatgccagggggatggagtgagctacgaggaaaccactattccccgacccagcgcctaccacaatctgtttggattaccactgattagtcgtcgagatgctgaggtggtactgacgagtcgtgagcttgacagcctggccttgaaccagtccacggggctgcctacccttactctaccccgaggaacgacctgcttaccccctgccttactcccttacctggaacagttccggcggattgtattctggttgggggatgaccttcggtcctgggaagccgccaagttgtttgcacgaaaactgaaccccaaacgatgcttcttggtgcgaccaggagaccagcaaccccgtcccctggaggccctgaacggaggcttcaatctttctcgtattcttcgtaccgccctgcctgcctggcacaagtccatcgtatctttccggcagcttcgggaggaggtgctaggagaactgtcaaatgtggagcaagcagctggcctccgctggagccgctttccagacctcaatcgtatcttgaagggacatcgaaagggcgagctgacggtcttcacagggccaacaggcagtggaaagacgacattcatcagtgagtatgccctggatttgtgttcccagggggtgaacacactgtggggtagcttcgagatcagcaatgtgagactagcccgggtcatgctgacacagtttgccgaggggcggctggaagatcaactggacaaatatgatcactgggctgaccgctttgaggacctgcccctctatttcatgactttccatggacagcaaagcatcaggactgtaatagatacaatgcaacatgcagtctacgtctatgacatttgtcatgtgatcatcgacaacctgcagttcatgatgggtcacgagcagctgtccacagacaggatcgcagctcaagactacatcatcggggtctttcggaagtttgcaacagacaataactgccatgtgacactggtcattcacccccggaaagaggatgatgacaaggaactgcagacagcgtccatttttggctcagccaaagtgagtggcctttagcggagctcaagctttggaaaatagagtgggcaagccaggaagcagacaatgttctgatcctgcaggacaggaagctggtaaccgggccagggaaacggtatctgcaggtgtccaagaaccgctttgatggagatgtaggtgtcttcccgcttgagttcaacaagaactccctcaccttctccattccaccaaagaacaaggcccggctcaagaagatcaaggatgacactggaccagtggccaaaaagccctcttctggcaaaaagggggctacgacacagaactctgagatttgctcaggccaggcccccactcccgaccagccagacacctccaagcgttcaaagtgaaggccgtgcagagctggtcactgaaatgagcctgataggataggctggagcataaaactctgcaagggctcctctatcctgtggtcctgagctgtgtgcccttctcagtctgaggggcctaacctagagcaggtttccatagtgagaaaattcaatgtagcagactactgagaaactactgtgttgctcaggctttgtttgaggtcctgtatatacagcactgaaaagagagataaagtccctgcctgcatgcattctggcggaagagacaagcaagcaatgaacaaattagcagaaaacctagttttagtgaaaaatgctgtaaagaaaatagaaatgcgatagagtgctggcaggctagtgtagataagtggtctgaaaaggtgtctctgagccgagggcatgtgagctggggcctaaacaactagaaggagagagccacgtgaacatccggcgaaggggacccaggcagagagaaaaggaaatccaagccctgaggtaggaatgagcaggtcagattcaaggcagtgaggtcaggccgcatgaacctggaggggaatcggggacttcatgcgaaactccagcctaggctttcaaagtcaaagggtgatacagtgggtaccaagctcctctgctccccactttgtagagcctagcatgaggtggcatgtactagaattggatcctaggtgcttagccctgcaatatcagggcctcactggtgggagctgcctcgggctgggttgcttggtcatagagccatagaaggaagctgtcagcccggagtgcctgccacctagacactgatgccattgtgtgctgcctcaagactgctggagtcaggacattttatagagccttttccagttttactaaaaaatttttccattgcaaaaaaa

SEQ ID NO: 365373 - DNA, 2775 bp, Homo sapiens
agctgctgcacatagcgacccagtccgttgtggagaacgctggccaagaagcggctcggagtcccgcgcgccgtcatagctacagcttggaggccgcggagcctaagcagcgaggagaggggggcgggactaaacctcgaggcttccggttccgggacgaccgctcccggagttttgcttccgaggtcaaggcgagtagcatgtgcgggagactcacgttgccggcgaagtgggagagagaaaagtggtaacctggggctgggggccggcgcggcggagctcggagtagtagagcggagtgaagacacgggggaggatagagactggcattcctttgggccgggggattggcgggagtcgtgctgggtgctctcgccgtgttgaggtcccagtgaggggaaggagaagcggaagagggtctctagtcggggcctagggcaaagggactacaaaaaggatgcagatgactatagaaatgaggacgacgaggagatgctgtggaggagcagtagaggtgagaagatgatgcaaagaaactgtgtcagtgaggaactgtatagagggtcatagaggtgaggtggcggagagaaactaactaacggaccatagaggtgggggacttgacagcctggccttgaaccagtccacggggctgcctacccttactctaccccgaggaacgacctgcttaccccctgccttactcccttacctggaacagttccggcggattgtattctggttgggggatgaccttcggtcctgggaagccgccaagttgtttgcacgaaaactgaaccccaaacgatgcttcttggtgcgaccaggagaccagcaaccccgtcccctggaggccctgaacggaggcttcaatctttctcgtattcttcgtaccgccctgcctgcctggcacaagtccatcgtatctttccggcagcttcgggaggaggtgctaggagaactgtcaaatgtggagcaagcagctggcctccgctggagccgctttccagacctcaatcgtatcttgaagggacatcgaaagggcgagctgacggtcttcacagggccaacaggcagtggaaagacgacattcatcagtgagtatgccctggatttgtgttcccagggggtgaacacactgtggggtagcttcgagatcagcaatgtgagactagcccgggtcatgctgacacagtttgccgaggggcggctggaagatcaactggacaaatatgatcactgggctgaccgctttgaggacctgcccctctatttcatgactttccatggacagcaaagcatcaggactgtaatagatacaatgcaacatgcagtctacgtctatgacatttgtcatgtgatcatcgacaacctgcagttcatgatgggtcacgagcagctgtccacagacaggatcgcagctcaagactacatcatcggggtctttcggaagtttgcaacagacaataactgccatgtgacactggtcattcacccccggaaagaggatgatgacaaggaactgcagacagcgtccatttttggctcagccaaagcaagccaggaagcagacaatgttctgatcctgcaggacaggaagctggtaaccgggccagggaaacggtatctgcaggtgtccaagaaccgctttgatggagatgtaggtgtcttcccgcttgagttcaacaagaactccctcaccttctccattccaccaaagaacaaggcccggctcaagaagatcaaggatgacactggaccagtggccaaaaagccctcttctggcaaaaagggggctacgacacagaactctgagatttgctcaggccaggcccccactcccgaccagccagacacctccaagcgttcaaagtgaaggccgtgcagagctggtcactgaaatgagcctgataggataggctggagcataaaactctgcaagggctcctctatcctgtggtcctgagctgtgtgcccttctcagtctgaggggcctaacctagagcaggtttccatagtgagaaaattcaatgtagcagactactgagaaactactgtgttgctcaggctttgtttgaggtcctgtatatacagcactgaaaagagagataaagtccctgcctgcatgcattctggcggaagagacaagcaagcaatgaacaaattagcagaaaacctagttttagtgaaaaatgctgtaaagaaaatagaaatgcgatagagtgctggcaggctagtgtagataagtggtctgaaaaggtgtctctgagccgagggcatgtgagctggggcctaaacaactagaaggagagagccacgtgaacatccggcgaaggggacccaggcagagagaaaaggaaatccaagccctgaggtaggaatgagcaggtcagattcaaggcagtgaggtcaggccgcatgaacctggaggggaatcggggacttcatgcgaaactccagcctaggctttcaaagtcaaagggtgatacagtgggtaccaagctcctctgctccccactttgtagagcctagcatgaggtggcatgtactagaattggatcctaggtgcttagccctgcaatatcagggcctcactggtgggagctgcctcgggctgggttgcttggtcatagagccatagaaggaagctgtcagcccggagtgcctgccacctagacactgatgccattgtgtgctgcctcaagactgctggagtcaggacattttatagagccttttccagttttactaaaaaatttttccattgcaaaaaaa

SEQ ID NO: 365374 - DNA, 2974 bp, Homo sapiens
  misc_feature (2793)..(2793): n is a, c, g, or t
  misc_feature (2795)..(2795): n is a, c, g, or t
  misc_feature (2797)..(2798): n is a, c, g, or t
  misc_feature (2807)..(2807): n is a, c, g, or t
  misc_feature (2818)..(2819): n is a, c, g, or t
  misc_feature (2826)..(2827): n is a, c, g, or t
  misc_feature (2833)..(2833): n is a, c, g, or t
  misc_feature (2835)..(2835): n is a, c, g, or t
  misc_feature (2837)..(2837): n is a, c, g, or t
agctgctgcacatagcgacccagtccgttgtggagaacgctggccaagaagcggctcggagtcccgcgcgccgtcatagctacagcttggaggccgcggagcctaagcagcgaggagaggggggcgggactaaacctcgaggcttccggttccgggacgaccgctcccggagttttgcttccgaggtcaaggcgagtagcatgtgcgggagactcacgttgccggcgaagtgggagagagaaaagtggtaacctggggctgggggccggcgcggcggagctcggagtagtagagcggagtgaagacacgggggaggatagagactggcattcctttgggccgggggattggcgggagtcgtgctgggtgctctcgccgtgttgaggtcccagtgaggggaaggagaagcggaagagggtctctagtcggggcctagggcaaagggactacaaaaaggatgcagatgactatagaaatgaggacgacgaggagatgctgtggaggagcagtagaggtgagaagatgatgcaaagaaactgtgtcagtgaggaactgtatagagggtcatagaggtgaggtggcggagagaaactaactaacggaccatagaggtgggggagccattgtagaaggacgtggacgcgaaagggtcgtgtagatgggcatatgtgtgaagcagcaacgtagaggggctgaagaggagaaattcatggagagaaagaatgcacctagagtgagctctgcagagtgctgcgtgggatatccctagagtttggtctagtgaaggcacgctaaccaggcacctaaggcatttcaagtagtgacttcccacatttggctaggaatgtgggtcctcctccgaagtgggtaccccctccgtatcttgttacccctgcgtggggagtggatgggtcggaggggcctgccccgaaacttggccccaggccctcctcgcagacgttacaggaaggagactctccaagccttggatatgccagtgttgcctgtaactgcaactgaaatccgccagtatttgcgggggcatgggatccccttccaggatggtcacagttgcctgcgggcactgagcccctttgcagagtcttcacagctcaaaggccagactggtgttaccacttccttcagcctcttcattgacaagaccacaggccactttctctgcatgaccagcctagcagaagggagctgggaagacttccaggccagcgtggaggggcgaggggatggggccagggaggggtttctgcttagcaaggcaccagaatttgaggacagcgaggaggtccggaggatctggaaccgagcaatacctctctgggagctgcctgatcaggaggaggttcagctggctgatacaatgtttggccttaccaaggttacagatgacacactcaagcgtttcagtgtgcgatatctgcgacctgctcgcagtcttgtcttcccttggttctcccctgggggctcaggattacgaggcctgaagctcctagaggctaaatgccagggggatggagtgagctacgaggaaaccactattccccgacccagcgcctaccacaatctgtttggattaccactgattagtcgtcgagatgctgaggtggtactgacgagtcgtgagcttgacagcctggccttgaaccagtccacggggctgcctacccttactctaccccgaggaacgacctgcttaccccctgccttactcccttacctggaacagttccggcggattgtattctggttgggggatgaccttcggtcctgggaagccgccaagttgtttgcacgaaaactgaaccccaaacgatgcttcttggtgcgaccaggagaccagcaaccccgtcccctggaggccctgaacggaggcttcaatctttctcgtattcttcgtaccgccctgcctgcctggcacaagtccatcgtatctttccggcagcttcgggaggaggtgctaggagaactgtcaaatgtggagcaagcagctggcctccgctggagccgctttccagacctcaatcgtatcttgaagggacatcgaaagggcgagctgacggtcttcacagggccaacaggcagtggaaagacgacattcatcagtgagtatgccctggatttgtgttcccagggggtgaacacactgtggggtagcttcgagatcagcaatgtgagactagcccgggtcatgctgacacagtttgccgaggggcggctggaagatcaactggacaaatatgatcactgggctgaccgctttgaggacctgcccctctatttcatgactttccatggacagcaaagcatcaggactgtaatagatacaatgcaacatgcagtctacgtctatgacatttgtcatgtgatcatcgacaacctgcagttcatgatgggtcacgagcagctgtccacagacaggatcgcagctcaagactacatcatcggggtctttcggaagtttgcaacagacaataactgccatgtgacactggtcattcacccccggaaagaggatgatgacaaggaactgcagacagcgtccatttttggctcagccaaagtgagtggcctttagcggagctcaagctttggaaaatagagtgggcaagccaggaagcagacaatgttctgatcctgcaggacaggaagctggtaaccgggccagggaaacggtatctgcaggtgtccaagaaccgctttgatggagatgtaggtgtcttcccgcttgagttcaacaagaactccctcaccttctccattccaccaaagaacagncngnncagagatcnggtggccggcnnggcaaanncctctntngnaagggtcgacggattcggtatggtcgcgggcctcgaagaaactccagtaggagcgggatggcgaaggcgagaggggcaacggggccccgggcaggccggggccagcagaagcagagcggggggtacaaccgggaagc

SEQ ID NO: 365375 - DNA, 2550 bp, Homo sapiens
agctgctgcacatagcgacccagtccgttgtggagaacgctggccaagaagcggctcggagtcccgcgcgccgtcatagctacagcttggaggccgcggagcctaagcagcgaggagaggggggcgggactaaacctcgaggcttccggttccgggacgaccgctcccggagttttgcttccgaggtcaaggcgagtagcatgtgcgggagactcacgttgccggcgaagtgggagagagaaaagtggtaacctggggctgggggccggcgcggcggagctcggagtagtagagcggagtgaagacacgggggaggatagagactggcattcctttgggccgggggattggcgggagtcgtgctgggtgctctcgccgtgttgaggtcccagtgaggggaaggagaagcggaagagggtctctagtcggggcctagggcaaagggactacaaaaaggatgcagatgactatagaaatgaggacgacgaggagatgctgtggaggagcagtagagggccaacaggcagtggaaagacgacattcatcagtgagtatgccctggatttgtgttcccagggggtgaacacactgtggggtagcttcgagatcagcaatgtgagactagcccgggtcatgctgacacagtttgccgaggggcggctggaagatcaactggacaaatatgatcactgggctgaccgctttgaggacctgcccctctatttcatgactttccatggacagcaaagcatcaggactgtaatagatacaatgcaacatgcagtctacgtctatgacatttgtcatgtgatcatcgacaacctgcagttcatgatgggtcacgagcagctgtccacagacaggtgacggtgacatcctctcttgtctagcttgagcccgcttggacatacaacacacacttctcaggcagctggcctctaggcacacatgctgtgctctcctattttctgagatgtgtgcaggcacgtaccacccccatgtgtatcatatggaggtgtggggtatggcagcaggatgtatggacagggatctgagtgtgagtccttgggtagagggaggtagagtgggttgtggtagtttgtggggagatgtgaatggatcaagagtatgtgtatgttcttgtccttctgtgtctgataagctctttgtgttgttgggatggcgtaggatcgcagctcaagactacatcatcggggtctttcggaagtttgcaacagacaataactgccatgtgacactggtcattcacccccggaaagaggatgatgacaaggaactgcagacagcgtccatttttggctcagccaaagcaagccaggaagcagacaatgttctgatcctgcaggacaggaagctggtaaccgggccagggaaacggtatctgcaggtgtccaagaaccgctttgatggagatgtaggtgtcttcccgcttgagttcaacaagaactccctcaccttctccattccaccaaagaacaaggcccggctcaagaagatcaaggatgacactggaccagtggccaaaaagccctcttctggcaaaaagggggctacgacacagaactctgagatttgctcaggccaggcccccactcccgaccagccagacacctccaagcgttcaaagtgaaggccgtgcagagctggtcactgaaatgagcctgataggataggctggagcataaaactctgcaagggctcctctatcctgtggtcctgagctgtgtgcccttctcagtctgaggggcctaacctagagcaggtttccatagtgagaaaattcaatgtagcagactactgagaaactactgtgttgctcaggctttgtttgaggtcctgtatatacagcactgaaaagagagataaagtccctgcctgcatgcattctggcggaagagacaagcaagcaatgaacaaattagcagaaaacctagttttagtgaaaaatgctgtaaagaaaatagaaatgcgatagagtgctggcaggctagtgtagataagtggtctgaaaaggtgtctctgagccgagggcatgtgagctggggcctaaacaactagaaggagagagccacgtgaacatccggcgaaggggacccaggcagagagaaaaggaaatccaagccctgaggtaggaatgagcaggtcagattcaaggcagtgaggtcaggccgcatgaacctggaggggaatcggggacttcatgcgaaactccagcctaggctttcaaagtcaaagggtgatacagtgggtaccaagctcctctgctccccactttgtagagcctagcatgaggtggcatgtactagaattggatcctaggtgcttagccctgcaatatcagggcctcactggtgggagctgcctcgggctgggttgcttggtcatagagccatagaaggaagctgtcagcccggagtgcctgccacctagacactgatgccattgtgtgctgcctcaagactgctggagtcaggacattttatagagccttttccagttttactaaaaaatttttccattgcaaaaaaa

SEQ ID NO: 365376 - DNA, 1517 bp, Homo sapiens
  misc_feature (40)..(40): n is a, c, g, or t
  misc_feature (42)..(42): n is a, c, g, or t
  misc_feature (46)..(46): n is a, c, g, or t
gagggcgccgaaaaaatcattacggctaaggtacgaggcngngtgntgactgtaatagatacaatgcaacatgcagtctacgtctatgacatttgtcatgtgatcatcgacaacctgcagttcatgatgggtcacgagcagctgtccacagacaggatcgcagctcaagactacatcatcggggtctttcggaagtttgcaacagacaataactgccatgtgacactggtcattcacccccggaaagaggatgatgacaaggaactgcagacagcgtccatttttggctcagccaaagcaagccaggaagcagacaatgttctgatcctgcaggacaggaagctggtaaccgggccagggaaacggtatctgcaggtgtccaagaaccgctttgatggagatgtaggtgtcttcccgcttgagttcaacaagaactccctcaccttctccattccaccaaagaacaaggcccggctcaagaagatcaaggatgacactggaccagtggccaaaaagccctcttctggcaaaaagggggctacgacacagaactctgagatttgctcaggccaggcccccactcccgaccagccagacacctccaagcgttcaaagtgaaggccgtgcagagctggtcactgaaatgagcctgataggataggctggagcataaaactctgcaagggctcctctatcctgtggtcctgagctgtgtgcccttctcagtctgaggggcctaacctagagcaggtttccatagtgagaaaattcaatgtagcagactactgagaaactactgtgttgctcaggctttgtttgaggtcctgtatatacagcactgaaaagagagataaagtccctgcctgcatgcattctggcggaagagacaagcaagcaatgaacaaattagcagaaaacctagttttagtgaaaaatgctgtaaagaaaatagaaatgcgatagagtgctggcaggctagtgtagataagtggtctgaaaaggtgtctctgagccgagggcatgtgagctggggcctaaacaactagaaggagagagccacgtgaacatccggcgaaggggacccaggcagagagaaaaggaaatccaagccctgaggtaggaatgagcaggtcagattcaaggcagtgaggtcaggccgcatgaacctggaggggaatcggggacttcatgcgaaactccagcctaggctttcaaagtcaaagggtgatacagtgggtaccaagctcctctgctccccactttgtagagcctagcatgaggtggcatgtactagaattggatcctaggtgcttagccctgcaatatcagggcctcactggtgggagctgcctcgggctgggttgcttggtcatagagccatagaaggaagctgtcagcccggagtgcctgccacctagacactgatgccattgtgtgctgcctcaagactgctggagtcaggacattttatagagccttttccagttttactaaaaaatttttccattgcaaaaaaa

SEQ ID NO: 365377 - DNA, 1321 bp, Homo sapiens
  misc_feature (1321)..(1321): n is a, c, g, or t
agctgctgcacatagcgacccagtccgttgtggagaacgctggccaagaagcggctcggagtcccgcgcgccgtcatagctacagcttggaggccgcggagcctaagcagcgaggagaggggggcgggactaaacctcgaggcttccggttccgggacgaccgctcccggagttttgcttccgaggtcaaggcgagtagcatgtgcgggagactcacgttgccggcgaagtgggagagagaaaagtgggccaacaggcagtggaaagacgacattcatcagtgagtatgccctggatttgtgttcccagggggtgaacacactgtggggtagcttcgagatcagcaatgtgagactagcccgggtcatgctgacacagtttgccgaggggcggctggaagatcaactggacaaatatgatcactgggctgaccgctttgaggacctgcccctctatttcatgactttccatggacagcaaagcatcaggactgtaatagatacaatgcaacatgcagtctacgtctatgacatttgtcatgtgatcatcgacaacctgcagttcatgatgggtcacgagcagctgtccacagacaggatcgcagctcaagactacatcatcggggtctttcggaagtttgcaacagacaataactgccatgtgacactggtcattcacccccggaaagaggatgatgacaaggaactgcagacagcgtccatttttggctcagccaaagcaagccaggaagcagacaatgttctgatcctgcaggacaggaagctggtaaccgggccagggaaacggtatctgcaggtgtccaagaaccgctttgatggagatgtaggtgtcttcccgcttgagttcaacaagaactccctcaccttctccattccaccaaagaacaaggcccggctcaagaagatcaaggatgacactggaccagtggccaaaaagccctcttctggcaaaaagggggctacgacacagaactctgagatttgctcaggccaggcccccactcccgaccagccagacacctccaagcgttcaaagtgaaggcggcaagcggtccgaaagaccgatagggatgcggcggacataaaccttgaggggcctcaaatcgaggggccagaggtgcaccatatcatcagagggcaaacaacacgtgcactaggaaaaactctgcgcacagagaaaccgtgtcgcagcgtaggaggtataataaagaaaaaagccggttgtcggacgaagaacaaagacattacatgcgaacacgacagagggtatgtggcgtctcagcgaggcgcacagtatatgn

SEQ ID NO: 365378 - DNA, 405 bp, Homo sapiens
ccacgaggagccgccgcggctcaggagcgggtggtgggcgtctgagaagtcgccaccatgaggaagctcttcagcttcgggagacgcctgggccaggcgctcctgagctccatggaccaagagtatgcgggtccgggttacgacattcgggactgggaactgcggaagatccacagggctgccatcaagggcgacgccgcggaggtggagcgctgcctgacgcgcaggttccgggacttggacgcccgcgacagaaaagacaggactgttctacatttggcctgtgcccatggccgtgtgcaagtggtcactctcttgctgcacagaagatgccagatcgacatctgtgacagactaaacaggacacctttaatgaaggtatatagtagccaactctttcagcat

SEQ ID NO: 365379 - DNA, 362 bp, Homo sapiens
ctgattttaaaaagcaaaattacaggccaggcatggtggctcacacctgtaatcccagcactttgggaggccgaggcgggtggatcacctgaggtcaggattttgagaccagcctggctaacatggtgaaaccccatgtctactaaaaatacaaaaattagctgggcatcatggcgggcgcctgtaatcccacctcccgaggagctgggacaacaggcacatgcgaccatgcccagaaacagcagctatgaagcctgcaaatttgaaaaaaagaaaagaacgtgcaaaagaacacaacctaaaagtggcttcagaggaaaagcaagaaaggctccaaagaagtgaaaataaacagccacagg

SEQ ID NO: 365380 - DNA, 1180 bp, Homo sapiens
ccacgaggagccgccgcggctcaggagcgggtggtgggcgtctgagaagtcgccaccatgaggaagctcttcagcttcgggagacgcctgggccaggcgctcctgagctccatggaccaagagtatgcgggtccgggttacgacattcgggactgggaactgcggaagatccacagggctgccatcaagggcgacgccgcggaggtggagcgctgcctgacgcgcaggttccgggacttggacgcccgcgacagaaaagacaggactgttctacatttggcctgtgcccatggccgtgtgcaagtggtcactctcttgctgcacagaagatgccagatcgacatctgtgacagactaaacaggacacctttaatgaaggctgtacacagccaggaagaggcttgtgccatcgttctcctggaatgtggcgccaatccaaacattgaggatatctacggcaacactgctctccattatgccgtgtataataaggggacttcactggcagaaagactgctttcccaccatgcaaatattgaagcactaaacaaggagggaaacactccacttttgtttgctataaattccaggagacagcatatggtggaatttttattgaagaaccaggcaaatatacatgccgttgacaatttcaaaagaacagccctcatacttgcagtacagcataacttgtcaagtatcgtcaccctcctgcttcaacaaaatatacgtatctcttctcaagacatgtttggccaaactgccgaggattatgctctttgttctgatttgagaagcatccgacaacaaattttggaacataaaaataaaatgcttaaaaatcatcttcgaaatgacaatcaagaagcagcagccatgaagaatgaaagttttaaaacacaaggagcaagttcaaaagtctcgctctatcaccagtctggagtccagtggcatgatctcagattactgcagccttcacctcccaggttcaagcaattctcctgcctcagcctcccgaggagctgggacaacaggcacatgcgaccatgcccagaaacagcagctatgaagcctgcaaatttgaaaaaaagaaaagaacgtgcaaaagaacacaacctaaaagtggcttcagaggaaaagcaagaaaggctccaaagaagtgaaaataaacagccacagg

SEQ ID NO: 365381 - DNA, 360 bp, Homo sapiens
gctggatccatcaatccgggttaccaggatctgttttctagttgtggcttcattttcagacaagttgtttccatatgatagcctcatagaaggtactaccagcttagtcctagcaagaaaaaagagtacttactcttcaatatttgcagcagaagtcccaggtctgttcttatgagggcagtttgagtcacttgctcttctctgaacgtggagaaggcactgtttagatgatggaggttggattcaggtgcatcccctggaatggggtttggcattagcttcacgtggtctagaataaaggggttctccaaaggaaaattagggtaggaatgctgagtaagcagaacaaacagatgtcta

SEQ ID NO: 365382 - DNA, 118 bp, Homo sapiens
tttaaagctaggttttaaaggtaggtcactggccagtttttatttcaatatatagtaggtaaacatacaggtctaaaatgatctaacaattccttaaaagtaaggctttgaagtttgc

SEQ ID NO: 365383 - DNA, 441 bp, Homo sapiens
gaaaggtttttataggtattcttcatcaaattgaagaagttatctttattcctattattctgagatcattcaataccgtaaatgggtgctgaattgcatcaaatttttttttctacattatgtgacttttcttctttagtctgttaatatggtgcattacattgattcagctgaatggtactctccccacccaacaacccagctgtctgtatgttcttaaggtggaagctcagagtgttgttttttttaacactatgaccctgaataaagcaacatatctatatagctagtcccagaatcactggtaattgcttacataagaagctccgtatggccagatgatacagattgtggacacatgagaaaaaccttcttgttgcaagtaaaatatatctgtggctgagaaaaaaagaccgtcaaatgaaaaattctacatacaaa

SEQ ID NO: 365384 - DNA, 2053 bp, Homo sapiens
ctcgactagaagactaagggggcgctccccggcttcctgcggcgtcggtggcgagctgaggtggaggcaggctgcggcagacggcgacagtggcggcggcgccatggcagggcttgcaggatccctgctgccttggtgatcccgggctgacagccagagagcacagcggctcagctcctggagagtgagggttgaagaaagcggagggcagccgcctgcgcccgctggctcccattaggtcggttcctgcagcggtgcccggcagccttggtgaaggccctgcccggcagagatcatgtattgcctccagtggctgctgcccgtcctcctcatccccaagcccctcaaccccgccctgtggttcagccactccatgttcatgggcttctacctgctcagcttcctcctggaacggaagccttgcacaatttgtgccttggttttcctggcagccctgttccttatctgctatagctgctggggaaactgtttcctgtaccactgctccgattccccgcttccagaatcggcgcatgatcccggcgttgtgggcacctaacggcctgccctgttagctttccaaggaagcagaagacgggaggggaggcattgacataggtcataaagcattggagtttcaaatcccgcagcctcgcgggtgtcacattcctgacggcgcctttttggcctgtgatgttttatccttacaatgtgaataatggcactgaccggtgcttttattgtaaagtcctatagtcgtgggtggtcttgtggttgtgtgtgttctgtccccatctaggtcctggctggccgcatgaccacccctctcgcctcattactgtgaggagtctgggtccatcctggtcagctgccccaatgtgacctggggcagataaaatgccagtctcattgtcacctctgtgacccctccttgtcagggtctccttccttcccagaatgttactgactcctcagtccctcttctggtttccctttatttctcttctacccttttccttttttggggagtacctgtccaagacagggctcatttttgcacttatctcgaatttgaagagattgctgacgcccgagagcctcgctttttcatccttctttccttgttcagcaggctagacagaaacatgtcttgactgttagttgtccacaaatcttcagtattttctccacttcatttttaagaaaggaagcaacagatagatgttgctctttcacctgggtgtctgggctcaagctttcccgcccagcctcacttcctttgcccttcctcctgcctttctcaactgtcccaaggagggggcctcattgtgtctcccgtgcatgctctgcagcattgaagtatggtgtgttcacgtagttctagcagtccccagctgagtgagtgggagagtacctgtgtgtttcgtaacggccttgatccccttgatagatgtttggatattttttggtgtgccctgtgtgtgtgtgtgtacaaatacatgtgtatattccttttaaagaagctttatcgaacgtggtctgattttgaggtttagcaatagctagctatatatggtaggtgccgctacagtttttatttagcatggggattgcagagtgaccagcacactggactccgaggtggttcagacaagacagaggggagcagtggccatcatcctcccgccaggagcttcttcgttcctgcgcatatagactgtacgttatgaagaatacccaggaagactttgtgactgtcacttgctgctttttctgcgcttcagtaacaagtgttggcaaacgagactttctcctggcccctgcctgctggagatcagcatgcctgtcctttcagtctgatccatccatctctctcttgcctgaggggaaagagagatgggccaggcagagaacagaactggaggcagtccatctagggaatgggactgtgaggccatacttgtgaaacgtctggactgctattctagagcttttatttggtgtgttcgttgcacagctgtttgaaatgtttaataaagctttataaacttta

SEQ ID NO: 365385 - DNA, 1030 bp, Homo sapiens
  misc_feature (999)..(999): n is a, c, g, or t
  misc_feature (1001)..(1001): n is a, c, g, or t
  misc_feature (1004)..(1004): n is a, c, g, or t
  misc_feature (1007)..(1007): n is a, c, g, or t
  misc_feature (1009)..(1009): n is a, c, g, or t
cattaggctagtagaggccggtgttaatcggacgaggctgaggtggaggcaggctgcggcagacggcgacagtggcggcggcgccatggcagggcttgcaggatccctgctgccttggtgatcccgggctgacagccagagagcacagcggctcagctcctggagagtgagggttgaagaaagcggagggcagccgcctgcgcccgctggctcccattaggtcggttcctgcagcggtgcccggcagccttggtgaaggccctgcccggcagagatcatgtattgcctccagtggctgctgcccgtcctcctcatccccaagcccctcaaccccgccctgtggttcagccactccatgttcatgggcttctacctgctcagcttcctcctggaacggaagccttgcacaatttgtgccttggttttcctggcagccctgttccttatctgctatagctgctggggaaactgtttcctgtaccactgctccgattccccgcttccagaatcggcgcatgatcccggcgttgtgggcacctaacggcctgccctgttagctttccaaggaagcagaagacgggaggggaggcattgacataggtcataaagcattggagtttcaaatcccgcagcctcgcgggtgtcacattcctgacggcgcctttttggcctgtgatgttttatccttacaatgtgaataatggcactgaccggtgcttttattgtaaagtcctatagtcgtgggtggtcttgtggttgtgtgtgttctgtccccatctaggtcctggctggccgcatgaccacccctctcgcctcattactgtgaggagtctgggtccatcctggtcagctgccccaatgtgacctggggcagataaaatgccagtctcattgtcacctctgtgacccctccttgtcagggtctccttccttcccagaatgttactgactcctcagtccctcttctggtttccctttatttctctacctcctttgggngnccnccnanacgggcttgcgcttcgacgag

SEQ ID NO: 365386 - DNA, 404 bp, Homo sapiens
cggccgcgccgccatattgtcccttctgggtcaccttaggcgtcgccgggtccccgtcactggggttttccttccgcataccccgggaaggcagggcgcccctgtccggcttcaggtgattgccgtgattggacctagcctgggccttggggggtcccttcccagcccggaggtgggtcatagtactcctgggtgctggctctggccttgtccaaggtcagcgcccttgcaggatgagacaggcagagccgggggcacggggctgggagcgcgaccaccatctctgcagccccgggttccacggcagggtgcccagcttgtgagaggcctgtcattctgtccccatcagtttagttgcgttgctttagttgcttttttgggggggaggtggggggacgtggggg

SEQ ID NO: 365387 - DNA, 2251 bp, Homo sapiens
ctcgactagaagactaagggggcgctccccggcttcctgcggcgtcggtggcgagctgaggtggaggcaggctgcggcagacggcgacagtggcggcggcgccatggcagggcttgcaggatccctgctgccttggtgatcccgggctgacagccagagagcacagcggctcagctcctggagagtgagggttgaagaaagcggagggcagccgcctgcgcccgctggctcccattaggtcggttcctgcagcggtgcccggcagccttggtgaaggccctgcccggcagagatcatgtattgcctccagtggctgctgcccgtcctcctcatccccaagcccctcaaccccgccctgtggttcagccactccatgttcatgggcttctacctgctcagcttcctcctggaacggaagccttgcacaatttgtgccttggttttcctggcagccctgttccttatctgctatagctgctggggaaactgtttcctgtaccactgctccgattccccgcttccagaatcggcgcatgatcccggcgttgtgggcacctaacggcctgccctgttagctttccaaggaagcagaagacgggaggggaggcattgacataggtcataaagcattggagtttcaaatcccgcagcctcgcgggtgtcacattcctgacggcgcctttttggcctgtgatgttttatccttacaatgtgaataatggcactgaccggtgcttttattgtaaagtcctatagtcgtgggtggtcttgtggttgtgtgtgttctgtccccatctaggtcctggctggccgcatgaccacccctctcgcctcattactgtgaggagtctgggtccatcctggtcagctgccccaatgtgacctggggcagataaaatgccagtctcattgtcacctctgtgacccctccttgtcagggtctccttccttcccagaatgttactgactcctcagtccctcttctggtttccctttatttctcttctacccttttccttttttggggagtacctgtccaagacagggctcatttttgcacttatctcgaatttgaagagattgctgacgcccgagagcctcgctttttcatccttctttccttgttcagcaggctagacagaaacatgtcttgactgttagttgtccacaaatcttcagtattttctccacttcatttttaagaaaggaagcaacagatagatgttgctctttcacctgggtgtctgggctcaagctttcccgcccagcctcacttcctttgcccttcctcctgcctttctcaactgtcccaaggagggggcctcattgtgtctcccgtgcatgctctgcagcattgaagtatggtgtgttcacgtagttctagcagtccccagctgagtgagtgggagagtacctgtgtgtttcgtaacggccttgatccccttgatagatgtttggatattttttggtgtgccctgtgtgtgtgtgtgtacaaatacatgtgtatattccttttaaagaagctttatcgaacgtggtctgattttgaggtttagcaatagctagctatatatggtaggtgccgctacagtttttatttagcatggggattgcagagtgaccagcacactggactccgaggtggttcagacaagacagaggggagcagtggccatcatcctcccgccaggagcttcttcgttcctgcgcatatagactgtacgttatgaagaatacccaggaagactttgtgactgtcacttgctgctttttctgcgcttcagtaacaagtgttggcaaacgagactttctcctggcccctgcctgctggagatcagcatgcctgtcctttcagtctgatccatccatctctctcttgcctgaggggaaagagagatgggccaggcagagaacagaactggaggcagtccatctagggaatgggactgtgaggccatacttgtgaaacgtctggactgctattctagagcttttatttggtgtgttcgttgcacagctgtttgaaatgtttaataaagctttataaactttaaaaaaaaaaaaaacacgcaaaagggggggtcctaaatcccgggggcaagtttgcggccccgttttggaacaaggcccaaggggggataaaaaggggggcgttaacatctgggggaagggcgggcttggggcccttctggggcttggcacccaagataggcggataatggttgtgacacaccttgggaatttgataaaa

SEQ ID NO: 365388 - DNA, 2169 bp, Homo sapiens
ctcgactagaagactaagggggcgctccccggcttcctgcggcgtcggtggcgagctgaggtggaggcaggctgcggcagacggcgacagtggcggcggcgccatggcagggcttgcaggatccctgctgccttggtgatcccgggctgacagccagagagcacagcggctcagctcctggagagtgagggttgaagaaagcggagggcagccgcctgcgcccgctggctcccattaggtcggttcctgcagcggtgcccggcagccttggtgaaggccctgcccggcagagatcatgtattgcctccagtggctgctgcccgtcctcctcatccccaagcccctcaaccccgccctgtggttcagccactccatgttcatgggcttctacctgctcagcttcctcctggaacggaagccttgcacaatttgtgccttggttttcctggcagccctgttccttatctgctatagctgctggggaaactgtttcctgtaccactgctccgattccccgcttccagaatcggcgcatgatcccggcgttgtgggcacctaacggcctgccctgttagctttccaaggaagcagaagacgggaggggaggcattgacataggtcataaagcattggagtttcaaatcccgcagcctcgcgggtgtcacattcctgacggcgcctttttggcctgtgatgttttatccttacaatgtgaataatggcactgaccggtgcttttattgtaaagtcctatagtcgtgggtggtcttgtggttgtgtgtgttctgtccccatctaggtcctggctggccgcatgaccacccctctcgcctcattactgtgaggagtctgggtccatcctggtcagctgccccaatgtgacctggggcagataaaatgccagtctcattgtcacctctgtgacccctccttgtcagggtctccttccttcccagaatgttactgactcctcagtccctcttctggtttccctttatttctcttctacccttttccttttttggggagtacctgtccaagacagggctcatttttgcacttatctcgaatttgaagagattgctgacgcccgagagcctcgctttttcatccttctttccttgttcagcaggctagacagaaacatgtcttgactgttagttgtccacaaatcttcagtattttctccacttcatttttaagaaaggaagcaacagatagatgttgctctttcacctgggtgtctgggctcaagctttcccgcccagcctcacttcctttgcccttcctcctgcctttctcaactgtcccaaggagggggcctcattgtgtctcccgtgcatgctctgcagcattgaagtatggtgtgttcacgtagttctagcagtccccagctgagtgagtgggagagtacctgtgtgtttcgtaacggccttgatccccttgatagatgtttggatattttttggtgtgccctgtgtgtgtgtgtgtacaaatacatgtgtatattccttttaaagaagctttatcgaacgtggtctgattttgaggtttagcaatagctagctatatatggtaggtgccgctacagtttttatttagcatggggattgcagagtgaccagcacactggactccgaggtggttcagacaagacagaggggagcagtggccatcatcctcccgccaggagcttcttcgttcctgcgcatatagactgtacgttatgaagaatacccaggaagactttgtgactgtcacttgctgctttttctgcgcttcagtaacaagtgttggcaaacgagactttctcctggcccctgcctgctggagatcagcatgcctgtcctttcagtctgatccatccatctctctcttgcctgaggggaaagagagatgggccaggcagagaacagaactggaggcagtccatctagggaatgggactgtgaggccatacttgtgaaacgtctggactgctattctagagcttttatttggtgtgttcgttgcacagctgtttgaaatgtttaataaagctttataaactttaaaaaaaaaaaaagtaaaaggaactcggcaaatcttaccccgcctgtttaccaaaacatcacctctagcatcaccagtattagaggcaccgcctgccgtgacactttgcatccagag

SEQ ID NO: 365389 - DNA, 2035 bp, Homo sapiens
cattaggctagtagaggccggtgttaatcggacgaggctgaggtggaggcaggctgcggcagacggcgacagtggcggcggcgccatggcagggcttgcaggatccctgctgccttggtgatcccgggctgacagccagagagcacagcggctcagctcctggagagtgagggttgaagaaagcggagggcagccgcctgcgcccgctggctcccattaggtcggttcctgcagcggtgcccggcagccttggtgaaggccctgcccggcagagatcatgtattgcctccagtggctgctgcccgtcctcctcatccccaagcccctcaaccccgccctgtggttcagccactccatgttcatgggcttctacctgctcagcttcctcctggaacggaagccttgcacaatttgtgccttggttttcctggcagccctgttccttatctgctatagctgctggggaaactgtttcctgtaccactgctccgattccccgcttccagaatcggcgcatgatcccggcgttgtgggcacctaacggcctgccctgttagctttccaaggaagcagaagacgggaggggaggcattgacataggtcataaagcattggagtttcaaatcccgcagcctcgcgggtgtcacattcctgacggcgcctttttggcctgtgatgttttatccttacaatgtgaataatggcactgaccggtgcttttattgtaaagtcctatagtcgtgggtggtcttgtggttgtgtgtgttctgtccccatctaggtcctggctggccgcatgaccacccctctcgcctcattactgtgaggagtctgggtccatcctggtcagctgccccaatgtgacctggggcagataaaatgccagtctcattgtcacctctgtgacccctccttgtcagggtctccttccttcccagaatgttactgactcctcagtccctcttctggtttccctttatttctcttctacccttttccttttttggggagtacctgtccaagacagggctcatttttgcacttatctcgaatttgaagagattgctgacgcccgagagcctcgctttttcatccttctttccttgttcagcaggctagacagaaacatgtcttgactgttagttgtccacaaatcttcagtattttctccacttcatttttaagaaaggaagcaacagatagatgttgctctttcacctgggtgtctgggctcaagctttcccgcccagcctcacttcctttgcccttcctcctgcctttctcaactgtcccaaggagggggcctcattgtgtctcccgtgcatgctctgcagcattgaagtatggtgtgttcacgtagttctagcagtccccagctgagtgagtgggagagtacctgtgtgtttcgtaacggccttgatccccttgatagatgtttggatattttttggtgtgccctgtgtgtgtgtgtgtacaaatacatgtgtatattccttttaaagaagctttatcgaacgtggtctgattttgaggtttagcaatagctagctatatatggtaggtgccgctacagtttttatttagcatggggattgcagagtgaccagcacactggactccgaggtggttcagacaagacagaggggagcagtggccatcatcctcccgccaggagcttcttcgttcctgcgcatatagactgtacgttatgaagaatacccaggaagactttgtgactgtcacttgctgctttttctgcgcttcagtaacaagtgttggcaaacgagactttctcctggcccctgcctgctggagatcagcatgcctgtcctttcagtctgatccatccatctctctcttgcctgaggggaaagagagatgggccaggcagagaacagaactggaggcagtccatctagggaatgggactgtgaggccatacttgtgaaacgtctggactgctattctagagcttttatttggtgtgttcgttgcacagctgtttgaaatgtttaataaagctttataaacttta

SEQ ID NO: 365390 - DNA, 2057 bp, Homo sapiens
ctcgactagaagactaagggggcgctccccggcttcctgcggcgtcggtggcgagctgaggtggaggcaggctgcggcagacggcgacagtggcggcggcgccatggcagggcttgcaggatccctgctgccttggtgatcccgggctgacagccagagagcacagcggctcagctcctggagagtgagggttgaagaaagcggagggcagccgcctgcgcccgctggctcccattaggtcggttcctgcagcggtgcccggcagccttggtgaaggccctgcccggcagagatcatgtattgcctccagtggctgctgcccgtcctcctcatccccaagcccctcaaccccgccctgtggttcagccactccatgttcatgggcttctacctgctcagcttcctcctggaacggaagccttgcacaatttgtgccttggttttcctggcagccctgttccttatctgctatagctgctggggaaactgtttcctgtaccactgctccgattccccgcttccagaatcggcgcatgatcccggcgttgtgggcacctaacggcctgccctgttagctttccaaggaagcagaagacgggaggggaggcattgacataggtcataaagcattggagtttcaaatcccgcagcctcgcgggtgtcacattcctgacggcgcctttttggcctgtgatgttttatccttacaatgtgaataatggcactgaccggtgcttttattgtaaagtcctatagtcgtgggtggtcttgtggttgtgtgtgttctgtccccatctaggtcctggctggccgcatgaccacccctctcgcctcattactgtgaggagtctgggtccatcctggtcagctgccccaatgtgacctggggcagataaaatgccagtctcattgtcacctctgtgacccctccttgtcagggtctccttccttcccagaatgttactgactcctcagtccctcttctggtttccctttatttctcttctacccttttccttttttggggagtacctgtccaagacagggctcatttttgcacttatctcgaatttgaagagattgctgacgcccgagagcctcgctttttcatccttctttccttgttcagcaggctagacagaaacatgtcttgactgttagttgtccacaaatcttcagtattttctccacttcatttttaagaaaggaagcaacagatagatgttgctctttcacctgggtgtctgggctcaagctttcccgcccagcctcacttcctttgcccttcctcctgcctttctcaactgtcccaaggagggggcctcattgtgtctcccgtgcatgctctgcagcattgaagtatggtgtgttcacgtagttctagcagtccccagctgagtgagtgggagagtacctgtgtgtttcgtaacggccttgatccccttgatagatgtttggatattttttggtgtgccctgtgtgtgtgtgtgtacaaatacatgtgtatattccttttaaagaagctttatcgaacgtggtctgattttgaggtttagcaatagctagctatatatggtaggtgccgctacagtttttatttagcatggggattgcagagtgaccagcacactggactccgaggtggttcagacaagacagaggggagcagtggccatcatcctcccgccaggagcttcttcgttcctgcgcatatagactgtacgttatgaagaatacccaggaagactttgtgactgtcacttgctgctttttctgcgcttcagtaacaagtgttggcaaacgagactttctcctggcccctgcctgctggagatcagcatgcctgtcctttcagtctgatccatccatctctctcttgcctgaggggaaagagagatgggccaggcagagaacagaactggaggcagtccatctagggaatgggactgtgaggccatacttgtgaaacgtctggactgctattctagagctttcaccggctgtgctttctcctcatatgcctcaaatgtttcatcaagctcgggttttcttcttaa

SEQ ID NO: 365391 - DNA, 1768 bp, Homo sapiens
  misc_feature (1655)..(1655): n is a, c, g, or t
  misc_feature (1658)..(1658): n is a, c, g, or t
  misc_feature (1660)..(1660): n is a, c, g, or t
  misc_feature (1662)..(1662): n is a, c, g, or t
  misc_feature (1669)..(1669): n is a, c, g, or t
  misc_feature (1674)..(1674): n is a, c, g, or t
  misc_feature (1676)..(1677): n is a, c, g, or t
  misc_feature (1685)..(1685): n is a, c, g, or t
  misc_feature (1687)..(1687): n is a, c, g, or t
ctcgactagaagactaagggggcgctccccggcttcctgcggcgtcggtggcgagctgaggtggaggcaggctgcggcagacggcgacagtggcggcggcgccatggcagggcttgcaggatccctgctgccttggtgatcccgggctgacagccagagagcacagcggctcagctcctggagagtgagggttgaagaaagcggagggcagccgcctgcgcccgctggctcccattaggtcggttcctgcagcggtgcccggcagccttggtgaaggccctgcccggcagagatcatgtattgcctccagtggctgctgcccgtcctcctcatccccaagcccctcaaccccgccctgtggttcagccactccatgttcatgggcttctacctgctcagcttcctcctggaacggaagccttgcacaatttgtgccttggttttcctggcagccctgttccttatctgctatagctgctggggaaactgtttcctgtaccactgctccgattccccgcttccagaatcggcgcatgatcccggcgttgtgggcacctaacggcctgccctgttagctttccaaggaagcagaagacgggaggggaggcattgacataggtcataaagcattggagtttcaaatcccgcagcctcgcgggtgtcacattcctgacggcgcctttttggcctgtgatgttttatccttacaatgtgaataatggcactgaccggtgcttttattgtaaagtcctatagtcgtgggtggtcttgtggttgtgtgtgttctgtccccatctaggtcctggctggccgcatgaccacccctctcgcctcattactgtgaggagtctgggtccatcctggtcagctgccccaatgtgacctggggcagataaaatgccagtctcattgtcacctctgtgacccctccttgtcagggtctccttccttcccagaatgttactgactcctcagtccctcttctggtttccctttatttctcttctacccttttccttttttggggagtacctgtccaagacagggctcatttttgcacttatctcgaatttgaagagattgctgacgcccgagagcctcgctttttcatccttctttccttgttcagcaggctagacagaaacatgtcttgactgttagttgtccacaaatcttcagtattttctccacttcatttttaagaaaggaagcaacagatagatgttgctctttcacctgggtgtctgggctcaagctttcccgcccagcctcacttcctttgcccttcctcctgcctttctcaactgtcccaaggagggggcctcattgtgtctcccgtgcatgctctgcagcattgaagtatggtgtgttcacgtagttctagcagtccccagctgagtgagtgggagagtacctgtgtgtttcgtaacggccttgatccccttgatagatgtttggatattttttggtgtgccctgtgtgtgtgtgtgtacaaatacatgtgtatattccttttaaagaagctttatcgaacgtggtctgattttgaggtttagcaatagctagctatatatggtaggtgccgctacagtttttatttagcatggggattgcagagtgaccagcacactggactccgaggtggttcagacaanccngncngggggcngggcntnntccccgcngngttttcggcgcgcttaacgggtttgaaaacccgcactggcgcccggggtttcggcccacaggggaagatcggccgcggaaa

SEQ ID NO: 365392 - DNA, 1592 bp, Homo sapiens
ctcgactagaagactaagggggcgctccccggcttcctgcggcgtcggtggcgagctgaggtggaggcaggctgcggcagacggcgacagtggcggcggcgccatggcagggcttgcaggatccctgctgccttggtgatcccgggctgacagccagagagcacagcggctcagctcctggagagtgagggttgaagaaagcggagggcagccgcctgcgcccgctggctcccattaggtcggttcctgcagcggtgcccggcagccttggtgaaggccctgcccggcagagatcatgtattgcctccagtggctgctgcccgtcctcctcatccccaagcccctcaaccccgccctgtggttcagccactccatgttcatgggcttctacctgctcagcttcctcctggaacggaagccttgcacaatttgtgccttggttttcctggcagccctgttccttatctgctatagctgctggggaaactgtttcctgtaccactgctccgattccccgcttccagaatcggcgcatgatcccggcgttgtgggcacctaacggcctgccctgttagctttccaaggaagcagaagacgggaggggaggcattgacataggtcataaagcattggagtttcaaatcccgcagcctcgcgggtgtcacattcctgacggcgcctttttggcctgtgatgttttatccttacaatgtgaataatggcactgaccggtgcttttattgtaaagtcctatagtcgtgggtggtcttgtggttgtgtgtgttctgtccccatctaggtcctggctggccgcatgaccacccctctcgcctcattactgtgaggagtctgggtccatcctggtcagctgccccaatgtgacctggggcagataaaatgccagtctcattgtcacctctgtgacccctccttgtcagggtctccttccttcccagaatgttactgactcctcagtccctcttctggtttccctttatttctcttctacccttttccttttttggggagtacctgtccaagacagggctcatttttgcacttatctcgaatttgaagagattgctgacgcccgagagcctcgctttttcatccttctttccttgttcagcaggctagacagaaacatgtcttgactgttagttgtccacaaatcttcagtattttctccacttcatttttaagaaaggaagcaacagatagatgttgctctttcacctgggtgtctgggctcaagctttcccgcccagcctcacttcctttgcccttcctcctgcctttctcaactgtcccaaggagggggcctcattgtgtctcccgtgcatgctctgcagcattgaagtatggtgtgttcacgtagttctagcagtccccagctgagtgagtgggagagtacctgtgtgtttcgtaacggccttgatccccttgatagatgtcggtcttcggggtgcctgggtgtggtgtgtgtccctctgtgtttttctttaagactttcgacgggccgttgggttgccggcctctttgcgggcggccgctttcctgggctgccggcgccgggcccgggctccacgggc

SEQ ID NO: 365393 - DNA, 2060 bp, Homo sapiens
  misc_feature (95)..(95): n is a, c, g, or t
aacaaaaaactatgtgctcagtaaggtgccgagcgacgcttcgggttggttaatttcagacagggcagctgatgtggaagatggtggactgcggngaagtgacagggggccatggcaggcttgcaggatccctgctgccttggtgatcccgggctgacagccagagagcacagcggctcagctcctggagagtgagggttgaagaaagcggagggcagccgcctgcgcccgctggctcccattaggtcggttcctgcagcggtgcccggcagccttggtgaaggccctgcccggcagagatcatgtattgcctccagtggctgctgcccgtcctcctcatccccaagcccctcaaccccgccctgtggttcagccactccatgttcatgggcttctacctgctcagcttcctcctggaacggaagccttgcacaatttgtgccttggttttcctggcagccctgttccttatctgctatagctgctggggaaactgtttcctgtaccactgctccgattccccgcttccagaatcggcgcatgatcccggcgttgtgggcacctaacggcctgccctgttagctttccaaggaagcagaagacgggaggggaggcattgacataggtcataaagcattggagtttcaaatcccgcagcctcgcgggtgtcacattcctgacggcgcctttttggcctgtgatgttttatccttacaatgtgaataatggcactgaccggtgcttttattgtaaagtcctatagtcgtgggtggtcttgtggttgtgtgtgttctgtccccatctaggtcctggctggccgcatgaccacccctctcgcctcattactgtgaggagtctgggtccatcctggtcagctgccccaatgtgacctggggcagataaaatgccagtctcattgtcacctctgtgacccctccttgtcagggtctccttccttcccagaatgttactgactcctcagtccctcttctggtttccctttatttctcttctacccttttccttttttggggagtacctgtccaagacagggctcatttttgcacttatctcgaatttgaagagattgctgacgcccgagagcctcgctttttcatccttctttccttgttcagcaggctagacagaaacatgtcttgactgttagttgtccacaaatcttcagtattttctccacttcatttttaagaaaggaagcaacagatagatgttgctctttcacctgggtgtctgggctcaagctttcccgcccagcctcacttcctttgcccttcctcctgcctttctcaactgtcccaaggagggggcctcattgtgtctcccgtgcatgctctgcagcattgaagtatggtgtgttcacgtagttctagcagtccccagctgagtgagtgggagagtacctgtgtgtttcgtaacggccttgatccccttgatagatgtttggatattttttggtgtgccctgtgtgtgtgtgtgtacaaatacatgtgtatattccttttaaagaagctttatcgaacgtggtctgattttgaggtttagcaatagctagctatatatggtaggtgccgctacagtttttatttagcatggggattgcagagtgaccagcacactggactccgaggtggttcagacaagacagaggggagcagtggccatcatcctcccgccaggagcttcttcgttcctgcgcatatagactgtacgttatgaagaatacccaggaagactttgtgactgtcacttgctgctttttctgcgcttcagtaacaagtgttggcaaacgagactttctcctggcccctgcctgctggagatcagcatgcctgtcctttcagtctgatccatccatctctctcttgcctgaggggaaagagagatgggccaggcagagaacagaactggaggcagtccatctagggaatgggactgtgaggccatacttgtgaaacgtctggactgctattctagagcttttatttggtgtgttcgttgcacagctgtttgaaatgtttaataaagctttataaacttta

SEQ ID NO: 365394 - DNA, 2049 bp, Homo sapiens
cggccgcgccgccatattgtcccttctgggtcaccttaggcgtcgccgggtccccgtcactggggttttccttccgcataccccgggaaggcagggcgcccctgtccggcttcaggatccctgctgccttggtgatcccgggctgacagccagagagcacagcggctcagctcctggagagtgagggttgaagaaagcggagggcagccgcctgcgcccgctggctcccattaggtcggttcctgcagcggtgcccggcagccttggtgaaggccctgcccggcagagatcatgtattgcctccagtggctgctgcccgtcctcctcatccccaagcccctcaaccccgccctgtggttcagccactccatgttcatgggcttctacctgctcagcttcctcctggaacggaagccttgcacaatttgtgccttggttttcctggcagccctgttccttatctgctatagctgctggggaaactgtttcctgtaccactgctccgattccccgcttccagaatcggcgcatgatcccggcgttgtgggcacctaacggcctgccctgttagctttccaaggaagcagaagacgggaggggaggcattgacataggtcataaagcattggagtttcaaatcccgcagcctcgcgggtgtcacattcctgacggcgcctttttggcctgtgatgttttatccttacaatgtgaataatggcactgaccggtgcttttattgtaaagtcctatagtcgtgggtggtcttgtggttgtgtgtgttctgtccccatctaggtcctggctggccgcatgaccacccctctcgcctcattactgtgaggagtctgggtccatcctggtcagctgccccaatgtgacctggggcagataaaatgccagtctcattgtcacctctgtgacccctccttgtcagggtctccttccttcccagaatgttactgactcctcagtccctcttctggtttccctttatttctcttctacccttttccttttttggggagtacctgtccaagacagggctcatttttgcacttatctcgaatttgaagagattgctgacgcccgagagcctcgctttttcatccttctttccttgttcagcaggctagacagaaacatgtcttgactgttagttgtccacaaatcttcagtattttctccacttcatttttaagaaaggaagcaacagatagatgttgctctttcacctgggtgtctgggctcaagctttcccgcccagcctcacttcctttgcccttcctcctgcctttctcaactgtcccaaggagggggcctcattgtgtctcccgtgcatgctctgcagcattgaagtatggtgtgttcacgtagttctagcagtccccagctgagtgagtgggagagtacctgtgtgtttcgtaacggccttgatccccttgatagatgtttggatattttttggtgtgccctgtgtgtgtgtgtgtacaaatacatgtgtatattccttttaaagaagctttatcgaacgtggtctgattttgaggtttagcaatagctagctatatatggtaggtgccgctacagtttttatttagcatggggattgcagagtgaccagcacactggactccgaggtggttcagacaagacagaggggagcagtggccatcatcctcccgccaggagcttcttcgttcctgcgcatatagactgtacgttatgaagaatacccaggaagactttgtgactgtcacttgctgctttttctgcgcttcagtaacaagtgttggcaaacgagactttctcctggcccctgcctgctggagatcagcatgcctgtcctttcagtctgatccatccatctctctcttgcctgaggggaaagagagatgggccaggcagagaacagaactggaggcagtccatctagggaatgggactgtgaggccatacttgtgaaacgtctggactgctattctagagcttttatttggtgtgttcgttgcacagctgtttgaaatgtttaataaagctttataaacttta

SEQ ID NO: 365395 - DNA, 1303 bp, Homo sapiens
ctcgactagaagactaagggggcgctccccggcttcctgcggcgtcggtggcgagctgaggtggaggcaggctgcggcagacggcgacagtggcggcggcgccatggcagggcttgcaggatccctgctgccttggtgatcccgggctgacagccagagagcacagcggctcagctcctggagagtgagggttgaagaaagcggagggcagccgcctgcgcccgctggctcccattaggtcggttcctgcagcggtgcccggcagccttggtgaaggccctgcccggcagagatcatgtattgcctccagtggctgctgcccgtcctcctcatccccaagcccctcaaccccgccctgtggttcagccactccatgttcatgggcttctacctgctcagcttcctcctggaacggaagccttgcacaatttgtgccttggttttcctggcagccctgttccttatctgctatagctgctggggaaactgtttcctgtaccactgctccgattccccgcttccagaatcggcgcatgatcccggcgttgtgggcacctaacggcctgccctgttagctttccaaggaagcagaagacgggaggggaggcattgacataggtcataaagcattggagtttcaaatcccgcagcctcgcgggtgtcacattcctgacggcgcctttttggcctgtgatgttttatccttacaatgtgaataatggcactgaccggtgcttttattgtaaagtcctatagtcgtgggtggtcttgtggttgtgtgtgttctgtccccatctaggtcctggctggccgcatgaccacccctctcgcctcattactgtgaggagtctgggtccatcctggtcagctgccccaatgtgacctggggcagataaaatgccagtctcattgtcacctctgtgacccctccttgtcagggtctccttccttcccagaatgttactgactcctcagtccctcttctggtttccctttatttctcttctacccttttccttttttggggagtacctgtccaagacagggctcatttttgcacttatctcgaatttgaagagattgctgacgcccgagagcctcgctttttcatccttctttccttgttcagcaggctagacagaaacatgtcttgactgttagttgtccacaaatcttcagtattttctccacttcatttttaagaaaggaagcaacagatagatgttgctctttcacctgggtgtctgggctcaagctttcccgcccagcctcacatgccactcaatataagccggtagagcac

SEQ ID NO: 365396 - DNA, 1048 bp, Homo sapiens
  misc_feature (1017)..(1017): n is a, c, g, or t
  misc_feature (1019)..(1019): n is a, c, g, or t
  misc_feature (1022)..(1022): n is a, c, g, or t
  misc_feature (1025)..(1025): n is a, c, g, or t
  misc_feature (1027)..(1027): n is a, c, g, or t
ctcgactagaagactaagggggcgctccccggcttcctgcggcgtcggtggcgagctgaggtggaggcaggctgcggcagacggcgacagtggcggcggcgccatggcagggcttgcaggatccctgctgccttggtgatcccgggctgacagccagagagcacagcggctcagctcctggagagtgagggttgaagaaagcggagggcagccgcctgcgcccgctggctcccattaggtcggttcctgcagcggtgcccggcagccttggtgaaggccctgcccggcagagatcatgtattgcctccagtggctgctgcccgtcctcctcatccccaagcccctcaaccccgccctgtggttcagccactccatgttcatgggcttctacctgctcagcttcctcctggaacggaagccttgcacaatttgtgccttggttttcctggcagccctgttccttatctgctatagctgctggggaaactgtttcctgtaccactgctccgattccccgcttccagaatcggcgcatgatcccggcgttgtgggcacctaacggcctgccctgttagctttccaaggaagcagaagacgggaggggaggcattgacataggtcataaagcattggagtttcaaatcccgcagcctcgcgggtgtcacattcctgacggcgcctttttggcctgtgatgttttatccttacaatgtgaataatggcactgaccggtgcttttattgtaaagtcctatagtcgtgggtggtcttgtggttgtgtgtgttctgtccccatctaggtcctggctggccgcatgaccacccctctcgcctcattactgtgaggagtctgggtccatcctggtcagctgccccaatgtgacctggggcagataaaatgccagtctcattgtcacctctgtgacccctccttgtcagggtctccttccttcccagaatgttactgactcctcagtccctcttctggtttccctttatttctctacctcctttgggngnccnccnanacgggcttgcgcttcgacgag

SEQ ID NO: 365397 - DNA, 1287 bp, Homo sapiens
ctgcatgataggccgtgggttaattcggcgaggccatctgtctggctgcgcatacaccctctcgcctcattactgtgaggagtctgggtccatcctggtcagctgccccaatgtgacctggggcagataaaatgccagtctcattgtcacctctgtgacccctccttgtcagggtctccttccttcccagaatgttactgactcctcagtccctcttctggtttccctttatttctcttctacccttttccttttttggggagtacctgtccaagacagggctcatttttgcacttatctcgaatttgaagagattgctgacgcccgagagcctcgctttttcatccttctttccttgttcagcaggctagacagaaacatgtcttgactgttagttgtccacaaatcttcagtattttctccacttcatttttaagaaaggaagcaacagatagatgttgctctttcacctgggtgtctgggctcaagctttcccgcccagcctcacttcctttgcccttcctcctgcctttctcaactgtcccaaggagggggcctcattgtgtctcccgtgcatgctctgcagcattgaagtatggtgtgttcacgtagttctagcagtccccagctgagtgagtgggagagtacctgtgtgtttcgtaacggccttgatccccttgatagatgtttggatattttttggtgtgccctgtgtgtgtgtgtgtacaaatacatgtgtatattccttttaaagaagctttatcgaacgtggtctgattttgaggtttagcaatagctagctatatatggtaggtgccgctacagtttttatttagcatggggattgcagagtgaccagcacactggactccgaggtggttcagacaagacagaggggagcagtggccatcatcctcccgccaggagcttcttcgttcctgcgcatatagactgtacgttatgaagaatacccaggaagactttgtgactgtcacttgctgctttttctgcgcttcagtaacaagtgttggcaaacgagactttctcctggcccctgcctgctggagatcagcatgcctgtcctttcagtctgatccatccatctctctcttgcctgaggggaaagagagatgggccaggcagagaacagaactggaggcagtccatctagggaatgggactgtgaggccatacttgtgaaacgtctggactgctattctagagcttttatttggtgtgttcgttgcacagctgtttgaaatgtttaataaagctttataaacttta

SEQ ID NO: 365398 - DNA, 1453 bp, Homo sapiens
ctcgactagaagactaagggggcgctccccggcttcctgcggcgtcggtggcgagctgaggtggaggcaggctgcggcagacggcgacagtggcggcggcgccatggcagggcttgcaggatccctgctgccttggtgatcccgggctgacagccagagagcacagcggctcagctcctggagagtgagggttgaagaaagcggagggcagccgcctgcgcccgctggctcccattaggtcggttcctgcagcggtgcccggcagccttggtgaaggccctgcccggcagagatcatgtattgcctccagtggctgctgcccgtcctcctcatccccaagcccctcaaccccgccctgtggttcagccactccatgttcatgggcttctacctgctcagcttcctcctggaacggaagccttgcacaatttgtgccttggttttcctggcagccctgttcttatctcgaatttgaagagattgctgacgcccgagagcctcgctttttcatccttctttccttgttcagcaggctagacagaaacatgtcttgactgttagttgtccacaaatcttcagtattttctccacttcatttttaagaaaggaagcaacagatagatgttgctctttcacctgggtgtctgggctcaagctttcccgcccagcctcacttcctttgcccttcctcctgcctttctcaactgtcccaaggagggggcctcattgtgtctcccgtgcatgctctgcagcattgaagtatggtgtgttcacgtagttctagcagtccccagctgagtgagtgggagagtacctgtgtgtttcgtaacggccttgatccccttgatagatgtttggatattttttggtgtgccctgtgtgtgtgtgtgtacaaatacatgtgtatattccttttaaagaagctttatcgaacgtggtctgattttgaggtttagcaatagctagctatatatggtaggtgccgctacagtttttatttagcatggggattgcagagtgaccagcacactggactccgaggtggttcagacaagacagaggggagcagtggccatcatcctcccgccaggagcttcttcgttcctgcgcatatagactgtacgttatgaagaatacccaggaagactttgtgactgtcacttgctgctttttctgcgcttcagtaacaagtgttggcaaacgagactttctcctggcccctgcctgctggagatcagcatgcctgtcctttcagtctgatccatccatctctctcttgcctgaggggaaagagagatgggccaggcagagaacagaactggaggcagtccatctagggaatgggactgtgaggccatacttgtgaaacgtctggactgctattctagagcttttatttggtgtgttcgttgcacagctgtttgaaatgtttaataaagctttataaacttta

SEQ ID NO: 365399 - DNA, 862 bp, Homo sapiens
cattaggctagtagaggccggtgttaatcggacgaggtctttcacctgggtgtctgggctcaagctttcccgcccagcctcacttcctttgcccttcctcctgcctttctcaactgtcccaaggagggggcctcattgtgtctcccgtgcatgctctgcagcattgaagtatggtgtgttcacgtagttctagcagtccccagctgagtgagtgggagagtacctgtgtgtttcgtaacggccttgatccccttgatagatgtttggatattttttggtgtgccctgtgtgtgtgtgtgtacaaatacatgtgtatattccttttaaagaagctttatcgaacgtggtctgattttgaggtttagcaatagctagctatatatggtaggtgccgctacagtttttatttagcatggggattgcagagtgaccagcacactggactccgaggtggttcagacaagacagaggggagcagtggccatcatcctcccgccaggagcttcttcgttcctgcgcatatagactgtacgttatgaagaatacccaggaagactttgtgactgtcacttgctgctttttctgcgcttcagtaacaagtgttggcaaacgagactttctcctggcccctgcctgctggagatcagcatgcctgtcctttcagtctgatccatccatctctctcttgcctgaggggaaagagagatgggccaggcagagaacagaactggaggcagtccatctagggaatgggactgtgaggccatacttgtgaaacgtctggactgctattctagagcttttatttggtgtgttcgttgcacagctgtttgaaatgtttaataaagctttataaacttta

SEQ ID NO: 365400 - DNA, 470 bp, Homo sapiens
cattaggctagtagaggccggtgttaatcggacgaggctgaggtggaggcaggctgcggcagacggcgacagtggcggcggcgccatggcagggcttgcaggatccctgctgccttggtgatcccgggctgacagccagagagcacagcggctcagctcctggagagtgagggttgaagaaagcggagggcagccgcctgcgcccgctggctcccattagcatggaggaatcgtgatgatggctgcagcccccagaaggtgaacttggcaggagctggctgagatgatttttctgctgatggtgaaatgtgctggcagagtctatacagcacctagcaacaggtagtaagctccttgggtgccgaatcagtattttctgccttggaatcaaatgtcagaagtcaacactcaaacttcttttgaccaaaaagattctacgacaattatccagaagttacaatgcaaggaag

SEQ ID NO: 365401 - DNA, 254 bp, Homo sapiens
tgtctgtctgtctgttctttgtctgtttgtctgttgtgttgacttttctcttcaggatccctgctgccttggtgatcccgggctgacagccagagagcacagcggctcagctcctggagagtgagggttgaagaaagcggagggcagccgcctgcgcccgctggctcccattaggtcggttcctgcagcggtgcccggcagccttggtgaaggccctgcccggcagagatcatgtattgcctccagtggctgct

SEQ ID NO: 365402 - DNA, 438 bp, Homo sapiens
tagtcgtgggtggtcttgtggttgtgtgtgttctgtccccatctaggtcctggctggccgcatgaccacccctctcgcctcattactgtgaggagtctgggtccatcctggtcagctgccccaatgtgacctggggcagataaaatgccagtctcattgtcacctctgtgacccctccttgtcagggtctccttccttcccagaatgttactgactcctcagtccctcttctggtttccctttatttctcttctacccttttccttttttggggagtacctgtccaagacagggctcatttttgcacttatctcgaatttgaagagattgctgacgcccgagagcctcgctttttcatccttctttccttgttcagcaggctagacagaaacatgtcttgactgttagttgtccacaaatcttcagtattttctccac

SEQ ID NO: 365403 - DNA, 451 bp, Homo sapiens
agtgctacctccactaacagggcacaccaaaaaaatatcccaacatctatcagacagaggggagcagtggccatcatcctcccgccaggagcttcttcgttcctgcgcatatagactgtacgttatgaagaatacccaggaagactttgtgactgtcacttgctgctttttctgcgcttcagtaacaagtgttggcaaacgagactttctcctggcccctgcctgctggagatcagcatgcctgtcctttcagtctgatccatccatctctctcttgcctgaggggaaagagagatgggccaggcagagaacagaactggaggcagtccatctagggaatgggactgtgaggccatacttgtgaaacgtctggactgctattctagagcttttatttggtgtgttcgttgcacagctgtttgaaatgtttaataaagctttataaacttta

SEQ ID NO: 365404 - DNA, 2168 bp, Homo sapiens
cattaggctagtagaggccggtgttaatcggacgaggctgaggtggaggcaggctgcggcagacggcgacagtggcggcggcgccatggcagggcttgcaggggcgcgagttgggaaccctctcccacccgaaaccccgtcagacttacctgcagcagcacgcggaagatgtaccagccgatgatgagcagttcagccgaggccgccgccactgccgccatggttccaagaatggatccctgctgccttggtgatcccgggctgacagccagagagcacagcggctcagctcctggagagtgagggttgaagaaagcggagggcagccgcctgcgcccgctggctcccattaggtcggttcctgcagcggtgcccggcagccttggtgaaggccctgcccggcagagatcatgtattgcctccagtggctgctgcccgtcctcctcatccccaagcccctcaaccccgccctgtggttcagccactccatgttcatgggcttctacctgctcagcttcctcctggaacggaagccttgcacaatttgtgccttggttttcctggcagccctgttccttatctgctatagctgctggggaaactgtttcctgtaccactgctccgattccccgcttccagaatcggcgcatgatcccggcgttgtgggcacctaacggcctgccctgttagctttccaaggaagcagaagacgggaggggaggcattgacataggtcataaagcattggagtttcaaatcccgcagcctcgcgggtgtcacattcctgacggcgcctttttggcctgtgatgttttatccttacaatgtgaataatggcactgaccggtgcttttattgtaaagtcctatagtcgtgggtggtcttgtggttgtgtgtgttctgtccccatctaggtcctggctggccgcatgaccacccctctcgcctcattactgtgaggagtctgggtccatcctggtcagctgccccaatgtgacctggggcagataaaatgccagtctcattgtcacctctgtgacccctccttgtcagggtctccttccttcccagaatgttactgactcctcagtccctcttctggtttccctttatttctcttctacccttttccttttttggggagtacctgtccaagacagggctcatttttgcacttatctcgaatttgaagagattgctgacgcccgagagcctcgctttttcatccttctttccttgttcagcaggctagacagaaacatgtcttgactgttagttgtccacaaatcttcagtattttctccacttcatttttaagaaaggaagcaacagatagatgttgctctttcacctgggtgtctgggctcaagctttcccgcccagcctcacttcctttgcccttcctcctgcctttctcaactgtcccaaggagggggcctcattgtgtctcccgtgcatgctctgcagcattgaagtatggtgtgttcacgtagttctagcagtccccagctgagtgagtgggagagtacctgtgtgtttcgtaacggccttgatccccttgatagatgtttggatattttttggtgtgccctgtgtgtgtgtgtgtacaaatacatgtgtatattccttttaaagaagctttatcgaacgtggtctgattttgaggtttagcaatagctagctatatatggtaggtgccgctacagtttttatttagcatggggattgcagagtgaccagcacactggactccgaggtggttcagacaagacagaggggagcagtggccatcatcctcccgccaggagcttcttcgttcctgcgcatatagactgtacgttatgaagaatacccaggaagactttgtgactgtcacttgctgctttttctgcgcttcagtaacaagtgttggcaaacgagactttctcctggcccctgcctgctggagatcagcatgcctgtcctttcagtctgatccatccatctctctcttgcctgaggggaaagagagatgggccaggcagagaacagaactggaggcagtccatctagggaatgggactgtgaggccatacttgtgaaacgtctggactgctattctagagcttttatttggtgtgttcgttgcacagctgtttgaaatgtttaataaagctttataaacttta

SEQ ID NO: 365405 - DNA, 359 bp, Homo sapiens
  misc_feature (131)..(131): n is a, c, g, or t
  misc_feature (133)..(133): n is a, c, g, or t
  misc_feature (326)..(326): n is a, c, g, or t
  misc_feature (353)..(353): n is a, c, g, or t
caaagacacgccctccagccaccatgactggggggcttcggcagaacccggagaccaccatggcctcatttgggccacaagtgaaaaacatggttcaggctggagcttccgggacgcgggcggcacgctgngnggtctcgggaagggcgtgtctttgtcctgccctgcatccaacagatccagaggatctctctcaacacactgaccctcaatgtcaagagtgaaaaggtttacactcgccatggggtccccatctcagtcactggcattgcccaggtaaaaatccaggggggcaggaacaagggagatgttgggcggccgcaagnttatttcccttttagttgagggtttanttttag

SEQ ID NO: 365406 - DNA, 300 bp, Homo sapiens
  misc_feature (31)..(31): n is a, c, g, or t
gcacgagcactgctatgattgccaactccancagtgtgaggttggcaaggggagcccttgccaacctcacactgctatgattgccaactccagcggtcccatgtcagccttctgatgatcccactccaccccacctcaacttatttaacttcctaattaaatcagactgtttgagcctgttgtctagaatattttcctgaccaagactgagggatgggctggaggttttcaactttgctacccaaataaattgctgtaagtaagtactaataaaacagaagcaactggaaattaaaaaaa

SEQ ID NO: 365407 - DNA, 171 bp, Homo sapiens
  misc_feature (31)..(31): n is a, c, g, or t
gcacgagcactgctatgattgccaactccancagtgtgaggttggcaaggggagcccttgccaacctcacactgctatgattgccaactccagcggtcccatgtcagccttctgatgatcccactccaccccacctcaacttatttaacttcctaattaaatcagactgtt

SEQ ID NO: 365408 - DNA, 1450 bp, Homo sapiens
tcatccacgcgttggtgagctctccatattgtcgagctgcaggaggtcgcgaattcactagtgattagagactgcgaggatcgcccggcgggagaaggagctggaggcccgggtgcggaagccagcggaagcggagcgctacaagctggagcgcctagccgaggcagagaagtcccaactaattatgcaggcggaggcagaagccgcgtctgtgcggatgcgtggggaagctgaggcctttgccataggggcccgagcccgagccgaggctgagcagatggccaagaaggcagaagccttccagctgtaccaagaggctgctcagctggacatgctgctagagaagctgccccaggtggcagaggagatcagtggtcccttgacttcagccaataagatcacactggtgtccagcggcagtgggaccatgggggcagccaaagtgactggggaagtactggacattctaactcgcctgccagagagtgtggaaagactcacaggcgtgagcatctcccaggtgaggtctcaggttggagctgaggagaattgctaggttcctgtgttgtgtgacacagtatgcctagcatttaaccagcatccaggcctgggagtcattgatgtttattaatcactttctgtgtgccagacacagtgctaagcttctacataaatgagttgttttaaatcaaactaccattagggtatataggattttacaaagtccagaaactcaacatccagcatgttcctactcattctgctagtgcagctggagtgaaatccaggtcgactgtctctgcaacctgtgcttgtggtcaccccactagtatagggaactagttgcagcctattgacagttaattaattctagggcatatcactgcttttctcagcgccccagttaattcacctgtagatcatggtagaagtcagcaaacaggctctggaaccactgttttgttgcgaatcctagctacaatgcctgctagctgtaatcttggacaagtaatcaacctctctatacctgtttcctcatcttaaaattgggttaataattagaaactaccctgttgaattgttgaggggctcgagcaaatatttgcagtgtttagaatagtgcctggtatatagtaagcattatgtgtatgttaaagaaatggggccaggtgcagtggcttacgcctgtaatcccagcactttgggaggctgaggcaggcagatcacctgaggttaggagttggagaccagcctggccaacatggtgaaacaccatctttactaaaaatacaaaaaaaaattagccaggcttggtggtgcatgcctgtaatctcagctactcgggaagctgaggcaggagaattgctggaacccaggagccgaaggttgcagtgagctgagatcacaccactgcactccagcctgggtgacagaataagactctatctca

SEQ ID NO: 365409 - DNA, 2513 bp, Homo sapiens
  misc_feature (7)..(7): n is a, c, g, or t
  misc_feature (35)..(35): n is a, c, g, or t
  misc_feature (46)..(46): n is a, c, g, or t
  misc_feature (78)..(79): n is a, c, g, or t
ggaaaanagcttatgaacatgaattacgaaatttnaatacgactcnactaatagggaaatttgccctcgaggcccaannaattcggcacgagggtctgcgagcggcccctgcccggctcccaggtccctgcgcgaccccgcccttcccgagaccccagccgggctgccgcccgcgtcccggaaggtgagtgggggaggggagatggagcctggggctgccgagaagcagggagagaggggaaagctccagcctgaaccatgtttttcacttgtggcccaaatgaggccatggtggtctccggtaagtactgttgttcccttcccagccagtgaccccagaacccctgtgagtctggcctctgccccttctccctctccctaccaacttcccagcaccagacttctgccccttgatggccacgaactgcccagtttgattcccaccattccaaggcccagactgcttcccctccagctcccagattctctcctgtgggttgtgtcccctcacccccgccagttcctcagtcttccacattcaagctctgccaccgttcctcactgccccacaccttgcaggggttctgccgaagccccccagtcatggtggctggagggcgtgtctttgtcctgccctgcatccaacagatccagaggatctctctcaacacactgaccctcaatgtcaagagtgaaaaggtttacactcgccatggggtccccatctcagtcactggcattgcccaggtgaagctttcagagccttttccccacagtccacttccccatcaccctctctcccagacattaagacatcttctggccacagtcttctcaacccttgcctgcagagaagttcctctgctagtctcatcttttccaggcaccccaaggcacttgcctcctcctcctttctttccctgaaatggaagaagcatttcttagagggctctcccttctctctctgctttttctctgacttcatgagacccccaccacacctttcctacccctactctggctacaggtaaaaatccaggggcagaacaaggagatgttggcggccgcctgtcagatgttcctggggaagacggaggctgagattgcccacattgccctggagacgttagagggccaccagagggccatcatggcccacatgactgtggaggagatctataaggacaggcagaaattctcagaacaggttttcaaagtggcctcctcagacctggtcaacatgggcatcagtgtggttagctacactctgaaggacattcacgatgaccaggactatttgcactctttggggaaggctcgaacagctcaagtccaaaaagatgcacggattggagaagcagaggccaagagagatgctgggatccgggaagctaaagccaagcaggaaaaggtgtctgctcagtacctgagtgagatcgagatggccaaggcacagagagattacgaactgaagaaggccgcctatgacatcgaggtcaacacccgccgagcacaggctgacctggcctatcagcttcaggtggccaagactaagcagcagattgaggagcagcgggtgcaggtgcaggtggtggagcgggcccagcaggtggcagtgcaggagcaggagatcgcccggcgggagaaggagctggaggcccgggtgcggaagccagcggaagcggagcgctacaagctggagcgcctagccgaggcagagaagtcccaactaattatgcaggcggaggcagaagccgcgtctgtgcggatgcgtggggaagctgaggcctttgccataggggcccgagcccgagccgaggctgagcagatggccaagaaggcagaagccttccagctgtaccaagaggctgctcagctggacatgctgctagagaagctgccccaggtggcagaggagatcagtggtcccttgacttcagccaataagatcacactggtgtccagcggcagtgggaccatgggggcagccaaagtgactggggaagtactggacattctaactcgcctgccagagagtgtggaaagactcacaggcgtgagcatctcccaggtgaatcacaagcctttgagaacagcctgagccttcagccctcacagatgcccagcctcatagctgaagttgcctgaatgatcctcctgttgcatgtaacccactggcctccctgagcatgtccattgacagtgaggtcccacccctcatctctccttgccaaatagtttgtgccttgtcttgaagggggttgctccccttgccaacctcacactgctatgattgccaactccagcggtcccatgtcagccttctgatgatcccactccaccccacctcaacttatttaacttcctaattaaatcagactgtttgagcctgttgtctagaatattttcctgaccaagactgagggatgggctggaggttttcaactttgctacccaaataaattgctgtaagtaagtactaataaaacagaagcaactggaaattaaaaaaa

SEQ ID NO: 365410 - DNA, 2600 bp, Homo sapiens
  misc_feature (7)..(7): n is a, c, g, or t
  misc_feature (35)..(35): n is a, c, g, or t
  misc_feature (46)..(46): n is a, c, g, or t
  misc_feature (78)..(79): n is a, c, g, or t
ggaaaanagcttatgaacatgaattacgaaatttnaatacgactcnactaatagggaaatttgccctcgaggcccaannaattcggcacgagggtctgcgagcggcccctgcccggctcccaggtccctgcgcgaccccgcccttcccgagaccccagccgggctgccgcccgcgtcccggaaggtgagtgggggaggggagatggagcctggggctgccgagaagcagggagagaggggaaagctccagcctgaaccatgtttttcacttgtggcccaaatgaggccatggtggtctccggtaagtactgttgttcccttcccagccagtgaccccagaacccctgtgagtctggcctctgccccttctccctctccctaccaacttcccagcaccagacttctgccccttgatggccacgaactgcccagtttgattcccaccattccaaggcccagactgcttcccctccagctcccagattctctcctgtgggttgtgtcccctcacccccgccagttcctcagtcttccacattcaagctctgccaccgttcctcactgccccacaccttgcaggggttctgccgaagccccccagtcatggtggctggagggcgtgtctttgtcctgccctgcatccaacagatccagaggtaggcaagaagggaaccagggaagggggacctccgttttctctttttcctcctcttcttactgtctgtcccttctttttcccctaggatctctctcaacacactgaccctcaatgtcaagagtgaaaaggtttacactcgccatggggtccccatctcagtcactggcattgcccaggtgaagctttcagagccttttccccacagtccacttccccatcaccctctctcccagacattaagacatcttctggccacagtcttctcaacccttgcctgcagagaagttcctctgctagtctcatcttttccaggcaccccaaggcacttgcctcctcctcctttctttccctgaaatggaagaagcatttcttagagggctctcccttctctctctgctttttctctgacttcatgagacccccaccacacctttcctacccctactctggctacaggtaaaaatccaggggcagaacaaggagatgttggcggccgcctgtcagatgttcctggggaagacggaggctgagattgcccacattgccctggagacgttagagggccaccagagggccatcatggcccacatgactgtggaggagatctataaggacaggcagaaattctcagaacaggttttcaaagtggcctcctcagacctggtcaacatgggcatcagtgtggttagctacactctgaaggacattcacgatgaccaggactatttgcactctttggggaaggctcgaacagctcaagtccaaaaagatgcacggattggagaagcagaggccaagagagatgctgggatccgggaagctaaagccaagcaggaaaaggtgtctgctcagtacctgagtgagatcgagatggccaaggcacagagagattacgaactgaagaaggccgcctatgacatcgaggtcaacacccgccgagcacaggctgacctggcctatcagcttcaggtggccaagactaagcagcagattgaggagcagcgggtgcaggtgcaggtggtggagcgggcccagcaggtggcagtgcaggagcaggagatcgcccggcgggagaaggagctggaggcccgggtgcggaagccagcggaagcggagcgctacaagctggagcgcctagccgaggcagagaagtcccaactaattatgcaggcggaggcagaagccgcgtctgtgcggatgcgtggggaagctgaggcctttgccataggggcccgagcccgagccgaggctgagcagatggccaagaaggcagaagccttccagctgtaccaagaggctgctcagctggacatgctgctagagaagctgccccaggtggcagaggagatcagtggtcccttgacttcagccaataagatcacactggtgtccagcggcagtgggaccatgggggcagccaaagtgactggggaagtactggacattctaactcgcctgccagagagtgtggaaagactcacaggcgtgagcatctcccaggtgaatcacaagcctttgagaacagcctgagccttcagccctcacagatgcccagcctcatagctgaagttgcctgaatgatcctcctgttgcatgtaacccactggcctccctgagcatgtccattgacagtgaggtcccacccctcatctctccttgccaaatagtttgtgccttgtcttgaagggggttgctccccttgccaacctcacactgctatgattgccaactccagcggtcccatgtcagccttctgatgatcccactccaccccacctcaacttatttaacttcctaattaaatcagactgtttgagcctgttgtctagaatattttcctgaccaagactgagggatgggctggaggttttcaactttgctacccaaataaattgctgtaagtaagtactaataaaacagaagcaactggaaattaaaaaaa

SEQ ID NO: 365411 - DNA, 2105 bp, Homo sapiens
  misc_feature (7)..(7): n is a, c, g, or t
  misc_feature (35)..(35): n is a, c, g, or t
  misc_feature (46)..(46): n is a, c, g, or t
  misc_feature (78)..(79): n is a, c, g, or t
ggaaaanagcttatgaacatgaattacgaaatttnaatacgactcnactaatagggaaatttgccctcgaggcccaannaattcggcacgagggtctgcgagcggcccctgcccggctcccaggtccctgcgcgaccccgcccttcccgagaccccagccgggctgccgcccgcgtcccggaaggtgagtgggggaggggagatggagcctggggctgccgagaagcagggagagaggggaaagctccagcctgaaccatgtttttcacttgtggcccaaatgaggccatggtggtctccgggttctgccgaagccccccagtcatggtggctggagggcgtgtctttgtcctgccctgcatccaacagatccagaggatctctctcaacacactgaccctcaatgtcaagagtgaaaaggtttacactcgccatggggtccccatctcagtcactggcattgcccaggtgaagctttcagagccttttccccacagtccacttccccatcaccctctctcccagacattaagacatcttctggccacagtcttctcaacccttgcctgcagagaagttcctctgctagtctcatcttttccaggcaccccaaggcacttgcctcctcctcctttctttccctgaaatggaagaagcatttcttagagggctctcccttctctctctgctttttctctgacttcatgagacccccaccacacctttcctacccctactctggctacaggtaaaaatccaggggcagaacaaggagatgttggcggccgcctgtcagatgttcctggggaagacggaggctgagattgcccacattgccctggagacgttagagggccaccagagggccatcatggcccacatgactgtggaggagatctataaggacaggcagaaattctcagaacaggttttcaaagtggcctcctcagacctggtcaacatgggcatcagtgtggttagctacactctgaaggacattcacgatgaccaggactatttgcactctttggggaaggctcgaacagctcaagtccaaaaagatgcacggattggagaagcagaggccaagagagatgctgggatccgggaagctaaagccaagcaggaaaaggtgtctgctcagtacctgagtgagatcgagatggccaaggcacagagagattacgaactgaagaaggccgcctatgacatcgaggtcaacacccgccgagcacaggctgacctggcctatcagcttcaggtggccaagactaagcagcagattgaggagcagcgggtgcaggtgcaggtggtggagcgggcccagcaggtggcagtgcaggagcaggagatcgcccggcgggagaaggagctggaggcccgggtgcggaagccagcggaagcggagcgctacaagctggagcgcctagccgaggcagagaagtcccaactaattatgcaggcggaggcagaagccgcgtctgtgcggatgcgtggggaagctgaggcctttgccataggggcccgagcccgagccgaggctgagcagatggccaagaaggcagaagccttccagctgtaccaagaggctgctcagctggacatgctgctagagaagctgccccaggtggcagaggagatcagtggtcccttgacttcagccaataagatcacactggtgtccagcggcagtgggaccatgggggcagccaaagtgactggggaagtactggacattctaactcgcctgccagagagtgtggaaagactcacaggcgtgagcatctcccaggtgaatcacaagcctttgagaacagcctgagccttcagccctcacagatgcccagcctcatagctgaagttgcctgaatgatcctcctgttgcatgtaacccactggcctccctgagcatgtccattgacagtgaggtcccacccctcatctctccttgccaaatagtttgtgccttgtcttgaagggggttgctccccttgccaacctcacactgctatgattgccaactccagcggtcccatgtcagccttctgatgatcccactccaccccacctcaacttatttaacttcctaattaaatcagactgtt

SEQ ID NO: 365412 - DNA, 2472 bp, Homo sapiens
  misc_feature (7)..(7): n is a, c, g, or t
  misc_feature (35)..(35): n is a, c, g, or t
  misc_feature (46)..(46): n is a, c, g, or t
  misc_feature (78)..(79): n is a, c, g, or t
ggaaaanagcttatgaacatgaattacgaaatttnaatacgactcnactaatagggaaatttgccctcgaggcccaannaattcggcacgagggtctgcgagcggcccctgcccggctcccaggtccctgcgcgaccccgcccttcccgagaccccagccgggctgccgcccgcgtcccggaaggtgagtgggggaggggagatggagcctggggctgccgagaagcagggagagaggggaaagctccagcctgaaccatgtttttcacttgtggcccaaatgaggccatggtggtctccgggttctgccgaagccccccagtcatggtggctggagggcgtgtctttgtcctgccctgcatccaacagatccagaggatctctctcaacacactgaccctcaatgtcaagagtgaaaaggtttacactcgccatggggtccccatctcagtcactggcattgcccaggtgaagctttcagagccttttccccacagtccacttccccatcaccctctctcccagacattaagacatcttctggccacagtcttctcaacccttgcctgcagagaagttcctctgctagtctcatcttttccaggcaccccaaggcacttgcctcctcctcctttctttccctgaaatggaagaagcatttcttagagggctctcccttctctctctgctttttctctgacttcatgagacccccaccacacctttcctacccctactctggctacaggtaaaaatccaggggcagaacaaggagatgttggcggccgcctgtcagatgttcctggggaagacggaggctgagattgcccacattgccctggagacgttagagggccaccagagggccatcatggcccacatgactgtggaggagatctataaggacaggcagaaattctcagaacaggttttcaaagtggcctcctcagacctggtcaacatgggcatcagtgtggttagctacactctgaaggacattcacgatgaccaggactatttgcactctttggggaaggctcgaacagctcaagtccaaaaagatgcacggattggagaagcagaggccaagagagatgctgggatccgggaagctaaagccaagcaggaaaaggtgtctgctcagtacctgagtgagatcgagatggccaaggcacagagagattacgaactgaagaaggccgcctatgacatcgaggtcaacacccgccgagcacaggctgacctggcctatcagcttcaggtggccaagactaagcagcagattgaggagcagcgggtgcaggtgcaggtggtggagcgggcccagcaggtggcagtgcaggagcaggagatcgcccggcgggagaaggagctggaggcccgggtgcggaagccagcggaagcggagcgctacaagctggagcgcctagccgaggcagagaagtcccaactaattatgcaggcggaggcagaagccgcgtctgtgcggatgcgtggggaagctgaggcctttgccataggggcccgagcccgagccgaggctgagcagatggccaagaaggcagaagccttccagctgtaccaagaggctgctcagctggacatgctgctagagaagctgccccaggtggcagaggagatcagtggtcccttgacttcagccaataagatcacactggtgtccagcggcagtgggaccatgggggcagccaaagtgactggggaagtactggacattctaactcgcctgccagagagtgtggaaagactcacaggcgtgagcatctcccaggtgaatcacaagcctttgagaacagcctgagccttcagccctcacagatgcccagcctcatagctgaagttgcctgaatgatcctcctgttgcatgtaacccactggcctccctgagcatgtccattgacagtgaggtcccacccctcatctctccttgccaaatagtttgtgccttgtcttgaagggggttgctccccttgccaacctcacactgctatgattgccaactccagcggtcccatgtcagccttctgatgatcccactccaccccacctcaacttatttaacttcctaattaaatcagactgttaaaaaaaaaaaaaaaaaaaaaagaaaaaaaaaaaaaaaaaaaaaacaaacaaaacagtgtggcggcggcacgcctcgggccccggaagaaaacgtcttgcgaacaccattgcggtggtgggcggccggggcccccataatgatagcaaagaacacacgacgctggccacaagagagcgtgtgtatccaacgagagagaaaacgcgcgcgccaccagaaaacgcggcgcggggggagtattctcccacccacttataaaaaaaacgccccggggggcgccacccgcacgtcgttgtcgtcgacacaaaaacacacgagaggaggggcgctcccgcagggcgaacccaacgggggcgaaatcgacacac

SEQ ID NO: 365413 - DNA, 2425 bp, Homo sapiens
  misc_feature (7)..(7): n is a, c, g, or t
  misc_feature (35)..(35): n is a, c, g, or t
  misc_feature (46)..(46): n is a, c, g, or t
  misc_feature (78)..(79): n is a, c, g, or t
ggaaaanagcttatgaacatgaattacgaaatttnaatacgactcnactaatagggaaatttgccctcgaggcccaannaattcggcacgagggtctgcgagcggcccctgcccggctcccaggtccctgcgcgaccccgcccttcccgagaccccagccgggctgccgcccgcgtcccggaaggtgagtgggggaggggagatggagcctggggctgccgagaagcagggagagaggggaaagctccagcctgaaccatgtttttcacttgtggcccaaatgaggccatggtggtctccgggttctgccgaagccccccagtcatggtggctggagggcgtgtctttgtcctgccctgcatccaacagatccagaggatctctctcaacacactgaccctcaatgtcaagagtgaaaaggtttacactcgccatggggtccccatctcagtcactggcattgcccaggtgaagctttcagagccttttccccacagtccacttccccatcaccctctctcccagacattaagacatcttctggccacagtcttctcaacccttgcctgcagagaagttcctctgctagtctcatcttttccaggcaccccaaggcacttgcctcctcctcctttctttccctgaaatggaagaagcatttcttagagggctctcccttctctctctgctttttctctgacttcatgagacccccaccacacctttcctacccctactctggctacaggtaaaaatccaggggcagaacaaggagatgttggcggccgcctgtcagatgttcctggggaagacggaggctgagattgcccacattgccctggagacgttagagggccaccagagggccatcatggcccacatgactgtggaggagatctataaggacaggcagaaattctcagaacaggttttcaaagtggcctcctcagacctggtcaacatgggcatcagtgtggttagctacactctgaaggacattcacgatgaccaggactatttgcactctttggggaaggctcgaacagctcaagtccaaaaagatgcacggattggagaagcagaggccaagagagatgctgggatccgggaagctaaagccaagcaggaaaaggtgtctgctcagtacctgagtgagatcgagatggccaaggcacagagagattacgaactgaagaaggccgcctatgacatcgaggtcaacacccgccgagcacaggctgacctggcctatcagcttcaggtggccaagactaagcagcagattgaggagcagcgggtgcaggtgcaggtggtggagcgggcccagcaggtggcagtgcaggagcaggagatcgcccggcgggagaaggagctggaggcccgggtgcggaagccagcggaagcggagcgctacaagctggagcgcctagccgaggcagagaagtaaatgtcccctccctgaccctgcctagctcacttgccacctaggcaccccaagatggagtgctgaagccttcaccacctggactcctatggatttcaggtttcaggagcgtctgcctctgcagcactgggcctttctcctgggagtaagggctgctgggctccaccctccacttcccttctgtccacaggtcccaactaattatgcaggcggaggcagaagccgcgtctgtgcggatgcgtggggaagctgaggcctttgccataggggcccgagcccgagccgaggctgagcagatggccaagaaggcagaagccttccagctgtaccaagaggctgctcagctggacatgctgctagagaagctgccccaggtggcagaggagatcagtggtcccttgacttcagccaataagatcacactggtgtccagcggcagtgggaccatgggggcagccaaagtgactggggaagtactggacattctaactcgcctgccagagagtgtggaaagactcacaggcgtgagcatctcccaggtgaatcacaagcctttgagaacagcctgagccttcagccctcacagatgcccagcctcatagctgaagttgcctgaatgatcctcctgttgcatgtaacccactggcctccctgagcatgtccattgacagtgaggtcccacccctcatctctccttgccaaatagtttgtgccttgtcttgaagggggttgctccccttgccaacctcacactgctatgattgccaactccagcggtcccatgtcagccttctgatgatcccactccaccccacctcaacttatttaacttcctaattaaatcagactgtttgagcctgttgtctagaatattttcctgaccaagactgagggatgggctggaggttttcaactttgctacccaaataaattgctgtaagtaagtactaataaaacagaagcaactggaaattaaaaaaa

SEQ ID NO: 365414 - DNA, 2053 bp, Homo sapiens
  misc_feature (7)..(7): n is a, c, g, or t
  misc_feature (35)..(35): n is a, c, g, or t
  misc_feature (46)..(46): n is a, c, g, or t
  misc_feature (78)..(79): n is a, c, g, or t
ggaaaanagcttatgaacatgaattacgaaatttnaatacgactcnactaatagggaaatttgccctcgaggcccaannaattcggcacgagggtctgcgagcggcccctgcccggctcccaggtccctgcgcgaccccgcccttcccgagaccccagccgggctgccgcccgcgtcccggaaggtgagtgggggaggggagatggagcctggggctgccgagaagcagggagagaggggaaagctccagcctgaaccatgtttttcacttgtggcccaaatgaggccatggtggtctccgggttctgccgaagccccccagtcatggtggctggagggcgtgtctttgtcctgccctgcatccaacagatccagaggatctctctcaacacactgaccctcaatgtcaagagtgaaaaggtttacactcgccatggggtccccatctcagtcactggcattgcccaggtgaagctttcagagccttttccccacagtccacttccccatcaccctctctcccagacattaagacatcttctggccacagtcttctcaacccttgcctgcagagaagttcctctgctagtctcatcttttccaggcaccccaaggcacttgcctcctcctcctttctttccctgaaatggaagaagcatttcttagagggctctcccttctctctctgctttttctctgacttcatgagacccccaccacacctttcctacccctactctggctacaggtaaaaatccaggggcagaacaaggagatgttggcggccgcctgtcagatgttcctggggaagacggaggctgagattgcccacattgccctggagacgttagagggccaccagagggccatcatggcccacatgactgtggaggagatctataaggacaggcagaaattctcagaacaggttttcaaagtggcctcctcagacctggtcaacatgggcatcagtgtggttagctacactctgaaggacattcacgatgaccaggactatttgcactctttggggaaggctcgaacagctcaagtccaaaaagatgcacggattggagaagcagaggccaagagagatgctgggatccgggaagctaaagccaagcaggaaaaggtgtctgctcagtacctgagtgagatcgagatggccaaggcacagagagattacgaactgaagaaggccgcctatgacatcgaggtcaacacccgccgagcacaggctgacctggcctatcagcttcaggtggccaagactaagcagcagattgaggagcagcgggtgcaggtgcaggtggtggagcgggcccagcaggtggcagtgcaggagcaggagatcgcccggcgggagaaggagctggaggcccgggtgcggaagccagcggaagcggagcgctacaagctggagcgcctagccgaggcagagaagtcccaactaattatgcaggcggaggcagaagccgcgtctgtgcggatgcgtggggaagctgaggcctttgccataggggcccgagcccgagccgaggctgagcagatggccaagaaggcagaagccttccagctgtaccaagaggctgctcagctggacatgctgctagagaagctgccccaggtggcagaggagatcagtggtcccttgacttcagccaataagatcacactggtgtccagcggcagtgggaccatgggggcagccaaagtgactggggaagtactggacattctaactcgcctgccagagagtgtggaaagactcacaggcgtgagcatctcccaggtgaatcacaagcctttgagaacagcctgagccttcagccctcacagatgcccagcctcatagctgaagttgcctgaatgatcctcctgttgcatgtaacccactggcctccctgagcatgtccattgacagtgaggtcccacccctcatctctccttgccaaatagtttgtgccttgtcttgaagggggttgctccccttgccaacctcacactgctatgattgccattgggccagcgggggtacagagctcgagttcta

SEQ ID NO: 365415 - DNA, 2216 bp, Homo sapiens
  misc_feature (7)..(7): n is a, c, g, or t
  misc_feature (35)..(35): n is a, c, g, or t
  misc_feature (46)..(46): n is a, c, g, or t
  misc_feature (78)..(79): n is a, c, g, or t
ggaaaanagcttatgaacatgaattacgaaatttnaatacgactcnactaatagggaaatttgccctcgaggcccaannaattcggcacgagggtctgcgagcggcccctgcccggctcccaggtccctgcgcgaccccgcccttcccgagaccccagccgggctgccgcccgcgtcccggaaggtgagtgggggaggggagatggagcctggggctgccgagaagcagggagagaggggaaagctccagcctgaaccatgtttttcacttgtggcccaaatgaggccatggtggtctccgggttctgccgaagccccccagtcatggtggctggagggcgtgtctttgtcctgccctgcatccaacagatccagaggatctctctcaacacactgaccctcaatgtcaagagtgaaaaggtttacactcgccatggggtccccatctcagtcactggcattgcccaggtgaagctttcagagccttttccccacagtccacttccccatcaccctctctcccagacattaagacatcttctggccacagtcttctcaacccttgcctgcagagaagttcctctgctagtctcatcttttccaggcaccccaaggcacttgcctcctcctcctttctttccctgaaatggaagaagcatttcttagagggctctcccttctctctctgctttttctctgacttcatgagacccccaccacacctttcctacccctactctggctacaggtaaaaatccaggggcagaacaaggagatgttggcggccgcctgtcagatgttcctggggaagacggaggctgagattgcccacattgccctggagacgttagagggccaccagagggccatcatggcccacatgactgtggaggagatctataaggacaggcagaaattctcagaacaggttttcaaagtggcctcctcagacctggtcaacatgggcatcagtgtggttagctacactctgaaggacattcacgatgaccaggactatttgcactctttggggaaggctcgaacagctcaagtccaaaaagatgcacggattggagaagcagaggccaagagagatgctgggatccgggaagctaaagccaagcaggaaaaggtgtctgctcagtacctgagtgagatcgagatggccaaggcacagagagattacgaactgaagaaggccgcctatgacatcgaggtcaacacccgccgagcacaggctgacctggcctatcagcttcagcagattgaggagcagcgggtgcaggtgcaggtggtggagcgggcccagcaggtggcagtgcaggagcaggagatcgcccggcgggagaaggagctggaggcccgggtgcggaagccagcggaagcggagcgctacaagctggagcgcctagccgaggcagagaagtcccaactaattatgcaggcggaggcagaagccgcgtctgtgcggatgcgtggggaagctgaggcctttgccataggggcccgagcccgagccgaggctgagcagatggccaagaaggcagaagccttccagctgtaccaagaggctgctcagctggacatgctgctagagaagctgccccaggtggcagaggagatcagtggtcccttgacttcagccaataagatcacactggtgtccagcggcagtgggaccatgggggcagccaaagtgactggggaagtactggacattctaactcgcctgccagagagtgtggaaagactcacaggcgtgagcatctcccaggtgaatcacaagcctttgagaacagcctgagccttcagccctcacagatgcccagcctcatagctgaagttgcctgaatgatcctcctgttgcatgtaacccactggcctccctgagcatgtccattgacagtgaggtcccacccctcatctctccttgccaaatagtttgtgccttgtcttgaagggggttgctccccttgccaacctcacactgctatgattgccaactccagcggtcccatgtcagccttctgatgatcccactccaccccacctcaacttatttaacttcctaattaaatcagactgtttgagcctgttgtctagaatattttcctgaccaagactgagggatgggctggaggttttcaactttgctacccaaataaattgctgtaagtaagtactaataaaacagaagcaactggaaattaaaaaaa

SEQ ID NO: 365416 - DNA, 2321 bp, Homo sapiens
  misc_feature (7)..(7): n is a, c, g, or t
  misc_feature (35)..(35): n is a, c, g, or t
  misc_feature (46)..(46): n is a, c, g, or t
  misc_feature (78)..(79): n is a, c, g, or t
ggaaaanagcttatgaacatgaattacgaaatttnaatacgactcnactaatagggaaatttgccctcgaggcccaannaattcggcacgagggtctgcgagcggcccctgcccggctcccaggtccctgcgcgaccccgcccttcccgagaccccagccgggctgccgcccgcgtcccggaaggtgagtgggggaggggagatggagcctggggctgccgagaagcagggagagaggggaaagctccagcctgaaccatgtttttcacttgtggcccaaatgaggccatggtggtctccgggttctgccgaagccccccagtcatggtggctggagggcgtgtctttgtcctgccctgcatccaacagatccagaggatctctctcaacacactgaccctcaatgtcaagagtgaaaaggtttacactcgccatggggtccccatctcagtcactggcattgcccaggtgaagctttcagagccttttccccacagtccacttccccatcaccctctctcccagacattaagacatcttctggccacagtcttctcaacccttgcctgcagagaagttcctctgctagtctcatcttttccaggcaccccaaggcacttgcctcctcctcctttctttccctgaaatggaagaagcatttcttagagggctctcccttctctctctgctttttctctgacttcatgagacccccaccacacctttcctacccctactctggctacaggtaaaaatccaggggcagaacaaggagatgttggcggccgcctgtcagatgttcctggggaagacggaggctgagattgcccacattgccctggagacgttagagggccaccagagggccatcatggcccacatgactgtggaggagatctataaggacaggcagaaattctcagaacaggttttcaaagtggcctcctcagacctggtcaacatgggcatcagtgtggttagctacactctgaaggacattcacgatgaccaggtaaaactaggcaattgatccttccccacttccttgctcccatctcttaagccctccaaaggactaatttctacatctctcccacaggactatttgcactctttggggaaggctcgaacagctcaagtccaaaaagatgcacggattggagaagcagaggccaagagagatgctgggatccgggaagctaaagccaagcaggaaaaggtgtctgctcagtacctgagtgagatcgagatggccaaggcacagagagattacgaactgaagaaggccgcctatgacatcgaggtcaacacccgccgagcacaggctgacctggcctatcagcttcaggtggccaagactaagcagcagattgaggagcagcgggtgcaggtgcaggtggtggagcgggcccagcaggtggcagtgcaggagcaggagatcgcccggcgggagaaggagctggaggcccgggtgcggaagccagcggaagcggagcgctacaagctggagcgcctagccgaggcagagaagtcccaactaattatgcaggcggaggcagaagccgcgtctgtgcggatgcgtggggaagctgaggcctttgccataggggcccgagcccgagccgaggctgagcagatggccaagaaggcagaagccttccagctgtaccaagaggctgctcagctggacatgctgctagagaagctgccccaggtggcagaggagatcagtggtcccttgacttcagccaataagatcacactggtgtccagcggcagtgggaccatgggggcagccaaagtgactggggaagtactggacattctaactcgcctgccagagagtgtggaaagactcacaggcgtgagcatctcccaggtgaatcacaagcctttgagaacagcctgagccttcagccctcacagatgcccagcctcatagctgaagttgcctgaatgatcctcctgttgcatgtaacccactggcctccctgagcatgtccattgacagtgaggtcccacccctcatctctccttgccaaatagtttgtgccttgtcttgaagggggttgctccccttgccaacctcacactgctatgattgccaactccagcggtcccatgtcagccttctgatgatcccactccaccccacctcaacttatttaacttcctaattaaatcagactgtttgagcctgttgtctagaatattttcctgaccaagactgagggatgggctggaggttttcaactttgctacccaaataaattgctgtaagtaagtactaataaaacagaagcaactggaaattaaaaaaa

SEQ ID NO: 365417 - DNA, 2271 bp, Homo sapiens
  misc_feature (7)..(7): n is a, c, g, or t
  misc_feature (35)..(35): n is a, c, g, or t
  misc_feature (46)..(46): n is a, c, g, or t
  misc_feature (78)..(79): n is a, c, g, or t
  misc_feature (1154)..(1154): n is a, c, g, or t
  misc_feature (1166)..(1166): n is a, c, g, or t
ggaaaanagcttatgaacatgaattacgaaatttnaatacgactcnactaatagggaaatttgccctcgaggcccaannaattcggcacgagggtctgcgagcggcccctgcccggctcccaggtccctgcgcgaccccgcccttcccgagaccccagccgggctgccgcccgcgtcccggaaggtgagtgggggaggggagatggagcctggggctgccgagaagcagggagagaggggaaagctccagcctgaaccatgtttttcacttgtggcccaaatgaggccatggtggtctccgggttctgccgaagccccccagtcatggtggctggagggcgtgtctttgtcctgccctgcatccaacagatccagaggatctctctcaacacactgaccctcaatgtcaagagtgaaaaggtttacactcgccatggggtccccatctcagtcactggcattgcccaggtgaagctttcagagccttttccccacagtccacttccccatcaccctctctcccagacattaagacatcttctggccacagtcttctcaacccttgcctgcagagaagttcctctgctagtctcatcttttccaggcaccccaaggcacttgcctcctcctcctttctttccctgaaatggaagaagcatttcttagagggctctcccttctctctctgctttttctctgacttcatgagacccccaccacacctttcctacccctactctggctacaggtaaaaatccaggggcagaacaaggagatgttggcggccgcctgtcagatgttcctggggaagacggaggctgagattgcccacattgccctggagacgttagagggccaccagagggccatcatggcccacatgactgtggaggagatctataaggacaggcagaaattctcagaacaggttttcaaagtggcctcctcagacctggtcaacatgggcatcagtgtggttagctacactctgaaggacattcacgatgaccaggactatttgcactctttggggaaggctcgaacagctcaagtccaaaaagatgcacggattggagaagcagaggccaagagagatgctgggatccggaagctaaagccaacgcatggggggaacacacaggggtgtctgctcnatgtacctgagntttggaaagggcaaatttcccggaacggcaatgggcccaagggcacagagagattacgaactgaagaaggccgcctatgacatcgaggtcaacacccgccgagcacaggctgacctggcctatcagcttcaggtggccaagactaagcagcagattgaggagcagcgggtgcaggtgcaggtggtggagcgggcccagcaggtggcagtgcaggagcaggagatcgcccggcgggagaaggagctggaggcccgggtgcggaagccagcggaagcggagcgctacaagctggagcgcctagccgaggcagagaagtcccaactaattatgcaggcggaggcagaagccgcgtctgtgcggatgcgtggggaagctgaggcctttgccataggggcccgagcccgagccgaggctgagcagatggccaagaaggcagaagccttccagctgtaccaagaggctgctcagctggacatgctgctagagaagctgccccaggtggcagaggagatcagtggtcccttgacttcagccaataagatcacactggtgtccagcggcagtgggaccatgggggcagccaaagtgactggggaagtactggacattctaactcgcctgccagagagtgtggaaagactcacaggcgtgagcatctcccaggtgaatcacaagcctttgagaacagcctgagccttcagccctcacagatgcccagcctcatagctgaagttgcctgaatgatcctcctgttgcatgtaacccactggcctccctgagcatgtccattgacagtgaggtcccacccctcatctctccttgccaaatagtttgtgccttgtcttgaagggggttgctccccttgccaacctcacactgctatgattgccaactccagcggtcccatgtcagccttctgatgatcccactccaccccacctcaacttatttaacttcctaattaaatcagactgtttgagcctgttgtctagaatattttcctgaccaagactgagggatgggctggaggttttcaactttgctacccaaataaattgctgtaagtaagtactaataaaacagaagcaactggaaattaaaaaaa

SEQ ID NO: 365418 - DNA, 2722 bp, Homo sapiens
  misc_feature (7)..(7): n is a, c, g, or t
  misc_feature (35)..(35): n is a, c, g, or t
  misc_feature (46)..(46): n is a, c, g, or t
  misc_feature (78)..(79): n is a, c, g, or t
ggaaaanagcttatgaacatgaattacgaaatttnaatacgactcnactaatagggaaatttgccctcgaggcccaannaattcggcacgagggtctgcgagcggcccctgcccggctcccaggtccctgcgcgaccccgcccttcccgagaccccagccgggctgccgcccgcgtcccggaaggtgagtgggggaggggagatggagcctggggctgccgagaagcagggagagaggggaaagctccagcctgaaccatgtttttcacttgtggcccaaatgaggccatggtggtctccgggttctgccgaagccccccagtcatggtggctggagggcgtgtctttgtcctgccctgcatccaacagatccagaggatctctctcaacacactgaccctcaatgtcaagagtgaaaaggtttacactcgccatggggtccccatctcagtcactggcattgcccaggtgaagctttcagagccttttccccacagtccacttccccatcaccctctctcccagacattaagacatcttctggccacagtcttctcaacccttgcctgcagagaagttcctctgctagtctcatcttttccaggcaccccaaggcacttgcctcctcctcctttctttccctgaaatggaagaagcatttcttagagggctctcccttctctctctgctttttctctgacttcatgagacccccaccacacctttcctacccctactctggctacaggtaaaaatccaggggcagaacaaggagatgttggcggccgcctgtcagatgttcctggggaagacggaggctgagattgcccacattgccctggagacgttagagggccaccagagggccatcatggcccacatgactgtggaggagatctataaggacaggcagaaattctcagaacaggttttcaaagtggcctcctcagacctggtcaacatgggcatcagtgtggttagctacactctgaaggacattcacgatgaccaggactatttgcactctttggggaaggctcgaacagctcaagtccaaaaagatgcacggattggagaagcagaggccaagagagatgctgggatccgggaagctaaagccaagcaggaaaaggtgtctgctcagtacctgagtgagatcgagatggccaaggcacagagagattacgaactgaagaaggccgcctatgacatcgaggtcaacacccgccgagcacaggctgacctggcctatcagcttcaggtggccaagactaagcagcagattgaggagcagcgggtgcaggtgcaggtggtggagcgggcccagcaggtggcagtgcaggagcaggagatcgcccggcgggagaaggagctggaggcccgggtgcggaagccagcggaagcggagcgctacaagctggagcgcctagccgaggcagagaagtcccaactaattatgcaggcggaggcagaagccgcgtctgtgcggatgcgtggggaagctgaggcctttgccataggggcccgagcccgagccgaggctgagcagatggccaagaaggcagaagccttccagctgtaccaagaggctgctcagctggacatgctgctagagaagctgccccaggtggcagaggagatcagtggtcccttgacttcagccaataagatcacactggtgtccagcggcagtgggaccatgggggcagccaaagtgactggggaagtactggacattctaactcgcctgccagagagtgtggaaagactcacaggcgtgagcatctcccaggtgaggtctcaggttggagctgaggagaattgctaggttcctgtgttgtgtgacacagtatgcctagcatttaaccagcatccaggcctgggagtcattgatgtttattaatcactttctgtgtgccagacacagtgctaagcttctacataaatgagttgttttaaatcaaactaccattagggtatataggattttacaaagtccagaaactcaacatccagcatgttcctactcattctgctagtgcagctggagtgaaatccaggtcgactgtctctgcaacctgtgcttgtggtcaccccactagtatagggaactagttgcagcctattgacagttaattaattctagggcatatcactgcttttctcagcgccccagttaattcacctgtagatcatggtagaagtcagcaaacaggctctggaaccactgttttgttgcgaatcctagctacaatgcctgctagctgtaatcttggacaagtaatcaacctctctatacctgtttcctcatcttaaaattgggttaataattagaaactaccctgttgaattgttgaggggctcgagcaaatatttgcagtgtttagaatagtgcctggtatatagtaagcattatgtgtatgttaaagaaatggggccaggtgcagtggcttacgcctgtaatcccagcactttgggaggctgaggcaggcagatcacctgaggttaggagttggagaccagcctggccaacatggtgaaacaccatctttactaaaaatacaaaaaaaaattagccaggcttggtggtgcatgcctgtaatctcagctactcgggaagctgaggcaggagaattgctggaacccaggagccgaaggttgcagtgagctgagatcacaccactgcactccagcctgggtgacagaataagactctatctca

SEQ ID NO: 365419 - DNA, 1868 bp, Homo sapiens
  misc_feature (7)..(7): n is a, c, g, or t
  misc_feature (35)..(35): n is a, c, g, or t
  misc_feature (46)..(46): n is a, c, g, or t
  misc_feature (78)..(79): n is a, c, g, or t
ggaaaanagcttatgaacatgaattacgaaatttnaatacgactcnactaatagggaaatttgccctcgaggcccaannaattcggcacgagggtctgcgagcggcccctgcccggctcccaggtccctgcgcgaccccgcccttcccgagaccccagccgggctgccgcccgcgtcccggaaggtgagtgggggaggggagatggagcctggggctgccgagaagcagggagagaggggaaagctccagcctgaaccatgtttttcacttgtggcccaaatgaggccatggtggtctccgggttctgccgaagccccccagtcatggtggctggagggcgtgtctttgtcctgccctgcatccaacagatccagaggatctctctcaacacactgaccctcaatgtcaagagtgaaaaggtttacactcgccatggggtccccatctcagtcactggcattgcccaggtgaagctttcagagccttttccccacagtccacttccccatcaccctctctcccagacattaagacatcttctggccacagtcttctcaacccttgcctgcagagaagttcctctgctagtctcatcttttccaggcaccccaaggcacttgcctcctcctcctttctttccctgaaatggaagaagcatttcttagagggctctcccttctctctctgctttttctctgacttcatgagacccccaccacacctttcctacccctactctggctacaggtaaaaatccaggggcagaacaaggagatgttggcggccgcctgtcagatgttcctggggaagacggaggctgagattgcccacattgccctggagacgttagagggccaccagagggccatcatggcccacatgactgtggaggagatctataaggacaggcagaaattctcagaacaggttttcaaagtggcctcctcagacctggtcaacatgggcatcagtgtggttagctacactctgaaggacattcacgatgaccaggactatttgcactctttggggaaggctcgaacagctcaagtccaaaaagatgcacggattggagaagcagaggccaagagagatgctgggatccgggaagctaaagccaagcaggaaaaggtgtctgctcagtacctgagtgagatcgagatggccaaggcacagagagattacgaactgaagaaggccgcctatgacatcgaggtcaacacccgccgagcacaggctgacctggcctatcagcttcaggtggcagaggagatcagtggtcccttgacttcagccaataagatcacactggtgtccagcggcagtgggaccatgggggcagccaaagtgactggggaagtactggacattctaactcgcctgccagagagtgtggaaagactcacaggcgtgagcatctcccaggtgaatcacaagcctttgagaacagcctgagccttcagccctcacagatgcccagcctcatagctgaagttgcctgaatgatcctcctgttgcatgtaacccactggcctccctgagcatgtccattgacagtgaggtcccacccctcatctctccttgccaaatagtttgtgccttgtcttgaagggggttgctccccttgccaacctcacactgctatgattgccaactccagcggtcccatgtcagccttctgatgatcccactccaccccacctcaacttatttaacttcctaattaaatcagactgtttgagcctgttgtctagaatattttcctgaccaagactgagggatgggctggaggttttcaactttgctacccaaataaattgctgtaagtaagtactaataaaacagaagcaactggaaattaaaaaaa

SEQ ID NO: 365420 - DNA, 1739 bp, Homo sapiens
  misc_feature (7)..(7): n is a, c, g, or t
  misc_feature (35)..(35): n is a, c, g, or t
  misc_feature (46)..(46): n is a, c, g, or t
  misc_feature (78)..(79): n is a, c, g, or t
ggaaaanagcttatgaacatgaattacgaaatttnaatacgactcnactaatagggaaatttgccctcgaggcccaannaattcggcacgagggtctgcgagcggcccctgcccggctcccaggtccctgcgcgaccccgcccttcccgagaccccagccgggctgccgcccgcgtcccggaaggtgagtgggggaggggagatggagcctggggctgccgagaagcagggagagaggggaaagctccagcctgaaccatgtttttcacttgtggcccaaatgaggccatggtggtctccgggttctgccgaagccccccagtcatggtggctggagggcgtgtctttgtcctgccctgcatccaacagatccagaggatctctctcaacacactgaccctcaatgtcaagagtgaaaaggtttacactcgccatggggtccccatctcagtcactggcattgcccaggtgaagctttcagagccttttccccacagtccacttccccatcaccctctctcccagacattaagacatcttctggccacagtcttctcaacccttgcctgcagagaagttcctctgctagtctcatcttttccaggcaccccaaggcacttgcctcctcctcctttctttccctgaaatggaagaagcatttcttagagggctctcccttctctctctgctttttctctgacttcatgagacccccaccacacctttcctacccctactctggctacaggtaaaaatccaggggcagaacaaggagatgttggcggccgcctgtcagatgttcctggggaagacggaggctgagattgcccacattgccctggagacgttagagggccaccagagggccatcatggcccacatgactgtggaggagatctataaggacaggcagaaattctcagaacaggttttcaaagtggcctcctcagacctggtcaacatgggcatcagtgtggttagctacactctgaaggacattcacgatgaccaggactatttgcactctttggggaaggctcgaacagctcaagtccaaaaagatgcacggattggagaagcagaggccaagagagatgctgggatccgggaagctaaagccaagcaggaaaaggtgtctgctcagtacctgagtgagatcgagatggccaaggcacagagagattacgaactgaagaaggccgcctatgacatcgaggtcaacacccgccgagcacaggctgacctggcctatcagcttcaggtggcagaggagatcagtggtcccttgacttcagccaataagatcacactggtgtccagcggcagtgggaccatgggggcagccaaagtgactggggaagtactggacattctaactcgcctgccagagagtgtggaaagactcacaggcgtgagcatctcccaggtgaatcacaagcctttgagaacagcctgagccttcagccctcacagatgcccagcctcatagctgaagttgcctgaatgatcctcctgttgcatgtaacccactggcctccctgagcatgtccattgacagtgaggtcccacccctcatctctccttgccaaatagtttgtgccttgtcttgaagggggttgctccccttgccaacctcacactgctatgattgccaactccagcggtcccatgtcagccttctgatgatcccactccaccccacctcaacttatttaacttcctaattaaatcagactgtt

SEQ ID NO: 365421 - DNA, 1467 bp, Homo sapiens
  misc_feature (7)..(7): n is a, c, g, or t
  misc_feature (35)..(35): n is a, c, g, or t
  misc_feature (46)..(46): n is a, c, g, or t
  misc_feature (78)..(79): n is a, c, g, or t
ggaaaanagcttatgaacatgaattacgaaatttnaatacgactcnactaatagggaaatttgccctcgaggcccaannaattcggcacgagggtctgcgagcggcccctgcccggctcccaggtccctgcgcgaccccgcccttcccgagaccccagccgggctgccgcccgcgtcccggaaggtgagtgggggaggggagatggagcctggggctgccgagaagcagggagagaggggaaagctccagcctgaaccatgtttttcacttgtggcccaaatgaggccatggtggtctccgggttctgccgaagccccccagtcatggtggctggagggcgtgtctttgtcctgccctgcatccaacagatccagaggatctctctcaacacactgaccctcaatgtcaagagtgaaaaggtttacactcgccatggggtccccatctcagtcactggcattgcccaggtgaagctttcagagccttttccccacagtccacttccccatcaccctctctcccagacattaagacatcttctggccacagtcttctcaacccttgcctgcagagaagttcctctgctagtctcatcttttccaggcaccccaaggcacttgcctcctcctcctttctttccctgaaatggaagaagcatttcttagagggctctcccttctctctctgctttttctctgacttcatgagacccccaccacacctttcctacccctactctggctacaggtaaaaatccaggggcagaacaaggagatgttggcggccgcctgtcagatgttcctggggaagacggaggctgagattgcccacattgccctggagacgttagagggccaccagagggccatcatggcccacatgactgtggaggagatctataaggacaggcagaaattctcagaacaggttttcaaagtggcctcctcagacctggtcaacatgggcatcagtgtggttagctacactctgaaggacattcacgatgaccaggactatttgcactctttggggaaggctcgaacagctcaagtccaaaaagatgcacggattggagaagcagaggccaagagagatgctgggatccgggaagctaaagccaagcaggaaaaggtgtctgctcagtacctgagtgagatcgagatggccaaggcacagagagattacgaactgaagaaggccgcctatgacatcgaggtcaacacccgccgagcacaggctgacctggcctatcagcttcaggtggccaagactaagcagcagattgaggagcagcgggtgcaggtgcaggtggtggagcgggcccagcaggtggcagtgcaggagcaggacccttgccaacctcacactgctatgattgccaactccagcggtcccatgtcagccttctgatgatcccactccaccccacctcaacttatttaacttcctaattaaatcagactgtt

SEQ ID NO: 365422 - DNA, 1319 bp, Homo sapiens
  misc_feature (7)..(7): n is a, c, g, or t
  misc_feature (35)..(35): n is a, c, g, or t
  misc_feature (46)..(46): n is a, c, g, or t
  misc_feature (78)..(79): n is a, c, g, or t
  misc_feature (1262)..(1262): n is a, c, g, or t
ggaaaanagcttatgaacatgaattacgaaatttnaatacgactcnactaatagggaaatttgccctcgaggcccaannaattcggcacgagggtctgcgagcggcccctgcccggctcccaggtccctgcgcgaccccgcccttcccgagaccccagccgggctgccgcccgcgtcccggaaggtgagtgggggaggggagatggagcctggggctgccgagaagcagggagagaggggaaagctccagcctgaaccatgtttttcacttgtggcccaaatgaggccatggtggtctccgggttctgccgaagccccccagtcatggtggctggagggcgtgtctttgtcctgccctgcatccaacagatccagaggatctctctcaacacactgaccctcaatgtcaagagtgaaaaggtttacactcgccatggggtccccatctcagtcactggcattgcccaggtgaagctttcagagccttttccccacagtccacttccccatcaccctctctcccagacattaagacatcttctggccacagtcttctcaacccttgcctgcagagaagttcctctgctagtctcatcttttccaggcaccccaaggcacttgcctcctcctcctttctttccctgaaatggaagaagcatttcttagagggctctcccttctctctctgctttttctctgacttcatgagacccccaccacacctttcctacccctactctggctacaggtaaaaatccaggggcagaacaaggagatgttggcggccgcctgtcagatgttcctggggaagacggaggctgagattgcccacattgccctggagacgttagagggccaccagagggccatcatggcccacatgactgtggaggagatctataaggacaggcagaaattctcagaacaggttttcaaagtggcctcctcagacctggtcaacatgggcatcagtgtggttagctacactctgaaggacattcacgatgaccaggactatttgcactctttggggaaggctcgaacagctcaagtccaaaaagatgcacggattggagaagcagaggccaagagagatgctgggatccgggaagctaaagccaagcaggaaaaggtgtctgctcagtacctgagtgagatcgagatggccaaggcacagagagattacgaactgaagaaggccgcctatgacatcgaggtcaacacccgccgagcacaggctgacctggcctatcagcttcagncaagactacacagatgaggacacggtcagtcagggatgacaccatggatcctctaat

SEQ ID NO: 365423 - DNA, 1659 bp, Homo sapiens
  misc_feature (7)..(7): n is a, c, g, or t
  misc_feature (35)..(35): n is a, c, g, or t
  misc_feature (46)..(46): n is a, c, g, or t
  misc_feature (78)..(79): n is a, c, g, or t
ggaaaanagcttatgaacatgaattacgaaatttnaatacgactcnactaatagggaaatttgccctcgaggcccaannaattcggcacgagggtctgcgagcggcccctgcccggctcccaggtccctgcgcgaccccgcccttcccgagaccccagccgggctgccgcccgcgtcccggaaggtgagtgggggaggggagatggagcctggggctgccgagaagcagggagagaggggaaagctccagcctgaaccatgtttttcacttgtggcccaaatgaggccatggtggtctccgggttctgccgaagccccccagtcatggtggctggagggcgtgtctttgtcctgccctgcatccaacagatccagaggatctctctcaacacactgaccctcaatgtcaagagtgaaaaggtttacactcgccatggggtccccatctcagtcactggcattgcccaggtgaagctttcagagccttttccccacagtccacttccccatcaccctctctcccagacattaagacatcttctggccacagtcttctcaacccttgcctgcagagaagttcctctgctagtctcatcttttccaggcaccccaaggcacttgcctcctcctcctttctttccctgaaatggaagaagcatttcttagagggctctcccttctctctctgctttttctctgacttcatgagacccccaccacacctttcctacccctactctggctacaggtaaaaatccaggggcagaacaaggagatgttggcggccgcctgtcagatgttcctggggaagacggaggctgagattgcccacattgccctggagacgttagagggccaccagagggccatcatggcccacatgactgtggaggagatctataaggacaggcagaaattctcagaacaggttttcaaagtggcctcctcagacctggtcaacatgggcatcagtgtggttagctacactctgaaggacattcacgatgaccaggactatttgcactctttggggaaggctcgaacagctcaagtccaaaaagatgcacggattggagaagcagaggccaagagagatgctgggatccgggaagctaaagccaagcaggaaaaggtgtctgctcagtacggaagtactggacattctaactcgcctgccagagagtgtggaaagactcacaggcgtgagcatctcccaggtgaatcacaagcctttgagaacagcctgagccttcagccctcacagatgcccagcctcatagctgaagttgcctgaatgatcctcctgttgcatgtaacccactggcctccctgagcatgtccattgacagtgaggtcccacccctcatctctccttgccaaatagtttgtgccttgtcttgaagggggttgctccccttgccaacctcacactgctatgattgccaactccagcggtcccatgtcagccttctgatgatcccactccaccccacctcaacttatttaacttcctaattaaatcagactgtttgagcctgttgtctagaatattttcctgaccaagactgagggatgggctggaggttttcaactttgctacccaaataaattgctgtaagtaagtactaataaaacagaagcaactggaaattaaaaaaa

SEQ ID NO: 365424 - DNA, 1229 bp, Homo sapiens
  misc_feature (7)..(7): n is a, c, g, or t
  misc_feature (35)..(35): n is a, c, g, or t
  misc_feature (46)..(46): n is a, c, g, or t
  misc_feature (78)..(79): n is a, c, g, or t
ggaaaanagcttatgaacatgaattacgaaatttnaatacgactcnactaatagggaaatttgccctcgaggcccaannaattcggcacgagggtctgcgagcggcccctgcccggctcccaggtccctgcgcgaccccgcccttcccgagaccccagccgggctgccgcccgcgtcccggaaggtgagtgggggaggggagatggagcctggggctgccgagaagcagggagagaggggaaagctccagcctgaaccatgtttttcacttgtggcccaaatgaggccatggtggtctccgggttctgccgaagccccccagtcatggtggctggagggcgtgtctttgtcctgccctgcatccaacagatccagaggatctctctcaacacactgaccctcaatgtcaagagtgaaaaggtttacactcgccatggggtccccatctcagtcactggcattgcccaggtgaagctttcagagccttttccccacagtccacttccccatcaccctctctcccagacattaagacatcttctggccacagtcttctcaacccttgcctgcagagaagttcctctgctagtctcatcttttccaggcaccccaaggcacttgcctcctcctcctttctttccctgaaatggaagaagcatttcttagagggctctcccttctctctctgctttttctctgacttcatgagacccccaccacacctttcctacccctactctggctacaggtaaaaatccaggggcagaacaaggagatgttggcggccgcctgtcagatgttcctggggaagacggaggctgagattgcccacattgccctggagacgttagagggccaccagagggccatcatggcccacatgactgtggaggttggcctaggggcagggaaccatctggaaggatgtcaaaatgaggggggcccaaggcccacactagtctgtgagagacagtggatccaagagcatacatcccggccgggcagggtggttcatgcctgtaatcccagcactttgggatgccaaggtgggcagatcacttgaggtcaggagttcgagaccagcctagccaacctggtgaaaccccttctctactacaaatacaaaaattagctgggtatggtgatgggtgtcggtaatcccagctacttgggaggctgaggcaggagaatcacttgaacccaggaggcagaggttgcagtgagcaaaa

SEQ ID NO: 365425 - DNA, 867 bp, Homo sapiens
  misc_feature (7)..(7): n is a, c, g, or t
  misc_feature (35)..(35): n is a, c, g, or t
  misc_feature (46)..(46): n is a, c, g, or t
  misc_feature (78)..(79): n is a, c, g, or t
ggaaaanagcttatgaacatgaattacgaaatttnaatacgactcnactaatagggaaatttgccctcgaggcccaannaattcggcacgagggtctgcgagcggcccctgcccggctcccaggtccctgcgcgaccccgcccttcccgagaccccagccgggctgccgcccgcgtcccggaaggtgagtgggggaggggagatggagcctggggctgccgagaagcagggagagaggggaaagctccagcctgaaccatgtttttcacttgtggcccaaatgaggccatggtggtctccgggttctgccgaagccccccagtcatggtggctggagggcgtgtctttgtcctgccctgcatccaacagatccagaggatctctctcaacacactgaccctcaatgtcaagagtgaaaaggtttacactcgccatggggtccccatctcagtcactggcattgcccaggtgaagctttcagagccttttccccacagtccacttccccatcaccctctctcccagacattaagacatcttctggccacaaccatctggaaggatgtcaaaatgaggggggcccaaggcccacactagtctgtgagagacagtggatccaagagcatacatcccggccgggcagggtggttcatgcctgtaatcccagcactttgggatgccaaggtgggcagatcacttgaggtcaggagttcgagaccagcctagccaacctggtgaaaccccttctctactacaaatacaaaaattagctgggtatggtgatgggtgtcggtaatcccagctacttgggaggctgaggcaggagaatcacttgaacccaggaggcagaggttgcagtgagcaaaa

SEQ ID NO: 365426 - DNA, 435 bp, Homo sapiens
gatctataaggacaggcagaaattctcagaacaggttttcaaagtggcctcctcagacctggtcaacatgggcatcagtgtggttagctacactctgaaggacattcacgatgaccaggtaaaactaggcaattgatccttccccacttccttgctcccatctcttaagccctccaaaggactaatttctacatctctcccacaggactatttgcactctttggggaaggctcgaacagctcaagtccaaaaagatgcacggattggagaagcagaggccaagagagatgctgggatccgggtgagagagatgggggttgcttagtgggaaaggggatagaagtggcacaactgagaagaagcaggggtgctgggtgagcagggaaaatacatgaggcagaaagagaaccttggtgggaagcaggctgtcaccgt

SEQ ID NO: 365427 - DNA, 460 bp, Homo sapiens
  misc_feature (11)..(11): n is a, c, g, or t
ggtgtgggtgntctagaggatcctccgctggccagtggcagaggagatcagtggtcccttgacttcagccaataagatcacactggtgtccagcggcagtgggaccatgggggcagccaaagtgactggggaagtactggacattctaactcgcctgccagagagtgtggaaagactcacaggcgtgagcatctcccaggtgaatcacaagcctttgagaacagcctgagccttcagccctcacagatgcccagcctcatagctgaagttgcctgaatgatcctcctgttgcatgtaacccactggcctccctgagcatgtccattgacagtgaggtcccacccctcatctctccttgccaaatagtttgtgccttgtcttgaagggggttgctccccttgccaacctcacactgctatgattgccattgggccagcgggggtacagagctcgagttcta

SEQ ID NO: 365428 - DNA, 2234 bp, Homo sapiens
  misc_feature (7)..(7): n is a, c, g, or t
  misc_feature (35)..(35): n is a, c, g, or t
  misc_feature (46)..(46): n is a, c, g, or t
  misc_feature (78)..(79): n is a, c, g, or t
ggaaaanagcttatgaacatgaattacgaaatttnaatacgactcnactaatagggaaatttgccctcgaggcccaannaattcggcacgagggtctgcgagcggcccctgcccggctcccaggtccctgcgcgaccccgcccttcccgagaccccagccgggctgccgcccgcgtcccggaaggtgagtgggggaggggagatggagcctggggctgccgagaagcagggagagaggggaaagctccagcctgaaccatgtttttcacttgtggcccaaatgaggccatggtggtctccgggttctgccgaagccccccagtcatggtggctggagggcgtgtctttgtcctgccctgcatccaacagatccagaggatctctctcaacacactgaccctcaatgtcaagagtgaaaaggtttacactcgccatggggtccccatctcagtcactggcattgcccaggtgaagctttcagagccttttccccacagtccacttccccatcaccctctctcccagacattaagacatcttctggccacagtcttctcaacccttgcctgcagagaagttcctctgctagtctcatcttttccaggcaccccaaggcacttgcctcctcctcctttctttccctgaaatggaagaagcatttcttagagggctctcccttctctctctgctttttctctgacttcatgagacccccaccacacctttcctacccctactctggctacaggtaaaaatccaggggcagaacaaggagatgttggcggccgcctgtcagatgttcctggggaagacggaggctgagattgcccacattgccctggagacgttagagggccaccagagggccatcatggcccacatgactgtggaggagatctataaggacaggcagaaattctcagaacaggttttcaaagtggcctcctcagacctggtcaacatgggcatcagtgtggttagctacactctgaaggacattcacgatgaccaggactatttgcactctttggggaaggctcgaacagctcaagtccaaaaagatgcacggattggagaagcagaggccaagagagatgctgggatccgggaagctaaagccaagcaggaaaaggtgtctgctcagtacctgagtgagatcgagatggccaaggcacagagagattacgaactgaagaaggccgcctatgacatcgaggtcaacacccgccgagcacaggctgacctggcctatcagcttcaggtggccaagactaagcagcagattgaggagcagcgggtgcaggtgcaggtggtggagcgggcccagcaggtggcagtgcaggagcaggagatcgcccggcgggagaaggagctggaggcccgggtgcggaagccagcggaagcggagcgctacaagctggagcgcctagccgaggcagagaagtcccaactaattatgcaggcggaggcagaagccgcgtctgtgcggatgcgtggggaagctgaggcctttgccataggggcccgagcccgagccgaggctgagcagatggccaagaaggcagaagccttccagctgtaccaagaggctgctcagctggacatgctgctagagaagctgccccaggtggcagaggagatcagtggtcccttgacttcagccaataagatcacactggtgtccagcggcagtgggaccatgggggcagccaaagtgactggggaagtactggacattctaactcgcctgccagagagtgtggaaagactcacaggcgtgagcatctcccaggtgaatcacaagcctttgagaacagcctgagccttcagccctcacagatgcccagcctcatagctgaagttgcctgaatgatcctcctgttgcatgtaacccactggcctccctgagcatgtccattgacagtgaggtcccacccctcatctctccttgccaaatagtttgtgccttgtcttgaagggggttgctccccttgccaacctcacactgctatgattgccaactccagcggtcccatgtcagccttctgatgatcccactccaccccacctcaacttatttaacttcctaattaaatcagactgtttgagcctgttgtctagaatattttcctgaccaagactgagggatgggctggaggttttcaactttgctacccaaataaattgctgtaagtaagtactaataaaacagaagcaactggaaattaaaaaaa

SEQ ID NO: 365429 - DNA, 1954 bp, Homo sapiens
  misc_feature (7)..(7): n is a, c, g, or t
  misc_feature (35)..(35): n is a, c, g, or t
  misc_feature (46)..(46): n is a, c, g, or t
  misc_feature (78)..(79): n is a, c, g, or t
ggaaaanagcttatgaacatgaattacgaaatttnaatacgactcnactaatagggaaatttgccctcgaggcccaannaattcggcacgagggtctgcgagcggcccctgcccggctcccaggtccctgcgcgaccccgcccttcccgagaccccagccgggctgccgcccgcgtcccggaaggtgagtgggggaggggagatggagcctggggctgccgagaagcagggagagaggggaaagctccagcctgaaccatgtttttcacttgtggcccaaatgaggccatggtggtctccgggttctgccgaagccccccagtcatggtggctggagggcgtgtctttgtcctgccctgcatccaacagatccagaggatctctctcaacacactgaccctcaatgtcaagagtgaaaaggtttacactcgccatggggtccccatctcagtcactggcattgcccaggtaaaaatccaggggcagaacaaggagatgttggcggccgcctgtcagatgttcctggggaagacggaggctgagattgcccacattgccctggagacgttagagggccaccagagggccatcatggcccacatgactgtggaggagatctataaggacaggcagaaattctcagaacaggttttcaaagtggcctcctcagacctggtcaacatgggcatcagtgtggttagctacactctgaaggacattcacgatgaccaggactatttgcactctttggggaaggctcgaacagctcaagtccaaaaagatgcacggattggagaagcagaggccaagagagatgctgggatccgggaagctaaagccaagcaggaaaaggtgtctgctcagtacctgagtgagatcgagatggccaaggcacagagagattacgaactgaagaaggccgcctatgacatcgaggtcaacacccgccgagcacaggctgacctggcctatcagcttcaggtggccaagactaagcagcagattgaggagcagcgggtgcaggtgcaggtggtggagcgggcccagcaggtggcagtgcaggagcaggagatcgcccggcgggagaaggagctggaggcccgggtgcggaagccagcggaagcggagcgctacaagctggagcgcctagccgaggcagagaagtcccaactaattatgcaggcggaggcagaagccgcgtctgtgcggatgcgtggggaagctgaggcctttgccataggggcccgagcccgagccgaggctgagcagatggccaagaaggcagaagccttccagctgtaccaagaggctgctcagctggacatgctgctagagaagctgccccaggtggcagaggagatcagtggtcccttgacttcagccaataagatcacactggtgtccagcggcagtgggaccatgggggcagccaaagtgactggggaagtactggacattctaactcgcctgccagagagtgtggaaagactcacaggcgtgagcatctcccaggtgaatcacaagcctttgagaacagcctgagccttcagccctcacagatgcccagcctcatagctgaagttgcctgaatgatcctcctgttgcatgtaacccactggcctccctgagcatgtccattgacagtgaggtcccacccctcatctctccttgccaaatagtttgtgccttgtcttgaagggggttgctccccttgccaacctcacactgctatgattgccaactccagcggtcccatgtcagccttctgatgatcccactccaccccacctcaacttatttaacttcctaattaaatcagactgtttgagcctgttgtctagaatattttcctgaccaagactgagggatgggctggaggttttcaactttgctacccaaataaattgctgtaagtaagtactaataaaacagaagcaactggaaattaaaaaaa

SEQ ID NO: 365430 - DNA, 2221 bp, Homo sapiens
  misc_feature (7)..(7): n is a, c, g, or t
  misc_feature (35)..(35): n is a, c, g, or t
  misc_feature (46)..(46): n is a, c, g, or t
  misc_feature (78)..(79): n is a, c, g, or t
ggaaaanagcttatgaacatgaattacgaaatttnaatacgactcnactaatagggaaatttgccctcgaggcccaannaattcggcacgagggtctgcgagcggcccctgcccggctcccaggtccctgcgcgaccccgcccttcccgagaccccagccgggctgccgcccgcgtcccggaaggtgagtgggggaggggagatggagcctggggctgccgagaagcagggagagaggggaaagctccagcctgaaccatgtttttcacttgtggcccaaatgaggccatggtggtctccgggttctgccgaagccccccagtcatggtggctggagggcgtgtctttgtcctgccctgcatccaacagatccagaggatctctctcaacacactgaccctcaatgtcaagagtgaaaaggtttacactcgccatggggtccccatctcagtcactggcattgcccaggtgaagctttcagagccttttccccacagtccacttccccatcaccctctctcccagacattaagacatcttctggccacagtcttctcaacccttgcctgcagagaagttcctctgctagtctcatcttttccaggcaccccaaggcacttgcctcctcctcctttctttccctgaaatggaagaagcatttcttagagggctctcccttctctctctgctttttctctgacttcatgagacccccaccacacctttcctacccctactctggctacaggtaaaaatccaggggcagaacaaggagatgttggcggccgcctgtcagatgttcctggggaagacggaggctgagattgcccacattgccctggagacgttagagggccaccagagggccatcatggcccacatgactgtggaggagatctataaggacaggcagaaattctcagaacaggttttcaaagtggcctcctcagacctggtcaacatgggcatcagtgtggttagctacactctgaaggacattcacgatgaccaggactatttgcactctttggggaaggctcgaacagctcaagtccaaaaagatgcacggattggagaagcagaggccaagagagatgctgggatccgggaagctaaagccaagcaggaaaaggtgtctgctcagtacctgagtgagatcgagatggccaaggcacagagagattacgaactgaagaaggccgcctatgacatcgaggtcaacacccgccgagcacaggctgacctggcctatcagcttcaggtggccaagactaagcagcagattgaggagcagcgggtgcaggtgcaggtggtggagcgggcccagcaggtggcagtgcaggagcaggagatcgcccggcgggagaaggagctggaggcccgggtgcggaagccagcggaagcggagcgctacaagctggagcgcctagccgaggcagagaagtcccaactaattatgcaggcggaggcagaagccgcgtctgtgcggatgcgtggggaagctgaggcctttgccataggggcccgagcccgagccgaggctgagcagatggccaagaaggcagaagccttccagctgtaccaagaggctgctcagctggacatgctgctagagaagctgccccaggtggcagaggagatcagtggtcccttgacttcagccaataagatcacactggtgtccagcggcagtgggaccatgggggcagccaaagtgactggggaagtactggacattctaactcgcctgccagagagtgtggaaagactcacaggcgtgagcatctcccaggtgaatcacaagcctttgagaacagcctgagccttcagccctcacagatgcccagcctcatagctgaagttgcctgaatgatcctcctgttgcatgtaacccactggcctccctgagcatgtccattgacagtgaggtcccacccctcatctctccttgccaaatagtttgtgccttgtcttgaagggggttgctccccttgccaacctcacactgctatgattgccaactccagcggtcccatgtcagccttctgatgatcccactccacccaactcattattacttctatttaaccatgtggcgacaaaaaaaaaaaatttggggccgccccgaaattaaactctgggcggcccaggaaaagcaccttcacaacgaggagggtccaaaacgggggggacaaggtgtcgtcagcggacacacgcacag

SEQ ID NO: 365431 - DNA, 2055 bp, Homo sapiens
  misc_feature (7)..(7): n is a, c, g, or t
  misc_feature (35)..(35): n is a, c, g, or t
  misc_feature (46)..(46): n is a, c, g, or t
  misc_feature (78)..(79): n is a, c, g, or t
ggaaaanagcttatgaacatgaattacgaaatttnaatacgactcnactaatagggaaatttgccctcgaggcccaannaattcggcacgagggtctgcgagcggcccctgcccggctcccaggtccctgcgcgaccccgcccttcccgagaccccagccgggctgccgcccgcgtcccggaaggtgagtgggggaggggagatggagcctggggctgccgagaagcagggagagaggggaaagctccagcctgaaccatgtttttcacttgtggcccaaatgaggccatggtggtctccgggttctgccgaagccccccagtcatggtggctggagggcgtgtctttgtcctgccctgcatccaacagatccagaggatctctctcaacacactgaccctcaatgtcaagagtgaaaaggtttacactcgccatggggtccccatctcagtcactggcattgcccaggtgaagctttcagagccttttccccacagtccacttccccatcaccctctctcccagacattaagacatcttctggccacagtcttctcaacccttgcctgcagagaagttcctctgctagtctcatcttttccaggcaccccaaggcacttgcctcctcctcctttctttccctgaaatggaagaagcatttcttagagggctctcccttctctctctgctttttctctgacttcatgagacccccaccacacctttcctacccctactctggctacaggtaaaaatccaggggcagaacaaggagatgttggcggccgcctgtcagatgttcctggggaagacggaggctgagattgcccacattgccctggagacgttagagggccaccagagggccatcatggcccacatgactgtggaggagatctataaggacaggcagaaattctcagaacaggttttcaaagtggcctcctcagacctggtcaacatgggcatcagtgtggttagctacactctgaaggacattcacgatgaccaggactatttgcactctttggggaaggctcgaacagctcaagtccaaaaagatgcacggattggagaagcagaggccaagagagatgctgggatccgggaagctaaagccaagcaggaaaaggtgtctgctcagtacctgagtgagatcgagatggccaaggcacagagagattacgaactgaagaaggccgcctatgacatcgaggtcaacacccgccgagcacaggctgacctggcctatcagcttcaggtggccaagactaagcagcagattgaggagcagcgggtgcaggtgcaggtggtggagcgggcccagcaggtggcagtgcaggagcaggacccgagccgaggctgagcagatggccaagaaggcagaagccttccagctgtaccaagaggctgctcagctggacatgctgctagagaagctgccccaggtggcagaggagatcagtggtcccttgacttcagccaataagatcacactggtgtccagcggcagtgggaccatgggggcagccaaagtgactggggaagtactggacattctaactcgcctgccagagagtgtggaaagactcacaggcgtgagcatctcccaggtgaatcacaagcctttgagaacagcctgagccttcagccctcacagatgcccagcctcatagctgaagttgcctgaatgatcctcctgttgcatgtaacccactggcctccctgagcatgtccattgacagtgaggtcccacccctcatctctccttgccaaatagtttgtgccttgtcttgaagggggttgctccccttgccaacctcacactgctatgattgccaactccagcggtcccatgtcagccttctgatgatcccactccaccccacctcaacttatttaacttcctaattaaatcagactgtttgagcctgttgtctagaatattttcctgaccaagactgagggatgggctggaggttttcaactttgctacccaaataaattgctgtaagtaagtactaataaaacagaagcaactggaaattaaaaaaa

SEQ ID NO: 365432 - DNA, 1686 bp, Homo sapiens
  misc_feature (7)..(7): n is a, c, g, or t
  misc_feature (35)..(35): n is a, c, g, or t
  misc_feature (46)..(46): n is a, c, g, or t
  misc_feature (78)..(79): n is a, c, g, or t
ggaaaanagcttatgaacatgaattacgaaatttnaatacgactcnactaatagggaaatttgccctcgaggcccaannaattcggcacgagggtctgcgagcggcccctgcccggctcccaggtccctgcgcgaccccgcccttcccgagaccccagccgggctgccgcccgcgtcccggaaggtgagtgggggaggggagatggagcctggggctgccgagaagcagggagagaggggaaagctccagcctgaaccatgtttttcacttgtggcccaaatgaggccatggtggtctccgggttctgccgaagccccccagtcatggtggctggagggcgtgtctttgtcctgccctgcatccaacagatccagaggatctctctcaacacactgaccctcaatgtcaagagtgaaaaggtttacactcgccatggggtccccatctcagtcactggcattgcccaggtaaaaatccaggggcagaacaaggagatgttggcggccgcctgtcagatgttcctggggaagacggaggctgagattgcccacattgccctggagacgttagagggccaccagagggccatcatggcccacatgactgtggaggagatctataaggacaggcagaaattctcagaacaggttttcaaagtggcctcctcagacctggtcaacatgggcatcagtgtggttagctacactctgaaggacattcacgatgaccaggactatttgcactctttggggaaggctcgaacagctcaagtccaaaaagatgcacggattggagaagcagaggccaagagagatgctgggatccgggaagctaaagccaagcaggaaaaggtgtctgctcagtacctgagtgagatcgagatggccaaggcacagagagattacgaactgaagaaggccgcctatgacatcgaggtcaacacccgccgagcacaggctgacctggcctatcagcttcagcccgagccgaggctgagcagatggccaagaaggcagaagccttccagctgtaccaagaggctgctcagctggacatgctgctagagaagctgccccaggtggcagaggagatcagtggtcccttgacttcagccaataagatcacactggtgtccagcggcagtgggaccatgggggcagccaaagtgactggggaagtactggacattctaactcgcctgccagagagtgtggaaagactcacaggcgtgagcatctcccaggtgaatcacaagcctttgagaacagcctgagccttcagccctcacagatgcccagcctcatagctgaagttgcctgaatgatcctcctgttgcatgtaacccactggcctccctgagcatgtccattgacagtgaggtcccacccctcatctctccttgccaaatagtttgtgccttgtcttgaagggggttgctccccttgccaacctcacactgctatgattgccaactccagcggtcccatgtcagccttctgatgatcccactccaccccacctcaacttatttaacttcctaattaaatcagactgtttgagcctgttgtctagaatattttcctgaccaagactgagggatgggctggaggttttcaactttgctacccaaataaattgctgtaagtaagtactaataaaacagaagcaactggaaattaaaaaaa

SEQ ID NO: 365433 - DNA, 1588 bp, Homo sapiens
  misc_feature (7)..(7): n is a, c, g, or t
  misc_feature (35)..(35): n is a, c, g, or t
  misc_feature (46)..(46): n is a, c, g, or t
  misc_feature (78)..(79): n is a, c, g, or t
ggaaaanagcttatgaacatgaattacgaaatttnaatacgactcnactaatagggaaatttgccctcgaggcccaannaattcggcacgagggtctgcgagcggcccctgcccggctcccaggtccctgcgcgaccccgcccttcccgagaccccagccgggctgccgcccgcgtcccggaaggtgagtgggggaggggagatggagcctggggctgccgagaagcagggagagaggggaaagctccagcctgaaccatgtttttcacttgtggcccaaatgaggccatggtggtctccgggttctgccgaagccccccagtcatggtggctggagggcgtgtctttgtcctgccctgcatccaacagatccagaggatctctctcaacacactgaccctcaatgtcaagagtgaaaaggtttacactcgccatggggtccccatctcagtcactggcattgcccaggtaaaaatccaggggcagaacaaggagatgttggcggccgcctgtcagatgttcctggggaagacggaggctgagattgcccacattgccctggagacgttagagggccaccagagggccatcatggcccacatgactgtggaggagatctataaggacaggcagaaattctcagaacaggttttcaaagtggcctcctcagacctggtcaacatgggcatcagtgtggttagctacactctgaaggacattcacgatgaccaggactatttgcactctttggggaaggctcgaacagctcaagtccaaaaagatgcacggattggagaagcagaggccaagagagatgctgggatccgggaagctaaagccaagcaggaaaaggtgtctgctcagtacctgagtgagatcgagatggccaaggcacagagagattacgaactgaagaaggccgcctatgacatcgaggtcaacacccgccgagcacaggctgacctggcctatcagcttcaggtggcagaggagatcagtggtcccttgacttcagccaataagatcacactggtgtccagcggcagtgggaccatgggggcagccaaagtgactggggaagtactggacattctaactcgcctgccagagagtgtggaaagactcacaggcgtgagcatctcccaggtgaatcacaagcctttgagaacagcctgagccttcagccctcacagatgcccagcctcatagctgaagttgcctgaatgatcctcctgttgcatgtaacccactggcctccctgagcatgtccattgacagtgaggtcccacccctcatctctccttgccaaatagtttgtgccttgtcttgaagggggttgctccccttgccaacctcacactgctatgattgccaactccagcggtcccatgtcagccttctgatgatcccactccaccccacctcaacttatttaacttcctaattaaatcagactgtttgagcctgttgtctagaatattttcctgaccaagactgagggatgggctggaggttttcaactttgctacccaaataaattgctgtaagtaagtactaataaaacagaagcaactggaaattaaaaaaa

SEQ ID NO: 365434 - DNA, 1733 bp, Homo sapiens
  misc_feature (7)..(7): n is a, c, g, or t
  misc_feature (35)..(35): n is a, c, g, or t
  misc_feature (46)..(46): n is a, c, g, or t
  misc_feature (78)..(79): n is a, c, g, or t
ggaaaanagcttatgaacatgaattacgaaatttnaatacgactcnactaatagggaaatttgccctcgaggcccaannaattcggcacgagggtctgcgagcggcccctgcccggctcccaggtccctgcgcgaccccgcccttcccgagaccccagccgggctgccgcccgcgtcccggaaggtgagtgggggaggggagatggagcctggggctgccgagaagcagggagagaggggaaagctccagcctgaaccatgtttttcacttgtggcccaaatgaggccatggtggtctccgggttctgccgaagccccccagtcatggtggctggagggcgtgtctttgtcctgccctgcatccaacagatccagaggatctctctcaacacactgaccctcaatgtcaagagtgaaaaggtttacactcgccatggggtccccatctcagtcactggcattgcccaggtgaagctttcagagccttttccccacagtccacttccccatcaccctctctcccagacattaagacatcttctggccacagtcttctcaacccttgcctgcagagaagttcctctgctagtctcatcttttccaggcaccccaaggcacttgcctcctcctcctttctttccctgaaatggaagaagcatttcttagagggctctcccttctctctctgctttttctctgacttcatgagacccccaccacacctttcctacccctactctggctacaggtaaaaatccaggggcagaacaaggagatgttggcggccgcctgtcagatgttcctggggaagacggaggctgagattgcccacattgccctggagacgttagagggccaccagagggccatcatggcccacatgactgtggaggagatctataaggacaggcagaaattctcagaacaggttttcaaagtggcctcctcagacctggtcaacatgggcatcagtgtggttagctacactctgaaggacattcacgatgaccaggactatttgcactctttggggaaggctcgaacagctcaagtccaaaaagatgcacggattggagaagcagaggccaagagagatgctgggatccgggaagctaaagccaagcaggaaaaggtgtctgctcagtacctgagtgagatcgagatggccaaggcacagagagattacgaactgaagaaggccgcctatgacatcgaggtcaacacccgccgagcacaggctgacctggcctatcagcttcaggtggccaagactaagcagcagattgaggagcagcgggtgcaggtgcaggtggtggagcgggcccagcaggtggcagtgcaggagcaggaggaagtactggacattctaactcgcctgccagagagtgtggaaagactcacaggcgtgagcatctcccaggtgaatcacaagcctttgagaacagcctgagccttcagccctcacagatgcccagcctcatagctgaagttgcctgaatgatcctcctgttgcatgtaacccactggcctccctgagcatgtccattgacagtgaggtcccacccctcatctctccttgccaaatagtttgtgccttgtcttgaagggggttgctccccttgccaacctcacactgctatgattgccaactccagcggtcccatgtcagccttctgatgatcccactccaccccacctcaacttatttaacttcctaattaaatcagactgtt

SEQ ID NO: 365435 - DNA, 641 bp, Homo sapiens
  misc_feature (11)..(11): n is a, c, g, or t
ggtgtgggtgntctagaggatcctccgctggccagtggcagaggagatcagtggtcccttgacttcagccaataagatcacactggtgtccagcggcagtgggaccatgggggcagccaaagtgactggggaagtactggacattctaactcgcctgccagagagtgtggaaagactcacaggcgtgagcatctcccaggtgaatcacaagcctttgagaacagcctgagccttcagccctcacagatgcccagcctcatagctgaagttgcctgaatgatcctcctgttgcatgtaacccactggcctccctgagcatgtccattgacagtgaggtcccacccctcatctctccttgccaaatagtttgtgccttgtcttgaagggggttgctccccttgccaacctcacactgctatgattgccaactccagcggtcccatgtcagccttctgatgatcccactccaccccacctcaacttatttaacttcctaattaaatcagactgtttgagcctgttgtctagaatattttcctgaccaagactgagggatgggctggaggttttcaactttgctacccaaataaattgctgtaagtaagtactaataaaacagaagcaactggaaattaaaaaaa

SEQ ID NO: 365436 - DNA, 1937 bp, Homo sapiens
  misc_feature (7)..(7): n is a, c, g, or t
  misc_feature (35)..(35): n is a, c, g, or t
  misc_feature (46)..(46): n is a, c, g, or t
  misc_feature (78)..(79): n is a, c, g, or t
  misc_feature (1154)..(1154): n is a, c, g, or t
  misc_feature (1166)..(1166): n is a, c, g, or t
  misc_feature (1334)..(1334): n is a, c, g, or t
  misc_feature (1336)..(1336): n is a, c, g, or t
ggaaaanagcttatgaacatgaattacgaaatttnaatacgactcnactaatagggaaatttgccctcgaggcccaannaattcggcacgagggtctgcgagcggcccctgcccggctcccaggtccctgcgcgaccccgcccttcccgagaccccagccgggctgccgcccgcgtcccggaaggtgagtgggggaggggagatggagcctggggctgccgagaagcagggagagaggggaaagctccagcctgaaccatgtttttcacttgtggcccaaatgaggccatggtggtctccgggttctgccgaagccccccagtcatggtggctggagggcgtgtctttgtcctgccctgcatccaacagatccagaggatctctctcaacacactgaccctcaatgtcaagagtgaaaaggtttacactcgccatggggtccccatctcagtcactggcattgcccaggtgaagctttcagagccttttccccacagtccacttccccatcaccctctctcccagacattaagacatcttctggccacagtcttctcaacccttgcctgcagagaagttcctctgctagtctcatcttttccaggcaccccaaggcacttgcctcctcctcctttctttccctgaaatggaagaagcatttcttagagggctctcccttctctctctgctttttctctgacttcatgagacccccaccacacctttcctacccctactctggctacaggtaaaaatccaggggcagaacaaggagatgttggcggccgcctgtcagatgttcctggggaagacggaggctgagattgcccacattgccctggagacgttagagggccaccagagggccatcatggcccacatgactgtggaggagatctataaggacaggcagaaattctcagaacaggttttcaaagtggcctcctcagacctggtcaacatgggcatcagtgtggttagctacactctgaaggacattcacgatgaccaggactatttgcactctttggggaaggctcgaacagctcaagtccaaaaagatgcacggattggagaagcagaggccaagagagatgctgggatccggaagctaaagccaacgcatggggggaacacacaggggtgtctgctcnatgtacctgagntttggaaagggcaaatttcccggaacggcaatgggcccaagggcacagagagattacgaactgaagaaggccgcctatgacatcgaggtcaacacccgccgagcacaggctgacctggcctatcagcttcagccttttgggggcccccctattccaaacgccttcagngngtggccaagactaagcagcagattgaggagcagcgggtgcaggtgcaggtggtggagcgggcccagcaggtggcagtgcaggagcaggaggaagtactggacattctaactcgcctgccagagagtgtggaaagactcacaggcgtgagcatctcccaggtgaatcacaagcctttgagaacagcctgagccttcagccctcacagatgcccagcctcatagctgaagttgcctgaatgatcctcctgttgcatgtaacccactggcctccctgagcatgtccattgacagtgaggtcccacccctcatctctccttgccaaatagtttgtgccttgtcttgaagggggttgctccccttgccaacctcacactgctatgattgccaactccagcggtcccatgtcagccttctgatgatcccactccaccccacctcaacttatttaacttcctaattaaatcagactgtttgagcctgttgtctagaatattttcctgaccaagactgagggatgggctggaggttttcaactttgctacccaaataaattgctgtaagtaagtactaataaaacagaagcaactggaaattaaaaaaa

SEQ ID NO: 365437 - DNA, 967 bp, Homo sapiens
  misc_feature (7)..(7): n is a, c, g, or t
  misc_feature (35)..(35): n is a, c, g, or t
  misc_feature (46)..(46): n is a, c, g, or t
  misc_feature (78)..(79): n is a, c, g, or t
ggaaaanagcttatgaacatgaattacgaaatttnaatacgactcnactaatagggaaatttgccctcgaggcccaannaattcggcacgagggtctgcgagcggcccctgcccggctcccaggtccctgcgcgaccccgcccttcccgagaccccagccgggctgccgcccgcgtcccggaaggtgagtgggggaggggagatggagcctggggctgccgagaagcagggagagaggggaaagctccagcctgaaccatgtttttcacttgtggcccaaatgaggccatggtggtctccgggttctgccgaagccccccagtcatggtggctggagggcgtgtctttgtcctgccctgcatccaacagatccagaggatctctctcaacacactgaccctcaatgtcaagagtgaaaaggtttacactcgccatggggtccccatctcagtcactggcattgcccaggtgaagctttcagagccttttccccacagtccacttccccatcaccctctctcccagacattaagacatcttctggccacagtcttctcaacccttgcctgcagagaagttcctctgctagtctcatcttttccaggcaccccaaggcacttgcctcctcctcctttctttccctgaaatggaagaagcatttcttagagggctctcccttctctctctgctttttctctgacttcatgagacccccaccacacctttcctacccctactctggctacaggtaaaaatccaggggcagaacaaggagatgttggcggccgcctgtcagatgttcctggggaagacggaggctgagaagaagacatatgagagagggctctccattctctctcagctgtatctacgacttcatagagacccaccaccacacctgttcttacccctactccggctacaggtaaaaacaggggcagaaccagagatgtggacgcgcggggga

SEQ ID NO: 365438 - DNA, 549 bp, Homo sapiens
tggtgctgtctggtggtgctgcttgatcggggatttcttgttcttaatgatttccgtcaatctcacaagcatccttaaccctcagatgcgtggggaagctgaggcctttgccataggggcccgagcccgagccgaggctgagcagatggccaagaaggcagaagccttccagctgtaccaagaggctgctcagctggacatgctgctagagaagctgccccaggtctggaggtcatgtgggcaccaagaaaggaggaaatagaaccagggactaaggggtggggtgtagtgaggggcttagggagaaacagcctagggggactctaaattaggggtgggaattattagtgaccaaagtgaggaaggatgatcagtggaacgaggaccttaaaacccagagtaagttgttttatgaggaatgtggtcagatcatgggcactgagtgggtgtctctctcctgccagggtggcagaggagatcagtggtcccttgacttcagccaataagatcacactggtgtccagcggcagtgggaccatgggggcagcc

SEQ ID NO: 365439 - DNA, 577 bp, Homo sapiens
caaaagtgagtccatgggcctgtgggaatgtgaggggagtgggtccgctccaccagatgccagcaccggggccagtgcagctcagagccctgtgtcggactacagggcctgcacagacggtcactcaaagaaagatgtccctgtgccctactccttggcgatggcaaagggcttctccacctcgatcttgccgcagtctgcgatgatcacatccttcaggggtttatcccggctgtctgtcttggtgctctccaccttctcaggaccggcacgagggaaaggagcccagaggtgctgtcaggtggcgaggatggagctgttcgactttgggacctgcgcacagccaaggaggtccagacgatcgaggtctataagcacgaggagtgctcgaggccccacaatgggcgctggattggatgtttggcaactgattccgactggatggtctgtggagggggcccagccctcaccctctggcacctccgatcctccacacccaccaccatcttccccatccgggcgccacagaagcacgtcaccttctaccaggacctggtgaggccctgtgtctcacttc

SEQ ID NO: 365440 - DNA, 266 bp, Homo sapiens
ctgctccgcccctctctgcccttcgtgtcctggaaggggccggctgggaggcaggggtgtgggcaggccagtcatgcccctctttcctccaggtcctgacagctgcaggcaacagctgccgggtggatgtcttcaccaacctgggttaccgagccttctccctgtccttctgatctctgacgacacccccagccagctcagggttttagagtgtttttcattttctttttttttttttttttacaataaagtttcaggctttttta

SEQ ID NO: 365441 - DNA, 1872 bp, Homo sapiens
gctttaggcgggcacagccgcgaggttctgcgcgggcgcggaagacgggcggcgcgtggcggaaggcaggcttgctcctcggggtgggggagggtatccggcttaagggggctgcggtggacaccacttcttaatgtcgggggtcttcgcggcgctcacctcggctcctagggttcgggacggtacgcaccagccaccttcgcgccgaaggcggtagggcgccacggagaggaaccgctctaggcacgtaaggcctcgtgaggttgcgtcgcgcgcggagcactctgggacttgtagttctggagatggagcgagctgtgccgctcgcggtgcctctgggtcagacagaggtgttccaggccttgcagcggctccatatgaccatcttctcccagagcgtctcaccatgtgggaagtttctggcggctggcaacaattacgggcagattgccatcttcagcttgtcctctgctttgagctcagaagccaaagaggaaagtaagaagccggtggtgactttccaagcccatgatgggcccgtctatagcatggtttccaccgatcgacatctgcttagtgctggggatggggaggtgaaggcctggctttgggcggagatgctcaagaagggctgtaaggagctgtggcgtcgtcagcctccatacaggaccagcctggaagtgcctgagatcaacgctttgctgctggtccccaaggagaattccctcatcctggctgggggagactgtcagttgcacactatggaccttgaaactgggactttcacgagggtcctccggggccacacagactacatccactgcctggcactgcgggaaaggagcccagaggtgctgtcaggtggcgaggatggagctgttcgactttgggacctgcgcacagccaaggaggtccagacgatcgaggtctataagcacgaggagtgctcgaggccccacaatgggcgctggattggatgtttggcaactgattccgactggatggtctgtggagggggcccagccctcaccctctggcacctccgatcctccacacccaccaccatcttccccatccgggcgccacagaagcacgtcaccttctaccaggacctgattctgtcagctggccagggccgctgcgtcaaccagtggcagctgagcggggagctgaaggcccaggtgcctggctcctccccagggctgctcagcctcagcctcaaccagcagcctgccgcgcctgagtgcaaggtcctgacagctgcaggcaacagctgccgggtggatgtcttcaccaacctgggttaccgagccttctccctgtccttctgatctctgacgacacccccagccagctcagggttttagagtgtttttcattttctttttttttttttttttacaataaagtttcaggcttttttaccatgctctttctttctatgaatgggggccaaatcggtggagtgatttatatattactctgtccgatcttgatacataaatacccagccccatccctgccctagaaaagatagacctatattaattcggaaaatagctctgttcacctgcccctgccacccacctggagctcctgccccacaaagctggcccctgctccggatgagcccctgctcccgatgagcccttgcccagcatcctggggcggggagggcatcagcttcttttggaagacaatctgggccctgtcgctccattggcctgaagaggaaagtgagcccctaagtgggcaagggcagccctctgggcccagccgtcaggtccttcggaagaggttactgagaaagccaccggcgggcccggggcccaggcgcagcgagaagcggggcgcggcacggcgcggggtcga

SEQ ID NO: 365442 - DNA, 1870 bp, Homo sapiens
tacggctaggtactgaggctggggttgaatcggccgagggaagtgggcggcgcgtggcggaaggcaggcttgctcctcggggtgggggagggtatccggcttaagggggctgcggtggacaccacttcttaatgtcgggggtcttcgcggcgctcacctcggctcctagggttcgggacggtacgcaccagccaccttcgcgccgaaggcggtagggcgccacggagaggaaccgctctaggcacgtaaggcctcgtgaggttgcgtcgcgcgcggagcactctgggacttgtagttctggagatggagcgagctgtgccgctcgcggtgcctctgggtcagacagaggtgttccaggccttgcagcggctccatatgaccatcttctcccagagcgtctcaccatgtgggaagtttctggcggctggcaacaattacgggcagattgccatcttcagcttgtcctctgctttgagctcagaagccaaagaggaaagtaagaagccggtggtgactttccaagcccatgatgggcccgtctatagcatggtttccaccgatcgacatctgcttagtgctggggatggggaggtgaaggcctggctttgggcggagatgctcaagaagggctgtaaggagctgtggcgtcgtcagcctccatacaggaccagcctggaagtgcctgagatcaacgctttgctgctggtccccaaggagaattccctcatcctggctgggggagactgtcagttgcacactatggaccttgaaactgggactttcacgagggtcctccggggccacacagactacatccactgcctggcactgcgggaaaggagcccagaggtgctgtcaggtggcgaggatggagctgttcgactttgggacctgcgcacagccaaggaggtccagacgatcgaggtctataagcacgaggagtgctcgaggccccacaatgggcgctggattggatgtttggcaactgattccgactggatggtctgtggagggggcccagccctcaccctctggcacctccgatcctccacacccaccaccatcttccccatccgggcgccacagaagcacgtcaccttctaccaggacctgattctgtcagctggccagggccgctgcgtcaaccagtggcagctgagcggggagctgaaggcccaggtgcctggctcctccccagggctgctcagcctcagcctcaaccagcagcctgccgcgcctgagtgcaaggtcctgacagctgcaggcaacagctgccgggtggatgtcttcaccaacctgggttaccgagccttctccctgtccttctgatctctgacgacacccccagccagctcagggttttagagtgtttttcattttctttttttttttttttttacaataaagtttcaggcttttttaccatgctctttctttctatgaatgggggccaaatcggtggagtgatttatatattactctgtccgatcttgatacataaatacccagccccatccctgccctagaaaagatagacctatattaattcggaaaatagctctgttcacctgcccctgccacccacctggagctcctgccccacaaagctggcccctgctccggatgagcccctgctcccgatgagcccttgcccagcatcctggggcggggagggcatcagcttcttttggaagacaatctgggccctgtcgctccattggcctgaagaggaaagtgagcccctaagtgggcaagggcagccctctgggcccagccgtcaggtccttcggaagaggttactgagaaagccaccggcgggcccggggcccaggcgcagcgagaagcggggcgcggcacggcgcggggtcga

SEQ ID NO: 365443 - DNA, 1149 bp, Homo sapiens
gctttaggcgggcacagccgcgaggttctgcgcgggcgcggaagacgggcggcgcgtggcggaaggcaggcttgctcctcggggtgggggagggtatccggcttaagggggctgcggtggacaccacttcttaatgtcgggggtcttcgcggcgctcacctcggctcctagggttcgggacggtacgcaccagccaccttcgcgccgaaggcggtagggcgccacggagaggaaccgctctaggcacgtaaggcctcgtgaggttgcgtcgcgcgcggagcactctgggacttgtagttctggagatggagcgagctgtgccgctcgcggtgcctctgggtcagacagaggtgttccaggccttgcagcggctccatatgaccatcttctcccagagcgtctcaccatgtgggaagtttctggcggctggcaacaattacgggcagattgccatcttcagcttgtcctctgctttgagctcagaagccaaagaggaaagtaagaagccggtggtgactttccaagcccatgatgggcccgtctatagcatggtttccaccgatcgacatctgcttagtgctggggatggggaggtgaaggcctggctttgggcggagatgctcaagaagggctgtaaggagctgtggcgtcgtcagcctccatacaggaccagcctggaagtgcctgagatcaacgctttgctgctggtccccaaggagaattccctcatcctggctgggggagactgtcagttgcacactatggaccttgaaactgggactttcacgagggtcctccggggccacacagactacatccactgcctggcactgcgggaaaggagcccagaggtgctgtcaggtggcgaggatggagctgttcgactttgggagcccatgatggcccgtctatagcatcggtttccaccgatcgacatctgcttagtgctggggatggggagatgaaggcctggctttgggacggagatgctcaagaagggctgtaaggagctgtggcgtcgtcagcctcacatacaggaccagcctggaagtgcctgagatcaacagctttgctgctggtccccaaggagaattccatcatcctggctgggggagactgtcagaagcacgtcaccttctcagacactgg

SEQ ID NO: 365444 - DNA, 1946 bp, Homo sapiens
gctttaggcgggcacagccgcgaggttctgcgcgggcgcggaagacgggcggcgcgtggcggaaggcaggcttgctcctcggggtgggggagggtatccggcttaagggggctgcggtggacaccacttcttaatgtcgggggtcttcgcggcgctcacctcggctcctagggttcgggacggtacgcaccagccaccttcgcgccgaaggcggtagggcgccacggagaggaaccgctctaggcacgtaaggcctcgtgaggttgcgtcgcgcgcggagcactctgggacttgtagttctggagatggagcgagctgtgccgctcgcggtgcctctgggtcagacagaggtgttccaggccttgcagcggctccatatgaccatcttctcccagagcgtctcaccatgtgggaagtttctggcggctggcaacaattacgggcagattgccatcttcagcttgtcctctgctttgagctcagaagccaaagaggaaagtaagaagccggtggtgactttccaaggtgggtatacctgtggagtctggcttcaggactttgggtgggattggctcactcagttctgcatttctctttagcccatgatgggcccgtctatagcatggtttccaccgatcgacatctgcttagtgctggggatggggaggtgaaggcctggctttgggcggagatgctcaagaagggctgtaaggagctgtggcgtcgtcagcctccatacaggaccagcctggaagtgcctgagatcaacgctttgctgctggtccccaaggagaattccctcatcctggctgggggagactgtcagttgcacactatggaccttgaaactgggactttcacgagggtcctccggggccacacagactacatccactgcctggcactgcgggaaaggagcccagaggtgctgtcaggtggcgaggatggagctgttcgactttgggacctgcgcacagccaaggaggtccagacgatcgaggtctataagcacgaggagtgctcgaggccccacaatgggcgctggattggatgtttggcaactgattccgactggatggtctgtggagggggcccagccctcaccctctggcacctccgatcctccacacccaccaccatcttccccatccgggcgccacagaagcacgtcaccttctaccaggacctgattctgtcagctggccagggccgctgcgtcaaccagtggcagctgagcggggagctgaaggcccaggtgcctggctcctccccagggctgctcagcctcagcctcaaccagcagcctgccgcgcctgagtgcaaggtcctgacagctgcaggcaacagctgccgggtggatgtcttcaccaacctgggttaccgagccttctccctgtccttctgatctctgacgacacccccagccagctcagggttttagagtgtttttcattttctttttttttttttttttacaataaagtttcaggcttttttaccatgctctttctttctatgaatgggggccaaatcggtggagtgatttatatattactctgtccgatcttgatacataaatacccagccccatccctgccctagaaaagatagacctatattaattcggaaaatagctctgttcacctgcccctgccacccacctggagctcctgccccacaaagctggcccctgctccggatgagcccctgctcccgatgagcccttgcccagcatcctggggcggggagggcatcagcttcttttggaagacaatctgggccctgtcgctccattggcctgaagaggaaagtgagcccctaagtgggcaagggcagccctctgggcccagccgtcaggtccttcggaagaggttactgagaaagccaccggcgggcccggggcccaggcgcagcgagaagcggggcgcggcacggcgcggggtcga

SEQ ID NO: 365445 - DNA, 1551 bp, Homo sapiens
taagtcttcaagagcagaaaggctcctcttaaaacctcattttatttacctatgtccaaggacagctgcaatccataaaggaaagggatacagaagtcaactaactatataaaaggacagactgccaccatgaaaaatcaagagacaggagaaaatgctcagaagccaaagaggaaagtaagaagccggtggtgactttccaagcccatgatgggcccgtctatagcatggtttccaccgatcgacatctgcttagtgctggggatggggaggtgaaggcctggctttgggcggagatgctcaagaagggctgtaaggagctgtggcgtcgtcagcctccatacaggaccagcctggaagtgcctgagatcaacgctttgctgctggtccccaaggagaattccctcatcctggctgggggagactgtcagttgcacactatggaccttgaaactgggactttcacgagggtcctccggggccacacagactacatccactgcctggcactgcgggaaaggagcccagaggtgctgtcaggtggcgaggatggagctgttcgactttgggacctgcgcacagccaaggaggtccagacgatcgaggtctataagcacgaggagtgctcgaggccccacaatgggcgctggattggatgtttggcaactgattccgactggatggtctgtggagggggcccagccctcaccctctggcacctccgatcctccacacccaccaccatcttccccatccgggcgccacagaagcacgtcaccttctaccaggacctgattctgtcagctggccagggccgctgcgtcaaccagtggcagctgagcggggagctgaaggcccaggtgcctggctcctccccagggctgctcagcctcagcctcaaccagcagcctgccgcgcctgagtgcaaggtcctgacagctgcaggcaacagctgccgggtggatgtcttcaccaacctgggttaccgagccttctccctgtccttctgatctctgacgacacccccagccagctcagggttttagagtgtttttcattttctttttttttttttttttacaataaagtttcaggcttttttaccatgctctttctttctatgaatgggggccaaatcggtggagtgatttatatattactctgtccgatcttgatacataaatacccagccccatccctgccctagaaaagatagacctatattaattcggaaaatagctctgttcacctgcccctgccacccacctggagctcctgccccacaaagctggcccctgctccggatgagcccctgctcccgatgagcccttgcccagcatcctggggcggggagggcatcagcttcttttggaagacaatctgggccctgtcgctccattggcctgaagaggaaagtgagcccctaagtgggcaagggcagccctctgggcccagccgtcaggtccttcggaagaggttactgagaaagccaccggcgggcccggggcccaggcgcagcgagaagcggggcgcggcacggcgcggggtcga

SEQ ID NO: 365446 - DNA, 1845 bp, Homo sapiens
gctttaggcgggcacagccgcgaggttctgcgcgggcgcggaagacgggcggcgcgtggcggaaggcaggcttgctcctcggggtgggggagggtatccggcttaagggggctgcggtggacaccacttcttaatgtcgggggtcttcgcggcgctcacctcggctcctagggttcgggacggtacgcaccagccaccttcgcgccgaaggcggtagggcgccacggagaggaaccgctctaggcacgtaaggcctcgtgaggttgcgtcgcgcgcggagcactctgggacttgtagttctggagatggagcgagctgtgccgctcgcggtgcctctgggtcagacagaggtgttccaggccttgcagcggctccatatgaccatcttctcccagagcgtctcaccatgtgggaagtttctggcggctggcaacaattacgggcagattgccatcttcagcttgtcctctgctttgagctcagaagccaaagaggaaacccatgatgggcccgtctatagcatggtttccaccgatcgacatctgcttagtgctggggatggggaggtgaaggcctggctttgggcggagatgctcaagaagggctgtaaggagctgtggcgtcgtcagcctccatacaggaccagcctggaagtgcctgagatcaacgctttgctgctggtccccaaggagaattccctcatcctggctgggggagactgtcagttgcacactatggaccttgaaactgggactttcacgagggtcctccggggccacacagactacatccactgcctggcactgcgggaaaggagcccagaggtgctgtcaggtggcgaggatggagctgttcgactttgggacctgcgcacagccaaggaggtccagacgatcgaggtctataagcacgaggagtgctcgaggccccacaatgggcgctggattggatgtttggcaactgattccgactggatggtctgtggagggggcccagccctcaccctctggcacctccgatcctccacacccaccaccatcttccccatccgggcgccacagaagcacgtcaccttctaccaggacctgattctgtcagctggccagggccgctgcgtcaaccagtggcagctgagcggggagctgaaggcccaggtgcctggctcctccccagggctgctcagcctcagcctcaaccagcagcctgccgcgcctgagtgcaaggtcctgacagctgcaggcaacagctgccgggtggatgtcttcaccaacctgggttaccgagccttctccctgtccttctgatctctgacgacacccccagccagctcagggttttagagtgtttttcattttctttttttttttttttttacaataaagtttcaggcttttttaccatgctctttctttctatgaatgggggccaaatcggtggagtgatttatatattactctgtccgatcttgatacataaatacccagccccatccctgccctagaaaagatagacctatattaattcggaaaatagctctgttcacctgcccctgccacccacctggagctcctgccccacaaagctggcccctgctccggatgagcccctgctcccgatgagcccttgcccagcatcctggggcggggagggcatcagcttcttttggaagacaatctgggccctgtcgctccattggcctgaagaggaaagtgagcccctaagtgggcaagggcagccctctgggcccagccgtcaggtccttcggaagaggttactgagaaagccaccggcgggcccggggcccaggcgcagcgagaagcggggcgcggcacggcgcggggtcga

SEQ ID NO: 365447 - DNA, 1955 bp, Homo sapiens
gctttaggcgggcacagccgcgaggttctgcgcgggcgcggaagacgggcggcgcgtggcggaaggcaggcttgctcctcggggtgggggagggtatccggcttaagggggctgcggtggacaccacttcttaatgtcgggggtcttcgcggcgctcacctcggctcctagggttcgggacggtacgcaccagccaccttcgcgccgaaggcggtagggcgccacggagaggaaccgctctaggcacgtaaggcctcgtgaggttgcgtcgcgcgcggagcactctgggacttgtagttctggagatggagcgagctgtgccgctcgcggtgcctctgggtcagacagaggtgttccaggccttgcagcggctccatatgaccatcttctcccagagcgtctcaccatgtgggaagtttctggcggctggcaacaattacgggcagattgccatcttcagcttgtcctctgctttgagctcagaagccaaagaggaaagtaagaagccggtggtgactttccaagcccatgatgggcccgtctatagcatggtttccaccgatcgacatctgcttagtgctggggatggggaggtgaaggcctggctttgggcggagatgctcaagaaggtaaggagtcgagcttgggaaagggctggggtgcctggacccagagagagcctttgaggtcacctggtatatctcttttgaagggctgtaaggagctgtggcgtcgtcagcctccatacaggaccagcctggaagtgcctgagatcaacgctttgctgctggtccccaaggagaattccctcatcctggctgggggagactgtcagttgcacactatggaccttgaaactgggactttcacgagggtcctccggggccacacagactacatccactgcctggcactgcgggaaaggagcccagaggtgctgtcaggtggcgaggatggagctgttcgactttgggacctgcgcacagccaaggaggtccagacgatcgaggtctataagcacgaggagtgctcgaggccccacaatgggcgctggattggatgtttggcaactgattccgactggatggtctgtggagggggcccagccctcaccctctggcacctccgatcctccacacccaccaccatcttccccatccgggcgccacagaagcacgtcaccttctaccaggacctgattctgtcagctggccagggccgctgcgtcaaccagtggcagctgagcggggagctgaaggcccaggtgcctggctcctccccagggctgctcagcctcagcctcaaccagcagcctgccgcgcctgagtgcaaggtcctgacagctgcaggcaacagctgccgggtggatgtcttcaccaacctgggttaccgagccttctccctgtccttctgatctctgacgacacccccagccagctcagggttttagagtgtttttcattttctttttttttttttttttacaataaagtttcaggcttttttaccatgctctttctttctatgaatgggggccaaatcggtggagtgatttatatattactctgtccgatcttgatacataaatacccagccccatccctgccctagaaaagatagacctatattaattcggaaaatagctctgttcacctgcccctgccacccacctggagctcctgccccacaaagctggcccctgctccggatgagcccctgctcccgatgagcccttgcccagcatcctggggcggggagggcatcagcttcttttggaagacaatctgggccctgtcgctccattggcctgaagaggaaagtgagcccctaagtgggcaagggcagccctctgggcccagccgtcaggtccttcggaagaggttactgagaaagccaccggcgggcccggggcccaggcgcagcgagaagcggggcgcggcacggcgcggggtcga

SEQ ID NO: 365448 - DNA, 1249 bp, Homo sapiens
gctttaggcgggcacagccgcgaggttctgcgcgggcgcggaagacgggcggcgcgtggcggaaggcaggcttgctcctcggggtgggggagggtatccggcttaagggggctgcggtggacaccacttcttaatgtcgggggtcttcgcggcgctcacctcggctcctagggttcgggacggtacgcaccagccaccttcgcgccgaaggcggtagggcgccacggagaggaaccgctctaggcacgtaaggcctcgtgaggttgcgtcgcgcgcggagcactctgggacttgtagttctggagatggagcgagctgtgccgctcgcggtgcctctgggtcagacagaggtgttccaggccttgcagcggctccatatgaccatcttctcccagagcgtctcaccatgtgggaagtttctggcggctggcaacaattacgggcagattgccatcttcagcttgtcctctgctttgagctcagaagccaaagaggaaagtaagaagccggtggtgactttccaagcccatgatgggcccgtctatagcatggtttccaccgatcgacatctgcttagtgctggggatggggaggtgaaggcctggctttgggcggagatgctcaagaagggctgtaaggagctgtggcgtcgtcagcctccatacaggaccagcctggaagtgcctgagatcaacgctttgctgctggtccccaaggacacccccagccagctcagggttttagagtgtttttcattttctttttttttttttttttacaataaagtttcaggcttttttaccatgctctttctttctatgaatgggggccaaatcggtggagtgatttatatattactctgtccgatcttgatacataaatacccagccccatccctgccctagaaaagatagacctatattaattcggaaaatagctctgttcacctgcccctgccacccacctggagctcctgccccacaaagctggcccctgctccggatgagcccctgctcccgatgagcccttgcccagcatcctggggcggggagggcatcagcttcttttggaagacaatctgggccctgtcgctccattggcctgaagaggaaagtgagcccctaagtgggcaagggcagccctctgggcccagccgtcaggtccttcggaagaggttactgagaaagccaccggcgggcccggggcccaggcgcagcgagaagcggggcgcggcacggcgcggggtcga

SEQ ID NO: 365449 - DNA, 1190 bp, Homo sapiens
aaatgcaggctgtacggtctgggtgttaggataggagaattccctcatcctggctgggggagactgtcagttgcacactatggaccttgaaactgggactttcacgagggtcctccggggccacacagactacatccactgcctggcactgcgggaaaggagcccagaggtgctgtcaggtggcgaggatggagctgttcgactttgggacctgcgcacagccaaggaggtccagacgatcgaggtctataagcacgaggagtgctcgaggccccacaatgggcgctggattggatgtttggcaactgattccgactggatggtctgtggagggggcccagccctcaccctctggcacctccgatcctccacacccaccaccatcttccccatccgggcgccacagaagcacgtcaccttctaccaggacctgattctgtcagctggccagggccgctgcgtcaaccagtggcagctgagcggggagctgaaggcccaggtgcctggctcctccccagggctgctcagcctcagcctcaaccagcagcctgccgcgcctgagtgcaaggtcctgacagctgcaggcaacagctgccgggtggatgtcttcaccaacctgggttaccgagccttctccctgtccttctgatctctgacgacacccccagccagctcagggttttagagtgtttttcattttctttttttttttttttttacaataaagtttcaggcttttttaccatgctctttctttctatgaatgggggccaaatcggtggagtgatttatatattactctgtccgatcttgatacataaatacccagccccatccctgccctagaaaagatagacctatattaattcggaaaatagctctgttcacctgcccctgccacccacctggagctcctgccccacaaagctggcccctgctccggatgagcccctgctcccgatgagcccttgcccagcatcctggggcggggagggcatcagcttcttttggaagacaatctgggccctgtcgctccattggcctgaagaggaaagtgagcccctaagtgggcaagggcagccctctgggcccagccgtcaggtccttcggaagaggttactgagaaagccaccggcgggcccggggcccaggcgcagcgagaagcggggcgcggcacggcgcggggtcga

SEQ ID NO: 365450 - DNA, 1045 bp, Homo sapiens
  misc_feature (23)..(23): n is a, c, g, or t
agacaggcttgtggccccgaganttaaggatcaggtggcgaggatggagctgttcgactttgggacctgcgcacagccaaggaggtccagacgatcgaggtctataagcacgaggagtgctcgaggccccacaatgggcgctggattggatgtttggcaactgattccgactggatggtctgtggagggggcccagccctcaccctctggcacctccgatcctccacacccaccaccatcttccccatccgggcgccacagaagcacgtcaccttctaccaggacctgattctgtcagctggccagggccgctgcgtcaaccagtggcagctgagcggggagctgaaggcccaggtgcctggctcctccccagggctgctcagcctcagcctcaaccagcagcctgccgcgcctgagtgcaaggtcctgacagctgcaggcaacagctgccgggtggatgtcttcaccaacctgggttaccgagccttctccctgtccttctgatctctgacgacacccccagccagctcagggttttagagtgtttttcattttctttttttttttttttttacaataaagtttcaggcttttttaccatgctctttctttctatgaatgggggccaaatcggtggagtgatttatatattactctgtccgatcttgatacataaatacccagccccatccctgccctagaaaagatagacctatattaattcggaaaatagctctgttcacctgcccctgccacccacctggagctcctgccccacaaagctggcccctgctccggatgagcccctgctcccgatgagcccttgcccagcatcctggggcggggagggcatcagcttcttttggaagacaatctgggccctgtcgctccattggcctgaagaggaaagtgagcccctaagtgggcaagggcagccctctgggcccagccgtcaggtccttcggaagaggttactgagaaagccaccggcgggcccggggcccaggcgcagcgagaagcggggcgcggcacggcgcggggtcga

SEQ ID NO: 365451 - DNA, 801 bp, Homo sapiens
gctttaggcgggcacagccgcgaggttctgcgcgggcgcggaagacgggcggcgcgtggcggaaggcaggcttgctcctcggggtgggggagggtatccggcttaagggggctgcggtggacaccacttcttaatgtcgggggtcttcgcggcgctcacctcggctcctagggttcgggacggtacgcaccagccaccttcgcgccgaaggcggtagggcgccacggagaggaaccgctctaggcacgtaaggcctcgtgaggttgcgtcgcgcgcggagcactctgggacttgtagttctggagatggagcgagctgtgccgctcgcggtgcctctgggtcagacagaggtgttccaggccttgcagcggctccatatgaccatcttctcccagagcgtctcaccatgtgggaagtttctggcggctggcaacaattacgggcagattgccatcttcagcttgtcctctgctttgagctcagaagccaaagaggaaagtaagaagccggtggtgactttccaagcccatgatgggcccgtctatagcatggtttccaccgatcgacatctgcttagtgctggggatggggaggtgaaggcctggctttgggcggagatgctcaagaagggctgtaaggagctgtggcgtcgtcagcctccatacaggaccagcctggaagtgcctgagatcaacgctttgctgctggtccccaaggacacccccagccagctcagggttttagagtgtttttcattttctttttttttttttttttacaataaagtttcaggctttttta

SEQ ID NO: 365452 - DNA, 960 bp, Homo sapiens
gctttaggcgggcacagccgcgaggttctgcgcgggcgcggaagacgggcggcgcgtggcggaaggcaggcttgctcctcggggtgggggagggtatccggcttaagggggctgcggtggacaccacttcttaatgtcgggggtcttcgcggcgctcacctcggctcctagggttcgggacggtacgcaccagccaccttcgcgccgaaggcggtagggcgccacggagaggaaccgctctaggcacgtaaggcctcgtgaggttgcgtcgcgcgcggagcactctgggacttgtagttctggagatggagcgagctgtgccgctcgcggtgcctctgggtcagacagaggtgttccaggccttgcagcggctccatatgaccatcttctcccagagcgtctcaccatgtgggaagtttctggcggctggcaacaattacgggcagattgccatcttcaggtaccctctgccgctgtccacccattagccctggcacttggccctcatgggacggatgcccccgtttctgactcctgggtcccctccgctgtccctgcagcttgtcctctgctttgagctcagaagccaaagaggaaagtaagaagccggtggtgactttccaaggtgggtatacctgtggagtctggcttcaggactttgggtgggattggctcactcagttctgcatttctctttagcccatgatgggcccgtctatagcatggtttccaccgatcgacatctgcttagtgctggggatggggaggtgaaggcctggctttgggcggagatgctcaagaaggtaaggagtcgagcttgggaaagggctggggtgcctggacccagagagagcctttgaggtcacctggtatatctcttttgaagggctgtaaggagctgtggcgtcgtcagcctccatacaggtgagcagggccacgtggatagagggtgcatcaggg

SEQ ID NO: 365453 - DNA, 1318 bp, Homo sapiens
gctttaggcgggcacagccgcgaggttctgcgcgggcgcggaagacgggcggcgcgtggcggaagggttcgggacggtacgcaccagccaccttcgcgccgaaggcggtagggcgccacggagaggaaccgctctaggcacgtaaggcctcgtgaggttgcgtcgcgcgcggagcactctgggacttgtagttctggagatggagcgagctgtgccgctcgcggtgcctctgggtcagacagaggtgttccaggccttgcagcggctccatatgaccatcttctcccagagcgtctcaccatgtgggaagtttctggcggctggcaacaattacgggcagattgccatcttcagcttgtcctctgctttgagctcagaagccaaagaggaaagtaagaagccggtggtgactttccaagcccatgatgggcccgtctatagcatggtttccaccgatcgacatctgcttagtgctggggatggggaggtgaaggcctggctttgggcggagatgctcaagaagggctgtaaggagctgtggcgtcgtcagcctccatacaggaccagcctggaagtgcctgagatcaacgctttgctgctggtccccaaggagaattccctcatcctggctgggggagactgtcagttgcacactatggaccttgaaactgggactttcacgagggtcctccggggccacacagactacatccactgcctggcactgcgggaaaggagcccagaggtgctgtcaggtggcgaggatggagctgttcgactttgggacctgcgcacagccaaggaggtccagacgatcgaggtctataagcacgaggagtgctcgaggccccacaatgggcgctggattggatgtttggcaactgattccgactggatggtctgtggagggggcccagccctcaccctctggcacctccgatcctccacacccaccaccatcttccccatccgggcgccacagaagcacgtcaccttctaccaggacctgattctgtcagctggccagggccgctgcgtcaaccagtggcagctgagcggggagctgaaggcccaggtgcctggctcctccccagggctgctcagcctcagcctcaaccagcagcctgccgcgcctgagtgcaaggtcctgacagctgcaggcaacagctgccgggtggatgtcttcaccaacctgggttaccgagccttctccctgtccttctgatctctgacgacacccccagccagctcagggttttagagtgtttttcattttctttttttttttttttttacaataaagtttcaggctttttta

SEQ ID NO: 365454 - DNA, 1424 bp, Homo sapiens
gctttaggcgggcacagccgcgaggttctgcgcgggcgcggaagacgggcggcgcgtggcggaaggcaggcttgctcctcggggtgggggagggtatccggcttaagggggctgcggtggacaccacttcttaatgtcgggggtcttcgcggcgctcacctcggctcctagggttcgggacggtacgcaccagccaccttcgcgccgaaggcggtagggcgccacggagaggaaccgctctaggcacgtaaggcctcgtgaggttgcgtcgcgcgcggagcactctgggacttgtagttctggagatggagcgagctgtgccgctcgcggtgcctctgggtcagacagaggtgttccaggccttgcagcggctccatatgaccatcttctcccagagcgtctcaccatgtgggaagtttctggcggctggcaacaattacgggcagattgccatcttcagcttgtcctctgctttgagctcagaagccaaagaggaaagtaagaagccggtggtgactttccaagcccatgatgggcccgtctatagcatggtttccaccgatcgacatctgcttagtgctggggatggggaggtgaaggcctggctttgggcggagatgctcaagaagggctgtaaggagctgtggcgtcgtcagcctccatacaggaccagcctggaagtgcctgagatcaacgctttgctgctggtccccaaggagaattccctcatcctggctgggggagactgtcagttgcacactatggaccttgaaactgggactttcacgagggtcctccggggccacacagactacatccactgcctggcactgcgggaaaggagcccagaggtgctgtcaggtggcgaggatggagctgttcgactttgggacctgcgcacagccaaggaggtccagacgatcgaggtctataagcacgaggagtgctcgaggccccacaatgggcgctggattggatgtttggcaactgattccgactggatggtctgtggagggggcccagccctcaccctctggcacctccgatcctccacacccaccaccatcttccccatccgggcgccacagaagcacgtcaccttctaccaggacctgattctgtcagctggccagggccgctgcgtcaaccagtggcagctgagcggggagctgaaggcccaggtgcctggctcctccccagggctgctcagcctcagcctcaaccagcagcctgccgcgcctgagtgcaaggtcctgacagctgcaggcaacagctgccgggtggatgtcttcaccaacctgggttaccgagccttctccctgtccttctgatctctgacgacacccccagccagctcagggttttagagtgtttttcattttctttttttttttttttttacaataaagtttcaggctttttta

SEQ ID NO: 365455 - DNA, 1987 bp, Homo sapiens
gctttaggcgggcacagccgcgaggttctgcgcgggcgcggaagacgggcggcgcgtggcggaaggcaggcttgctcctcggggtgggggagggtatccggcttaagggggctgcggtggacaccacttcttaatgtcgggggtcttcgcggcgctcacctcggctcctagggttcgggacggtacgcaccagccaccttcgcgccgaaggcggtagggcgccacggagaggaaccgctctaggcacgtaaggcctcgtgaggttgcgtcgcgcgcggagcactctgggacttgtagttctggagatggagcgagctgtgccgctcgcggtgcctctgggtcagacagaggtgttccaggccttgcagcggctccatatgaccatcttctcccagagcgtctcaccatgtgggaagtttctggcggctggcaacaattacgggcagattgccatcttcagcttgtcctctgctttgagctcagaagccaaagaggaaagtaagaagccggtggtgactttccaagcccatgatgggcccgtctatagcatggtttccaccgatcgacatctgcttagtgctggggatggggaggtgaaggcctggctttgggcggagatgctcaagaagggctgtaaggagctgtggcgtcgtcagcctccatacaggaccagcctggaagtgcctgagatcaacgctttgctgctggtccccaaggagaattccctcatcctggctgggggagactgtcagttgcacactatggaccttgaaactgggactttcacgagggtcctccggggccacacagactacatccactgcctggcactgcgggaaaggagcccagaggtgctgtcaggtggcgaggatggagctgttcgactttgggacctgcgcacagccaaggaggtccagacgatcgaggtctataagcacgaggagtgctcgaggccccacaatgggcgctggattggatgtttggcaactgattccgactggatggtctgtggagggggcccagccctcaccctctggcacctccgatcctccacacccaccaccatcttccccatccgggcgccacagaagcacgtcaccttctaccaggacctgattctgtcagctggccagggccgctgcgtcaaccagtggcagctgagcggggagctgaaggcccaggtgcctggctcctccccagggctgctcagcctcagcctcaaccagcagcctgccgcgcctgagtgcaaggtcctgacagctgcaggcaacagctgccgggtggatgtcttcaccaacctgggttaccgagccttctccctgtccttctgatctctgacgacacccccagccagctcagggttttagagtgtttttcattttctttttttttttttttttacaataaagtttcaggcttttttaaaaaaaaaaaaaaaaaacaaaacaaacaaaaaaaaaaaaagggggggcgcagcaccaaaagagaactccccagaaggggagcaccaaagaaagcagcaggcgaccgcaaagagtacaattgaacaacaaagtgggcgccacactaagaggagcgaccgtaaatatacacaacgagacgagagcgcaacagacggacgcgcagcgtattaaacaacacgatacgcgaacacaggagagacaaaaccaccagcacaacgagggcggaacacactgggagcagaagcacacacctaaaccatcccgggcggggaggcacaccacaaatggcggccacacaacagcccgcaaacgaagcgcagcactgaagagagccgccctacggggagcgacaatactcagacacaaccctgcacaagaggggagagtaaacaggaggggggcaaaacaatcagcgaggagcaagcgtgcacgcccaccgccggcgaagcaaagtaggccaccacgaagagacagcgaacgaggcaagacaaacaaatagaccccccaccgaagacgcaagaaaa

SEQ ID NO: 365456 - DNA, 1890 bp, Homo sapiens
gctttaggcgggcacagccgcgaggttctgcgcgggcgcggaagacgggcggcgcgtggcggaaggcaggcttgctcctcggggtgggggagggtatccggcttaagggggctgcggtggacaccacttcttaatgtcgggggtcttcgcggcgctcacctcggctcctagggttcgggacggtacgcaccagccaccttcgcgccgaaggcggtagggcgccacggagaggaaccgctctaggcacgtaaggcctcgtgaggttgcgtcgcgcgcggagcactctgggacttgtagttctggagatggagcgagctgtgccgctcgcggtgcctctgggtcagacagaggtgttccaggccttgcagcggctccatatgaccatcttctcccagagcgtctcaccatgtgggaagtttctggcggctggcaacaattacgggcagattgccatcttcagcttgtcctctgctttgagctcagaagccaaagaggaaagtaagaagccggtggtgactttccaagttctgcatttctctttagcccatgatgggcccgtctatagcatggtttccaccgatcgacatctgcttagtgctggggatggggaggtgaaggcctggctttgggcggagatgctcaagaagggctgtaaggagctgtggcgtcgtcagcctccatacaggaccagcctggaagtgcctgagatcaacgctttgctgctggtccccaaggagaattccctcatcctggctgggggagactgtcagttgcacactatggaccttgaaactgggactttcacgagggtcctccggggccacacagactacatccactgcctggcactgcgggaaaggagcccagaggtgctgtcaggtggcgaggatggagctgttcgactttgggacctgcgcacagccaaggaggtccagacgatcgaggtctataagcacgaggagtgctcgaggccccacaatgggcgctggattggatgtttggcaactgattccgactggatggtctgtggagggggcccagccctcaccctctggcacctccgatcctccacacccaccaccatcttccccatccgggcgccacagaagcacgtcaccttctaccaggacctgattctgtcagctggccagggccgctgcgtcaaccagtggcagctgagcggggagctgaaggcccaggtgcctggctcctccccagggctgctcagcctcagcctcaaccagcagcctgccgcgcctgagtgcaaggtcctgacagctgcaggcaacagctgccgggtggatgtcttcaccaacctgggttaccgagccttctccctgtccttctgatctctgacgacacccccagccagctcagggttttagagtgtttttcattttctttttttttttttttttacaataaagtttcaggcttttttaccatgctctttctttctatgaatgggggccaaatcggtggagtgatttatatattactctgtccgatcttgatacataaatacccagccccatccctgccctagaaaagatagacctatattaattcggaaaatagctctgttcacctgcccctgccacccacctggagctcctgccccacaaagctggcccctgctccggatgagcccctgctcccgatgagcccttgcccagcatcctggggcggggagggcatcagcttcttttggaagacaatctgggccctgtcgctccattggcctgaagaggaaagtgagcccctaagtgggcaagggcagccctctgggcccagccgtcaggtccttcggaagaggttactgagaaagccaccggcgggcccggggcccaggcgcagcgagaagcggggcgcggcacggcgcggggtcga

SEQ ID NO: 365457 - DNA, 1821 bp, Homo sapiens
  misc_feature (28)..(28): n is a, c, g, or t
ttaccggggtcttaaggtagcgaggccncctggggggtgtgtgtaaattttcgggccaccgagggagtcgggggtcttcgcggcgctcacctcggctcctagggttcgggacggtacgcaccagccaccttcgcgccgaaggcggtagggcgccacggagaggaaccgctctaggcacgtaaggcctcgtgaggttgcgtcgcgcgcggagcactctgggacttgtagttctggagatggagcgagctgtgccgctcgcggtgcctctgggtcagacagaggtgttccaggccttgcagcggctccatatgaccatcttctcccagagcgtctcaccatgtgggaagtttctggcggctggcaacaattacgggcagattgccatcttcagcttgtcctctgctttgagctcagaagccaaagaggaaagtaagaagccggtggtgactttccaagttctgcatttctctttagcccatgatgggcccgtctatagcatggtttccaccgatcgacatctgcttagtgctggggatggggaggtgaaggcctggctttgggcggagatgctcaagaagggctgtaaggagctgtggcgtcgtcagcctccatacaggaccagcctggaagtgcctgagatcaacgctttgctgctggtccccaaggagaattccctcatcctggctgggggagactgtcagttgcacactatggaccttgaaactgggactttcacgagggtcctccggggccacacagactacatccactgcctggcactgcgggaaaggagcccagaggtgctgtcaggtggcgaggatggagctgttcgactttgggacctgcgcacagccaaggaggtccagacgatcgaggtctataagcacgaggagtgctcgaggccccacaatgggcgctggattggatgtttggcaactgattccgactggatggtctgtggagggggcccagccctcaccctctggcacctccgatcctccacacccaccaccatcttccccatccgggcgccacagaagcacgtcaccttctaccaggacctgattctgtcagctggccagggccgctgcgtcaaccagtggcagctgagcggggagctgaaggcccaggtgcctggctcctccccagggctgctcagcctcagcctcaaccagcagcctgccgcgcctgagtgcaaggtcctgacagctgcaggcaacagctgccgggtggatgtcttcaccaacctgggttaccgagccttctccctgtccttctgatctctgacgacacccccagccagctcagggttttagagtgtttttcattttctttttttttttttttttacaataaagtttcaggcttttttaccatgctctttctttctatgaatgggggccaaatcggtggagtgatttatatattactctgtccgatcttgatacataaatacccagccccatccctgccctagaaaagatagacctatattaattcggaaaatagctctgttcacctgcccctgccacccacctggagctcctgccccacaaagctggcccctgctccggatgagcccctgctcccgatgagcccttgcccagcatcctggggcggggagggcatcagcttcttttggaagacaatctgggccctgtcgctccattggcctgaagaggaaagtgagcccctaagtgggcaagggcagccctctgggcccagccgtcaggtccttcggaagaggttactgagaaagccaccggcgggcccggggcccaggcgcagcgagaagcggggcgcggcacggcgcggggtcga

SEQ ID NO: 365458 - DNA, 2029 bp, Homo sapiens
gctttaggcgggcacagccgcgaggttctgcgcgggcgcggaagacgggcggcgcgtggcggaaggcaggcttgctcctcggggtgggggagggtatccggcttaagggggctgcggtggacaccacttcttaatgtcgggggtcttcgcggcgctcacctcggctcctagggttcgggacggtacgcaccagccaccttcgcgccgaaggcggtagggcgccacggagaggaaccgctctaggcacgtaaggcctcgtgaggttgcgtcgcgcgcggagcactctgggacttgtagttctggagatggagcgagctgtgccgctcgcggtgcctctgggtcagacagaggtgttccaggccttgcagcggctccatatgaccatcttctcccagagcgtctcaccatgtgggaagtttctggcggctggcaacaattacgggcagattgccatcttcagcttgtcctctgctttgagctcagaagccaaagaggaaagtaagaagccggtggtgactttccaaggtgggtatacctgtggagtctggcttcaggactttgggtgggattggctcactcagttctgcatttctctttagcccatgatgggcccgtctatagcatggtttccaccgatcgacatctgcttagtgctggggatggggaggtgaaggcctggctttgggcggagatgctcaagaaggtaaggagtcgagcttgggaaagggctggggtgcctggacccagagagagcctttgaggtcacctggtatatctcttttgaagggctgtaaggagctgtggcgtcgtcagcctccatacaggaccagcctggaagtgcctgagatcaacgctttgctgctggtccccaaggagaattccctcatcctggctgggggagactgtcagttgcacactatggaccttgaaactgggactttcacgagggtcctccggggccacacagactacatccactgcctggcactgcgggaaaggagcccagaggtgctgtcaggtggcgaggatggagctgttcgactttgggacctgcgcacagccaaggaggtccagacgatcgaggtctataagcacgaggagtgctcgaggccccacaatgggcgctggattggatgtttggcaactgattccgactggatggtctgtggagggggcccagccctcaccctctggcacctccgatcctccacacccaccaccatcttccccatccgggcgccacagaagcacgtcaccttctaccaggacctgattctgtcagctggccagggccgctgcgtcaaccagtggcagctgagcggggagctgaaggcccaggtgcctggctcctccccagggctgctcagcctcagcctcaaccagcagcctgccgcgcctgagtgcaaggtcctgacagctgcaggcaacagctgccgggtggatgtcttcaccaacctgggttaccgagccttctccctgtccttctgatctctgacgacacccccagccagctcagggttttagagtgtttttcattttctttttttttttttttttacaataaagtttcaggcttttttaccatgctctttctttctatgaatgggggccaaatcggtggagtgatttatatattactctgtccgatcttgatacataaatacccagccccatccctgccctagaaaagatagacctatattaattcggaaaatagctctgttcacctgcccctgccacccacctggagctcctgccccacaaagctggcccctgctccggatgagcccctgctcccgatgagcccttgcccagcatcctggggcggggagggcatcagcttcttttggaagacaatctgggccctgtcgctccattggcctgaagaggaaagtgagcccctaagtgggcaagggcagccctctgggcccagccgtcaggtccttcggaagaggttactgagaaagccaccggcgggcccggggcccaggcgcagcgagaagcggggcgcggcacggcgcggggtcga

SEQ ID NO: 365459 - DNA, 1177 bp, Homo sapiens
cctcatcctgctcctccacaggagaattccctcatcctggctgggggagactgtcagttgcacactatggaccttgaaactgggactttcacgagggtcctccggggccacacagactacatccactgcctggcactgcgggaaaggagcccagaggtgctgtcaggtggcgaggatggagctgttcgactttgggacctgcgcacagccaaggaggtccagacgatcgaggtctataagcacgaggagtgctcgaggccccacaatgggcgctggattggatgtttggcaactgattccgactggatggtctgtggagggggcccagccctcaccctctggcacctccgatcctccacacccaccaccatcttccccatccgggcgccacagaagcacgtcaccttctaccaggacctgattctgtcagctggccagggccgctgcgtcaaccagtggcagctgagcggggagctgaaggcccaggtgcctggctcctccccagggctgctcagcctcagcctcaaccagcagcctgccgcgcctgagtgcaaggtcctgacagctgcaggcaacagctgccgggtggatgtcttcaccaacctgggttaccgagccttctccctgtccttctgatctctgacgacacccccagccagctcagggttttagagtgtttttcattttctttttttttttttttttacaataaagtttcaggcttttttaccatgctctttctttctatgaatgggggccaaatcggtggagtgatttatatattactctgtccgatcttgatacataaatacccagccccatccctgccctagaaaagatagacctatattaattcggaaaatagctctgttcacctgcccctgccacccacctggagctcctgccccacaaagctggcccctgctccggatgagcccctgctcccgatgagcccttgcccagcatcctggggcggggagggcatcagcttcttttggaagacaatctgggccctgtcgctccattggcctgaagaggaaagtgagcccctaagtgggcaagggcagccctctgggcccagccgtcaggtccttcggaagaggttactgagaaagccaccggcgggcccggggcccaggcgcagcgagaagcggggcgcggcacggcgcggggtcga

SEQ ID NO: 365460 - DNA, 336 bp, Homo sapiens
  misc_feature (1)..(1): n is a, c, g, or t
ncagcgaacaaaagagcagttgctcttgggtccgacttcttcacttgacctaactgattatgcgaaatacccaagattcatgctactgtaccacagatttgttttcacagcaataaatcttcagttctttgtttatgattccacttaacaaaaggcctgcagaagtgatttattatttgggtatttggagataatacatttgatggttttttggaaaacctttttcactccatactcagatatgcttcattgtcaaatgcatatttagattagattattgaattgtaatgtttatctgctgctttttttaaataaaatttgactgaaaatgtttaa

SEQ ID NO: 365461 - DNA, 5260 bp, Homo sapiens
tatatttttaaattttgcatttgacttaaagtgccatgagaaaatttgcatactgcaaggtggtcctagccacctccttgatttgggtactcttggatatgttcctgctgctttacttcagtgaatgcaacaaatgtgatgaaaaaaaggagagaggacttcctgctggagatgttctagagccagtacaaaagcctcatgaaggtcctggagaaatggggaaaccagtcgtcattcctaaagaggatcaagaaaagatgaaagagatgtttaaaatcaatcagttcaatttaatggcaagtgagatgattgcactcaacagatctttaccagatgttaggttagaagggtgtaaaacaaaggtgtatccagataatcttcctacaacaagtgtggtgattgttttccacaatgaggcttggagcacacttctgcgaactgtccatagtgtcattaatcgctcaccaagacacatgatagaagaaattgttctagtagatgatgccagtgaaagagactttttgaaaaggcctttagagagttatgtgaaaaaactaaaagtaccagttcatgtaattcgaatggaacaacgttctggattgatcagagctagattaaaaggagctgctgtgtctaaaggccaagtgatcaccttcctggatgcccattgtgagtgtacagtgggatggctggagcctctcttggccaggatcaaacatgacaggagaacagtggtgtgtcccatcatcgatgtgatcagtgatgatacttttgagtacatggcaggctctgatatgacctatggtgggttcaactggaagctcaattttcgctggtatcctgttccccaaagagaaatggacagaaggaaaggtgatcggactcttcctgtcaggacacctaccatggcaggaggccttttttcaatagacagagattactttcaggaaattggaacatatgatgctggaatggatatttggggaggagaaaacctagaaatttcctttaggatttggcagtgtggaggaactttggaaattgttacatgctcacatgttggacatgtgtttcggaaagctacaccttacacgtttccaggaggcacagggcagattatcaataaaaataacagacgacttgcagaagtgtggatggatgaattcaagaatttcttctatataatttctccaggtgttacaaaggtagattatggagatatatcgtcaagagttggtctaagacacaaactacaatgcaaacctttttcctggtacctagagaatatatatcctgattctcaaattccacgtcactatttctcattgggagagatacgaaatgtggaaacgaatcagtgtctagataacatggctagaaaagagaatgaaaaagttggaatttttaattgccatggtatggggggtaatcaggttttctcttatactgccaacaaagaaattagaacagatgacctttgcttggatgtttccaaacttaatggcccagttacaatgctcaaatgccaccacctaaaaggcaaccaactctgggagtatgacccagtgaaattaaccctgcagcatgtgaacagtaatcagtgcctggataaagccacagaagaggatagccaggtgcccagcattagagactgcaatggaagtcggtcccagcagtggcttcttcgaaacgtcaccctgccagaaatattctgagaccaaatttacaaaaaaacgaaaaaaataaggattgactgggctacctcagcatacatttctgccacattcttaagtagcaaaaaaggaaaagtgctttcctcctctgcaggatgtaaggtttatcagccattaaaacttagacttctctagcttttcactagctgtgaaccagccttcctgtccatggacgtgaaactgcatagtaatgagactgtgcacactgatgtttacaagattgaaagagtctttctccgaaaatcatggtaaagaatactgagacaatgaaaaaaaatcaacaaaatatgctttctggagaactgtaccttttatggtttgcttgcacatcagtagtttctgctgaacgtgctgtcataatgaagagatttccaagattttttttcctgattagaactggtagccagtatattaaatattgatataaaaataaaagaactggaaccagattcagaatcatgaaaacaacatttttacaacaacaaaaaaactatattaaacagggtttaaaggaaattaaaacagaactatgagaagtacaatttgttatagtatagtatcaaatttctatatagattttatacctcagtggggaaaaataactgattccaatgacattcattttgttttcatctgtgatagtcatggatgcttttattttccttggggtgctgaaattgagctgaaaaaaaaaggctctttgaatatagttttaatttctctctacagttttttttgtttggtttgtgggctgttggaattgtaatttttaattgccttctaaaaaatggaaatttaacaatgtctgatctcagctgaacaaattagatgtttcagttgctcttgggtcaactggcttacagatttacatgtgcacacacacacaaatttcttatcacattttcgacttcttcacttgacctaactgattatgcgaaatacccaagattcatgctactgtaccacagatttgttttcacagcaataaatcttcagttctttgtttatgattccacttaacaaaaggcctgcagaagtgatttattatttgggtatttggagataatacatttgatggttttttggaaaacctttttcactccatactcagatatgcttcattgtcaaatgcatatttagattagattattgaattgtaatgtttatctgctgctttttttaaataaaatttgactgaaaatgtttaattggcattttttaatgacttagccaaagaagtgcagctattattccatattaataggcttgcatttcttttcctaaatcttatttaggctaaatcagttttatttttctctgattttttttaataccacagaatcacctgagtgtcaattgaaagttgtcaattaaaaggtaaccttttaatctcgtaggaggaatctcattaagacatttttcctgatatgtagagcagtctgttggcaaaaatgcatatattttctttcatatttgtaaaattatatttaatggaattcttttctttgattatcaaggactttcactgcaggcagtgctatttcttgtgcctaagaatgtttccaaaagtcgcatcgctaatgatatttgccaagttgagtgtacacaaagtttctcatatcctgttcaagttaatcaacatcaagcacatggggatgctttagggtgagtctatagtacaaaatgcataaaccatgtccccaggaaatttgaaaggaagcaggtgctgaatggaatttttttccttttccatgagctgtgttaattctatctccagtaggcctaatgcttgaataagcaagatgtctaatcaataaattattttcatgctcagaatttcaggtttttgtactccagcatagcttggtcttatttcttactgtatgaaagcttaacagcaatgtgatttaaggttttgttttaaatgggagatgtaagtgatttaattcatgggtacttttagaacctgatagataatcccattgcctttatttttctaattaaagaattcctaaatactttgaaaatacaaaatattcctgaatagttgtgccttacattggttttatttgaagttagagtggatccctgtttatcataattacttgtaattaggcagatgcttatcactctattataactcaaattgggaagaaaagaatgaaaaagaaaacaatggctgggtactggctcatacctgtaattttagcattttgggaaggtgagacgataggaccacttgagggcaggagtttgaggttgcagtgagctatgatggtgccactgcactccagcctgggcaacagagaagaaaccatgtatcttaaaaaaaaagaaaaaatgaaggatgaaaaagtgggattattatttaaccagtgaagaattcataaatgtgacaattaaggataatttgaatctcacaaatctattcaccccaccccagtcaaggtctattttaatatatctatcttcattggcattcttgagaaatagtgctgccattgaacattgggaatattcatccattctgcagatggaggacatcgtgcaggccatgtcctcattgctcccattctacatttagctgagaaacagaggttcctctttgtaaggatttgatgctcttctcatcttccaagaagtataccaagagcaaatttaactctatagttacctgttcttcaaagaaaaaagaaacttagaaggtagtgtttctgaggtcataactgtgaggggttgtatacaaagaatgagtcactttttaagccatttggaaaattagatctgtttctaattagatgacattttctccattctctgatttcctgaagattgccaagcatttgcttgataatctaccaggactgataattttgcagaatatgaggcaaatatatgaaattcagttgtgtatctatatcctagcaacaaacacttgaaaatataacgttaaaatatgccatttgtaatagcatcaaataagtcaaacttctaagtaggaagaaagttaacaacaagacctctactctgaaaactacaaaacagtgctgggaagaattatagagcaccaaaataaatggctattctatgctcatggattgaaagactgcataatggtaagatgtcagttccccacaaattgttatctagattcaatgagatcaaaatcccacaaggccatcttgtagaaattggcaaatacatatatgaaaatgcaacagattctaagtagccaagataattttgaagaagaaaaatattaagagagtatggtactagagttaggataaacaacaaatagaaatagacatgtccagaaatagacccacatgtatatggttattggcttttcaacaaaaacaagctattcaatagaaaaagggaagatttttcagttggagttgaagtaactggatgtctgggaaaaagcaatgttaataatgccttcttcataccatgcacagtttattcaaaatggattatagaactaaatgtgaatggcaaaacaataaatcttgtaaaaggaa

SEQ ID NO: 365462 - DNA, 3568 bp, Homo sapiens
tatatttttaaattttgcatttgacttaaagtgccatgagaaaatttgcatactgcaaggtggtcctagccacctccttgatttgggtactcttggatatgttcctgctgctttacttcagtgaatgcaacaaatgtgatgaaaaaaaggagagaggacttcctgctggagatgttctagagccagtacaaaagcctcatgaaggtcctggagaaatggggaaaccagtcgtcattcctaaagaggatcaagaaaagatgaaagagatgtttaaaatcaatcagttcaatttaatggcaagtgagatgattgcactcaacagatctttaccagatgttaggttagaagggtgtaaaacaaaggtgtatccagataatcttcctacaacaagtgtggtgattgttttccacaatgaggcttggagcacacttctgcgaactgtccatagtgtcattaatcgctcaccaagacacatgatagaagaaattgttctagtagatgatgccagtgaaagagactttttgaaaaggcctttagagagttatgtgaaaaaactaaaagtaccagttcatgtaattcgaatggaacaacgttctggattgatcagagctagattaaaaggagctgctgtgtctaaaggccaagtgatcaccttcctggatgcccattgtgagtgtacagtgggatggctggagcctctcttggccaggatcaaacatgacaggagaacagtggtgtgtcccatcatcgatgtgatcagtgatgatacttttgagtacatggcaggctctgatatgacctatggtgggttcaactggaagctcaattttcgctggtatcctgttccccaaagagaaatggacagaaggaaaggtgatcggactcttcctgtcaggacacctaccatggcaggaggccttttttcaatagacagagattactttcaggaaattggaacatatgatgctggaatggatatttggggaggagaaaacctagaaatttcctttaggatttggcagtgtggaggaactttggaaattgttacatgctcacatgttggacatgtgtttcggaaagctacaccttacacgtttccaggaggcacagggcagattatcaataaaaataacagacgacttgcagaagtgtggatggatgaattcaagaatttcttctatataatttctccaggtgttacaaaggtagattatggagatatatcgtcaagagttggtctaagacacaaactacaatgcaaacctttttcctggtacctagagaatatatatcctgattctcaaattccacgtcactatttctcattgggagagatacgaaatgtggaaacgaatcagtgtctagataacatggctagaaaagagaatgaaaaagttggaatttttaattgccatggtatggggggtaatcaggttttctcttatactgccaacaaagaaattagaacagatgacctttgcttggatgtttccaaacttaatggcccagttacaatgctcaaatgccaccacctaaaaggcaaccaactctgggagtatgacccagtgaaattaaccctgcagcatgtgaacagtaatcagtgcctggataaagccacagaagaggatagccaggtgcccagcattagagactgcaatggaagtcggtcccagcagtggcttcttcgaaacgtcaccctgccagaaatattctgagaccaaatttacaaaaaaacgaaaaaaataaggattgactgggctacctcagcatacatttctgccacattcttaagtagcaaaaaaggaaaagtgctttcctcctctgcaggatgtaaggtttatcagccattaaaacttagacttctctagcttttcactagctgtgaaccagccttcctgtccatggacgtgaaactgcatagtaatgagactgtgcacactgatgtttacaagattgaaagagtctttctccgaaaatcatggtaaagaatactgagacaatgaaaaaaaatcaacaaaatatgctttctggagaactgtaccttttatggtttgcttgcacatcagtagtttctgctgaacgtgctgtcataatgaagagatttccaagattttttttcctgattagaactggtagccagtatattaaatattgatataaaaataaaagaactggaaccagattcagaatcatgaaaacaacatttttacaacaacaaaaaaactatattaaacagggtttaaaggaaattaaaacagaactatgagaagtacaatttgttatagtatagtatcaaatttctatatagattttatacctcagtggggaaaaataactgattccaatgacattcattttgttttcatctgtgatagtcatggatgcttttattttccttggggtgctgaaattgagctgaaaaaaaaaggctctttgaatatagttttaatttctctctacagttttttttgtttggtttgtgggctgttggaattgtaatttttaattgccttctaaaaaatggaaatttaacaatgtctgatctcagctgaacaaattagatgtttcagttgctcttgggtcaactggcttacagatttacatgtgcacacacacacaaatttcttatcacattttcgacttcttcacttgacctaactgattatgcgaaatacccaagattcatgctactgtaccacagatttgttttcacagcaataaatcttcagttctttgtttatgattccacttaacaaaaggcctgcagaagtgatttattatttgggtatttggagataatacatttgatggttttttggaaaacctttttcactccatactcagatatgcttcattgtcaaatgcatatttagattagattattgaattgtaatgtttatctgctgctttttttaaataaaatttgactgaaaatgtttaattggcattttttaatgacttagccaaagaagtgcagctattattccatattaataggcttgcatttcttttcctaaatcttatttaggctaaatcagttttatttttctctgattttttttaataccacagaatcacctgagtgtcaattgaaagttgtcaattaaaaggtaaccttttaatctcgtaggaggaatctcattaagacatttttcctgatatgtagagcagtctgttggcaaaaatgcatatattttctttcatatttgtaaaattatatttaatggaattcttttctttgattatcaaggactttcactgcaggcagtgctatttcttgtgcctaagaatgtttccaaaagtcgcatcgctaatgatatttgccaagttgagtgtacacaaagtttctcatatcctgttcaagttaatcaacatcaagcacatggggatgctttagggtgagtctatagtacaaaatgcataaaccatgtccccaggaaatttgaaaggaagcaggtgctgaatggaatttttttccttttccatgagctgtgttaattctatctccagtaggcctaatgcttgaataagcaagatgtctaatcaataaattattttcatgctcaga

SEQ ID NO: 365463 - DNA, 3054 bp, Homo sapiens
cgagcggcctgcggggcgcccctgcggccgggcccgccgcggcggagcttgccgccgcgcgcctagcgaggtgccatgagaaaatttgcatactgcaaggtggtcctagccacctccttgatttgggtactcttggatatgttcctgctgctttacttcagtgaatgcaacaaatgtgatgaaaaaaaggagagaggacttcctgctggagatgcgcaggtaaattgaacatgaaattggaaattgacaaggatgttgaagtagcagaaagttaccagtgagttaagttctagagccagtacaaaagcctcatgaaggtcctggagaaatggggaaaccagtcgtcattcctaaagaggatcaagaaaagatgaaagagatgtttaaaatcaatcagttcaatttaatggcaagtgagatgattgcactcaacagatctttaccagatgttaggttagaagggtgtaaaacaaaggtgtatccagataatcttcctacaacaagtgtggtgattgttttccacaatgaggcttggagcacacttctgcgaactgtccatagtgtcattaatcgctcaccaagacacatgatagaagaaattgttctagtagatgatgccagtgaaagagactttttgaaaaggcctttagagagttatgtgaaaaaactaaaagtaccagttcatgtaattcgaatggaacaacgttctggattgatcagagctagattaaaaggagctgctgtgtctaaaggccaagtgatcaccttcctggatgcccattgtgagtgtacagtgggatggctggagcctctcttggccaggatcaaacatgacaggagaacagtggtgtgtcccatcatcgatgtgatcagtgatgatacttttgagtacatggcaggctctgatatgacctatggtgggttcaactggaagctcaattttcgctggtatcctgttccccaaagagaaatggacagaaggaaaggtgatcggactcttcctgtcaggacacctaccatggcaggaggccttttttcaatagacagagattactttcaggaaattggaacatatgatgctggaatggatatttggggaggagaaaacctagaaatttcctttaggatttggcagtgtggaggaactttggaaattgttacatgctcacatgttggacatgtgtttcggaaagctacaccttacacgtttccaggaggcacagggcagattatcaataaaaataacagacgacttgcagaagtgtggatggatgaattcaagaatttcttctatataatttctccaggtgttacaaaggtagattatggagatatatcgtcaagagttggtctaagacacaaactacaatgcaaacctttttcctggtacctagagaatatatatcctgattctcaaattccacgtcactatttctcattgggagagatacgaaatgtggaaacgaatcagtgtctagataacatggctagaaaagagaatgaaaaagttggaatttttaattgccatggtatggggggtaatcaggttttctcttatactgccaacaaagaaattagaacagatgacctttgcttggatgtttccaaacttaatggcccagttacaatgctcaaatgccaccacctaaaaggcaaccaactctgggagtatgacccagtgaaattaaccctgcagcatgtgaacagtaatcagtgcctggataaagccacagaagaggatagccaggtgcccagcattagagactgcaatggaagtcggtcccagcagtggcttcttcgaaacgtcaccctgccagaaatattctgagaccaaatttacaaaaaaacgaaaaaaataaggattgactgggctacctcagcatacatttctgccacattcttaagtagcaaaaaaggaaaagtgctttcctcctctgcaggatgtaaggtttatcagccattaaaacttagacttctctagcttttcactagctgtgaaccagccttcctgtccatggacgtgaaactgcatagtaatgagactgtgcacactgatgtttacaagattgaaagagtctttctccgaaaatcatggtaaagaatactgagacaatgaaaaaaaatcaacaaaatatgctttctggagaactgtaccttttatggtttgcttgcacatcagtagtttctgctgaacgtgctgtcataatgaagagatttccaagattttttttcctgattagaactggtagccagtatattaaatattgatataaaaataaaagaactggaaccagattcagaatcatgaaaacaacatttttacaacaacaaaaaaactatattaaacagggtttaaaggaaattaaaacagaactatgagaagtacaatttgttatagtatagtatcaaatttctatatagattttatacctcagtggggaaaaataactgattccaatgacattcattttgttttcatctgtgatagtcatggatgcttttattttccttggggtgctgaaattgagctgaaaaaaaaaggctctttgaatatagttttaatttctctctacagttttttttgtttggtttgtgggctgttggaattgtaatttttaattgccttctaaaaaatggaaatttaacaatgtctgatctcagctgaacaaattagatgtttcagttgctcttgggtcaactggcttacagatttacatgtgcacacacacacaaatttcttatcacattttcgacttcttcacttgacctaactgattatgcgaaatacccaagattcatgctactgtaccacagatttgttttcacagcaataaatcttcagttctttgtttatgattccacttaacaaaaggcctgcagaagtgatttattatttgggtatttggagataatacatttgatggttttttggaaaacctttttcactccatactcagatatgcttcattgtcaaatgcatatttagattagattattgaattgtaatgtttatctgctgctttttttaaataaaatttgactgaaaatgtttaa

SEQ ID NO: 365464 - DNA, 3290 bp, Homo sapiens
  misc_feature (3290)..(3290): n is a, c, g, or t
tatatttttaaattttgcatttgacttaaagtgccatgagaaaatttgcatactgcaaggtggtcctagccacctccttgatttgggtactcttggatatgttcctgctgctttacttcagtgaatgcaacaaatgtgatgaaaaaaaggagagaggacttcctgctggagatgttctagagccagtacaaaagcctcatgaaggtcctggagaaatggggaaaccagtcgtcattcctaaagaggatcaagaaaagatgaaagagatgtttaaaatcaatcagttcaatttaatggcaagtgagatgattgcactcaacagatctttaccagatgttaggttagaagggtgtaaaacaaaggtgtatccagataatcttcctacaacaagtgtggtgattgttttccacaatgaggcttggagcacacttctgcgaactgtccatagtgtcattaatcgctcaccaagacacatgatagaagaaattgttctagtagatgatgccagtgaaagagactttttgaaaaggcctttagagagttatgtgaaaaaactaaaagtaccagttcatgtaattcgaatggaacaacgttctggattgatcagagctagattaaaaggagctgctgtgtctaaaggccaagtgatcaccttcctggatgcccattgtgagtgtacagtgggatggctggagcctctcttggccaggatcaaacatgacaggagaacagtggtgtgtcccatcatcgatgtgatcagtgatgatacttttgagtacatggcaggctctgatatgacctatggtgggttcaactggaagctcaattttcgctggtatcctgttccccaaagagaaatggacagaaggaaaggtgatcggactcttcctgtcaggacacctaccatggcaggaggccttttttcaatagacagagattactttcaggaaattggaacatatgatgctggaatggatatttggggaggagaaaacctagaaatttcctttaggatttggcagtgtggaggaactttggaaattgttacatgctcacatgttggacatgtgtttcggaaagctacaccttacacgtttccaggaggcacagggcagattatcaataaaaataacagacgacttgcagaagtgtggatggatgaattcaagaatttcttctatataatttctccaggtgttacaaaggtagattatggagatatatcgtcaagagttggtctaagacacaaactacaatgcaaacctttttcctggtacctagagaatatatatcctgattctcaaattccacgtcactatttctcattgggagagatacgaaatgtggaaacgaatcagtgtctagataacatggctagaaaagagaatgaaaaagttggaatttttaattgccatggtatggggggtaatcaggttttctcttatactgccaacaaagaaattagaacagatgacctttgcttggatgtttccaaacttaatggcccagttacaatgctcaaatgccaccacctaaaaggcaaccaactctgggagtatgacccagtgaaattaaccctgcagcatgtgaacagtaatcagtgcctggataaagccacagaagaggatagccaggtgcccagcattagagactgcaatggaagtcggtcccagcagtggcttcttcgaaacgtcaccctgccagaaatattctgagaccaaatttacaaaaaaacgaaaaaaataaggattgactgggctacctcagcatacatttctgccacattcttaagtagcaaaaaaggaaaagtgctttcctcctctgcaggatgtaaggtttatcagccattaaaacttagacttctctagcttttcactagctgtgaaccagccttcctgtccatggacgtgaaactgcatagtaatgagactgtgcacactgatgtttacaagattgaaagagtctttctccgaaaatcatggtaaagaatactgagacaatgaaaaaaaatcaacaaaatatgctttctggagaactgtaccttttatggtttgcttgcacatcagtagtttctgctgaacgtgctgtcataatgaagagatttccaagattttttttcctgattagaactggtagccagtatattaaatattgatataaaaataaaagaactggaaccagattcagaatcatgaaaacaacatttttacaacaacaaaaaaactatattaaacagggtttaaaggaaattaaaacagaactatgagaagtacaatttgttatagtatagtatcaaatttctatatagattttatacctcagtggggaaaaataactgattccaatgacattcattttgttttcatctgtgatagtcatggatgcttttattttccttggggtgctgaaattgagctgaaaaaaaaaggctctttgaatatagttttaatttctctctacagttttttttgtttggtttgtgggctgttggaattgtaatttttaattgccttctaaaaaatggaaatttaacaatgtctgatctcagctgaacaaattagatgtttcagttgctcttgggtcaactggcttacagatttacatgtgcacacacacacaaatttcttatcacattttcgacttcttcacttgacctaactgattatgcgaaatacccaagattcatgctactgtaccacagatttgttttcacagcaataaatcttcagttctttgtttatgattccacttaacaaaaggcctgcagaagtgatttattatttgggtatttggagataatacatttgatggttttttggaaaacctttttcactccatactcagatatgcttcattgtcaaatgcatatttagattagattattgaattgtaatgtttatctgctgctttttttaaataaaatttgactgaaaatgtttaagaagagaaaaaaaaaaagaaaaaaaaaaaaaaaaagatttggggggcgccttgggccctggaaaaagtttttaaagaacacatacgtttgggggcgcggggggccccacataggttaacgtagaaccggtgtgccaaagaggtgggtcacccaaagagaagaacccggggcgcaaacagacatgagggcgtggggatctcccccaccagatgaaaaaaaacgccccggcgggggaacaccgccgagggttctgtaaaaaaaatccaggagggagaagccggaaaggaccaaaaggggggcattcactcaccaacgaggaggcacaaggggacgccgatatataaatacn

SEQ ID NO: 365465 - DNA, 2887 bp, Homo sapiens
tatatttttaaattttgcatttgacttaaagtgccatgagaaaatttgcatactgcaaggtggtcctagccacctccttgatttgggtactcttggatatgttcctgctgctttacttcagtgaatgcaacaaatgtgatgaaaaaaaggagagaggacttcctgctggagatgttctagagccagtacaaaagcctcatgaaggtcctggagaaatggggaaaccagtcgtcattcctaaagaggatcaagaaaagatgaaagagatgtttaaaatcaatcagttcaatttaatggcaagtgagatgattgcactcaacagatctttaccagatgttaggttagaagggtgtaaaacaaaggtgtatccagataatcttcctacaacaagtgtggtgattgttttccacaatgaggcttggagcacacttctgcgaactgtccatagtgtcattaatcgctcaccaagacacatgatagaagaaattgttctagtagatgatgccagtgaaagagactttttgaaaaggcctttagagagttatgtgaaaaaactaaaagtaccagttcatgtaattcgaatggaacaacgttctggattgatcagagctagatttgagtgtacagtgggatggctggagcctctcttggccaggatcaaacatgacaggagaacagtggtgtgtcccatcatcgatgtgatcagtgatgatacttttgagtacatggcaggctctgatatgacctatggtgggttcaactggaagctcaattttcgctggtatcctgttccccaaagagaaatggacagaaggaaaggtgatcggactcttcctgtcaggacacctaccatggcaggaggccttttttcaatagacagagattactttcaggaaattggaacatatgatgctggaatggatatttggggaggagaaaacctagaaatttcctttaggatttggcagtgtggaggaactttggaaattgttacatgctcacatgttggacatgtgtttcggaaagctacaccttacacgtttccaggaggcacagggcagattatcaataaaaataacagacgacttgcagaagtgtggatggatgaattcaagaatttcttctatataatttctccaggtgttacaaaggtagattatggagatatatcgtcaagagttggtctaagacacaaactacaatgcaaacctttttcctggtacctagagaatatatatcctgattctcaaattccacgtcactatttctcattgggagagatacgaaatgtggaaacgaatcagtgtctagataacatggctagaaaagagaatgaaaaagttggaatttttaattgccatggtatggggggtaatcaggttttctcttatactgccaacaaagaaattagaacagatgacctttgcttggatgtttccaaacttaatggcccagttacaatgctcaaatgccaccacctaaaaggcaaccaactctgggagtatgacccagtgaaattaaccctgcagcatgtgaacagtaatcagtgcctggataaagccacagaagaggatagccaggtgcccagcattagagactgcaatggaagtcggtcccagcagtggcttcttcgaaacgtcaccctgccagaaatattctgagaccaaatttacaaaaaaacgaaaaaaataaggattgactgggctacctcagcatacatttctgccacattcttaagtagcaaaaaaggaaaagtgctttcctcctctgcaggatgtaaggtttatcagccattaaaacttagacttctctagcttttcactagctgtgaaccagccttcctgtccatggacgtgaaactgcatagtaatgagactgtgcacactgatgtttacaagattgaaagagtctttctccgaaaatcatggtaaagaatactgagacaatgaaaaaaaatcaacaaaatatgctttctggagaactgtaccttttatggtttgcttgcacatcagtagtttctgctgaacgtgctgtcataatgaagagatttccaagattttttttcctgattagaactggtagccagtatattaaatattgatataaaaataaaagaactggaaccagattcagaatcatgaaaacaacatttttacaacaacaaaaaaactatattaaacagggtttaaaggaaattaaaacagaactatgagaagtacaatttgttatagtatagtatcaaatttctatatagattttatacctcagtggggaaaaataactgattccaatgacattcattttgttttcatctgtgatagtcatggatgcttttattttccttggggtgctgaaattgagctgaaaaaaaaaggctctttgaatatagttttaatttctctctacagttttttttgtttggtttgtgggctgttggaattgtaatttttaattgccttctaaaaaatggaaatttaacaatgtctgatctcagctgaacaaattagatgtttcagttgctcttgggtcaactggcttacagatttacatgtgcacacacacacaaatttcttatcacattttcgacttcttcacttgacctaactgattatgcgaaatacccaagattcatgctactgtaccacagatttgttttcacagcaataaatcttcagttctttgtttatgattccacttaacaaaaggcctgcagaagtgatttattatttgggtatttggagataatacatttgatggttttttggaaaacctttttcactccatactcagatatgcttcattgtcaaatgcatatttagattagattattgaattgtaatgtttatctgctgctttttttaaataaaatttgactgaaaatgtttaa

SEQ ID NO: 365466 - DNA, 2879 bp, Homo sapiens
tatatttttaaattttgcatttgacttaaagtgccatgagaaaatttgcatactgcaaggtggtcctagccacctccttgatttgggtactcttggatatgttcctgctgctttacttcagtgaatgcaacaaatgtgatgaaaaaaaggagagaggacttcctgctggagatgttctagagccagtacaaaagcctcatgaaggtcctggagaaatggggaaaccagtcgtcattcctaaagaggatcaagaaaagatgaaagagatgtttaaaatcaatcagttcaatttaatggcaagtgagatgattgcactcaacagatctttaccagatgttaggttagaagggtgtaaaacaaaggtgtatccagataatcttcctacaacaagtgtggtgattgttttccacaatgaggcttggagcacacttctgcgaactgtccatagtgtcattaatcgctcaccaagacacatgatagaagaaattgttctagtagatgatgccagtgaaagagactttttgaaaaggcctttagagagttatgtgaaaaaactaaaagtaccagttcatgtaattcgaatggaacaacgttctggattgatcagagctagattaaaaggagctgctgtgtctaaaggccaagtgatcaccttcctggatgcccattgtgagtgtacagtgggatggctggagcctctcttggccaggatcaaacatgacaggagaacagtggtgtgtcccatcatcgatgtgatcagtgatgatacttttgagtacatggcaggctctgatatgacctatggtgggttcaactggaagctcaattttcgctggtatcctgttccccaaagagaaatggacagaaggaaaggtgatcggactcttcctgtcaggacacctaccatggcaggaggccttttttcaatagacagagattactttcaggaaattggaacatatgatgctggaatggatatttggggaggagaaaacctagaaatttcctttaggatttggcagtgtggaggaactttggaaattgttacatgctcacatgttggacatgtgtttcggaaagctacaccttacacgtttccaggaggcacagggcagattatcaataaaaataagtgttacaaaggtagattatggagatatatcgtcaagagttggtctaagacacaaactacaatgcaaacctttttcctggtacctagagaatatatatcctgattctcaaattccacgtcactatttctcattgggagagatacgaaatgtggaaacgaatcagtgtctagataacatggctagaaaagagaatgaaaaagttggaatttttaattgccatggtatggggggtaatcaggttttctcttatactgccaacaaagaaattagaacagatgacctttgcttggatgtttccaaacttaatggcccagttacaatgctcaaatgccaccacctaaaaggcaaccaactctgggagtatgacccagtgaaattaaccctgcagcatgtgaacagtaatcagtgcctggataaagccacagaagaggatagccaggtgcccagcattagagactgcaatggaagtcggtcccagcagtggcttcttcgaaacgtcaccctgccagaaatattctgagaccaaatttacaaaaaaacgaaaaaaataaggattgactgggctacctcagcatacatttctgccacattcttaagtagcaaaaaaggaaaagtgctttcctcctctgcaggatgtaaggtttatcagccattaaaacttagacttctctagcttttcactagctgtgaaccagccttcctgtccatggacgtgaaactgcatagtaatgagactgtgcacactgatgtttacaagattgaaagagtctttctccgaaaatcatggtaaagaatactgagacaatgaaaaaaaatcaacaaaatatgctttctggagaactgtaccttttatggtttgcttgcacatcagtagtttctgctgaacgtgctgtcataatgaagagatttccaagattttttttcctgattagaactggtagccagtatattaaatattgatataaaaataaaagaactggaaccagattcagaatcatgaaaacaacatttttacaacaacaaaaaaactatattaaacagggtttaaaggaaattaaaacagaactatgagaagtacaatttgttatagtatagtatcaaatttctatatagattttatacctcagtggggaaaaataactgattccaatgacattcattttgttttcatctgtgatagtcatggatgcttttattttccttggggtgctgaaattgagctgaaaaaaaaaggctctttgaatatagttttaatttctctctacagttttttttgtttggtttgtgggctgttggaattgtaatttttaattgccttctaaaaaatggaaatttaacaatgtctgatctcagctgaacaaattagatgtttcagttgctcttgggtcaactggcttacagatttacatgtgcacacacacacaaatttcttatcacattttcgacttcttcacttgacctaactgattatgcgaaatacccaagattcatgctactgtaccacagatttgttttcacagcaataaatcttcagttctttgtttatgattccacttaacaaaaggcctgcagaagtgatttattatttgggtatttggagataatacatttgatggttttttggaaaacctttttcactccatactcagatatgcttcattgtcaaatgcatatttagattagattattgaattgtaatgtttatctgctgctttttttaaataaaatttgactgaaaatgtttaa

SEQ ID NO: 365467 - DNA, 1784 bp, Homo sapiens
ttgtaagacctttctagaccaatgaattttagatactcagacagcgataggccaataggccatttcagagtagggccagggaaagtttaggttgatatttagtgtatatgtgtgtgtatctgtctgtctaattaacttctccaactcctgatattttcattatttattgtcccatagatacgaaatgtggaaacgaatcagtgtctagataacatggctagaaaagagaatgaaaaagttggaatttttaattgccatggtatggggggtaatcaggttttctcttatactgccaacaaagaaattagaacagatgacctttgcttggatgtttccaaacttaatggcccagttacaatgctcaaatgccaccacctaaaaggcaaccaactctgggagtatgacccagtgaaattaaccctgcagcatgtgaacagtaatcagtgcctggataaagccacagaagaggatagccaggtgcccagcattagagactgcaatggaagtcggtcccagcagtggcttcttcgaaacgtcaccctgccagaaatattctgagaccaaatttacaaaaaaacgaaaaaaataaggattgactgggctacctcagcatacatttctgccacattcttaagtagcaaaaaaggaaaagtgctttcctcctctgcaggatgtaaggtttatcagccattaaaacttagacttctctagcttttcactagctgtgaaccagccttcctgtccatggacgtgaaactgcatagtaatgagactgtgcacactgatgtttacaagattgaaagagtctttctccgaaaatcatggtaaagaatactgagacaatgaaaaaaaatcaacaaaatatgctttctggagaactgtaccttttatggtttgcttgcacatcagtagtttctgctgaacgtgctgtcataatgaagagatttccaagattttttttcctgattagaactggtagccagtatattaaatattgatataaaaataaaagaactggaaccagattcagaatcatgaaaacaacatttttacaacaacaaaaaaactatattaaacagggtttaaaggaaattaaaacagaactatgagaagtacaatttgttatagtatagtatcaaatttctatatagattttatacctcagtggggaaaaataactgattccaatgacattcattttgttttcatctgtgatagtcatggatgcttttattttccttggggtgctgaaattgagctgaaaaaaaaaggctctttgaatatagttttaatttctctctacagttttttttgtttggtttgtgggctgttggaattgtaatttttaattgccttctaaaaaatggaaatttaacaatgtctgatctcagctgaacaaattagatgtttcagttgctcttgggtcaactggcttacagatttacatgtgcacacacacacaaatttcttatcacattttcgacttcttcacttgacctaactgattatgcgaaatacccaagattcatgctactgtaccacagatttgttttcacagcaataaatcttcagttctttgtttatgattccacttaacaaaaggcctgcagaagtgatttattatttgggtatttggagataatacatttgatggttttttggaaaacctttttcactccatactcagatatgcttcattgtcaaatgcatatttagattagattattgaattgtaatgtttatctgctgctttttttaaataaaatttgactgaaaatgtttaa

SEQ ID NO: 365468 - DNA, 1700 bp, Homo sapiens
  misc_feature (163)..(163): n is a, c, g, or t
gaaattatatagaagaaattcttgaattcatccatccacacttctgcaagtcgtctgttatttttattgataatctgccctgcctcctggaaacgtgtaaggtgtagctttccgaaacacatgtccaacatgtgagcatgtaacaatttccaaagttcctccncactgccaaatcctaaaggaaatttccaggttttctcttatactgccaacaaagaaattagaacagatgacctttgcttggatgtttccaaacttaatggcccagttacaatgctcaaatgccaccacctaaaaggcaaccaactctgggagtatgacccagtgaaattaaccctgcagcatgtgaacagtaatcagtgcctggataaagccacagaagaggatagccaggtgcccagcattagagactgcaatggaagtcggtcccagcagtggcttcttcgaaacgtcaccctgccagaaatattctgagaccaaatttacaaaaaaacgaaaaaaataaggattgactgggctacctcagcatacatttctgccacattcttaagtagcaaaaaaggaaaagtgctttcctcctctgcaggatgtaaggtttatcagccattaaaacttagacttctctagcttttcactagctgtgaaccagccttcctgtccatggacgtgaaactgcatagtaatgagactgtgcacactgatgtttacaagattgaaagagtctttctccgaaaatcatggtaaagaatactgagacaatgaaaaaaaatcaacaaaatatgctttctggagaactgtaccttttatggtttgcttgcacatcagtagtttctgctgaacgtgctgtcataatgaagagatttccaagattttttttcctgattagaactggtagccagtatattaaatattgatataaaaataaaagaactggaaccagattcagaatcatgaaaacaacatttttacaacaacaaaaaaactatattaaacagggtttaaaggaaattaaaacagaactatgagaagtacaatttgttatagtatagtatcaaatttctatatagattttatacctcagtggggaaaaataactgattccaatgacattcattttgttttcatctgtgatagtcatggatgcttttattttccttggggtgctgaaattgagctgaaaaaaaaaggctctttgaatatagttttaatttctctctacagttttttttgtttggtttgtgggctgttggaattgtaatttttaattgccttctaaaaaatggaaatttaacaatgtctgatctcagctgaacaaattagatgtttcagttgctcttgggtcaactggcttacagatttacatgtgcacacacacacaaatttcttatcacattttcgacttcttcacttgacctaactgattatgcgaaatacccaagattcatgctactgtaccacagatttgttttcacagcaataaatcttcagttctttgtttatgattccacttaacaaaaggcctgcagaagtgatttattatttgggtatttggagataatacatttgatggttttttggaaaacctttttcactccatactcagatatgcttcattgtcaaatgcatatttagattagattattgaattgtaatgtttatctgctgctttttttaaataaaatttgactgaaaatgtttaa

SEQ ID NO: 365469 - DNA, 825 bp, Homo sapiens
gatcaagaaaagatgaaagagatgtttaaaatcaatcagttcaatttaatggcaagtgagatgattgcactcaacagatctttaccagatgttaggttagaagggtaagtacttactgtggtcctgatagtatgtgaatgaaaagtatattctgaattttcagtaaattgcacttgagtgctgattgttcttaaggcaaatgttatatcactatgttactacttaccccacttagaaaataattaaatgctgatagaaataatatctcaagcttctactgattattagcactatgtatttcaggcattggaagataattatttatcttaatggattagaaggggattttaaactttattattaccaaaatactcacatactcaactttttacaaaaagatttaagttgtatgtaacttgaaacagtgaaatacacagtcgtaagtatacagctcactgaattttttgctatgtatacacctgtgtaaccatcagccaaatcaagacatagaatgatcccatcacccctgaaagtctccttatgttttttgtagtcattacttacatccccagaggcagccgttatattgacctctctaaacatagattagttttgtctctttttgaactttttatgatggatccacaccattttttgtgcctttaagattcatattgttgcatgtatcagaattttattcttttctactgcaaatagtgatttgtaatatgaatatgccattgtttatttatacattgatagacctttggattatttctactttttgacccctataaataaagctattgtgacattcttgttcat

SEQ ID NO: 365470 - DNA, 5314 bp, Homo sapiens
tatatttttaaattttgcatttgacttaaagtgccatgagaaaatttgcatactgcaaggtggtcctagccacctccttgatttgggtactcttggatatgttcctgctgctttacttcagtgaatgcaacaaatgtgatgaaaaaaaggagagaggacttcctgctggagatgttctagagccagtacaaaagcctcatgaaggtcctggagaaatggggaaaccagtcgtcattcctaaagaggatcaagaaaagatgaaagagatgtttaaaatcaatcagttcaatttaatggcaagtgagatgattgcactcaacagatctttaccagatgttaggttagaagggtgtaaaacaaaggtgtatccagataatcttcctacaacaagtgtggtgattgttttccacaatgaggcttggagcacacttctgcgaactgtccatagtgtcattaatcgctcaccaagacacatgatagaagaaattgttctagtagatgatgccagtgaaagagactttttgaaaaggcctttagagagttatgtgaaaaaactaaaagtaccagttcatgtaattcgaatggaacaacgttctggattgatcagagctagattaaaaggagctgctgtgtctaaaggccaagtgatcaccttcctggatgcccattgtgagtgtacagtgggatggctggagcctctcttggccaggatcaaacatgacaggagaacagtggtgtgtcccatcatcgatgtgatcagtgatgatacttttgagtacatggcaggctctgatatgacctatggtgggttcaactggaagctcaattttcgctggtatcctgttccccaaagagaaatggacagaaggaaaggtgatcggactcttcctgtcaggacacctaccatggcaggaggccttttttcaatagacagagattactttcaggaaattggaacatatgatgctggaatggatatttggggaggagaaaacctagaaatttcctttaggatttggcagtgtggaggaactttggaaattgttacatgctcacatgttggacatgtgtttcggaaagctacaccttacacgtttccaggaggcacagggcagattatcaataaaaataacagacgacttgcagaagtgtggatggatgaattcaagaatttcttctatataatttctccaggtgttacaaaggtagattatggagatatatcgtcaagagttggtctaagacacaaactacaatgcaaacctttttcctggtacctagagaatatatatcctgattctcaaattccacgtcactatttctcattgggagagatacgaaatgtggaaacgaatcagtgtctagataacatggctagaaaagagaatgaaaaagttggaatttttaattgccatggtatggggggtaatcaggttttctcttatactgccaacaaagaaattagaacagatgacctttgcttggatgtttccaaacttaatggcccagttacaatgctcaaatgccaccacctaaaaggcaaccaactctgggagtatgacccagtgaaattaaccctgcagcatgtgaacagtaatcagtgcctggataaagccacagaagaggatagccaggtgcccagcattagagactgcaatggaagtcggtcccagcagtggcttcttcgaaacgtcaccctgccagaaatattctgagaccaaatttacaaaaaaacgaaaaaaataaggattgactgggctacctcagcatacatttctgccacattcttaagtagcaaaaaaggaaaagtgctttcctcctctgcaggatgtaaggtttatcagccattaaaacttagacttctctagcttttcactagctgtgaaccagccttcctgtccatggacgtgaaactgcatagtaatgagactgtgcacactgatgtttacaagattgaaagagtctttctccgaaaatcatggtaaagaatactgagacaatgaaaaaaaatcaacaaaatatgctttctggagaactgtaccttttatggtttgcttgcacatcagtagtttctgctgaacgtgctgtcataatgaagagatttccaagattttttttcctgattagaactggtagccagtatattaaatattgatataaaaataaaagaactggaaccagattcagaatcatgaaaacaacatttttacaacaacaaaaaaactatattaaacagggtttaaaggaaattaaaacagaactatgagaagtacaatttgttatagtatagtatcaaatttctatatagattttatacctcagtggggaaaaataactgattccaatgacattcattttgttttcatctgtgatagtcatggatgcttttattttccttggggtgctgaaattgagctgaaaaaaaaaggctctttgaatatagttttaatttctctctacagttttttttgtttggtttgtgggctgttggaattgtaatttttaattgccttctaaaaaatggaaatttaacaatgtctgatctcagctgaacaaattagatgtttcagttgctcttgggtcaactggcttacagatttacatgtgcacacacacacaaatttcttatcacattttcgacttcttcacttgacctaactgattatgcgaaatacccaagattcatgctactgtaccacagatttgttttcacagcaataaatcttcagttctttgtttatgattccacttaacaaaaggcctgcagaagtgatttattatttgggtatttggagataatacatttgatggttttttggaaaacctttttcactccatactcagatatgcttcattgtcaaatgcatatttagattagattattgaattgtaatgtttatctgctgctttttttaaataaaatttgactgaaaatgtttaattggcattttttaatgacttagccaaagaagtgcagctattattccatattaataggcttgcatttcttttcctaaatcttatttaggctaaatcagttttatttttctctgattttttttaataccacagaatcacctgagtgtcaattgaaagttgtcaattaaaaggtaaccttttaatctcgtaggaggaatctcattaagacatttttcctgatatgtagagcagtctgttggcaaaaatgcatatattttctttcatatttgtaaaattatatttaatggaattcttttctttgattatcaaggactttcactgcaggcagtgctatttcttgtgcctaagaatgtttccaaaagtcgcatcgctaatgatatttgccaagttgagtgtacacaaagtttctcatatcctgttcaagttaatcaacatcaagcacatggggatgctttagggtgagtctatagtacaaaatgcataaaccatgtccccaggaaatttgaaaggaagcaggtgctgaatggaatttttttccttttccatgagctgtgttaattctatctccagtaggcctaatgcttgaataagcaagatgtctaatcaataaattattttcatgctcagaatttcaggtttttgtactccagcatagcttggtcttatttcttactgtatgaaagcttaacagcaatgtgatttaaggttttgttttaaatgggagatgtaagtgatttaattcatgggtacttttagaacctgatagataatcccattgcctttatttttctaattaaagaattcctaaatactttgaaaatacaaaatattcctgaatagttgtgccttacattggttttatttgaagttagagtggatccctgtttatcataattacttgtaattaggcagatgcttatcactctattataactcaaattgggaagaaaagaatgaaaaagaaaacaatggctgggtactggctcatacctgtaattttagcattttgggaaggtgagacgataggaccacttgagggcaggagtttgaggttgcagtgagctatgatggtgccactgcactccagcctgggcaacagagaagaaaccatgtatcttaaaaaaaaagaaaaaatgaaggatgaaaaagtgggattattatttaaccagtgaagaattcataaatgtgacaattaaggataatttgaatctcacaaatctattcaccccaccccagtcaaggtctattttaatatatctatcttcattggcattcttgagaaatagtgctgccattgaacattgggaatattcatccattctgcagatggaggacatcgtgcaggccatgtcctcattgctcccattctacatttagctgagaaacagaggttcctctttgtaaggatttgatgctcttctcatcttccaagaagtataccaagagcaaatttaactctatagttacctgttcttcaaagaaaaaagaaacttagaaggtagtgtttctgaggtcataactgtgaggggttgtatacaaagaatgagtcactttttaagccatttggaaaattagatctgtttctaattagatgacattttctccattctctgatttcctgaagattgccaagcatttgcttgataatctaccaggactgataattttgcagaatatgaggcaaatatatgaaattcagttgtgtatctatatcctagcaacaaacacttgaaaatataacgttaaaatatgccatttgtaatagcatcaaataagtcaaacttctaagtaggaagaaagttaacaacaagacctctactctgaaaactacaaaacagtgctgggaagaattatagagcaccaaaataaatggctattctatgctcatggattgaaagactgcataatggtaagatgtcagttccccacaaattgttatctagattcaatgagatcaaaatcccacaaggccatcttgtagaaattggcaaatacatatatgaaaatgcaacagattctaagtagccaagataattttgaagaagaaaaataaaattggagcacttgtactacccaatgtcaagacttgctctaaagctacaacagttaagagagtatggtactagagttaggataaacaacaaatagaaatagacatgtccagaaatagacccacatgtatatggttattggcttttcaacaaaaacaagctattcaatagaaaaagggaagatttttcagttggagttgaagtaactggatgtctgggaaaaagcaatgttaataatgccttcttcataccatgcacagtttattcaaaatggattatagaactaaatgtgaatggcaaaacaataaatcttgtaaaaggaa

SEQ ID NO: 365471 - DNA, 2941 bp, Homo sapiens
tatatttttaaattttgcatttgacttaaagtgccatgagaaaatttgcatactgcaaggtggtcctagccacctccttgatttgggtactcttggatatgttcctgctgctttacttcagtgaatgcaacaaatgtgatgaaaaaaaggagagaggacttcctgctggagatgttctagagccagtacaaaagcctcatgaaggtcctggagaaatggggaaaccagtcgtcattcctaaagaggatcaagaaaagatgaaagagatgtttaaaatcaatcagttcaatttaatggcaagtgagatgattgcactcaacagatctttaccagatgttaggttagaagggtgtaaaacaaaggtgtatccagataatcttcctacaacaagtgtggtgattgttttccacaatgaggcttggagcacacttctgcgaactgtccatagtgtcattaatcgctcaccaagacacatgatagaagaaattgttctagtagatgatgccagtgaaagagactttttgaaaaggcctttagagagttatgtgaaaaaactaaaagtaccagttcatgtaattcgaatggaacaacgttctggattgatcagagctagattaaaaggagctgctgtgtctaaaggccaagtgatcaccttcctggatgcccattgtgagtgtacagtgggatggctggagcctctcttggccaggatcaaacatgacaggagaacagtggtgtgtcccatcatcgatgtgatcagtgatgatacttttgagtacatggcaggctctgatatgacctatggtgggttcaactggaagctcaattttcgctggtatcctgttccccaaagagaaatggacagaaggaaaggtgatcggactcttcctgtcaggacacctaccatggcaggaggccttttttcaatagacagagattactttcaggaaattggaacatatgatgctggaatggatatttggggaggagaaaacctagaaatttcctttaggatttggcagtgtggaggaactttggaaattgttacatgctcacatgttggacatgtgtttcggaaagctacaccttacacgtttccaggaggcacagggcagattatcaataaaaataacagacgacttgcagaagtgtggatggatgaattcaagaatttcttctatataatttctccaggtgttacaaaggtagattatggagatatatcgtcaagagttggtctaagacacaaactacaatgcaaacctttttcctggtacctagagaatatatatcctgattctcaaattccacgtcactatttctcattgggagagatacgaaatgtggaaacgaatcagtgtctagataacatggctagaaaagagaatgaaaaagttggaatttttaattgccatggtatggggggtaatcaggttttctcttatactgccaacaaagaaattagaacagatgacctttgcttggatgtttccaaacttaatggcccagttacaatgctcaaatgccaccacctaaaaggcaaccaactctgggagtatgacccagtgaaattaaccctgcagcatgtgaacagtaatcagtgcctggataaagccacagaagaggatagccaggtgcccagcattagagactgcaatggaagtcggtcccagcagtggcttcttcgaaacgtcaccctgccagaaatattctgagaccaaatttacaaaaaaacgaaaaaaataaggattgactgggctacctcagcatacatttctgccacattcttaagtagcaaaaaaggaaaagtgctttcctcctctgcaggatgtaaggtttatcagccattaaaacttagacttctctagcttttcactagctgtgaaccagccttcctgtccatggacgtgaaactgcatagtaatgagactgtgcacactgatgtttacaagattgaaagagtctttctccgaaaatcatggtaaagaatactgagacaatgaaaaaaaatcaacaaaatatgctttctggagaactgtaccttttatggtttgcttgcacatcagtagtttctgctgaacgtgctgtcataatgaagagatttccaagattttttttcctgattagaactggtagccagtatattaaatattgatataaaaataaaagaactggaaccagattcagaatcatgaaaacaacatttttacaacaacaaaaaaactatattaaacagggtttaaaggaaattaaaacagaactatgagaagtacaatttgttatagtatagtatcaaatttctatatagattttatacctcagtggggaaaaataactgattccaatgacattcattttgttttcatctgtgatagtcatggatgcttttattttccttggggtgctgaaattgagctgaaaaaaaaaggctctttgaatatagttttaatttctctctacagttttttttgtttggtttgtgggctgttggaattgtaatttttaattgccttctaaaaaatggaaatttaacaatgtctgatctcagctgaacaaattagatgtttcagttgctcttgggtcaactggcttacagatttacatgtgcacacacacacaaatttcttatcacattttcgacttcttcacttgacctaactgattatgcgaaatacccaagattcatgctactgtaccacagatttgttttcacagcaataaatcttcagttctttgtttatgattccacttaacaaaaggcctgcagaagtgatttattatttgggtatttggagataatacatttgatggttttttggaaaacctttttcactccatactcagatatgcttcattgtcaaatgcatatttagattagattattgaattgtaatgtttatctgctgctttttttaaataaaatttgactgaaaatgtttaa

SEQ ID NO: 365472 - DNA, 2887 bp, Homo sapiens
tatatttttaaattttgcatttgacttaaagtgccatgagaaaatttgcatactgcaaggtggtcctagccacctccttgatttgggtactcttggatatgttcctgctgctttacttcagtgaatgcaacaaatgtgatgaaaaaaaggagagaggacttcctgctggagatgttctagagccagtacaaaagcctcatgaaggtcctggagaaatggggaaaccagtcgtcattcctaaagaggatcaagaaaagatgaaagagatgtttaaaatcaatcagttcaatttaatggcaagtgagatgattgcactcaacagatctttaccagatgttaggttagaagggtgtaaaacaaaggtgtatccagataatcttcctacaacaagtgtggtgattgttttccacaatgaggcttggagcacacttctgcgaactgtccatagtgtcattaatcgctcaccaagacacatgatagaagaaattgttctagtagatgatgccagtgaaagagactttttgaaaaggcctttagagagttatgtgaaaaaactaaaagtaccagttcatgtaattcgaatggaacaacgttctggattgatcagagctagattaaaaggagctgctgtgtctaaaggccaagtgatcaccttcctggatgcccattgtgagtgtacagtgggatggctggagcctctcttggccaggatcaaacatgacaggagaacagtggtgtgtcccatcatcgatgtgatcagtgatgatacttttgagtacatggcaggctctgatatgacctatggtgggttcaactggaagctcaattttcgctggtatcctgttccccaaagagaaatggacagaaggaaaggtgatcggactcttcctgtcaggacacctaccatggcaggaggccttttttcaatagacagagattactttcaggaaattggaacatatgatgctggaatggatatttggggaggagaaaacctagaaatttcctttaggatttggcagtgtggaggaactttggaaattgttacatgctcacatgttggacatgtgtttcggaaagctacaccttacacgtttccaggaggcacagggcagattatcaataaaaataacagacgacttgcagaagtgtggatggatgaattcaagaatttcttctatataatttctccaggtgttacaaaggtagattatggagatatatcgtcaagagttggtctaagacacaaactacaatgcaaacctttttcctggtacctagagaatatatatcctgattctcaaattccacgtcactatttctcattgggagagatacgaaatgtggaaacgaatcagtgtctagataacatggctagaaaagagaatgaaaaagttggaatttttaattgccatggtatggggggtaatcaggttttctcttatactgccaacaaagaaattagaacagatgacctttgcttggatgtttccaaacttaatggcccagttacaatgctcaaatgccaccacctaaaaggcaaccaactctgggagtatgacccagtgaaattaaccctgcagcatgtgaacagtaatcagtgcctggataaagccacagaagaggatagccaggtgcccagcattagagactgcaatggaagtcggtcccagcagtggcttcttcgaaacgtcaccctgccagaaatattctgagaccaaatttacaaaaaaacgaaaaaaataaggattgactgggctacctcagcatacatttctgccacattcttaagtagcaaaaaaggaaaagtgctttcctcctctgcaggatgtaaggtttatcagccattggacgtgaaactgcatagtaatgagactgtgcacactgatgtttacaagattgaaagagtctttctccgaaaatcatggtaaagaatactgagacaatgaaaaaaaatcaacaaaatatgctttctggagaactgtaccttttatggtttgcttgcacatcagtagtttctgctgaacgtgctgtcataatgaagagatttccaagattttttttcctgattagaactggtagccagtatattaaatattgatataaaaataaaagaactggaaccagattcagaatcatgaaaacaacatttttacaacaacaaaaaaactatattaaacagggtttaaaggaaattaaaacagaactatgagaagtacaatttgttatagtatagtatcaaatttctatatagattttatacctcagtggggaaaaataactgattccaatgacattcattttgttttcatctgtgatagtcatggatgcttttattttccttggggtgctgaaattgagctgaaaaaaaaaggctctttgaatatagttttaatttctctctacagttttttttgtttggtttgtgggctgttggaattgtaatttttaattgccttctaaaaaatggaaatttaacaatgtctgatctcagctgaacaaattagatgtttcagttgctcttgggtcaactggcttacagatttacatgtgcacacacacacaaatttcttatcacattttcgacttcttcacttgacctaactgattatgcgaaatacccaagattcatgctactgtaccacagatttgttttcacagcaataaatcttcagttctttgtttatgattccacttaacaaaaggcctgcagaagtgatttattatttgggtatttggagataatacatttgatggttttttggaaaacctttttcactccatactcagatatgcttcattgtcaaatgcatatttagattagattattgaattgtaatgtttatctgctgctttttttaaataaaatttgactgaaaatgtttaa

SEQ ID NO: 365473 - DNA, 2069 bp, Homo sapiens
gtccatttctcttatggggaacaggacagaaggaaaggtgatcacttggcctttagacacagcagctcctttcaggaaattggaacatatgatgctggaatggatatttggggaggagaaaacctagaaatttcctttaggatttggcagtgtggaggaactttggaaattgttacatgctcacatgttggacatgtgtttcggaaagctacaccttacacgtttccaggaggcacagggcagattatcaataaaaataacagacgacttgcagaagtgtggatggatgaattcaagaatttcttctatataatttctccaggtgttacaaaggtagattatggagatatatcgtcaagagttggtctaagacacaaactacaatgcaaacctttttcctggtacctagagaatatatatcctgattctcaaattccacgtcactatttctcattgggagagatacgaaatgtggaaacgaatcagtgtctagataacatggctagaaaagagaatgaaaaagttggaatttttaattgccatggtatggggggtaatcaggttttctcttatactgccaacaaagaaattagaacagatgacctttgcttggatgtttccaaacttaatggcccagttacaatgctcaaatgccaccacctaaaaggcaaccaactctgggagtatgacccagtgaaattaaccctgcagcatgtgaacagtaatcagtgcctggataaagccacagaagaggatagccaggtgcccagcattagagactgcaatggaagtcggtcccagcagtggcttcttcgaaacgtcaccctgccagaaatattctgagaccaaatttacaaaaaaacgaaaaaaataaggattgactgggctacctcagcatacatttctgccacattcttaagtagcaaaaaaggaaaagtgctttcctcctctgcaggatgtaaggtttatcagccattaaaacttagacttctctagcttttcactagctgtgaaccagccttcctgtccatggacgtgaaactgcatagtaatgagactgtgcacactgatgtttacaagattgaaagagtctttctccgaaaatcatggtaaagaatactgagacaatgaaaaaaaatcaacaaaatatgctttctggagaactgtaccttttatggtttgcttgcacatcagtagtttctgctgaacgtgctgtcataatgaagagatttccaagattttttttcctgattagaactggtagccagtatattaaatattgatataaaaataaaagaactggaaccagattcagaatcatgaaaacaacatttttacaacaacaaaaaaactatattaaacagggtttaaaggaaattaaaacagaactatgagaagtacaatttgttatagtatagtatcaaatttctatatagattttatacctcagtggggaaaaataactgattccaatgacattcattttgttttcatctgtgatagtcatggatgcttttattttccttggggtgctgaaattgagctgaaaaaaaaaggctctttgaatatagttttaatttctctctacagttttttttgtttggtttgtgggctgttggaattgtaatttttaattgccttctaaaaaatggaaatttaacaatgtctgatctcagctgaacaaattagatgtttcagttgctcttgggtcaactggcttacagatttacatgtgcacacacacacaaatttcttatcacattttcgacttcttcacttgacctaactgattatgcgaaatacccaagattcatgctactgtaccacagatttgttttcacagcaataaatcttcagttctttgtttatgattccacttaacaaaaggcctgcagaagtgatttattatttgggtatttggagataatacatttgatggttttttggaaaacctttttcactccatactcagatatgcttcattgtcaaatgcatatttagattagattattgaattgtaatgtttatctgctgctttttttaaataaaatttgactgaaaatgtttaa

SEQ ID NO: 365474 - DNA, 1176 bp, Homo sapiens
tatatttttaaattttgcatttgacttaaagtgccatgagaaaatttgcatactgcaaggtggtcctagccacctccttgatttgggtactcttggatatgttcctgctgctttacttcagtgaatgcaacaaatgtgatgaaaaaaaggagagaggacttcctgctggagatgttctagagccagtacaaaagcctcatgaaggtcctggagaaatggggaaaccagtcgtcattcctaaagaggatcaagaaaagatgaaagagatgtttaaaatcaatcagttcaatttaatggcaagtgagatgattgcactcaacagatctttaccagatgttaggttagaagggtgtaaaacaaaggtgtatccagataatcttcctacaacaagtgtggtgattgttttccacaatgaggcttggagcacacttctgcgaactgtccatagtgtcattaatcgctcaccaagacacatgatagaagaaattgttctagtagatgatgccagtgaaagagactttttgaaaaggcctttagagagttatgtgaaaaaactaaaagtaccagttcatgtaattcgaatggaacaacgttctggattgatcagagctagattaaaaggagctgctgtgtctaaaggccaagtgatcaccttcctggatgcccattgtgagtgtacagtgggatggctggagcctctcttggccaggatcaaacatgacaggagaacagtggtgtgtcccatcatcgatgtgatcagtgatgatacttttgagtacatggcaggctctgatatgacctatggtgggttcaactggaagctcaattttcgctggtatcctgttccccaaagagaaatggacagaaggaaaggtgatcggactcttcctgtcaggacacctaccatggcaggaggccttttttcaatagacagagattactttcaggaaattggaacatatgatgctggaatggatatttggggaggagaaaacctagaaatttcctttaggatttggcagtgtggaggaactttggaaattgttacatgctcacatgttggacatgtgtttcggaaagctacaccttacacgtttccaggaggctggaggttgcagtgagccaagatcacgccactgcactccagcctgggcaacaaagtgagaccctgtctca

SEQ ID NO: 365475 - DNA, 504 bp, Homo sapiens
agagggaggggcacagggggctgaggagtgctgggtcgggcttccagctccctacaacgcagaccagtactggagttcgtggtgctggaagaccgccgcccgactctgggccccgggtaggaaacgtaagtgccaggaagttagcagagtggttctttggctggcgcctgaacctcgccagtcttcgtcgcccctcccctgccaacgcctaccccgcttcgaccggagggtgcgctgtccctctggtcactgtgatcaccgtccatggccgcctgcggatacccacgccgtgctcagaagagggctctgaggccacgcccgcctgtggggtcggtggccgggcttccgggaccccagagggagtcgtcgcgcgctaggtggaggggacccctctggaatccggcgatccccgggcgcagatgcaggagcgggtggggagagccgcgttcctggcatgtttgcctcaaaggggctcacaggaagggaacccgcgcctcgaaggac

SEQ ID NO: 365476 - DNA, 1418 bp, Homo sapiens
agagggaggggcacagggggctgaggagtgctgggtcgggcttccagctccctacaacgcagaccagtactggagttcgtggtgctggaagaccgccgcccgactctgggccccgggtaggaaacaacaatttcggacctcctggggtctatgctaggtatgaggtgtatctttgccctccatcaagtagcaaagatggacatgtaaacaaatttcgacactgtgatgactgccacaaaaagcagcattatgaggttgaatgtaaaaggataaccttagcggcggcgggggccggaggatgaaggaaggcttcctgaggtaggcgctggttgaaactgaagttggagagagcaagtggcatttgctgaagtgcatttccggtagaaaactccagtggtccctcacctgactgagtggcgcagtcagagataaatggaacagagtctacaaataaacattttataaagatgatccttcaatacatattctacagcccagttaaaatgtgagaggccatgatctacagacagccatttataaaggtggatcagggccggacacggtggctcaacgtctgtaatcccggcactgtgggaggccaaagcgggaggatcgcttgagcccaggagttcgagaccaacctggccaacatggtgagaccccatctttacaaaaaaatatatatatccaggcatagtggtgtgcacctgtggtcctgtggtcccagctactcaggaagctgaggcagttgaggctgcagtgagccacgttctggccactacactccagcctgggcatcaaagtgacaagaccaaaaaaaaaaaaaaatgtggattggaaggaggcaagaaagaagtcaggaaaagggtggaatgtaagtccctaaggacacaatcttactcacaattgtatctccaacatttggcataatgcctaatacgtaagtattttatgaattaattaaacgagaacacaagcctaaattaaggcaatggcaatggagaagaagaaaccaacttgagaaatatttaaaggtcattgtcaatggaacttagtgactttaatggttaattttatctatcaacttggctaggcgatgctacccatgttactcagtttttggtcaaacactagtctagttgttgctatgaattgtatttgttagatgtgattaacatttaaatcagcagactttgattaaagtacattaccctctataatgagggtgggccgcatccggtcagttcaaattaaaacgagacccttaagaagaagcaattcagcctccagactgcagcgtcaaatctccctgggtctccaggctgtttgtctgccctgcagatttcagacttgccagctcccagaataatgtgagccaattccttaaaataaatctctttctgcatatacacatccta

SEQ ID NO: 365477 - DNA, 1860 bp, Homo sapiens
agagggaggggcacagggggctgaggagtgctgggtcgggcttccagctccctacaacgcagaccagtactggagttcgtggtgctggaagaccgccgcccgactctgggccccgggtaggaaacgtaagtgccaggaagttagcagagtggttctttggctggcgcctgaacctcgccagtcttcgtcgcccctcccctgccaacgcctaccccgcttcgaccggagggtgcgctgtccctctggtcactgtgatcaccgtccatggccgcctgcggatacccacgccgtgctcagaagagggctctgaggccacgcccgcctgtggggtcggtggccgggcttccgggaccccagagggagtcgtcgcgcgctaggtggaggggacccctctggaatccggcgatccccgggcgcagatgcaggagcgggtggggagagccgcgttcctggcatgtttgcctcgagttagtcacgaaggaatcgaagagagccttagtcttcgaggcttttcccttcctgtgagcccctttgaggccagcacattgatttttttttctttcgcagaacaatttcggacctcctggggtctatgctaggtatgaggtgtatctttgccctccatcaagtagcaaagatggacatgtaaacaaatttcgacactgtgatgactgccacaaaaagcagcattatgaggttgaatgtaaaaggataaccttagcggcggcgggggccggaggatgaaggaaggcttcctgaggtaggcgctggttgaaactgaagttggagagagcaagtggcatttgctgaagtgcatttccggtagaaaactccagtggtccctcacctgactgagtggcgcagtcagagataaatggaacagagtctacaaataaacattttataaagatgatccttcaatacatattctacagcccagttaaaatgtgagaggccatgatctacagacagccatttataaaggtggatcagggccggacacggtggctcaacgtctgtaatcccggcactgtgggaggccaaagcgggaggatcgcttgagcccaggagttcgagaccaacctggccaacatggtgagaccccatctttacaaaaaaatatatatatccaggcatagtggtgtgcacctgtggtcctgtggtcccagctactcaggaagctgaggcagttgaggctgcagtgagccacgttctggccactacactccagcctgggcatcaaagtgacaagaccaaaaaaaaaaaaaaatgtggattggaaggaggcaagaaagaagtcaggaaaagggtggaatgtaagtccctaaggacacaatcttactcacaattgtatctccaacatttggcataatgcctaatacgtaagtattttatgaattaattaaacgagaacacaagcctaaattaaggcaatggcaatggagaagaagaaaccaacttgagaaatatttaaaggtcattgtcaatggaacttagtgactttaatggttaattttatctatcaacttggctaggcgatgctacccatgttactcagtttttggtcaaacactagtctagttgttgctatgaattgtatttgttagatgtgattaacatttaaatcagcagactttgattaaagtacattaccctctataatgagggtgggccgcatccggtcagttcaaattaaaacgagacccttaagaagaagcaattcagcctccagactgcagcgtcaaatctccctgggtctccaggctgtttgtctgccctgcagatttcagacttgccagctcccagaataatgtgagccaattccttaaaataaatctctttctgcatatacacatccta

SEQ ID NO: 365478 - DNA, 1061 bp, Homo sapiens
ggaatggtactttagagttcacctacaacaatggtgttggttgggttgtgcttcacttctgcggtaaccctgtggactttccctccatagaaaggcttcgtgtggaatatcactgtcgctgagtacccagtcttggcacagttgatgctgacttttcctccgagctccacccacgggatggtgagaatggaccgggcgtaggcactaggcagggtgaatacgtactcctccccgtgttccaggagcctcaacacaccttcccctatcatagagacccccacggacatgcccatgaacttgccctcgtgccgaattcggcacgaggctgcgaaccacgtgggtcccgggcgcgtttcgggtgctggcggctgcagccggagttcaaacctaagcagctggaaggaaccatggccaactgtgagcgtaccttcattgcgatcaaaccagatggggtccagcggggtcttgtgggagagattatcaagcgttttgagcagaaaggattccgccttgttggtctgaaattcatgcaagcttccgaagatcttctcaaggaacactacgttgacctgaaggaccgtccattctttgccggcctggtgaaatacatgcactcagggccggtagttgccatggtctgggaggggctgaatgtggtgaagacgggccgagtcatgctcggggagaccaaccctgcagactccaagcctgggaccatccgtggagacttctgcatacaagttggcaggaacattatacatggcagtgattctgtggagagtgcagagaaggagatcggcttgtggtttcaccctgaggaactggtagattacacgagctgtgctcagaactggatctatgaatgacaggagggcagaccacattgcttttcacatccatttcccctccttcccatgggcagaggaccaggctgtaggaaatctagttatttacaggaacttcatcataatttggagggaagctcttggagctgtgagttctccctgtacagtgttaccatccccgaccatctgattaaaatgcttcctcccagcatagga

SEQ ID NO: 365479 - DNA, 563 bp, Homo sapiens
  misc_feature (27)..(27): n is a, c, g, or t
aatataggctagtacgaggctggtgtntgaatcggccgtgggaagatcttctcaaggaacactacgttgacctgaaggaccgtccattctttgccggcctggtgaaatacatgcactcagggccggtagttgccatggtctgggaggggctgaatgtggtgaagacgggccgagtcatgctcggggagaccaaccctgcagactccaagcctgggaccatccgtggagacttctgcatacaagttggcaggaacattatacatggcagtgattctgtggagagtgcagagaaggagatcggcttgtggtttcaccctgaggaactggtagattacacgagctgtgctcagaactggatctatgaatgacaggagggcagaccacattgcttttcacatccatttcccctccttcccatgggcagaggaccaggctgtaggaaatctagttatttacaggaacttcatcataatttggagggaagctcttggagctgtgagttctccctgtacagtgttaccatccccgaccatctgattaaaatgcttcctcccagcatagga

SEQ ID NO: 365480 - DNA, 1040 bp, Homo sapiens
  misc_feature (27)..(27): n is a, c, g, or t
  misc_feature (896)..(896): n is a, c, g, or t
aatataggctagtacgaggctggtgtntgaatcggccgtgggaaccatggccaactgtgagcgtaccttcattgcgatcaaaccagatggggtccagcggggtcttgtgggagagattatcaagcgttttgagcagaaaggattccgccttgttggtctgaaattcatgcaagcttccgaagatcttctcaaggaacactacgttgacctgaaggaccgtccattctttgccggcctggtgaaatacatgcactcagggccggtagttgccatggtctgggaggggctgaatgtggtgaagacgggccgagtcatgctcggggagaccaaccctgcagactccaagcctgggaccatccgtggagacttctgcatacaagttggcaggaacattatacatggcagtgattctgtggagagtgcagagaaggagatcggcttgtggtttcaccctgaggaactggtagattacacgagctgtgctcagaactggatctatgaatgacaggagggcagaccacattgcttttcacatccatttcccctccttcccatgggcagaggaccaggctgtaggaaatctagttatttacaggaacttcatcataatttggagggaagctcttggagctgtgagttctccctgtacagtgttaccatccccgaccatctgattaaaatgcttcctcccagcataggaaaaaaaaaaaaaaaaaaaaaaaaaaaaaagggggctttttggggggggggaaaaaagctggtacggaatgggcacatgggccatacggcggtctcctggacccagtctttttgtccaaagggggggaactgggggcccccaaaaggggccgtataattcgaaacccagggtacgtgaacaccacgaaacaaaaaangcaacaagaagggagaaagcacaacataaaacaagggcaaaaacaacgccactaccccacacacaaactacaaccgaacgacacgacacaacgaaagcgacggccaccgaggcaacgtcgcgaaaaagtcgaagcacaccaaag

SEQ ID NO: 365481 - DNA, 931 bp, Homo sapiens
ggtctaatgtccatggagcttcagcttttatgctgctgtggctgtagatttctggcaatgggcgcattttaatccttctggtcttggtcatgtgactatctctttctccaccaggaacattatacatggcagtgattctgtggagagtgcagagaaggagatcggcttgtggtttcaccctgaggaactggtagattacacgagctgtgctcagaactggatctatgaatgacaggagggcagaccacattgcttttcacatccatttcccctccttcccatgggcagaggaccaggctgtaggaaatctagttatttacaggaacttcatcataatttggagggaagctcttggagctgtgagttctccctgtacagtgttaccatccccgaccatctgattaaaatgcttcctcccagttcattgagttggttacttcatattgttgcattgcttttttttccttcttttcatgtacactgaataacctgacctaatagagagtgtaaatactataaaaatgatttattttgagatctcacatacacacaggcattctttgcctgcccttcttaacccccgcatcccttccactcttggcactgagctattcaacaggcatctatggagcatgtgctacgtggccaagactggactaggtgcagaggattcatcagaaatgaaagaaaacatgagggctgggtgtgctggcttgtgcttgtgataccagctacttgggaggctgagatgggagaccagcctgggtaacatagcaagaccctgtctcactaaaaaaaaaaaaagaaaaattaggctgggtacgatggctcatgcctttaatcccagctattcaggaggctgaggaggagaatcgctagaggccagaagttcaagtccagggtgggcaacatagcaagacgctgtctttac

SEQ ID NO: 365482 - DNA, 610 bp, Homo sapiens
tcagtgccaatagggagacaactgatataaaattggagaagtacatttagtcctgtcactgctcccttccagtgtggagaatgaattgggttataacagaatcagtgagcccaaccgctcatgttttacatagcagggtggatgaggggaaattaaatggattatatgtccttagatggtttgggggttattctcattctctgtcctgttgaataggcttccgaagatcttctcaaggaacactacgttgacctgaaggaccgtccattctttgccggcctggtgaaatacatgcactcagggccggtagttgccatggtgagtgtgcctgtgtgggatactccaagtatgcattgcttgtcatctgtgctaggctctcttctagacactggggatacagccatgaatgagaccaaatagatacctgttttcatataccagctaatggttagtgataggcttcagaaatgaaatatgcccagaaatgaataggagtagcaaatgatcactttagattgggtgatcaaagaacgcaatttttaagctgtgatctgaatgacaagaagcagcgatctgaatgacaagaagcagccagccatgtacagaatca

SEQ ID NO: 365483 - DNA, 718 bp, Homo sapiens
caaagggctgggattacaggcgtgagccactgcgccctgcccacacttggcattttaaggaggctgctctggttgctgtatggagaatacattgtagaaaggcaagcatgagggcagggagatcaggatcctcagtgctggaataagtggatatactctataaacatttgttcagtgaatgaatataatcttaaggggcctttttatttttccttttttgaattaatagttgccagattttctgctgtgattggttttcttctttgaccatatcttcttctgtccttggaggtctgggaggggctgaatgtggtgaagacgggccgagtcatgctcggggagaccaaccctgcagactccaagcctgggaccatccgtggagacttctgcatacaagttggcaggtgagattttggtatttttcccccttttccaaaatctgatttagttgccacaaggatttgggtttccgaggctggaggtagacatgataccatatgcaggttgattttatcggagtttattgttttcctccctcttaagttggcgtttggctttggttgttaacatcacttagtcgtacctctgttacacgaagtgtagaacctggtacaacacactttgctggccagtctttcctgaaggctctcactgtttgcaccagcgtggccgggagggctggatgtggggagggcatttttcagccttaagtgaatgg

SEQ ID NO: 365484 - DNA, 853 bp, Homo sapiens
  misc_feature (28)..(28): n is a, c, g, or t
gaaaaaacgacgaaggtctacgatgctntggtacaaaaaagcagcgcgttgttataaccgacggcagtactatacggtctaggtagcgagactgcattatgaatcggagaggcagtgctgcgaaccacgtgggtcccgggcgcgtttcgggtgctggcggctgcagccggagttcaaacctaagcagctggaaggaaccatggccaactgtgagcgtaccttcattgcgatcaaaccagatggggtccagcggggtcttgtgggagagattatcaagcgttttgagcagaaaggattccgccttgttggtctgaaattcatgcaagcttccgaagatcttctcaaggaacactacgttgacctgaaggaccgtccattctttgccggcctggtgaaatacatgcactcagggccggtagttgccatggtctgggaggggctgaatgtggtgaagacgggccgagtcatgctcggggagaccaaccctgcagactccaagcctgggaccatccgtggagacttctgcatacaagttggcaggaacattatacatggcagtgattctgtggagagtgcagagaaggagatcggcttgtggtttcaccctgaggaactggtagattacacgagctgtgctcagaactggatctatgaatgacaggagggcagaccacattgcttttcacatccatttcccctccttcccatgggcagaggaccaggctgtaggaaatctagttatttacaggaacttcatcataatttggagggaagctcttggagctgtgagttctccctgtacagtgttaccatccccgaccatctgattaaaatgcttcctcccagcatagga

SEQ ID NO: 365485 - DNA, 1274 bp, Homo sapiens
ggcagaagcgttccgtgcgtgcaagtgctgcgaaccacgtgggtcccgggcgcgtttcgggtgctggcggctgcagccggagttcaaacctaagcagctggaaggaaccatggccaactgtgagcgtaccttcattgcgatcaaaccagatggggtccagcggggtcttgtgggagagattatcaagcgttttgagcagaaaggattccgccttgttggtctgaaattcatgcaagcttccgaagatcttctcaaggaacactacgttgacctgaaggaccgtccattctttgccggcctggtgaaatacatgcactcagggccggtagttgccatggtctgggaggggctgaatgtggtgaagacgggccgagtcatgctcggggagaccaaccctgcagactccaagcctgggaccatccgtggagacttctgcatacaagttggcaggaacattatacatggcagtgattctgtggagagtgcagagaaggagatcggcttgtggtttcaccctgaggaactggtagattacacgagctgtgctcagaactggatctatgaatgacaggagggcagaccacattgcttttcacatccatttcccctccttcccatgggcagaggaccaggctgtaggaaatctagttatttacaggaacttcatcataatttggagggaagctcttggagctgtgagttctccctgtacagtgttaccatccccgaccatctgattaaaatgcttcctcccagcataggattcattgagttggttacttcatattgttgcattgcttttttttccttcttttcatgtacactgaataacctgacctaatagagagtgtaaatactataaaaatgatttattttgagatctcacatacacacaggcattctttgcctgcccttcttaacccccgcatcccttccactcttggcactgagctattcaacaggcatctatggagcatgtgctacgtggccaagactggactaggtgcagaggattcatcagaaatgaaagaaaacatgagggctgggtgtgctggcttgtgcttgtgataccagctacttgggaggctgagatgggagaccagcctgggtaacatagcaagaccctgtctcactaaaaaaaaaaaaagaaaaattaggctgggtacgatggctcatgcctttaatcccagctattcaggaggctgaggaggagaatcgctagaggccagaagttcaagtccagggtgggcaacatagcaagacgctgtctttac

SEQ ID NO: 365486 - DNA, 1077 bp, Homo sapiens
ggcagaagcgttccgtgcgtgcaagtgctgcgaaccacgtgggtcccgggcgcgtttcgggtgctggcggctgcagccggagttcaaacctaagcagctggaaggaaccatggccaactgtgagcgtaccttcattgcgatcaaaccagatggggtccagcggggtcttgtgggagagattatcaagcgttttgagcagaaaggattccgccttgttggtctgaaattcatgcaagcttccgaagatcttctcaaggaacactacgttgacctgaaggaccgtccattctttgccggcctggtgaaatacatgcactcagggccggtagttgccatggtctgggaggggctgaatgtggtgaagacgggccgagtcatgctcggggagaccaaccctgcagactccaagcctgggaccatccgtggagacttctgcatacaagttggcaggaacattatacatggcagtgattctgtggagagtgcagagaaggagatcggcttgtggtttcaccctgaggaactggtagattacacgagctgtgctcagaactggatctatgaatgacaggagggcagaccacattgcttttcacatccatttcccctccttcccatgggcagaggaccaggctgtaggaaatctagttatttacaggaacttcatcataatttggagggaagctcttggagctgtgagttctccctgtacagtgttaccatccccgaccatctgattaaaatgcttcctcccagcataggaaaaaaaaaaaaaaaaaaaaaaaacaaaaaaacaacaatagaaaaaaaacagggggggggggcggcaccgataaaaatcacccgcggggcgcaccccctggtgacgacgccaccccgcatctctgtcacagagggcaccacgggaggagctatcatcagcacaccagcgcgcgccttacacagccacgcgagggaaacaacgccgggggccttggggagaccccatggcggggggactatgcggacaaccccagagtaggcgaggcacaaatgagcgcatggcaccgcacatcggcaaaagccggatatgaaatc

SEQ ID NO: 365487 - DNA, 854 bp, Homo sapiens
ggcagaagcgttccgtgcgtgcaagtgctgcgaaccacgtgggtcccgggcgcgtttcgggtgctggcggctgcagccggagttcaaacctaagcagctggaaggaaccatggccaactgtgagcgtaccttcattgcgatcaaaccagatggggtccagcggggtcttgtgggagagattatcaagcgttttgagcagaaaggattccgccttgttggtctgaaattcatgcaagcttccgaagatcttctcaaggaacactacgttgacctgaaggaccgtccattctttgccggcctggtgaaatacatgcactcagggccggtagttgccatggtctgggaggggctgaatgtggtgaagacgggccgagtcatgctcggggagaccaaccctgcagactccaagcctgggaccatccgtggagacttctgcatacaagttggcaggaacattatacatggcagtgattctgtggagagtgcagagaaggagatcggcttgtggtttcaccctgaggaactggtagattacacgagctgtgctcagaactggatctatgaatgacaggagggcagaccacattgcttttcacatccatttcccctccttcccatgggcagaggaccaggctgtaggaaatctagttatttacaggaacttcatcataatttggagggaagctcttggagctgtgagttctccctgtacagtgttaccatccccgaccatctgattaaaatgcttcctcccagcatagggaaccaacaaaacaacaaccacaacaaaaaaccgcgggggacctctattcggggggcgggcacacacaggcgtactgacacggcgccacggg

SEQ ID NO: 365488 - DNA, 1119 bp, Homo sapiens
ggcagaagcgttccgtgcgtgcaagtgctgcgaaccacgtgggtcccgggcgcgtttcgggtgctggcggctgcagccggagttcaaacctaagcagctggaaggaaccatggccaactgtgagcgtaccttcattgcgatcaaaccagatggggtccagcggggtcttgtgggagagattatcaagcgttttgagcagaaaggattccgccttgttggtctgaaattcatgcaagcttccgaagatcttctcaaggaacactacgttgacctgaaggaccgtccattctttgccggcctggtgaaatacatgcactcagggccggtagttgccatggtctgggaggggctgaatgtggtgaagacgggccgagtcatgctcggggagaccaaccctgcagactccaagcctgggaccatccgtggagacttctgcatacaagttggcaggaacattatacatggcagtgattctgtggagagtgcagagaaggagatcggcttgtggtttcaccctgaggaactggtagattacacgagctgtgctcagaactggatctatgaatgacaggagggcagaccacattgcttttcacatccatttcccctccttcccatgggcagaggaccaggctgtaggaaatctagttatttacaggaacttcatcataatttggagggaagctcttggagctgtgagttctccctgtacagtgttaccatccccgaccatctgattaaaatgcttcctcccagcataggaaaaaaaaacacgaacaaacacgaaatcgagcacacagacaaacacaagacgggcagagacaacaaaaaatcccaacaggcgcaccacaaataaacaacacacagactggcaaaaagcgcccaaagcggaggaactaaaacgaccgcgaagaggcgcacaacacacggcacaggaccgagaacacgccaccacagccgaccatggagaggacgacccaaaaggggcggcggcaacaccgaggggaacaaccaccaggagaataacgcacagaggccacaaccacgcgagacaccgacaacaagcgacaacgccgacgcaaccggcgaaagaagagcgaaaatatagcagcgagacaa

SEQ ID NO: 365489 - DNA, 813 bp, Homo sapiens
  misc_feature (5)..(5): n is a, c, g, or t
  misc_feature (26)..(27): n is a, c, g, or t
catcngctaggtcgaggctgggtgtnngaagtgctgcgaaccacgtgggtcccgggcgcgtttcgggtgctggcggctgcagccggagttcaaacctaagcagctggaaggaaccatggccaactgtgagcgtaccttcattgcgatcaaaccagatggggtccagcggggtcttgtgggagagattatcaagcgttttgagcagaaaggattccgccttgttggtctgaaattcatgcaagcttccgaagatcttctcaaggaacactacgttgacctgaaggaccgtccattctttgccggcctggtgaaatacatgcactcagggccggtagttgccatggtctgggaggggctgaatgtggtgaagacgggccgagtcatgctcggggagaccaaccctgcagactccaagcctgggaccatccgtggagacttctgcatacaagttggcaggaacattatacatggcagtgattctgtggagagtgcagagaaggagatcggcttgtggtttcaccctgaggaactggtagattacacgagctgtgctcagaactggatctatgaatgacaggagggcagaccacattgcttttcacatccatttcccctccttcccatgggcagaggaccaggctgtaggaaatctagttatttacaggaacttcatcataatttggagggaagctcttggagctgtgagttctccctgtacagtgttaccatccccgacatctgattaaatgcttcctccagcaaaaaaaaaaaaaaacaaaaaaaaatggggggataaaagggggggggaaaaag

SEQ ID NO: 365490 - DNA, 911 bp, Homo sapiens
  misc_feature (5)..(5): n is a, c, g, or t
  misc_feature (26)..(27): n is a, c, g, or t
catcngctaggtcgaggctgggtgtnngaagtggccctgtggctaggtaccatagagtctctacacaggactaagtcagcctggtgtgcaggggaggcagacacacaaacagaaaattggactacagtgctaagatgctgtaagaagaggttaactaaaggacaggaagatggggccaagagatggtgctactgtctactttagggatcgtctttcaaggcgaggggcctcctatctcaagctgtgatacaggaaccatggccaactgtgagcgtaccttcattgcgatcaaaccagatggggtccagcggggtcttgtgggagagattatcaagcgttttgagcagaaaggattccgccttgttggtctgaaattcatgcaagcttccgaagatcttctcaaggaacactacgttgacctgaaggaccgtccattctttgccggcctggtgaaatacatgcactcagggccggtagttgccatggtctgggaggggctgaatgtggtgaagacgggccgagtcatgctcggggagaccaaccctgcagactccaagcctgggaccatccgtggagacttctgcatacaagttggcaggaacattatacatggcagtgattctgtggagagtgcagagaaggagatcggcttgtggtttcaccctgaggaactggtagattacacgagctgtgctcagaactggatctatgaatgacaggagggcagaccacattgcttttcacatccatttcccctccttcccatgggcagaggaccaggctgtaggaaatctagttatttacaggaacttcatcataatttggagggaagctcttggagctgtgagttctccctgtacagtgttaccatccccgaccatctgattaaaatgcttcctcccagcatagga

SEQ ID NO: 365491 - DNA, 938 bp, Homo sapiens
aagaggtgttcgggatcctgagaggaaaaagaaaggagtgtagtcgcgggagtgggttaggccctgtggctaggtaccatagagtctctacacaggactaagtcagcctggtgtgcaggggaggcagacacacaaacagaaaattggactacagtgctaagatgctgtaagaagaggttaactaaaggacaggaagatggggccaagagatggtgctactgtctactttagggatcgtctttcaaggcgaggggcctcctatctcaagctgtgatacaggaaccatggccaactgtgagcgtaccttcattgcgatcaaaccagatggggtccagcggggtcttgtgggagagattatcaagcgttttgagcagaaaggattccgccttgttggtctgaaattcatgcaagcttccgaagatcttctcaaggaacactacgttgacctgaaggaccgtccattctttgccggcctggtgaaatacatgcactcagggccggtagttgccatggtctgggaggggctgaatgtggtgaagacgggccgagtcatgctcggggagaccaaccctgcagactccaagcctgggaccatccgtggagacttctgcatacaagttggcaggaacattatacatggcagtgattctgtggagagtgcagagaaggagatcggcttgtggtttcaccctgaggaactggtagattacacgagctgtgctcagaactggatctatgaatgacaggagggcagaccacattgcttttcacatccatttcccctccttcccatgggcagaggaccaggctgtaggaaatctagttatttacaggaacttcatcataatttggagggaagctcttggagctgtgagttctccctgtacagtgttaccatccccgaccatctgattaaaatgcttcctcccagcatagga

SEQ ID NO: 365492 - DNA, 920 bp, Homo sapiens
  misc_feature (27)..(27): n is a, c, g, or t
aatataggctagtacgaggctggtgtntgaatcggccgtggggccctgtggctaggtaccatagagtctctacacaggactaagtcagcctggtgtgcaggggaggcagacacacaaacagaaaattggactacagtgctaagatgctgtaagaagaggttaactaaaggacaggaagatggggccaagagatggtgctactgtctactttagggatcgtctttcaaggcgaggggcctcctatctcaagctgtgatacaggaaccatggccaactgtgagcgtaccttcattgcgatcaaaccagatggggtccagcggggtcttgtgggagagattatcaagcgttttgagcagaaaggattccgccttgttggtctgaaattcatgcaagcttccgaagatcttctcaaggaacactacgttgacctgaaggaccgtccattctttgccggcctggtgaaatacatgcactcagggccggtagttgccatggtctgggaggggctgaatgtggtgaagacgggccgagtcatgctcggggagaccaaccctgcagactccaagcctgggaccatccgtggagacttctgcatacaagttggcaggaacattatacatggcagtgattctgtggagagtgcagagaaggagatcggcttgtggtttcaccctgaggaactggtagattacacgagctgtgctcagaactggatctatgaatgacaggagggcagaccacattgcttttcacatccatttcccctccttcccatgggcagaggaccaggctgtaggaaatctagttatttacaggaacttcatcataatttggagggaagctcttggagctgtgagttctccctgtacagtgttaccatccccgaccatctgattaaaatgcttcctcccagcatagga

SEQ ID NO: 365493 - DNA, 1371 bp, Homo sapiens
ggaatggtactttagagttcacctacaacaatggtgttggttgggttgtgcttcacttctgcggtaaccctgtggactttccctccatagaaaggcttcgtgtggaatatcactgtcgctgagtacccagtcttggcacagttgatgctgacttttcctccgagctccacccacgggatggtgagaatggaccgggcgtaggcactaggcagggtgaatacgtactcctccccgtgttccaggagcctcaacacaccttcccctatcatagagacccccacggacatgcccatgaacttgccctcgtgccgaattcggcacgaggctgcgaaccacgtgggtcccgggcgcgtttcgggtgctggcggctgcagccggagttcaaacctaagcagctggaagggccctgtggctaggtaccatagagtctctacacaggactaagtcagcctggtgtgcaggggaggcagacacacaaacagaaaattggactacagtgctaagatgctgtaagaagaggttaactaaaggacaggaagatggggccaagagatggtgctactgtctactttagggatcgtctttcaaggcgaggggcctcctatctcaagctgtgatacaggaaccatggccaactgtgagcgtaccttcattgcgatcaaaccagatggggtccagcggggtcttgtgggagagattatcaagcgttttgagcagaaaggattccgccttgttggtctgaaattcatgcaagcttccgaagatcttctcaaggaacactacgttgacctgaaggaccgtccattctttgccggcctggtgaaatacatgcactcagggccggtagttgccatggtctgggaggggctgaatgtggtgaagacgggccgagtcatgctcggggagaccaaccctgcagactccaagcctgggaccatccgtggagacttctgcatacaagttggcaggaacattatacatggcagtgattctgtggagagtgcagagaaggagatcggcttgtggtttcaccctgaggaactggtagattacacgagctgtgctcagaactggatctatgaatgacaggagggcagaccacattgcttttcacatccatttcccctccttcccatgggcagaggaccaggctgtaggaaatctagttatttacaggaacttcatcataatttggagggaagctcttggagctgtgagttctccctgtacagtgttaccatccccgacatctgattaaatgcttcctccagcaaaaaaaaaaacggggtttttcgggggggaaaaggttaaagggcggggatggtccgccacttgtaaggggaacgcggccaagggggtatgactgaggga

SEQ ID NO: 365494 - DNA, 763 bp, Homo sapiens
ggcagaagcgttccgtgcgtgcaagtgctgcgaaccacgtgggtcccgggcgcgtttcgggtgctggcggctgcagccggagttcaaacctaagcagctggaaggaaccatggccaactgtgagcgtaccttcattgcgatcaaaccagatggggtccagcggggtcttgtgggagagattatcaagcgttttgagcagaaaggattccgccttgttggtctgaaattcatgcaagcttccgaagatcttctcaaggaacactacgttgacctgaaggaccgtccattctttgccggcctggtgaaatacatgcactcagggccggtagttgccatggtctgggaggggctgaatgtggtgaagacgggccgagtcatgctcggggagaccaaccctgcagactccaagcctgggaccatccgtggagacttctgcatacaagttggcaggaacattatacatggcagtgattctgtggagagtgcagagaaggagatcggcttgtggtttcaccctgaggaactggtagattacacgagctgtgctcagaactggatctatgaatgacaggagggcagaccacattgcttttcacatccatttcccctccttcccatgggcagaggaccaggctgtaggaaatctagttatttacaggaacttcatcataatttggagggaagctcttggagctgtgagttctccctgtacagtgttaccatccccgaccatctgattaaaatgcttcctcccagcatagga

SEQ ID NO: 365495 - DNA, 786 bp, Homo sapiens
acctccagaagctgtctacaccatgcgtccggcgcgcgtgcccagtgcgtacgtgagcatgctcatatgctgtccctctacgagatcctggtcatagagtacgatgcttggattcgtcactcaaattaaagagattcgcccgcgcgatgggcggcacacgtgctgacatcagtatccaagatagttgaagtttctgagtgtcatggaactgaatctattccaccgacgtgagtccaacttgaactccataccaacttcaccgccgaagatcttctcaaggaacactacgttgacctgaaggaccgtccattctttgccggcctggtgaaatacatgcactcagggccggtagttgccatggtctgggaggggctgaatgtggtgaagacgggccgagtcatgctcggggagaccaaccctgcagactccaagcctgggaccatccgtggagacttctgcatacaagttggcaggaacattatacatggcagtgattctgtggagagtgcagagaaggagatcggcttgtggtttcaccctgaggaactggtagattacacgagctgtgctcagaactggatctatgaatgacaggagggcagaccacattgcttttcacatccatttcccctccttcccatgggcagaggaccaggctgtaggaaatctagttatttacaggaacttcatcataatttggagggaagctcttggagctgtgagttctccctgtacagtgttaccatccccgaccatctgattaaaatgcttcctcccagcatagga

SEQ ID NO: 365496 - DNA, 554 bp, Homo sapiens
  misc_feature (537)..(537): n is a, c, g, or t
gcggcttatggtgcagacatggccaagtccaagaaccacaccacacacaaccagtcccgaaaatggcacagaaatggtatcaagaaaccccgatcacaaagatacgaatctcttaagggggtggaccccaagttcctgaggaacatgcgcttgccaagaagcacaacaaaaagggcctaaagaagatgcaggccaacaatgccaaggccatgagtgcacgtgccgaggctatcaaggccctcgtaaagcccaaggaggtttcaccctgaggaactggtagattacacgagctgtgctcagaactggatctatgaatgacaggagggcagaccacattgcttttcacatccatttcccctccttcccatgggcagaggaccaggctgtaggaaatctagttatttacaggaacttcatcataatttggagggaagctcttggagctgtgagttctccctgtacagtgttaccatccccgaccatctgattaaaatgcttcctcccagaaaaaaaaaaaaaaaaaaaaacaaaaaaaanaaaaaaaaaaacacaaa

SEQ ID NO: 365497 - DNA, 769 bp, Homo sapiens
  misc_feature (5)..(5): n is a, c, g, or t
  misc_feature (26)..(27): n is a, c, g, or t
catcngctaggtcgaggctgggtgtnngaagtgctgcgaaccacgtgggtcccgggcgcgtttcgggtgctggcggctgcagccggagttcaaacctaagcagctggaaggaaccatggccaactgtgagcgtaccttcattgcgatcaaaccagatggggtccagcggggtcttgtgggagagattatcaagcgttttgagcagaaaggattccgccttgttggtctgaaattcatgcaagcttccgaagatcttctcaaggaacactacgttgacctgaaggaccgtccattctttgccggcctggtgaaatacatgcactcagggccggtagttgccatggtctgggaggggctgaatgtggtgaagacgggccgagtcatgctcggggagaccaaccctgcagactccaagcctgggaccatccgtggagacttctgcatacaagttggcaggaacattatacatggcagtgattctgtggagagtgcagagaaggagatcggcttgtggtttcaccctgaggaactggtagattacacgagctgtgctcagaactggatctatgaatgacaggagggcagaccacattgcttttcacatccatttcccctccttcccatgggcagaggaccaggctgtaggaaatctagttatttacaggaacttcatcataatttggagggaagctcttggagctgtgagttctccctgtacagtgttaccatccccgaccatctgattaaaatgcttcctcccagcatagga

SEQ ID NO: 365498 - DNA, 807 bp, Homo sapiens
ggcagaagcgttccgtgcgtgcaagtgctgcgaaccacgtgggtcccgggcgcgtttcgggtgctggcggctgcagccggagttcaaacctaagcagctggaaggaaccatggccaactgtgagcgtaccttcattgcgatcaaaccagatggggtccagcggggtcttgtgggagagattatcaagcgttttgagcagaaaggattccgccttgttggtctgaaattcatgcaagcttccgaagatcttctcaaggaacactacgttgacctgaaggaccgtccattctttgccggcctggtgaaatacatgcactcagggccggtagttgccatggtctgggaggggctgaatgtggtgaagacgggccgagtcatgctcggggagaccaaccctgcagactccaagcctgggaccatccgtggagacttctgcatacaagttggcaggaacattatacatggcagtgattctgtggagagtgcagagaaggagatcggcttgtggtttcaccctgaggaactggtagattacacgagctgtgctcagaactggatctatgaatgacaggagggcagaccacattgcttttcacatccatttcccctccttcccatgggcagaggaccaggctgtaggaaatctagttatttacaggaacttcatcataatttggagggaagctcttggagctgtgagttctccctgtacagtgttaccatccccgacatctgattaaatgcttcctccagcaaaaaaaaaaaaaaacaaaaaaaaatggggggataaaagggggggggaaaaag

SEQ ID NO: 365499 - DNA, 1103 bp, Homo sapiens
  misc_feature (959)..(959): n is a, c, g, or t
ggcagaagcgttccgtgcgtgcaagtgctgcgaaccacgtgggtcccgggcgcgtttcgggtgctggcggctgcagccggagttcaaacctaagcagctggaaggaaccatggccaactgtgagcgtaccttcattgcgatcaaaccagatggggtccagcggggtcttgtgggagagattatcaagcgttttgagcagaaaggattccgccttgttggtctgaaattcatgcaagcttccgaagatcttctcaaggaacactacgttgacctgaaggaccgtccattctttgccggcctggtgaaatacatgcactcagggccggtagttgccatggtctgggaggggctgaatgtggtgaagacgggccgagtcatgctcggggagaccaaccctgcagactccaagcctgggaccatccgtggagacttctgcatacaagttggcaggaacattatacatggcagtgattctgtggagagtgcagagaaggagatcggcttgtggtttcaccctgaggaactggtagattacacgagctgtgctcagaactggatctatgaatgacaggagggcagaccacattgcttttcacatccatttcccctccttcccatgggcagaggaccaggctgtaggaaatctagttatttacaggaacttcatcataatttggagggaagctcttggagctgtgagttctccctgtacagtgttaccatccccgaccatctgattaaaatgcttcctcccagcataggaaaaaaaaaaaaaaaaaaaaaaaaaaaaaagggggctttttggggggggggaaaaaagctggtacggaatgggcacatgggccatacggcggtctcctggacccagtctttttgtccaaagggggggaactgggggcccccaaaaggggccgtataattcgaaacccagggtacgtgaacaccacgaaacaaaaaangcaacaagaagggagaaagcacaacataaaacaagggcaaaaacaacgccactaccccacacacaaactacaaccgaacgacacgacacaacgaaagcgacggccaccgaggcaacgtcgcgaaaaagtcgaagcacaccaaag

SEQ ID NO: 365500 - DNA, 811 bp, Homo sapiens
  misc_feature (794)..(794): n is a, c, g, or t
ggcagaagcgttccgtgcgtgcaagtgctgcgaaccacgtgggtcccgggcgcgtttcgggtgctggcggctgcagccggagttcaaacctaagcagctggaaggaaccatggccaactgtgagcgtaccttcattgcgatcaaaccagatggggtccagcggggtcttgtgggagagattatcaagcgttttgagcagaaaggattccgccttgttggtctgaaattcatgcaagcttccgaagatcttctcaaggaacactacgttgacctgaaggaccgtccattctttgccggcctggtgaaatacatgcactcagggccggtagttgccatggtctgggaggggctgaatgtggtgaagacgggccgagtcatgctcggggagaccaaccctgcagactccaagcctgggaccatccgtggagacttctgcatacaagttggcaggaacattatacatggcagtgattctgtggagagtgcagagaaggagatcggcttgtggtttcaccctgaggaactggtagattacacgagctgtgctcagaactggatctatgaatgacaggagggcagaccacattgcttttcacatccatttcccctccttcccatgggcagaggaccaggctgtaggaaatctagttatttacaggaacttcatcataatttggagggaagctcttggagctgtgagttctccctgtacagtgttaccatccccgaccatctgattaaaatgcttcctcccagcataggaaaaaaaaaaaaaaaaaaaaaacaaaaaaaanaaaaaaaaaaacacaaa

SEQ ID NO: 365501 - DNA, 1281 bp, Homo sapiens
ggaatggtactttagagttcacctacaacaatggtgttggttgggttgtgcttcacttctgcggtaaccctgtggactttccctccatagaaaggcttcgtgtggaatatcactgtcgctgagtacccagtcttggcacagttgatgctgacttttcctccgagctccacccacgggatggtgagaatggaccgggcgtaggcactaggcagggtgaatacgtactcctccccgtgttccaggagcctcaacacaccttcccctatcatagagacccccacggacatgcccatgaacttgccctcgtgccgaattcggcacgaggctgcgaaccacgtgggtcccgggcgcgtttcgggtgctggcggctgcagccggagttcaaacctaagcagctggaagggccctgtggctaggtaccatagagtctctacacaggactaagtcagcctggtgtgcaggggaggcagacacacaaacagaaaattggactacagtgctaagatgctgtaagaagaggttaactaaaggacaggaagatggggccaagagatggtgctactgtctactttagggatcgtctttcaaggcgaggggcctcctatctcaagctgtgatacaggaaccatggccaactgtgagcgtaccttcattgcgatcaaaccagatggggtccagcggggtcttgtgggagagattatcaagcgttttgagcagaaaggattccgccttgttggtctgaaattcatgcaagcttccgaagatcttctcaaggaacactacgttgacctgaaggaccgtccattctttgccggcctggtgaaatacatgcactcagggccggtagttgccatggtctgggaggggctgaatgtggtgaagacgggccgagtcatgctcggggagaccaaccctgcagactccaagcctgggaccatccgtggagacttctgcatacaagttggcaggaacattatacatggcagtgattctgtggagagtgcagagaaggagatcggcttgtggtttcaccctgaggaactggtagattacacgagctgtgctcagaactggatctatgaatgacaggagggcagaccacattgcttttcacatccatttcccctccttcccatgggcagaggaccaggctgtaggaaatctagttatttacaggaacttcatcataatttggagggaagctcttggagctgtgagttctccctgtacagtgttaccatccccgaccatctgattaaaatgcttcctcccagcatagga

SEQ ID NO: 365502 - DNA, 1221 bp, Homo sapiens
gtcaggcgcgacgacagggctgtgctttatttgtgtctgtcgagagcagtgccgggccggagttggcgctctgtaagtgcttgctgaataaatgacgggtgtgtgtgtcattcattcagcaagcactgagtcttactgttgtgtcaccgggaccgatgtggagggacatttttagggtgtatttctggcgctttagtcctgttttctcctggacaatttatgcttgccccgcaccccatcgtgcgattctccgcagtctttgggctttgtctctctctctttttttttttttggaagttgcagaatggtgataaatgattttctttgctcctattgactgctggccctgtggctaggtaccatagagtctctacacaggactaagtcagcctggtgtgcaggggaggcagacacacaaacagaaaattggactacagtgctaagatgctgtaagaagaggttaactaaaggacaggaagatggggccaagagatggtgctactgtctactttagggatcgtctttcaaggcgaggggcctcctatctcaagctgtgatacaggaaccatggccaactgtgagcgtaccttcattgcgatcaaaccagatggggtccagcggggtcttgtgggagagattatcaagcgttttgagcagaaaggattccgccttgttggtctgaaattcatgcaagcttccgaagatcttctcaaggaacactacgttgacctgaaggaccgtccattctttgccggcctggtgaaatacatgcactcagggccggtagttgccatggtctgggaggggctgaatgtggtgaagacgggccgagtcatgctcggggagaccaaccctgcagactccaagcctgggaccatccgtggagacttctgcatacaagttggcaggaacattatacatggcagtgattctgtggagagtgcagagaaggagatcggcttgtggtttcaccctgaggaactggtagattacacgagctgtgctcagaactggatctatgaatgacaggagggcagaccacattgcttttcacatccatttcccctccttcccatgggcagaggaccaggctgtaggaaatctagttatttacaggaacttcatcataatttggagggaagctcttggagctgtgagttctccctgtacagtgttaccatccccgaccatctgattaaaatgcttcctcccagcatagga

SEQ ID NO: 365503 - DNA, 1331 bp, Homo sapiens
ggaatggtactttagagttcacctacaacaatggtgttggttgggttgtgcttcacttctgcggtaaccctgtggactttccctccatagaaaggcttcgtgtggaatatcactgtcgctgagtacccagtcttggcacagttgatgctgacttttcctccgagctccacccacgggatggtgagaatggaccgggcgtaggcactaggcagggtgaatacgtactcctccccgtgttccaggagcctcaacacaccttcccctatcatagagacccccacggacatgcccatgaacttgccctcgtgccgaattcggcacgaggctgcgaaccacgtgggtcccgggcgcgtttcgggtgctggcggctgcagccggagttcaaacctaagcagctggaagggccctgtggctaggtaccatagagtctctacacaggactaagtcagcctggtgtgcaggggaggcagacacacaaacagaaaattggactacagtgctaagatgctgtaagaagaggttaactaaaggacaggaagatggggccaagagatggtgctactgtctactttagggatcgtctttcaaggcgaggggcctcctatctcaagctgtgatacaggaaccatggccaactgtgagcgtaccttcattgcgatcaaaccagatggggtccagcggggtcttgtgggagagattatcaagcgttttgagcagaaaggattccgccttgttggtctgaaattcatgcaagcttccgaagatcttctcaaggaacactacgttgacctgaaggaccgtccattctttgccggcctggtgaaatacatgcactcagggccggtagttgccatggtctgggaggggctgaatgtggtgaagacgggccgagtcatgctcggggagaccaaccctgcagactccaagcctgggaccatccgtggagacttctgcatacaagttggcaggaacattatacatggcagtgattctgtggagagtgcagagaaggagatcggcttgtggtttcaccctgaggaactggtagattacacgagctgtgctcagaactggatctatgaatgacaggagggcagaccacattgcttttcacatccatttcccctccttcccatgggcagaggaccaggctgtaggaaatctagttatttacaggaacttcatcataatttggagggaagctcttggagctgtgagttctccctgtacagtgttaccatccccgaccatctgattaaaatgcttcctcccagaaagaaacagagaacaaagcaaaaaaaaagccgaggactattggggcacaaaaggga

SEQ ID NO: 365504 - DNA, 764 bp, Homo sapiens
ggcagaagcgttccgtgcgtgcaagtgctgcgaaccacgtgggtcccgggcgcgtttcgggtgctggcggctgcagccggagttcaaacctaagcagctggaaggaaccatggccaactgtgagcgtaccttcattgcgatcaaaccagatggggtccagcggggtcttgtgggagagattatcaagcgttttgagcagaaaggattccgccttgttggtctgaaattcatgcaagcttccgaagatcttctcaaggaacactacgttgacctgaaggaccgtccattctttgccggcctggtgaaatacatgcactcagggccggtagttgccatggtctgggaggggctgaatgtggtgaagacgggccgagtcatgctcggggagaccaaccctgcagactccaagcctgggaccatccgtggagacttctgcatacaagttggcaggtgagattttggtatttttcccccttttccaaaatctgatttagttgccacaaggatttgggtttccgaggctggaggtagacatgataccatatgcaggttgattttatcggagtttattgttttcctccctcttaagttggcgtttggctttggttgttaacatcacttagtcgtacctctgttacacgaagtgtagaacctggtacaacacactttgctggccagtctttcctgaaggctctcactgtttgcaccagcgtggccgggagggctggatgtggggagggcatttttcagccttaagtgaatgg

SEQ ID NO: 365505 - DNA, 2475 bp, Homo sapiens
acgtgaccctgacccaataagggtggaaggctgagtcccgcagagccaataacgagagtccgagaggcgacggaggcggactctgtgaggaaacaagaagagaggcccaagatggagacggcggcggctgtagcggcgtgacaggagccccatggcacctgcccagccccacctcagcccatcttgacaaaatctaaggctccatggagccaccacggggcccccctgccaatggggccgagccatcccgggcagtgggcaccgtcaaagtatacctgcccaacaagcaacgcacggtggtgactgtccgggatggcatgagtgtctacgactctctagacaaggccctgaaggtgcggggtctaaatcaggactgctgtgtggtctaccgactcatcaagggacgaaagacggtcactgcctgggacacagccattgctcccctggatggcgaggagctcattgtcgaggtccttgaagatgtcccgctgaccatgcacaattttgtacggaagaccttcttcagcctggcgttctgtgacttctgccttaagtttctgttccatggcttccgttgccaaacctgtggctacaagttccaccagcattgttcctccaaggtccccacagtctgtgttgacatgagtaccaaccgccaacagttctaccacagtgtccaggatttgtccggaggctccagacagcatgaggctccctcgaaccgccccctgaatgagttgctaaccccccagggtcccagcccccgcacccagcactgtgacccggagcacttccccttccctgccccagccaatgcccccctacagcgcatccgctccacgtccactcccaacgtccatatggtcagcaccacggcccccatggactccaacctcatccagctcactggccagagtttcagcactgatgctgccggtagtagaggaggtagtgatggaaccccccgggggagccccagcccagccagcgtgtcctcggggaggaagtccccacattccaagtcaccagcagagcagcgcgagcggaagtccttggccgatgacaagaagaaagtgaagaacctggggtaccgggactcaggctattactgggaggtaccacccagtgaggtgcagctgctgaagaggatcgggacgggctcgtttggcaccgtgtttcgagggcggtggcatggcgatgtggccgtgaaggtgctcaaggtgtcccagcccacagctgagcaggcccaggctttcaagaatgagatgcaggtgctcaggaagacgcgacatgtcaacatcttgctgtttatgggcttcatgacccggccgggatttgccatcatcacacagtggtgtgagggctccagcctctaccatcacctgcatgtggccgacacacgcttcgacatggtccagctcatcgacgtggcccggcagactgcccagggcatggactacctccatgccaagaacatcatccaccgagatctcaagtctaacaacatcttcctacatgaggggctcacggtgaagatcggtgactttggcttggccacagtgaagactcgatggagcggggcccagcccttggagcagccctcaggatctgtgctgtggatggcagctgaggtgatccgtatgcaggacccgaacccctacagcttccagtcagacgtctatgcctacggggttgtgctctacgagcttatgactggctcactgccttacagccacattggctgccgtgaccagattatctttatggtgggccgtggctatctgtccccggacctcagcaaaatctccagcaactgccccaaggccatgcggcgcctgctgtctgactgcctcaagttccagcgggaggagcggcccctcttcccccagatcctggccacaattgagctgctgcaacggtcactccccaagattgagcggagtgcctcggaaccctccttgcaccgcacccaggccgatgagttgcctgcctgcctactcagcgcagcccgccttgtgccttaggccccgcccaagccaccagggagccaatctcagccctccacgccaaggagccttgcccaccagccaatcaatgttcgtctctgccctgatgctgcctcaggatcccccattccccaccctgggagatgagggggtccccatgtgcttttccagttcttctggaattgggggacccccgccaaagactgagccccctgtctcctccatcatttggtttcctcttggctttggggatacttctaaattttgggagctcctccatctccaatggctgggatttgtggcagggattccactcagaacctctctggaatttgtgcctgatgtgccttccactggattttggggttcccagcaccccatgtggattttggggggtcccttttgtgtctcccccgccattcaaggactcctctctttcttcaccaagaagcacagaattctgctgggc

SEQ ID NO: 365506 - DNA, 1637 bp, Homo sapiens
acgtgaccctgacccaataagggtggaaggctgagtcccgcagagccaataacgagagtccgagaggcgacggaggcggactctgtgaggaaacaagaagagaggcccaagatggagacggcggcggctgtagcggcgtgacaggagccccatggcacctgcccagccccacctcagcccatcttgacaaaatctaaggctccatggagccaccacggggcccccctgccaatggggccgagccatcccgggcagtgggcaccgtcaaagtatacctgcccaacaagcaacgcacggtggtgactgtccgggatggcatgagtgtctacgactctctagacaaggccctgaaggtgcggggtctaaatcaggactgctgtgtggtctaccgactcatcaagggacgaaagacggtcactgcctgggacacagccattgctcccctggatggcgaggagctcattgtcgaggtccttgaagatgtcccgctgaccatgcacaattttgtacggaagaccttcttcagcctggcgttctgtgacttctgccttaagtttctgttccatggcttccgttgccaaacctgtggctacaagttccaccagcattgttcctccaaggtccccacagtctgtgttgacatgagtaccaaccgccaacagttctaccacagtgtccaggatttgtccggaggctccagacagcatgaggctccctcgaaccgccccctgaatgagttgctaaccccccagggtcccaggtagggatgccttagctgaagagctgctgggggagaaaaagatcttggggctcttgtagaccacgagccatactttattcatttgtttacttgacaaacatttattgagcacctacaagtgtgagtaagggcatgaaactgggaccttgggcaagtcacctcatttctctgggcctcagttttctcatctgtaaagaggggatgatgatactttctaccatataaaggttctggtgaggcttaaatgagttaagacatgttcagtgcctagaacaggatctggtacagtgtaaataatcaatttttttgttattaattataaatatatttataagcatctaactactttgctaattctagtataatcatactcaagcctttccattttgaaatacgtattattttatcataaattacttcccttttattgcttttttatgttaaatattatataaaactatagctatattaaaatatattattgctctaatatatattttatgatgtgcatattttatggtatatttatgttattgtatcatgttgtattacataattttatataatgtagaacatcatacatgtttatatgatacataaaataaagttagggtattattttaaattatgagtgtatgtgcattaattacctttgagtttcatttcaggatagtgaagggaacattaacatatttttgtaactttacaatatgtttagcatatatcatatgtataacatgtatgtataacaatatggtaatatgtatattttaaaacattgccatttttatatagatgatacatattatataacatttgaaaagtacatgtaattataatatataattataaaatatgatacattaccctttcccca

SEQ ID NO: 365507 - DNA, 1682 bp, Homo sapiens
  misc_feature (994)..(994): n is a, c, g, or t
acgtgaccctgacccaataagggtggaaggctgagtcccgcagagccaataacgagagtccgagaggcgacggaggcggactctgtgaggaaacaagaagagaggcccaagatggagacggcggcggctgtagcggcgtgacagtgaagctgagaccttggcactcaagagtgagacaagcaacaggagggcctgagcagagaaggaactggaaggacttcagatgtgagcaggatctcttggactgtcgtgtgaaaattaggctgcagggggcgacaggagcctggactttgaattttattttgtcccctgccactttgcttctagactatcattattggacctctgaattcttgtctgccttcttgtaggagccccatggcacctgcccagccccacctcagcccatcttgacaaaatctaaggctccatggagccaccacggggcccccctgccaatggggccgagccatcccgggcagtgggcaccgtcaaagtatacctgcccaacaagcaacgcacggtggtgactgtccgggatggcatgagtgtctacgactctctagacaaggccctgaaggtgcggggtctaaatcaggactgctgtgtggtctaccgactcatcaagggacgaaagacggtcactgcctgggacacagccattgctcccctggatggcgaggagctcattgtcgaggtccttgaagatgtcccgctgaccatgcacaattttgtacggaagaccttcttcagcctggcgttctgtgacttctgccttaagtttctgttccatggcttccgttgccaaacctgtggctacaagttccaccagcattgttcctccaaggtccccacagtctgtgttgacatgagtaccaaccgccaacagttctaccacagtgtccaggatttgtccggaggctccagacagcatgaggctccctcgaaccgccccctgaatgagttgctaaccccccagggtcccagccccganccagcatgtgaccggagcatgtcccacccatttcccctggcccagcgcaagtgctccgcgcctacaggcgcagtgccgacttccgacgtgcagctcgccaacagtccatatgtgtcagccaacaccggcccccccatggaactcacaagctcatccaagctcacatggcaccaggagttttcagcacctgatgctgcccggtaagatagagcgaggtagtgatgggaagcccccccacggggggaggcaccccaagcacacagccaaggcagctgttcctcgaggggcaaggaaaagatcccccacaatttgtcacaaaaggtccacacaaggcacaagagccaaggcggccgaacgcgcgcacacgtccatgggggccgagtagaccagagacccgacacacgtcgcaacgaaaaccctcgacgcggttaacacgagcgaactaacaagggctactttaacgcgggaaggtaacccaccccccaagtggaagaggtggcacagcttaggcttcgcaccaaggactcccgcgggacacggagcggacgcgtaggggacaccagcagttaccaagaagggacacgcgcgcgcattgggcgacatgtgggacccgccaaaaggtcgcctcacacgagagtccccacgccccaacaggtgagacaggccccaggactctccaaccactggg

SEQ ID NO: 365508 - DNA, 148 bp, Homo sapiens
gagcggccgcctactactactactgctcgaattcaagcttctaacgatgtacgggcccatgtggattttggggggtcccttttgtgtctcccccgccattcaaggactcctctctttcttcaccaagaagcacagaattctgctgggc

SEQ ID NO: 365509 - DNA, 2587 bp, Homo sapiens
acgtgaccctgacccaataagggtggaaggctgagtcccgcagagccaataacgagagtccgagaggcgacggaggcggactctgtgaggaaacaagaagagaggcccaagatggagacggcggcggctgtagcggcgtgacaggagccccatggcacctgcccagccccacctcagcccatcttgacaaaatctaaggctccatggagccaccacggggcccccctgccaatggggccgagccatcccgggcagtgggcaccgtcaaagtatacctgcccaacaagcaacgcacggtggtgactgtccgggatggcatgagtgtctacgactctctagacaaggccctgaaggtgcggggtctaaatcaggactgctgtgtggtctaccgactcatcaagggacgaaagacggtcactgcctgggacacagccattgctcccctggatggcgaggagctcattgtcgaggtccttgaagatgtcccgctgaccatgcacaattttgtacggaagaccttcttcagcctggcgttctgtgacttctgccttaagtttctgttccatggcttccgttgccaaacctgtggctacaagttccaccagcattgttcctccaaggtccccacagtctgtgttgacatgagtaccaaccgccaacagtgagcccagcctggggtgggtggggggatggggagcacagaggcccagccacgaggcccttacagacagctgacccgtgtccccttgctttatacccttcatgccctcaaggttctaccacagtgtccaggatttgtccggaggctccagacagcatgaggctccctcgaaccgccccctgaatgagttgctaaccccccagggtcccagcccccgcacccagcactgtgacccggagcacttccccttccctgccccagccaatgcccccctacagcgcatccgctccacgtccactcccaacgtccatatggtcagcaccacggcccccatggactccaacctcatccagctcactggccagagtttcagcactgatgctgccggtagtagaggaggtagtgatggaaccccccgggggagccccagcccagccagcgtgtcctcggggaggaagtccccacattccaagtcaccagcagagcagcgcgagcggaagtccttggccgatgacaagaagaaagtgaagaacctggggtaccgggactcaggctattactgggaggtaccacccagtgaggtgcagctgctgaagaggatcgggacgggctcgtttggcaccgtgtttcgagggcggtggcatggcgatgtggccgtgaaggtgctcaaggtgtcccagcccacagctgagcaggcccaggctttcaagaatgagatgcaggtgctcaggaagacgcgacatgtcaacatcttgctgtttatgggcttcatgacccggccgggatttgccatcatcacacagtggtgtgagggctccagcctctaccatcacctgcatgtggccgacacacgcttcgacatggtccagctcatcgacgtggcccggcagactgcccagggcatggactacctccatgccaagaacatcatccaccgagatctcaagtctaacaacatcttcctacatgaggggctcacggtgaagatcggtgactttggcttggccacagtgaagactcgatggagcggggcccagcccttggagcagccctcaggatctgtgctgtggatggcagctgaggtgatccgtatgcaggacccgaacccctacagcttccagtcagacgtctatgcctacggggttgtgctctacgagcttatgactggctcactgccttacagccacattggctgccgtgaccagattatctttatggtgggccgtggctatctgtccccggacctcagcaaaatctccagcaactgccccaaggccatgcggcgcctgctgtctgactgcctcaagttccagcgggaggagcggcccctcttcccccagatcctggccacaattgagctgctgcaacggtcactccccaagattgagcggagtgcctcggaaccctccttgcaccgcacccaggccgatgagttgcctgcctgcctactcagcgcagcccgccttgtgccttaggccccgcccaagccaccagggagccaatctcagccctccacgccaaggagccttgcccaccagccaatcaatgttcgtctctgccctgatgctgcctcaggatcccccattccccaccctgggagatgagggggtccccatgtgcttttccagttcttctggaattgggggacccccgccaaagactgagccccctgtctcctccatcatttggtttcctcttggctttggggatacttctaaattttgggagctcctccatctccaatggctgggatttgtggcagggattccactcagaacctctctggaatttgtgcctgatgtgccttccactggattttggggttcccagcaccccatgtggattttggggggtcccttttgtgtctcccccgccattcaaggactcctctctttcttcaccaagaagcacagaattctgctgggc

SEQ ID NO: 365510 - DNA, 2371 bp, Homo sapiens
  misc_feature (263)..(263): n is a, c, g, or t
atatctaatggctcctagtgactgacagctgggcgtgcccgccgtagccactgacgtgcctaggcctgtcaccagtgcacgctagggtcaacagttgccaggtatacctgctctacaatgcaaagcgagggatggctgacttgttacggagacttgcataagttgtctatcaatctttagcagcaacggctggttaagcgatgcttggggctcttaagattccccagactgtgcttgctgtggcgtctacgctgtacttctantctatagggtgtaggacaatgtacgaggtcaccttggtcctgagaggatcagctacggacgcaaatatgacatcccctggatggcgaggagctcattgtcgaggtccttgaagatgtcccgctgaccatgcacaattttgtacggaagaccttcttcagcctggcgttctgtgacttctgccttaagtttctgttccatggcttccgttgccaaacctgtggctacaagttccaccagcattgttcctccaaggtccccacagtctgtgttgacatgagtaccaaccgccaacagttctaccacagtgtccaggatttgtccggaggctccagacagcatgaggctccctcgaaccgccccctgaatgagttgctaaccccccagggtcccagcccccgcacccagcactgtgacccggagcacttccccttccctgccccagccaatgcccccctacagcgcatccgctccacgtccactcccaacgtccatatggtcagcaccacggcccccatggactccaacctcatccagctcactggccagagtttcagcactgatgctgccggtagtagaggaggtagtgatggaaccccccgggggagccccagcccagccagcgtgtcctcggggaggaagtccccacattccaagtcaccagcagagcagcgcgagcggaagtccttggccgatgacaagaagaaagtgaagaacctggggtaccgggactcaggctattactgggaggtaccacccagtgaggtgcagctgctgaagaggatcgggacgggctcgtttggcaccgtgtttcgagggcggtggcatggcgatgtggccgtgaaggtgctcaaggtgtcccagcccacagctgagcaggcccaggctttcaagaatgagatgcaggtgctcaggaagacgcgacatgtcaacatcttgctgtttatgggcttcatgacccggccgggatttgccatcatcacacagtggtgtgagggctccagcctctaccatcacctgcatgtggccgacacacgcttcgacatggtccagctcatcgacgtggcccggcagactgcccagggcatggactacctccatgccaagaacatcatccaccgagatctcaagtctaacaacatcttcctacatgaggggctcacggtgaagatcggtgactttggcttggccacagtgaagactcgatggagcggggcccagcccttggagcagccctcaggatctgtgctgtggatggcagctgaggtgatccgtatgcaggacccgaacccctacagcttccagtcagacgtctatgcctacggggttgtgctctacgagcttatgactggctcactgccttacagccacattggctgccgtgaccagattatctttatggtgggccgtggctatctgtccccggacctcagcaaaatctccagcaactgccccaaggccatgcggcgcctgctgtctgactgcctcaagttccagcgggaggagcggcccctcttcccccagatcctggccacaattgagctgctgcaacggtcactccccaagattgagcggagtgcctcggaaccctccttgcaccgcacccaggccgatgagttgcctgcctgcctactcagcgcagcccgccttgtgccttaggccccgcccaagccaccagggagccaatctcagccctccacgccaaggagccttgcccaccagccaatcaatgttcgtctctgccctgatgctgcctcaggatcccccattccccaccctgggagatgagggggtccccatgtgcttttccagttcttctggaattgggggacccccgccaaagactgagccccctgtctcctccatcatttggtttcctcttggctttggggatacttctaaattttgggagctcctccatctccaatggctgggatttgtggcagggattccactcagaacctctctggaatttgtgcctgatgtgccttccactggattttggggttcccagcaccccatgtggattttggggggtcccttttgtgtctcccccgccattcaaggactcctctctttcttcaccaagaagcacagaattctgctgggc

SEQ ID NO: 365511 - DNA, 1641 bp, Homo sapiens
ctcgaacccgacactcaaactgggatttctcatcacccacggcccccatggactccaacctcatccagctcactggccagagtttcagcactgatgctgccggtagtagaggaggtagtgatggaaccccccgggggagccccagcccagccagcgtgtcctcggggaggaagtccccacattccaagtcaccagcagagcagcgcgagcggaagtccttggccgatgacaagaagaaagtgaagaacctggggtaccgggactcaggctattactgggaggtaccacccagtgaggtgcagctgctgaagaggatcgggacgggctcgtttggcaccgtgtttcgagggcggtggcatggcgatgtggccgtgaaggtgctcaaggtgtcccagcccacagctgagcaggcccaggctttcaagaatgagatgcaggtgctcaggaagacgcgacatgtcaacatcttgctgtttatgggcttcatgacccggccgggatttgccatcatcacacagtggtgtgagggctccagcctctaccatcacctgcatgtggccgacacacgcttcgacatggtccagctcatcgacgtggcccggcagactgcccagggcatggactacctccatgccaagaacatcatccaccgagatctcaagtctaacaacatcttcctacatgaggggctcacggtgaagatcggtgactttggcttggccacagtgaagactcgatggagcggggcccagcccttggagcagccctcaggatctgtgctgtggatggcagctgaggtgatccgtatgcaggacccgaacccctacagcttccagtcagacgtctatgcctacggggttgtgctctacgagcttatgactggctcactgccttacagccacattggctgccgtgaccagattatctttatggtgggccgtggctatctgtccccggacctcagcaaaatctccagcaactgccccaaggccatgcggcgcctgctgtctgactgcctcaagttccagcgggaggagcggcccctcttcccccagatcctggccacaattgagctgctgcaacggtcactccccaagattgagcggagtgcctcggaaccctccttgcaccgcacccaggccgatgagttgcctgcctgcctactcagcgcagcccgccttgtgccttaggccccgcccaagccaccagggagccaatctcagccctccacgccaaggagccttgcccaccagccaatcaatgttcgtctctgccctgatgctgcctcaggatcccccattccccaccctgggagatgagggggtccccatgtgcttttccagttcttctggaattgggggacccccgccaaagactgagccccctgtctcctccatcatttggtttcctcttggctttggggatacttctaaattttgggagctcctccatctccaatggctgggatttgtggcagggattccactcagaacctctctggaatttgtgcctgatgtgccttccactggattttggggttcccagcaccccatgtggattttggggggtcccttttgtgtctcccccgccattcaaggactcctctctttcttcaccaagaagcacagaattctgctgggc

SEQ ID NO: 365512 - DNA, 1802 bp, Homo sapiens
acgtgaccctgacccaataagggtggaaggctgagtcccgcagagccaataacgagagtccgagaggcgacggaggcggactctgtgaggaaacaagaagagaggcccaagatggagacggcggcggctgtagcggcgtgacaggagccccatggcacctgcccagccccacctcagcccatcttgacaaaatctaaggctccatggagccaccacggggcccccctgccaatggggccgagccatcccgggcagtgggcaccgtcaaagtatacctgcccaacaagcaacgcacggtggtgactgtccgggatggcatgagtgtctacgactctctagacaaggccctgaaggtgcggggtctaaatcaggactgctgtgtggtctaccgactcatcaagggacgaaagacggtcactgcctgggacacagccattgctcccctggatggcgaggagctcattgtcgaggtccttgaagatgtcccgctgaccatgcacaattttgtacggaagaccttcttcagcctggcgttctgtgacttctgccttaagtttctgttccatggcttccgttgccaaacctgtggctacaagttccaccagcattgttcctccaaggtccccacagtctgtgttgacatgagtaccaaccgccaacagttctaccacagtgtccaggatttgtccggaggctccagacagcatgaggctccctcgaaccgccccctgaatgagttgctaaccccccagggtcccagcccccgcacccagcactgtgacccggagcacttccccttccctgccccagccaatgcccccctacagcgcatccgctccacgtccactcccaacgtccatatggtcagcaccacggcccccatggactccaacctcatccagctcactggccagagtttcagcactgatgctgccggtagtagaggaggtagtgatggaaccccccgggggagccccagcccagccagcgtgtcctcggggaggaagtccccacattccaagtcaccagcagagcagcgcgagcggaagtccttggccgatgacaagaagaaagtgaagaacctggggtaccgggactcaggctattactgggaggtaccacccagtgaggtgcagctgctgaagaggatcgggacgggctcgtttggcaccgtgtttcgagggcggtggcatggcgatgtggccgtgaaggtgctcaaggtgtcccagcccacagctgagcaggcccaggctttcaagaatgagatgcaggtgctcaggaagacgcgacatgtcaacatcttgctgtttatgggcttcatgacccggccgggatttgccatcatcacacagtggtgtgagggctccagcctctaccatcacctgcatgtggccgacacacgcttcgacatggtccagctcatcgacgtggcccggcagactgcccagggcatggactacctccatgccaagaacatcatccaccgagatctcaagtctaacaacatcttcctacatgaggggctcacggtgaagatcggtgactttggcttggccacagtgaagactcgatggagcggggcccagcccttggagcagccctcaggatctgtgctgtggatggcagctgaggtgatccgtatgcaggacacgtatggtcaagtcattctaataatcgcacacgtactaacatcctcaatatctattcggcctagcaaactcaatctacgcacgcactcacagtcgcatataatcctctctcaaggacacgaatgttcaggtaccgagctgaattgtatatta

SEQ ID NO: 365513 - DNA, 1177 bp, Homo sapiens
aagttccagcgggaggagcggcccctcttcccccagatcctggccacaattgagctgctgcaacggtcactccccaagattgagcggagtgcctcggaaccctccttgcaccgcacccaggccgatgagttgcctgcctgcctactcagcgcagcccgccttgtgccttaggccccgcccaagccaccagggagccaatctcagccctccacgccaaggagccttgcccaccagccaatcaatgttcgtctctgccctgatgctgcctcaggatcccccattccccagcccttggagcagccctcaggatctgtgctgtggatggcagctgaggtgatccgtatgcaggacccgaacccctacagcttccagtcagacgtctatgcctacggggttgtgctctacgagcttatgactggctcactgccttacagccacattggctgccgtgaccagattatctttatggtgggccgtggctatctgtccccggacctcagcaaaatctccagcaactgccccaaggccatgcggcgcctgctgtctgactgcctcaagttccagcgggaggagcggcccctcttcccccagatcctggccacaattgagctgctgcaacggtcactccccaagattgagcggagtgcctcggaaccctccttgcaccgcacccaggccgatgagttgcctgcctgcctactcagcgcagcccgccttgtgccttaggccccgcccaagccaccagggagccaatctcagccctccacgccaaggagccttgcccaccagccaatcaatgttcgtctctgccctgatgctgcctcaggatcccccattccccaccctgggagatgagggggtccccatgtgcttttccagttcttctggaattgggggacccccgccaaagactgagccccctgtctcctccatcatttggtttcctcttggctttggggatacttctaaattttgggagctcctccatctccaatggctgggatttgtggcagggattccactcagaacctctctggaatttgtgcctgatgtgccttccactggattttggggttcccagcaccccatgtggattttggggggtcccttttgtgtctcccccgccattcaaggactcctctctttcttcaccaagaagcacagaattctgctgggc

SEQ ID NO: 365514 - DNA, 1455 bp, Homo sapiens
  misc_feature (767)..(767): n is a, c, g, or t
acgtgaccctgacccaataagggtggaaggctgagtcccgcagagccaataacgagagtccgagaggcgacggaggcggactctgtgaggaaacaagaagagaggcccaagatggagacggcggcggctgtagcggcgtgacaggagccccatggcacctgcccagccccacctcagcccatcttgacaaaatctaaggctccatggagccaccacggggcccccctgccaatggggccgagccatcccgggcagtgggcaccgtcaaagtatacctgcccaacaagcaacgcacggtggtgactgtccgggatggcatgagtgtctacgactctctagacaaggccctgaaggtgcggggtctaaatcaggactgctgtgtggtctaccgactcatcaagggacgaaagacggtcactgcctgggacacagccattgctcccctggatggcgaggagctcattgtcgaggtccttgaagatgtcccgctgaccatgcacaattttgtacggaagaccttcttcagcctggcgttctgtgacttctgccttaagtttctgttccatggcttccgttgccaaacctgtggctacaagttccaccagcattgttcctccaaggtccccacagtctgtgttgacatgagtaccaaccgccaacagttctaccacagtgtccaggatttgtccggaggctccagacagcatgaggctccctcgaaccgccccctgaatgagttgctaaccccccagggtcccagccccganccagcatgtgaccggagcatgtcccacccatttcccctggcccagcgcaagtgctccgcgcctacaggcgcagtgccgacttccgacgtgcagctcgccaacagtccatatgtgtcagccaacaccggcccccccatggaactcacaagctcatccaagctcacatggcaccaggagttttcagcacctgatgctgcccggtaagatagagcgaggtagtgatgggaagcccccccacggggggaggcaccccaagcacacagccaaggcagctgttcctcgaggggcaaggaaaagatcccccacaatttgtcacaaaaggtccacacaaggcacaagagccaaggcggccgaacgcgcgcacacgtccatgggggccgagtagaccagagacccgacacacgtcgcaacgaaaaccctcgacgcggttaacacgagcgaactaacaagggctactttaacgcgggaaggtaacccaccccccaagtggaagaggtggcacagcttaggcttcgcaccaaggactcccgcgggacacggagcggacgcgtaggggacaccagcagttaccaagaagggacacgcgcgcgcattgggcgacatgtgggacccgccaaaaggtcgcctcacacgagagtccccacgccccaacaggtgagacaggccccaggactctccaaccactggg

SEQ ID NO: 365515 - DNA, 1864 bp, Homo sapiens
acgtgaccctgacccaataagggtggaaggctgagtcccgcagagccaataacgagagtccgagaggcgacggaggcggactctgtgaggaaacaagaagagaggcccaagatggagacggcggcggctgtagcggcgtgacagtgaagctgagaccttggcactcaagagtgagacaagcaacaggagggcctgagcagagaaggaactggaaggacttcagatgtgagcaggatctcttggactgtcgtgtgaaaattaggctgcagggggcgacaggagcctggactttgaattttattttgtcccctgccactttgcttctagactatcattattggacctctgaattcttgtctgccttcttgtaggagccccatggcacctgcccagccccacctcagcccatcttgacaaaatctaaggctccatggagccaccacggggcccccctgccaatggggccgagccatcccgggcagtgggcaccgtcaaagtatacctgcccaacaagcaacgcacggtggtgactgtccgggatggcatgagtgtctacgactctctagacaaggccctgaaggtgcggggtctaaatcaggactgctgtgtggtctaccgactcatcaagggacgaaagacggtcactgcctgggacacagccattgctcccctggatggcgaggagctcattgtcgaggtccttgaagatgtcccgctgaccatgcacaattttgtacggaagaccttcttcagcctggcgttctgtgacttctgccttaagtttctgttccatggcttccgttgccaaacctgtggctacaagttccaccagcattgttcctccaaggtccccacagtctgtgttgacatgagtaccaaccgccaacagttctaccacagtgtccaggatttgtccggaggctccagacagcatgaggctccctcgaaccgccccctgaatgagttgctaaccccccagggtcccaggtagggatgccttagctgaagagctgctgggggagaaaaagatcttggggctcttgtagaccacgagccatactttattcatttgtttacttgacaaacatttattgagcacctacaagtgtgagtaagggcatgaaactgggaccttgggcaagtcacctcatttctctgggcctcagttttctcatctgtaaagaggggatgatgatactttctaccatataaaggttctggtgaggcttaaatgagttaagacatgttcagtgcctagaacaggatctggtacagtgtaaataatcaatttttttgttattaattataaatatatttataagcatctaactactttgctaattctagtataatcatactcaagcctttccattttgaaatacgtattattttatcataaattacttcccttttattgcttttttatgttaaatattatataaaactatagctatattaaaatatattattgctctaatatatattttatgatgtgcatattttatggtatatttatgttattgtatcatgttgtattacataattttatataatgtagaacatcatacatgtttatatgatacataaaataaagttagggtattattttaaattatgagtgtatgtgcattaattacctttgagtttcatttcaggatagtgaagggaacattaacatatttttgtaactttacaatatgtttagcatatatcatatgtataacatgtatgtataacaatatggtaatatgtatattttaaaacattgccatttttatatagatgatacatattatataacatttgaaaagtacatgtaattataatatataattataaaatatgatacattaccctttcccca

SEQ ID NO: 365516 - DNA, 515 bp, Homo sapiens
aacccccagccaatccgccacctgcctccacccccacagctacctccatgccaagaacatcatccaccgagatctcaagtctaacagtatctatctgtccctgggctggggttgagtgggggtgtcaagggcttagaaggatgcctcttgtgggggttctgggaattacaagggaggggcatgtgtcccagagctccttgccaggtggcagagctgtggccagccagggggctttaatggcagtctcttagaagtcagaggtgtggctggttcaggtactattcttggggactctggttagagtctgatgtctgacagttgtggagggcattatggtcaacatcagaggcatagtgggttcggatgccctccgaggggcttcctgttcaggagtcacagcggggctgagtgtggggggcattagcaggcgttccctgcccacgtcaaggttgtggatagtttgcgtgatattaaggggctcctggtcaggatcagagggatgagtggtatagggg

SEQ ID NO: 365517 - DNA, 517 bp, Homo sapiens
agtgagctgagaccatgccattgcactccagcctgggcaacaagagcgaaactctgtcagaaaaaaaaaaaaacagaaaaaaaaaaaaaaaaaacccaggacattctgttcgtgcttcttatgtacctgacggctcagtgcagtgtgtactgacttccccattggtccccagcacagagtcttgtgtgctcctctaccctccaagacagtatgctctgtcccccttccctgttctctcccccgcaaccctgtgcagtgaagctgagaccttggcactcaagagtgagacaagcaacaggagggcctgagcagagaaggaactggaaggacttcagatgtgagcaggatctcttggactgtcgtgtgaaaattaggctgcagggggcgacaggagcctggactttgaattttattttgtcccctgccactttgcttctagactatcattattggacctctgaattcttgtctgccttcttgtaggagccccatggcacctgcccagccccacctcagc

SEQ ID NO: 365518 - DNA, 1553 bp, Homo sapiens
ggctggtacggtccgagttttatggatatggagacggcggcggctgtagcggcgtgacaggagccccatggcacctgcccagccccacctcagcccatcttgacaaaatctaaggctccatggagccaccacggggcccccctgccaatggggccgagccatcccgggcagtgggcaccgtcaaagtatacctgcccaacaagcaacgcacggtggtgactgtccgggatggcatgagtgtctacgactctctagacaaggccctgaaggtgcggggtctaaatcaggactgctgtgtggtctaccgactcatcaagggacgaaagacggtcactgcctgggacacagccattgctcccctggatggcgaggagctcattgtcgaggtccttgaagatgtcccgctgaccatgcacaattttgtacggaagaccttcttcagcctggcgttctgtgacttctgccttaagtttctgttccatggcttccgttgccaaacctgtggctacaagttccaccagcattgttcctccaaggtccccacagtctgtgttgacatgagtaccaaccgccaacagttctaccacagtgtccaggatttgtccggaggctccagacagcatgaggctccctcgaaccgccccctgaatgagttgctaaccccccagggtcccaggtagggatgccttagctgaagagctgctgggggagaaaaagatcttggggctcttgtagaccacgagccatactttattcatttgtttacttgacaaacatttattgagcacctacaagtgtgagtaagggcatgaaactgggaccttgggcaagtcacctcatttctctgggcctcagttttctcatctgtaaagaggggatgatgatactttctaccatataaaggttctggtgaggcttaaatgagttaagacatgttcagtgcctagaacaggatctggtacagtgtaaataatcaatttttttgttattaattataaatatatttataagcatctaactactttgctaattctagtataatcatactcaagcctttccattttgaaatacgtattattttatcataaattacttcccttttattgcttttttatgttaaatattatataaaactatagctatattaaaatatattattgctctaatatatattttatgatgtgcatattttatggtatatttatgttattgtatcatgttgtattacataattttatataatgtagaacatcatacatgtttatatgatacataaaataaagttagggtattattttaaattatgagtgtatgtgcattaattacctttgagtttcatttcaggatagtgaagggaacattaacatatttttgtaactttacaatatgtttagcatatatcatatgtataacatgtatgtataacaatatggtaatatgtatattttaaaacattgccatttttatatagatgatacatattatataacatttgaaaagtacatgtaattataatatataattataaaatatgatacattaccctttcccca

SEQ ID NO: 365519 - DNA, 780 bp, Homo sapiens
ggggcaccaatgggaacctcccaggcagggtgagaggcatggctattaggagtccctgtagtggtccttgaccctggcggacatcttcctacatgaggggctcacggtgaagatcggtgactttggcttggccacagtgaagactcgatggagcggggcccagcccttggagcagccctcaggatctgtgctgtggatggcagctgaggtgatccgtatgcaggacccgaacccctacagcttccagtcagacgtctatgcctacggggttgtgctctacgagcttatgactggctcactgccttacagccacattggctgccgtgaccaggtgagccccacaccttacccacagttccctgggctgagggatcccctcaggcatccataccccacatcccctcctttgcactgataaatgccacactttccccagaaacctaaaattttctaggataaggactcccagaatcccttgggctccagacacttacaataaattctctgggtctcccctaccccaacttccctcttctcacatccacagccctctgggacaaaaatctttgaagtccaaaatgccccgaatctctatacctagaatcccctgaggcccccaaataccccaaagccctctgtatccctagacgcctatagtcgtctgctctgggtactcaaaatcccccagatcctcaaagcccagatctcatttctcccagcatcccatttttccccagaaacagaacccctttgtgcttctggaatagtcatggacaccca

SEQ ID NO: 365520 - DNA, 2447 bp, Homo sapiens
acgtgaccctgacccaataagggtggaaggctgagtcccgcagagccaataacgagagtccgagaggcgacggaggcggactctgtgaggaaacaagaagagaggcccaagatggagacggcggcggctgtagcggcgtgacaggagccccatggcacctgcccagccccacctcagcccatcttgacaaaatctaaggctccatggagccaccacggggcccccctgccaatggggccgagccatcccgggcagtgggcaccgtcaaagtatacctgcccaacaagcaacgcacggtggtgactgtccgggatggcatgagtgtctacgactctctagacaaggccctgaaggtgcggggtctaaatcaggactgctgtgtggtctaccgactcatcaagggacgaaagacggtcactgcctgggacacagccattgctcccctggatggcgaggagctcattgtcgaggtccttgaagatgtcccgctgaccatgcacaattttgtacggaagaccttcttcagcctggcgttctgtgacttctgccttaagtttctgttccatggcttccgttgccaaacctgtggctacaagttccaccagcattgttcctccaaggtccccacagtctgtgttgacatgagtaccaaccgccaacagttctaccacagtgtccaggatttgtccggaggctccagacagcatgaggctccctcgaaccgccccctgaatgagttgctaaccccccagggtcccagcccccgcacccagcactgtgacccggagcacttccccttccctgccccagccaatgcccccctacagcgcatccgctccacgtccactcccaacgtccatatggtcagcaccacggcccccatggactccaacctcatccagctcactggccagagtttcagcactgatgctgccggtagtagaggaggtagtgatggaaccccccgggggagccccagcccagccagcgtgtcctcggggaggaagtccccacattccaagtcaccagcagagcagcgcgagcggaagtccttggccgatgacaagaagaaagtgaagaacctggggtaccgggactcaggctattactgggaggtaccacccagtgaggtgcagctgctgaagaggatcgggacgggctcgtttggcaccgtgtttcgagggcggtggcatggcgatgtggccgtgaaggtgctcaaggtgtcccagcccacagctgagcaggcccaggctttcaagaatgagatgcaggtgctcaggaagacgcgacatgtcaacatcttgctgtttatgggcttcatgacccggccgggatttgccatcatcacacagtggtgtgagggctccagcctctaccatcacctgcatgtggccgacacacgcttcgacatggtccagctcatcgacgtggcccggcagactgcccagggcatggactacctccatgccaagaacatcatccaccgagatctcaagtctaacaacatcttcctacatgaggggctcacggtgaagatcggtgactttggcttggccacagtgaagactcgatggagcggggcccagcccttggagcagccctcaggatctgtgctgtggatggcagctgaggtgatccgtatgcaggacccgaacccctacagcttccagtcagacgtctatgcctacggggttgtgctctacgagcttatgactggctcactgccttacagccacattggctgccgtgaccagattatctttatggtgggccgtggctatctgtccccggacctcagcaaaatctccagcaactgccccaaggccatgcggcgcctgctgtctgactgcctcaagttccagcgggaggagcggcccctcttcccccagggtcactccccaagattgagcggagtgcctcggaaccctccttgcaccgcacccaggccgatgagttgcctgcctgcctactcagcgcagcccgccttgtgccttaggccccgcccaagccaccagggagccaatctcagccctccacgccaaggagccttgcccaccagccaatcaatgttcgtctctgccctgatgctgcctcaggatcccccattccccaccctgggagatgagggggtccccatgtgcttttccagttcttctggaattgggggacccccgccaaagactgagccccctgtctcctccatcatttggtttcctcttggctttggggatacttctaaattttgggagctcctccatctccaatggctgggatttgtggcagggattccactcagaacctctctggaatttgtgcctgatgtgccttccactggattttggggttcccagcaccccatgtggattttggggggtcccttttgtgtctcccccgccattcaaggactcctctctttcttcaccaagaagcacagaattctgctgggc

SEQ ID NO: 365521 - DNA, 2391 bp, Homo sapiens
ggctggtacggtccgagttttatggatatggagacggcggcggctgtagcggcgtgacaggagccccatggcacctgcccagccccacctcagcccatcttgacaaaatctaaggctccatggagccaccacggggcccccctgccaatggggccgagccatcccgggcagtgggcaccgtcaaagtatacctgcccaacaagcaacgcacggtggtgactgtccgggatggcatgagtgtctacgactctctagacaaggccctgaaggtgcggggtctaaatcaggactgctgtgtggtctaccgactcatcaagggacgaaagacggtcactgcctgggacacagccattgctcccctggatggcgaggagctcattgtcgaggtccttgaagatgtcccgctgaccatgcacaattttgtacggaagaccttcttcagcctggcgttctgtgacttctgccttaagtttctgttccatggcttccgttgccaaacctgtggctacaagttccaccagcattgttcctccaaggtccccacagtctgtgttgacatgagtaccaaccgccaacagttctaccacagtgtccaggatttgtccggaggctccagacagcatgaggctccctcgaaccgccccctgaatgagttgctaaccccccagggtcccagcccccgcacccagcactgtgacccggagcacttccccttccctgccccagccaatgcccccctacagcgcatccgctccacgtccactcccaacgtccatatggtcagcaccacggcccccatggactccaacctcatccagctcactggccagagtttcagcactgatgctgccggtagtagaggaggtagtgatggaaccccccgggggagccccagcccagccagcgtgtcctcggggaggaagtccccacattccaagtcaccagcagagcagcgcgagcggaagtccttggccgatgacaagaagaaagtgaagaacctggggtaccgggactcaggctattactgggaggtaccacccagtgaggtgcagctgctgaagaggatcgggacgggctcgtttggcaccgtgtttcgagggcggtggcatggcgatgtggccgtgaaggtgctcaaggtgtcccagcccacagctgagcaggcccaggctttcaagaatgagatgcaggtgctcaggaagacgcgacatgtcaacatcttgctgtttatgggcttcatgacccggccgggatttgccatcatcacacagtggtgtgagggctccagcctctaccatcacctgcatgtggccgacacacgcttcgacatggtccagctcatcgacgtggcccggcagactgcccagggcatggactacctccatgccaagaacatcatccaccgagatctcaagtctaacaacatcttcctacatgaggggctcacggtgaagatcggtgactttggcttggccacagtgaagactcgatggagcggggcccagcccttggagcagccctcaggatctgtgctgtggatggcagctgaggtgatccgtatgcaggacccgaacccctacagcttccagtcagacgtctatgcctacggggttgtgctctacgagcttatgactggctcactgccttacagccacattggctgccgtgaccagattatctttatggtgggccgtggctatctgtccccggacctcagcaaaatctccagcaactgccccaaggccatgcggcgcctgctgtctgactgcctcaagttccagcgggaggagcggcccctcttcccccagatcctggccacaattgagctgctgcaacggtcactccccaagattgagcggagtgcctcggaaccctccttgcaccgcacccaggccgatgagttgcctgcctgcctactcagcgcagcccgccttgtgccttaggccccgcccaagccaccagggagccaatctcagccctccacgccaaggagccttgcccaccagccaatcaatgttcgtctctgccctgatgctgcctcaggatcccccattccccaccctgggagatgagggggtccccatgtgcttttccagttcttctggaattgggggacccccgccaaagactgagccccctgtctcctccatcatttggtttcctcttggctttggggatacttctaaattttgggagctcctccatctccaatggctgggatttgtggcagggattccactcagaacctctctggaatttgtgcctgatgtgccttccactggattttggggttcccagcaccccatgtggattttggggggtcccttttgtgtctcccccgccattcaaggactcctctctttcttcaccaagaagcacagaattctgctgggc

SEQ ID NO: 365522 - DNA, 2203 bp, Homo sapiens
acgtgaccctgacccaataagggtggaaggctgagtcccgcagagccaataacgagagtccgagaggcgacggaggcggactctgtgaggaaacaagaagagaggcccaagatggagacggcggcggctgtagcggcgtgacaggagccccatggcacctgcccagccccacctcagcccatcttgacaaaatctaaggctccatggagccaccacggggcccccctgccaatggggccgagccatcccgggcagtgggcaccgtcaaagtatacctgcccaacaagcaacgcacggtggtgactgtccgggatggcatgagtgtctacgactctctagacaaggccctgaaggtgcggggtctaaatcaggactgctgtgtggtctaccgactcatcaagggacgaaagacggtcactgcctgggacacagccattgctcccctggatggcgaggagctcattgtcgaggtccttgaagatgtcccgctgaccatgcacaattttgtacggaagaccttcttcagcctggcgttctgtgacttctgccttaagtttctgttccatggcttccgttgccaaacctgtggctacaagttccaccagcattgttcctccaaggtccccacagtctgtgttgacatgagtaccaaccgccaacagttctaccacagtgtccaggatttgtccggaggctccagacagcatgaggctccctcgaaccgccccctgaatgagttgctaaccccccagggtcccagcccccgcacccagcactgtgacccggagcacttccccttccctgccccagccaatgcccccctacagcgcatccgctccacgtccactcccaacgtccatatggtcagcaccacggcccccatggactccaacctcatccagctcactggccagagtttcagcactgatgctgccggtagtagaggaggtagtgatggaaccccccgggggagccccagcccagccagcgtgtcctcggggaggaagtccccacattccaagtcaccagcagagcagcgcgagcggaagtccttggccgatgacaagaagaaagtgaagaacctggggtaccgggactcaggctattactgggaggtaccacccagtgaggtgcagctgctgaagaggatcgggacgggctcgtttggcaccgtgtttcgagggcggtggcatggcgatgtggccgtgaaggtgctcaaggtgtcccagcccacagctgagcaggcccaggctttcaagaatgagatgcaggtgctcaggaagacgcgacatgtcaacatcttgctgtttatgggcttcatgacccggccgggatttgccatcatcacacagtggtgtgagggctccagcctctaccatcacctgcatgtggccgacacacgcttcgacatggtccagctcatcgacgtggcccggcagactgcccagggcatggactacctccatgccaagaacatcatccaccgagatctcaagtctaacaacatcttcctacatgaggggctcacggtgaagatcggtgactttggcttggccacagtgaagactcgatggagcggggcccagcccttggagcagccctcaggatctgtgctgtggatggcagctgaggtgatccgtatgcaggacccgaacccctacagcttccagtcagacgtctatgcctacggggttgtgctctacgagcttatgactggctcactgccttacagccacattggctgccgtgaccaggtgagccccacaccttacccacagttccctgggctgagggatcccctcaggcatccataccccacatcccctcctttgcactgataaatgccacactttccccagaaacctaaaattttctaggataaggactcccagaatcccttgggctccagacacttacaataaattctctgggtctcccctaccccaacttccctcttctcacatccacagccctctgggacaaaaatctttgaagtccaaaatgccccgaatctctatacctagaatcccctgaggcccccaaataccccaaagccctctgtatccctagacgcctatagtcgtctgctctgggtactcaaaatcccccagatcctcaaagcccagatctcatttctcccagcatcccatttttccccagaaacagaacccctttgtgcttctggaatagtcatggacaccca

SEQ ID NO: 365523 - DNA, 1052 bp, Homo sapiens
ggggcaccaatgggaacctcccaggcagggtgagaggcatggctattaggagtccctgtagtggtccttgaccctggcggacatcttcctacatgaggggctcacggtgaagatcggtgactttggcttggccacagtgaagactcgatggagcggggcccagcccttggagcagccctcaggatctgtgctgtggatggcagctgaggtgatccgtatgcaggacccgaacccctacagcttccagtcagacgtctatgcctacggggttgtgctctacgagcttatgactggctcactgccttacagccacattggctgccgtgaccagattatctttatggtgggccgtggctatctgtccccggacctcagcaaaatctccagcaactgccccaaggccatgcggcgcctgctgtctgactgcctcaagttccagcgggaggagcggcccctcttcccccagatcctggccacaattgagctgctgcaacggtcactccccaagattgagcggagtgcctcggaaccctccttgcaccgcacccaggccgatgagttgcctgcctgcctactcagcgcagcccgccttgtgccttaggccccgcccaagccaccagggagccaatctcagccctccacgccaaggagccttgcccaccagccaatcaatgttcgtctctgccctgatgctgcctcaggatcccccattccccaccctgggagatgagggggtccccatgtgcttttccagttcttctggaattgggggacccccgccaaagactgagccccctgtctcctccatcatttggtttcctcttggctttggggatacttctaaattttgggagctcctccatctccaatggctgggatttgtggcagggattccactcagaacctctctggaatttgtgcctgatgtgccttccactggattttggggttcccagcaccccatgtggattttggggggtcccttttgtgtctcccccgccattcaaggactcctctctttcttcaccaagaagcacagaattctgctgggc

SEQ ID NO: 365524 - DNA, 872 bp, Homo sapiens
ctggtctggcctgttgtaggcagctgaggtgatccgtatgcaggacccgaacccctacagcttccagtcagacgtctatgcctacggggttgtgctctacgagcttatgactggctcactgccttacagccacattggctgccgtgaccagattatctttatggtgggccgtggctatctgtccccggacctcagcaaaatctccagcaactgccccaaggccatgcggcgcctgctgtctgactgcctcaagttccagcgggaggagcggcccctcttcccccagatcctggccacaattgagctgctgcaacggtcactccccaagattgagcggagtgcctcggaaccctccttgcaccgcacccaggccgatgagttgcctgcctgcctactcagcgcagcccgccttgtgccttaggccccgcccaagccaccagggagccaatctcagccctccacgccaaggagccttgcccaccagccaatcaatgttcgtctctgccctgatgctgcctcaggatcccccattccccaccctgggagatgagggggtccccatgtgcttttccagttcttctggaattgggggacccccgccaaagactgagccccctgtctcctccatcatttggtttcctcttggctttggggatacttctaaattttgggagctcctccatctccaatggctgggatttgtggcagggattccactcagaacctctctggaatttgtgcctgatgtgccttccactggattttggggttcccagcaccccatgtggattttggggggtcccttttgtgtctcccccgccattcaaggactcctctctttcttcaccaagaagcacagaattctgctgggc

SEQ ID NO: 365525 - DNA, 410 bp, Homo sapiens
tgggtgacagagtgagactccgtctcaaaaataaataagcaaacaaatataatggaatccttccatgcgctcccctctggtaccatcgctcttcgtctttgtctgaaggtaaccactgttttaaagttcatacttgtcatttctgcatacgtctttatactacatacagttgactcttgaacaacatgggcttgcactgtgcaggtctgcttacatgcagattttcttttacctctgccacccctgagacaacaagaacaatccctcctcttcctcctcctcctcagcctactcagtgtgaagacgatgacgatgaagactttcatgatgatccacttctatttaataaatagtaaatatattttctcttccttatgattttcttagagtttcttttctctagcttactt

SEQ ID NO: 365526 - DNA, 280 bp, Homo sapiens
tctacttagaaaaatcccactattcaccacatgtattcatttagtgttccattttattggtcctaaaatcactgaattcaggtagagtagaaactgggtccatcctacacccatgttgctctaattatatttgagatatttactaggcaaaccatcgcatttatgcatattaggggataattctgtttagaaaggttatgtgacatatagctaaaatgacttctatgaatatgactaatagagactaatataaaatttaataaatatgtcaactataaca

SEQ ID NO: 365527 - DNA, 366 bp, Homo sapiens
atgtaatatattcacaagtgtctttatgaagtgattttgatactctttgtcttctccctggcatctccttgttctttaataatttttttccttggtttattttggtcttatttttctttttaaagcctttccttaaatatctattctatgttgcttatcatttgttgtcttttttttttttttttgagacccagtttcgctcttgttgcctaggctggagtacaatgatgtgatctcggctcaccacagcctctgcctccaaggttcaagcggttctcctgcctcagcctcccaagtagctgggattacaggcatgtgctaccacgcccagctaatttgtgtatttttagtagagatgggatttct

SEQ ID NO: 365528 - DNA, 461 bp, Homo sapiens
gacccagcctggcccccaccagcaagttcttaccagcacacgtgacttcctgtgtgagctgacccccaccccactctaccgcatctcccctgccttgcacctcagttgctctgtccagccccaccccctttacctttcctctgccacccttgtcaccatcctgccctgggacctttgcacttgctgtgttctccaccctgaacacaaacatcatcactccctcagggtctcctcttgtcctcttgctgaggcacacgctgcgggaagagcatgtcaggcagaaagaatagcccacacaaaagccctgtcttgaccaggtgtggttggtggtgcctgcctgtgatccaagccctttgggaggctgaggtgagaggatcacttgagccaggattcccaggctgcagcgagctatgattgcaacactgcactccagcctgagcaacagagcaagaccctgtctc

SEQ ID NO: 365529 - DNA, 513 bp, Homo sapiens
gaccttgttgcggttgacttgcagtggtctaagcccacctcaggtttcttcccaagactaccaacaaatcttccctcttgctgtggggaaatgagtcttccttcaacatcttcagtgaaaatatcaaggcccttcggcatgggctccgccagcatctctcgccgatgccttcactccaaatcctctcttctttcttcccttgtctctgtgtctgtagacaactggtctcttttcagggctaactctgatttgggttctcctttctccagagccttctttaatcccttaggcactgtggttttcccctcagtccattcagcatgagctctccatttcttttttttctttttcttttttttgagacggagtctcagtctgtcgctcaggctggaatgcagtggtgtgatcttggctcacctgcaacctccgcctcctgggttcaagtgattcccctgcctcagcctcccgagtagctgggactataggcaccagccaccacgctcagctaatttt

SEQ ID NO: 365530 - DNA, 260 bp, Homo sapiens
ttttattttaaatcatagcatgggggcattttttttattatatattttttcttctcctttttttcagagacagaatcttgctctgtcatccagactggagggcagtgatgttctgaacatcgctcactgcagccttcaaatcaggctcaagcaatcctcctgcctcagccttctgagtcactggaataacaggtatgtgccactgggcctggctctatattttcagtatatttaaggcatgtcgaaaaaaaattgtatag

SEQ ID NO: 365531 - DNA, 425 bp, Homo sapiens
gctgatctggtccaaacgcccacgctctcctccctctagggaagccctcgctgtctcctgcctcctgcactgtcctctttctgcctccacctaaggagaagcctgccttgaagaaaaacctccagcttcctccatggtgcagcttgaaagacctcccacttgtctgaacttttgctttttacacatcttgctcaagcggcagtgagctgggcaggcagcctgagattgaattcagcttgaggctgaagattaggttgaatccttggagtgataaaagctttagctctaccttcctcatttgtaaaaggccaattaattataatatgtgttttgccagatcgggattttttttttgggggggtgggggtgggacgaactcttgctctgttgcccaggctggagtgcagtgacgccatctcggctca

SEQ ID NO: 365532 - DNA, 2005 bp, Homo sapiens
cccagcgcagctcagctaaactcagcggagccagcgcggcgcgatggaaggtcgagtgcagctgatgaaggccctcctggctcggcccctccggcccgcggcgcgtcgctggaggaacccgattccctttcccgagacgtttgatggcgataccgaccggctcccggagttcatcgtgcagacgagctcctacatgttcgtggacgagaacacgttctccaacgacgccctgaaggtgacgttcctcatcacccgcctcacggggcccgccctgcagtgggtgatcccctacatcaagaaggagagccccctcctcagtgattaccggggcttcctggctgagatgaagcgggtctttggatgggaggaggacgaggacttctaggccgggagaccctcgggcctggggacgggtgctctgggaagggtccgctgtgttactggccgccgccagggtcgccaccggcgccctccctccgcgcctccctccccctcgagccgccacgatgtcccctgcgctcctgtcccctcccgcgtagtgcttgcctttgttccaggaatagcgctccaggctcctgctgccgcccctgggcctcactctggagcgggctgcctccgccctctcgtgacagctcagcccctcccatgcacatttggacgctgtcctgcgctccagttgcacaaagctgagctcctgttacacactgacagaccactgacagccgccgctgccaacccccctcctcctcaccagacttccagacgactacatcatgctgcccacagacctgcgctgccactgccatcgccatccatcgcattccaccgacagactgctgcttctagtgatctgtactcacctcggaggtatctgggctggacacagcccctggacaatgatccagacagctggctgcccctcaagggacctgttaccttcagcgagacccatttcctccccaatcccagagactttttgtgctcctgccacatggctgccagggctcagttgtgcctggcagccaaatcgagtctctcattttctcttgtggaccagttagttttgcccagaatccatttctcttctgaatttgcagcattttctcaggtgctttttgatcaacaaaataacttgtatcttctgcttaactcctttatactacctggagaaaagtattttccatattttcaataaatgtcagacactattgagaaagaaatagagtctgaatgaatatggcacctttccctccctggtcctgtaaatgtggtccatatcttgttcagaagcgatatcccctgccattcagtgactgatgttgactcctgcattataaaacatctaagatagagtcctgtggtaacctgggggatagtgtccccactggtgatccttctgtcccagatgttgaatcctctaaaccagttaggattatcccaagcctcttagtaaatgaatcgttacctcattttggtcaacactatgtgagaagtcagccagcaggctcttggaaaatgtatcctcatttccagaaagtggtttgaaaacacaattcccaaattgttacaaaccataaatcccacacagattattggtgaacagctgtaaaattttactcaacccatgattcagggaaccaacagaattatataggtgcttttcaaaagcatttataaattcttgattatgtaggtagtggggggaaatgcagaaatgagatcattaatttagatacaaacctggttgatgaccagggggttttattttgcagaagaattgggtatttggtatcattttattcaattacatgtgatcctggtacatttcataagcttgggtaaaaaaattttttgttattttccatgcacaataagggaaatgttttaattggctttgtgcctcctgctttacaacagttctggcctcaagttaccaggtagcctgaactttgattttattttaccattaaattgctttaataccattgtatttggtgaagtttta

SEQ ID NO: 365533 - DNA, 160 bp, Homo sapiens
cggggaatcgtgtgccaggcactgttcctacctttaaactttataccaccctatgaatagtagatactattatcaatcttattttaagatgagaaaactgaggctcagaaaggttaaataactttccaagattacacagcaaggtcaaggactgatagct

SEQ ID NO: 365534 - DNA, 308 bp, Homo sapiens
ggattggagtcattgagtctctccttaaaggaaataattgacagaattgtctggttagccctttactggctaaagatcttcccttaggaagagggctgttttaggattgagaaaagtggccaggcacagtggctcatgcctgtaatcccagcaccctgggaggccaaggtgggagggtcacttgtgcccaggagttctagaccagcctgggaaacagcaagaccctgtatctaccaaaaaaataaaagtgacctttagtcactcactttgggaggccaaggtgggtggatcacttgagtttgagacca

SEQ ID NO: 365535 - DNA, 511 bp, Homo sapiens
tgaaaatgggtagtagaagtatgatgatattatttcgtggtaatgaatttacctttatgacagatcattatccccttctgtagctgaactggatgaaggacaagtctagcagaataacctggtagtacttggatttattggctttaaatttttaagctggaaaaatgcagtagcagccaggttatctctgtatgaatgttgcagaggaggacagagatgaaggaagtcacattttctttctagtaatggtagaaagcaggtgatgatgacagtcttttaacgaaacatgaatgcagttgctcatatgctttgccattttagtgcacaagtcaaggagtaaatgagtagaaaaaaatccataagatatcatcatcatcaataataaaaaattgcttaaggtctcattgagtgttacaccataggaaagagcaaagatttctttttaaaatgagttagacgagacttccctctcaggtgtgtataatccaggttcatgctttaaaggctatat

SEQ ID NO: 365536 - DNA, 561 bp, Homo sapiens
taccaagtaactggttcttgaccatcattaatactagcgtctcatttcctgtgggtggcgtgggctctggtggtgtgcttaggaaccagtcattcatatagaactgaagaaaatctgttctgaattctaagacagattttccaacaaacttttggatcaataccaagttttaagttgtcagttccctataaagccctaggggtgcctagcttagctaaagggaaagaattcaaggtttctgtgggtgaagtaagacagggaacttcaggggaactccagaaagaatttcctgggaaataaaattgcatcacggctcacctgcctgagctgcttagagtgttcatgcttctactaaagaagccttcttctctctgcagccccacattttaaatacgaacagtataataacaaactccaccaagaagagctgatcattcaccacacaatgtgatttctaattgcttgaataataccgtatgatggaataatttcctacccagtaaaaatgatttctttttttttcagagtgataatatcctgttaaaatataatgccattcta

SEQ ID NO: 365537 - DNA, 985 bp, Homo sapiens
acccagaagaatgtagaactttcataacagaaagaaaagattttaggcatctattttaccatctcagaggaagatagctgcagttgtgtaaaacagtgaaggaagactttgaaagagcagaatcgtgaggaatgatgccagtgccatttgctgaaaatgaaagcaggaacttggaccagaagttttagaatcctgaatttatcaaagaaatgtgaaggctgaggcttacagagatcgaagagtagaggatgcattgaggccacagttgaaggaaagaagcctggatttccactgaatttgggctaaatttccactattcttcttcctcttccttaagattctgctcattgggttacccaccaacccaggaaacagacttatctccttatcctcaagttgctgaaggcaggaagaatgagcaaggttttgctcaaggaagagctattgtaacaaaataattgtaattagtctgatagtgcagggaaagaaactccatttcttctgaggaattcggggcattatttgcatttgaaaaagcaatctcattagagcagtatgttatattataagacattttgcagaaaaatgtttgagaagaaccatagcagtctcttgcatgtgcatgtgtgcccacacacagacacacacacactctgaattttccacttaaaagtacatatacttcaattaaaaagcaatttgaaaagtaatataaattgatcaggggatgttcctaaatttaaagagggaaagacttgtagaggtttaaaaataaaaggacttggggttggaggaacaggcattagggaaagctatatggcaaggttaaaagaattgtggaattaatgctatttaaaaataattgcattagaaatctagctaatgggaattagtccatttcattgacttagatagttataaaattaattcctttttgtgggaattttaattgggtggctacaaccagatgcacatgaggaatccc

SEQ ID NO: 365538 - DNA, 750 bp, Homo sapiens
acccagaagaatgtagaactttcataacagaaagaaaagattttaggcatctattttaccatctcagaggaagatagctgcagttgtgtaaaacagatttatttattcaaaaatcaactatttatggaatacctactttgtcttgagccctgatgtgagagctggagatcccaagatgaataagacaccgtcgctactctcaaggaactcacagcccagtgaaagacacagagaagaaactagacagttgtagttgtatcagacacctgtagttgccatctacctttccagaaattgtcctttcccacctacacagtcacaaaaggcaatatgattctaccctcactttcccaagatgattggtccctcaggaagcagttgactcatgagtattctacattgttattgaagtgatgattcttctgaccagtgaagcagggtcatatttcctgcatttagaattttatttggttcccagcaagacaatagcagttagagtgaataactcagtaatgggagcactgattgaaaaagaaagatgagaagaacctctgggacttgaacaagatttaatctctattgttctcaaagaaaactggtctgcataaaagagctcaaactgaattgttctaaactggaggggaaggggacttctaaacagcctattatttgagattatccagattatataacttaattccagatacttaggaatcattttattttcaataaattctatcttttcatctt

SEQ ID NO: 365539 - DNA, 847 bp, Homo sapiens
cccatctccagaatttctgattccgggaagcctgggatggggcctgagaacttctcacaagtttccaggtgatggtgatgttgtggtcccagagctacacttggagaatcactcctttatgctaaactttaaggaatacccaaaagctgctctagaactgaccttacaggaaacttgcctctggtgctgctggcctatagaaattcactttaatgctgttgtctctgctgcttggactgataccatttctgattcaggagctagacctataccactgggacacgactaaaagtcttacagcaatgagaatggaacctcgtttctttacactgctctattctgaattgaagttgcatttgagtgtgtttgattggaggaggctgggtcacatgcctgcattctggttttaagggagattggggatttgtatttgacttctattttgggaagctgaaactcataaaatggaaatttctttaaatgtaagaagactatgcaaaggattgatagacagccatggatatggcagttgtcaactatagcagtactactgaaagtaacctgtccacaaactgtttttaatggtcttctagggcacaaggaacctgaaccagaatataaatccatgtactgctttcttcattgaaaaatgtcagtagaactaagcaatgtgcttagtgtcttagtttattttacgttgtggcacaaactccttatctcattcttagaccagtaacagtctgcataccaaacttagagtaataaatcaatatcaacctccaccaagatttcaggtgatataccaagggtctcttaggcctaaccaataactttgtttaaaaaaaaa

SEQ ID NO: 365540 - DNA, 823 bp, Homo sapiens
ggagttgctgataaagctcctaaggtgaaaacaaaatgtcacattcctctgctttctaaagggtgtcacagagactggacacatggtcccataggactcactagatgtgagagtcacagagccacttgatccttggcccctatagatataaaaaccatgtaaggaggttctgatccagaggagatgggcctcatgctcctgggatgaagcccctaccctgcccctacaggggtgggggacttgggcaccaaggaatgagatattggggagatctgaaagcatgggagcttggcatctccatctccagcaaaaccacaggcccacttcacagctgtcacctggagttcttgggagaacttaatgtttgttccttaaaatgtgttccctgtagtgtggaggtggaaagtggtaaaggatcgaacagagaggggtgcccccaactgtctggagatttcagaagggagggggctgctgctggattagtccctagcagcagagtggagatctctaagggtctgcatttgtgttatccctgggaaggaaaggataggaccactccatctgttttccttgacatcagagatcacaagtcaggatttcagtggttcctggatagggtgtccttataattgattgtccaaacagggaccctgagaatgaaggggaagctaatcagatgggaagctcagattgtgctctaaaacccagatgtatgttcaccctgtacctggagctcctgggaaggaggacaagtgggcaggagccataaggctgtgtcaatggctgctctgccaaactcaccttgagactggttagaggcaag

SEQ ID NO: 365541 - DNA, 294 bp, Homo sapiens
agagataaggtctcactatgttgcctaggttggtctcgaactcctggcctcaaacagtcttcctgccgcagcctcccaaagtgttgggattacaggcatgagccaccatacccggccagtgtcttattaatattagagtgctagatctgacgatacaggcctgaaggtaggagagaaggaggaaggtggcagagggatgatcttctgatggggaatctccagagctgaggtcacaaatggggagactgagtcccactggcagataggtcatgtgcagacatgctgctgttttgt

SEQ ID NO: 365542 - DNA, 401 bp, Homo sapiens
gttaccatggatggaagggagccagatgctattcatcaagacaatgagaaaaagtcccccaaagtatttcagagatctttgaggctgcccctcttgtcacagacccagagctatagggggaccagcccaggatgccttccatgggcttgctgcaaagagacacttgggtctcttcttcccacatttcaggacagtgctcctcagccaccccagttgctgtggcccaagtgaccgcaggtgtggctcaatctgcagcttcagaagatacaagctgtaaacattagtggtatccatatgctgctaattctaaaggcatacagagtgcaagagctgtgagggcatgacttcctcctcctagatttgaaaggatgtctcagacagcctggagatccaggcagaga

SEQ ID NO: 365543 - DNA, 469 bp, Homo sapiens
ttggatgttttgacgggttattgcaatcttttctgaaattgaatttcagtttgcttcaatagcatttcccagtaaataggagtgactctggtatctcgtttgtgaatcttgatgtaataatcggaggtaattgaagcgtgcacaaaccacagagacttatgacatgtttttaaacaaggattgactgatacgaaactaattgaacaaaagctggaaatcagattcctccaagaaaccttgcacagaatacagggtctttcataatggcactgagtttgactttaaaagtggcgtgttcaagtttccttattttcctgaaggagtttaggagtaagttactgacaggcaaggttgtgacccaatgaccagagttaatcatctggcgactggaattaatcttttgtctgtcctgtggtttggattaaccagggtcggtcatcccctcatgccttggtggcccctatgaatt

SEQ ID NO: 365544 - DNA, 2283 bp, Homo sapiens
ctctccgcccccaccccctgtcggcgtctgggcctcgtccccttctctctgtctcccttgcctcccccatcacgtcccctgacaccgacaccccattgctcccacagtctccccagtctccactttggtccccagcgctgtctgcccgaggatttgcctgaaggctgcccccaactctgcacccgccccccgagggccaccgaggaccatgactaagacagatcctgccccgatggccccgccaccccgaggagaggaggaagaagaggaggaggaggatgaacccgtccccgaggcccccagccccacccaggagcgccggcagaagcctgttgtgcacccctcggcacctgcccccctccctaaggactacgctttcaccttcttcgatcccaatgacccggcgtgccaggagatcctgtttgaccctcagaccaccatccccgagctgtttgccattgtgcgccagtgggtgccccaagtccagcacaagatagacgtcatcggcaatgagattctgcgccgaggctgccatgtgaacgatcgtgacgggctgaccgacatgacactgctccactatgcgtgcaaagctggggcccacggagtcggggaccccgcggcagccgtgcgcctctcgcagcagctgctggcgctgggcgcagatgtgacgctgcgcagccgctggaccaacatgaacgcgcttcactacgcggcctattttgatgtgcccgacctcgtgcgtgtgctgctgaagggtgcgaggccgcgagtggtgaactccacgtgcagtgacttcaaccacggctcagccctgcacatcgctgcttccagcctgtgcctgggcgccgccaaatgtttgctggagcacggcgccaaccctgcgctgaggaatcgaaaaggacaggtgccggcggaggtggtcccagatcctatggacatgtccctggacaaggcagaggcggcactggtggccaaggagctgcggacgcttctggaagaggcagtgccactatcttgcgccctccccaaggtcacgctacccaactatgacaacgtcccaggcaatctcatgcttagcgcactgggcttgcgcctgggagaccgcgtgctgctggatggccagaagacgggcacactgcggttctgtgggaccacggagtttgccagcggccagtgggtgggcgtggagctggacgaacctgagggcaagaacgatggcagcgttgggggcgttcggtacttcatctgccctcccaagcagggtctctttgcctccgtgtccaagatctccaaggcagtggacgcacccccctcctctgtcacctccacaccccggaccccccggatggacttctcccgtgtcaccggcaaaggccgcagggaacacaaaggcaagaagaagaccccatcatccccatctctgggcagcttgcagcagcgtgacggggccaaggctgaggttggagaccaggtccttgtcgcgggccagaagcaggggatcgtgcgcttctacgggaagacagactttgccccaggttactggtatggcattgagctggaccagcccacaggcaagcatgatggctctgtcttcggtgtccggtacttcacttgccccccgaggcatggggtcttcgcaccagcatcccgtattcagaggattggcggatccactgattcccccggggacagcgttggagccaaaaaagtgcatcaagtgacaatgacgcagcccaaacgcaccttcaccacagtccggaccccaaaggacattgcatcagagaactccatttccaggttgctgttctgctgctggttcccctggatgctgagggcggagatgcagtcttagaggccctggacacctgacaaagagacagagtccccactagcatctcctgacacccgaggagccctgagtcaccctgagatagagattcccagtaacacatccagagtagagacccctgttagccagccctcgatcattgaggccccattattaacagatactcccataataacccccaaatacagaccccatgtcacccagaaagagattccctgagtagcaccttcaggctagtccctatccccaacccctcagagcagattcccagattaacagatttccatatcaccccaaatgatggtgaccctctccacataatgcattacaacagaacattcttgaatcacccaaccctggatcagaaacctccccattaacaaacactgccccttaagtcctcttgaaataaacataggtcacacccccaaagc

SEQ ID NO: 365545 - DNA, 3447 bp, Homo sapiens
ctctccgcccccaccccctgtcggcgtctgggcctcgtccccttctctctgtctcccttgcctcccccatcacgtcccctgacaccgacaccccattgctcccacagtctccccagtctccactttggtccccagcgctgtctgcccgagatccagttgcgcggaggccacccggggccctggaagctcctaggggcttggaccctggagcctgccgggcaccctctccagctgacctctgcctccaggatttgcctgaaggctgcccccaactctgcacccgccccccgagggccaccgaggaccatgactaagacagatcctgccccgatggccccgccaccccgaggagaggaggaagaagaggaggaggaggatgaacccgtccccgaggcccccagccccacccaggagcgccggcagaagcctgttgtgcacccctcggcacctgcccccctccctaaggactacgctttcaccttcttcgatcccaatgacccggcgtgccaggagatcctgtttgaccctcagaccaccatccccgagctgtttgccattgtgcgccagtgggtgccccaagtccagcacaagatagacgtcatcggcaatgagattctgcgccgaggctgccatgtgaacgatcgtgacgggctgaccgacatgacactgctccactatgcgtgcaaagctggggcccacggagtcggggaccccgcggcagccgtgcgcctctcgcagcagctgctggcgctgggcgcagatgtgacgctgcgcagccgctggaccaacatgaacgcgcttcactacgcggcctattttgatgtgcccgacctcgtgcgtgtgctgctgaagggtgcgaggccgcgagtggtgaactccacgtgcagtgacttcaaccacggctcagccctgcacatcgctgcttccagcctgtgcctgggcgccgccaaatgtttgctggagcacggcgccaaccctgcgctgaggaatcgaaaaggacaggtgccggcggaggtggtcccagatcctatggacatgtccctggacaaggcagaggcggcactggtggccaaggagctgcggacgcttctggaagaggcagtgccactatcttgcgccctccccaaggtcacgctacccaactatgacaacgtcccaggcaatctcatgcttagcgcactgggcttgcgcctgggagaccgcgtgctgctggatggccagaagacgggcacactgcggttctgtgggaccacggagtttgccagcggccagtgggtgggcgtggagctggacgaacctgagggcaagaacgatggcagcgttgggggcgttcggtacttcatctgccctcccaagcagggtctctttgcctccgtgtccaagatctccaaggcagtggacgcacccccctcctctgtcacctccacaccccggaccccccggatggacttctcccgtgtcaccggcaaaggccgcagggaacacaaaggcaagaagaagaccccatcatccccatctctgggcagcttgcagcagcgtgacggggccaaggctgaggttggagaccaggtccttgtcgcgggccagaagcaggggatcgtgcgcttctacgggaagacagactttgccccaggttactggtatggcattgagctggaccagcccacaggcaagcatgatggctctgtcttcggtgtccggtacttcacttgccccccgaggcatggggtcttcgcaccagcatcccgtattcagaggattggcggatccactgattcccccggggacagcgttggagccaaaaaagtgcatcaagtgacaatgacgcagcccaaacgcaccttcaccacagtccggaccccaaaggacattgcatcagagaactccatttccaggttgctgttctgctgctggttcccctggatgctgagggcggagatgcagtcttagaggccctggacacctgacaaagagacagagtccccactagcatctcctgacacccgaggagccctgagtcaccctgagatagagattcccagtaacacatccagagtagagacccctgttagccagccctcgatcattgaggccccattattaacagatactcccataataacccccaaatacagaccccatgtcacccagaaagagattccctgagtagcaccttcaggctagtccctatccccaacccctcagagcagattcccagattaacagatttccatatcaccccaaatgatggtgaccctctccacataatgcattacaacagaacattcttgaatcacccaaccctggatcagaaacctccccattaacaaacactgccccttaagtcctcttgaaataaacataggtcacacccccaaagcaaaagagtaacagacattcatgtcattgttccccatttaacatcagtcctctcaagatgtcgtgaccccatggtcaccctgaagcccttagattccaacccctcaatcagagacttccttcattaacaaagacccttgttcttatccctcaagaagaaacccaccataaccagcccactgtcacccctaatttacagacaccaaaacagtcctggaagtgctaattacaggaccccccaagtcttcctaccctctgcaccctcaagaaacccccagtgccttgtatgaagcccaccccacatggcccacagctcctgtgctggccagactcccagaaaattctctattttttaagtaacgacttccccctttgggggaccccaaaatttggaggccccattctaggactctggggatcccaaaccctagagtacacacgtcccaaactcccctgtgccctcaagtcctacagcccctagaagaccccaatgccgtaactcctaggacccccaaatcatggaatcccaaatccccagggaatcccaaatttgaaaatccaatcccaagtccccaggaaacccaatcatgaggtccttgtgcctggtatggaggagactgcagtcaggatatgcattccaggctcccagacacctcaagccctattcacaggcaccaggaaaccccacacaggaattcccatccctggaaactggagaatttcaatgccccgagtccatgggtttcaagacaccaaattccaagagccccagccctaagggaaccccaaatcctaaagcctccatctctaataaatggaaggccccaaggccctgaggggatctcaaatcctggaaccccgatttcaatctacgttctagtcactggcctcaaaggaccccacagcacctgggccagaccaacagctcgagggagaacctgaaggcccagggggtccagggcggacctggggccccgaccaccaaggacagctcacgactgccccttcactgcatgtccccaaactcagcatgactcctgtcctcttcaataaagacgtttctatggc

SEQ ID NO: 365546 - DNA, 3475 bp, Homo sapiens
ccttcttgttgtcgttgttcggtggggtggtgttcggtgtgtctgtctgttgttgtcttgttgtggggtagttacaagaaccaggacttctggctttatttatttttgctctggagattcagccaaacttcactcatactctcacagggcaacagtgggtgaggtcagtagcagtccccctggacatgcagactccaaggtactgcactctctgtcaggcttttgtttcagggggtggagtttgctgctatatgggaattgcctgatcttccaacttttcaagacacactgggcatcgagatttttatgtgaacccacctgagtttgaaacctcatgctggccacacagaaaatgcctgtgggttgactgtggcccatgtgccaccagcttgagaccctgcattagaggctctaaaaggcaaagacctacagctcccctactgaggctggaaggagggggtcagttgcgtggggtgaccttggacctcttgccaccccagctttcaccttcttcgatcccaatgacccggcgtgccaggagatcctgtttgaccctcagaccaccatccccgagctgtttgccattgtgcgccagtgggtgccccaagtccagcacaagatagacgtcatcggcaatgagattctgcgccgaggctgccatgtgaacgatcgtgacgggctgaccgacatgacactgctccactatgcgtgcaaagctggggcccacggagtcggggaccccgcggcagccgtgcgcctctcgcagcagctgctggcgctgggcgcagatgtgacgctgcgcagccgctggaccaacatgaacgcgcttcactacgcggcctattttgatgtgcccgacctcgtgcgtgtgctgctgaagggtgcgaggccgcgagtggtgaactccacgtgcagtgacttcaaccacggctcagccctgcacatcgctgcttccagcctgtgcctgggcgccgccaaatgtttgctggagcacggcgccaaccctgcgctgaggaatcgaaaaggacaggtgccggcggaggtggtcccagatcctatggacatgtccctggacaaggcagaggcggcactggtggccaaggagctgcggacgcttctggaagaggcagtgccactatcttgcgccctccccaaggtcacgctacccaactatgacaacgtcccaggcaatctcatgcttagcgcactgggcttgcgcctgggagaccgcgtgctgctggatggccagaagacgggcacactgcggttctgtgggaccacggagtttgccagcggccagtgggtgggcgtggagctggacgaacctgagggcaagaacgatggcagcgttgggggcgttcggtacttcatctgccctcccaagcagggtctctttgcctccgtgtccaagatctccaaggcagtggacgcacccccctcctctgtcacctccacaccccggaccccccggatggacttctcccgtgtcaccggcaaaggccgcagggaacacaaaggcaagaagaagaccccatcatccccatctctgggcagcttgcagcagcgtgacggggccaaggctgaggttggagaccaggtccttgtcgcgggccagaagcaggggatcgtgcgcttctacgggaagacagactttgccccaggttactggtatggcattgagctggaccagcccacaggcaagcatgatggctctgtcttcggtgtccggtacttcacttgccccccgaggcatggggtcttcgcaccagcatcccgtattcagaggattggcggatccactgattcccccggggacagcgttggagccaaaaaagtgcatcaagtgacaatgacgcagcccaaacgcaccttcaccacagtccggaccccaaaggacattgcatcagagaactccatttccaggttgctgttctgctgctggttcccctggatgctgagggcggagatgcagtcttagaggccctggacacctgacaaagagacagagtccccactagcatctcctgacacccgaggagccctgagtcaccctgagatagagattcccagtaacacatccagagtagagacccctgttagccagccctcgatcattgaggccccattattaacagatactcccataataacccccaaatacagaccccatgtcacccagaaagagattccctgagtagcaccttcaggctagtccctatccccaacccctcagagcagattcccagattaacagatttccatatcaccccaaatgatggtgaccctctccacataatgcattacaacagaacattcttgaatcacccaaccctggatcagaaacctccccattaacaaacactgccccttaagtcctcttgaaataaacataggtcacacccccaaagcaaaagagtaacagacattcatgtcattgttccccatttaacatcagtcctctcaagatgtcgtgaccccatggtcaccctgaagcccttagattccaacccctcaatcagagacttccttcattaacaaagacccttgttcttatccctcaagaagaaacccaccataaccagcccactgtcacccctaatttacagacaccaaaacagtcctggaagtgctaattacaggaccccccaagtcttcctaccctctgcaccctcaagaaacccccagtgccttgtatgaagcccaccccacatggcccacagctcctgtgctggccagactcccagaaaattctctattttttaagtaacgacttccccctttgggggaccccaaaatttggaggccccattctaggactctggggatcccaaaccctagagtacacacgtcccaaactcccctgtgccctcaagtcctacagcccctagaagaccccaatgccgtaactcctaggacccccaaatcatggaatcccaaatccccagggaatcccaaatttgaaaatccaatcccaagtccccaggaaacccaatcatgaggtccttgtgcctggtatggaggagactgcagtcaggatatgcattccaggctcccagacacctcaagccctattcacaggcaccaggaaaccccacacaggaattcccatccctggaaactggagaatttcaatgccccgagtccatgggtttcaagacaccaaattccaagagccccagccctaagggaaccccaaatcctaaagcctccatctctaataaatggaaggccccaaggccctgaggggatctcaaatcctggaaccccgatttcaatctacgttctagtcactggcctcaaaggaccccacagcacctgggccagaccaacagctcgagggagaacctgaaggcccagggggtccagggcggacctggggccccgaccaccaaggacagctcacgactgccccttcactgcatgtccccaaactcagcatgactcctgtcctcttcaataaagacgtttctatggc

SEQ ID NO: 365547 - DNA, 1479 bp, Homo sapiens
  misc_feature (34)..(34): n is a, c, g, or t
  misc_feature (37)..(37): n is a, c, g, or t
  misc_feature (59)..(59): n is a, c, g, or t
gccccagtgtctagaatggggctccaactttggnggncattctaggactctggggatcncaaaccctagagtacacacgtcccaaactcccctgtgccctcaagtcctacagcccctagaagacccaatgccgtaacagatactcccataataacccccaaatacagaccccatgtcacccagaaagagattccctgagtagcaccttcaggctagtccctatccccaacccctcagagcagattcccagattaacagatttccatatcaccccaaatgatggtgaccctctccacataatgcattacaacagaacattcttgaatcacccaaccctggatcagaaacctccccattaacaaacactgccccttaagtcctcttgaaataaacataggtcacacccccaaagcaaaagagtaacagacattcatgtcattgttccccatttaacatcagtcctctcaagatgtcgtgaccccatggtcaccctgaagcccttagattccaacccctcaatcagagacttccttcattaacaaagacccttgttcttatccctcaagaagaaacccaccataaccagcccactgtcacccctaatttacagacaccaaaacagtcctggaagtgctaattacaggaccccccaagtcttcctaccctctgcaccctcaagaaacccccagtgccttgtatgaagcccaccccacatggcccacagctcctgtgctggccagactcccagaaaattctctattttttaagtaacgacttccccctttgggggaccccaaaatttggaggccccattctaggactctggggatcccaaaccctagagtacacacgtcccaaactcccctgtgccctcaagtcctacagcccctagaagaccccaatgccgtaactcctaggacccccaaatcatggaatcccaaatccccagggaatcccaaatttgaaaatccaatcccaagtccccaggaaacccaatcatgaggtccttgtgcctggtatggaggagactgcagtcaggatatgcattccaggctcccagacacctcaagccctattcacaggcaccaggaaaccccacacaggaattcccatccctggaaactggagaatttcaatgccccgagtccatgggtttcaagacaccaaattccaagagccccagccctaagggaaccccaaatcctaaagcctccatctctaataaatggaaggccccaaggccctgaggggatctcaaatcctggaaccccgatttcaatctacgttctagtcactggcctcaaaggaccccacagcacctgggccagaccaacagctcgagggagaacctgaaggcccagggggtccagggcggacctggggccccgaccaccaaggacagctcacgactgccccttcactgcatgtccccaaactcagcatgactcctgtcctcttcaataaagacgtttctatggc

SEQ ID NO: 365548 - DNA, 2323 bp, Homo sapiens
ctctccgcccccaccccctgtcggcgtctgggcctcgtccccttctctctgtctcccttgcctcccccatcacgtcccctgacaccgacaccccattgctcccacagtctccccagtctccactttggtccccagcgctgtctgcccgaggatttgcctgaaggctgcccccaactctgcacccgccccccgagggccaccgaggaccatgactaagacagatcctgccccgatggccccgccaccccgaggagaggaggaagaagaggaggaggaggatgaacccgtccccgaggcccccagccccacccaggagcgccggcagaagcctgttgtgcacccctcggcacctgcccccctccctaaggactacgctttcaccttcttcgatcccaatgacccggcgtgccaggagatcctgtttgaccctcagaccaccatccccgagctgtttgccattgtgcgccagtgggtgccccaagtccagcacaagatagacgtcatcggcaatgagattctgcgccgaggctgccatgtgaacgatcgtgacgggctgaccgacatgacactgctccactatgcgtgcaaagctggggcccacggagtcggggaccccgcggcagccgtgcgcctctcgcagcagctgctggcgctgggcgcagatgtgacgctgcgcagccgctggaccaacatgaacgcgcttcactacgcggcctattttgatgtgcccgacctcgtgcgtgtgctgctgaagggtgcgaggccgcgagtggtgaactccacgtgcagtgacttcaaccacggctcagccctgcacatcgctgcttccagcctgtgcctgggcgccgccaaatgtttgctggagcacggcgccaaccctgcgctgaggaatcgaaaaggacaggtgccggcggaggtggtcccagatcctatggacatgtccctggacaaggcagaggcggcactggtggccaaggagctgcggacgcttctggaagaggcagtgccactatcttgcgccctccccaaggtcacgctacccaactatgacaacgtcccaggcaatctcatgcttagcgcactgggcttgcgcctgggagaccgcgtgctgctggatggccagaagacgggcacactgcggttctgtgggaccacggagtttgccagcggccagtgggtgggcgtggagctggacgaacctgagggcaagaacgatggcagcgttgggggcgttcggtacttcatctgccctcccaagcagggtctctttgcctccgtgtccaagatctccaaggcagtggacgcacccccctcctctgtcacctccacaccccggaccccccggatggacttctcccgtgtcaccggcaaaggccgcagggaacacaaaggcaagaagaagaccccatcatccccatctctgggcagcttgcagcagcgtgacggggccaaggctgaggttggagaccaggtccttgtcgcgggccagaagcaggggatcgtgcgcttctacgggaagacagactttgccccaggttactggtatggcattgagctggaccagcccacaggcaagcatgatggctctgtcttcggtgtccggtacttcacttgccccccgaggcatggggtcttcgcaccagcatcccgtattcagaggattggcggatccactgattcccccggggacagcgttggagccaaaaaagtgcatcaagtgacaatgacgcagcccaaacgcaccttcaccacagtccggaccccaaaggacattgcatcagagaactccatttccaggttgctgttctgctgctggttcccctggatgctgagggcggagatgcagtcttagaggccctggacacctgacaaagagacagagtccccactagcatctcctgacacccgaggagccctgagtcaccctgagatagagattcccagtaacacatccagagtagagacccctgttagccagccctcgatcattgaggccccattattaacagatactcccataataacccccaaatacagaccccatgtcacccagaaagagattccctgagtagcaccttcaggctagtccctatccccaacccctcagagcagattcccagattaacagatttccatatcaccccaaatgatggtgaccctctccacataatgcattacaacagaacattcttgaatcacgttgacagctttctcttgaagatgtagcttcattgctctttaaagtgtcaactccaaattctataactagataaagtcattcttgagaaaagaagacttattcagataaaagaaagcttcaaac

SEQ ID NO: 365549 - DNA, 3349 bp, Homo sapiens
ctctccgcccccaccccctgtcggcgtctgggcctcgtccccttctctctgtctcccttgcctcccccatcacgtcccctgacaccgacaccccattgctcccacagtctccccagtctccactttggtccccagcgctgtctgcccgaggatttgcctgaaggctgcccccaactctgcacccgccccccgagggccaccgaggaccatgactaagacagatcctgccccgatggccccgccaccccgaggagaggaggaagaagaggaggaggaggatgaacccgtccccgaggcccccagccccacccaggagcgccggcagaagcctgttgtgcacccctcggcacctgcccccctccctaaggactacgctttcaccttcttcgatcccaatgacccggcgtgccaggagatcctgtttgaccctcagaccaccatccccgagctgtttgccattgtgcgccagtgggtgccccaagtccagcacaagatagacgtcatcggcaatgagattctgcgccgaggctgccatgtgaacgatcgtgacgggctgaccgacatgacactgctccactatgcgtgcaaagctggggcccacggagtcggggaccccgcggcagccgtgcgcctctcgcagcagctgctggcgctgggcgcagatgtgacgctgcgcagccgctggaccaacatgaacgcgcttcactacgcggcctattttgatgtgcccgacctcgtgcgtgtgctgctgaagggtgcgaggccgcgagtggtgaactccacgtgcagtgacttcaaccacggctcagccctgcacatcgctgcttccagcctgtgcctgggcgccgccaaatgtttgctggagcacggcgccaaccctgcgctgaggaatcgaaaaggacaggtgccggcggaggtggtcccagatcctatggacatgtccctggacaaggcagaggcggcactggtggccaaggagctgcggacgcttctggaagaggcagtgccactatcttgcgccctccccaaggtcacgctacccaactatgacaacgtcccaggcaatctcatgcttagcgcactgggcttgcgcctgggagaccgcgtgctgctggatggccagaagacgggcacactgcggttctgtgggaccacggagtttgccagcggccagtgggtgggcgtggagctggacgaacctgagggcaagaacgatggcagcgttgggggcgttcggtacttcatctgccctcccaagcagggtctctttgcctccgtgtccaagatctccaaggcagtggacgcacccccctcctctgtcacctccacaccccggaccccccggatggacttctcccgtgtcaccggcaaaggccgcagggaacacaaaggcaagaagaagaccccatcatccccatctctgggcagcttgcagcagcgtgacggggccaaggctgaggttggagaccaggtccttgtcgcgggccagaagcaggggatcgtgcgcttctacgggaagacagactttgccccaggttactggtatggcattgagctggaccagcccacaggcaagcatgatggctctgtcttcggtgtccggtacttcacttgccccccgaggcatggggtcttcgcaccagcatcccgtattcagaggattggcggatccactgattcccccggggacagcgttggagccaaaaaagtgcatcaagtgacaatgacgcagcccaaacgcaccttcaccacagtccggaccccaaaggacattgcatcagagaactccatttccaggttgctgttctgctgctggttcccctggatgctgagggcggagatgcagtcttagaggccctggacacctgacaaagagacagagtccccactagcatctcctgacacccgaggagccctgagtcaccctgagatagagattcccagtaacacatccagagtagagacccctgttagccagccctcgatcattgaggccccattattaacagatactcccataataacccccaaatacagaccccatgtcacccagaaagagattccctgagtagcaccttcaggctagtccctatccccaacccctcagagcagattcccagattaacagatttccatatcaccccaaatgatggtgaccctctccacataatgcattacaacagaacattcttgaatcacccaaccctggatcagaaacctccccattaacaaacactgccccttaagtcctcttgaaataaacataggtcacacccccaaagcaaaagagtaacagacattcatgtcattgttccccatttaacatcagtcctctcaagatgtcgtgaccccatggtcaccctgaagcccttagattccaacccctcaatcagagacttccttcattaacaaagacccttgttcttatccctcaagaagaaacccaccataaccagcccactgtcacccctaatttacagacaccaaaacagtcctggaagtgctaattacaggaccccccaagtcttcctaccctctgcaccctcaagaaacccccagtgccttgtatgaagcccaccccacatggcccacagctcctgtgctggccagactcccagaaaattctctattttttaagtaacgacttccccctttgggggaccccaaaatttggaggccccattctaggactctggggatcccaaaccctagagtacacacgtcccaaactcccctgtgccctcaagtcctacagcccctagaagaccccaatgccgtaactcctaggacccccaaatcatggaatcccaaatccccagggaatcccaaatttgaaaatccaatcccaagtccccaggaaacccaatcatgaggtccttgtgcctggtatggaggagactgcagtcaggatatgcattccaggctcccagacacctcaagccctattcacaggcaccaggaaaccccacacaggaattcccatccctggaaactggagaatttcaatgccccgagtccatgggtttcaagacaccaaattccaagagccccagccctaagggaaccccaaatcctaaagcctccatctctaataaatggaaggccccaaggccctgaggggatctcaaatcctggaaccccgatttcaatctacgttctagtcactggcctcaaaggaccccacagcacctgggccagaccaacagctcgagggagaacctgaaggcccagggggtccagggcggacctggggccccgaccaccaaggacagctcacgactgccccttcactgcatgtccccaaactcagcatgactcctgtcctcttcaataaagacgtttctatggc

SEQ ID NO: 365550 - DNA, 3753 bp, Homo sapiens
ctctccgcccccaccccctgtcggcgtctgggcctcgtccccttctctctgtctcccttgcctcccccatcacgtcccctgacaccgacaccccattgctcccacagtctccccagtctccactttggtccccagcgctgtctgcccgaggatttgcctgaaggctgcccccaactctgcacccgccccccgagggccaccgaggaccatgactaagacagatcctgccccgatggccccgccaccccgaggagaggaggaagaagaggaggaggaggatgaacccgtccccgaggcccccagccccacccaggagcgccggcagaagcctgttgtgcacccctcggcacctgcccccctccctaaggactacgctttcaccttcttcgatcccaatgacccggcgtgccaggagatcctgtttgaccctcagaccaccatccccgagctgtttgccattgtgcgccagtgggtgccccaagtccagcacaagatagacgtcatcggcaatgagattctgcgccgaggctgccatgtgaacgatcgtgacgggctgaccgacatgacactgctccactatgcgtgcaaagctggggcccacggagtcggggaccccgcggcagccgtgcgcctctcgcagcagctgctggcgctgggcgcagatgtgacgctgcgcagccgctggaccaacatgaacgcgcttcactacgcggcctattttgatgtgcccgacctcgtgcgtgtgctgctgaagggtgcgaggccgcgagtggtgaactccacgtgcagtgacttcaaccacggctcagccctgcacatcgctgcttccagcctgtgcctgggcgccgccaaatgtttgctggagcacggcgccaaccctgcgctgaggaatcgaaaaggacaggtgccggcggaggtggtcccagatcctatggacatgtccctggacaaggcagaggcggcactggtggccaaggagctgcggacgcttctggaagaggcagtgccactatcttgcgccctccccaaggtcacgctacccaactatgacaacgtcccaggcaatctcatgcttagcgcactgggcttgcgcctgggagaccgcgtgctgctggatggccagaagacgggcacactgcggttctgtgggaccacggagtttgccagcggccagtgggtgggcgtggagctggacgaacctgagggcaagaacgatggcagcgttgggggcgttcggtacttcatctgccctcccaagcagggtctctttgcctccgtgtccaagatctccaaggcagtggacgcacccccctcctctgtcacctccacaccccggaccccccggatggacttctcccgtgtcaccggcaaaggccgcagggaacacaaaggcaagaagaagaccccatcatccccatctctgggcagcttgcagcagcgtgacggggccaaggctgaggttggagaccaggtccttgtcgcgggccagaagcaggggatcgtgcgcttctacgggaagacagactttgccccaggttactggtatggcattgagctggaccagcccacaggcaagcatgatggctctgtcttcggtgtccggtacttcacttgccccccgaggcatggggtcttcgcaccagcatcccgtattcagaggattggcggatccactgattcccccggggacagcgttggagccaaaaaagtgcatcaagtgacaatgacgcagcccaaacgcaccttcaccacagtccggaccccaaaggacattgcatcagagaactccatttccaggttgctgttctgctgctggttcccctggatgctgagggcggagatgcagtcttagaggccctggacacctgacaaagagacagagtccccactagcatctcctgacacccgaggagccctgagtcaccctgagatagagattcccagtaacacatccagagtagagacccctgttagccagccctcgatcattgaggccccattattaacagatactcccataataacccccaaatacagaccccatgtcacccagaaagagattccctgagtagcaccttcaggctagtccctatccccaacccctcagagcagattcccagattaacagatttccatatcaccccaaatgatggtgaccctctccacataatgcattacaacagaacattcttgaatcacccaaccctggatcagaaacctccccattaacaaacactgccccttaagtcctcttgaaataaacataggtcacacccccaaagcaaaagagtaacagacattcatgtcattgttccccatttaacatcagtcctctcaagatgtcgtgaccccatggtcaccctgaagcccttagattccaacccctcaatcagagacttccttcattaacaaagacccttgttcttatccctcaagaagaaacccaccataaccagcccactgtcacccctaatttacagacaccaaaacagtcctggaagtgctaattacaggaccccccaagtcttcctaccctctgcaccctcaagaaacccccagtgccttgtatgaagcccaccccacatggcccacagctcctgtgctggccagactcccagaaaattctctattttttaagtaacgacttccccctttgggggaccccaaaatttggaggccccattctaggactctggggatcccaaaccctagagtacacacgtcccaaactcccctgtgccctcaagtcctacagcccctagaagaccccaatgccgtaactcctaggacccccaaatcatggaatcccaaatccccagggaatcccaaatttgaaaatccaatcccaagtccccaggaaacccaatcatgaggtccttgtgcctggtatggaggagactgcagtcaggatatgcattccaggctcccagacacctcaagccctattcacaggcaccaggaaaccccacacaggaattcccatccctggaaactggagaatttcaatgccccgagtccatgggtttcaagacaccaaattccaagagccccagccctaagggaaccccaaatcctaaagcctccatctctaataaatggaaggccccaaggccctgaggggatctcaaatcctggaaccccgatttcaatctacgttctagtcactggcctcaaaggaccccacagcacctgggccagaccaacagctcgagggagaacctgaaggcccagggggtccagggcggacctggggccccgaccaccaaggacagctcacgactgccccttcactgcatgtccccaaactcagcatgactcctgtcctcttcaataaagacgtttctatggcaaaaaaaaaaacaaaaaaaaaaaaaaaaaaaaaaaaaaaaaaaaatgacagaaaaacaaaagaaacagaaaaataacatagaaaaacaaaaaaaggggagcggggcgacccgaaaaaaggaaccccaccgagggggaggacaacacacatggacacgacagccaccgaccgacgtatggtaggaaacaaagagggcgcccacaacaaagaacgaggcgaccgaagaattaaaaagaaacaaaggagcagcgcaggcacgcagcgccaaacaaaacacgagcgagagggaggtggaaaccgaacagaacacgactacggcgaagacactaactagtgagcgaaaagaccagccaccccccccgtcggggggggcgagccaacatagtgagggacagcgaaaccat

SEQ ID NO: 365551 - DNA, 1178 bp, Homo sapiens
ctctccgcccccaccccctgtcggcgtctgggcctcgtccccttctctctgtctcccttgcctcccccatcacgtcccctgacaccgacaccccattgctcccacagtctccccagtctccactttggtccccagcgctgtctgcccgaggatttgcctgaaggctgcccccaactctgcacccgccccccgagggccaccgaggaccatgactaagacagatcctgccccgatggccccgccaccccgaggagaggaggaagaagaggaggaggaggatgaacccgtccccgaggcccccagccccacccaggagcgccggcagaagcctgttgtgcacccctcggcacctgcccccctccctaaggactacgctttcaccttcttcgatcccaatgacccggcgtgccaggagatcctgtttgaccctcagaccaccatccccgagctgtttgccattgtgcgccagtgggtgccccaagtccagcacaagatagacgtcatcggcaatgagattctgcgccgaggctgccatgtgaacgatcgtgacgggctgaccgacatgacactgctccactatgcgtgcaaagctggggcccacggagtcggggaccccgcggcagccgtgcgcctctcgcagcagctgctggcgctgggcgcagatgtgacgctgcgcagccgctggaccaacatgaacgcgcttcactacgcggcctattttgatgtgcccgacctcgtgcgtgtgctgctgaagggtgcgaggccgcgagtggtgaactccacgtgcagtgacttcaaccacggctcagccctgcacatcgctgcttccagcctgtgcctgggcgccgccaaatgtttgctggagcacggcgccaaccctgcgctgaggaatcgaaaaggacaggtgccggcggaggtggtcccagatcctatggacatgtccctggacaaggcagaggcggcactggtggccaaggagctgcggacgcttctggaagaggcagtgccactatcttgcgccctccccaaggtcacgctacccaactatgacaacgtcccaggcaatctcatgcttagcgcactgggcttgcgcctgggagaccgcgtgctgctggatggccagaaggtcaggggctgggatgtgtgtttgcatggtgggtgggggtgggactcagccc

SEQ ID NO: 365552 - DNA, 427 bp, Homo sapiens
cataagcaagaatatgaaacctttcatttgacaatagaagttaaaacattttgtgttcccatagtaaatattgtgattgggaagaactatttgactccttgagaagattatagagtttttcaattcgactgtttccttgagaataaggaaagaaattcattattacaactgaaaatgaatgaatgaagatccagggtaaatgtattctggaaataatatttcatggaagatactccccctttattctaagcactgccaaaaatgatttgatgctgaatgtaacattcagggcaaaataataagatcaaaaggggtgtattatagttatattaagctagtctgatcctttgaaatctgtgtaaaaggcctgacaaagcagtaatttttacatatggaaatgtatttataataaaagcatacggataat

SEQ ID NO: 365553 - DNA, 631 bp, Homo sapiens
ccatatacccaccctctagcacacatgtagtaaggagcttcgcttgtgttgcttgcttaaaaaaattatttgaagatctaatgtattcacatgatttttaaataaaaacacgaagtctttctaactttccttaccttttctttcttctttcttttccaagacacaggatattactgtttcccagggcactggaattacaggcctgagccactgtgcttggtacaagattaaggacttctagggagaggcagaggaggaacgggtcttgctctgtcacccaggctgaagtgcagtggtacaatcatggctcactgcagccttcacatcccaggcttaagtgatcctcctctcgagtcggggtcttgcgggccaggcaccgtggctcgtgcctgtcatctcagctctttgggaggcttagtcagtggatcacttgaggctacaggccccatgcaagtgcaaaaccaagcagaacggtcaggacatcttcaaagctccaaaatactcacctttggccaggcatggcgactcaagtctgtaatgtcagctctttgtgaggctgagatgtacggatcacttgagctcaggagttggataccagcctgggcaaggtgatgaaaccccatctctacga

SEQ ID NO: 365554 - DNA, 472 bp, Homo sapiens
caaaaaaaatctgaatttccacaatacattgagcatcaagggctcagatagggattgtggcccaaatttcaaatcaactaggaaaaagtgaattatgaaataggtactattaactatcactttagaagaacatgttggaggcatttttttacttcacacacttttggtaacttaaatatttaaatataataataaaagttatagaagataatatagttggagtcataaagtctaaaaggaaatgggtctttctaagtctaatatggatagaattaatgaaatgaatgtctggaactatacctcaaaaaggaactttaataacatcaaaagcaacaatatactgagaaaatatttgcaatgtgacaataagttaatatgcttaatatgtgaagtgcactttcagacagattttcaaaatcattcataaaaagataaaaaccaaggaaagtaagagcaaagaaagtaaacatac

SEQ ID NO: 365555 - DNA, 334 bp, Homo sapiens
ttgtctggctcttagtgttttctgcacagaagttatgtgtgcttcttttatccatgatttattgctcaaaacaagtgagatgccaagtctagtatcagtggggtggggaagtaaaatcttcccaacagaaaggggcagtgtgtgtttgtaaataaagatacactcccacagagagagtgtgagtaactttccctagccagtgagctggtacgtggaagagctgggagtctgaactcaagcagaacagtgtctgactcccatgatgaattaaaatggattttgagaggttcccatgaaattcatggaggttttgtgtgtgtgtgtccggattact

SEQ ID NO: 365556 - DNA, 361 bp, Homo sapiens
gagatggagtctctgtcacccaggttagagtgcaatagtgtaatctgggctcactgctacgtctgcctctcgggttcaagcaattctcctgcctcagcctcccaagtagctgggattacaggtgcacaccaccacacctggctaatttttgtatttttagtacagatggggtttcaccatgttggccaggctggtctcgaactcctgacctcaggtgatctgcctacctcagcctcccaaagtgctgggattacaggtgtgagctaccacacctggccacaaatttcttcttcttataaggacacgagttagggtggaataagcctcatccaacagctttattttaccttagtcacctctt

SEQ ID NO: 365557 - DNA, 180 bp, Homo sapiens
gaggaaaagagaaagagaaagggtacaaagagcttatgtgaagaaacaatatctgacatctttccaaatctgaggaagaaaatggacatctaaattcagtaagcttaatggttcaaactagggtgaatccacagaggcccacagctagacacattataatcaaaatgttgaaagtgaaaa

SEQ ID NO: 365558 - DNA, 444 bp, Homo sapiens
tgagacaagagtctcgctttgttgccaggctggagtgcaggagcacaatctcagctcactgcaagcttgtgatccgcccgtctcagccttccaaagtgctgggattataggcgtgagccaccgcgcctggcctaacatcgtattgtcttatgtactcaagtgccagcaaaccattttgctagcaccatagcagtaatgtagtaagagctatatgctgcaatatacttgatcagttctgaacatcttgctttaatactttgtggtattacagttcaaaagcacgttcaaagtttatacttgttctaacagctataatattactaattaggaacaatataaatagaataattacctctttggatgtgcctattaagtcaaatactaattttttagtcccatctcctagctgttcaaagtgtttttctttgatatttatttaattaa

SEQ ID NO: 365559 - DNA, 1115 bp, Homo sapiens
agaggaagagagagagagagctcatgagccaggatccctggggaatttgaagtcagtgtgaccagggttctgtggctctggggtcagagctgggacacaggacccagcaggagggccaccaccccttccttttggaaacagctctggttccaagcagcaatcaggtaggaggatcggggctttggctgatgatgcacacacaagatgctgatggtgtacggtgagatattgtgaacgcaacaactggagctgtagttggcgtgtgtgagtgtgtacctgcggttctgtttagtggcgagacaaggtatgtttcagtactgctttcacggcaactgtgtaatgcatatgctctttctacactagcggtttgctcagttttgtctgtccggttaagttggagaaagaaccaagttgtgttgttctctggagggggtgctgctgcctctccttgagtagttctgtgacccccaatccagctgttttgtagagaatccttctagcttctggtatgcctgctctccagcagctggaaacagatcttcctgcctgaccaaagctccttgtttcttgcgtggcatgtttgttcttcccgatccggtggctgtcgtagccgagggcctgcctgccaccttcctttatcatttgccctgttggggttcagggtgcatccttagcccaggacctgctcttccagcatcatgggttttttcctaaagatctcaacggctcccttgggctccataaaatatttcttttttaaaaaagcagactcctttcatgcattgggatgaacggccctcttgtctgggtgctgggctacagcaaacaaatgtgtttgaatcccagtattccagagattcctggcggtgggctgtctagaagaggcgaggctggatctcacggtttttaaactgtatttttacccctttgggacccatacctgtgccctggagtctttcatgaggcacgtgggtcctctgcatcctcactctcccccctagcccaggtgcagccccgggaggggtgccctgaccccgccttaaacaaccaactttcccaccgaatcccatctggcgggcggggggggggggtttgggtgccaagtgccctggaaa

SEQ ID NO: 365560 - DNA, 725 bp, Homo sapiens
  misc_feature (10)..(10): n is a, c, g, or t
  misc_feature (20)..(20): n is a, c, g, or t
tcagttgtcncccgggttanggatagtcgaccagccccgggggtgctgctgcctctccttgagtagttctgtgacccccaatccagctgttttgtagagaatccttctagcttctggtatgcctgctctccagcagctggaaacagatcttcctgcctgaccaaagctccttgtttcttgcgtggcatgtttgttcttcccgatccggtggctgtcgtagccgagggcctgcctgccaccttcctttatcatttgccctgttggggttcagggtgcatccttagcccaggacctgctcttccagcatcatgggttttttcctaaagatctcaacggctcccttgggctccataaaatatttcttttttaaaaaagcagactcctttcatgcattgggatgaacggccctcttgtctgggtgctgggctacagcaaacaaatgtgtttgaatcccagtattccagagattcctggcggtgggctgtctagaagaggcgaggctggatctcacggtttttaaactgtatttttacccctttgggacccatacctgtgccctggagtctttcatgaggcacgtgggtcctctgcatcctcactctcccccctagcccaggtgcagccccgggaggggtgccctgaccccgccttaaacaaccaactttcccaccgaatcccatctggcgggcggggggggggggtttgggtgccaagtgccctggaaa

SEQ ID NO: 365561 - DNA, 5213 bp, Homo sapiens
  misc_feature (5212)..(5212): n is a, c, g, or t
gctgttggctgggctcgggagggaacgctccaggtaaagcgctgggggaggaagcgacgccgaggagctacggtttcctccagaggtctccgcccctctgcccctatattcccagagctcgagtctgatccgggccttgccgggcaccctggaaaggcgggggtgatagtacagatggagacgcaactgcagagcattttcgaagaggtggtgaaaacggaagttatagaagaggcttttcctggcatgtttatggatactcctgaagatgagaaaacaaaactaattagctgtttgggggccttcagacagttttggggtggtctttctcaggagtctcatgaacagtgtatccagtggattgttaagtttattcatggtcagcatagtcctaaaagaatttcttttctttatgactgcttagcaatggcagttgagactggtctccttccacccaggctggtttgtgaatccctgataaactctgacactcttgagtgggaaagaacacagctttgggccttaacatttaaactggttcggaaaataattgggggagtggattacaagggtgttcgagatctcttaaaagtgattttggagaagattttgacaattcctaatacagtgagctctgctgttgtacagcagcttctggcagcaagagaggttatagcatatatcttggaaagaaatgcctgcttattaccagcctattttgcagtcactgagatcaggaaactgtatcctgaaggcaaacttccacactggttacttggaaacctagtatcagactttgtggataccttcaggcccacagcaaggataaactccatttgtggtcgctgtagtcttctgccagttgtaaataattcgggtgccatttgtaattcatggaaactggatcctgctactcttcgttttcctttgaaaggccttttgccatatgataaggatctgtttgaaccacagactgctttgttgagatatgtattggagcagccttattccagggatatggtctgcaatatgctaggtttaaataagcagcacaagcagcgctgccctgtgctggaggaccagttggtggatctggttgtttatgccatggagcgatctgagaccgaggagaagtttgacgatgggggaacaagccaactcctgtggcagcatctctcaagtcagctcattttctttgtgcttttccagtttgcaagttttccacatatggtgctttctcttcatcagaagttagcagggcgaggactgattaaaggcagagatcatcttatgtgggttctcctgcaattcatttctggaagtattcagaaaaatgcactagctgattttctccctgtgatgaagctcttcgacttgctatacccagaaaaagaatatatcccagttcctgatattaacaaaccccagtcaacccatgcctttgcaatgacctgtatttggattcatctcaatagaaaagctcaaaatgacaactccaagctacagattccaatacctcattccctaagacttcaccatgagttcctgcagcagagtctaagaaataaaagtttacagatgaatgactataagattgctctattgtgtaatgcatactctacaaattcagaatgttttacattacccatgggagctctggtagaaactatttatggaaatggaattatgaggatacctctccctggaacaaactgtatggcttcaggatctattacccccttacctatgaacctcctggattcactgacagttcatgccaaaatgagccttattcacagcattgcaaccagggtgataaaacttgctcatgcaaagtccagtgtggccttggctccagccctagtggaaacttacagtcgtttattggtctatatggaaatagagtctttgggcatcaaaggatttatcagtcagcttttgccaactgttttcaaatcacatgcatgggggatcttacacacactccttgagatgtttagctaccggatgcatcatattcagcctcattacagagttcagctcctgagtcatcttcatactttggctgcagttgcacaaacaaaccagaaccagctccatctttgtgtcgagagcactgctctcaggcttataacagcattaggtagctcagaggtacaaccgcagtttacacgcttccttagtgatcccaaaacagtgctctcagcagaatctgaagaactgaaccgagccttgatattgaccttggctagagcaactcatgtaacagatttttttacaggctctgattcaattcagggaacttggtgtaaagacatacttcagaccatcatgagtttcactcctcataattgggcttcacacaccctgagctgttttccaggcccactacaggcattcttcaaacaaaataatgtgcctcaggaaagccgttttaatctgaaaaaaaatgtggaggaggagtataggaagtggaagtcaatgagcaacgaaaacgacattattacccacttctctatgcagggctcccctcctctctttctttgtcttctctggaaaatgctcttggaaacagatcatattaatcagattggctatagagtattagagagaattggagccagggccttggtagcccatgtgaggacatttgcagatttcctggtatatgagttttctacatcagcagggggtcagcaactcaataaatgcattgaaattcttaatgacatggtatggaagtataacattgttacactggacagattaattctctgcctggccatgcgtagtcacgaaggaaatgaagcccaggtttgttatttcataattcagttgctgttactcaaaccaaacgattttagaaatcgagtaagtgactttgtgaaggaaaattccccagagcactggttacagaatgactggcacaccaagcacatgaattatcacaagaaatatccagagaagttgtattttgagggcctcgcggaacaggtggatcctcctgtacagatccagtctccctatctgcccatctattttgggaatgtgtgtcttcgattccttccagtatttgatatagtaatccacagatttttagagttgcttccggtatccaaatcactggagactctactggatcatctaggaggcttatataaatttcatgatcgtccagtgacttatctgtataacactctgcactattatgaaatgcacctgagagaccgcgcatttctcaaacgaaaactcgtccatgcgatcattggctctctgaaggataatcgaccgcagggctggtgtctaagtgacacttacctgaaatgcgctatgaatgcacgagaggaaaatccttgggttccagatgacacctactattgcagattgattggcagactagtcgatacgatggctggcaaatctcctggtccctttccaaactgtgactggagattcaatgagtttcccaacccagctgcccatgctctccatgttacttgtgtggagctcatggccttggcagtttcaggcaaagaagttgggaatgcccttctaaatgttgtcctaaaaagtcagcctttagtgccaagagagaacattacagcatggatgaatgcaattggtttgatcatcactgccctaccagagccatattggattgttcttcatgatcgaattgtgagtgtcatcagcagccccagcttgacgtctgaaacagagtgggttggctatccattccgcctctttgatttcactgcctgtcatcagtcctactctgagatgagttgtagctatacgttagctcttgcacatgctgtgtggcaccattctagcatcggacaactttctctcattccaaagtttcttactgaagtacttcttcctatagtgaagaccgaattccagttgctttatgtataccatcttgttggaccatttttacaaagatttcagcaagagagaactcgttgtatgatagagattggtgtggcgttttatgacatgctgctgaatgttgaccagtgtagcacccatttaaattacatggatcccatctgtgacttcctctatcacatgaagtatatgtttactggtgacagcgtgaaagagcaagtagagaagattatctgtaacttaaaaccagctttaaaacttcgtcttcgattcatcacacacattagcaagatggagccagctgcagtgcctccacaagccatgaacagtgggtctccagcacctcagtctaatcaggtgcccgtgtctttaccagtaactcagtgaagccagactgtactgtggagaaagtagaaatatatccgtctttgagagtggactcaaaccttttaaatctgaatgcgatcacactgtagtgatatagtagaagcagtgatgatattcagattgttttattttgattcaaatgatgaatctgttgacaccttataactcccatctccctatctatatttttgtctctaagagatcaagtaagatacatgttgttcatattcataacaacttattagagctatgtaggaacatagaggtatctgtgatcaaatgacttgtcattggcactttcagtctttcctattctagccgttgtttttgtttgtattttttattattaatgacatatttagtcttcagatatattattttaaaggcaccacacatgtaaaacagttattacaaatattttatacataaatctcttggtagattttcagaataatagagatttatatcaagaaaaggaatctagattttgttgcattgtaggagcaaacaaggcttcatattctttttaaaatgacttgaaattttattataaatttccatagtttctatcaaggtcaactggcagttttattacctttgctatggacttgaacttactgtataaaattagttggaagccatgtaagaaaataacatctgaaaattcttgaacttaaaatcatgcttaaatggttgattctccaatttctttttttaaaaataagttaattgcttttgcaggttgacactctcacctgacagatgatgtaattcttcaatttttataatcttaaaatttttaaattttatatttgtaaatacagtacacattttatttcttggattttgagagacattgttaattttgggggaattggcattgcgaaagacttgaaaactaatgagtaaagtctgctgaatgaataaaccnt

SEQ ID NO: 365562 - DNA, 2817 bp, Homo sapiens
gctgttggctgggctcgggagggaacgctccaggtaaagcgctgggggaggaagcgacgccgaggagctacggtttcctccagaggtctccgcccctctgcccctatattcccagagctcgagtctgatccgggccttgccgggcaccctggaaaggcgggggtgatagtacagatggagacgcaactgcagagcattttcgaagaggtggtgaaaacggaagttatagaagaggcttttcctggcatgtttatggatactcctgaagatgagaaaacaaaactaattagctgtttgggggccttcagacagttttggggtggtctttctcaggagtctcatgaacagtgtatccagtggattgttaagtttattcatggtcagcatagtcctaaaagaatttcttttctttatgactgcttagcaatggcagttgagactggtctccttccacccaggctggtttgtgaatccctgataaactctgacactcttgagtgggaaagaacacagctttgggccttaacatttaaactggttcggaaaataattgggggagtggattacaagggtgttcgagatctcttaaaagtgattttggagaagattttgacaattcctaatacagtgagctctgctgttgtacagcagcttctggcagcaagagaggttatagcatatatcttggaaagaaatgcctgcttattaccagcctattttgcagtcactgagatcaggaaactgtatcctgaaggcaaacttccacactggttacttggaaacctagtatcagactttgtggataccttcaggcccacagcaaggataaactccatttgtggtcgctgtagtcttctgccagttgtaaataattcgggtgccatttgtaattcatggaaactggatcctgctactcttcgttttcctttgaaaggccttttgccatatgataaggatctgtttgaaccacagactgctttgttgagatatgtattggagcagccttattccagggatatggtctgcaatatgctaggtttaaataagcagcacaagcagcgctgccctgtgctggaggaccagttggtggatctggttgtttatgccatggagcgatctgagaccgaggagaagtttgacgatgggggaacaagccaactcctgtggcagcatctctcaagtcagctcattttctttgtgcttttccagtttgcaagttttccacatatggtgctttctcttcatcagaagttagcagggcgaggactgattaaaggcagagatcatcttatgtgggttctcctgcaattcatttctggaagtattcagaaaaatgcactagctgattttctccctgtgatgaagctcttcgacttgctatacccagaaaaagaatatatcccagttcctgatattaacaaaccccagtcaacccatgcctttgcaatgacctgtatttggattcatctcaatagaaaagctcaaaatgacaactccaagctacagattccaatacctcattccctaagacttcaccatgagttcctgcagcagagtctaagaaataaaagtttacagatgaatgactataagattgctctattgtgtaatgcatactctacaaattcagaatgttttacattacccatgggagctctggtagaaactatttatggaaatggaattatgaggatacctctccctggaacaaactgtatggcttcaggatctattacccccttacctatgaacctcctggattcactgacagttcatgccaaaatgagccttattcacagcattgcaaccagggtgataaaacttgctcatgcaaagtccagtgtggccttggctccagccctagtggaaacttacagtcgtttattggtctatatggaaatagagtctttgggcatcaaaggatttatcagtcagcttttgccaactgttttcaaatcacatgcatgggggatcttacacacactccttgagatgtttagctaccggatgcatcatattcagcctcattacagagttcagctcctgagtcatcttcatactttggctgcagttgcacaaacaaaccagaaccagctccatctttgtgtcgagagcactgctctcaggcttataacagcattaggtagctcagaggtacaaccgcagtttacacgcttccttagtgatcccaaaacagtgctctcagcagaatctgaagaactgaaccgagccttgatattgaccttggctagagcaactcatgtaacagatttttttacaggctctgattcaattcagggaacttggtgtaaagacatacttcagaccatcatgagtttcactcctcataattgggcttcacacaccctgagctgttttccaggcccactacaggcattcttcaaacaaaataatgtgcctcaggaaagccgttttaatctgaaaaaaaatgtggaggaggagtataggaagtggaagtcaatgagcaacgaaaacgacattattacccacttctctatgcagggctcccctcctctctttctttgtcttctctggaaaatgctcttggaaacagatcatattaatcagattggctatagagtattagagagaattggagccagggccttggtagcccatgtgaggacatttgcagatttcctggtatatgagttttctacatcagcagggggtcagcaactcaataaatgcattgaaattcttaatgacatggtatggaagtataacattgttacactggacagattaattctctgcctggtaagaataaatacatttctaagcttattctcttag

SEQ ID NO: 365563 - DNA, 823 bp, Homo sapiens
catgcgcttagctccacaacttctttctccatgtggatatagcatttttccaacttgcatatgatgatgccattctactatgcattgccctttgtcaaattgaaacaatgatgtccatagtggaagtcaaaagttaatgggaagtcggttttgtaggaaacctgaaaacattttttcatgaagcttatcctgtataataatataacatgatgcagctttaatagactaaatctaaccttgacttcttaagttcaacttcattccgtgcttctcagcctcttgttacaattaatgcccattaactggtaacttctgaaactaaccgagaggcttttggaatactgtatttaatctctgccctcacaagcagcgctgccctgtgctggaggaccagttggtggatctggttgtttatgccatggagcgatctgagaccgaggagaagtttgacgatgggggaacaagccaactcctgtggcagcatctctcaagtcagctcattttctttgtgcttttccagtttgcaagttttccacatatggtgctttctcttcatcagaaggtatgtactaaatcttatggtcggagtgacttcacctgttgattactgtattttagactgctgtgggcattccctagtgattttagaactgacagaagttctgagccctaatttctgtcctgtttagtgcttttatagtttcttaactttttactttcttgtcacctgtaaaaacaggattcagtcattcattctatgtattctcagtgcaggcaccagcagatacaagatgaaaaggcactgtatatcctcaaggagcac

SEQ ID NO: 365564 - DNA, 5567 bp, Homo sapiens
  misc_feature (5566)..(5566): n is a, c, g, or t
gctgttggctgggctcgggagggaacgctccaggtaaagcgctgggggaggaagcgacgccgaggagctacggtttcctccagaggtctccgcccctctgcccctatattcccagagctcgagtctgatccgggccttgccgggcaccctggaaaggcgggggtgatagtacagatggagacgcaactgcagagcattttcgaagaggtggtgaaaacggaagttatagaagaggcttttcctggcatgtttatggatactcctgaagatgagaaaacaaaactaattagctgtttgggggccttcagacagttttggggtggtctttctcaggagtctcatgaacagtgtatccagtggattgttaagtttattcatggtcagcatagtcctaaaagaatttcttttctttatgactgcttagcaatggcagttgagactggtctccttccacccaggctggtttgtgaatccctgataaactctgacactcttgagtgggaaagaacacagctttgggccttaacatttaaactggttcggaaaataattgggggagtggattacaagggtgttcgagatctcttaaaagtgattttggagaagattttgacaattcctaatacagtgagctctgctgttgtacagcagcttctggcagcaagagaggttatagcatatatcttggaaagaaatgcctgcttattaccagcctattttgcagtcactgagatcaggaaactgtatcctgaaggcaaacttccacactggttacttggaaacctagtatcagactttgtggataccttcaggcccacagcaaggataaactccatttgtggtcgctgtagtcttctgccagttgtaaataattcgggtgccatttgtaattcatggaaactggatcctgctactcttcgttttcctttgaaaggccttttgccatatgataaggatctgtttgaaccacagactgctttgttgagatatgtattggagcagccttattccagggatatggtctgcaatatgctaggtttaaataagcagcacaagcagcgctgccctgtgctggaggaccagttggtggatctggttgtttatgccatggagcgatctgagaccgaggagaagtttgacgatgggggaacaagccaactcctgtggcagcatctctcaagtcagctcattttctttgtgcttttccagtttgcaagttttccacatatggtgctttctcttcatcagaagttagcagggcgaggactgattaaaggcagagatcatcttatgtgggttctcctgcaattcatttctggaagtattcagaaaaatgcactagctgattttctccctgtgatgaagctcttcgacttgctatacccagaaaaagaatatatcccagttcctgatattaacaaaccccagtcaacccatgcctttgcaatgacctgtatttggattcatctcaatagaaaagctcaaaatgacaactccaagctacagattccaatacctcattccctaagacttcaccatgagttcctgcagcagagtctaagaaataaaagtttacagatgaatgactataagattgctctattgtgtaatgcatactctacaaattcagaatgttttacattacccatgggagctctggtagaaactatttatggaaatggaattatgaggatacctctccctggaacaaactgtatggcttcaggatctattacccccttacctatgaacctcctggattcactgacagttcatgccaaaatgagccttattcacagcattgcaaccagggtgataaaacttgctcatgcaaagtccagtgtggccttggctccagccctagtggaaacttacagtcgtttattggtctatatggaaatagagtctttgggcatcaaaggatttatcagtcagcttttgccaactgttttcaaatcacatgcatgggggatcttacacacactccttgagatgtttagctaccggatgcatcatattcagcctcattacagagttcagctcctgagtcatcttcatactttggctgcagttgcacaaacaaaccagaaccagctccatctttgtgtcgagagcactgctctcaggcttataacagcattaggtagctcagaggtacaaccgcagtttacacgcttccttagtgatcccaaaacagtgctctcagcagaatctgaagaactgaaccgagccttgatattgaccttggctagagcaactcatgtaacagatttttttacaggctctgattcaattcagggaacttggtgtaaagacatacttcagaccatcatgagtttcactcctcataattgggcttcacacaccctgagctgttttccaggcccactacaggcattcttcaaacaaaataatgtgcctcaggaaagccgttttaatctgaaaaaaaatgtggaggaggagtataggaagtggaagtcaatgagcaacgaaaacgacattattacccacttctctatgcagggctcccctcctctctttctttgtcttctctggaaaatgctcttggaaacagatcatattaatcagattggctatagagtattagagagaattggagccagggccttggtagcccatgtgaggacatttgcagatttcctggtatatgagttttctacatcagcagggggtcagcaactcaataaatgcattgaaattcttaatgacatggtatggaagtataacattgttacactggacagattaattctctgcctggccatgcgtagtcacgaaggaaatgaagcccaggtttgttatttcataattcagttgctgttactcaaaccaaacgattttagaaatcgagtaagtgactttgtgaaggaaaattccccagagcactggttacagaatgactggcacaccaagcacatgaattatcacaaggtactagtcctaattggtatttcaaatagtccttttaaagccatacttgagtatttgatgaagtgatttggccgttttctctctggttctaatgttttttctcttgtctatatagaagtaagttagctctctgaacttcttcaaggtttgagagtttctataatgttgagaataaattgaaactgcagttttagtggacataaggacttctataaaaagaagtaaagtataatcaagtataattttaaatgtttccttgcaaaaaaaaatctaaacaatgttttcacatttagctcttttaagagaattttttaaaaaatgctctaaccatttatcatcttctcaattccacagaaatatccagagaagttgtattttgagggcctcgcggaacaggtggatcctcctgtacagatccagtctccctatctgcccatctattttgggaatgtgtgtcttcgattccttccagtatttgatatagtaatccacagatttttagagttgcttccggtatccaaatcactggagactctactggatcatctaggaggcttatataaatttcatgatcgtccagtgacttatctgtataacactctgcactattatgaaatgcacctgagagaccgcgcatttctcaaacgaaaactcgtccatgcgatcattggctctctgaaggataatcgaccgcagggctggtgtctaagtgacacttacctgaaatgcgctatgaatgcacgagaggaaaatccttgggttccagatgacacctactattgcagattgattggcagactagtcgatacgatggctggcaaatctcctggtccctttccaaactgtgactggagattcaatgagtttcccaacccagctgcccatgctctccatgttacttgtgtggagctcatggccttggcagtttcaggcaaagaagttgggaatgcccttctaaatgttgtcctaaaaagtcagcctttagtgccaagagagaacattacagcatggatgaatgcaattggtttgatcatcactgccctaccagagccatattggattgttcttcatgatcgaattgtgagtgtcatcagcagccccagcttgacgtctgaaacagagtgggttggctatccattccgcctctttgatttcactgcctgtcatcagtcctactctgagatgagttgtagctatacgttagctcttgcacatgctgtgtggcaccattctagcatcggacaactttctctcattccaaagtttcttactgaagtacttcttcctatagtgaagaccgaattccagttgctttatgtataccatcttgttggaccatttttacaaagatttcagcaagagagaactcgttgtatgatagagattggtgtggcgttttatgacatgctgctgaatgttgaccagtgtagcacccatttaaattacatggatcccatctgtgacttcctctatcacatgaagtatatgtttactggtgacagcgtgaaagagcaagtagagaagattatctgtaacttaaaaccagctttaaaacttcgtcttcgattcatcacacacattagcaagatggagccagctgcagtgcctccacaagccatgaacagtgggtctccagcacctcagtctaatcaggtgcccgtgtctttaccagtaactcagtgaagccagactgtactgtggagaaagtagaaatatatccgtctttgagagtggactcaaaccttttaaatctgaatgcgatcacactgtagtgatatagtagaagcagtgatgatattcagattgttttattttgattcaaatgatgaatctgttgacaccttataactcccatctccctatctatatttttgtctctaagagatcaagtaagatacatgttgttcatattcataacaacttattagagctatgtaggaacatagaggtatctgtgatcaaatgacttgtcattggcactttcagtctttcctattctagccgttgtttttgtttgtattttttattattaatgacatatttagtcttcagatatattattttaaaggcaccacacatgtaaaacagttattacaaatattttatacataaatctcttggtagattttcagaataatagagatttatatcaagaaaaggaatctagattttgttgcattgtaggagcaaacaaggcttcatattctttttaaaatgacttgaaattttattataaatttccatagtttctatcaaggtcaactggcagttttattacctttgctatggacttgaacttactgtataaaattagttggaagccatgtaagaaaataacatctgaaaattcttgaacttaaaatcatgcttaaatggttgattctccaatttctttttttaaaaataagttaattgcttttgcaggttgacactctcacctgacagatgatgtaattcttcaatttttataatcttaaaatttttaaattttatatttgtaaatacagtacacattttatttcttggattttgagagacattgttaattttgggggaattggcattgcgaaagacttgaaaactaatgagtaaagtctgctgaatgaataaaccnt

SEQ ID NO: 365565 - DNA, 5159 bp, Homo sapiens
  misc_feature (5158)..(5158): n is a, c, g, or t
gctgttggctgggctcgggagggaacgctccaggtaaagcgctgggggaggaagcgacgccgaggagctacggtttcctccagaggtctccgcccctctgcccctatattcccagagctcgagtctgatccgggccttgccgggcaccctggaaaggcgggggtgatagtacagatggagacgcaactgcagagcattttcgaagaggtggtgaaaacggaagttatagaagaggcttttcctggcatgtttatggatactcctgaagatgagaaaacaaaactaattagctgtttgggggccttcagacagttttggggtggtctttctcaggagtctcatgaacagtgtatccagtggattgttaagtttattcatggtcagcatagtcctaaaagaatttcttttctttatgactgcttagcaatggcagttgagactggtctccttccacccaggctggtttgtgaatccctgataaactctgacactcttgagtgggaaagaacacagctttgggccttaacatttaaactggttcggaaaataattgggggagtggattacaagggtgttcgagatctcttaaaagtgattttggagaagattttgacaattcctaatacagtgagctctgctgttgtacagcagcttctggcagcaagagaggttatagcatatatcttggaaagaaatgcctgcttattaccagcctattttgcagtcactgagatcaggaaactgtatcctgaaggcaaacttccacactggttacttggaaacctagtatcagactttgtggataccttcaggcccacagcaaggataaactccatttgtggtcgctgtagtcttctgccagttgtaaataattcgggtgccatttgtaattcatggaaactggatcctgctactcttcgttttcctttgaaaggccttttgccatatgataaggatctgtttgaaccacagactgctttgttgagatatgtattggagcagccttattccagggatatggtctgcaatatgctaggtttaaataagcagcacaagcagcgctgccctgtgctggaggaccagttggtggatctggttgtttatgccatggagcgatctgagaccgaggagaagtttgacgatgggggaacaagccaactcctgtggcagcatctctcaagtcagctcattttctttgtgcttttccagtttgcaagttttccacatatggtgctttctcttcatcagaagttagcagggcgaggactgattaaaggcagagatcatcttatgtgggttctcctgcaattcatttctggaagtattcagaaaaatgcactagctgattttctccctgtgatgaagctcttcgacttgctatacccagaaaaagaatatatcccagttcctgatattaacaaaccccagtcaacccatgcctttgcaatgacctgtatttggattcatctcaatagaaaagctcaaaatgacaactccaagctacagattccaatacctcattccctaagacttcaccatgagttcctgcagcagagtctaagaaataaaagtttacagatgaatgactataagattgctctattgtgtaatgcatactctacaaattcagaatgttttacattacccatgggagctctggtagaaactatttatggaaatggaattatgaggatacctctccctggaacaaactgtatggcttcaggatctattacccccttacctatgaacctcctggattcactgacagttcatgccaaaatgagccttattcacagcattgcaaccagggtgataaaacttgctcatgcaaagtccagtgtggccttggctccagccctagtggaaacttacagtcgtttattggtctatatggaaatagagtctttgggcatcaaaggatttatcagtcagcttttgccaactgttttcaaatcacatgcatgggggatcttacacacactccttgagatgtttagctaccggatgcatcatattcagcctcattacagagttcagctcctgagtcatcttcatactttggctgcagttgcacaaacaaaccagaaccagctccatctttgtgtcgagagcactgctctcaggcttataacagcattaggtagctcagaggtacaaccgcagtttacacgcttccttagtgatcccttggctagagcaactcatgtaacagatttttttacaggctctgattcaattcagggaacttggtgtaaagacatacttcagaccatcatgagtttcactcctcataattgggcttcacacaccctgagctgttttccaggcccactacaggcattcttcaaacaaaataatgtgcctcaggaaagccgttttaatctgaaaaaaaatgtggaggaggagtataggaagtggaagtcaatgagcaacgaaaacgacattattacccacttctctatgcagggctcccctcctctctttctttgtcttctctggaaaatgctcttggaaacagatcatattaatcagattggctatagagtattagagagaattggagccagggccttggtagcccatgtgaggacatttgcagatttcctggtatatgagttttctacatcagcagggggtcagcaactcaataaatgcattgaaattcttaatgacatggtatggaagtataacattgttacactggacagattaattctctgcctggccatgcgtagtcacgaaggaaatgaagcccaggtttgttatttcataattcagttgctgttactcaaaccaaacgattttagaaatcgagtaagtgactttgtgaaggaaaattccccagagcactggttacagaatgactggcacaccaagcacatgaattatcacaagaaatatccagagaagttgtattttgagggcctcgcggaacaggtggatcctcctgtacagatccagtctccctatctgcccatctattttgggaatgtgtgtcttcgattccttccagtatttgatatagtaatccacagatttttagagttgcttccggtatccaaatcactggagactctactggatcatctaggaggcttatataaatttcatgatcgtccagtgacttatctgtataacactctgcactattatgaaatgcacctgagagaccgcgcatttctcaaacgaaaactcgtccatgcgatcattggctctctgaaggataatcgaccgcagggctggtgtctaagtgacacttacctgaaatgcgctatgaatgcacgagaggaaaatccttgggttccagatgacacctactattgcagattgattggcagactagtcgatacgatggctggcaaatctcctggtccctttccaaactgtgactggagattcaatgagtttcccaacccagctgcccatgctctccatgttacttgtgtggagctcatggccttggcagtttcaggcaaagaagttgggaatgcccttctaaatgttgtcctaaaaagtcagcctttagtgccaagagagaacattacagcatggatgaatgcaattggtttgatcatcactgccctaccagagccatattggattgttcttcatgatcgaattgtgagtgtcatcagcagccccagcttgacgtctgaaacagagtgggttggctatccattccgcctctttgatttcactgcctgtcatcagtcctactctgagatgagttgtagctatacgttagctcttgcacatgctgtgtggcaccattctagcatcggacaactttctctcattccaaagtttcttactgaagtacttcttcctatagtgaagaccgaattccagttgctttatgtataccatcttgttggaccatttttacaaagatttcagcaagagagaactcgttgtatgatagagattggtgtggcgttttatgacatgctgctgaatgttgaccagtgtagcacccatttaaattacatggatcccatctgtgacttcctctatcacatgaagtatatgtttactggtgacagcgtgaaagagcaagtagagaagattatctgtaacttaaaaccagctttaaaacttcgtcttcgattcatcacacacattagcaagatggagccagctgcagtgcctccacaagccatgaacagtgggtctccagcacctcagtctaatcaggtgcccgtgtctttaccagtaactcagtgaagccagactgtactgtggagaaagtagaaatatatccgtctttgagagtggactcaaaccttttaaatctgaatgcgatcacactgtagtgatatagtagaagcagtgatgatattcagattgttttattttgattcaaatgatgaatctgttgacaccttataactcccatctccctatctatatttttgtctctaagagatcaagtaagatacatgttgttcatattcataacaacttattagagctatgtaggaacatagaggtatctgtgatcaaatgacttgtcattggcactttcagtctttcctattctagccgttgtttttgtttgtattttttattattaatgacatatttagtcttcagatatattattttaaaggcaccacacatgtaaaacagttattacaaatattttatacataaatctcttggtagattttcagaataatagagatttatatcaagaaaaggaatctagattttgttgcattgtaggagcaaacaaggcttcatattctttttaaaatgacttgaaattttattataaatttccatagtttctatcaaggtcaactggcagttttattacctttgctatggacttgaacttactgtataaaattagttggaagccatgtaagaaaataacatctgaaaattcttgaacttaaaatcatgcttaaatggttgattctccaatttctttttttaaaaataagttaattgcttttgcaggttgacactctcacctgacagatgatgtaattcttcaatttttataatcttaaaatttttaaattttatatttgtaaatacagtacacattttatttcttggattttgagagacattgttaattttgggggaattggcattgcgaaagacttgaaaactaatgagtaaagtctgctgaatgaataaaccnt

SEQ ID NO: 365566 - DNA, 3305 bp, Homo sapiens
  misc_feature (3304)..(3304): n is a, c, g, or t
accgcgcctggccttcgggtagatttctttaaaaagatattgaagtaggctggaaaatgctacattgaaaaaaattctatggcggtgacatttggagtggcatagtttaacgttaaccccttagctgtggagcatagatataaaagtagttattatattttagggggaataatgtaagtctataaatcaataagatgtcaggataagatggaggtgtagaaaaaatatttctaggaaacagtgagaaatcttatctgcttaggtgatagctgtgaaagatagattaaatttttaaaagtaaagatggacatcccaggcagaaggaatggtaagccagaaataggcaagaaaggtcatatatgtttggggaatactgaacagttggtttgggatagactagacgtctaaggaaattataatagtgagattttactttgttaaaatctaggctttcagatggccctcatgattttacacaggttgaacattttcatataatttttctgttgtttttcaaaggccatgcgtagtcacgaaggaaatgaagcccaggtttgttatttcataattcagttgctgttactcaaaccaaacgattttagaaatcgagtaagtgactttgtgaaggaaaattccccagagcactggttacagaatgactggcacaccaagcacatgaattatcacaaggtactagtcctaattggtatttcaaatagtccttttaaagccatacttgagtatttgatgaagtgatttggccgttttctctctggttctaatgttttttctcttgtctatatagaagtaagttagctctctgaacttcttcaaggtttgagagtttctataatgttgagaataaattgaaactgcagttttagtggacataaggacttctataaaaagaagtaaagtataatcaagtataattttaaatgtttccttgcaaaaaaaaatctaaacaatgttttcacatttagctcttttaagagaattttttaaaaaatgctctaaccatttatcatcttctcaattccacagaaatatccagagaagttgtattttgagggcctcgcggaacaggtggatcctcctgtacagatccagtctccctatctgcccatctattttgggaatgtgtgtcttcgattccttccagtatttgatatagtaatccacagatttttagagttgcttccggtatccaaatcactggagactctactggatcatctaggaggcttatataaatttcatgatcgtccagtgacttatctgtataacactctgcactattatgaaatgcacctgagagaccgcgcatttctcaaacgaaaactcgtccatgcgatcattggctctctgaaggataatcgaccgcagggctggtgtctaagtgacacttacctgaaatgcgctatgaatgcacgagaggaaaatccttgggttccagatgacacctactattgcagattgattggcagactagtcgatacgatggctggcaaatctcctggtccctttccaaactgtgactggagattcaatgagtttcccaacccagctgcccatgctctccatgttacttgtgtggagctcatggccttggcagtttcaggcaaagaagttgggaatgcccttctaaatgttgtcctaaaaagtcagcctttagtgccaagagagaacattacagcatggatgaatgcaattggtttgatcatcactgccctaccagagccatattggattgttcttcatgatcgaattgtgagtgtcatcagcagccccagcttgacgtctgaaacagagtgggttggctatccattccgcctctttgatttcactgcctgtcatcagtcctactctgagatgagttgtagctatacgttagctcttgcacatgctgtgtggcaccattctagcatcggacaactttctctcattccaaagtttcttactgaagtacttcttcctatagtgaagaccgaattccagttgctttatgtataccatcttgttggaccatttttacaaagatttcagcaagagagaactcgttgtatgatagagattggtgtggcgttttatgacatgctgctgaatgttgaccagtgtagcacccatttaaattacatggatcccatctgtgacttcctctatcacatgaagtatatgtttactggtgacagcgtgaaagagcaagtagagaagattatctgtaacttaaaaccagctttaaaacttcgtcttcgattcatcacacacattagcaagatggagccagctgcagtgcctccacaagccatgaacagtgggtctccagcacctcagtctaatcaggtgcccgtgtctttaccagtaactcagtgaagccagactgtactgtggagaaagtagaaatatatccgtctttgagagtggactcaaaccttttaaatctgaatgcgatcacactgtagtgatatagtagaagcagtgatgatattcagattgttttattttgattcaaatgatgaatctgttgacaccttataactcccatctccctatctatatttttgtctctaagagatcaagtaagatacatgttgttcatattcataacaacttattagagctatgtaggaacatagaggtatctgtgatcaaatgacttgtcattggcactttcagtctttcctattctagccgttgtttttgtttgtattttttattattaatgacatatttagtcttcagatatattattttaaaggcaccacacatgtaaaacagttattacaaatattttatacataaatctcttggtagattttcagaataatagagatttatatcaagaaaaggaatctagattttgttgcattgtaggagcaaacaaggcttcatattctttttaaaatgacttgaaattttattataaatttccatagtttctatcaaggtcaactggcagttttattacctttgctatggacttgaacttactgtataaaattagttggaagccatgtaagaaaataacatctgaaaattcttgaacttaaaatcatgcttaaatggttgattctccaatttctttttttaaaaataagttaattgcttttgcaggttgacactctcacctgacagatgatgtaattcttcaatttttataatcttaaaatttttaaattttatatttgtaaatacagtacacattttatttcttggattttgagagacattgttaattttgggggaattggcattgcgaaagacttgaaaactaatgagtaaagtctgctgaatgaataaaccnt

SEQ ID NO: 365567 - DNA, 2787 bp, Homo sapiens
  misc_feature (2786)..(2786): n is a, c, g, or t
cacttaaaacaagattctcttcatcttgttttcaagatttcaagattcttttaaaaattagcatgaagtatgggataatgattggggaggaagtatttttaaaaagccttcttgagtttttatgcatattacatttttattcaataaaaaattccccattgttttattgaaatggattagttgtcgatcctctgaattagacatattctttaaaaataagatccgttgtcagccatctaaaatgtttttataaattcatacttacattcttttttgccggttgcagtcagcctttagtgccaagagagaacattacagcatggatgaatgcaattggtttgatcatcactgccctaccagtgagttaataattgtgatttgtacttagtgatgaaatacagccagctgttccatgtcagcaaaaagaaaaagatgcatataggatgcccttgtacgggacgtcatgcaaattaatgaagtattttatgtttttaaagttttttcatattattactgctttaaaaatctacagtgactagtttttgcttttctgtattagatctaaatatatctatgtgacttacgggtctctgcattttctggtaccaccttacctatccaactttagtttttacataatagcttgatctactcttggccacttaacgtgttgtatatctacagcctttgttccttcagatagtgcttaagacatgttttaggtacttctgaatgtgagggaataagacatttttcttattccagaagcttcttctttccatcaccttctctaaagcctattcattctttgctagcttagagcctcctttctcagtgaatgaagccttccctgacttttccagctcacatgaagactcctttctctgacctccacacatatttttttaaagtttattatttttaaataagtaataaagctatagatttattgtttgataaattaattgatttactgcatagtgtatatcaggtacctaaatgagctggacagatacatgtatggagccccttaactcacagttacttctcccaggttgttactgacttaatttgaccagttacaaagccacccagctgtattgtgcagaagctggaaaaatagaaaactttaaagaatgagaaaacactattactttagactttggggtggaatgctggataagtgatatttttcactagctttcctccgattttaaaggagccatattggattgttcttcatgatcgaattgtgagtgtcatcagcagccccagcttgacgtctgaaacagagtgggttggctatccattccgcctctttgatttcactgcctgtcatcagtcctactctgagatgagttgtagctatacgttagctcttgcacatgctgtgtggcaccattctagcatcggacaactttctctcattccaaagtttcttactgaagtacttcttcctatagtgaagaccgaattccagttgctttatgtataccatcttgttggaccatttttacaaagatttcagcaagagagaactcgttgtatgatagagattggtgtggcgttttatgacatgctgctgaatgttgaccagtgtagcacccatttaaattacatggatcccatctgtgacttcctctatcacatgaagtatatgtttactggtgacagcgtgaaagagcaagtagagaagattatctgtaacttaaaaccagctttaaaacttcgtcttcgattcatcacacacattagcaagatggagccagctgcagtgcctccacaagccatgaacagtgggtctccagcacctcagtctaatcaggtgcccgtgtctttaccagtaactcagtgaagccagactgtactgtggagaaagtagaaatatatccgtctttgagagtggactcaaaccttttaaatctgaatgcgatcacactgtagtgatatagtagaagcagtgatgatattcagattgttttattttgattcaaatgatgaatctgttgacaccttataactcccatctccctatctatatttttgtctctaagagatcaagtaagatacatgttgttcatattcataacaacttattagagctatgtaggaacatagaggtatctgtgatcaaatgacttgtcattggcactttcagtctttcctattctagccgttgtttttgtttgtattttttattattaatgacatatttagtcttcagatatattattttaaaggcaccacacatgtaaaacagttattacaaatattttatacataaatctcttggtagattttcagaataatagagatttatatcaagaaaaggaatctagattttgttgcattgtaggagcaaacaaggcttcatattctttttaaaatgacttgaaattttattataaatttccatagtttctatcaaggtcaactggcagttttattacctttgctatggacttgaacttactgtataaaattagttggaagccatgtaagaaaataacatctgaaaattcttgaacttaaaatcatgcttaaatggttgattctccaatttctttttttaaaaataagttaattgcttttgcaggttgacactctcacctgacagatgatgtaattcttcaatttttataatcttaaaatttttaaattttatatttgtaaatacagtacacattttatttcttggattttgagagacattgttaattttgggggaattggcattgcgaaagacttgaaaactaatgagtaaagtctgctgaatgaataaaccnt

SEQ ID NO: 365568 - DNA, 4442 bp, Homo sapiens
  misc_feature (4441)..(4441): n is a, c, g, or t
gctgttggctgggctcgggagggaacgctccaggtaaagcgctgggggaggaagcgacgccgaggagctacggtttcctccagaggtctccgcccctctgcccctatattcccagagctcgagtctgatccgggccttgccgggcaccctggaaaggcgggggtgatagtacagatggagacgcaactgcagagcattttcgaagaggtggtgaaaacggaagttatagaagaggcttttcctggcatgtttatggatactcctgaagatgagaaaacaaaactaattagctgtttgggggccttcagacagttttggggtggtctttctcaggagtctcatgaacagtgtatccagtggattgttaagtttattcatggtcagcatagtcctaaaagaatttcttttctttatgactgcttagcaatggcagttgagactggtctccttccacccaggctggtttgtgaatccctgataaactctgacactcttgagtgggaaagaacacagctttgggccttaacatttaaactggttcggaaaataattgggggagtggattacaagggtgttcgagatctcttaaaagtgattttggagaagattttgacaattcctaatacagtgagctctgctgttgtacagcagcttctggcagcaagagaggttatagcatatatcttggaaagaaatgcctgcttattaccagcctattttgcagtcactgagatcaggaaactgtatcctgaaggcaaacttccacactggttacttggaaacctagtatcagactttgtggataccttcaggcccacagcaaggataaactccatttgtggtcgctgtagtcttctgccagttgtaaataattcgggtgccatttgtaattcatggaaactggatcctgctactcttcgttttcctttgaaaggccttttgccatatgataaggatctgtttgaaccacagactgctttgttgagatatgtattggagcagccttattccagggatatggtctgcaatatgctaggtttaaataagcagcacaagcagcgctgccctgtgctggaggaccagttggtggatctggttgtttatgccatggagcgatctgagaccgaggagaagtttgacgatgggggaacaagccaactcctgtggcagcatctctcaagtcagctcattttctttgtgcttttccagtttgcaagttttccacatatggtgctttctcttcatcagaagttagcagggcgaggactgattaaaggcagagatcatcttatgtgggttctcctgcaattcatttctggaagtattcagaaaaatgcactagctgattttctccctgtgatgaagctcttcgacttgctatacccagaaaaagaatatatcccagttcctgatattaacaaaccccagtcaacccatgcctttgcaatgacctgtatttggattcatctcaatagaaaagctcaaaatgacaactccaagctacagattccaatacctcattccctaagacttcaccatgagttcctgcagcagagtctaagaaataaaagtttacagatgaatgactataagattgctctattgtgtaatgcatactctacaaattcagaatgttttacattacccatgggagctctggtagaaactatttatggaaatggaattatgaggatacctctccctggaacaaactgtatggcttcaggatctattacccccttacctatgaacctcctggattcactgacagttcatgccaaaatgagccttattcacagcattgcaaccagggtgataaaacttgctcatgcaaagtccagtgtggccttggctccagccctagtggaaacttacagtcgtttattggtctatatggaaatagagtctttgggcatcaaaggatttatcagtcagcttttgccaactgttttcaaatcacatgcatgggggatcttacacacactccttgagatgtttagctaccggatgcatcatattcagcctcattacagagttcagctcctgagtcatcttcatactttggctgcagttgcacaaacaaaccagaaccagctccatctttgtgtcgagagcactgctctcaggcttataacagcattaggtagctcagaggtacaaccgcagtttacacgcttccttagtgatcccaaaacagtgctctcagcagaatctgaagaactgaaccgagccttgatattgaccttggctagagcaactcatgtaacagatttttttacaggctctgattcaattcagggaacttggtgtaaagacatacttcagaccatcatgagtttcactcctcataattgggcttcacacaccctgagctgttttccaggcccactacaggcattcttcaaacaaaataatgtgcctcaggaaagccgttttaatctgaaaaaaaatgtggaggaggagtataggaagtggaagtcaatgagcaacgaaaacgacattattacccacttctctatgcagggctcccctcctctctttctttgtcttctctggaaaatgctcttggaaacagatcatattaatcagattggctatagagtattagagagaattggagccagggccttggtagcccatgtgaggacatttgcagatttcctggtatatgagttttctacatcagcagggggtcagcaactcaataaatgcattgaaattcttaatgacatggtatggaagtataacattgttacactggacagattaattctctgcctggccatgcgtagtcacgaaggaaatgaagcccaggtttgttatttcataattcagttgctgttactcaaaccaaacgattttagaaatcgagtaagtgactttgtgaaggaaaattccccagagcactggttacagaatgactggcacaccaagcacatgaattatcacaagaaatatccagagaagttgtattttgagggcctcgcggaacaggtggatcctcctgtacagatccagtctccctatctgcccatctattttgggaatgtgtgtcttcgattccttccagtatttgatatagtaatccacagatttttagagttgcttccggtatccaaatcactggagactctactggatcatctaggaggcttatataaatttcatgatcgtccagtgacttatctgtataacactctgcactattatgaaatgcacctgagagaccgcgcatttctcaaacgaaaactcgtccatgcgatcattggctctctgaaggataatcgaccgcagggctggtgtctaagtgacacttacctgaaatgcgctatgaatgcacgagaggaaaatccttgggttccagatgacacctactattgcagattgattggcagactagtcgatacgatggctggcaaatctcctggtccctttccaaactgtgactggagattcaatgagtttcccaacccagctgcccatgctctccatgttacttgtgtggagctcatggccttggcagtttcaggcaaagaagttgggaatgcccttctaaatgttgtcctaaaaagtcagcctttagtgccaagagagaacattacagcatggatgaatgcaattggtttgatcatcactgccctaccagagccatattggattgttcttcatgatcgaattgtgagtgtcatcagcagccccagcttgacgtctgaaacagagtgggttggctatccattccgcctctttgatttcactgcctgtcatcagtcctactctgagatgagttgtagctatacgttagctcttgcacatgctgtgtggcaccattctagcatcggacaactttctctcattccaaagtttcttactgaagtacttcttcctatagtgaagaccgaattccagttgctttatgtataccatcttgttggaccatttttacaaagatttcagcaagagagaactcgttgtatgatagagattggtgtggcgttttatgacatgctgctgaatgttgaccagtgtagcacccatttaaattacatggatcccatctgtgacttcctctatcacatgaagtatatgtttactggtgacagcgtgaaagagcaagtagagaagattatctgtaacttaaaaccagctttaaaacttcgtcttcgattcatcacacacattagcaagatggagccagctgcagtgcctccacaagccatgaacagtgggtctccagcacctcagtctaatcaggttgacactctcacctgacagatgatgtaattcttcaatttttataatcttaaaatttttaaattttatatttgtaaatacagtacacattttatttcttggattttgagagacattgttaattttgggggaattggcattgcgaaagacttgaaaactaatgagtaaagtctgctgaatgaataaaccnt

SEQ ID NO: 365569 - DNA, 802 bp, Homo sapiens
  misc_feature (32)..(32): n is a, c, g, or t
  misc_feature (801)..(801): n is a, c, g, or t
ccaaatggaatccccaaatggaatccccccanatggaaccatctccctatctatatttttgtctctaagagatcaagtaagatacatgttgttcatattcataacaacttattagagctatgtaggaacatagaggtatctgtgatcaaatgacttgtcattggcactttcagtctttcctattctagccgttgtttttgtttgtattttttattattaatgacatatttagtcttcagatatattattttaaaggcaccacacatgtaaaacagttattacaaatattttatacataaatctcttggtagattttcagaataatagagatttatatcaagaaaaggaatctagattttgttgcattgtaggagcaaacaaggcttcatattctttttaaaatgacttgaaattttattataaatttccatagtttctatcaaggtcaactggcagttttattacctttgctatggacttgaacttactgtataaaattagttggaagccatgtaagaaaataacatctgaaaattcttgaacttaaaatcatgcttaaatggttgattctccaatttctttttttaaaaataagttaattgcttttgcaggttgacactctcacctgacagatgatgtaattcttcaatttttataatcttaaaatttttaaattttatatttgtaaatacagtacacattttatttcttggattttgagagacattgttaattttgggggaattggcattgcgaaagacttgaaaactaatgagtaaagtctgctgaatgaataaaccnt

SEQ ID NO: 365570 - DNA, 471 bp, Homo sapiens
aactggcgagtgattttttagaaggaagcaaaagggagctaacctttaaacagttatcatgtgcaatctttacatatattatctcattttatataaatgttcatatatttcaggggcagtctcaattttccttttgtacgtatttatttgacttccctctttctttctctctttagttacttggaaacctagtatcagactttgtggataccttcaggcccacagcaaggataaactccatttgtggtaggattataattttaaatatgccaaatagtacctgatttttagtaatctaattattgaacaaagctgagggatgttctcttaatatgtgccttggtggcttgtcattttggtgactctctaagagcttaatataatgcctttcccttgttttcacttactctgtgtgccaagtacagggaggaaaaagaaactctctggaatgggtttaagcttcatttaaaa

SEQ ID NO: 365571 - DNA, 4579 bp, Homo sapiens
gctgttggctgggctcgggagggaacgctccaggtaaagcgctgggggaggaagcgacgccgaggagctacggtttcctccagaggtctccgcccctctgcccctatattcccagagctcgagtctgatccgggccttgccgggcaccctggaaaggcgggggtgatagtacagatggagacgcaactgcagagcattttcgaagaggtggtgaaaacggaagttatagaagaggcttttcctggcatgtttatggatactcctgaagatgagaaaacaaaactaattagctgtttgggggccttcagacagttttggggtggtctttctcaggagtctcatgaacagtgtatccagtggattgttaagtttattcatggtcagcatagtcctaaaagaatttcttttctttatgactgcttagcaatggcagttgagactggtctccttccacccaggctggtttgtgaatccctgataaactctgacactcttgagtgggaaagaacacagctttgggccttaacatttaaactggttcggaaaataattgggggagtggattacaagggtgttcgagatctcttaaaagtgattttggagaagattttgacaattcctaatacagtgagctctgctgttgtacagcagcttctggcagcaagagaggttatagcatatatcttggaaagaaatgcctgcttattaccagcctattttgcagtcactgagatcaggaaactgtatcctgaaggcaaacttccacactggttacttggaaacctagtatcagactttgtggataccttcaggcccacagcaaggataaactccatttgtggtcgctgtagtcttctgccagttgtaaataattcgggtgccatttgtaattcatggaaactggatcctgctactcttcgttttcctttgaaaggccttttgccatatgataaggatctgtttgaaccacagactgctttgttgagatatgtattggagcagccttattccagggatatggtctgcaatatgctaggtttaaataagcagcacaagcagcgctgccctgtgctggaggaccagttggtggatctggttgtttatgccatggagcgatctgagaccgaggagaagtttgacgatgggggaacaagccaactcctgtggcagcatctctcaagtcagctcattttctttgtgcttttccagtttgcaagttttccacatatggtgctttctcttcatcagaagttagcagggcgaggactgattaaaggcagagatcatcttatgtgggttctcctgcaattcatttctggaagtattcagaaaaatgcactagctgattttctccctgtgatgaagctcttcgacttgctatacccagaaaaagaatatatcccagttcctgatattaacaaaccccagtcaacccatgcctttgcaatgacctgtatttggattcatctcaatagaaaagctcaaaatgacaactccaagctacagattccaatacctcattccctaagacttcaccatgagttcctgcagcagagtctaagaaataaaagtttacagatgaatgactataagattgctctattgtgtaatgcatactctacaaattcagaatgttttacattacccatgggagctctggtagaaactatttatggaaatggaattatgaggatacctctccctggaacaaactgtatggcttcaggatctattacccccttacctatgaacctcctggattcactgacagttcatgccaaaatgagccttattcacagcattgcaaccagggtgataaaacttgctcatgcaaagtccagtgtggccttggctccagccctagtggaaacttacagtcgtttattggtctatatggaaatagagtctttgggcatcaaaggatttatcagtcagcttttgccaactgttttcaaatcacatgcatgggggatcttacacacactccttgagatgtttagctaccggatgcatcatattcagcctcattacagagttcagctcctgagtcatcttcatactttggctgcagttgcacaaacaaaccagaaccagctccatctttgtgtcgagagcactgctctcaggcttataacagcattaggtagctcagaggtacaaccgcagtttacacgcttccttagtgatcccaaaacagtgctctcagcagaatctgaagaactgaaccgagccttgatattgaccttggctagagcaactcatgtaacagatttttttacaggctctgattcaattcagggaacttggtgtaaagacatacttcagaccatcatgagtttcactcctcataattgggcttcacacaccctgagctgttttccaggcccactacaggcattcttcaaacaaaataatgtgcctcaggaaagccgttttaatctgaaaaaaaatgtggaggaggagtataggaagtggaagtcaatgagcaacgaaaacgacattattacccacttctctatgcagggctcccctcctctctttctttgtcttctctggaaaatgctcttggaaacagatcatattaatcagattggctatagagtattagagagaattggagccagggccttggtagcccatgtgaggacatttgcagatttcctggtatatgagttttctacatcagcagggggtcagcaactcaataaatgcattgaaattcttaatgacatggtatggaagtataacattgttacactggacagattaattctctgcctggccatgcgtagtcacgaaggaaatgaagcccaggtttgttatttcataattcagttgctgttactcaaaccaaacgattttagaaatcgagtaagtgactttgtgaaggaaaattccccagagcactggttacagaatgactggcacaccaagcacatgaattatcacaagaaatatccagagaagttgtattttgagggcctcgcggaacaggtggatcctcctgtacagatccagtctccctatctgcccatctattttgggaatgtgtgtcttcgattccttccagtatttgatatagtaatccacagatttttagagttgcttccggtatccaaatcactggagactctactggatcatctaggaggcttatataaatttcatgatcgtccagtgacttatctgtataacactctgcactattatgaaatgcacctgagagaccgcgcatttctcaaacgaaaactcgtccatgcgatcattggctctctgaaggataatcgaccgcagggctggtgtctaagtgacacttacctgaaatgcgctatgaatgcacgagaggaaaatccttgggttccagatgacacctactattgcagattgattggcagactagtcgatacgatggctggcaaatctcctggtccctttccaaactgtgactggagattcaatgagtttcccaacccagctgcccatgctctccatgttacttgtgtggagctcatggccttggcagtttcaggcaaagaagttgggaatgcccttctaaatgttgtcctaaaaagtcagcctttagtgccaagagagaacattacagcatggatgaatgcaattggtttgatcatcactgccctaccagagccatattggattgttcttcatgatcgaattgtgagtgtcatcagcagccccagcttgacgtctgaaacagagtgggttggctatccattccgcctctttgatttcactgcctgtcatcagtcctactctgagatgagttgtagctatacgttagctcttgcacatgctgtgtggcaccattctagcatcggacaactttctctcattccaaagtttcttactgaagtacttcttcctatagtgaagaccgaattccagttgctttatgtataccatcttgttggaccatttttacaaagatttcagcaagagagaactcgttgtatgatagagattggtgtggcgttttatgacatgctgctgaatgttgaccagtgtagcacccatttaaattacatggatcccatctgtgacttcctctatcacatgaagtatatgtttactggtgacagcgtgaaagagcaagtagagaagattatctgtaacttaaaaccagctttaaaacttcgtcttcgattcatcacacacattagcaagatggagccagctgcagtgcctccacaagccatgaacagtgggtctccagcacctcagtctaatcagtaaaaagtcagagtacacagcaagggttccaaattaagaggaagcaaaacgctgcccagatcctgagaaacctggagaaaatcaaccttagtagtttcaactcatacattgtcttgtttgattttgttctttgttttttatcctctttaagcacagatgcgtgttgaagtctaaggtgttctgtcatcacactctctttactagaataagtgtgcccaggcagaaaaaaaagtgtattcaatgttgctggcatgtgtggattcacagctcgtggctgtaaggaaatctgggggtttcataaatccattaaaatccttttagagttgcc

SEQ ID NO: 365572 - DNA, 6073 bp, Homo sapiens
  misc_feature (6072)..(6072): n is a, c, g, or t
gctgttggctgggctcgggagggaacgctccaggtaaagcgctgggggaggaagcgacgccgaggagctacggtttcctccagaggtctccgcccctctgcccctatattcccagagctcgagtctgatccgggccttgccgggcaccctggaaaggcgggggtgatagtacagatggagacgcaactgcagagcattttcgaagaggtggtgaaaacggaagttatagaagaggcttttcctggcatgtttatggatactcctgaagatgagaaaacaaaactaattagctgtttgggggccttcagacagttttggggtggtctttctcaggagtctcatgaacagtgtatccagtggattgttaagtttattcatggtcagcatagtcctaaaagaatttcttttctttatgactgcttagcaatggcagttgagactggtctccttccacccaggctggtttgtgaatccctgataaactctgacactcttgagtgggaaagaacacagctttgggccttaacatttaaactggttcggaaaataattgggggagtggattacaagggtgttcgagatctcttaaaagtgattttggagaagattttgacaattcctaatacagtgagctctgctgttgtacagcagcttctggcagcaagagaggttatagcatatatcttggaaagaaatgcctgcttattaccagcctattttgcagtcactgagatcaggaaactgtatcctgaaggcaaacttccacactggttacttggaaacctagtatcagactttgtggataccttcaggcccacagcaaggataaactccatttgtggtcgctgtagtcttctgccagttgtaaataattcgggtgccatttgtaattcatggaaactggatcctgctactcttcgttttcctttgaaaggccttttgccatatgataaggatctgtttgaaccacagactgctttgttgagatatgtattggagcagccttattccagggatatggtctgcaatatgctaggtttaaataagcagcacaagcagcgctgccctgtgctggaggaccagttggtggatctggttgtttatgccatggagcgatctgagaccgaggagaagtttgacgatgggggaacaagccaactcctgtggcagcatctctcaagtcagctcattttctttgtgcttttccagtttgcaagttttccacatatggtgctttctcttcatcagaagttagcagggcgaggactgattaaaggcagagatcatcttatgtgggttctcctgcaattcatttctggaagtattcagaaaaatgcactagctgattttctccctgtgatgaagctcttcgacttgctatacccagaaaaagaatatatcccagttcctgatattaacaaaccccagtcaacccatgcctttgcaatgacctgtatttggattcatctcaatagaaaagctcaaaatgacaactccaagctacagattccaatacctcattccctaagacttcaccatgagttcctgcagcagagtctaagaaataaaagtttacagatgaatgactataagattgctctattgtgtaatgcatactctacaaattcagaatgttttacattacccatgggagctctggtagaaactatttatggaaatggaattatgaggatacctctccctggaacaaactgtatggcttcaggatctattacccccttacctatgaacctcctggattcactgacagttcatgccaaaatgagccttattcacagcattgcaaccagggtgataaaacttgctcatgcaaagtccagtgtggccttggctccagccctagtggaaacttacagtcgtttattggtctatatggaaatagagtctttgggcatcaaaggatttatcagtcagcttttgccaactgttttcaaatcacatgcatgggggatcttacacacactccttgagatgtttagctaccggatgcatcatattcagcctcattacagagttcagctcctgagtcatcttcatactttggctgcagttgcacaaacaaaccagaaccagctccatctttgtgtcgagagcactgctctcaggcttataacagcattaggtagctcagaggtacaaccgcagtttacacgcttccttagtgatcccaaaacagtgctctcagcagaatctgaagaactgaaccgagccttgatattgaccttggctagagcaactcatgtaacagatttttttacaggctctgattcaattcagggaacttggtgtaaagacatacttcagaccatcatgagtttcactcctcataattgggcttcacacaccctgagctgttttccaggcccactacaggcattcttcaaacaaaataatgtgcctcaggaaagccgttttaatctgaaaaaaaatgtggaggaggagtataggaagtggaagtcaatgagcaacgaaaacgacattattacccacttctctatgcagggctcccctcctctctttctttgtcttctctggaaaatgctcttggaaacagatcatattaatcagattggctatagagtattagagagaattggagccagggccttggtagcccatgtgaggacatttgcagatttcctggtatatgagttttctacatcagcagggggtcagcaactcaataaatgcattgaaattcttaatgacatggtatggaagtataacattgttacactggacagattaattctctgcctggccatgcgtagtcacgaaggaaatgaagcccaggtttgttatttcataattcagttgctgttactcaaaccaaacgattttagaaatcgagtaagtgactttgtgaaggaaaattccccagagcactggttacagaatgactggcacaccaagcacatgaattatcacaagaaatatccagagaagttgtattttgagggcctcgcggaacaggtggatcctcctgtacagatccagtctccctatctgcccatctattttgggaatgtgtgtcttcgattccttccagtatttgatatagtaatccacagatttttagagttgcttccggtatccaaatcactggagactctactggatcatctaggaggcttatataaatttcatgatcgtccagtgacttatctgtataacactctgcactattatgaaatgcacctgagagaccgcgcatttctcaaacgaaaactcgtccatgcgatcattggctctctgaaggataatcgaccgcagggctggtgtctaagtgacacttacctgaaatgcgctatgaatgcacgagaggaaaatccttgggttccagatgacacctactattgcagattgattggcagactagtcgatacgatggctggcaaatctcctggtccctttccaaactgtgactggagattcaatgagtttcccaacccagctgcccatgctctccatgttacttgtgtggagctcatggccttggcagtttcaggcaaagaagttgggaatgcccttctaaatgttgtcctaaaaagtcagcctttagtgccaagagagaacattacagcatggatgaatgcaattggtttgatcatcactgccctaccagtgagttaataattgtgatttgtacttagtgatgaaatacagccagctgttccatgtcagcaaaaagaaaaagatgcatataggatgcccttgtacgggacgtcatgcaaattaatgaagtattttatgtttttaaagttttttcatattattactgctttaaaaatctacagtgactagtttttgcttttctgtattagatctaaatatatctatgtgacttacgggtctctgcattttctggtaccaccttacctatccaactttagtttttacataatagcttgatctactcttggccacttaacgtgttgtatatctacagcctttgttccttcagatagtgcttaagacatgttttaggtacttctgaatgtgagggaataagacatttttcttattccagaagcttcttctttccatcaccttctctaaagcctattcattctttgctagcttagagcctcctttctcagtgaatgaagccttccctgacttttccagctcacatgaagactcctttctctgacctccacacatatttttttaaagtttattatttttaaataagtaataaagctatagatttattgtttgataaattaattgatttactgcatagtgtatatcaggtacctaaatgagctggacagatacatgtatggagccccttaactcacagttacttctcccaggttgttactgacttaatttgaccagttacaaagccacccagctgtattgtgcagaagctggaaaaatagaaaactttaaagaatgagaaaacactattactttagactttggggtggaatgctggataagtgatatttttcactagctttcctccgattttaaaggagccatattggattgttcttcatgatcgaattgtgagtgtcatcagcagccccagcttgacgtctgaaacagagtgggttggctatccattccgcctctttgatttcactgcctgtcatcagtcctactctgagatgagttgtagctatacgttagctcttgcacatgctgtgtggcaccattctagcatcggacaactttctctcattccaaagtttcttactgaagtacttcttcctatagtgaagaccgaattccagttgctttatgtataccatcttgttggaccatttttacaaagatttcagcaagagagaactcgttgtatgatagagattggtgtggcgttttatgacatgctgctgaatgttgaccagtgtagcacccatttaaattacatggatcccatctgtgacttcctctatcacatgaagtatatgtttactggtgacagcgtgaaagagcaagtagagaagattatctgtaacttaaaaccagctttaaaacttcgtcttcgattcatcacacacattagcaagatggagccagctgcagtgcctccacaagccatgaacagtgggtctccagcacctcagtctaatcaggtgcccgtgtctttaccagtaactcagtgaagccagactgtactgtggagaaagtagaaatatatccgtctttgagagtggactcaaaccttttaaatctgaatgcgatcacactgtagtgatatagtagaagcagtgatgatattcagattgttttattttgattcaaatgatgaatctgttgacaccttataactcccatctccctatctatatttttgtctctaagagatcaagtaagatacatgttgttcatattcataacaacttattagagctatgtaggaacatagaggtatctgtgatcaaatgacttgtcattggcactttcagtctttcctattctagccgttgtttttgtttgtattttttattattaatgacatatttagtcttcagatatattattttaaaggcaccacacatgtaaaacagttattacaaatattttatacataaatctcttggtagattttcagaataatagagatttatatcaagaaaaggaatctagattttgttgcattgtaggagcaaacaaggcttcatattctttttaaaatgacttgaaattttattataaatttccatagtttctatcaaggtcaactggcagttttattacctttgctatggacttgaacttactgtataaaattagttggaagccatgtaagaaaataacatctgaaaattcttgaacttaaaatcatgcttaaatggttgattctccaatttctttttttaaaaataagttaattgcttttgcaggttgacactctcacctgacagatgatgtaattcttcaatttttataatcttaaaatttttaaattttatatttgtaaatacagtacacattttatttcttggattttgagagacattgttaattttgggggaattggcattgcgaaagacttgaaaactaatgagtaaagtctgctgaatgaataaaccnt

SEQ ID NO: 365573 - DNA, 4924 bp, Homo sapiens
gctgttggctgggctcgggagggaacgctccaggtaaagcgctgggggaggaagcgacgccgaggagctacggtttcctccagaggtctccgcccctctgcccctatattcccagagctcgagtctgatccgggccttgccgggcaccctggaaaggcgggggtgatagtacagatggagacgcaactgcagagcattttcgaagaggtggtgaaaacggaagttatagaagaggcttttcctggcatgtttatggatactcctgaagatgagaaaacaaaactaattagctgtttgggggccttcagacagttttggggtggtctttctcaggagtctcatgaacagtgtatccagtggattgttaagtttattcatggtcagcatagtcctaaaagaatttcttttctttatgactgcttagcaatggcagttgagactggtctccttccacccaggctggtttgtgaatccctgataaactctgacactcttgagtgggaaagaacacagctttgggccttaacatttaaactggttcggaaaataattgggggagtggattacaagggtgttcgagatctcttaaaagtgattttggagaagattttgacaattcctaatacagtgagctctgctgttgtacagcagcttctggcagcaagagaggttatagcatatatcttggaaagaaatgcctgcttattaccagcctattttgcagtcactgagatcaggaaactgtatcctgaaggcaaacttccacactggttacttggaaacctagtatcagactttgtggataccttcaggcccacagcaaggataaactccatttgtggtcgctgtagtcttctgccagttgtaaataattcgggtgccatttgtaattcatggaaactggatcctgctactcttcgttttcctttgaaaggccttttgccatatgataaggatctgtttgaaccacagactgctttgttgagatatgtattggagcagccttattccagggatatggtctgcaatatgctaggtttaaataagcagcacaagcagcgctgccctgtgctggaggaccagttggtggatctggttgtttatgccatggagcgatctgagaccgaggagaagtttgacgatgggggaacaagccaactcctgtggcagcatctctcaagtcagctcattttctttgtgcttttccagtttgcaagttttccacatatggtgctttctcttcatcagaagttagcagggcgaggactgattaaaggcagagatcatcttatgtgggttctcctgcaattcatttctggaagtattcagaaaaatgcactagctgattttctccctgtgatgaagctcttcgacttgctatacccagaaaaagaatatatcccagttcctgatattaacaaaccccagtcaacccatgcctttgcaatgacctgtatttggattcatctcaatagaaaagctcaaaatgacaactccaagctacagattccaatacctcattccctaagacttcaccatgagttcctgcagcagagtctaagaaataaaagtttacagatgaatgactataagattgctctattgtgtaatgcatactctacaaattcagaatgttttacattacccatgggagctctggtagaaactatttatggaaatggaattatgaggatacctctccctggaacaaactgtatggcttcaggatctattacccccttacctatgaacctcctggattcactgacagttcatgccaaaatgagccttattcacagcattgcaaccagggtgataaaacttgctcatgcaaagtccagtgtggccttggctccagccctagtggaaacttacagtcgtttattggtctatatggaaatagagtctttgggcatcaaaggatttatcagtcagcttttgccaactgttttcaaatcacatgcatgggggatcttacacacactccttgagatgtttagctaccggatgcatcatattcagcctcattacagagttcagctcctgagtcatcttcatactttggctgcagttgcacaaacaaaccagaaccagctccatctttgtgtcgagagcactgctctcaggcttataacagcattaggtagctcagaggtacaaccgcagtttacacgcttccttagtgatcccaaaacagtgctctcagcagaatctgaagaactgaaccgagccttgatattgaccttggctagagcaactcatgtaacagatttttttacaggctctgattcaattcagggaacttggtgtaaagacatacttcagaccatcatgagtttcactcctcataattgggcttcacacaccctgagctgttttccaggcccactacaggcattcttcaaacaaaataatgtgcctcaggaaagccgttttaatctgaaaaaaaatgtggaggaggagtataggaagtggaagtcaatgagcaacgaaaacgacattattacccacttctctatgcagggctcccctcctctctttctttgtcttctctggaaaatgctcttggaaacagatcatattaatcagattggctatagagtattagagagaattggagccagggccttggtagcccatgtgaggacatttgcagatttcctggtatatgagttttctacatcagcagggggtcagcaactcaataaatgcattgaaattcttaatgacatggtatggaagtataacattgttacactggacagattaattctctgcctggccatgcgtagtcacgaaggaaatgaagcccaggtttgttatttcataattcagttgctgttactcaaaccaaacgattttagaaatcgagtaagtgactttgtgaaggaaaattccccagagcactggttacagaatgactggcacaccaagcacatgaattatcacaagaaatatccagagaagttgtattttgagggcctcgcggaacaggtggatcctcctgtacagatccagtctccctatctgcccatctattttgggaatgtgtgtcttcgattccttccagtatttgatatagtaatccacagatttttagagttgcttccggtatccaaatcactggagactctactggatcatctaggaggcttatataaatttcatgatcgtccagtgacttatctgtataacactctgcactattatgaaatgcacctgagagaccgcgcatttctcaaacgaaaactcgtccatgcgatcattggctctctgaaggataatcgaccgcagggctggtgtctaagtgacacttacctgaaatgcgctatgaatgcacgagaggaaaatccttgggttccagatgacacctactattgcagattgattggcagactagtcgatacgatggctggcaaatctcctggtccctttccaaactgtgactggagattcaatgagtttcccaacccagctgcccatgctctccatgttacttgtgtggagctcatggccttggcagtttcaggcaaagaagttgggaatgcccttctaaatgttgtcctaaaaagtcagcctttagtgccaagagagaacattacagcatggatgaatgcaattggtttgatcatcactgccctaccagagccatattggattgttcttcatgatcgaattgtgagtgtcatcagcagccccagcttgacgtctgaaacagagtgggttggctatccattccgcctctttgatttcactgcctgtcatcagtcctactctgagatgagttgtagctatacgttagctcttgcacatgctgtgtggcaccattctagcatcggacaactttctctcattccaaagtttcttactgaagtacttcttcctatagtgaagaccgaattccagttgctttatgtataccatcttgttggaccatttttacaaagatttcagcaagagagaactcgttgtatgatagagattggtgtggcgttttatgacatgctgctgaatgttgaccagtgtagcacccatttaaattacatggatcccatctgtgacttcctctatcacatgaagtatatgtttactggtgacagcgtgaaagagcaagtagagaagattatctgtaacttaaaaccagctttaaaacttcgtcttcgattcatcacacacattagcaagatggagccagctgcagtgcctccacaagccatgaacagtgggtctccagcacctcagtctaatcagtaaaaagtcagagtacacagcaagggttccaaattaagaggaagcaaaacgctgcccagatcctgagaaacctggagaaaatcaaccttagtagtttcaactcatacattgtcttgtttgattttgttctttgttttttatcctctttaagcacagatgcgtgttgaagtctaaggtgttctgtcatcacactctctttactagaataagtgtgcccaggcagaaaaaaaagtgtattcaatgttgctggcatgtgtggattcacagctcgtggctgtaaggaaatctgggggtttcataaatccattaaaatccttttagagttgccaacccgcagtaggattttctttctttttttgttctttttttccccttccaagtgaggcacataaaggattctacctagtccatgaatgaacagtttcatagaaacattaaaaccctaacataacatgaattattcacaaagttgcatgaaacaataatatttaggttatccaaattataagaagcctgaaggttaccaccaaactattaaatttttctaggcattaattacataactaaacaaatgtatttcttaaaattctctcttcctctacatacacacagtaacatcaaaaacaacaagagcaactaaacctcaatgagtagctacaatgcagaaagagtc

SEQ ID NO: 365574 - DNA, 1512 bp, Homo sapiens
gctgttggctgggctcgggagggaacgctccaggtaaagcgctgggggaggaagcgacgccgaggagctacggtttcctccagaggtctccgcccctctgcccctatattcccagagctcgagtctgatccgggccttgccgggcaccctggaaaggcgggggtgatagtacagatggagacgcaactgcagagcattttcgaagaggtggtgaaaacggaagttatagaagaggcttttcctggcatgtttatggatactcctgaagatgagaaaacaaaactaattagctgtttgggggccttcagacagttttggggtggtctttctcaggagtctcatgaacagtgtatccagtggattgttaagtttattcatggtcagcatagtcctaaaagaatttcttttctttatgactgcttagcaatggcagttgagactggtctccttccacccaggctggtttgtgaatccctgataaactctgacactcttgagtgggaaagaacacagctttgggccttaacatttaaactggttcggaaaataattgggggagtggattacaagggtgttcgagatctcttaaaagtgattttggagaagattttgacaattcctaatacagtgagctctgctgttgtacagcagcttctggcagcaagagaggttatagcatatatcttggaaagaaatgcctgcttattaccagcctattttgcagtcactgagatcaggaaactgtatcctgaaggcaaacttccacactggttacttggaaacctagtatcagactttgtggataccttcaggcccacagcaaggataaactccatttgtggtcgctgtagtcttctgccagttgtaaataattcgggtgccatttgtaattcatggaaactggatcctgctactcttcgttttcctttgaaaggccttttgccatatgataaggatctgtttgaaccacagactgctttgttgagatatgtattggagcagccttattccagggatatggtctgcaatatgctaggtttaaataagcagcacaagcagcgctgccctgtgctggaggaccagttggtggatctggttgtttatgccatggagcgatctgagaccgaggagaagtttgacgatgggggaacaagccaactcctgtggcagcatctctcaagtcagctcattttctttgtgcttttccagtttgcaagttttccacatatggtgctttctcttcatcagaaggtatgtactaaatcttatggtcggagtgacttcacctgttgattactgtattttagactgctgtgggcattccctagtgattttagaactgacagaagttctgagccctaatttctgtcctgtttagtgcttttatagtttcttaactttttactttcttgtcacctgtaaaaacaggattcagtcattcattctatgtattctcagtgcaggcaccagcagatacaagatgaaaaggcactgtatatcctcaaggagcac

SEQ ID NO: 365575 - DNA, 1081 bp, Homo sapiens
gatgtatccccactttccccatcagcttaccctccagcaaatacgagactatacccttcaatatccagcactcagggctcaaccatgtgttttgggagcaagggaatggggttcctctaggtcaggaatcggcaaactcagtactcaagccagatctggccagctgcctacaagctgataatggttttttttatttttaaatggttacattgtaaactgttatataagtacctgataatatcattaattttgtttcttggcctgccatgcttaaaatattaactctctggccctttaagaaaaaaacgtgctgacccctgctctagatcaaagaaaacaaacctcaaaaatactttcctccctctaccccacttgacccttgtcccggggcagtaggcatctccgtcaaaactcttgtccctggtctgtggtaactttctcagctccccaacccatgtccctcaaagtcccctccctatagggcaagaacccagcaacttcgctctgccccgactctaggcgggatgtagctcattttgggatacgagtctccatcgtggagcctggcttcttccgaacccctgtgaccaacctggagagtctggagaaaaccctgcaggcctgctgggcacggctgcctcctgccacacaggcccactatgggggggccttcctcaccaagtacctgaaaatgcaacagcgcatcatgaacctgatctgtgacccggacctaaccaaggtgagccgatgcctggagcatgccctgactgctcgacacccccgaacccgctacagcccaggttgggatgccaagctgctctggctgcctgcctcctacctgccagccagcctggtggatgctgtgctcacctgggtccttcccaagcctgcccaagcagtctactgaatccagccttccagcaagagattgtttttcaaggacaaggactttgatttatttctgcccccaccctggtactgcctggtgcctgccacaaaataagcactaacaaaagtgtattgtttaaaaaataaaaagaaggtgggcagaaatgtgcccagtggaaaaaatgaccccatt

SEQ ID NO: 365576 - DNA, 499 bp, Homo sapiens
actccggactttggccttagcagtagttagtgtgggaggctgggaagactgggagcagtctcttaaacaaaagcaaaagaataagcttcgggcgctgtagtacctgccagctttcgccacaggaggtaagtggatactgggagctgggggaactgagaagactagccagatattacatgtattgccaactcaaaactttcagcttttaacatgcttcctcacacattatcccctttgatcctccacaactctgaggtggacctggtgggtcttagccccacttggtagatgagaaaataggttgagagagacagtgagatgctcagtatcacacagcaaacctcttggccctatacatcattccaaacacaagacccaggttgcatatagaaggttcagtgtccctggtttagaaggagaggtggtgtgaggcaagcaagaagatgcctctgctgcactccagcctgggcgacagagtgagactccatctcaaaaaaaa

SEQ ID NO: 365577 - DNA, 1288 bp, Homo sapiens
actccggactttggccttagcagtagttagtgtgggaggctgggaagactgggagcagtctcttaaacaaaagcaaaagaataagcttcgggcgctgtagtacctgccagctttcgccacaggaggctgccacctgtaggtcacttgggctccagctatgtggctgcctcttctgctgggtgccttactctgggcagtgctgtggttgctcagggaccggcagagcctgcccgccagcaatgcctttgtcttcatcaccggctgtgactcaggctttgggcgccttctggcactgcagctggaccagagaggcttccgagtcctggccagctgcctgaccccctccggggccgaggacctgcagcgggtggcctcctcccgcctccacaccaccctgttggatatcactgatccccagagcgtccagcaggcagccaagtgggtggagatgcacgttaaggaagcagggctttttggtctggtgaataatgctggtgtggctggtatcatcggacccacaccatggctgacccgggacgatttccagcgggtgctgaatgtgaacacaatgggtcccatcggggtcacccttgccctgctgcctctgctgcagcaagcccggggccgggtgatcaacatcaccagcgtcctgggtcgcctggcagccaatggtgggggctactgtgtctccaaatttggcctggaggccttctctgacagcctgaggcgggatgtagctcattttgggatacgagtctccatcgtggagcctggcttcttccgaacccctgtgaccaacctggagagtctggagaaaaccctgcaggcctgctgggcacggctgcctcctgccacacaggcccactatgggggggccttcctcaccaagtacctgaaaatgcaacagcgcatcatgaacctgatctgtgacccggacctaaccaaggtgagccgatgcctggagcatgccctgactgctcgacacccccgaacccgctacagcccaggttgggatgccaagctgctctggctgcctgcctcctacctgccagccagcctggtggatgctgtgctcacctgggtccttcccaagcctgcccaagcagtctactgaatccagccttccagcaagagattgtttttcaaggacaaggactttgatttatttctgcccccaccctggtactgcctggtgcctgccacaaaataagcactaacaaaagtgtattgtttaaaaaataaaaagaaggtgggcagaaatgtgcccagtggaaaaaatgaccccatt

SEQ ID NO: 365578 - DNA, 1150 bp, Homo sapiens
agcgttccagcttccggagccggagggggcccggcgtacccagcccccagcccgacgtgaccatgctgtcccgcctcctaaaagaacaccaggccaagcagaatgaacgcaaggagctgcaggaaaagaggaggcgagaggctatcactgcagcgacctgcctgacagaagctttggtggatcacctcaatgtgggtgtggcccaggcctacatgaaccagagaaagctggaccatgaggtgaagaccctacaggtccaggctgcccaatttgccaagcagacaggccagtggatcggaatggtggagaacttcaaccaggcactcaagggctttttggtctggtgaataatgctggtgtggctggtatcatcggacccacaccatggctgacccgggacgatttccagcgggtgctgaatgtgaacacaatgggtcccatcggggtcacccttgccctgctgcctctgctgcagcaagcccggggccgggtgatcaacatcaccagcgtcctgggtcgcctggcagccaatggtgggggctactgtgtctccaaatttggcctggaggccttctctgacagcctgaggcgggatgtagctcattttgggatacgagtctccatcgtggagcctggcttcttccgaacccctgtgaccaacctggagagtctggagaaaaccctgcaggcctgctgggcacggctgcctcctgccacacaggcccactatgggggggccttcctcaccaagtacctgaaaatgcaacagcgcatcatgaacctgatctgtgacccggacctaaccaaggtgagccgatgcctggagcatgccctgactgctcgacacccccgaacccgctacagcccaggttgggatgccaagctgctctggctgcctgcctcctacctgccagccagcctggtggatgctgtgctcacctgggtccttcccaagcctgcccaagcagtctactgaatccagccttccagcaagagattgtttttcaaggacaaggactttgatttatttctgcccccaccctggtactgcctggtgcctgccacaaaataagcactaacaaaagtgtattgtttaaaaaataaaaagaaggtgggcagaaatgtgcccagtggaaaaaatgaccccatt

SEQ ID NO: 365579 - DNA, 375 bp, Homo sapiens
ctgtggtaagctaaagggacaatttgaggagaagcagttttcagatgctcccaggaagaagagggagctgtgggagtgcctcacctacccccagcatccttttcatctccccacagggctttttggtctggtgaataatgctggtgtggctggtatcatcggacccacaccatggctgacccgggacgatttccagcgggtgctgaatgtgaacacaatgggtcccatcggggtcacccttgccctgctgcctctgctgcagcaagcccggggccgggtgatcaacatcaccagcgtcctgggtcgcctggcagccaatggtgggggctactgtgtctccaaatttggcctggaggccttctctgacagcctgag

SEQ ID NO: 365580 - DNA, 454 bp, Homo sapiens
taagatgggctggagtgaggaagggaaactgattgcaaccacctatggggctgcagacctgaaaatgcaacagcgcatcatgaacctgatctgtgacccggacctaaccaaggtgagccgatgcctggagcatgccctgactgctcgacacccccgaacccgctacagcccaggttgggatgccaagctgctctggctgcctgcctcctacctgccagccagcctggtggatgctgtgctcacctgggtccttcccaagcctgcccaagcagtctactgaatccagccttccagcaagagattgtttttcaaggacaaggactttgatttatttctgcccccaccctggtactgcctggtgcctgccacaaaataagcactaacaaaagtgtattgtttaaaaaataaaaagaaggtgggcagaaatgtgcccagtggaaaaaatgaccccatt

SEQ ID NO: 365581 - DNA, 738 bp, Homo sapiens
tacgccgggccccggttctgatagtgagttcaatgttagtattttccttaagaccaaggagagattttcagtcagagaagataaatgcccagtcccagactactgtgctttctcggcaaaaaagactgagacactgaggatgtgaatgtcaaagtagtaagcagggactaaaggggatggggaggtcaaaaggcaagcatcacaacacctcagtggggagctgggaatttgagtgttaaaggacctcaagagggcagctgagaaaataggccagtggtctcaggctgacgcattccagtctctgtgggaaagtcataaagccaaagcctgaatttggccaaagaagtggatttgtctttatcttgttacctcaatgagggctggaagaactagtagctgatcaccaaggtacctgacctgagagtcttagtgctgtttatacattcaagactgtgactaacataaaatgcctaattagaaagtcacatttcccctgtcccgccgtcatgtcacttcaggtccttgtgtctaaccctgggtctggcatttgcccataggctctgtggcatcagctatcataagagtagtcaagagagatgaacttgataacctgtgttctctccaaagagcagaaagtgggtactatacgtggctacgttgctttgttaggctggcagaacagtccctccctgacagcattcctttggaaaataattcagataagctgaattctggttt

SEQ ID NO: 365582 - DNA, 958 bp, Homo sapiens
ggacgcgtgggtcgacccacgcgtcggaggtgtcgtcctgtttccctggcaggccagactgtatgaccgggatgtggcttctgcagctccagaaaaagcagagaaccctgctggccatggctccaaggaggtgaaaggcaaaactcacacttactatcaggtgctgattgatgctcgtgactgcccacatatatctcagagatctcagacagaagctgtgaccttcttggctaaccatgatgacagtcgggccctctatgccatcccaggcttggactatgtcagccatgaagacatcctcccctacacctccactgatcaggttcccatccaacatgaactctttgaaagatttcttctgtatgaccagacaaaagcacctccttttgtggctcgggagacgctaagggcctggcaagagaagaatcacccctggctggagctctccgatgttcatcgggaaacaactgagaacatacgtgtcactgtcatccccttctacatgggcatgagggaagcccagaattcccacgtgtactggtggcgctactgtatccgtttggagaaccttgacagtgatgtggtacagctccgggagcggcactggaggatattcagtctctctggcaccttggagacagtgcgaggccgaggggtagtgggcagggtgagcatccttggtctagtaattctggtcctgtgtggcaagcctgggggcttagcgcatggcttccttctcctttgttgttatagacagaggctcactttgtgaatacattgtgttgttttgggttagaaatcttaaaacaactacatgagatatgtttcttgaaacccatttcatagatgaaaagagtgagactgagaagttaaataaccagcccatggtcccatagctagtagtggcagggcctcaatttaaacccaagtgagtctgaagtcaaaacttgtgtagttt

SEQ ID NO: 365583 - DNA, 644 bp, Homo sapiens
tgctctgagctccggggtgggaccaggcgggccaagagggccgggacgccgcgcggggcagtgtgggactggggcggaacgccgcccggccgcgggtcgggctctgtgtcagcagccgggcgggcgctcgggcgggacatggcagcctgtacagcccggcgggccctggccgtgggcagccgctggtggtcccggtcgctgactggggcccggtggccaaggccgctctgtgcggcggccggagctggagccttctcgccagcgtcgaccacgacgacgcggaggcacctctcgtcccgaaaccgaccagagggcaaagtgttggagacagttggtgtgtttgaggtgccaaaacagaatggaaaatatgagaccgggcagcttttccttcatagcatttttggctaccgaggtgtcgtcctgtttccctggcaggccagactgtatgaccgggatgtggcttctgcagctccagaaaaagcagagaaccctgctggccatggctccaaggaggtgaaaggcaaaactcacacttactatcaggtgctgattgatgctcgtgactgcccacatatagtaagtaagcaagatggctgggcttgggggtcctctccatggaaagtcctgcatcccaatggggacaa

SEQ ID NO: 365584 - DNA, 3449 bp, Homo sapiens
tgctctgagctccggggtgggaccaggcgggccaagagggccgggacgccgcgcggggcagtgtgggactggggcggaacgccgcccggccgcgggtcgggctctgtgtcagcagccgggcgggcgctcgggcgggacatggcagcctgtacagcccggcgggccctggccgtgggcagccgctggtggtcccggtcgctgactggggcccggtggccaaggccgctctgtgcggcggccggagctggagccttctcgccagcgtcgaccacgacgacgcggaggcacctctcgtcccgaaaccgaccagagggcaaagtgttggagacagttggtgtgtttgaggtgccaaaacagaatggaaaatatgagaccgggcagcttttccttcatagcatttttggctaccgaggtgtcgtcctgtttccctggcaggccagactgtatgaccgggatgtggcttctgcagctccagaaaaagcagagaaccctgctggccatggctccaaggaggtgaaaggcaaaactcacacttactatcaggtgctgattgatgctcgtgactgcccacatatatctcagagatctcagacagaagctgtgaccttcttggctaaccatgatgacagtcgggccctctatgccatcccaggcttggactatgtcagccatgaagacatcctcccctacacctccactgatcaggttcccatccaacatgaactctttgaaagatttcttctgtatgaccagacaaaagcacctccttttgtggctcgggagacgctaagggcctggcaagagaagaatcacccctggctggagctctccgatgttcatcgggaaacaactgagaacatacgtgtcactgtcatccccttctacatgggcatgagggaagcccagaattcccacgtgtactggtggcgctactgtatccgtttggagaaccttgacagtgatgtggtacagctccgggagcggcactggaggatattcagtctctctggcaccttggagacagtgcgaggccgaggggtagtgggcagggaaccagtgttatccaaggagcagcctgcgttccagtatagcagccacgtctcgctgcaggcttccagtgggcacatgtggggcacgttccgctttgaaagacctgatggctcccactttgatgttcggattcctcccttctccctggaaagcaataaagatgagaagacaccaccctcaggccttcactggtaggccagctgaggccccaagtgcccaggcttggtcaccgggaagaacaactctcatcccacaattgctgcagaactcttctctccccatcatgggccacagtgggtctcttaatttgattgtggggttctttttgtggggaggggtggtataacttttcttcagaagacccatgtgggacacctccaaggctggcctcctcataagccctgcctacaccatgttccagtaaacctctccaccaaggaactgtgttcagctgccacaggcctggaggagtttcctggcctgtcacgtgaggtttgatcagtaaaccagtgcacgcttggccacccttgccatttctgctcccagagtctcaggctccccttctgacccagtgtgcgcccttgactgctttctttgctgcccttccagggagctgcccccctggtagggcatgtgcctgtttccctctcagcctggaggctggctggacatctcctagggtcactgtgcctctcagctagttggcgggggtgctggactggactcttgttcactttaccttctgccaaatgcagagagggaggccagtgtcagggtcggagtggcctggctcttagcactgaccgaccattgccatttctggcctcgctaggcccaggagaggagggaggcaagccagtcgggtttcctggagcaatgggtgtgccagccctcagcatgactctgccaagcatccagaccacaaatgcaggaatttggctgaggagcagctttaggtatggattgatgactaagtcaagctacttcctgagcttctctcagatttccaagagccagagatgaattgtgctgcatcttgccccaattcttaggatttcttttcctccgccactgcagtgattgttagaggtagttttcttgaattaatattaaatcacagttccagcccttgttattcttgtccttagtcctccagggggagctggggttgcagggcaacagtacagtcgcgcttacgacctggctagaacacaaggtcagatgataaacagaagcacaggaactcagcccatggccgcaagctggtcaaggcctgctcactgtaaacatggctctgtaccattgagtttaacacaattttattagaaattagtgtttgcttccatcacttatgctgagcaaccaaatattacagttatgtgataaaggaaaaattctttcctgcccaggacctgcgccatcctttaggccgaccttggtcacataccaaattcaataaaacccaatactggcctgtgttgttaacagcaggctgccaggtttctcagaaactgacaagaaaatctgaccttcatccatactttgtttacttacccctgggctgcttggagttgaaaaatgcacacagccaagagttgctttctgaatagggctggaaactttcaaagaaaacccccaaacttttaagtcacaaagtctgattaaagaagctaagatcatgtcagtgagttcaatgttagtattttccttaagaccaaggagagattttcagtcagagaagataaatgcccagtcccagactactgtgctttctcggcaaaaaagactgagacactgaggatgtgaatgtcaaagtagtaagcagggactaaaggggatggggaggtcaaaaggcaagcatcacaacacctcagtggggagctgggaatttgagtgttaaaggacctcaagagggcagctgagaaaataggccagtggtctcaggctgacgcattccagtctctgtgggaaagtcataaagccaaagcctgaatttggccaaagaagtggatttgtctttatcttgttacctcaatgagggctggaagaactagtagctgatcaccaaggtacctgacctgagagtcttagtgctgtttatacattcaagactgtgactaacataaaatgcctaattagaaagtcacatttcccctgtcccgccgtcatgtcacttcaggtccttgtgtctaaccctgggtctggcatttgcccataggctctgtggcatcagctatcataagagtagtcaagagagatgaacttgataacctgtgttctctccaaagagcagaaagtgggtactatacgtggctacgttgctttgttaggctggcagaacagtccctccctgacagcattcctttggaaaataattcagataagctgaattctggttt

SEQ ID NO: 365585 - DNA, 2466 bp, Homo sapiens
tgctctgagctccggggtgggaccaggcgggccaagagggccgggacgccgcgcggggcagtgtgggactggggcggaacgccgcccggccgcgggtcgggctctgtgtcagcagccgggcgggcgctcgggcgggacatggcagcctgtacagcccggcgggccctggccgtgggcagccgctggtggtcccggtcgctgactggggcccggtggccaaggccgctctgtgcggcggccggagctggagccttctcgccagcgtcgaccacgacgacgcggaggcacctctcgtcccgaaaccgaccagagggcaaagtgttggagacagttggtgtgtttgaggtgccaaaacagaatggaaaatatgagaccgggcagcttttccttcatagcatttttggctaccgaggtgtcgtcctgtttccctggcaggccagactgtatgaccgggatgtggcttctgcagctccagaaaaagcagagaaccctgctggccatggctccaaggaggtgaaaggcaaaactcacacttactatcaggtgctgattgatgctcgtgactgcccacatatatctcagagatctcagacagaagctgtgaccttcttggctaaccatgatgacagtcgggccctctatgccatcccaggcttggactatgtcagccatgaagacatcctcccctacacctccactgatcaggttcccatccaacatgaactctttgaaagatttcttctgtatgaccagacaaaagcacctccttttgtggctcgggagacgctaagggcctggcaagagaagaatcacccctggctggagctctccgatgttcatcgggaaacaactgagaacatacgtgtcactgtcatccccttctacatgggcatgagggaagcccagaattcccacgtgtactggtggcgctactgtatccgtttggagaaccttgacagtgatgtggtacagctccgggagcggcactggaggatattcagtctctctggcaccttggagacagtgcgaggccgaggggtagtgggcagggaaccagtgttatccaaggagcagcctgcgttccagtatagcagccacgtctcgctgcaggcttccagtgggcacatgtggggcacgttccgctttgaaagacctgatggctcccactttgatgttcggattcctcccttctccctggaaagcaataaagatgagaagacaccaccctcaggccttcactggtaggccagctgaggccccaagtgcccaggcttggtcaccgggaagaacaactctcatcccacaattgctgcagaactcttctctccccatcatgggccacagtgggtctcttaatttgattgtggggttctttttgtggggaggggtggtataacttttcttcagaagacccatgtgggacacctccaaggctggcctcctcataagccctgcctacaccatgttccagtaaacctctccaccaaggaactgtgttcagctgccacaggcctggaggagtttcctggcctgtcacgtgaggtttgatcagtaaaccagtgcacgcttggccacccttgccatttctgctcccagagtctcaggctccccttctgacccagtgtgcgcccttgactgctttctttgctgcccttccagggagctgcccccctggtagggcatgtgcctgtttccctctcagcctggaggctggctggacatctcctagggtcactgtgcctctcagctagttggcgggggtgctggactggactcttgttcactttaccttctgccaaatgcagagagggaggccagtgtcagggtcggagtggcctggctcttagcactgaccgaccattgccatttctggcctcgctaggcccaggagaggagggaggcaagccagtcgggtttcctggagcaatgggtgtgccagccctcagcatgactctgccaagcatccagaccacaaatgcaggaatttggctgaggagcagctttaggtatggattgatgactaagtcaagctacttcctgagcttctctcagatttccaagagccagagatgaattgtgctgcatcttgccccaattcttaggatttcttttcctccgccactgcagtgattgttagaggtagttttcttgaattaatattaaatcacagttccagcccttgtaaaaaaaaaaaggaagcaaagacacagacagaatgtgttctcggcggctagggccccccgggagaaggcgttgcaaaaccaacctgtggtgtggcgccccgggcggcccaaataaggctagttgaacaagggcgcaacacggggggacccacacgagaaaccccggggactaagaaccacatctggggatcttccccaaatagaaaaaacgccggggagaacacgacggcgttcttgacacacccagagaggagcgtcggacagcaaacggggccctacaaag

SEQ ID NO: 365586 - DNA, 3103 bp, Homo sapiens
  misc_feature (3077)..(3077): n is a, c, g, or t
tgctctgagctccggggtgggaccaggcgggccaagagggccgggacgccgcgcggggcagtgtgggactggggcggaacgccgcccggccgcgggtcgggctctgtgtcagcagccgggcgggcgctcgggcgggacatggcagcctgtacagcccggcgggccctggccgtgggcagccgctggtggtcccggtcgctgactggggcccggtggccaaggccgctctgtgcggcggccggagctggagccttctcgccagcgtcgaccacgacgacgcggaggcacctctcgtcccgaaaccgaccagagggcaaagtgttggagacagttggtgtgtttgaggtgccaaaacagaatggaaaatatgagaccgggcagcttttccttcatagcatttttggctaccgaggtgtcgtcctgtttccctggcaggccagactgtatgaccgggatgtggcttctgcagctccagaaaaagcagagaaccctgctggccatggctccaaggaggtgaaaggcaaaactcacacttactatcaggtgctgattgatgctcgtgactgcccacatatatctcagagatctcagacagaagctgtgaccttcttggctaaccatgatgacagtcgggccctctatgccatcccaggcttggactatgtcagccatgaagacatcctcccctacacctccactgatcaggttcccatccaacatgaactctttgaaagatttcttctgtatgaccagacaaaagcacctccttttgtggctcgggagacgctaagggcctggcaagagaagaatcacccctggctggagctctccgatgttcatcgggaaacaactgagaacatacgtgtcactgtcatccccttctacatgggcatgagggaagcccagaattcccacgtgtactggtggcgctactgtatccgtttggagaaccttgacagtgatgtggtacagctccgggagcggcactggaggatattcagtctctctggcaccttggagacagtgcgaggccgaggggtagtgggcagggaaccagtgttatccaaggagcagcctgcgttccagtatagcagccacgtctcgctgcaggcttccagtgggcacatgtggggcacgttccgctttgaaagacctgatggctcccactttgatgttcggattcctcccttctccctggaaagcaataaagatgagaagacaccaccctcaggccttcactggtaggccagctgaggccccaagtgcccaggcttggtcaccgggaagaacaactctcatcccacaattgctgcagaactcttctctccccatcatgggccacagtgggtctcttaatttgattgtggggttctttttgtggggaggggtggtataacttttcttcagaagacccatgtgggacacctccaaggctggcctcctcataagccctgcctacaccatgttccagtaaacctctccaccaaggaactgtgttcagctgccacaggcctggaggagtttcctggcctgtcacgtgaggtttgatcagtaaaccagtgcacgcttggccacccttgccatttctgctcccagagtctcaggctccccttctgacccagtgtgcgcccttgactgctttctttgctgcccttccagggagctgcccccctggtagggcatgtgcctgtttccctctcagcctggaggctggctggacatctcctagggtcactgtgcctctcagctagttggcgggggtgctggactggactcttgttcactttaccttctgccaaatgcagagagggaggccagtgtcagggtcggagtggcctggctcttagcactgaccgaccattgccatttctggcctcgctaggcccaggagaggagggaggcaagccagtcgggtttcctggagcaatgggtgtgccagccctcagcatgactctgccaagcatccagaccacaaatgcaggaatttggctgaggagcagctttaggtatggattgatgactaagtcaagctacttcctgagcttctctcagatttccaagagccagagatgaattgtgctgcatcttgccccaattcttaggatttcttttcctccgccactgcagtgattgttagaggtagttttcttgaattaatattaaatcacagttccagcccttgttattcttgtccttagtcctccagggggagctggggttgcagggcaacagtacagtcgcgcttacgacctggctagaacacaaggtcagatgataaacagaagcacaggaactcagcccatggccgcaagctggtcaaggcctgctcactgtaaacatggctctgtaccattgagtttaacacaattttattagaaattagtgtttgcttccatcacttatgctgagcaaccaaatattacagttatgtgataaaggaaaaattctttcctgcccaggacctgcgccatcctttaggccgaccttggtcacataccaaattcaataaaacccaatactggcctgtgttgttaacagcaggctgccaggtttctcagaaactgacaagaaaatctgaccttcatccatactttgtttacttacccctgggctgcttggagttgaaaaatgcacacagccaagagttgctttctgaatagggctggaaactttcaaagaaaacccccaaacttttaagtcacaaagtctgattaaagaagctaagatcatgtcagtgagttcaatgttagtattttccttaagaccaaggagagattttcagtcagagaagataaatgcccagtcccagactactgtgctttctcggcaaaaaagactgagacactgaggatgtgaatgtcaaagtagtaagcagggactaaaggggatggggaggtcaaaaggcaagcatcacaacacctcagtggggagctgggaatttgagtgttaaaggacctcaagagggcagctgagaaaataggccagtggtctcaggctgacgcattccagtctctgtgggaaagtcataaagccaaagcctgaatttggccaaagatgattttctctacttgtacctnatgcgcacgaggtaccgactgatatt

SEQ ID NO: 365587 - DNA, 2523 bp, Homo sapiens
  misc_feature (2236)..(2236): n is a, c, g, or t
  misc_feature (2523)..(2523): n is a, c, g, or t
tgctctgagctccggggtgggaccaggcgggccaagagggccgggacgccgcgcggggcagtgtgggactggggcggaacgccgcccggccgcgggtcgggctctgtgtcagcagccgggcgggcgctcgggcgggacatggcagcctgtacagcccggcgggccctggccgtgggcagccgctggtggtcccggtcgctgactggggcccggtggccaaggccgctctgtgcggcggccggagctggagccttctcgccagcgtcgaccacgacgacgcggaggcacctctcgtcccgaaaccgaccagagggcaaagtgttggagacagttggtgtgtttgaggtgccaaaacagaatggaaaatatgagaccgggcagcttttccttcatagcatttttggctaccgaggtgtcgtcctgtttccctggcaggccagactgtatgaccgggatgtggcttctgcagctccagaaaaagcagagaaccctgctggccatggctccaaggaggtgaaaggcaaaactcacacttactatcaggtgctgattgatgctcgtgactgcccacatatatctcagagatctcagacagaagctgtgaccttcttggctaaccatgatgacagtcgggccctctatgccatcccaggcttggactatgtcagccatgaagacatcctcccctacacctccactgatcaggttcccatccaacatgaactctttgaaagatttcttctgtatgaccagacaaaagcacctccttttgtggctcgggagacgctaagggcctggcaagagaagaatcacccctggctggagctctccgatgttcatcgggaaacaactgagaacatacgtgtcactgtcatccccttctacatgggcatgagggaagcccagaattcccacgtgtactggtggcgctactgtatccgtttggagaaccttgacagtgatgtggtacagctccgggagcggcactggaggatattcagtctctctggcaccttggagacagtgcgaggccgaggggtagtgggcagggaaccagtgttatccaaggagcagcctgcgttccagtatagcagccacgtctcgctgcaggcttccagtgggcacatgtggggcacgttccgctttgaaagacctgatggctcccactttgatgttcggattcctcccttctccctggaaagcaataaagatgagaagacaccaccctcaggccttcactggtaggccagctgaggccccaagtgcccaggcttggtcaccgggaagaacaactctcatcccacaattgctgcagaactcttctctccccatcatgggccacagtgggtctcttaatttgattgtggggttctttttgtggggaggggtggtataacttttcttcagaagacccatgtgggacacctccaaggctggcctcctcataagccctgcctacaccatgttccagtaaacctctccaccaaggaactgtgttcagctgccacaggcctggaggagtttcctggcctgtcacgtgaggtttgatcagtaaaccagtgcacgcttggccacccttgccatttctgctcccagagtctcaggctccccttctgacccagtgtgcgcccttgactgctttctttgctgcccttccagggagctgcccccctggtagggcatgtgcctgtttccctctcagcctggaggctggctggacatctcctagggtcactgtgcctctcagctagttggcgggggtgctggactggactcttgttcactttaccttctgccaaatgcagagagggaggccagtgtcagggtcggagtggcctggctcttagcactgaccgaccattgccatttctggcctcgctaggcccaggagaggagggaggcaagccagtcgggtttcctggagcaatgggtgtgccagccctcagcatgactctgccaagcatccagaccacaaatgcaggaatttggctgaggagcagctttaggtatggattgatgactaagtcaagctacttcctgagcttctctcagatttccaagagccagagatgaattgtgctgcatcttgccccaattcttaggatttcttttcctccgccactgcagtgattgttagaggtagttttcttgaattaatattaaatcacagttccagcccttgtaaaaaaaaaaaaaaaataagaaaaaaacaacaaaaaaaaaaaagggggggggnggcaaataaattccccgggggggccccaatgaatgtgcctcgcccatttcgttgtgtaaaaaaaagggggcccctattagaggggccattaatttatacgcaggacaccgcgcgcgtttaaaaaaccgttgctgctctggagaaacggcttctgtgggcgcttttgtgaagacgacccaacctctggcggcggaacattgtcggccacccccgaggattaaggtcgggaaataaatggttacggtgtaccgcaattctcgcgaaatgctcgtttatacctgaatacn

SEQ ID NO: 365588 - DNA, 1818 bp, Homo sapiens
tgctctgagctccggggtgggaccaggcgggccaagagggccgggacgccgcgcggggcagtgtgggactggggcggaacgccgcccggccgcgggtcgggctctgtgtcagcagccgggcgggcgctcgggcgggacatggcagcctgtacagcccggcgggccctggccgtgggcagccgctggtggtcccggtcgctgactggggcccggtggccaaggccgctctgtgcggcggccggagctggagccttctcgccagcgtcgaccacgacgacgcggaggcacctctcgtcccgaaaccgaccagagggcaaagtgttggagacagttggtgtgtttgaggtgccaaaacagaatggaaaatatgagaccgggcagcttttccttcatagcatttttggctaccgaggtgtcgtcctgtttccctggcaggccagactgtatgaccgggatgtggcttctgcagctccagaaaaagcagagaaccctgctggccatggctccaaggaggtgaaaggcaaaactcacacttactatcaggtgctgattgatgctcgtgactgcccacatatatctcagagatctcagacagaagctgtgaccttcttggctaaccatgatgacagtcgggccctctatgccatcccaggcttggactatgtcagccatgaagacatcctcccctacacctccactgatcaggttcccatccaacatgaactctttgaaagatttcttctgtatgaccagacaaaagcacctccttttgtggctcgggagacgctaagggcctggcaagagaagaatcacccctggctggagctctccgatgttcatcgggaaacaactgagaacatacgtgtcactgtcatccccttctacatgggcatgagggaagcccagaattcccacgtgtactggtggcgctactgtatccgtttggagaaccttgacagtgatgtggtacagctccgggagcggcactggaggatattcagtctctctggcaccttggagacagtgcgaggccgaggggtagtgggcagggaaccagtgttatccaaggagcagcctgcgttccagtatagcagccacgtctcgctgcaggcttccagtgggcacatgtggggcacgttccgctttgaaagacctgatggctcccactttgatgttcggattcctcccttctccctggaaagcaataaagatgagaagacaccaccctcaggccttcactggtaggccagctgaggccccaagtgcccaggcttggtcaccgggaagaacaactctcatcccacaattgctgcagaactcttctctccccatcatgggccacagtgggtctcttaatttgattgtggggttctttttgtggggaggggtggtataacttttcttcagaagacccatgtgggacacctccaaggctggcctcctcataagccctgcctacaccatgttccagtaaacctctccaccaaggaactgtgttcagctgccacaggcctggaggagtttcctggcctgtcacgtgaggtttgatcagtaaaccagtgcacgcttgccagccctcagcatgactctgccaagcatccagaccacaaatgcaggaatttggctgaggagcagctttaggtatggattgatgactaagtcaagctacttcctgagcttctctcagatttccaagagccagagatgaattgtgctgcatcttgccccaattcttaggatttcttttcctccgccactgcagtgattgttagaggtagttttcttgaattaatattaaatcacagttccagcccttgt

SEQ ID NO: 365589 - DNA, 2085 bp, Homo sapiens
ggacgcgtgggtcgacccacgcgtcgggggcggaacgccgcccggccgcgggtcgggctctgtgtcagcagccgggcgggcgctcgggcgggacatggcagcctgtacagcccggcgggccctggccgtgggcagccgctggtggtcccggtcgctgactggggcccggtggccaaggccgctctgtgcggcggccggagctggagccttctcgccagcgtcgaccacgacgacgcggaggcacctctcgtcccgaaaccgaccagagggcaaagtgttggagacagttggtgtgtttgaggtgccaaaacagaatggaaaatatgagaccgggcagcttttccttcatagcatttttggctaccgaggtgtcgtcctgtttccctggcaggccagactgtatgaccgggatgtggcttctgcagctccagaaaaagcagagaaccctgctggccatggctccaaggaggtgaaaggctctcagagatctcagacagaagctgtgaccttcttggctaaccatgatgacagtcgggccctctatgccatcccaggcttggactatgtcagccatgaagacatcctcccctacacctccactgatcaggttcccatccaacatgaactctttgaaagatttcttctgtatgaccagacaaaagcacctccttttgtggctcgggagacgctaagggcctggcaagagaagaatcacccctggctggagctctccgatgttcatcgggaaacaactgagaacatacgtgtcactgtcatccccttctacatgggcatgagggaagcccagaattcccacgtgtactggtggcgctactgtatccgtttggagaaccttgacagtgatgtggtacagctccgggagcggcactggaggatattcagtctctctggcaccttggagacagtgcgaggccgaggggtagtgggcagggaaccagtgttatccaaggagcagcctgcgttccagtatagcagccacgtctcgctgcaggcttccagtgggcacatgtggggcacgttccgctttgaaagacctgatggctcccactttgatgttcggattcctcccttctccctggaaagcaataaagatgagaagacaccaccctcaggccttcactggtaggccagctgaggccccaagtgcccaggcttggtcaccgggaagaacaactctcatcccacaattgctgcagaactcttctctccccatcatgggccacagtgggtctcttaatttgattgtggggttctttttgtggggaggggtggtataacttttcttcagaagacccatgtgggacacctccaaggctggcctcctcataagccctgcctacaccatgttccagtaaacctctccaccaaggaactgtgttcagctgccacaggcctggaggagtttcctggcctgtcacgtgaggtttgatcagtaaaccagtgcacgcttggccacccttgccatttctgctcccagagtctcaggctccccttctgacccagtgtgcgcccttgactgctttctttgctgcccttccagggagctgcccccctggtagggcatgtgcctgtttccctctcagcctggaggctggctggacatctcctagggtcactgtgcctctcagctagttggcgggggtgctggactggactcttgttcactttaccttctgccaaatgcagagagggaggccagtgtcagggtcggagtggcctggctcttagcactgaccgaccattgccatttctggcctcgctaggcccaggagaggagggaggcaagccagtcgggtttcctggagcaatgggtgtgccagccctcagcatgactctgccaagcatccagaccacaaatgcaggaatttggctgaggagcagctttaggtatggattgatgactaagtcaagctacttcctgagcttctctcagatttccaagagccagagatgaattgtgctgcatcttgccccaattcttaggatttcttttcctccgccactgcagtgattgttagaggtagttttcttgaattaatattaaatcacagttccagcccttgt

SEQ ID NO: 365590 - DNA, 1736 bp, Homo sapiens
  misc_feature (3)..(3): n is a, c, g, or t
  misc_feature (67)..(67): n is a, c, g, or t
  misc_feature (70)..(70): n is a, c, g, or t
  misc_feature (87)..(87): n is a, c, g, or t
  misc_feature (89)..(89): n is a, c, g, or t
  misc_feature (102)..(102): n is a, c, g, or t
tgnagccaactttttaccggtttttgctctccgcccagaaaagaaaaaccccgctgccttgctccangangtgaaagcaaaataaantnactttcagtgctnattaatgctcgtaactgcccacatttttctcagagatctcagacagaagctgtgaccttcttggctaaccatgatgacagtcgggccctctatgccatcccaggcttggactatgtcagccatgaagacatcctcccctacacctccactgatcaggttcccatccaacatgaactctttgaaagatttcttctgtatgaccagacaaaagcacctccttttgtggctcgggagacgctaagggcctggcaagagaagaatcacccctggctggagctctccgatgttcatcgggaaacaactgagaacatacgtgtcactgtcatccccttctacatgggcatgagggaagcccagaattcccacgtgtactggtggcgctactgtatccgtttggagaaccttgacagtgatgtggtacagctccgggagcggcactggaggatattcagtctctctggcaccttggagacagtgcgaggccgaggggtagtgggcagggaaccagtgttatccaaggagcagcctgcgttccagtatagcagccacgtctcgctgcaggcttccagtgggcacatgtggggcacgttccgctttgaaagacctgatggctcccactttgatgttcggattcctcccttctccctggaaagcaataaagatgagaagacaccaccctcaggccttcactggtaggccagctgaggccccaagtgcccaggcttggtcaccgggaagaacaactctcatcccacaattgctgcagaactcttctctccccatcatgggccacagtgggtctcttaatttgattgtggggttctttttgtggggaggggtggtataacttttcttcagaagacccatgtgggacacctccaaggctggcctcctcataagccctgcctacaccatgttccagtaaacctctccaccaaggaactgtgttcagctgccacaggcctggaggagtttcctggcctgtcacgtgaggtttgatcagtaaaccagtgcacgcttggccacccttgccatttctgctcccagagtctcaggctccccttctgacccagtgtgcgcccttgactgctttctttgctgcccttccagggagctgcccccctggtagggcatgtgcctgtttccctctcagcctggaggctggctggacatctcctagggtcactgtgcctctcagctagttggcgggggtgctggactggactcttgttcactttaccttctgccaaatgcagagagggaggccagtgtcagggtcggagtggcctggctcttagcactgaccgaccattgccatttctggcctcgctaggcccaggagaggagggaggcaagccagtcgggtttcctggagcaatgggtgtgccagccctcagcatgactctgccaagcatccagaccacaaatgcaggaatttggctgaggagcagctttaggtatggattgatgactaagtcaagctacttcctgagcttctctcagatttccaagagccagagatgaattgtgctgcatcttgccccaattcttaggatttcttttcctccgccactgcagtgattgttagaggtagttttcttgaattaatattaaatcacagttccagcccttgt

SEQ ID NO: 365591 - DNA, 1256 bp, Homo sapiens
tgctctgagctccggggtgggaccaggcgggccaagagggccgggacgccgcgcggggcagtgtgggactggggcggaacgccgcccggccgcgggtcgggctctgtgtcagcagccgggcgggcgctcgggcgggacatggcagcctgtacagcccggcgggccctggccgtgggcagccgctggtggtcccggtcgctgactggggcccggtggccaaggccgctctgtgcggcggccggagctggagccttctcgccagcgtcgaccacgacgacgcggaggcacctctcgtcccgaaaccgaccagagggcaaagtgttggagacagttggtgtgtttgaggtgccaaaacagaatggaaaatatgagaccgggcagcttttccttcatagcatttttggctaccgaggtgtcgtcctgtttccctggcaggccagactgtatgaccgggatgtggcttctgcagctccagaaaaagcagagaaccctgctggccatggctccaaggaggtgaaaggcaaaactcacacttactatcaggtgctgattgatgctcgtgactgcccacatatatctcagagatctcagacagaagctgtgaccttcttggctaaccatgatgacagtcgggccctctatgccatcccaggcttggactatgtcagccatgaagacatcctcccctacacctccactgatcaggttcccatccaacatgaactctttgaaagatttcttctgtatgaccagacaaaagcacctccttttgtggctcgggagacgctaagggcctggcaagagaagaatcacccctggctggagctctccgatgttcatcgggaaacaactgagaacatacgtgtcactgtcatccccttctacatgggcatgagggaagcccagaattcccacgtgtactggtggcgctactgtatccgtttggagaaccttgacagtgatgtggtacagctccgggagcggcactggaggatattcagtctctctggcaccttggagacagtgcgaggccgaggggtagtgggcagagacagggtctcgctgtgtcacccaggctggagtgcagtggtgcgaccatagtttactttcctgagcttctctcagatttccaagagccagagatgaattgtgctgcatcttgccccaattcttaggatttcttttcctccgccactgcagtgattgttagaggtagttttcttgaattaatattaaatcacagttccagcccttgt

SEQ ID NO: 365592 - DNA, 1341 bp, Homo sapiens
tgctctgagctccggggtgggaccaggcgggccaagagggccgggacgccgcgcggggcagtgtgggactggggcggaacgccgcccggccgcgggtcgggctctgtgtcagcagccgggcgggcgctcgggcgggacatggcagcctgtacagcccggcgggccctggccgtgggcagccgctggtggtcccggtcgctgactggggcccggtggccaaggccgctctgtgcggcggccggagctggagccttctcgccagcgtcgaccacgacgacgcggaggcacctctcgtcccgaaaccgaccagagggcaaagtgttggagacagttggtgtgtttgaggtgccaaaacagaatggaaaatatgagaccgggcagcttttccttcatagcatttttggctaccgaggtgtcgtcctgtttccctggcaggccagactgtatgaccgggatgtggcttctgcagctccagaaaaagcagagaaccctgctggccatggctccaaggaggtgaaaggcaaaactcacacttactatcaggtgctgattgatgctcgtgactgcccacatatatctcagagatctcagacagaagctgtgaccttcttggctaaccatgatgacagtcgggccctctatgccatcccaggcttggactatgtcagccatgaagacatcctcccctacacctccactgatcaggttcccatccaacatgaactctttgaaagatttcttctgtatgaccagacaaaagcacctccttttgtggctcgggagacgctaagggcctggcaagagaagaatcacccctggctggagctctccgatgttcatcgggaaacaactgagaacatacgtgtcactgtcatccccttctacatgggcatgagggaagcccagaattcccacgtgtactggtggcgctactgtatccgtttggagaaccttgacagtgatgtggtacagctccgggagcggcactggaggatattcagtctctctggcaccttggagacagtgcgaggccgaggggtagtgggcagggtgagcatccttggtctagtaattctggtcctgtgtggcaagcctgggggcttagcgcatggcttccttctcctttgttgttatagacagaggctcactttgtgaatacattgtgttgttttgggttagaaatcttaaaacaactacatgagatatgtttcttgaaacccatttcatagatgaaaagagtgagactgagaagttaaataaccagcccatggtcccatagctagtagtggcagggcctcaatttaaacccaagtgagtctgaagtcaaaacttgtgtagttt

SEQ ID NO: 365593 - DNA, 1161 bp, Homo sapiens
gcggccgcctactactgctctaattcaagcttctaacgatgtacggggacatggctctgtaccattgagtttaacacaattttattagaaattagtgtttgcttccatcacttatgctgagcaaccaaatattacagttatgtgataaaggaaaaattctttcctgcccaggacctgcgccatcctttaggccgaccttggtcacataccaaattcaataaaacccaatactggcctgtgttgttaacagcaggctgccaggtttctcagaaactgacaagaaaatctgaccttcatccatactttgtttacttacccctgggctgcttggagttgaaaaatgcacacagccaagagttgctttctgaatagggctggaaactttcaaagaaaacccccaaacttttaagtcacaaagtctgattaaagaagctaagatcatgtcagtgagttcaatgttagtattttccttaagaccaaggagagattttcagtcagagaagataaatgcccagtcccagactactgtgctttctcggcaaaaaagactgagacactgaggatgtgaatgtcaaagtagtaagcagggactaaaggggatggggaggtcaaaaggcaagcatcacaacacctcagtggggagctgggaatttgagtgttaaaggacctcaagagggcagctgagaaaataggccagtggtctcaggctgacgcattccagtctctgtgggaaagtcataaagccaaagcctgaatttggccaaagaagtggatttgtctttatcttgttacctcaatgagggctggaagaactagtagctgatcaccaaggtacctgacctgagagtcttagtgctgtttatacattcaagactgtgactaacataaaatgcctaattagaaagtcacatttcccctgtcccgccgtcatgtcacttcaggtccttgtgtctaaccctgggtctggcatttgcccataggctctgtggcatcagctatcataagagtagtcaagagagatgaacttgataacctgtgttctctccaaagagcagaaagtgggtactatacgtggctacgttgctttgttaggctggcagaacagtccctccctgacagcattcctttggaaaataattcagataagctgaattctggttt

SEQ ID NO: 365594 - DNA, 434 bp, Homo sapiens
gtggcgctactgtatccgtttggagaaccttgacagtgatgtggtacagctccgggagcggcactggaggatattcagtctctctggcaccttggagacagtgcgaggccgaggggtagtgggcagggtgagcatccttggtctagtaattctggtcctgtgtggcaagcctgggggcttagcgcatggcttccttctcctttgttgttatagacagaggctcactttgtgaatacattgtgttgttttgggttagaaatcttaaaacaactacatgagatatgtttcttgaaacccatttcatagatgaaaagagtgagactgagaagttaaataaccagcccatggtcccatagctagtagtggcagggcctcaatttaaacccaagtgagtctgaagtcaaaacttgtgtagtttttaaaactggtatagt

SEQ ID NO: 365595 - DNA, 1070 bp, Homo sapiens
  misc_feature (884)..(884): n is a, c, g, or t
  misc_feature (916)..(916): n is a, c, g, or t
  misc_feature (918)..(918): n is a, c, g, or t
  misc_feature (920)..(920): n is a, c, g, or t
ggacgcgtgggtcgacccacgcgtcgggggcggaacgccgcccggccgcgggtcgggctctgtgtcagcagccgggcgggcgctcgggcgggacatggcagcctgtacagcccggcgggccctggccgtgggcagccgctggtggtcccggtcgctgactggggcccggtggccaaggccgctctgtgcggcggccggagctggagccttctcgccagcgtcgaccacgacgacgcggaggcacctctcgtcccgaaaccgaccagagggcaaagtgttggagacagttggtgtgtttgaggtgccaaaacagaatggaaaatatgagaccgggcagcttttccttcatagcatttttggctaccgaggtgtcgtcctgtttccctggcaggccagactgtatgaccgggatgtggcttctgcagctccagaaaaagcagagaaccctgctggccatggctccaaggaggtgaaaggcaaaactcacacttactatcaggtgctgattgatgctcgtgactgcccacatatatctcagagatctcagacagaagctgtgaccttcttggctaaccatgatgacagtcgggccctctatgccatcccaggcttggactatgtcagccatgaagacatcctcccctacacctccactgatcaggttcccatccaacatgaactctttgaaagatttcttctgtatgaccagacaaaagcacctccttttgtggctcgggagacgctaagggcctggcaagagaagaatcacccctggctggagctctccgatgttcatcgggaaacaactgagaacatacgtgtcactgtcatccccttctacatgggcatgagggaagcccagaattccagtggtactggggggntactgaatcggtgggaacttgacggagtgggncngncgggagcggctgagggattcggctcgggcctgggaatggcagcccggtttggggggaggtctcgtggccacgtgggcggggcgctgattgggcaaaacgcagtgagggagaggacatcggcaggtcagagcacgaacggcgggggggaag

SEQ ID NO: 365596 - DNA, 2183 bp, Homo sapiens
tgctctgagctccggggtgggaccaggcgggccaagagggccgggacgccgcgcggggcagtgtgggactggggcggaacgccgcccggccgcgggtcgggctctgtgtcagcagccgggcgggcgctcgggcgggacatggcagcctgtacagcccggcgggccctggccgtgggcagccgctggtggtcccggtcgctgactggggcccggtggccaaggccgctctgtgcggcggccggagctggagccttctcgccagcgtcgaccacgacgacgcggaggcacctctcgtcccgaaaccgaccagagggcaaagtgttggagacagttggtgtgtttgaggtgccaaaacagaatggaaaatatgagaccgggcagcttttccttcatagcatttttggctaccgaggtgtcgtcctgtttccctggcaggccagactgtatgaccgggatgtggcttctgcagctccagaaaaagcagagaaccctgctggccatggctccaaggaggtgaaaggcaaaactcacacttactatcaggtgctgattgatgctcgtgactgcccacatatatctcagagatctcagacagaagctgtgaccttcttggctaaccatgatgacagtcgggccctctatgccatcccaggcttggactatgtcagccatgaagacatcctcccctacacctccactgatcaggttcccatccaacatgaactctttgaaagatttcttctgtatgaccagacaaaagcacctccttttgtggctcgggagacgctaagggcctggcaagagaagaatcacccctggctggagctctccgatgttcatcgggaaacaactgagaacatacgtgtcactgtcatccccttctacatgggcatgagggaagcccagaattcccacgtgtactggtggcgctactgtatccgtttggagaaccttgacagtgatgtggtacagctccgggagcggcactggaggatattcagtctctctggcaccttggagacagtgcgaggccgaggggtagtgggcagggaaccagtgttatccaaggagcagcctgcgttccagtatagcagccacgtctcgctgcaggcttccagtgggcacatgtggggcacgttccgctttgaaagacctgatggctcccactttgatgttcggattcctcccttctccctggaaagcaataaagatgagaagacaccaccctcaggccttcactggtaggccagctgaggccccaagtgcccaggcttggtcaccgggaagaacaactctcatcccacaattgctgcagaactcttctctccccatcatgggccacagtgggtctcttaatttgattgtggggttctttttgtggggaggggtggtataacttttcttcagaagacccatgtgggacacctccaaggctggcctcctcataagccctgcctacaccatgttccagtaaacctctccaccaaggaactgtgttcagctgccacaggcctggaggagtttcctggcctgtcacgtgaggtttgatcagtaaaccagtgcacgcttggccacccttgccatttctgctcccagagtctcaggctccccttctgacccagtgtgcgcccttgactgctttctttgctgcccttccagggagctgcccccctggtagggcatgtgcctgtttccctctcagcctggaggctggctggacatctcctagggtcactgtgcctctcagctagttggcgggggtgctggactggactcttgttcactttaccttctgccaaatgcagagagggaggccagtgtcagggtcggagtggcctggctcttagcactgaccgaccattgccatttctggcctcgctaggcccaggagaggagggaggcaagccagtcgggtttcctggagcaatgggtgtgccagccctcagcatgactctgccaagcatccagaccacaaatgcaggaatttggctgaggagcagctttaggtatggattgatgactaagtcaagctacttcctgagcttctctcagatttccaagagccagagatgaattgtgctgcatcttgccccaattcttaggatttcttttcctccgccactgcagtgattgttagaggtagttttcttgaattaatattaaatcacagttccagcccttgt

SEQ ID NO: 365597 - DNA, 2139 bp, Homo sapiens
ggacgcgtgggtcgacccacgcgtcgggggcggaacgccgcccggccgcgggtcgggctctgtgtcagcagccgggcgggcgctcgggcgggacatggcagcctgtacagcccggcgggccctggccgtgggcagccgctggtggtcccggtcgctgactggggcccggtggccaaggccgctctgtgcggcggccggagctggagccttctcgccagcgtcgaccacgacgacgcggaggcacctctcgtcccgaaaccgaccagagggcaaagtgttggagacagttggtgtgtttgaggtgccaaaacagaatggaaaatatgagaccgggcagcttttccttcatagcatttttggctaccgaggtgtcgtcctgtttccctggcaggccagactgtatgaccgggatgtggcttctgcagctccagaaaaagcagagaaccctgctggccatggctccaaggaggtgaaaggcaaaactcacacttactatcaggtgctgattgatgctcgtgactgcccacatatatctcagagatctcagacagaagctgtgaccttcttggctaaccatgatgacagtcgggccctctatgccatcccaggcttggactatgtcagccatgaagacatcctcccctacacctccactgatcaggttcccatccaacatgaactctttgaaagatttcttctgtatgaccagacaaaagcacctccttttgtggctcgggagacgctaagggcctggcaagagaagaatcacccctggctggagctctccgatgttcatcgggaaacaactgagaacatacgtgtcactgtcatccccttctacatgggcatgagggaagcccagaattcccacgtgtactggtggcgctactgtatccgtttggagaaccttgacagtgatgtggtacagctccgggagcggcactggaggatattcagtctctctggcaccttggagacagtgcgaggccgaggggtagtgggcagggaaccagtgttatccaaggagcagcctgcgttccagtatagcagccacgtctcgctgcaggcttccagtgggcacatgtggggcacgttccgctttgaaagacctgatggctcccactttgatgttcggattcctcccttctccctggaaagcaataaagatgagaagacaccaccctcaggccttcactggtaggccagctgaggccccaagtgcccaggcttggtcaccgggaagaacaactctcatcccacaattgctgcagaactcttctctccccatcatgggccacagtgggtctcttaatttgattgtggggttctttttgtggggaggggtggtataacttttcttcagaagacccatgtgggacacctccaaggctggcctcctcataagccctgcctacaccatgttccagtaaacctctccaccaaggaactgtgttcagctgccacaggcctggaggagtttcctggcctgtcacgtgaggtttgatcagtaaaccagtgcacgcttggccacccttgccatttctgctcccagagtctcaggctccccttctgacccagtgtgcgcccttgactgctttctttgctgcccttccagggagctgcccccctggtagggcatgtgcctgtttccctctcagcctggaggctggctggacatctcctagggtcactgtgcctctcagctagttggcgggggtgctggactggactcttgttcactttaccttctgccaaatgcagagagggaggccagtgtcagggtcggagtggcctggctcttagcactgaccgaccattgccatttctggcctcgctaggcccaggagaggagggaggcaagccagtcgggtttcctggagcaatgggtgtgccagccctcagcatgactctgccaagcatccagaccacaaatgcaggaatttggctgaggagcagctttaggtatggattgatgactaagtcaagctacttcctgagcttctctcagatttccaagagccagagatgaattgtgctgcatcttgccccaattcttaggatttcttttcctccgccactgcagtgattgttagaggtagttttcttgaattaatattaaatcacagttccagcccttgt

SEQ ID NO: 365598 - DNA, 3008 bp, Homo sapiens
  misc_feature (3008)..(3008): n is a, c, g, or t
tgctctgagctccggggtgggaccaggcgggccaagagggccgggacgccgcgcggggcagtgtgggactggggcggaacgccgcccggccgcgggtcgggctctgtgtcagcagccgggcgggcgctcgggcgggacatggcagcctgtacagcccggcgggccctggccgtgggcagccgctggtggtcccggtcgctgactggggcccggtggccaaggccgctctgtgcggcggccggagctggagccttctcgccagcgtcgaccacgacgacgcggaggcacctctcgtcccgaaaccgaccagagggcaaagtgttggagacagttggtgtgtttgaggtgccaaaacagaatggaaaatatgagaccgggcagcttttccttcatagcatttttggctaccgaggtgtcgtcctgtttccctggcaggccagactgtatgaccgggatgtggcttctgcagctccagaaaaagcagagaaccctgctggccatggctccaaggaggtgaaaggcaaaactcacacttactatcaggtgctgattgatgctcgtgactgcccacatatatctcagagatctcagacagaagctgtgaccttcttggctaaccatgatgacagtcgggccctctatgccatcccaggcttggactatgtcagccatgaagacatcctcccctacacctccactgatcaggttcccatccaacatgaactctttgaaagatttcttctgtatgaccagacaaaagcacctccttttgtggctcgggagacgctaagggcctggcaagagaagaatcacccctggctggagctctccgatgttcatcgggaaacaactgagaacatacgtgtcactgtcatccccttctacatgggcatgagggaagcccagaattcccacgtgtactggtggcgctactgtatccgtttggagaaccttgacagtgatgtggtacagctccgggagcggcactggaggatattcagtctctctggcaccttggagacagtgcgaggccgaggggtagtgggcagggaaccagtgttatccaaggagcagcctgcgttccagtatagcagccacgtctcgctgcaggcttccagtgggcacatgtggggcacgttccgctttgaaagacctgatggctcccactttgatgttcggattcctcccttctccctggaaagcaataaagatgagaagacaccaccctcaggccttcactggtaggccagctgaggccccaagtgcccaggcttggtcaccgggaagaacaactctcatcccacaattgctgcagaactcttctctccccatcatgggccacagtgggtctcttaatttgattgtggggttctttttgtggggaggggtggtataacttttcttcagaagacccatgtgggacacctccaaggctggcctcctcataagccctgcctacaccatgttccagtaaacctctccaccaaggaactgtgttcagctgccacaggcctggaggagtttcctggcctgtcacgtgaggtttgatcagtaaaccagtgcacgcttggccacccttgccatttctgctcccagagtctcaggctccccttctgacccagtgtgcgcccttgactgctttctttgctgcccttccagggagctgcccccctggtagggcatgtgcctgtttccctctcagcctggaggctggctggacatctcctagggtcactgtgcctctcagctagttggcgggggtgctggactggactcttgttcactttaccttctgccaaatgcagagagggaggccagtgtcagggtcggagtggcctggctcttagcactgaccgaccattgccatttctggcctcgctaggcccaggagaggagggaggcaagccagtcgggtttcctggagcaatgggtgtgccagccctcagcatgactctgccaagcatccagaccacaaatgcaggaatttggctgaggagcagctttaggtatggattgatgactaagtcaagctacttcctgagcttctctcagatttccaagagccagagatgaattgtgctgcatcttgccccaattcttaggatttcttttcctccgccactgcagtgattgttagaggtagttttcttgaattaatattaaatcacagttccagcccttgttattcttgtccttagtcctccagggggagctggggttgcagggcaacagtacagtcgcgcttacgacctggctagaacacaaggtcagatgataaacagaagcacaggaactcagcccatggccgcaagctggtcaaggcctgctcactgtaaacatggctctgtaccattgagtttaacacaattttattagaaattagtgtttgcttccatcacttatgctgagcaaccaaatattacagttatgtgataaaggaaaaattctttcctgcccaggacctgcgccatcctttaggccgaccttggtcacataccaaattcaataaaacccaatactggcctgtgttgttaacagcaggctgccaggtttctcagaaactgacaagaaaatctgaccttcatccatactttgtttacttacccctgggctgcttggagttgaaaaatgcacacagccaagagttgctttctgaatagggctggaaactttcaaagaaaacccccaaacttttaagtcacaaagtctgattaaagaagctaagatcatgtcaaaaaaaaaaaaaaaaaaaaaaaaaaaaaaaaaaaaaaaaaaaaaaaaaaaaaaaacaacaacaggaaaaaaaaaaaaaagagaaaaaaaaagagaccaacgacgagcaagaggaggcttcttggagagccgggctcacaacaaaccaggagaagtagcacgcaccggcgtccccataaggtcgggagcacatcaattgtgcgcaccaagagtagagatacgagcgcccaccgggagcagactactataacaacagcagggcccacgcatacagn

SEQ ID NO: 365599 - DNA, 2889 bp, Homo sapiens
tgctctgagctccggggtgggaccaggcgggccaagagggccgggacgccgcgcggggcagtgtgggactggggcggaacgccgcccggccgcgggtcgggctctgtgtcagcagccgggcgggcgctcgggcgggacatggcagcctgtacagcccggcgggccctggccgtgggcagccgctggtggtcccggtcgctgactggggcccggtggccaaggccgctctgtgcggcggccggagctggagccttctcgccagcgtcgaccacgacgacgcggaggcacctctcgtcccgaaaccgaccagagggcaaagtgttggagacagttggtgtgtttgaggtgccaaaacagaatggaaaatatgagaccgggcagcttttccttcatagcatttttggctaccgaggtgtcgtcctgtttccctggcaggccagactgtatgaccgggatgtggcttctgcagctccagaaaaagcagagaaccctgctggccatggctccaaggaggtgaaaggcaaaactcacacttactatcaggtgctgattgatgctcgtgactgcccacatatatctcagagatctcagacagaagctgtgaccttcttggctaaccatgatgacagtcgggccctctatgccatcccaggcttggactatgtcagccatgaagacatcctcccctacacctccactgatcaggttcccatccaacatgaactctttgaaagatttcttctgtatgaccagacaaaagcacctccttttgtggctcgggagacgctaagggcctggcaagagaagaatcacccctggctggagctctccgatgttcatcgggaaacaactgagaacatacgtgtcactgtcatccccttctacatgggcatgagggaagcccagaattcccacgtgtactggtggcgctactgtatccgtttggagaaccttgacagtgatgtggtacagctccgggagcggcactggaggatattcagtctctctggcaccttggagacagtgcgaggccgaggggtagtgggcagggaaccagtgttatccaaggagcagcctgcgttccagtatagcagccacgtctcgctgcaggcttccagtgggcacatgtggggcacgttccgctttgaaagacctgatggctcccactttgatgttcggattcctcccttctccctggaaagcaataaagatgagaagacaccaccctcaggccttcactggtaggccagctgaggccccaagtgcccaggcttggtcaccgggaagaacaactctcatcccacaattgctgcagaactcttctctccccatcatgggccacagtgggtctcttaatttgattgtggggttctttttgtggggaggggtggtataacttttcttcagaagacccatgtgggacacctccaaggctggcctcctcataagccctgcctacaccatgttccagtaaacctctccaccaaggaactgtgttcagctgccacaggcctggaggagtttcctggcctgtcacgtgaggtttgatcagtaaaccagtgcacgcttggccacccttgccatttctgctcccagagtctcaggctccccttctgacccagtgtgcgcccttgactgctttctttgctgcccttccagggagctgcccccctggtagggcatgtgcctgtttccctctcagcctggaggctggctggacatctcctagggtcactgtgcctctcagctagttggcgggggtgctggactggactcttgttcactttaccttctgccaaatgcagagagggaggccagtgtcagggtcggagtggcctggctcttagcactgaccgaccattgccatttctggcctcgctaggcccaggagaggagggaggcaagccagtcgggtttcctggagcaatgggtgtgccagccctcagcatgactctgccaagcatccagaccacaaatgcaggaatttggctgaggagcagctttaggtatggattgatgactaagtcaagctacttcctgagcttctctcagatttccaagagccagagatgaattgtgctgcatcttgccccaattcttaggatttcttttcctccgccactgcagtgattgttagaggtagttttcttgaattaatattaaatcacagttccagcccttgtaaaaaaaaaaaaaaaaaaaaaaaaaaaaaaaaaaaaaaaaaacaaaaaaaaaaaaaagggggaggacaaacaagaaaaaccacagagagacacccaccaacacgcccacagcaagaagagaacaagaggacccacaaaaagcacgcataaaacacacgcacaggaaaaacaaaaaaaagaaaaagacgaaaaaagcgaacacgcaaaatagaaacaacccaaaaaaagggaggcacacaaagaggagacaaaaccacaagaacaaagacgccccaacagacacaaaccacacacgcgggccacacacgggaacccatgaagaaacaccaccagcaacgcaaaacacaacagcaaaaaacaaaacaaaactacaacaggagaaacgcagacaacagcacaaaaaaaacacagccagacacaaccacgaccaaaaagaagacaagccacaccagcagaagaacaacaagggaccacacgaccagagaaaagaggccgagaaaagggacggaacaccgcgcccagagacaaggggaggagagcgcagaaaaggaaggaaagacacgacagcacagacacacagaggagaagcgagaacaaaaagcgcagaacgacgacaacagaaacacgagaggacaagacaaaaggaggcggagaaagagacaagcgcgacagccgcacagaggagagaaacgagagaagagaagaa

SEQ ID NO: 365600 - DNA, 3415 bp, Homo sapiens
tgctctgagctccggggtgggaccaggcgggccaagagggccgggacgccgcgcggggcagtgtgggactggggcggaacgccgcccggccgcgggtcgggctctgtgtcagcagccgggcgggcgctcgggcgggacatggcagcctgtacagcccggcgggccctggccgtgggcagccgctggtggtcccggtcgctgactggggcccggtggccaaggccgctctgtgcggcggccggagctggagccttctcgccagcgtcgaccacgacgacgcggaggcacctctcgtcccgaaaccgaccagagggcaaagtgttggagacagttggtgtgtttgaggtgccaaaacagaatggaaaatatgagaccgggcagcttttccttcatagcatttttggctaccgaggtgtcgtcctgtttccctggcaggccagactgtatgaccgggatgtggcttctgcagctccagaaaaagcagagaaccctgctggccatggctccaaggaggtgaaaggcaaaactcacacttactatcaggtgctgattgatgctcgtgactgcccacatatatctcagagatctcagacagaagctgtgaccttcttggctaaccatgatgacagtcgggccctctatgccatcccaggcttggactatgtcagccatgaagacatcctcccctacacctccactgatcaggttcccatccaacatgaactctttgaaagatttcttctgtatgaccagacaaaagcacctccttttgtggctcgggagacgctaagggcctggcaagagaagaatcacccctggctggagctctccgatgttcatcgggaaacaactgagaacatacgtgtcactgtcatccccttctacatgggcatgagggaagcccagaattcccacgtgtactggtggcgctactgtatccgtttggagaaccttgacagtgatgtggtacagctccgggagcggcactggaggatattcagtctctctggcaccttggagacagtgcgaggccgaggggtagtgggcagggaaccagtgttatccaaggagcagcctgcgttccagtatagcagccacgtctcgctgcaggcttccagtgggcacatgtggggcacgttccgctttgaaagacctgatggctcccactttgatgttcggattcctcccttctccctggaaagcaataaagatgagaagacaccaccctcaggccttcactggtaggccagctgaggccccaagtgcccaggcttggtcaccgggaagaacaactctcatcccacaattgctgcagaactcttctctccccatcatgggccacagtggggaggggtggtataacttttcttcagaagacccatgtgggacacctccaaggctggcctcctcataagccctgcctacaccatgttccagtaaacctctccaccaaggaactgtgttcagctgccacaggcctggaggagtttcctggcctgtcacgtgaggtttgatcagtaaaccagtgcacgcttggccacccttgccatttctgctcccagagtctcaggctccccttctgacccagtgtgcgcccttgactgctttctttgctgcccttccagggagctgcccccctggtagggcatgtgcctgtttccctctcagcctggaggctggctggacatctcctagggtcactgtgcctctcagctagttggcgggggtgctggactggactcttgttcactttaccttctgccaaatgcagagagggaggccagtgtcagggtcggagtggcctggctcttagcactgaccgaccattgccatttctggcctcgctaggcccaggagaggagggaggcaagccagtcgggtttcctggagcaatgggtgtgccagccctcagcatgactctgccaagcatccagaccacaaatgcaggaatttggctgaggagcagctttaggtatggattgatgactaagtcaagctacttcctgagcttctctcagatttccaagagccagagatgaattgtgctgcatcttgccccaattcttaggatttcttttcctccgccactgcagtgattgttagaggtagttttcttgaattaatattaaatcacagttccagcccttgttattcttgtccttagtcctccagggggagctggggttgcagggcaacagtacagtcgcgcttacgacctggctagaacacaaggtcagatgataaacagaagcacaggaactcagcccatggccgcaagctggtcaaggcctgctcactgtaaacatggctctgtaccattgagtttaacacaattttattagaaattagtgtttgcttccatcacttatgctgagcaaccaaatattacagttatgtgataaaggaaaaattctttcctgcccaggacctgcgccatcctttaggccgaccttggtcacataccaaattcaataaaacccaatactggcctgtgttgttaacagcaggctgccaggtttctcagaaactgacaagaaaatctgaccttcatccatactttgtttacttacccctgggctgcttggagttgaaaaatgcacacagccaagagttgctttctgaatagggctggaaactttcaaagaaaacccccaaacttttaagtcacaaagtctgattaaagaagctaagatcatgtcagtgagttcaatgttagtattttccttaagaccaaggagagattttcagtcagagaagataaatgcccagtcccagactactgtgctttctcggcaaaaaagactgagacactgaggatgtgaatgtcaaagtagtaagcagggactaaaggggatggggaggtcaaaaggcaagcatcacaacacctcagtggggagctgggaatttgagtgttaaaggacctcaagagggcagctgagaaaataggccagtggtctcaggctgacgcattccagtctctgtgggaaagtcataaagccaaagcctgaatttggccaaagaagtggatttgtctttatcttgttacctcaatgagggctggaagaactagtagctgatcaccaaggtacctgacctgagagtcttagtgctgtttatacattcaagactgtgactaacataaaatgcctaattagaaagtcacatttcccctgtcccgccgtcatgtcacttcaggtccttgtgtctaaccctgggtctggcatttgcccataggctctgtggcatcagctatcataagagtagtcaagagagatgaacttgataacctgtgttctctccaaagagcagaaagtgggtactatacgtggctacgttgctttgttaggctggcagaacagtccctccctgacagcattcctttggaaaataattcagataagctgaattctggttt

SEQ ID NO: 365601 - DNA, 1570 bp, Homo sapiens
tgctctgagctccggggtgggaccaggcgggccaagagggccgggacgccgcgcggggcagtgtgggactggggcggaacgccgcccggccgcgggtcgggctctgtgtcagcagccgggcgggcgctcgggcgggacatggcagcctgtacagcccggcgggccctggccgtgggcagccgctggtggtcccggtcgctgactggggcccggtggccaaggccgctctgtgcggcggccggagctggagccttctcgccagcgtcgaccacgacgacgcggaggcacctctcgtcccgaaaccgaccagagggcaaagtgttggagacagttggtgtgtttgaggtgccaaaacagaatggaaaatatgagaccgggcagcttttccttcatagcatttttggctaccgaggtgtcgtcctgtttccctggcaggccagactgtatgaccgggatgtggcttctgcagctccagaaaaagcagagaaccctgctggccatggctccaaggaggtgaaaggcaaaactcacacttactatcaggtgctgattgatgctcgtgactgcccacatatatctcagagatctcagacagaagctgtgaccttcttggctaaccatgatgacagtcgggccctctatgccatcccaggcttggactatgtcagccatgaagacatcctcccctacacctccactgatcaggttcccatccaacatgaactctttgaaagatttcttctgtatgaccagacaaaagcacctccttttgtggctcgggagacgctaagggcctggcaagagaagaatcacccctggctggagctctccgatgttcatcgggaaacaactgagaacatacgtgtcactgtcatccccttctacatgggcatgagggaagcccagaattcccacgtgtactggtggcgctactgtatccgtttggagaaccttgacagtgatgtggtacagctccgggagcggcactggaggatattcagtctctctggcaccttggagacagtgcgaggccgaggggtagtgggcagggaaccagtgttatccaaggagcagcctgcgttccagtatagcagccacgtctcgctgcaggcttccagtgggcacatgtggggcacgttccgctttgaaagacctgatggctcccactttgatgttcggattcctcccttctccctggaaagcaataaagatgagaagacaccaccctcaggccttcactggtaggccagctgaggccccaagtgcccaggcttggtcaccgggaagaacaactctcatcccacaattgctgcagaactcttctctccccatcatgggccacagtgggtctcttaatttgattgtggggttctttttgtggggaggggtggtataacttttcttcagaagacccatgtgggacacctccaaggctggcctcctcataagccctgcctacaccatgttccagtaaacctctccaccaaggaactgtgttcagctgccacaggcctggaggagtttcctggcctgtcacgtgaggtttgatcagtaaaccagtgcacgcttg

SEQ ID NO: 365602 - DNA, 2078 bp, Homo sapiens
tgctctgagctccggggtgggaccaggcgggccaagagggccgggacgccgcgcggggcagtgtgggactggggcggaacgccgcccggccgcgggtcgggctctgtgtcagcagccgggcgggcgctcgggcgggacatggcagcctgtacagcccggcgggccctggccgtgggcagccgctggtggtcccggtcgctgactggggcccggtggccaaggccgctctgtgcggcggccggagctggagccttctcgccagcgtcgaccacgacgacgcggaggcacctctcgtcccgaaaccgaccagagggcaaagtgttggagacagttggtgtgtttgaggtgccaaaacagaatggaaaatatgagaccgggcagcttttccttcatagcatttttggctaccgaggtgtcgtcctgtttccctggcaggccagactgtatgaccgggatgtggcttctgcagctccagaaaaagcagagaaccctgctggccatggctccaaggaggtgaaaggcaaaactcacacttactatcaggtgctgattgatgctcgtgactgcccacatatatctcagagatctcagacagaagctgtgaccttcttggctaaccatgatgacagtcgggccctctatgccatcccaggcttggactatgtcagccatgaagacatcctcccctacacctccactgatcaggttcccatccaacatgaactctttgaaagatttcttctgtatgaccagacaaaagcacctccttttgtggctcgggagacgctaagggcctggcaagagaagaatcacccctggctggagctctccgatgttcatcgggaaacaactgagaacatacgtgtcactgtcatccccttctacatgggcatgagggaagcccagaattcccacgtgtactggtggcgctactgtatccgtttggagaaccttgacagtgatgtggtacagctccgggagcggcactggaggatattcagtctctctggcaccttggagacagtgcgaggccgaggggtagtgggcagggaaccagtgttatccaaggagcagcctgcgttccagtatagcagccacgtctcgctgcaggcttccagtgggcacatgtggggcacgttccgctttgaaagacctgatggctcccactttgatgttcggattcctcccttctccctggaaagcaataaagatgagaagacaccaccctcaggccttcactggtaggccagctgaggccccaagtgcccaggcttggtcaccgggaagaacaactctcatcccacaattgctgcagaactcttctctccccatcatgggccacagtgggtctcttaatttgattgtggggttctttttgtggggaggggtggtataacttttcttcagaagacccatgtgggacacctccaaggctggcctcctcataagccctgcctacaccatgttccagtaaacctctccaccaaggaactgtgttcagctgccacaggcctggaggagtttcctggcctgtcacgtgaggtttgatcagtaaaccagtgcacgcttgaaaaaaaaaaaaaaaaaaaaaaaaaaaaaaaaaaaaaaaaaaggggggggcgcggactaaaaagaatactccccgagagggcgcccaaggtaaagccgggctacccagaggtttcttgtggacaaaggggggcccaataaaggagggcggcgacaataaaagagcacacaagcaggggcgcggcgggttaaacacagggtgcgcgaagccgggggaggaacaccctgtgcaacacgctggggagacccccttgcgggagaagggcagacccccttaatcctccggagggggggctgcaggcactttggggcgacgacaaattatctcataaaaagagagatttaatacggccacaaagggggaggaaattatataaaatttttaaaggggtggcatacagcggcgggggtaaacacaaaggcggagaaattatgcttggaggtgggtaaaaaaagttttgggataaccagggaatataagatttttggagaaattttttaaccaggag

SEQ ID NO: 365603 - DNA, 1600 bp, Homo sapiens
tgctctgagctccggggtgggaccaggcgggccaagagggccgggacgccgcgcggggcagtgtgggactggggcggaacgccgcccggccgcgggtcgggctctgtgtcagcagccgggcgggcgctcgggcgggacatggcagcctgtacagcccggcgggccctggccgtgggcagccgctggtggtcccggtcgctgactggggcccggtggccaaggccgctctgtgcggcggccggagctggagccttctcgccagcgtcgaccacgacgacgcggaggcacctctcgtcccgaaaccgaccagagggcaaagtgttggagacagttggtgtgtttgaggtgccaaaacagaatggaaaatatgagaccgggcagcttttccttcatagcatttttggctaccgaggtgtcgtcctgtttccctggcaggccagactgtatgaccgggatgtggcttctgcagctccagaaaaagcagagaaccctgctggccatggctccaaggaggtgaaaggcaaaactcacacttactatcaggtgctgattgatgctcgtgactgcccacatatatctcagagatctcagacagaagctgtgaccttcttggctaaccatgatgacagtcgggccctctatgccatcccaggcttggactatgtcagccatgaagacatcctcccctacacctccactgatcaggttcccatccaacatgaactctttgaaagatttcttctgtatgaccagacaaaagcacctccttttgtggctcgggagacgctaagggcctggcaagagaagaatcacccctggctggagctctccgatgttcatcgggaaacaactgagaacatacgtgtcactgtcatccccttctacatgggcatgagggaagcccagaattcccacgtgtactggtggcgctactgtatccgtttggagaaccttgacagtgatgtggtacagctccgggagcggcactggaggatattcagtctctctggcaccttggagacagtgcgaggccgaggggtagtgggcagggaaccagtgttatccaaggagcagcctgcgttccagtatagcagccacgtctcgctgcaggcttccagtgggcacatgtggggcacgttccgctttgaaagacctgatggctcccactttgatgttcggattcctcccttctccctggaaagcaataaagatgagaagacaccaccctcaggccttcactggtaggccagctgaggccccaagtgcccaggcttggtcaccgggaagaacaactctcatcccacaattgctgcagaactcttctctccccatcatgggccacagtgggtctcttaatttgattgtggggttctttttgtggggaggggtggtataacttttcttcagaagacccatgtgggacacctccaaggctggcctcctcataagccctgcctacaccatgttccagtaaacctctccaccaaggaactgtgttcagctgccacaggcctggaggagtttcctggcctgtcacgtgaggtttgatcagtaaaccagtgcacgcttggcgcggggttggctcgctaccacaagccag

SEQ ID NO: 365604 - DNA, 3313 bp, Homo sapiens
tgctctgagctccggggtgggaccaggcgggccaagagggccgggacgccgcgcggggcagtgtgggactggggcggaacgccgcccggccgcgggtcgggctctgtgtcagcagccgggcgggcgctcgggcgggacatggcagcctgtacagcccggcgggccctggccgtgggcagccgctggtggtcccggtcgctgactggggcccggtggccaaggccgctctgtgcggcggccggagctggagccttctcgccagcgtcgaccacgacgacgcggaggcacctctcgtcccgaaaccgaccagagggcaaagtgttggagacagttggtgtgtttgaggtgccaaaacagaatggaaaatatgagaccgggcagcttttccttcatagcatttttggctaccgaggtgtcgtcctgtttccctggcaggccagactgtatgaccgggatgtggcttctgcagctccagaaaaagcagagaaccctgctggccatggctccaaggaggtgaaaggcaaaactcacacttactatcaggtgctgattgatgctcgtgactgcccacatatatctcagagatctcagacagaagctgtgaccttcttggctaaccatgatgacagtcgggccctctatgccatcccaggcttggactatgtcagccatgaagacatcctcccctacacctccactgatcaggttcccatccaacatgaactctttgaaagatttcttctgtatgaccagacaaaagcacctccttttgtggctcgggagacgctaagggcctggcaagagaagaatcacccctggctggagctctccgatgttcatcgggaaacaactgagaacatacgtgtcactgtcatccccttctacatgggcatgagggaagcccagaattccgggaaccagtgttatccaaggagcagcctgcgttccagtatagcagccacgtctcgctgcaggcttccagtgggcacatgtggggcacgttccgctttgaaagacctgatggctcccactttgatgttcggattcctcccttctccctggaaagcaataaagatgagaagacaccaccctcaggccttcactggtaggccagctgaggccccaagtgcccaggcttggtcaccgggaagaacaactctcatcccacaattgctgcagaactcttctctccccatcatgggccacagtgggtctcttaatttgattgtggggttctttttgtggggaggggtggtataacttttcttcagaagacccatgtgggacacctccaaggctggcctcctcataagccctgcctacaccatgttccagtaaacctctccaccaaggaactgtgttcagctgccacaggcctggaggagtttcctggcctgtcacgtgaggtttgatcagtaaaccagtgcacgcttggccacccttgccatttctgctcccagagtctcaggctccccttctgacccagtgtgcgcccttgactgctttctttgctgcccttccagggagctgcccccctggtagggcatgtgcctgtttccctctcagcctggaggctggctggacatctcctagggtcactgtgcctctcagctagttggcgggggtgctggactggactcttgttcactttaccttctgccaaatgcagagagggaggccagtgtcagggtcggagtggcctggctcttagcactgaccgaccattgccatttctggcctcgctaggcccaggagaggagggaggcaagccagtcgggtttcctggagcaatgggtgtgccagccctcagcatgactctgccaagcatccagaccacaaatgcaggaatttggctgaggagcagctttaggtatggattgatgactaagtcaagctacttcctgagcttctctcagatttccaagagccagagatgaattgtgctgcatcttgccccaattcttaggatttcttttcctccgccactgcagtgattgttagaggtagttttcttgaattaatattaaatcacagttccagcccttgttattcttgtccttagtcctccagggggagctggggttgcagggcaacagtacagtcgcgcttacgacctggctagaacacaaggtcagatgataaacagaagcacaggaactcagcccatggccgcaagctggtcaaggcctgctcactgtaaacatggctctgtaccattgagtttaacacaattttattagaaattagtgtttgcttccatcacttatgctgagcaaccaaatattacagttatgtgataaaggaaaaattctttcctgcccaggacctgcgccatcctttaggccgaccttggtcacataccaaattcaataaaacccaatactggcctgtgttgttaacagcaggctgccaggtttctcagaaactgacaagaaaatctgaccttcatccatactttgtttacttacccctgggctgcttggagttgaaaaatgcacacagccaagagttgctttctgaatagggctggaaactttcaaagaaaacccccaaacttttaagtcacaaagtctgattaaagaagctaagatcatgtcagtgagttcaatgttagtattttccttaagaccaaggagagattttcagtcagagaagataaatgcccagtcccagactactgtgctttctcggcaaaaaagactgagacactgaggatgtgaatgtcaaagtagtaagcagggactaaaggggatggggaggtcaaaaggcaagcatcacaacacctcagtggggagctgggaatttgagtgttaaaggacctcaagagggcagctgagaaaataggccagtggtctcaggctgacgcattccagtctctgtgggaaagtcataaagccaaagcctgaatttggccaaagaagtggatttgtctttatcttgttacctcaatgagggctggaagaactagtagctgatcaccaaggtacctgacctgagagtcttagtgctgtttatacattcaagactgtgactaacataaaatgcctaattagaaagtcacatttcccctgtcccgccgtcatgtcacttcaggtccttgtgtctaaccctgggtctggcatttgcccataggctctgtggcatcagctatcataagagtagtcaagagagatgaacttgataacctgtgttctctccaaagagcagaaagtgggtactatacgtggctacgttgctttgttaggctggcagaacagtccctccctgacagcattcctttggaaaataattcagataagctgaattctggttt

SEQ ID NO: 365605 - DNA, 1114 bp, Homo sapiens
  misc_feature (928)..(928): n is a, c, g, or t
  misc_feature (960)..(960): n is a, c, g, or t
  misc_feature (962)..(962): n is a, c, g, or t
  misc_feature (964)..(964): n is a, c, g, or t
tgctctgagctccggggtgggaccaggcgggccaagagggccgggacgccgcgcggggcagtgtgggactggggcggaacgccgcccggccgcgggtcgggctctgtgtcagcagccgggcgggcgctcgggcgggacatggcagcctgtacagcccggcgggccctggccgtgggcagccgctggtggtcccggtcgctgactggggcccggtggccaaggccgctctgtgcggcggccggagctggagccttctcgccagcgtcgaccacgacgacgcggaggcacctctcgtcccgaaaccgaccagagggcaaagtgttggagacagttggtgtgtttgaggtgccaaaacagaatggaaaatatgagaccgggcagcttttccttcatagcatttttggctaccgaggtgtcgtcctgtttccctggcaggccagactgtatgaccgggatgtggcttctgcagctccagaaaaagcagagaaccctgctggccatggctccaaggaggtgaaaggcaaaactcacacttactatcaggtgctgattgatgctcgtgactgcccacatatatctcagagatctcagacagaagctgtgaccttcttggctaaccatgatgacagtcgggccctctatgccatcccaggcttggactatgtcagccatgaagacatcctcccctacacctccactgatcaggttcccatccaacatgaactctttgaaagatttcttctgtatgaccagacaaaagcacctccttttgtggctcgggagacgctaagggcctggcaagagaagaatcacccctggctggagctctccgatgttcatcgggaaacaactgagaacatacgtgtcactgtcatccccttctacatgggcatgagggaagcccagaattccagtggtactggggggntactgaatcggtgggaacttgacggagtgggncngncgggagcggctgagggattcggctcgggcctgggaatggcagcccggtttggggggaggtctcgtggccacgtgggcggggcgctgattgggcaaaacgcagtgagggagaggacatcggcaggtcagagcacgaacggcgggggggaag

SEQ ID NO: 365606 - DNA, 560 bp, Homo sapiens
gaacggctacgcggccgcggagccgggggcgggggccgggcgcgcacagaccgatctctggaaacatggctacagaacatgttaatggaaatggtactgaagagcccatggatactacttctgcagttatccattcagaaaattttcagacattgcttgatgctggtttaccacagaaagttgctgaaaaactagatgaaatttacgttgcagggctagttgcacatagtgatttagatgaaagagctattgaagctttaaaagaattcaatgaagacggtgcattggcagttcttcaacagtttaaagacagtgatctctctcatgttcagaacaaaagtgcctttttatgtggagtcatgaagacttacaggcagagagaaaaacaagggaccaaagtagcagattctagtaaaggaccagatgaggcaaaaattaaggtatgtctttctatactccctttagttttaaagtcattttaactgtttcctaattttggtaaatattccttgggtatgaaatggatgtatgttagatgttgagataattcatcaatcttt

SEQ ID NO: 365607 - DNA, 7498 bp, Homo sapiens
agagaggagccgactcggcagggactgggggaccgggccgagagtgcgagcgagcgagggagggagtgagggagcgtgcgagccagaaggggaaaggcggccactcgtgcctgagcgaccgcagaggggagtgggagcagtggggtaaaggagcggggggcgggaataagaaaggccgagagaaggcggacagaggctagtggtggtggtggtggtagggggagaaggaggagctggaggagggcaggggctgagggagtgagtgaagcggacgcgcgagggaggggagggaagggaagggaagggaagggggggtcacgcgggggcgcgcgcgcgcaccgggagcgcgctcggaggcgagtggaactggatcgggtttgctgccagcggcgtgagcttcggccgccattttacaacagctccactcgcgccggacacagggagcagcgagcacgcgtttcccgcaacccgataccatcggacaggatttctccgcctcagcccaacggggagatctctggaaacatggctacagaacatgttaatggaaatggtactgaagagcccatggatactacttctgcagttatccattcagaaaattttcagacattgcttgatgctggtttaccacagaaagttgctgaaaaactagatgaaatttacgttgcagggctagttgcacatagtgatttagatgaaagagctattgaagctttaaaagaattcaatgaagacggtgcattggcagttcttcaacagtttaaagacagtgatctctctcatgttcagaacaaaagtgcctttttatgtggagtcatgaagacttacaggcagagagaaaaacaagggaccaaagtagcagattctagtaaaggaccagatgaggcaaaaattaaggcactcttggaaagaacaggctacacacttgatgtgaccactggacagaggaagtatggaggaccacctccagattccgtttattcaggtcagcagccttctgttggcactgagatatttgtgggaaagatcccaagagatctatttgaggatgaacttgttccattatttgagaaagctggacctatatgggatcttcgtctaatgatggatccactcactggtctcaatagaggttatgcgtttgtcactttttgtacaaaagaagcagctcaggaggctgttaaactgtataataatcatgaaattcgttctggaaaacatattggtgtctgcatctcagttgccaacaataggctttttgtgggctctattcctaagagtaaaaccaaggaacagattcttgaagaatttagcaaagtaacagagggtcttacagacgtcattttataccaccaaccggatgacaagaaaaaaaacagaggcttttgctttcttgaatatgaagatcacaaaacagctgcccaggcaaggcgtaggttaatgagtggtaaagtcaaggtctgggggaatgttggaactgttgaatgggctgatcctatagaagatcctgatcctgaggttatggcaaaggtaaaagtgctgtttgtacgcaaccttgccaatactgtaacagaagagattttagaaaaggcatttagtcagtttgggaaactggaacgagtgaagaagttaaaagattatgcgttcattcattttgatgagcgagatggtgctgtcaaggctatggaagaaatgaatggcaaagacttggagggagaaaatattgaaattgtttttgccaagccaccagatcagaaaaggaaagaaagaaaagctcagaggcaagcagcaaaaaatcaaatgtatgacgattactactattatggtccacctcatatgccccctccaacaagaggtcgagggcgtggaggtagaggtggttatggatatcctccagattattatggatatgaagattattatgattattatggttatgattaccataactatcgtggtggatatgaagatccatactatggttatgaagattttcaagttggagctagaggaaggggtggtagaggagcaaggggtgctgctccatccagaggtcgtggggctgctcctccccgcggtagagccggttattcacagagaggaggtcctggatcagcaagaggcgttcgaggtgcgagaggaggtgcccaacaacaaagaggccgcgggcagggaaaaggggtcgaggccggtcctgacctgttacaatgaagactgacttgctatgtgggattacaccagaagcttgcagtggagtaatggtaaggaaatcaagcaaccttaaatatgtcggctgtataggagcatattctattgcagaagaccttcctatgaagatcatggaatcaaatacgggacattgaactaatacttggactttgatatgaatttctttaacaattttctctgcagtgcaagttattaaactaaagctactctattttcaaaatgtgttccaacagaaatccttcataactcctagcatggtatcttaataaagaataaagttcttttaaaaatctgctctaagtagatttttccccttttttaaattaaggatcccaacagtggtattttgaaatattctcttgaatttgtgcatttaaattttattgcagtggtatagatgaatgccactgatggtatccttaaattttatttctgctcaccaaggttaatcatgattgtctatatcttttttatagtgatcacttttgaattgtgttcagatatgcagtttcaggtgtaatcatcagagctggttagtcaggcattccagatagtggttcttttcagaacctttttaaaagggttggttaactacctcagtagcagaggattgaactataccctgtctgtactgtacatagaaaatctttgtagataaaagcaaggcttgttaaatatgatatgagggtaagattttaatataccaaatgtaacattcttagttgcctttagtttcagaggcttgtaagacttcctcatgaccatcataacaggccttgcttttgtcgtattttgtggctgaaaaagcagccttgcttcttcagatattgtagttatttggatgtataatagtttagcaagatgttacttttgtaagacatcagatgttcaaaaaagtgcatccgaacttgtactaaatactgcagtgtccctttataaaaagtcagactaaaactgacaattgtacagcgaacctgacatttggatattttgaagttttttcataaatcatagaaattagtatatggctgtagtttagctttttaggtaaaaggtatgtttcattagtgcatttcttcctgctgatcactgtaaacatgtgaatcagctttccatttcttatgcaggtcatgataacttgtagagtagagtacaatcatttgtgctatgtttttaattttctaaagcaccttgatgacagtgagtgtccagtggtgaagcatcctctattgaaccaccctcaaaaatttttttgccaagtcctaagttgatagcttaaagtaaaaagtgaaaattatagtttcattaggacttggtgtaaagaaatcccctccccccttccccaaagggatactgcagttatatcacatacccaataggcaccacgatgaagatcagagcttatacttaattaaggttttatacacaccagttccccagtaaatgcaaatttaacaagaaaatcagacatgtcatatgttcaaaatgctcatggcaaacaatcattttgcattcctgcaaataaaattgttttatactgtaagctggaggcgagtgtaacttatttttgtaataaagtttttattttttttatgtgtcattaatataaatgtgtgttagtgtagaaatcttctggtttaaaaacttagaattgcacacatttcagtatgtttatttgtacttacataattttagaatagtggttgccaatagcctgtatgtttcacattaattggttttttgttatctaaataaatcattttagtatgttgtatgtcagttactgggatagctgggacatagagtgtaatttaaaatttgtcaataagtattcattggaatatatgtaaatgtgccttgccggttattgaaacttatctacaaaatgagtatggggtgacaaaaattagttcctggtgcttaatgaaactttctgccactgattttatatattaccccgtgcttttttaaagtacatctctctcaaaacttagtgtaagtttgagggctacacaaaacatttacatttcattctaacataatgaatataataggttgtggaaagtgggtaaactaaatgtagccttcagtaaaattgaatctcagtgtaatccttggtgctggcatttctcagttccgaggagttaaatgatcccatctaagaggtcattgccatgcctattggcactttactgtcatagcatttttaagggacactgtcaaggtgtttaagttctcagaattacttgttgggattttaggacaggtttgtttacttaaagtaagaactgcattgtcaaagttgaaagaggaacacttttgtgagttcacaaatgtgttcttaagaaaacattaaaatatggagctctgggttttcaagactatttggcattcttaatttggggacttgggagggaaactgataaaaagaaattgaagaattgatggttatacttaaagaagggtaatgtaaacagtggtgatgaaatatatacacatcaagtgaaattacttgacagtgttcatttgaatgactttgaattcaagccattataattacttttaaaattaaatatcatttgcactgttctgataatgggtgcagtttttgagcaatataatcagagctaaatatgcatgtagtgattagtgatgtgaacaattaacgttctgagaagaaatactaactgtggtattttcaaacttaaatttctgtagtaaaatcagtatcaaagtcttatcagatcaaggaaaaacaggcaatgcatataaacatacttttgaatgttgtgtggcctataaagcaataatgcaatttatatggaatgtcatgggatatgagaaatggaaatgcaaaaataactaatcctttagtaaaaatgtcaacatgttaaagggggaatgttaactaatgtaggttattgctatttgtgatttgtttatgggttcttggctttgacagcttcaaagaatggacagtgataagttaaaagaaattttgtatattgtcaaggaaagggtcttaaatccgagtcaagtcccttccttggggtaaaaaatgtattcttaaagcattctgatgttaaaaagaaaacttaagttatctaaccaaaacagacgcaagattttgtttctgcagactacttggcaatcaaaagtgatcataaatttaggttatcagttttcagaaagttgctttgtgagaaaattttgttagatatattctcccaagcatgctttttgtggaaggttttcagccattgccactgaatcagatgttaaaaatgaagggaaaattgagtgtgcacacacacaactgttgtacactcatgattgcagtttttagcttaagaaacttttctaccagttactgtgaatctgacttaaaatgtaaagtttcctcatgataaaataggaacaacatagaaatggattgatggggtgatctgagttattgtatataaaagtttttaaagaatagaatgaacatcaagctagataggcaaaaattgacacattcagaacagcttttttgactgcgaagccaaaagttgtcagaaacagcaaaagatcccttattattacagagtattttacgtagtctctattttaaggagagaaattaaatagaagggcttcatgcatttaggggagggtgctaaaacttctcaagttcgtcaaacttacaggaatacccaccatgatcattttctctctaattatgtataccacaaaattttcatctggccataggaattcactggtgggtgtaaaattaatgactaaagaaattaagtgacaaatacataaaagaaacagacttgtggggatattgttttaaggtgtattaattactcagtgatgataccactcaatagggcatgccactacttttcttaagatgctaattatgaagcagtgctcacaggcattttttaactagcaaattagtagatggacttttggggtctgtcactttttaaaagtatttaagacttaaattctattagcaccacagtctgccttcagtaatacacctaaaatatttttcaggaccagaagcattcagtttgaaaatttgcagatgcaaaccagtattattactaacgctctgggtcaaagattaggtttttaatattaacagtagtctggtaaatatttagaagtctggcattgagaaacaaaagcttgtacctgactagtatttttatttaaaaaaattagttctgttagcttatttaaattgtgttttatttatccgtagaatttatatttatttcattcctttcatctcactgaaaactgtctgcaggccctttgatttggattagatgtgtgaagtactgtcttttgccaaaaacctcaaattacctgttcttttcaacgtagtgggtttgtgcttgtttggagatcagttcaaaaactatctgtactatctgtactgcctctgatgttaagattttatgtatagcataaggaagctagctctgactatattttcctaagaataaagacctatttttgtagcatgtcttaggatctccaggagtccaagaattattgtgggtgtcctccaattcatcactcttcacttaacagcttttaagtagacacttggaatctttagaggtctgtcgccctttgattatccatacattcgaagtaactagccaatggtgaaaaattcctcaagatatcctcagttgcaatcacattactggaagatgaatagaataaatgtattaggctggtcttaatttttgatggaaatattctgttgtcccgtacttgccattggatttgataaagttagtggtaatttggaaagaatcggggacttgccaatatatttgtgggttttagcttatacccctaggatttcttggttgcgggacgagcagttttggccacttccatcaggacaagactttttaggtcacttagtgcaggttttagtttctattttggattaacaacatttatattgattatcgaaaagaagctttcatcatttcagaacagtcctggaagtttgactttgagtgtgggagaagtcctaataaaccattttggaaattagtgtctccaagtgttacagcttcctaaaatgggtttctaacacagtgggatcaaaataaggttattttaggataatatactgtaaacttaattgactgtctgattttctactttgtctataaagtggcttacaacaggttctaatctagaaaggagttataaaggttatctgtaatgtttatgaatt

SEQ ID NO: 365608 - DNA, 7444 bp, Homo sapiens
agagaggagccgactcggcagggactgggggaccgggccgagagtgcgagcgagcgagggagggagtgagggagcgtgcgagccagaaggggaaaggcggccactcgtgcctgagcgaccgcagaggggagtgggagcagtggggtaaaggagcggggggcgggaataagaaaggccgagagaaggcggacagaggctagtggtggtggtggtggtagggggagaaggaggagctggaggagggcaggggctgagggagtgagtgaagcggacgcgcgagggaggggagggaagggaagggaagggaagggggggtcacgcgggggcgcgcgcgcgcaccgggagcgcgctcggaggcgagtggaactggatcgggtttgctgccagcggcgtgagcttcggccgccattttacaacagctccactcgcgccggacacagggagcagcgagcacgcgtttcccgcaacccgataccatcggacaggatttctccgcctcagcccaacggggagatctctggaaacatggctacagaacatgttaatggaaatggtactgaagagcccatggatactacttctgcagttatccattcagaaaattttcagacattgcttgatgctggtttaccacagaaagttgctgaaaaactagatgaaatttacgttgcagggctagttgcacatagtgatttagatgaaagagctattgaagctttaaaagaattcaatgaagacggtgcattggcagttcttcaacagtttaaagacagtgatctctctcatgttcagaacaaaagtgcctttttatgtggagtcatgaagacttacaggcagagagaaaaacaagggaccaaagtagcagattctagtaaaggaccagatgaggcaaaaattaaggcactcttggaaagaacaggctacacacttgatgtgaccactggacagaggaagtatggaggaccacctccagattccgtttattcaggtcagcagccttctgttggcactgagatatttgtgggaaagatcccaagagatctatttgaggatgaacttgttccattatttgagaaagctggacctatatgggatcttcgtctaatgatggatccactcactggtctcaatagaggttatgcgtttgtcactttttgtacaaaagaagcagctcaggaggctgttaaactgtataataatcatgaaattcgttctggaaaacatattggtgtctgcatctcagttgccaacaataggctttttgtgggctctattcctaagagtaaaaccaaggaacagattcttgaagaatttagcaaagtaacagagggtcttacagacgtcattttataccaccaaccggatgacaagaaaaaaaacagaggcttttgctttcttgaatatgaagatcacaaaacagctgcccaggcaaggcgtaggttaatgagtggtaaagtcaaggtctgggggaatgttggaactgttgaatgggctgatcctatagaagatcctgatcctgaggttatggcaaaggtaaaagtgctgtttgtacgcaaccttgccaatactgtaacagaagagattttagaaaaggcatttagtcagtttgggaaactggaacgagtgaagaagttaaaagattatgcgttcattcattttgatgagcgagatggtgctgtcaaggctatggaagaaatgaatggcaaagacttggagggagaaaatattgaaattgtttttgccaagccaccagatcagaaaaggaaagaaagaaaagctcagaggcaagcagcaaaaaatcaaatgtatgacgattactactattatggtccacctcatatgccccctccaacaagaggtcgagggcgtggaggtagaggtggttatggatatcctccagattattatggatatgaagattattatgattattatggttatgattaccataactatcgtggtggatatgaagatccatactatggttatgaagattttcaagttggagctagaggaaggggtggtagaggagcaaggggtgctgctccatccagaggtcgtggggctgctcctccccgcggtagagccggttattcacagagaggaggtcctggatcacagggaaaaggggtcgaggccggtcctgacctgttacaatgaagactgacttgctatgtgggattacaccagaagcttgcagtggagtaatggtaaggaaatcaagcaaccttaaatatgtcggctgtataggagcatattctattgcagaagaccttcctatgaagatcatggaatcaaatacgggacattgaactaatacttggactttgatatgaatttctttaacaattttctctgcagtgcaagttattaaactaaagctactctattttcaaaatgtgttccaacagaaatccttcataactcctagcatggtatcttaataaagaataaagttcttttaaaaatctgctctaagtagatttttccccttttttaaattaaggatcccaacagtggtattttgaaatattctcttgaatttgtgcatttaaattttattgcagtggtatagatgaatgccactgatggtatccttaaattttatttctgctcaccaaggttaatcatgattgtctatatcttttttatagtgatcacttttgaattgtgttcagatatgcagtttcaggtgtaatcatcagagctggttagtcaggcattccagatagtggttcttttcagaacctttttaaaagggttggttaactacctcagtagcagaggattgaactataccctgtctgtactgtacatagaaaatctttgtagataaaagcaaggcttgttaaatatgatatgagggtaagattttaatataccaaatgtaacattcttagttgcctttagtttcagaggcttgtaagacttcctcatgaccatcataacaggccttgcttttgtcgtattttgtggctgaaaaagcagccttgcttcttcagatattgtagttatttggatgtataatagtttagcaagatgttacttttgtaagacatcagatgttcaaaaaagtgcatccgaacttgtactaaatactgcagtgtccctttataaaaagtcagactaaaactgacaattgtacagcgaacctgacatttggatattttgaagttttttcataaatcatagaaattagtatatggctgtagtttagctttttaggtaaaaggtatgtttcattagtgcatttcttcctgctgatcactgtaaacatgtgaatcagctttccatttcttatgcaggtcatgataacttgtagagtagagtacaatcatttgtgctatgtttttaattttctaaagcaccttgatgacagtgagtgtccagtggtgaagcatcctctattgaaccaccctcaaaaatttttttgccaagtcctaagttgatagcttaaagtaaaaagtgaaaattatagtttcattaggacttggtgtaaagaaatcccctccccccttccccaaagggatactgcagttatatcacatacccaataggcaccacgatgaagatcagagcttatacttaattaaggttttatacacaccagttccccagtaaatgcaaatttaacaagaaaatcagacatgtcatatgttcaaaatgctcatggcaaacaatcattttgcattcctgcaaataaaattgttttatactgtaagctggaggcgagtgtaacttatttttgtaataaagtttttattttttttatgtgtcattaatataaatgtgtgttagtgtagaaatcttctggtttaaaaacttagaattgcacacatttcagtatgtttatttgtacttacataattttagaatagtggttgccaatagcctgtatgtttcacattaattggttttttgttatctaaataaatcattttagtatgttgtatgtcagttactgggatagctgggacatagagtgtaatttaaaatttgtcaataagtattcattggaatatatgtaaatgtgccttgccggttattgaaacttatctacaaaatgagtatggggtgacaaaaattagttcctggtgcttaatgaaactttctgccactgattttatatattaccccgtgcttttttaaagtacatctctctcaaaacttagtgtaagtttgagggctacacaaaacatttacatttcattctaacataatgaatataataggttgtggaaagtgggtaaactaaatgtagccttcagtaaaattgaatctcagtgtaatccttggtgctggcatttctcagttccgaggagttaaatgatcccatctaagaggtcattgccatgcctattggcactttactgtcatagcatttttaagggacactgtcaaggtgtttaagttctcagaattacttgttgggattttaggacaggtttgtttacttaaagtaagaactgcattgtcaaagttgaaagaggaacacttttgtgagttcacaaatgtgttcttaagaaaacattaaaatatggagctctgggttttcaagactatttggcattcttaatttggggacttgggagggaaactgataaaaagaaattgaagaattgatggttatacttaaagaagggtaatgtaaacagtggtgatgaaatatatacacatcaagtgaaattacttgacagtgttcatttgaatgactttgaattcaagccattataattacttttaaaattaaatatcatttgcactgttctgataatgggtgcagtttttgagcaatataatcagagctaaatatgcatgtagtgattagtgatgtgaacaattaacgttctgagaagaaatactaactgtggtattttcaaacttaaatttctgtagtaaaatcagtatcaaagtcttatcagatcaaggaaaaacaggcaatgcatataaacatacttttgaatgttgtgtggcctataaagcaataatgcaatttatatggaatgtcatgggatatgagaaatggaaatgcaaaaataactaatcctttagtaaaaatgtcaacatgttaaagggggaatgttaactaatgtaggttattgctatttgtgatttgtttatgggttcttggctttgacagcttcaaagaatggacagtgataagttaaaagaaattttgtatattgtcaaggaaagggtcttaaatccgagtcaagtcccttccttggggtaaaaaatgtattcttaaagcattctgatgttaaaaagaaaacttaagttatctaaccaaaacagacgcaagattttgtttctgcagactacttggcaatcaaaagtgatcataaatttaggttatcagttttcagaaagttgctttgtgagaaaattttgttagatatattctcccaagcatgctttttgtggaaggttttcagccattgccactgaatcagatgttaaaaatgaagggaaaattgagtgtgcacacacacaactgttgtacactcatgattgcagtttttagcttaagaaacttttctaccagttactgtgaatctgacttaaaatgtaaagtttcctcatgataaaataggaacaacatagaaatggattgatggggtgatctgagttattgtatataaaagtttttaaagaatagaatgaacatcaagctagataggcaaaaattgacacattcagaacagcttttttgactgcgaagccaaaagttgtcagaaacagcaaaagatcccttattattacagagtattttacgtagtctctattttaaggagagaaattaaatagaagggcttcatgcatttaggggagggtgctaaaacttctcaagttcgtcaaacttacaggaatacccaccatgatcattttctctctaattatgtataccacaaaattttcatctggccataggaattcactggtgggtgtaaaattaatgactaaagaaattaagtgacaaatacataaaagaaacagacttgtggggatattgttttaaggtgtattaattactcagtgatgataccactcaatagggcatgccactacttttcttaagatgctaattatgaagcagtgctcacaggcattttttaactagcaaattagtagatggacttttggggtctgtcactttttaaaagtatttaagacttaaattctattagcaccacagtctgccttcagtaatacacctaaaatatttttcaggaccagaagcattcagtttgaaaatttgcagatgcaaaccagtattattactaacgctctgggtcaaagattaggtttttaatattaacagtagtctggtaaatatttagaagtctggcattgagaaacaaaagcttgtacctgactagtatttttatttaaaaaaattagttctgttagcttatttaaattgtgttttatttatccgtagaatttatatttatttcattcctttcatctcactgaaaactgtctgcaggccctttgatttggattagatgtgtgaagtactgtcttttgccaaaaacctcaaattacctgttcttttcaacgtagtgggtttgtgcttgtttggagatcagttcaaaaactatctgtactatctgtactgcctctgatgttaagattttatgtatagcataaggaagctagctctgactatattttcctaagaataaagacctatttttgtagcatgtcttaggatctccaggagtccaagaattattgtgggtgtcctccaattcatcactcttcacttaacagcttttaagtagacacttggaatctttagaggtctgtcgccctttgattatccatacattcgaagtaactagccaatggtgaaaaattcctcaagatatcctcagttgcaatcacattactggaagatgaatagaataaatgtattaggctggtcttaatttttgatggaaatattctgttgtcccgtacttgccattggatttgataaagttagtggtaatttggaaagaatcggggacttgccaatatatttgtgggttttagcttatacccctaggatttcttggttgcgggacgagcagttttggccacttccatcaggacaagactttttaggtcacttagtgcaggttttagtttctattttggattaacaacatttatattgattatcgaaaagaagctttcatcatttcagaacagtcctggaagtttgactttgagtgtgggagaagtcctaataaaccattttggaaattagtgtctccaagtgttacagcttcctaaaatgggtttctaacacagtgggatcaaaataaggttattttaggataatatactgtaaacttaattgactgtctgattttctactttgtctataaagtggcttacaacaggttctaatctagaaaggagttataaaggttatctgtaatgtttatgaatt

SEQ ID NO: 365609 - DNA, 7131 bp, Homo sapiens
agagaggagccgactcggcagggactgggggaccgggccgagagtgcgagcgagcgagggagggagtgagggagcgtgcgagccagaaggggaaaggcggccactcgtgcctgagcgaccgcagaggggagtgggagcagtggggtaaaggagcggggggcgggaataagaaaggccgagagaaggcggacagaggctagtggtggtggtggtggtagggggagaaggaggagctggaggagggcaggggctgagggagtgagtgaagcggacgcgcgagggaggggagggaagggaagggaagggaagggggggtcacgcgggggcgcgcgcgcgcaccgggagcgcgctcggaggcgagtggaactggatcgggtttgctgccagcggcgtgagcttcggccgccattttacaacagctccactcgcgccggacacagggagcagcgagcacgcgtttcccgcaacccgataccatcggacaggatttctccgcctcagcccaacggggagatctctggaaacatggctacagaacatgttaatggaaatggtactgaagagcccatggatactacttctgcagttatccattcagaaaattttcagacattgcttgatgctggtttaccacagaaagttgctgaaaaactagatgaaatttacgttgcagggctagttgcacatagtgatttagatgaaagagctattgaagctttaaaagaattcaatgaagacggtgcattggcagttcttcaacagtttaaagacagtgatctctctcatgttcagaacaaaagtgcctttttatgtggagtcatgaagacttacaggcagagagaaaaacaagggaccaaagtagcagattctagtaaaggaccagatgaggcaaaaattaaggcactcttggaaagaacaggctacacacttgatgtgaccactggacagaggaagtatggaggaccacctccagattccgtttattcaggtcagcagccttctgttggcactgagatatttgtgggaaagatcccaagagatctatttgaggatgaacttgttccattatttgagaaagctggacctatatgggatcttcgtctaatgatggatccactcactggtctcaatagaggttatgcgtttgtcactttttgtacaaaagaagcagctcaggaggctgttaaactgtataataatcatgaaattcgttctggaaaacatattggtgtctgcatctcagttgccaacaataggctttttgtgggctctattcctaagagtaaaaccaaggaacagattcttgaagaatttagcaaagtaacagagggtcttacagacgtcattttataccaccaaccggatgacaagaaaaaaaacagaggcttttgctttcttgaatatgaagatcacaaaacagctgcccaggcaaggcgtaggttaatgagtggtaaagtcaaggtctgggggaatgttggaactgttgaatgggctgatcctatagaagatcctgatcctgaggttatggcaaaggtaaaagtgctgtttgtacgcaaccttgccaatactgtaacagaagagattttagaaaaggcatttagtcagtttgggaaactggaacgagtgaagaagttaaaagattatgcgttcattcattttgatgagcgagatggtgctgtcaaggctatggaagaaatgaatggcaaagacttggagggagaaaatattgaaattgtttttgccaagccaccagatcagaaaaggaaagaaagaaaagctcagaggcaagcagcaaaaaatcaaatcagggaaaaggggtcgaggccggtcctgacctgttacaatgaagactgacttgctatgtgggattacaccagaagcttgcagtggagtaatggtaaggaaatcaagcaaccttaaatatgtcggctgtataggagcatattctattgcagaagaccttcctatgaagatcatggaatcaaatacgggacattgaactaatacttggactttgatatgaatttctttaacaattttctctgcagtgcaagttattaaactaaagctactctattttcaaaatgtgttccaacagaaatccttcataactcctagcatggtatcttaataaagaataaagttcttttaaaaatctgctctaagtagatttttccccttttttaaattaaggatcccaacagtggtattttgaaatattctcttgaatttgtgcatttaaattttattgcagtggtatagatgaatgccactgatggtatccttaaattttatttctgctcaccaaggttaatcatgattgtctatatcttttttatagtgatcacttttgaattgtgttcagatatgcagtttcaggtgtaatcatcagagctggttagtcaggcattccagatagtggttcttttcagaacctttttaaaagggttggttaactacctcagtagcagaggattgaactataccctgtctgtactgtacatagaaaatctttgtagataaaagcaaggcttgttaaatatgatatgagggtaagattttaatataccaaatgtaacattcttagttgcctttagtttcagaggcttgtaagacttcctcatgaccatcataacaggccttgcttttgtcgtattttgtggctgaaaaagcagccttgcttcttcagatattgtagttatttggatgtataatagtttagcaagatgttacttttgtaagacatcagatgttcaaaaaagtgcatccgaacttgtactaaatactgcagtgtccctttataaaaagtcagactaaaactgacaattgtacagcgaacctgacatttggatattttgaagttttttcataaatcatagaaattagtatatggctgtagtttagctttttaggtaaaaggtatgtttcattagtgcatttcttcctgctgatcactgtaaacatgtgaatcagctttccatttcttatgcaggtcatgataacttgtagagtagagtacaatcatttgtgctatgtttttaattttctaaagcaccttgatgacagtgagtgtccagtggtgaagcatcctctattgaaccaccctcaaaaatttttttgccaagtcctaagttgatagcttaaagtaaaaagtgaaaattatagtttcattaggacttggtgtaaagaaatcccctccccccttccccaaagggatactgcagttatatcacatacccaataggcaccacgatgaagatcagagcttatacttaattaaggttttatacacaccagttccccagtaaatgcaaatttaacaagaaaatcagacatgtcatatgttcaaaatgctcatggcaaacaatcattttgcattcctgcaaataaaattgttttatactgtaagctggaggcgagtgtaacttatttttgtaataaagtttttattttttttatgtgtcattaatataaatgtgtgttagtgtagaaatcttctggtttaaaaacttagaattgcacacatttcagtatgtttatttgtacttacataattttagaatagtggttgccaatagcctgtatgtttcacattaattggttttttgttatctaaataaatcattttagtatgttgtatgtcagttactgggatagctgggacatagagtgtaatttaaaatttgtcaataagtattcattggaatatatgtaaatgtgccttgccggttattgaaacttatctacaaaatgagtatggggtgacaaaaattagttcctggtgcttaatgaaactttctgccactgattttatatattaccccgtgcttttttaaagtacatctctctcaaaacttagtgtaagtttgagggctacacaaaacatttacatttcattctaacataatgaatataataggttgtggaaagtgggtaaactaaatgtagccttcagtaaaattgaatctcagtgtaatccttggtgctggcatttctcagttccgaggagttaaatgatcccatctaagaggtcattgccatgcctattggcactttactgtcatagcatttttaagggacactgtcaaggtgtttaagttctcagaattacttgttgggattttaggacaggtttgtttacttaaagtaagaactgcattgtcaaagttgaaagaggaacacttttgtgagttcacaaatgtgttcttaagaaaacattaaaatatggagctctgggttttcaagactatttggcattcttaatttggggacttgggagggaaactgataaaaagaaattgaagaattgatggttatacttaaagaagggtaatgtaaacagtggtgatgaaatatatacacatcaagtgaaattacttgacagtgttcatttgaatgactttgaattcaagccattataattacttttaaaattaaatatcatttgcactgttctgataatgggtgcagtttttgagcaatataatcagagctaaatatgcatgtagtgattagtgatgtgaacaattaacgttctgagaagaaatactaactgtggtattttcaaacttaaatttctgtagtaaaatcagtatcaaagtcttatcagatcaaggaaaaacaggcaatgcatataaacatacttttgaatgttgtgtggcctataaagcaataatgcaatttatatggaatgtcatgggatatgagaaatggaaatgcaaaaataactaatcctttagtaaaaatgtcaacatgttaaagggggaatgttaactaatgtaggttattgctatttgtgatttgtttatgggttcttggctttgacagcttcaaagaatggacagtgataagttaaaagaaattttgtatattgtcaaggaaagggtcttaaatccgagtcaagtcccttccttggggtaaaaaatgtattcttaaagcattctgatgttaaaaagaaaacttaagttatctaaccaaaacagacgcaagattttgtttctgcagactacttggcaatcaaaagtgatcataaatttaggttatcagttttcagaaagttgctttgtgagaaaattttgttagatatattctcccaagcatgctttttgtggaaggttttcagccattgccactgaatcagatgttaaaaatgaagggaaaattgagtgtgcacacacacaactgttgtacactcatgattgcagtttttagcttaagaaacttttctaccagttactgtgaatctgacttaaaatgtaaagtttcctcatgataaaataggaacaacatagaaatggattgatggggtgatctgagttattgtatataaaagtttttaaagaatagaatgaacatcaagctagataggcaaaaattgacacattcagaacagcttttttgactgcgaagccaaaagttgtcagaaacagcaaaagatcccttattattacagagtattttacgtagtctctattttaaggagagaaattaaatagaagggcttcatgcatttaggggagggtgctaaaacttctcaagttcgtcaaacttacaggaatacccaccatgatcattttctctctaattatgtataccacaaaattttcatctggccataggaattcactggtgggtgtaaaattaatgactaaagaaattaagtgacaaatacataaaagaaacagacttgtggggatattgttttaaggtgtattaattactcagtgatgataccactcaatagggcatgccactacttttcttaagatgctaattatgaagcagtgctcacaggcattttttaactagcaaattagtagatggacttttggggtctgtcactttttaaaagtatttaagacttaaattctattagcaccacagtctgccttcagtaatacacctaaaatatttttcaggaccagaagcattcagtttgaaaatttgcagatgcaaaccagtattattactaacgctctgggtcaaagattaggtttttaatattaacagtagtctggtaaatatttagaagtctggcattgagaaacaaaagcttgtacctgactagtatttttatttaaaaaaattagttctgttagcttatttaaattgtgttttatttatccgtagaatttatatttatttcattcctttcatctcactgaaaactgtctgcaggccctttgatttggattagatgtgtgaagtactgtcttttgccaaaaacctcaaattacctgttcttttcaacgtagtgggtttgtgcttgtttggagatcagttcaaaaactatctgtactatctgtactgcctctgatgttaagattttatgtatagcataaggaagctagctctgactatattttcctaagaataaagacctatttttgtagcatgtcttaggatctccaggagtccaagaattattgtgggtgtcctccaattcatcactcttcacttaacagcttttaagtagacacttggaatctttagaggtctgtcgccctttgattatccatacattcgaagtaactagccaatggtgaaaaattcctcaagatatcctcagttgcaatcacattactggaagatgaatagaataaatgtattaggctggtcttaatttttgatggaaatattctgttgtcccgtacttgccattggatttgataaagttagtggtaatttggaaagaatcggggacttgccaatatatttgtgggttttagcttatacccctaggatttcttggttgcgggacgagcagttttggccacttccatcaggacaagactttttaggtcacttagtgcaggttttagtttctattttggattaacaacatttatattgattatcgaaaagaagctttcatcatttcagaacagtcctggaagtttgactttgagtgtgggagaagtcctaataaaccattttggaaattagtgtctccaagtgttacagcttcctaaaatgggtttctaacacagtgggatcaaaataaggttattttaggataatatactgtaaacttaattgactgtctgattttctactttgtctataaagtggcttacaacaggttctaatctagaaaggagttataaaggttatctgtaatgtttatgaatt

SEQ ID NO: 365610 - DNA, 7038 bp, Homo sapiens
gaacggctacgcggccgcggagccgggggcgggggccgggcgcgcacagaccgatctctggaaacatggctacagaacatgttaatggaaatggtactgaagagcccatggatactacttctgcagttatccattcagaaaattttcagacattgcttgatgctggtttaccacagaaagttgctgaaaaactagatgaaatttacgttgcagggctagttgcacatagtgatttagatgaaagagctattgaagctttaaaagaattcaatgaagacggtgcattggcagttcttcaacagtttaaagacagtgatctctctcatgttcagaacaaaagtgcctttttatgtggagtcatgaagacttacaggcagagagaaaaacaagggaccaaagtagcagattctagtaaaggaccagatgaggcaaaaattaaggcactcttggaaagaacaggctacacacttgatgtgaccactggacagaggaagtatggaggaccacctccagattccgtttattcaggtcagcagccttctgttggcactgagatatttgtgggaaagatcccaagagatctatttgaggatgaacttgttccattatttgagaaagctggacctatatgggatcttcgtctaatgatggatccactcactggtctcaatagaggttatgcgtttgtcactttttgtacaaaagaagcagctcaggaggctgttaaactgtataataatcatgaaattcgttctggaaaacatattggtgtctgcatctcagttgccaacaataggctttttgtgggctctattcctaagagtaaaaccaaggaacagattcttgaagaatttagcaaagtaacagagggtcttacagacgtcattttataccaccaaccggatgacaagaaaaaaaacagaggcttttgctttcttgaatatgaagatcacaaaacagctgcccaggcaaggcgtaggttaatgagtggtaaagtcaaggtctgggggaatgttggaactgttgaatgggctgatcctatagaagatcctgatcctgaggttatggcaaaggtaaaagtgctgtttgtacgcaaccttgccaatactgtaacagaagagattttagaaaaggcatttagtcagtttgggaaactggaacgagtgaagaagttaaaagattatgcgttcattcattttgatgagcgagatggtgctgtcaaggctatggaagaaatgaatggcaaagacttggagggagaaaatattgaaattgtttttgccaagccaccagatcagaaaaggaaagaaagaaaagctcagaggcaagcagcaaaaaatcaaatgtatgacgattactactattatggtccacctcatatgccccctccaacaagaggtcgagggcgtggaggtagaggtggttatggatatcctccagattattatggatatgaagattattatgattattatggttatgattaccataactatcgtggtggatatgaagatccatactatggttatgaagattttcaagttggagctagaggaaggggtggtagaggagcaaggggtgctgctccatccagaggtcgtggggctgctcctccccgcggtagagccggttattcacagagaggaggtcctggatcagcaagaggcgttcgaggtgcgagaggaggtgcccaacaacaaagaggccgcgggcagggaaaaggggtcgaggccggtcctgacctgttacaatgaagactgacttgctatgtgggattacaccagaagcttgcagtggagtaatggtaaggaaatcaagcaaccttaaatatgtcggctgtataggagcatattctattgcagaagaccttcctatgaagatcatggaatcaaatacgggacattgaactaatacttggactttgatatgaatttctttaacaattttctctgcagtgcaagttattaaactaaagctactctattttcaaaatgtgttccaacagaaatccttcataactcctagcatggtatcttaataaagaataaagttcttttaaaaatctgctctaagtagatttttccccttttttaaattaaggatcccaacagtggtattttgaaatattctcttgaatttgtgcatttaaattttattgcagtggtatagatgaatgccactgatggtatccttaaattttatttctgctcaccaaggttaatcatgattgtctatatcttttttatagtgatcacttttgaattgtgttcagatatgcagtttcaggtgtaatcatcagagctggttagtcaggcattccagatagtggttcttttcagaacctttttaaaagggttggttaactacctcagtagcagaggattgaactataccctgtctgtactgtacatagaaaatctttgtagataaaagcaaggcttgttaaatatgatatgagggtaagattttaatataccaaatgtaacattcttagttgcctttagtttcagaggcttgtaagacttcctcatgaccatcataacaggccttgcttttgtcgtattttgtggctgaaaaagcagccttgcttcttcagatattgtagttatttggatgtataatagtttagcaagatgttacttttgtaagacatcagatgttcaaaaaagtgcatccgaacttgtactaaatactgcagtgtccctttataaaaagtcagactaaaactgacaattgtacagcgaacctgacatttggatattttgaagttttttcataaatcatagaaattagtatatggctgtagtttagctttttaggtaaaaggtatgtttcattagtgcatttcttcctgctgatcactgtaaacatgtgaatcagctttccatttcttatgcaggtcatgataacttgtagagtagagtacaatcatttgtgctatgtttttaattttctaaagcaccttgatgacagtgagtgtccagtggtgaagcatcctctattgaaccaccctcaaaaatttttttgccaagtcctaagttgatagcttaaagtaaaaagtgaaaattatagtttcattaggacttggtgtaaagaaatcccctccccccttccccaaagggatactgcagttatatcacatacccaataggcaccacgatgaagatcagagcttatacttaattaaggttttatacacaccagttccccagtaaatgcaaatttaacaagaaaatcagacatgtcatatgttcaaaatgctcatggcaaacaatcattttgcattcctgcaaataaaattgttttatactgtaagctggaggcgagtgtaacttatttttgtaataaagtttttattttttttatgtgtcattaatataaatgtgtgttagtgtagaaatcttctggtttaaaaacttagaattgcacacatttcagtatgtttatttgtacttacataattttagaatagtggttgccaatagcctgtatgtttcacattaattggttttttgttatctaaataaatcattttagtatgttgtatgtcagttactgggatagctgggacatagagtgtaatttaaaatttgtcaataagtattcattggaatatatgtaaatgtgccttgccggttattgaaacttatctacaaaatgagtatggggtgacaaaaattagttcctggtgcttaatgaaactttctgccactgattttatatattaccccgtgcttttttaaagtacatctctctcaaaacttagtgtaagtttgagggctacacaaaacatttacatttcattctaacataatgaatataataggttgtggaaagtgggtaaactaaatgtagccttcagtaaaattgaatctcagtgtaatccttggtgctggcatttctcagttccgaggagttaaatgatcccatctaagaggtcattgccatgcctattggcactttactgtcatagcatttttaagggacactgtcaaggtgtttaagttctcagaattacttgttgggattttaggacaggtttgtttacttaaagtaagaactgcattgtcaaagttgaaagaggaacacttttgtgagttcacaaatgtgttcttaagaaaacattaaaatatggagctctgggttttcaagactatttggcattcttaatttggggacttgggagggaaactgataaaaagaaattgaagaattgatggttatacttaaagaagggtaatgtaaacagtggtgatgaaatatatacacatcaagtgaaattacttgacagtgttcatttgaatgactttgaattcaagccattataattacttttaaaattaaatatcatttgcactgttctgataatgggtgcagtttttgagcaatataatcagagctaaatatgcatgtagtgattagtgatgtgaacaattaacgttctgagaagaaatactaactgtggtattttcaaacttaaatttctgtagtaaaatcagtatcaaagtcttatcagatcaaggaaaaacaggcaatgcatataaacatacttttgaatgttgtgtggcctataaagcaataatgcaatttatatggaatgtcatgggatatgagaaatggaaatgcaaaaataactaatcctttagtaaaaatgtcaacatgttaaagggggaatgttaactaatgtaggttattgctatttgtgatttgtttatgggttcttggctttgacagcttcaaagaatggacagtgataagttaaaagaaattttgtatattgtcaaggaaagggtcttaaatccgagtcaagtcccttccttggggtaaaaaatgtattcttaaagcattctgatgttaaaaagaaaacttaagttatctaaccaaaacagacgcaagattttgtttctgcagactacttggcaatcaaaagtgatcataaatttaggttatcagttttcagaaagttgctttgtgagaaaattttgttagatatattctcccaagcatgctttttgtggaaggttttcagccattgccactgaatcagatgttaaaaatgaagggaaaattgagtgtgcacacacacaactgttgtacactcatgattgcagtttttagcttaagaaacttttctaccagttactgtgaatctgacttaaaatgtaaagtttcctcatgataaaataggaacaacatagaaatggattgatggggtgatctgagttattgtatataaaagtttttaaagaatagaatgaacatcaagctagataggcaaaaattgacacattcagaacagcttttttgactgcgaagccaaaagttgtcagaaacagcaaaagatcccttattattacagagtattttacgtagtctctattttaaggagagaaattaaatagaagggcttcatgcatttaggggagggtgctaaaacttctcaagttcgtcaaacttacaggaatacccaccatgatcattttctctctaattatgtataccacaaaattttcatctggccataggaattcactggtgggtgtaaaattaatgactaaagaaattaagtgacaaatacataaaagaaacagacttgtggggatattgttttaaggtgtattaattactcagtgatgataccactcaatagggcatgccactacttttcttaagatgctaattatgaagcagtgctcacaggcattttttaactagcaaattagtagatggacttttggggtctgtcactttttaaaagtatttaagacttaaattctattagcaccacagtctgccttcagtaatacacctaaaatatttttcaggaccagaagcattcagtttgaaaatttgcagatgcaaaccagtattattactaacgctctgggtcaaagattaggtttttaatattaacagtagtctggtaaatatttagaagtctggcattgagaaacaaaagcttgtacctgactagtatttttatttaaaaaaattagttctgttagcttatttaaattgtgttttatttatccgtagaatttatatttatttcattcctttcatctcactgaaaactgtctgcaggccctttgatttggattagatgtgtgaagtactgtcttttgccaaaaacctcaaattacctgttcttttcaacgtagtgggtttgtgcttgtttggagatcagttcaaaaactatctgtactatctgtactgcctctgatgttaagattttatgtatagcataaggaagctagctctgactatattttcctaagaataaagacctatttttgtagcatgtcttaggatctccaggagtccaagaattattgtgggtgtcctccaattcatcactcttcacttaacagcttttaagtagacacttggaatctttagaggtctgtcgccctttgattatccatacattcgaagtaactagccaatggtgaaaaattcctcaagatatcctcagttgcaatcacattactggaagatgaatagaataaatgtattaggctggtcttaatttttgatggaaatattctgttgtcccgtacttgccattggatttgataaagttagtggtaatttggaaagaatcggggacttgccaatatatttgtgggttttagcttatacccctaggatttcttggttgcgggacgagcagttttggccacttccatcaggacaagactttttaggtcacttagtgcaggttttagtttctattttggattaacaacatttatattgattatcgaaaagaagctttcatcatttcagaacagtcctggaagtttgactttgagtgtgggagaagtcctaataaaccattttggaaattagtgtctccaagtgttacagcttcctaaaatgggtttctaacacagtgggatcaaaataaggttattttaggataatatactgtaaacttaattgactgtctgattttctactttgtctataaagtggcttacaacaggttctaatctagaaaggagttataaaggttatctgtaatgtttatgaatt

SEQ ID NO: 365611 - DNA, 7338 bp, Homo sapiens
agagaggagccgactcggcagggactgggggaccgggccgagagtgcgagcgagcgagggagggagtgagggagcgtgcgagccagaaggggaaaggcggccactcgtgcctgagcgaccgcagaggggagtgggagcagtggggtaaaggagcggggggcgggaataagaaaggccgagagaaggcggacagaggctagtggtggtggtggtggtagggggagaaggaggagctggaggagggcaggggctgagggagtgagtgaagcggacgcgcgagggaggggagggaagggaagggaagggaagggggggtcacgcgggggcgcgcgcgcgcaccgggagcgcgctcggaggcgagtggaactggatcgggtttgctgccagcggcgtgagcttcggccgccattttacaacagctccactcgcgccggacacagggagcagcgagcacgcgtttcccgcaacccgataccatcggacaggatttctccgcctcagcccaacggggagggctagttgcacatagtgatttagatgaaagagctattgaagctttaaaagaattcaatgaagacggtgcattggcagttcttcaacagtttaaagacagtgatctctctcatgttcagaacaaaagtgcctttttatgtggagtcatgaagacttacaggcagagagaaaaacaagggaccaaagtagcagattctagtaaaggaccagatgaggcaaaaattaaggcactcttggaaagaacaggctacacacttgatgtgaccactggacagaggaagtatggaggaccacctccagattccgtttattcaggtcagcagccttctgttggcactgagatatttgtgggaaagatcccaagagatctatttgaggatgaacttgttccattatttgagaaagctggacctatatgggatcttcgtctaatgatggatccactcactggtctcaatagaggttatgcgtttgtcactttttgtacaaaagaagcagctcaggaggctgttaaactgtataataatcatgaaattcgttctggaaaacatattggtgtctgcatctcagttgccaacaataggctttttgtgggctctattcctaagagtaaaaccaaggaacagattcttgaagaatttagcaaagtaacagagggtcttacagacgtcattttataccaccaaccggatgacaagaaaaaaaacagaggcttttgctttcttgaatatgaagatcacaaaacagctgcccaggcaaggcgtaggttaatgagtggtaaagtcaaggtctgggggaatgttggaactgttgaatgggctgatcctatagaagatcctgatcctgaggttatggcaaaggtaaaagtgctgtttgtacgcaaccttgccaatactgtaacagaagagattttagaaaaggcatttagtcagtttgggaaactggaacgagtgaagaagttaaaagattatgcgttcattcattttgatgagcgagatggtgctgtcaaggctatggaagaaatgaatggcaaagacttggagggagaaaatattgaaattgtttttgccaagccaccagatcagaaaaggaaagaaagaaaagctcagaggcaagcagcaaaaaatcaaatgtatgacgattactactattatggtccacctcatatgccccctccaacaagaggtcgagggcgtggaggtagaggtggttatggatatcctccagattattatggatatgaagattattatgattattatggttatgattaccataactatcgtggtggatatgaagatccatactatggttatgaagattttcaagttggagctagaggaaggggtggtagaggagcaaggggtgctgctccatccagaggtcgtggggctgctcctccccgcggtagagccggttattcacagagaggaggtcctggatcagcaagaggcgttcgaggtgcgagaggaggtgcccaacaacaaagaggccgcgggcagggaaaaggggtcgaggccggtcctgacctgttacaatgaagactgacttgctatgtgggattacaccagaagcttgcagtggagtaatggtaaggaaatcaagcaaccttaaatatgtcggctgtataggagcatattctattgcagaagaccttcctatgaagatcatggaatcaaatacgggacattgaactaatacttggactttgatatgaatttctttaacaattttctctgcagtgcaagttattaaactaaagctactctattttcaaaatgtgttccaacagaaatccttcataactcctagcatggtatcttaataaagaataaagttcttttaaaaatctgctctaagtagatttttccccttttttaaattaaggatcccaacagtggtattttgaaatattctcttgaatttgtgcatttaaattttattgcagtggtatagatgaatgccactgatggtatccttaaattttatttctgctcaccaaggttaatcatgattgtctatatcttttttatagtgatcacttttgaattgtgttcagatatgcagtttcaggtgtaatcatcagagctggttagtcaggcattccagatagtggttcttttcagaacctttttaaaagggttggttaactacctcagtagcagaggattgaactataccctgtctgtactgtacatagaaaatctttgtagataaaagcaaggcttgttaaatatgatatgagggtaagattttaatataccaaatgtaacattcttagttgcctttagtttcagaggcttgtaagacttcctcatgaccatcataacaggccttgcttttgtcgtattttgtggctgaaaaagcagccttgcttcttcagatattgtagttatttggatgtataatagtttagcaagatgttacttttgtaagacatcagatgttcaaaaaagtgcatccgaacttgtactaaatactgcagtgtccctttataaaaagtcagactaaaactgacaattgtacagcgaacctgacatttggatattttgaagttttttcataaatcatagaaattagtatatggctgtagtttagctttttaggtaaaaggtatgtttcattagtgcatttcttcctgctgatcactgtaaacatgtgaatcagctttccatttcttatgcaggtcatgataacttgtagagtagagtacaatcatttgtgctatgtttttaattttctaaagcaccttgatgacagtgagtgtccagtggtgaagcatcctctattgaaccaccctcaaaaatttttttgccaagtcctaagttgatagcttaaagtaaaaagtgaaaattatagtttcattaggacttggtgtaaagaaatcccctccccccttccccaaagggatactgcagttatatcacatacccaataggcaccacgatgaagatcagagcttatacttaattaaggttttatacacaccagttccccagtaaatgcaaatttaacaagaaaatcagacatgtcatatgttcaaaatgctcatggcaaacaatcattttgcattcctgcaaataaaattgttttatactgtaagctggaggcgagtgtaacttatttttgtaataaagtttttattttttttatgtgtcattaatataaatgtgtgttagtgtagaaatcttctggtttaaaaacttagaattgcacacatttcagtatgtttatttgtacttacataattttagaatagtggttgccaatagcctgtatgtttcacattaattggttttttgttatctaaataaatcattttagtatgttgtatgtcagttactgggatagctgggacatagagtgtaatttaaaatttgtcaataagtattcattggaatatatgtaaatgtgccttgccggttattgaaacttatctacaaaatgagtatggggtgacaaaaattagttcctggtgcttaatgaaactttctgccactgattttatatattaccccgtgcttttttaaagtacatctctctcaaaacttagtgtaagtttgagggctacacaaaacatttacatttcattctaacataatgaatataataggttgtggaaagtgggtaaactaaatgtagccttcagtaaaattgaatctcagtgtaatccttggtgctggcatttctcagttccgaggagttaaatgatcccatctaagaggtcattgccatgcctattggcactttactgtcatagcatttttaagggacactgtcaaggtgtttaagttctcagaattacttgttgggattttaggacaggtttgtttacttaaagtaagaactgcattgtcaaagttgaaagaggaacacttttgtgagttcacaaatgtgttcttaagaaaacattaaaatatggagctctgggttttcaagactatttggcattcttaatttggggacttgggagggaaactgataaaaagaaattgaagaattgatggttatacttaaagaagggtaatgtaaacagtggtgatgaaatatatacacatcaagtgaaattacttgacagtgttcatttgaatgactttgaattcaagccattataattacttttaaaattaaatatcatttgcactgttctgataatgggtgcagtttttgagcaatataatcagagctaaatatgcatgtagtgattagtgatgtgaacaattaacgttctgagaagaaatactaactgtggtattttcaaacttaaatttctgtagtaaaatcagtatcaaagtcttatcagatcaaggaaaaacaggcaatgcatataaacatacttttgaatgttgtgtggcctataaagcaataatgcaatttatatggaatgtcatgggatatgagaaatggaaatgcaaaaataactaatcctttagtaaaaatgtcaacatgttaaagggggaatgttaactaatgtaggttattgctatttgtgatttgtttatgggttcttggctttgacagcttcaaagaatggacagtgataagttaaaagaaattttgtatattgtcaaggaaagggtcttaaatccgagtcaagtcccttccttggggtaaaaaatgtattcttaaagcattctgatgttaaaaagaaaacttaagttatctaaccaaaacagacgcaagattttgtttctgcagactacttggcaatcaaaagtgatcataaatttaggttatcagttttcagaaagttgctttgtgagaaaattttgttagatatattctcccaagcatgctttttgtggaaggttttcagccattgccactgaatcagatgttaaaaatgaagggaaaattgagtgtgcacacacacaactgttgtacactcatgattgcagtttttagcttaagaaacttttctaccagttactgtgaatctgacttaaaatgtaaagtttcctcatgataaaataggaacaacatagaaatggattgatggggtgatctgagttattgtatataaaagtttttaaagaatagaatgaacatcaagctagataggcaaaaattgacacattcagaacagcttttttgactgcgaagccaaaagttgtcagaaacagcaaaagatcccttattattacagagtattttacgtagtctctattttaaggagagaaattaaatagaagggcttcatgcatttaggggagggtgctaaaacttctcaagttcgtcaaacttacaggaatacccaccatgatcattttctctctaattatgtataccacaaaattttcatctggccataggaattcactggtgggtgtaaaattaatgactaaagaaattaagtgacaaatacataaaagaaacagacttgtggggatattgttttaaggtgtattaattactcagtgatgataccactcaatagggcatgccactacttttcttaagatgctaattatgaagcagtgctcacaggcattttttaactagcaaattagtagatggacttttggggtctgtcactttttaaaagtatttaagacttaaattctattagcaccacagtctgccttcagtaatacacctaaaatatttttcaggaccagaagcattcagtttgaaaatttgcagatgcaaaccagtattattactaacgctctgggtcaaagattaggtttttaatattaacagtagtctggtaaatatttagaagtctggcattgagaaacaaaagcttgtacctgactagtatttttatttaaaaaaattagttctgttagcttatttaaattgtgttttatttatccgtagaatttatatttatttcattcctttcatctcactgaaaactgtctgcaggccctttgatttggattagatgtgtgaagtactgtcttttgccaaaaacctcaaattacctgttcttttcaacgtagtgggtttgtgcttgtttggagatcagttcaaaaactatctgtactatctgtactgcctctgatgttaagattttatgtatagcataaggaagctagctctgactatattttcctaagaataaagacctatttttgtagcatgtcttaggatctccaggagtccaagaattattgtgggtgtcctccaattcatcactcttcacttaacagcttttaagtagacacttggaatctttagaggtctgtcgccctttgattatccatacattcgaagtaactagccaatggtgaaaaattcctcaagatatcctcagttgcaatcacattactggaagatgaatagaataaatgtattaggctggtcttaatttttgatggaaatattctgttgtcccgtacttgccattggatttgataaagttagtggtaatttggaaagaatcggggacttgccaatatatttgtgggttttagcttatacccctaggatttcttggttgcgggacgagcagttttggccacttccatcaggacaagactttttaggtcacttagtgcaggttttagtttctattttggattaacaacatttatattgattatcgaaaagaagctttcatcatttcagaacagtcctggaagtttgactttgagtgtgggagaagtcctaataaaccattttggaaattagtgtctccaagtgttacagcttcctaaaatgggtttctaacacagtgggatcaaaataaggttattttaggataatatactgtaaacttaattgactgtctgattttctactttgtctataaagtggcttacaacaggttctaatctagaaaggagttataaaggttatctgtaatgtttatgaatt

SEQ ID NO: 365612 - DNA, 3054 bp, Homo sapiens
agagaggagccgactcggcagggactgggggaccgggccgagagtgcgagcgagcgagggagggagtgagggagcgtgcgagccagaaggggaaaggcggccactcgtgcctgagcgaccgcagaggggagtgggagcagtggggtaaaggagcggggggcgggaataagaaaggccgagagaaggcggacagaggctagtggtggtggtggtggtagggggagaaggaggagctggaggagggcaggggctgagggagtgagtgaagcggacgcgcgagggaggggagggaagggaagggaagggaagggggggtcacgcgggggcgcgcgcgcgcaccgggagcgcgctcggaggcgagtggaactggatcgggtttgctgccagcggcgtgagcttcggccgccattttacaacagctccactcgcgccggacacagggagcagcgagcacgcgtttcccgcaacccgataccatcggacaggatttctccgcctcagcccaacggggagatctctggaaacatggctacagaacatgttaatggaaatggtactgaagagcccatggatactacttctgcagttatccattcagaaaattttcagacattgcttgatgctggtttaccacagaaagttgctgaaaaactagatgaaatttacgttgcagggctagttgcacatagtgatttagatgaaagagctattgaagctttaaaagaattcaatgaagacggtgcattggcagttcttcaacagtttaaagacagtgatctctctcatgttcagaacaaaagtgcctttttatgtggagtcatgaagacttacaggcagagagaaaaacaagggaccaaagtagcagattctagtaaaggaccagatgaggcaaaaattaaggcactcttggaaagaacaggctacacacttgatgtgaccactggacagaggaagtatggaggaccacctccagattccgtttattcaggtcagcagccttctgttggcactgagatatttgtgggaaagatcccaagagatctatttgaggatgaacttgttccattatttgagaaagctggacctatatgggatcttcgtctaatgatggatccactcactggtctcaatagaggttatgcgtttgtcactttttgtacaaaagaagcagctcaggaggctgttaaactgtataataatcatgaaattcgttctggaaaacatattggtgtctgcatctcagttgccaacaataggctttttgtgggctctattcctaagagtaaaaccaaggaacagattcttgaagaatttagcaaagtaacagagggtcttacagacgtcattttataccaccaaccggatgacaagaaaaaaaacagaggcttttgctttcttgaatatgaagatcacaaaacagctgcccaggcaaggcgtaggttaatgagtggtaaagtcaaggtctgggggaatgttggaactgttgaatgggctgatcctatagaagatcctgatcctgaggttatggcaaaggtaaaagtgctgtttgtacgcaaccttgccaatactgtaacagaagagattttagaaaaggcatttagtcagtttgggaaactggaacgagtgaagaagttaaaagattatgcgttcattcattttgatgagcgagatggtgctgtcaaggctatggaagaaatgaatggcaaagacttggagggagaaaatattgaaattgtttttgccaagccaccagatcagaaaaggaaagaaagaaaagctcagaggcaagcagcaaaaaatcaaatgtatgacgattactactattatggtccacctcatatgccccctccaacaagaggtcgagggcgtggaggtagaggtggttatggatatcctccagattattatggatatgaagattattatgattattatggttatgattaccataactatcgtggtggatatgaagatccatactatggttatgaagattttcaagttggagctagaggaaggggtggtagaggagcaaggggtgctgctccatccagaggtcgtggggctgctcctccccgcggtagagccggttattcacagagaggaggtcctggatcagcaagaggcgttcgaggtgcgagaggaggtgcccaacaacaaagaggccgcggggtacgtggtgcgaggggtggccgcggtggaaatgtaggaggaaagcgcaaagctgatgggtacaaccagccagattccaagcggcgccagaccaataatcagaactggggctcccaacccattgctcagcaaccgctccaaggtggtgatcattctggtaactatggttacaaatctgaaaaccaggagttttatcaggatacttttgggcaacagtggaagtagaaacagtagggcctctgtaaaattggagactgataggttgatcagaaactcaccctaaatctgaacgggtgccgctataatttgtgacatctggcaagatttccctttatgtatatattttaacaatccgcttggacacgaacaaagccacacttctaactgcttctggcgaactgattttatttttaatttttttcaataaagatattcttagatactgaaagaaatagttaatgagtttgcatttgtgcttgagaaaatttggctcaagtccatttggctgtagtgtcaacgatgtttccagtagtgtttagatttggtgtcttcaaaggtagttgattaaaaccaagtgtgtctttaatatcttgtatcagaataactttgtatgttaccaacttaaattgctagaataaggtaaattgatacacaactgctatttttaatttagaactttgacctaatttgggttttcaaaaccattttggctacttgtattctttatgctgttgtttatttcaataaaaaattcacacctaaatgtatacttactaaaattgtgtttacaattcgtttttcacaaaatttcctgcaaatttggttcaaattgtatagcatgtcaaggccaattaaagggttttgtgccttgttaaaaaaagt

SEQ ID NO: 365613 - DNA, 7393 bp, Homo sapiens
agagaggagccgactcggcagggactgggggaccgggccgagagtgcgagcgagcgagggagggagtgagggagcgtgcgagccagaaggggaaaggcggccactcgtgcctgagcgaccgcagaggggagtgggagcagtggggtaaaggagcggggggcgggaataagaaaggccgagagaaggcggacagaggctagtggtggtggtggtggtagggggagaaggaggagctggaggagggcaggggctgagggagtgagtgaagcggacgcgcgagggaggggagggaagggaagggaagggaagggggggtcacgcgggggcgcgcgcgcgcaccgggagcgcgctcggaggcgagtggaactggatcgggtttgctgccagcggcgtgagcttcggccgccattttacaacagctccactcgcgccggacacagggagcagcgagcacgcgtttcccgcaacccgataccatcggacaggatttctccgcctcagcccaacggggagatctctggaaacatggctacagaacatgttaatggaaatggtactgaagagcccatggatactacttctgcagttatccattcagaaaattttcagacattgcttgatgctggtttaccacagaaagttgctgaaaaactagatgaaatttacgttgcagggctagttgcacatagtgatttagatgaaagagctattgaagctttaaaagaattcaatgaagacggtgcattggcagttcttcaacagtttaaagacagtgatctctctcatgttcagaacaaaagtgcctttttatgtggagtcatgaagacttacaggcagagagaaaaacaagggaccaaagtagcagattctagtaaaggaccagatgaggcaaaaattaaggcactcttggaaagaacaggctacacacttgatgtgaccactggacagaggaagtatggaggaccacctccagattccgtttattcaggtcagcagccttctgttggcactgagatatttgtgggaaagatcccaagagatctatttgaggatgaacttgttccattatttgagaaagctggacctatatgggatcttcgtctaatgatggatccactcactggtctcaatagaggttatgcgtttgtcactttttgtacaaaagaagcagctcaggaggctgttaaactgtataataatcatgaaattcgttctggaaaacatattggtgtctgcatctcagttgccaacaataggctttttgtgggctctattcctaagagtaaaaccaaggaacagattcttgaagaatttagcaaagtaacagagggtcttacagacgtcattttataccaccaaccggatgacaagaaaaaaaacagaggcttttgctttcttgaatatgaagatcacaaaacagctgcccaggtaaaagtgctgtttgtacgcaaccttgccaatactgtaacagaagagattttagaaaaggcatttagtcagtttgggaaactggaacgagtgaagaagttaaaagattatgcgttcattcattttgatgagcgagatggtgctgtcaaggctatggaagaaatgaatggcaaagacttggagggagaaaatattgaaattgtttttgccaagccaccagatcagaaaaggaaagaaagaaaagctcagaggcaagcagcaaaaaatcaaatgtatgacgattactactattatggtccacctcatatgccccctccaacaagaggtcgagggcgtggaggtagaggtggttatggatatcctccagattattatggatatgaagattattatgattattatggttatgattaccataactatcgtggtggatatgaagatccatactatggttatgaagattttcaagttggagctagaggaaggggtggtagaggagcaaggggtgctgctccatccagaggtcgtggggctgctcctccccgcggtagagccggttattcacagagaggaggtcctggatcagcaagaggcgttcgaggtgcgagaggaggtgcccaacaacaaagaggccgcgggcagggaaaaggggtcgaggccggtcctgacctgttacaatgaagactgacttgctatgtgggattacaccagaagcttgcagtggagtaatggtaaggaaatcaagcaaccttaaatatgtcggctgtataggagcatattctattgcagaagaccttcctatgaagatcatggaatcaaatacgggacattgaactaatacttggactttgatatgaatttctttaacaattttctctgcagtgcaagttattaaactaaagctactctattttcaaaatgtgttccaacagaaatccttcataactcctagcatggtatcttaataaagaataaagttcttttaaaaatctgctctaagtagatttttccccttttttaaattaaggatcccaacagtggtattttgaaatattctcttgaatttgtgcatttaaattttattgcagtggtatagatgaatgccactgatggtatccttaaattttatttctgctcaccaaggttaatcatgattgtctatatcttttttatagtgatcacttttgaattgtgttcagatatgcagtttcaggtgtaatcatcagagctggttagtcaggcattccagatagtggttcttttcagaacctttttaaaagggttggttaactacctcagtagcagaggattgaactataccctgtctgtactgtacatagaaaatctttgtagataaaagcaaggcttgttaaatatgatatgagggtaagattttaatataccaaatgtaacattcttagttgcctttagtttcagaggcttgtaagacttcctcatgaccatcataacaggccttgcttttgtcgtattttgtggctgaaaaagcagccttgcttcttcagatattgtagttatttggatgtataatagtttagcaagatgttacttttgtaagacatcagatgttcaaaaaagtgcatccgaacttgtactaaatactgcagtgtccctttataaaaagtcagactaaaactgacaattgtacagcgaacctgacatttggatattttgaagttttttcataaatcatagaaattagtatatggctgtagtttagctttttaggtaaaaggtatgtttcattagtgcatttcttcctgctgatcactgtaaacatgtgaatcagctttccatttcttatgcaggtcatgataacttgtagagtagagtacaatcatttgtgctatgtttttaattttctaaagcaccttgatgacagtgagtgtccagtggtgaagcatcctctattgaaccaccctcaaaaatttttttgccaagtcctaagttgatagcttaaagtaaaaagtgaaaattatagtttcattaggacttggtgtaaagaaatcccctccccccttccccaaagggatactgcagttatatcacatacccaataggcaccacgatgaagatcagagcttatacttaattaaggttttatacacaccagttccccagtaaatgcaaatttaacaagaaaatcagacatgtcatatgttcaaaatgctcatggcaaacaatcattttgcattcctgcaaataaaattgttttatactgtaagctggaggcgagtgtaacttatttttgtaataaagtttttattttttttatgtgtcattaatataaatgtgtgttagtgtagaaatcttctggtttaaaaacttagaattgcacacatttcagtatgtttatttgtacttacataattttagaatagtggttgccaatagcctgtatgtttcacattaattggttttttgttatctaaataaatcattttagtatgttgtatgtcagttactgggatagctgggacatagagtgtaatttaaaatttgtcaataagtattcattggaatatatgtaaatgtgccttgccggttattgaaacttatctacaaaatgagtatggggtgacaaaaattagttcctggtgcttaatgaaactttctgccactgattttatatattaccccgtgcttttttaaagtacatctctctcaaaacttagtgtaagtttgagggctacacaaaacatttacatttcattctaacataatgaatataataggttgtggaaagtgggtaaactaaatgtagccttcagtaaaattgaatctcagtgtaatccttggtgctggcatttctcagttccgaggagttaaatgatcccatctaagaggtcattgccatgcctattggcactttactgtcatagcatttttaagggacactgtcaaggtgtttaagttctcagaattacttgttgggattttaggacaggtttgtttacttaaagtaagaactgcattgtcaaagttgaaagaggaacacttttgtgagttcacaaatgtgttcttaagaaaacattaaaatatggagctctgggttttcaagactatttggcattcttaatttggggacttgggagggaaactgataaaaagaaattgaagaattgatggttatacttaaagaagggtaatgtaaacagtggtgatgaaatatatacacatcaagtgaaattacttgacagtgttcatttgaatgactttgaattcaagccattataattacttttaaaattaaatatcatttgcactgttctgataatgggtgcagtttttgagcaatataatcagagctaaatatgcatgtagtgattagtgatgtgaacaattaacgttctgagaagaaatactaactgtggtattttcaaacttaaatttctgtagtaaaatcagtatcaaagtcttatcagatcaaggaaaaacaggcaatgcatataaacatacttttgaatgttgtgtggcctataaagcaataatgcaatttatatggaatgtcatgggatatgagaaatggaaatgcaaaaataactaatcctttagtaaaaatgtcaacatgttaaagggggaatgttaactaatgtaggttattgctatttgtgatttgtttatgggttcttggctttgacagcttcaaagaatggacagtgataagttaaaagaaattttgtatattgtcaaggaaagggtcttaaatccgagtcaagtcccttccttggggtaaaaaatgtattcttaaagcattctgatgttaaaaagaaaacttaagttatctaaccaaaacagacgcaagattttgtttctgcagactacttggcaatcaaaagtgatcataaatttaggttatcagttttcagaaagttgctttgtgagaaaattttgttagatatattctcccaagcatgctttttgtggaaggttttcagccattgccactgaatcagatgttaaaaatgaagggaaaattgagtgtgcacacacacaactgttgtacactcatgattgcagtttttagcttaagaaacttttctaccagttactgtgaatctgacttaaaatgtaaagtttcctcatgataaaataggaacaacatagaaatggattgatggggtgatctgagttattgtatataaaagtttttaaagaatagaatgaacatcaagctagataggcaaaaattgacacattcagaacagcttttttgactgcgaagccaaaagttgtcagaaacagcaaaagatcccttattattacagagtattttacgtagtctctattttaaggagagaaattaaatagaagggcttcatgcatttaggggagggtgctaaaacttctcaagttcgtcaaacttacaggaatacccaccatgatcattttctctctaattatgtataccacaaaattttcatctggccataggaattcactggtgggtgtaaaattaatgactaaagaaattaagtgacaaatacataaaagaaacagacttgtggggatattgttttaaggtgtattaattactcagtgatgataccactcaatagggcatgccactacttttcttaagatgctaattatgaagcagtgctcacaggcattttttaactagcaaattagtagatggacttttggggtctgtcactttttaaaagtatttaagacttaaattctattagcaccacagtctgccttcagtaatacacctaaaatatttttcaggaccagaagcattcagtttgaaaatttgcagatgcaaaccagtattattactaacgctctgggtcaaagattaggtttttaatattaacagtagtctggtaaatatttagaagtctggcattgagaaacaaaagcttgtacctgactagtatttttatttaaaaaaattagttctgttagcttatttaaattgtgttttatttatccgtagaatttatatttatttcattcctttcatctcactgaaaactgtctgcaggccctttgatttggattagatgtgtgaagtactgtcttttgccaaaaacctcaaattacctgttcttttcaacgtagtgggtttgtgcttgtttggagatcagttcaaaaactatctgtactatctgtactgcctctgatgttaagattttatgtatagcataaggaagctagctctgactatattttcctaagaataaagacctatttttgtagcatgtcttaggatctccaggagtccaagaattattgtgggtgtcctccaattcatcactcttcacttaacagcttttaagtagacacttggaatctttagaggtctgtcgccctttgattatccatacattcgaagtaactagccaatggtgaaaaattcctcaagatatcctcagttgcaatcacattactggaagatgaatagaataaatgtattaggctggtcttaatttttgatggaaatattctgttgtcccgtacttgccattggatttgataaagttagtggtaatttggaaagaatcggggacttgccaatatatttgtgggttttagcttatacccctaggatttcttggttgcgggacgagcagttttggccacttccatcaggacaagactttttaggtcacttagtgcaggttttagtttctattttggattaacaacatttatattgattatcgaaaagaagctttcatcatttcagaacagtcctggaagtttgactttgagtgtgggagaagtcctaataaaccattttggaaattagtgtctccaagtgttacagcttcctaaaatgggtttctaacacagtgggatcaaaataaggttattttaggataatatactgtaaacttaattgactgtctgattttctactttgtctataaagtggcttacaacaggttctaatctagaaaggagttataaaggttatctgtaatgtttatgaatt

SEQ ID NO: 365614 - DNA, 4264 bp, Homo sapiens
agagaggagccgactcggcagggactgggggaccgggccgagagtgcgagcgagcgagggagggagtgagggagcgtgcgagccagaaggggaaaggcggccactcgtgcctgagcgaccgcagaggggagtgggagcagtggggtaaaggagcggggggcgggaataagaaaggccgagagaaggcggacagaggctagtggtggtggtggtggtagggggagaaggaggagctggaggagggcaggggctgagggagtgagtgaagcggacgcgcgagggaggggagggaagggaagggaagggaagggggggtcacgcgggggcgcgcgcgcgcaccgggagcgcgctcggaggcgagtggaactggatcgggtttgctgccagcggcgtgagcttcggccgccattttacaacagctccactcgcgccggacacagggagcagcgagcacgcgtttcccgcaacccgataccatcggacaggatttctccgcctcagcccaacggggagatctctggaaacatggctacagaacatgttaatggaaatggtactgaagagcccatggatactacttctgcagttatccattcagaaaattttcagacattgcttgatgctggtttaccacagaaagttgctgaaaaactagatgaaatttacgttgcagggctagttgcacatagtgatttagatgaaagagctattgaagctttaaaagaattcaatgaagacggtgcattggcagttcttcaacagtttaaagacagtgatctctctcatgttcagaacaaaagtgcctttttatgtggagtcatgaagacttacaggcagagagaaaaacaagggaccaaagtagcagattctagtaaaggaccagatgaggcaaaaattaaggcactcttggaaagaacaggctacacacttgatgtgaccactggacagaggaagtatggaggaccacctccagattccgtttattcaggtcagcagccttctgttggcactgagatatttgtgggaaagatcccaagagatctatttgaggatgaacttgttccattatttgagaaagctggacctatatgggatcttcgtctaatgatggatccactcactggtctcaatagaggttatgcgtttgtcactttttgtacaaaagaagcagctcaggaggctgttaaactgtataataatcatgaaattcgttctggaaaacatattggtgtctgcatctcagttgccaacaataggctttttgtgggctctattcctaagagtaaaaccaaggaacagattcttgaagaatttagcaaagtaacagagggtcttacagacgtcattttataccaccaaccggatgacaagaaaaaaaacagaggcttttgctttcttgaatatgaagatcacaaaacagctgcccaggcaaggcgtaggttaatgagtggtaaagtcaaggtctgggggaatgttggaactgttgaatgggctgatcctatagaagatcctgatcctgaggttatggcaaaggtaaaagtgctgtttgtacgcaaccttgccaatactgtaacagaagagattttagaaaaggcatttagtcagtttgggaaactggaacgagtgaagaagttaaaagattatgcgttcattcattttgatgagcgagatggtgctgtcaaggctatggaagaaatgaatggcaaagacttggagggagaaaatattgaaattgtttttgccaagccaccagatcagaaaaggaaagaaagaaaagctcagaggcaagcagcaaaaaatcaaatgtatgacgattactactattatggtccacctcatatgccccctccaacaagaggtcgagggcgtggaggtagaggtggttatggatatcctccagattattatggatatgaagattattatgattattatggttatgattaccataactatcgtggtggatatgaagatccatactatggttatgaagattttcaagttggagctagaggaaggggtggtagaggagcaaggggtgctgctccatccagaggtcgtggggctgctcctccccgcggtagagccggttattcacagagaggaggtcctggatcagcaagaggcgttcgaggtgcgagaggaggtgcccaacaacaaagaggccgcgggcagggaaaaggggtcgaggccggtcctgacctgttacaatgaagactgacttgctatgtgggattacaccagaagcttgcagtggagtaatggtaaggaaatcaagcaaccttaaatatgtcggctgtataggagcatattctattgcagaagaccttcctatgaagatcatggaatcaaatacgggacattgaactaatacttggactttgatatgaatttctttaacaattttctctgcagtgcaagttattaaactaaagctactctattttcaaaatgtgttccaacagaaatccttcataactcctagcatggtatcttaataaagaataaagttcttttaaaaatctgctctaagtagatttttccccttttttaaattaaggatcccaacagtggtattttgaaatattctcttgaatttgtgcatttaaattttattgcagtggtatagatgaatgccactgatggtatccttaaattttatttctgctcaccaaggttaatcatgattgtctatatcttttttatagtgatcacttttgaattgtgttcagatatgcagtttcaggtgtaatcatcagagctggttagtcaggcattccagatagtggttcttttcagaacctttttaaaagggttggttaactacctcagtagcagaggattgaactataccctgtctgtactgtacatagaaaatctttgtagataaaagcaaggcttgttaaatatgatatgagggtaagattttaatataccaaatgtaacattcttagttgcctttagtttcagaggcttgtaagacttcctcatgaccatcataacaggccttgcttttgtcgtattttgtggctgaaaaagcagccttgcttcttcagatattgtagttatttggatgtataatagtttagcaagatgttacttttgtaagacatcagatgttcaaaaaagtgcatccgaacttgtactaaatactgcagtgtccctttataaaaagtcagactaaaactgacaattgtacagcgaacctgacatttggatattttgaagttttttcataaatcatagaaattagtatatggctgtagtttagctttttaggtaaaaggtatgtttcattagtgcatttcttcctgctgatcactgtaaacatgtgaatcagctttccatttcttatgcaggtcatgataacttgtagagtagagtacaatcatttgtgctatgtttttaattttctaaagcaccttgatgacagtgagtgtccagtggtgaagcatcctctattgaaccaccctcaaaaatttttttgccaagtcctaagttgatagcttaaagtaaaaagtgaaaattatagtttcattaggacttggtgtaaagaaatcccctccccccttccccaaagggatactgcagttatatcacatacccaataggcaccacgatgaagatcagagcttatacttaattaaggttttatacacaccagttccccagtaaatgcaaatttaacaagaaaatcagacatgtcatatgttcaaaatgctcatggcaaacaatcattttgcattcctgcaaataaaattgttttatactgtaagctggaggcgagtgtaacttatttttgtaataaagtttttaattgacagtgaacatgctgatggtacatgtaaaacaagaagagttgaagaagatatgtgaagaacaatgtattattcctacatagaaataattgatcccattatttggtgtcatgtagtatgtgaatatttattcttaaacgtgactactacatttctacataagaaataccctaccagctgcctacaagcagttcagaatgcctagtgccgcggtggtcctactgtgaataattttcagctactttaaaattatattgtacgttcctcaagcatgtcatatcctctccctagtagagtatctatattactagttactgatgtacctgaaggcaagtctgatgaatttctaggatggtaccatattcttgtcatcttgccgattacattataagtgttggactagaatacgatgtactagtagtatagaatataactagattattatg

SEQ ID NO: 365615 - DNA, 3948 bp, Homo sapiens
agagaggagccgactcggcagggactgggggaccgggccgagagtgcgagcgagcgagggagggagtgagggagcgtgcgagccagaaggggaaaggcggccactcgtgcctgagcgaccgcagaggggagtgggagcagtggggtaaaggagcggggggcgggaataagaaaggccgagagaaggcggacagaggctagtggtggtggtggtggtagggggagaaggaggagctggaggagggcaggggctgagggagtgagtgaagcggacgcgcgagggaggggagggaagggaagggaagggaagggggggtcacgcgggggcgcgcgcgcgcaccgggagcgcgctcggaggcgagtggaactggatcgggtttgctgccagcggcgtgagcttcggccgccattttacaacagctccactcgcgccggacacagggagcagcgagcacgcgtttcccgcaacccgataccatcggacaggatttctccgcctcagcccaacggggagatctctggaaacatggctacagaacatgttaatggaaatggtactgaagagcccatggatactacttctgcagttatccattcagaaaattttcagacattgcttgatgctggtttaccacagaaagttgctgaaaaactagatgaaatttacgttgcagggctagttgcacatagtgatttagatgaaagagctattgaagctttaaaagaattcaatgaagacggtgcattggcagttcttcaacagtttaaagacagtgatctctctcatgttcagaacaaaagtgcctttttatgtggagtcatgaagacttacaggcagagagaaaaacaagggaccaaagtagcagattctagtaaaggaccagatgaggcaaaaattaaggcactcttggaaagaacaggctacacacttgatgtgaccactggacagaggaagtatggaggaccacctccagattccgtttattcaggtcagcagccttctgttggcactgagatatttgtgggaaagatcccaagagatctatttgaggatgaacttgttccattatttgagaaagctggacctatatgggatcttcgtctaatgatggatccactcactggtctcaatagaggttatgcgtttgtcactttttgtacaaaagaagcagctcaggaggctgttaaactgtataataatcatgaaattcgttctggaaaacatattggtgtctgcatctcagttgccaacaataggctttttgtgggctctattcctaagagtaaaaccaaggaacagattcttgaagaatttagcaaagtaacagagggtcttacagacgtcattttataccaccaaccggatgacaagaaaaaaaacagaggcttttgctttcttgaatatgaagatcacaaaacagctgcccaggcaaggcgtaggttaatgagtggtaaagtcaaggtctgggggaatgttggaactgttgaatgggctgatcctatagaagatcctgatcctgaggttatggcaaaggtaaaagtgctgtttgtacgcaaccttgccaatactgtaacagaagagattttagaaaaggcatttagtcagtttgggaaactggaacgagtgaagaagttaaaagattatgcgttcattcattttgatgagcgagatggtgctgtcaaggctatggaagaaatgaatggcaaagacttggagggagaaaatattgaaattgtttttgccaagccaccagatcagaaaaggaaagaaagaaaagctcagaggcaagcagcaaaaaatcaaatgtatgacgattactactattatggtccacctcatatgccccctccaacaagaggtcgagggcgtggaggtagaggtggttatggatatcctccagattattatggatatgaagattattatgattattatggttatgattaccataactatcgtggtggatatgaagatccatactatggttatgaagattttcaagttggagctagaggaaggggtggtagaggagcaaggggtgctgctccatccagaggtcgtggggctgctcctccccgcggtagagccggttattcacagagaggaggtcctggatcagcaagaggcgttcgaggtgcgagaggaggtgcccaacaacaaagaggccgcgggcagggaaaaggggtcgaggccggtcctgacctgttacaatgaagactgacttgctatgtgggattacaccagaagcttgcagtggagtaatggtaaggaaatcaagcaaccttaaatatgtcggctgtataggagcatattctattgcagaagaccttcctatgaagatcatggaatcaaatacgggacattgaactaatacttggactttgatatgaatttctttaacaattttctctgcagtgcaagttattaaactaaagctactctattttcaaaatgtgttccaacagaaatccttcataactcctagcatggtatcttaataaagaataaagttcttttaaaaatctgctctaagtagatttttccccttttttaaattaaggatcccaacagtggtattttgaaatattctcttgaatttgtgcatttaaattttattgcagtggtatagatgaatgccactgatggtatccttaaattttatttctgctcaccaaggttaatcatgattgtctatatcttttttatagtgatcacttttgaattgtgttcagatatgcagtttcaggtgtaatcatcagagctggttagtcaggcattccagatagtggttcttttcagaacctttttaaaagggttggttaactacctcagtagcagaggattgaactataccctgtctgtactgtacatagaaaatctttgtagataaaagcaaggcttgttaaatatgatatgagggtaagattttaatataccaaatgtaacattcttagttgcctttagtttcagaggcttgtaagacttcctcatgaccatcataacaggccttgcttttgtcgtattttgtggctgaaaaagcagccttgcttcttcagatattgtagttatttggatgtataatagtttagcaagatgttacttttgtaagacatcagatgttcaaaaaagtgcatccgaacttgtactaaatactgcagtgtccctttataaaaagtcagactaaaactgacaattgtacagcgaacctgacatttggatattttgaagttttttcataaatcatagaaattagtatatggctgtagtttagctttttaggtaaaaggtatgtttcattagtgcatttcttcctgctgatcactgtaaacatgtgaatcagctttccatttcttatgcaggtcatgataacttgtagagtagagtacaatcatttgtgctatgtttttaattttctaaagcaccttgatgacagtgagtgtccagtggtgaagcatcctctattgaaccaccctcaaaaatttttttgccaagtcctaagttgatagcttaaagtaaaaagtgaaaattatagtttcattaggacttggtgtaaagaaatcccctccccccttccccaaagggatactgcagttatatcacatacccaataggcaccacgatgaagatcagagcttatacttaattaaggttttatacacaccagttccccagtaaatgcaaatttaacaagaaaatcagacatgtcatatgttcaaaatgctcatggcaaacaatcattttgcattcctgcaaataaaattgttttatactgtaagctggaggcgagtgtaacttatttttgtaataaagtttttacggtactgtttctctagtgtgtcaagcaatactagagtgtgctgttagatgtatgccatgctccggattgtgaaacgtagaaatgcacacacatcagtaggtatattggtatctttacataatctcttacgt

SEQ ID NO: 365616 - DNA, 3774 bp, Homo sapiens
agagaggagccgactcggcagggactgggggaccgggccgagagtgcgagcgagcgagggagggagtgagggagcgtgcgagccagaaggggaaaggcggccactcgtgcctgagcgaccgcagaggggagtgggagcagtggggtaaaggagcggggggcgggaataagaaaggccgagagaaggcggacagaggctagtggtggtggtggtggtagggggagaaggaggagctggaggagggcaggggctgagggagtgagtgaagcggacgcgcgagggaggggagggaagggaagggaagggaagggggggtcacgcgggggcgcgcgcgcgcaccgggagcgcgctcggaggcgagtggaactggatcgggtttgctgccagcggcgtgagcttcggccgccattttacaacagctccactcgcgccggacacagggagcagcgagcacgcgtttcccgcaacccgataccatcggacaggatttctccgcctcagcccaacggggagatctctggaaacatggctacagaacatgttaatggaaatggtactgaagagcccatggatactacttctgcagttatccattcagaaaattttcagacattgcttgatgctggtttaccacagaaagttgctgaaaaactagatgaaatttacgttgcagggctagttgcacatagtgatttagatgaaagagctattgaagctttaaaagaattcaatgaagacggtgcattggcagttcttcaacagtttaaagacagtgatctctctcatgttcagaacaaaagtgcctttttatgtggagtcatgaagacttacaggcagagagaaaaacaagggaccaaagtagcagattctagtaaaggaccagatgaggcaaaaattaaggcactcttggaaagaacaggctacacacttgatgtgaccactggacagaggaagtatggaggaccacctccagattccgtttattcaggtcagcagccttctgttggcactgagatatttgtgggaaagatcccaagagatctatttgaggatgaacttgttccattatttgagaaagctggacctatatgggatcttcgtctaatgatggatccactcactggtctcaatagaggttatgcgtttgtcactttttgtacaaaagaagcagctcaggaggctgttaaactgtataataatcatgaaattcgttctggaaaacatattggtgtctgcatctcagttgccaacaataggctttttgtgggctctattcctaagagtaaaaccaaggaacagattcttgaagaatttagcaaagtaacagagggtcttacagacgtcattttataccaccaaccggatgacaagaaaaaaaacagaggcttttgctttcttgaatatgaagatcacaaaacagctgcccaggcaaggcgtaggttaatgagtggtaaagtcaaggtctgggggaatgttggaactgttgaatgggctgatcctatagaagatcctgatcctgaggttatggcaaaggtaaaagtgctgtttgtacgcaaccttgccaatactgtaacagaagagattttagaaaaggcatttagtcagtttgggaaactggaacgagtgaagaagttaaaagattatgcgttcattcattttgatgagcgagatggtgctgtcaaggctatggaagaaatgaatggcaaagacttggagggagaaaatattgaaattgtttttgccaagccaccagatcagaaaaggaaagaaagaaaagctcagaggcaagcagcaaaaaatcaaatgtatgacgattactactattatggtccacctcatatgccccctccaacaagaggtcgagggcgtggaggtagaggtggttatggatatcctccagattattatggatatgaagattattatgattattatggttatgattaccataactatcgtggtggatatgaagatccatactatggttatgaagattttcaagttggagctagaggaaggggtggtagaggagcaaggggtgctgctccatccagaggtcgtggggctgctcctccccgcggtagagccggttattcacagagaggaggtcctggatcagcaagaggcgttcgaggtgcgagaggaggtgcccaacaacaaagaggccgcgggcagggaaaaggggtcgaggccggtcctgacctgttacaatgaagactgacttgctatgtgggattacaccagaagcttgcagtggagtaatggtaaggaaatcaagcaaccttaaatatgtcggctgtataggagcatattctattgcagaagaccttcctatgaagatcatggaatcaaatacgggacattgaactaatacttggactttgatatgaatttctttaacaattttctctgcagtgcaagttattaaactaaagctactctattttcaaaatgtgttccaacagaaatccttcataactcctagcatggtatcttaataaagaataaagttcttttaaaaatctgctctaagtagatttttccccttttttaaattaaggatcccaacagtggtattttgaaatattctcttgaatttgtgcatttaaattttattgcagtggtatagatgaatgccactgatggtatccttaaattttatttctgctcaccaaggttaatcatgattgtctatatcttttttatagtgatcacttttgaattgtgttcagatatgcagtttcaggtgtaatcatcagagctggttagtcaggcattccagatagtggttcttttcagaacctttttaaaagggttggttaactacctcagtagcagaggattgaactataccctgtctgtactgtacatagaaaatctttgtagataaaagcaaggcttgttaaatatgatatgagggtaagattttaatataccaaatgtaacattcttagttgcctttagtttcagaggcttgtaagacttcctcatgaccatcataacaggccttgcttttgtcgtattttgtggctgaaaaagcagccttgcttcttcagatattgtagttatttggatgtataatagtttagcaagatgttacttttgtaagacatcagatgttcaaaaaagtgcatccgaacttgtactaaatactgcagtgtccctttataaaaagtcagactaaaactgacaattgtacagcgaacctgacatttggatattttgaagttttttcataaatcatagaaattagtatatggctgtagtttagctttttaggtaaaaggtatgtttcattagtgcatttcttcctgctgatcactgtaaacatgtgaatcagctttccatttcttatgcaggtcatgataacttgtagagtagagtacaatcatttgtgctatgtttttaattttctaaagcaccttgatgacagtgagtgtccagtggtgaagcatcctctattgaaccaccctcaaaaatttttttgccaagtcctaagttgatagcttaaagtaaaaagtgaaaattatagtttcattaggacttggtgtaaagaaatcccctccccccttccccaaagggatactgcagttatatcacatacccaataggcaccacgatgaagatcagagcttatacttaattaaggttttatacacaccagttccccagtaaatgcaaatttaacaagaaaatcagacatgtcatatgttcaaaatgctcatggcaaacaatcattttgcattcctgcaaataaaattgttttatactgta

SEQ ID NO: 365617 - DNA, 6763 bp, Homo sapiens
gcgtggtcgcggccgaggtacgcggggtttaaagacagtgatctctctcatgttcagaacaaaagtgcctttttatgtggagtcatgaagacttacaggcagagagaaaaacaagggaccaaagtagcagattctagtaaaggaccagatgaggcaaaaattaaggcactcttggaaagaacaggctacacacttgatgtgaccactggacagaggaagtatggaggaccacctccagattccgtttattcaggtcagcagccttctgttggcactgagatatttgtgggaaagatcccaagagatctatttgaggatgaacttgttccattatttgagaaagctggacctatatgggatcttcgtctaatgatggatccactcactggtctcaatagaggttatgcgtttgtcactttttgtacaaaagaagcagctcaggaggctgttaaactgtataataatcatgaaattcgttctggaaaacatattggtgtctgcatctcagttgccaacaataggctttttgtgggctctattcctaagagtaaaaccaaggaacagattcttgaagaatttagcaaagtaacagagggtcttacagacgtcattttataccaccaaccggatgacaagaaaaaaaacagaggcttttgctttcttgaatatgaagatcacaaaacagctgcccaggcaaggcgtaggttaatgagtggtaaagtcaaggtctgggggaatgttggaactgttgaatgggctgatcctatagaagatcctgatcctgaggttatggcaaaggtaaaagtgctgtttgtacgcaaccttgccaatactgtaacagaagagattttagaaaaggcatttagtcagtttgggaaactggaacgagtgaagaagttaaaagattatgcgttcattcattttgatgagcgagatggtgctgtcaaggctatggaagaaatgaatggcaaagacttggagggagaaaatattgaaattgtttttgccaagccaccagatcagaaaaggaaagaaagaaaagctcagaggcaagcagcaaaaaatcaaatgtatgacgattactactattatggtccacctcatatgccccctccaacaagaggtcgagggcgtggaggtagaggtggttatggatatcctccagattattatggatatgaagattattatgattattatggttatgattaccataactatcgtggtggatatgaagatccatactatggttatgaagattttcaagttggagctagaggaaggggtggtagaggagcaaggggtgctgctccatccagaggtcgtggggctgctcctccccgcggtagagccggttattcacagagaggaggtcctggatcagcaagaggcgttcgaggtgcgagaggaggtgcccaacaacaaagaggccgcgggcagggaaaaggggtcgaggccggtcctgacctgttacaatgaagactgacttgctatgtgggattacaccagaagcttgcagtggagtaatggtaaggaaatcaagcaaccttaaatatgtcggctgtataggagcatattctattgcagaagaccttcctatgaagatcatggaatcaaatacgggacattgaactaatacttggactttgatatgaatttctttaacaattttctctgcagtgcaagttattaaactaaagctactctattttcaaaatgtgttccaacagaaatccttcataactcctagcatggtatcttaataaagaataaagttcttttaaaaatctgctctaagtagatttttccccttttttaaattaaggatcccaacagtggtattttgaaatattctcttgaatttgtgcatttaaattttattgcagtggtatagatgaatgccactgatggtatccttaaattttatttctgctcaccaaggttaatcatgattgtctatatcttttttatagtgatcacttttgaattgtgttcagatatgcagtttcaggtgtaatcatcagagctggttagtcaggcattccagatagtggttcttttcagaacctttttaaaagggttggttaactacctcagtagcagaggattgaactataccctgtctgtactgtacatagaaaatctttgtagataaaagcaaggcttgttaaatatgatatgagggtaagattttaatataccaaatgtaacattcttagttgcctttagtttcagaggcttgtaagacttcctcatgaccatcataacaggccttgcttttgtcgtattttgtggctgaaaaagcagccttgcttcttcagatattgtagttatttggatgtataatagtttagcaagatgttacttttgtaagacatcagatgttcaaaaaagtgcatccgaacttgtactaaatactgcagtgtccctttataaaaagtcagactaaaactgacaattgtacagcgaacctgacatttggatattttgaagttttttcataaatcatagaaattagtatatggctgtagtttagctttttaggtaaaaggtatgtttcattagtgcatttcttcctgctgatcactgtaaacatgtgaatcagctttccatttcttatgcaggtcatgataacttgtagagtagagtacaatcatttgtgctatgtttttaattttctaaagcaccttgatgacagtgagtgtccagtggtgaagcatcctctattgaaccaccctcaaaaatttttttgccaagtcctaagttgatagcttaaagtaaaaagtgaaaattatagtttcattaggacttggtgtaaagaaatcccctccccccttccccaaagggatactgcagttatatcacatacccaataggcaccacgatgaagatcagagcttatacttaattaaggttttatacacaccagttccccagtaaatgcaaatttaacaagaaaatcagacatgtcatatgttcaaaatgctcatggcaaacaatcattttgcattcctgcaaataaaattgttttatactgtaagctggaggcgagtgtaacttatttttgtaataaagtttttattttttttatgtgtcattaatataaatgtgtgttagtgtagaaatcttctggtttaaaaacttagaattgcacacatttcagtatgtttatttgtacttacataattttagaatagtggttgccaatagcctgtatgtttcacattaattggttttttgttatctaaataaatcattttagtatgttgtatgtcagttactgggatagctgggacatagagtgtaatttaaaatttgtcaataagtattcattggaatatatgtaaatgtgccttgccggttattgaaacttatctacaaaatgagtatggggtgacaaaaattagttcctggtgcttaatgaaactttctgccactgattttatatattaccccgtgcttttttaaagtacatctctctcaaaacttagtgtaagtttgagggctacacaaaacatttacatttcattctaacataatgaatataataggttgtggaaagtgggtaaactaaatgtagccttcagtaaaattgaatctcagtgtaatccttggtgctggcatttctcagttccgaggagttaaatgatcccatctaagaggtcattgccatgcctattggcactttactgtcatagcatttttaagggacactgtcaaggtgtttaagttctcagaattacttgttgggattttaggacaggtttgtttacttaaagtaagaactgcattgtcaaagttgaaagaggaacacttttgtgagttcacaaatgtgttcttaagaaaacattaaaatatggagctctgggttttcaagactatttggcattcttaatttggggacttgggagggaaactgataaaaagaaattgaagaattgatggttatacttaaagaagggtaatgtaaacagtggtgatgaaatatatacacatcaagtgaaattacttgacagtgttcatttgaatgactttgaattcaagccattataattacttttaaaattaaatatcatttgcactgttctgataatgggtgcagtttttgagcaatataatcagagctaaatatgcatgtagtgattagtgatgtgaacaattaacgttctgagaagaaatactaactgtggtattttcaaacttaaatttctgtagtaaaatcagtatcaaagtcttatcagatcaaggaaaaacaggcaatgcatataaacatacttttgaatgttgtgtggcctataaagcaataatgcaatttatatggaatgtcatgggatatgagaaatggaaatgcaaaaataactaatcctttagtaaaaatgtcaacatgttaaagggggaatgttaactaatgtaggttattgctatttgtgatttgtttatgggttcttggctttgacagcttcaaagaatggacagtgataagttaaaagaaattttgtatattgtcaaggaaagggtcttaaatccgagtcaagtcccttccttggggtaaaaaatgtattcttaaagcattctgatgttaaaaagaaaacttaagttatctaaccaaaacagacgcaagattttgtttctgcagactacttggcaatcaaaagtgatcataaatttaggttatcagttttcagaaagttgctttgtgagaaaattttgttagatatattctcccaagcatgctttttgtggaaggttttcagccattgccactgaatcagatgttaaaaatgaagggaaaattgagtgtgcacacacacaactgttgtacactcatgattgcagtttttagcttaagaaacttttctaccagttactgtgaatctgacttaaaatgtaaagtttcctcatgataaaataggaacaacatagaaatggattgatggggtgatctgagttattgtatataaaagtttttaaagaatagaatgaacatcaagctagataggcaaaaattgacacattcagaacagcttttttgactgcgaagccaaaagttgtcagaaacagcaaaagatcccttattattacagagtattttacgtagtctctattttaaggagagaaattaaatagaagggcttcatgcatttaggggagggtgctaaaacttctcaagttcgtcaaacttacaggaatacccaccatgatcattttctctctaattatgtataccacaaaattttcatctggccataggaattcactggtgggtgtaaaattaatgactaaagaaattaagtgacaaatacataaaagaaacagacttgtggggatattgttttaaggtgtattaattactcagtgatgataccactcaatagggcatgccactacttttcttaagatgctaattatgaagcagtgctcacaggcattttttaactagcaaattagtagatggacttttggggtctgtcactttttaaaagtatttaagacttaaattctattagcaccacagtctgccttcagtaatacacctaaaatatttttcaggaccagaagcattcagtttgaaaatttgcagatgcaaaccagtattattactaacgctctgggtcaaagattaggtttttaatattaacagtagtctggtaaatatttagaagtctggcattgagaaacaaaagcttgtacctgactagtatttttatttaaaaaaattagttctgttagcttatttaaattgtgttttatttatccgtagaatttatatttatttcattcctttcatctcactgaaaactgtctgcaggccctttgatttggattagatgtgtgaagtactgtcttttgccaaaaacctcaaattacctgttcttttcaacgtagtgggtttgtgcttgtttggagatcagttcaaaaactatctgtactatctgtactgcctctgatgttaagattttatgtatagcataaggaagctagctctgactatattttcctaagaataaagacctatttttgtagcatgtcttaggatctccaggagtccaagaattattgtgggtgtcctccaattcatcactcttcacttaacagcttttaagtagacacttggaatctttagaggtctgtcgccctttgattatccatacattcgaagtaactagccaatggtgaaaaattcctcaagatatcctcagttgcaatcacattactggaagatgaatagaataaatgtattaggctggtcttaatttttgatggaaatattctgttgtcccgtacttgccattggatttgataaagttagtggtaatttggaaagaatcggggacttgccaatatatttgtgggttttagcttatacccctaggatttcttggttgcgggacgagcagttttggccacttccatcaggacaagactttttaggtcacttagtgcaggttttagtttctattttggattaacaacatttatattgattatcgaaaagaagctttcatcatttcagaacagtcctggaagtttgactttgagtgtgggagaagtcctaataaaccattttggaaattagtgtctccaagtgttacagcttcctaaaatgggtttctaacacagtgggatcaaaataaggttattttaggataatatactgtaaacttaattgactgtctgattttctactttgtctataaagtggcttacaacaggttctaatctagaaaggagttataaaggttatctgtaatgtttatgaatt

SEQ ID NO: 365618 - DNA, 7312 bp, Homo sapiens
agagaggagccgactcggcagggactgggggaccgggccgagagtgcgagcgagcgagggagggagtgagggagcgtgcgagccagaaggggaaaggcggccactcgtgcctgagcgaccgcagaggggagtgggagcagtggggtaaaggagcggggggcgggaataagaaaggccgagagaaggcggacagaggctagtggtggtggtggtggtagggggagaaggaggagctggaggagggcaggggctgagggagtgagtgaagcggacgcgcgagggaggggagggaagggaagggaagggaagggggggtcacgcgggggcgcgcgcgcgcaccgggagcgcgctcggaggcgagtggaactggatcgggtttgctgccagcggcgtgagcttcggccgccattttacaacagctccactcgcgccggacacagggagcagcgagcacgcgtttcccgcaacccgataccatcggacaggatttctccgcctcagcccaacggggagggctagttgcacatagtgatttagatgaaagagctattgaagctttaaaagaattcaatgaagacggtgcattggcagttcttcaacagtttaaagacagtgatctctctcatgttcagaacaaaagtgcctttttatgtggagtcatgaagacttacaggcagagagaaaaacaagggaccaaagtagcagattctagtaaaggaccagatgaggcaaaaattaaggcactcttggaaagaacaggctacacacttgatgtgaccactggacagaggaagtatggaggaccacctccagattccgtttattcagatatttgtgggaaagatcccaagagatctatttgaggatgaacttgttccattatttgagaaagctggacctatatgggatcttcgtctaatgatggatccactcactggtctcaatagaggttatgcgtttgtcactttttgtacaaaagaagcagctcaggaggctgttaaactgtataataatcatgaaattcgttctggaaaacatattggtgtctgcatctcagttgccaacaataggctttttgtgggctctattcctaagagtaaaaccaaggaacagattcttgaagaatttagcaaagtaacagagggtcttacagacgtcattttataccaccaaccggatgacaagaaaaaaaacagaggcttttgctttcttgaatatgaagatcacaaaacagctgcccaggcaaggcgtaggttaatgagtggtaaagtcaaggtctgggggaatgttggaactgttgaatgggctgatcctatagaagatcctgatcctgaggttatggcaaaggtaaaagtgctgtttgtacgcaaccttgccaatactgtaacagaagagattttagaaaaggcatttagtcagtttgggaaactggaacgagtgaagaagttaaaagattatgcgttcattcattttgatgagcgagatggtgctgtcaaggctatggaagaaatgaatggcaaagacttggagggagaaaatattgaaattgtttttgccaagccaccagatcagaaaaggaaagaaagaaaagctcagaggcaagcagcaaaaaatcaaatgtatgacgattactactattatggtccacctcatatgccccctccaacaagaggtcgagggcgtggaggtagaggtggttatggatatcctccagattattatggatatgaagattattatgattattatggttatgattaccataactatcgtggtggatatgaagatccatactatggttatgaagattttcaagttggagctagaggaaggggtggtagaggagcaaggggtgctgctccatccagaggtcgtggggctgctcctccccgcggtagagccggttattcacagagaggaggtcctggatcagcaagaggcgttcgaggtgcgagaggaggtgcccaacaacaaagaggccgcgggcagggaaaaggggtcgaggccggtcctgacctgttacaatgaagactgacttgctatgtgggattacaccagaagcttgcagtggagtaatggtaaggaaatcaagcaaccttaaatatgtcggctgtataggagcatattctattgcagaagaccttcctatgaagatcatggaatcaaatacgggacattgaactaatacttggactttgatatgaatttctttaacaattttctctgcagtgcaagttattaaactaaagctactctattttcaaaatgtgttccaacagaaatccttcataactcctagcatggtatcttaataaagaataaagttcttttaaaaatctgctctaagtagatttttccccttttttaaattaaggatcccaacagtggtattttgaaatattctcttgaatttgtgcatttaaattttattgcagtggtatagatgaatgccactgatggtatccttaaattttatttctgctcaccaaggttaatcatgattgtctatatcttttttatagtgatcacttttgaattgtgttcagatatgcagtttcaggtgtaatcatcagagctggttagtcaggcattccagatagtggttcttttcagaacctttttaaaagggttggttaactacctcagtagcagaggattgaactataccctgtctgtactgtacatagaaaatctttgtagataaaagcaaggcttgttaaatatgatatgagggtaagattttaatataccaaatgtaacattcttagttgcctttagtttcagaggcttgtaagacttcctcatgaccatcataacaggccttgcttttgtcgtattttgtggctgaaaaagcagccttgcttcttcagatattgtagttatttggatgtataatagtttagcaagatgttacttttgtaagacatcagatgttcaaaaaagtgcatccgaacttgtactaaatactgcagtgtccctttataaaaagtcagactaaaactgacaattgtacagcgaacctgacatttggatattttgaagttttttcataaatcatagaaattagtatatggctgtagtttagctttttaggtaaaaggtatgtttcattagtgcatttcttcctgctgatcactgtaaacatgtgaatcagctttccatttcttatgcaggtcatgataacttgtagagtagagtacaatcatttgtgctatgtttttaattttctaaagcaccttgatgacagtgagtgtccagtggtgaagcatcctctattgaaccaccctcaaaaatttttttgccaagtcctaagttgatagcttaaagtaaaaagtgaaaattatagtttcattaggacttggtgtaaagaaatcccctccccccttccccaaagggatactgcagttatatcacatacccaataggcaccacgatgaagatcagagcttatacttaattaaggttttatacacaccagttccccagtaaatgcaaatttaacaagaaaatcagacatgtcatatgttcaaaatgctcatggcaaacaatcattttgcattcctgcaaataaaattgttttatactgtaagctggaggcgagtgtaacttatttttgtaataaagtttttattttttttatgtgtcattaatataaatgtgtgttagtgtagaaatcttctggtttaaaaacttagaattgcacacatttcagtatgtttatttgtacttacataattttagaatagtggttgccaatagcctgtatgtttcacattaattggttttttgttatctaaataaatcattttagtatgttgtatgtcagttactgggatagctgggacatagagtgtaatttaaaatttgtcaataagtattcattggaatatatgtaaatgtgccttgccggttattgaaacttatctacaaaatgagtatggggtgacaaaaattagttcctggtgcttaatgaaactttctgccactgattttatatattaccccgtgcttttttaaagtacatctctctcaaaacttagtgtaagtttgagggctacacaaaacatttacatttcattctaacataatgaatataataggttgtggaaagtgggtaaactaaatgtagccttcagtaaaattgaatctcagtgtaatccttggtgctggcatttctcagttccgaggagttaaatgatcccatctaagaggtcattgccatgcctattggcactttactgtcatagcatttttaagggacactgtcaaggtgtttaagttctcagaattacttgttgggattttaggacaggtttgtttacttaaagtaagaactgcattgtcaaagttgaaagaggaacacttttgtgagttcacaaatgtgttcttaagaaaacattaaaatatggagctctgggttttcaagactatttggcattcttaatttggggacttgggagggaaactgataaaaagaaattgaagaattgatggttatacttaaagaagggtaatgtaaacagtggtgatgaaatatatacacatcaagtgaaattacttgacagtgttcatttgaatgactttgaattcaagccattataattacttttaaaattaaatatcatttgcactgttctgataatgggtgcagtttttgagcaatataatcagagctaaatatgcatgtagtgattagtgatgtgaacaattaacgttctgagaagaaatactaactgtggtattttcaaacttaaatttctgtagtaaaatcagtatcaaagtcttatcagatcaaggaaaaacaggcaatgcatataaacatacttttgaatgttgtgtggcctataaagcaataatgcaatttatatggaatgtcatgggatatgagaaatggaaatgcaaaaataactaatcctttagtaaaaatgtcaacatgttaaagggggaatgttaactaatgtaggttattgctatttgtgatttgtttatgggttcttggctttgacagcttcaaagaatggacagtgataagttaaaagaaattttgtatattgtcaaggaaagggtcttaaatccgagtcaagtcccttccttggggtaaaaaatgtattcttaaagcattctgatgttaaaaagaaaacttaagttatctaaccaaaacagacgcaagattttgtttctgcagactacttggcaatcaaaagtgatcataaatttaggttatcagttttcagaaagttgctttgtgagaaaattttgttagatatattctcccaagcatgctttttgtggaaggttttcagccattgccactgaatcagatgttaaaaatgaagggaaaattgagtgtgcacacacacaactgttgtacactcatgattgcagtttttagcttaagaaacttttctaccagttactgtgaatctgacttaaaatgtaaagtttcctcatgataaaataggaacaacatagaaatggattgatggggtgatctgagttattgtatataaaagtttttaaagaatagaatgaacatcaagctagataggcaaaaattgacacattcagaacagcttttttgactgcgaagccaaaagttgtcagaaacagcaaaagatcccttattattacagagtattttacgtagtctctattttaaggagagaaattaaatagaagggcttcatgcatttaggggagggtgctaaaacttctcaagttcgtcaaacttacaggaatacccaccatgatcattttctctctaattatgtataccacaaaattttcatctggccataggaattcactggtgggtgtaaaattaatgactaaagaaattaagtgacaaatacataaaagaaacagacttgtggggatattgttttaaggtgtattaattactcagtgatgataccactcaatagggcatgccactacttttcttaagatgctaattatgaagcagtgctcacaggcattttttaactagcaaattagtagatggacttttggggtctgtcactttttaaaagtatttaagacttaaattctattagcaccacagtctgccttcagtaatacacctaaaatatttttcaggaccagaagcattcagtttgaaaatttgcagatgcaaaccagtattattactaacgctctgggtcaaagattaggtttttaatattaacagtagtctggtaaatatttagaagtctggcattgagaaacaaaagcttgtacctgactagtatttttatttaaaaaaattagttctgttagcttatttaaattgtgttttatttatccgtagaatttatatttatttcattcctttcatctcactgaaaactgtctgcaggccctttgatttggattagatgtgtgaagtactgtcttttgccaaaaacctcaaattacctgttcttttcaacgtagtgggtttgtgcttgtttggagatcagttcaaaaactatctgtactatctgtactgcctctgatgttaagattttatgtatagcataaggaagctagctctgactatattttcctaagaataaagacctatttttgtagcatgtcttaggatctccaggagtccaagaattattgtgggtgtcctccaattcatcactcttcacttaacagcttttaagtagacacttggaatctttagaggtctgtcgccctttgattatccatacattcgaagtaactagccaatggtgaaaaattcctcaagatatcctcagttgcaatcacattactggaagatgaatagaataaatgtattaggctggtcttaatttttgatggaaatattctgttgtcccgtacttgccattggatttgataaagttagtggtaatttggaaagaatcggggacttgccaatatatttgtgggttttagcttatacccctaggatttcttggttgcgggacgagcagttttggccacttccatcaggacaagactttttaggtcacttagtgcaggttttagtttctattttggattaacaacatttatattgattatcgaaaagaagctttcatcatttcagaacagtcctggaagtttgactttgagtgtgggagaagtcctaataaaccattttggaaattagtgtctccaagtgttacagcttcctaaaatgggtttctaacacagtgggatcaaaataaggttattttaggataatatactgtaaacttaattgactgtctgattttctactttgtctataaagtggcttacaacaggttctaatctagaaaggagttataaaggttatctgtaatgtttatgaatt

SEQ ID NO: 365619 - DNA, 6421 bp, Homo sapiens
  misc_feature (32)..(32): n is a, c, g, or t
  misc_feature (44)..(44): n is a, c, g, or t
tgatataaaccactgctttaatattgtaaacntaaatgtccaantataatgaccaacttatctaataatgaaaactgcagtagcagaactattaagcagatctttataattaacttatgaagactatttaacatagaaaaatatttatatgtaaaaaacacagacccaaattacatattctctataagtatatggttaaaaaacctgcaagaaaatatacctaaatgctaatgttcattgcattcagatgatagaattatggattttatccatagatttttcttctagattttatagtttttaaaaattatgatgccccttatatttatattgggaaatatacatttaaacaaactattatttggctaccatgctaatattcacaaccatgtggcactagcctaaaataaacttttcagaagaaactaaattattctatctaaatattctgggaaacgtttaagtgatattggaatctctatcaaaatttccacaccagagtgaagaaagacaaattagatgtgggatgaaagttgttctcactgataagtgagagctaaatgatgagaacacatggacacataaagggcaacaacacacactggggctatggaagaaatgaatggcaaagacttggagggagaaaatattgaaattgtttttgccaagccaccagatcagaaaaggaaagaaagaaaagctcagaggcaagcagcaaaaaatcaaatgtatgacgattactactattatggtccacctcatatgccccctccaacaagaggtcgagggcgtggaggtagaggtggttatggatatcctccagattattatggatatgaagattattatgattattatggttatgattaccataactatcgtggtggatatgaagatccatactatggttatgaagattttcaagttggagctagaggaaggggtggtagaggagcaaggggtgctgctccatccagaggtcgtggggctgctcctccccgcggtagagccggttattcacagagaggaggtcctggatcagcaagaggcgttcgaggtgcgagaggaggtgcccaacaacaaagaggccgcgggcagggaaaaggggtcgaggccggtcctgacctgttacaatgaagactgacttgctatgtgggattacaccagaagcttgcagtggagtaatggtaaggaaatcaagcaaccttaaatatgtcggctgtataggagcatattctattgcagaagaccttcctatgaagatcatggaatcaaatacgggacattgaactaatacttggactttgatatgaatttctttaacaattttctctgcagtgcaagttattaaactaaagctactctattttcaaaatgtgttccaacagaaatccttcataactcctagcatggtatcttaataaagaataaagttcttttaaaaatctgctctaagtagatttttccccttttttaaattaaggatcccaacagtggtattttgaaatattctcttgaatttgtgcatttaaattttattgcagtggtatagatgaatgccactgatggtatccttaaattttatttctgctcaccaaggttaatcatgattgtctatatcttttttatagtgatcacttttgaattgtgttcagatatgcagtttcaggtgtaatcatcagagctggttagtcaggcattccagatagtggttcttttcagaacctttttaaaagggttggttaactacctcagtagcagaggattgaactataccctgtctgtactgtacatagaaaatctttgtagataaaagcaaggcttgttaaatatgatatgagggtaagattttaatataccaaatgtaacattcttagttgcctttagtttcagaggcttgtaagacttcctcatgaccatcataacaggccttgcttttgtcgtattttgtggctgaaaaagcagccttgcttcttcagatattgtagttatttggatgtataatagtttagcaagatgttacttttgtaagacatcagatgttcaaaaaagtgcatccgaacttgtactaaatactgcagtgtccctttataaaaagtcagactaaaactgacaattgtacagcgaacctgacatttggatattttgaagttttttcataaatcatagaaattagtatatggctgtagtttagctttttaggtaaaaggtatgtttcattagtgcatttcttcctgctgatcactgtaaacatgtgaatcagctttccatttcttatgcaggtcatgataacttgtagagtagagtacaatcatttgtgctatgtttttaattttctaaagcaccttgatgacagtgagtgtccagtggtgaagcatcctctattgaaccaccctcaaaaatttttttgccaagtcctaagttgatagcttaaagtaaaaagtgaaaattatagtttcattaggacttggtgtaaagaaatcccctccccccttccccaaagggatactgcagttatatcacatacccaataggcaccacgatgaagatcagagcttatacttaattaaggttttatacacaccagttccccagtaaatgcaaatttaacaagaaaatcagacatgtcatatgttcaaaatgctcatggcaaacaatcattttgcattcctgcaaataaaattgttttatactgtaagctggaggcgagtgtaacttatttttgtaataaagtttttattttttttatgtgtcattaatataaatgtgtgttagtgtagaaatcttctggtttaaaaacttagaattgcacacatttcagtatgtttatttgtacttacataattttagaatagtggttgccaatagcctgtatgtttcacattaattggttttttgttatctaaataaatcattttagtatgttgtatgtcagttactgggatagctgggacatagagtgtaatttaaaatttgtcaataagtattcattggaatatatgtaaatgtgccttgccggttattgaaacttatctacaaaatgagtatggggtgacaaaaattagttcctggtgcttaatgaaactttctgccactgattttatatattaccccgtgcttttttaaagtacatctctctcaaaacttagtgtaagtttgagggctacacaaaacatttacatttcattctaacataatgaatataataggttgtggaaagtgggtaaactaaatgtagccttcagtaaaattgaatctcagtgtaatccttggtgctggcatttctcagttccgaggagttaaatgatcccatctaagaggtcattgccatgcctattggcactttactgtcatagcatttttaagggacactgtcaaggtgtttaagttctcagaattacttgttgggattttaggacaggtttgtttacttaaagtaagaactgcattgtcaaagttgaaagaggaacacttttgtgagttcacaaatgtgttcttaagaaaacattaaaatatggagctctgggttttcaagactatttggcattcttaatttggggacttgggagggaaactgataaaaagaaattgaagaattgatggttatacttaaagaagggtaatgtaaacagtggtgatgaaatatatacacatcaagtgaaattacttgacagtgttcatttgaatgactttgaattcaagccattataattacttttaaaattaaatatcatttgcactgttctgataatgggtgcagtttttgagcaatataatcagagctaaatatgcatgtagtgattagtgatgtgaacaattaacgttctgagaagaaatactaactgtggtattttcaaacttaaatttctgtagtaaaatcagtatcaaagtcttatcagatcaaggaaaaacaggcaatgcatataaacatacttttgaatgttgtgtggcctataaagcaataatgcaatttatatggaatgtcatgggatatgagaaatggaaatgcaaaaataactaatcctttagtaaaaatgtcaacatgttaaagggggaatgttaactaatgtaggttattgctatttgtgatttgtttatgggttcttggctttgacagcttcaaagaatggacagtgataagttaaaagaaattttgtatattgtcaaggaaagggtcttaaatccgagtcaagtcccttccttggggtaaaaaatgtattcttaaagcattctgatgttaaaaagaaaacttaagttatctaaccaaaacagacgcaagattttgtttctgcagactacttggcaatcaaaagtgatcataaatttaggttatcagttttcagaaagttgctttgtgagaaaattttgttagatatattctcccaagcatgctttttgtggaaggttttcagccattgccactgaatcagatgttaaaaatgaagggaaaattgagtgtgcacacacacaactgttgtacactcatgattgcagtttttagcttaagaaacttttctaccagttactgtgaatctgacttaaaatgtaaagtttcctcatgataaaataggaacaacatagaaatggattgatggggtgatctgagttattgtatataaaagtttttaaagaatagaatgaacatcaagctagataggcaaaaattgacacattcagaacagcttttttgactgcgaagccaaaagttgtcagaaacagcaaaagatcccttattattacagagtattttacgtagtctctattttaaggagagaaattaaatagaagggcttcatgcatttaggggagggtgctaaaacttctcaagttcgtcaaacttacaggaatacccaccatgatcattttctctctaattatgtataccacaaaattttcatctggccataggaattcactggtgggtgtaaaattaatgactaaagaaattaagtgacaaatacataaaagaaacagacttgtggggatattgttttaaggtgtattaattactcagtgatgataccactcaatagggcatgccactacttttcttaagatgctaattatgaagcagtgctcacaggcattttttaactagcaaattagtagatggacttttggggtctgtcactttttaaaagtatttaagacttaaattctattagcaccacagtctgccttcagtaatacacctaaaatatttttcaggaccagaagcattcagtttgaaaatttgcagatgcaaaccagtattattactaacgctctgggtcaaagattaggtttttaatattaacagtagtctggtaaatatttagaagtctggcattgagaaacaaaagcttgtacctgactagtatttttatttaaaaaaattagttctgttagcttatttaaattgtgttttatttatccgtagaatttatatttatttcattcctttcatctcactgaaaactgtctgcaggccctttgatttggattagatgtgtgaagtactgtcttttgccaaaaacctcaaattacctgttcttttcaacgtagtgggtttgtgcttgtttggagatcagttcaaaaactatctgtactatctgtactgcctctgatgttaagattttatgtatagcataaggaagctagctctgactatattttcctaagaataaagacctatttttgtagcatgtcttaggatctccaggagtccaagaattattgtgggtgtcctccaattcatcactcttcacttaacagcttttaagtagacacttggaatctttagaggtctgtcgccctttgattatccatacattcgaagtaactagccaatggtgaaaaattcctcaagatatcctcagttgcaatcacattactggaagatgaatagaataaatgtattaggctggtcttaatttttgatggaaatattctgttgtcccgtacttgccattggatttgataaagttagtggtaatttggaaagaatcggggacttgccaatatatttgtgggttttagcttatacccctaggatttcttggttgcgggacgagcagttttggccacttccatcaggacaagactttttaggtcacttagtgcaggttttagtttctattttggattaacaacatttatattgattatcgaaaagaagctttcatcatttcagaacagtcctggaagtttgactttgagtgtgggagaagtcctaataaaccattttggaaattagtgtctccaagtgttacagcttcctaaaatgggtttctaacacagtgggatcaaaataaggttattttaggataatatactgtaaacttaattgactgtctgattttctactttgtctataaagtggcttacaacaggttctaatctagaaaggagttataaaggttatctgtaatgtttatgaatt

SEQ ID NO: 365620 - DNA, 5743 bp, Homo sapiens
gcacgaggagagagagagagagagagagaaagagcagcaaaaaatcaaatgtatgacgattactactattatggtccacctcatatgccccctccaacaagaggtcgagggcgtggaggtagaggtggttatggatatcctccagattattatggatatgaagattattatgattattatggttatgattaccataactatcgtggtggatatgaagatccatactatggttatgaagattttcaagttggagctagaggaaggggtggtagaggagcaaggggtgctgctccatccagaggtcgtggggctgctcctccccgcggtagagccggttattcacagagaggaggtcctggatcagcaagaggcgttcgaggtgcgagaggaggtgcccaacaacaaagaggccgcgggcagggaaaaggggtcgaggccggtcctgacctgttacaatgaagactgacttgctatgtgggattacaccagaagcttgcagtggagtaatggtaaggaaatcaagcaaccttaaatatgtcggctgtataggagcatattctattgcagaagaccttcctatgaagatcatggaatcaaatacgggacattgaactaatacttggactttgatatgaatttctttaacaattttctctgcagtgcaagttattaaactaaagctactctattttcaaaatgtgttccaacagaaatccttcataactcctagcatggtatcttaataaagaataaagttcttttaaaaatctgctctaagtagatttttccccttttttaaattaaggatcccaacagtggtattttgaaatattctcttgaatttgtgcatttaaattttattgcagtggtatagatgaatgccactgatggtatccttaaattttatttctgctcaccaaggttaatcatgattgtctatatcttttttatagtgatcacttttgaattgtgttcagatatgcagtttcaggtgtaatcatcagagctggttagtcaggcattccagatagtggttcttttcagaacctttttaaaagggttggttaactacctcagtagcagaggattgaactataccctgtctgtactgtacatagaaaatctttgtagataaaagcaaggcttgttaaatatgatatgagggtaagattttaatataccaaatgtaacattcttagttgcctttagtttcagaggcttgtaagacttcctcatgaccatcataacaggccttgcttttgtcgtattttgtggctgaaaaagcagccttgcttcttcagatattgtagttatttggatgtataatagtttagcaagatgttacttttgtaagacatcagatgttcaaaaaagtgcatccgaacttgtactaaatactgcagtgtccctttataaaaagtcagactaaaactgacaattgtacagcgaacctgacatttggatattttgaagttttttcataaatcatagaaattagtatatggctgtagtttagctttttaggtaaaaggtatgtttcattagtgcatttcttcctgctgatcactgtaaacatgtgaatcagctttccatttcttatgcaggtcatgataacttgtagagtagagtacaatcatttgtgctatgtttttaattttctaaagcaccttgatgacagtgagtgtccagtggtgaagcatcctctattgaaccaccctcaaaaatttttttgccaagtcctaagttgatagcttaaagtaaaaagtgaaaattatagtttcattaggacttggtgtaaagaaatcccctccccccttccccaaagggatactgcagttatatcacatacccaataggcaccacgatgaagatcagagcttatacttaattaaggttttatacacaccagttccccagtaaatgcaaatttaacaagaaaatcagacatgtcatatgttcaaaatgctcatggcaaacaatcattttgcattcctgcaaataaaattgttttatactgtaagctggaggcgagtgtaacttatttttgtaataaagtttttattttttttatgtgtcattaatataaatgtgtgttagtgtagaaatcttctggtttaaaaacttagaattgcacacatttcagtatgtttatttgtacttacataattttagaatagtggttgccaatagcctgtatgtttcacattaattggttttttgttatctaaataaatcattttagtatgttgtatgtcagttactgggatagctgggacatagagtgtaatttaaaatttgtcaataagtattcattggaatatatgtaaatgtgccttgccggttattgaaacttatctacaaaatgagtatggggtgacaaaaattagttcctggtgcttaatgaaactttctgccactgattttatatattaccccgtgcttttttaaagtacatctctctcaaaacttagtgtaagtttgagggctacacaaaacatttacatttcattctaacataatgaatataataggttgtggaaagtgggtaaactaaatgtagccttcagtaaaattgaatctcagtgtaatccttggtgctggcatttctcagttccgaggagttaaatgatcccatctaagaggtcattgccatgcctattggcactttactgtcatagcatttttaagggacactgtcaaggtgtttaagttctcagaattacttgttgggattttaggacaggtttgtttacttaaagtaagaactgcattgtcaaagttgaaagaggaacacttttgtgagttcacaaatgtgttcttaagaaaacattaaaatatggagctctgggttttcaagactatttggcattcttaatttggggacttgggagggaaactgataaaaagaaattgaagaattgatggttatacttaaagaagggtaatgtaaacagtggtgatgaaatatatacacatcaagtgaaattacttgacagtgttcatttgaatgactttgaattcaagccattataattacttttaaaattaaatatcatttgcactgttctgataatgggtgcagtttttgagcaatataatcagagctaaatatgcatgtagtgattagtgatgtgaacaattaacgttctgagaagaaatactaactgtggtattttcaaacttaaatttctgtagtaaaatcagtatcaaagtcttatcagatcaaggaaaaacaggcaatgcatataaacatacttttgaatgttgtgtggcctataaagcaataatgcaatttatatggaatgtcatgggatatgagaaatggaaatgcaaaaataactaatcctttagtaaaaatgtcaacatgttaaagggggaatgttaactaatgtaggttattgctatttgtgatttgtttatgggttcttggctttgacagcttcaaagaatggacagtgataagttaaaagaaattttgtatattgtcaaggaaagggtcttaaatccgagtcaagtcccttccttggggtaaaaaatgtattcttaaagcattctgatgttaaaaagaaaacttaagttatctaaccaaaacagacgcaagattttgtttctgcagactacttggcaatcaaaagtgatcataaatttaggttatcagttttcagaaagttgctttgtgagaaaattttgttagatatattctcccaagcatgctttttgtggaaggttttcagccattgccactgaatcagatgttaaaaatgaagggaaaattgagtgtgcacacacacaactgttgtacactcatgattgcagtttttagcttaagaaacttttctaccagttactgtgaatctgacttaaaatgtaaagtttcctcatgataaaataggaacaacatagaaatggattgatggggtgatctgagttattgtatataaaagtttttaaagaatagaatgaacatcaagctagataggcaaaaattgacacattcagaacagcttttttgactgcgaagccaaaagttgtcagaaacagcaaaagatcccttattattacagagtattttacgtagtctctattttaaggagagaaattaaatagaagggcttcatgcatttaggggagggtgctaaaacttctcaagttcgtcaaacttacaggaatacccaccatgatcattttctctctaattatgtataccacaaaattttcatctggccataggaattcactggtgggtgtaaaattaatgactaaagaaattaagtgacaaatacataaaagaaacagacttgtggggatattgttttaaggtgtattaattactcagtgatgataccactcaatagggcatgccactacttttcttaagatgctaattatgaagcagtgctcacaggcattttttaactagcaaattagtagatggacttttggggtctgtcactttttaaaagtatttaagacttaaattctattagcaccacagtctgccttcagtaatacacctaaaatatttttcaggaccagaagcattcagtttgaaaatttgcagatgcaaaccagtattattactaacgctctgggtcaaagattaggtttttaatattaacagtagtctggtaaatatttagaagtctggcattgagaaacaaaagcttgtacctgactagtatttttatttaaaaaaattagttctgttagcttatttaaattgtgttttatttatccgtagaatttatatttatttcattcctttcatctcactgaaaactgtctgcaggccctttgatttggattagatgtgtgaagtactgtcttttgccaaaaacctcaaattacctgttcttttcaacgtagtgggtttgtgcttgtttggagatcagttcaaaaactatctgtactatctgtactgcctctgatgttaagattttatgtatagcataaggaagctagctctgactatattttcctaagaataaagacctatttttgtagcatgtcttaggatctccaggagtccaagaattattgtgggtgtcctccaattcatcactcttcacttaacagcttttaagtagacacttggaatctttagaggtctgtcgccctttgattatccatacattcgaagtaactagccaatggtgaaaaattcctcaagatatcctcagttgcaatcacattactggaagatgaatagaataaatgtattaggctggtcttaatttttgatggaaatattctgttgtcccgtacttgccattggatttgataaagttagtggtaatttggaaagaatcggggacttgccaatatatttgtgggttttagcttatacccctaggatttcttggttgcgggacgagcagttttggccacttccatcaggacaagactttttaggtcacttagtgcaggttttagtttctattttggattaacaacatttatattgattatcgaaaagaagctttcatcatttcagaacagtcctggaagtttgactttgagtgtgggagaagtcctaataaaccattttggaaattagtgtctccaagtgttacagcttcctaaaatgggtttctaacacagtgggatcaaaataaggttattttaggataatatactgtaaacttaattgactgtctgattttctactttgtctataaagtggcttacaacaggttctaatctagaaaggagttataaaggttatctgtaatgtttatgaatt

SEQ ID NO: 365621 - DNA, 2660 bp, Homo sapiens
agagaggagccgactcggcagggactgggggaccgggccgagagtgcgagcgagcgagggagggagtgagggagcgtgcgagccagaaggggaaaggcggccactcgtgcctgagcgaccgcagaggggagtgggagcagtggggtaaaggagcggggggcgggaataagaaaggccgagagaaggcggacagaggctagtggtggtggtggtggtagggggagaaggaggagctggaggagggcaggggctgagggagtgagtgaagcggacgcgcgagggaggggagggaagggaagggaagggaagggggggtcacgcgggggcgcgcgcgcgcaccgggagcgcgctcggaggcgagtggaactggatcgggtttgctgccagcggcgtgagcttcggccgccattttacaacagctccactcgcgccggacacagggagcagcgagcacgcgtttcccgcaacccgataccatcggacaggatttctccgcctcagcccaacggggagatctctggaaacatggctacagaacatgttaatggaaatggtactgaagagcccatggatactacttctgcagttatccattcagaaaattttcagacattgcttgatgctggtttaccacagaaagttgctgaaaaactagatgaaatttacgttgcagggctagttgcacatagtgatttagatgaaagagctattgaagctttaaaagaattcaatgaagacggtgcattggcagttcttcaacagtttaaagacagtgatctctctcatgttcagaacaaaagtgcctttttatgtggagtcatgaagacttacaggcagagagaaaaacaagggaccaaagtagcagattctagtaaaggaccagatgaggcaaaaattaaggcactcttggaaagaacaggctacacacttgatgtgaccactggacagaggaagtatggaggaccacctccagattccgtttattcaggtcagcagccttctgttggcactgagatatttgtgggaaagatcccaagagatctatttgaggatgaacttgttccattatttgagaaagctggacctatatgggatcttcgtctaatgatggatccactcactggtctcaatagaggttatgcgtttgtcactttttgtacaaaagaagcagctcaggaggctgttaaactgtataataatcatgaaattcgttctggaaaacatattggtgtctgcatctcagttgccaacaataggctttttgtgggctctattcctaagagtaaaaccaaggaacagattcttgaagaatttagcaaagtaacagagggtcttacagacgtcattttataccaccaaccggatgacaagaaaaaaaacagaggcttttgctttcttgaatatgaagatcacaaaacagctgcccaggcaaggcgtaggttaatgagtggtaaagtcaaggtctgggggaatgttggaactgttgaatgggctgatcctatagaagatcctgatcctgaggttatggcaaaggtaaaagtgctgtttgtacgcaaccttgccaatactgtaacagaagagattttagaaaaggcatttagtcagtttgggaaactggaacgagtgaagaagttaaaagattatgcgttcattcattttgatgagcgagatggtgctgtcaaggctatggaagaaatgaatggcaaagacttggagggagaaaatattgaaattgtttttgccaagccaccagatcagaaaaggaaagaaagaaaagctcagaggcaagcagcaaaaaatcaaatgtatgacgattactactattatggtccacctcatatgccccctccaacaagaggtcgagggcgtggaggtagaggtggttatggatatcctccagattattatggatatgaagattattatgattattatggttatgattaccataactatcgtggtggatatgaagatccatactatggttatgaagattttcaagttggagctagaggaaggggtggtagaggagcaaggggtgctgctccatccagaggtcgtggggctgctcctccccgcggtagagccggttattcacagagaggaggtcctggatcagcaagaggcgttcgaggtgcgagaggaggtgcccaacaacaaagaggccgcggggtacgtggtgcgaggggtggccgcggtggaaatgtaggaggaaagcgcaaagctgatgggtacaaccagccagattccaagcggcgccagaccaataatcagaactggggctcccaacccattgctcagcaaccgctccaagcagggaaaaggggtcgaggccggtcctgacctgttacaatgaagactgacttgctatgtgggattacaccagaagcttgcagtggagtaatggtaaggaaatcaagcaaccttaaatatgtcggctgtataggagcatattctattgcagaagaccttcctatgaagatcatggaatcaaatacgggacattgaactaatacttggactttgatatgaatttctttaacaattttctctgcagtgcaagttattaaactaaagctactctattttcaaaatgtgttccaacagaaatccttcataactcctagcatggtatcttaataaagaataaagttctttta

SEQ ID NO: 365622 - DNA, 4757 bp, Homo sapiens
ggtcgactataccctgtctgtactgtacatagttcaatcctctgctactgaggtagttaacctttttaaaagggttggttaactacctcagtagcagaggattgaactataccctgtctgtactgtacatagaaaatctttgtagataaaagcaaggcttgttaaatatgatatgagggtaagattttaatataccaaatgtaacattcttagttgcctttagtttcagaggcttgtaagacttcctcatgaccatcataacaggccttgcttttgtcgtattttgtggctgaaaaagcagccttgcttcttcagatattgtagttatttggatgtataatagtttagcaagatgttacttttgtaagacatcagatgttcaaaaaagtgcatccgaacttgtactaaatactgcagtgtccctttataaaaagtcagactaaaactgacaattgtacagcgaacctgacatttggatattttgaagttttttcataaatcatagaaattagtatatggctgtagtttagctttttaggtaaaaggtatgtttcattagtgcatttcttcctgctgatcactgtaaacatgtgaatcagctttccatttcttatgcaggtcatgataacttgtagagtagagtacaatcatttgtgctatgtttttaattttctaaagcaccttgatgacagtgagtgtccagtggtgaagcatcctctattgaaccaccctcaaaaatttttttgccaagtcctaagttgatagcttaaagtaaaaagtgaaaattatagtttcattaggacttggtgtaaagaaatcccctccccccttccccaaagggatactgcagttatatcacatacccaataggcaccacgatgaagatcagagcttatacttaattaaggttttatacacaccagttccccagtaaatgcaaatttaacaagaaaatcagacatgtcatatgttcaaaatgctcatggcaaacaatcattttgcattcctgcaaataaaattgttttatactgtaagctggaggcgagtgtaacttatttttgtaataaagtttttattttttttatgtgtcattaatataaatgtgtgttagtgtagaaatcttctggtttaaaaacttagaattgcacacatttcagtatgtttatttgtacttacataattttagaatagtggttgccaatagcctgtatgtttcacattaattggttttttgttatctaaataaatcattttagtatgttgtatgtcagttactgggatagctgggacatagagtgtaatttaaaatttgtcaataagtattcattggaatatatgtaaatgtgccttgccggttattgaaacttatctacaaaatgagtatggggtgacaaaaattagttcctggtgcttaatgaaactttctgccactgattttatatattaccccgtgcttttttaaagtacatctctctcaaaacttagtgtaagtttgagggctacacaaaacatttacatttcattctaacataatgaatataataggttgtggaaagtgggtaaactaaatgtagccttcagtaaaattgaatctcagtgtaatccttggtgctggcatttctcagttccgaggagttaaatgatcccatctaagaggtcattgccatgcctattggcactttactgtcatagcatttttaagggacactgtcaaggtgtttaagttctcagaattacttgttgggattttaggacaggtttgtttacttaaagtaagaactgcattgtcaaagttgaaagaggaacacttttgtgagttcacaaatgtgttcttaagaaaacattaaaatatggagctctgggttttcaagactatttggcattcttaatttggggacttgggagggaaactgataaaaagaaattgaagaattgatggttatacttaaagaagggtaatgtaaacagtggtgatgaaatatatacacatcaagtgaaattacttgacagtgttcatttgaatgactttgaattcaagccattataattacttttaaaattaaatatcatttgcactgttctgataatgggtgcagtttttgagcaatataatcagagctaaatatgcatgtagtgattagtgatgtgaacaattaacgttctgagaagaaatactaactgtggtattttcaaacttaaatttctgtagtaaaatcagtatcaaagtcttatcagatcaaggaaaaacaggcaatgcatataaacatacttttgaatgttgtgtggcctataaagcaataatgcaatttatatggaatgtcatgggatatgagaaatggaaatgcaaaaataactaatcctttagtaaaaatgtcaacatgttaaagggggaatgttaactaatgtaggttattgctatttgtgatttgtttatgggttcttggctttgacagcttcaaagaatggacagtgataagttaaaagaaattttgtatattgtcaaggaaagggtcttaaatccgagtcaagtcccttccttggggtaaaaaatgtattcttaaagcattctgatgttaaaaagaaaacttaagttatctaaccaaaacagacgcaagattttgtttctgcagactacttggcaatcaaaagtgatcataaatttaggttatcagttttcagaaagttgctttgtgagaaaattttgttagatatattctcccaagcatgctttttgtggaaggttttcagccattgccactgaatcagatgttaaaaatgaagggaaaattgagtgtgcacacacacaactgttgtacactcatgattgcagtttttagcttaagaaacttttctaccagttactgtgaatctgacttaaaatgtaaagtttcctcatgataaaataggaacaacatagaaatggattgatggggtgatctgagttattgtatataaaagtttttaaagaatagaatgaacatcaagctagataggcaaaaattgacacattcagaacagcttttttgactgcgaagccaaaagttgtcagaaacagcaaaagatcccttattattacagagtattttacgtagtctctattttaaggagagaaattaaatagaagggcttcatgcatttaggggagggtgctaaaacttctcaagttcgtcaaacttacaggaatacccaccatgatcattttctctctaattatgtataccacaaaattttcatctggccataggaattcactggtgggtgtaaaattaatgactaaagaaattaagtgacaaatacataaaagaaacagacttgtggggatattgttttaaggtgtattaattactcagtgatgataccactcaatagggcatgccactacttttcttaagatgctaattatgaagcagtgctcacaggcattttttaactagcaaattagtagatggacttttggggtctgtcactttttaaaagtatttaagacttaaattctattagcaccacagtctgccttcagtaatacacctaaaatatttttcaggaccagaagcattcagtttgaaaatttgcagatgcaaaccagtattattactaacgctctgggtcaaagattaggtttttaatattaacagtagtctggtaaatatttagaagtctggcattgagaaacaaaagcttgtacctgactagtatttttatttaaaaaaattagttctgttagcttatttaaattgtgttttatttatccgtagaatttatatttatttcattcctttcatctcactgaaaactgtctgcaggccctttgatttggattagatgtgtgaagtactgtcttttgccaaaaacctcaaattacctgttcttttcaacgtagtgggtttgtgcttgtttggagatcagttcaaaaactatctgtactatctgtactgcctctgatgttaagattttatgtatagcataaggaagctagctctgactatattttcctaagaataaagacctatttttgtagcatgtcttaggatctccaggagtccaagaattattgtgggtgtcctccaattcatcactcttcacttaacagcttttaagtagacacttggaatctttagaggtctgtcgccctttgattatccatacattcgaagtaactagccaatggtgaaaaattcctcaagatatcctcagttgcaatcacattactggaagatgaatagaataaatgtattaggctggtcttaatttttgatggaaatattctgttgtcccgtacttgccattggatttgataaagttagtggtaatttggaaagaatcggggacttgccaatatatttgtgggttttagcttatacccctaggatttcttggttgcgggacgagcagttttggccacttccatcaggacaagactttttaggtcacttagtgcaggttttagtttctattttggattaacaacatttatattgattatcgaaaagaagctttcatcatttcagaacagtcctggaagtttgactttgagtgtgggagaagtcctaataaaccattttggaaattagtgtctccaagtgttacagcttcctaaaatgggtttctaacacagtgggatcaaaataaggttattttaggataatatactgtaaacttaattgactgtctgattttctactttgtctataaagtggcttacaacaggttctaatctagaaaggagttataaaggttatctgtaatgtttatgaatt

SEQ ID NO: 365623 - DNA, 1645 bp, Homo sapiens
agagaggagccgactcggcagggactgggggaccgggccgagagtgcgagcgagcgagggagggagtgagggagcgtgcgagccagaaggggaaaggcggccactcgtgcctgagcgaccgcagaggggagtgggagcagtggggtaaaggagcggggggcgggaataagaaaggccgagagaaggcggacagaggctagtggtggtggtggtggtagggggagaaggaggagctggaggagggcaggggctgagggagtgagtgaagcggacgcgcgagggaggggagggaagggaagggaagggaagggggggtcacgcgggggcgcgcgcgcgcaccgggagcgcgctcggaggcgagtggaactggatcgggtttgctgccagcggcgtgagcttcggccgccattttacaacagctccactcgcgccggacacagggagcagcgagcacgcgtttcccgcaacccgataccatcggacaggatttctccgcctcagcccaacggggagatctctggaaacatggctacagaacatgttaatggaaatggtactgaagagcccatggatactacttctgcagttatccattcagaaaattttcagacattgcttgatgctggtttaccacagaaagttgctgaaaaactagatgaaatttacgttgcagggctagttgcacatagtgatttagatgaaagagctattgaagctttaaaagaattcaatgaagacggtgcattggcagttcttcaacagtttaaagacagtgatctctctcatgttcagaacaaaagtgcctttttatgtggagtcatgaagacttacaggcagagagaaaaacaagggaccaaagtagcagattctagtaaaggaccagatgaggcaaaaattaaggcactcttggaaagaacaggctacacacttgatgtgaccactggacagaggaagtatggaggaccacctccagattccgtttattcaggtcagcagccttctgttggcactgagatatttgtgggaaagatcccaagagatctatttgaggatgaacttgttccattatttgagaaagctggacctatatgggatcttcgtctaatgatggatccactcactggtctcaatagaggttatgcgtttgtcactttttgtacaaaagaagcagctcaggaggctgttaaactgtataataatcatgaaattcgttctggaaaacatattggtgtctgcatctcagttgccaacaataggctttttgtgggctctattcctaagagtaaaaccaaggaacagattcttgaagaatttagcaaagtaacagagggtcttacagacgtcattttataccaccaaccggatgacaagaaaaaaaacagaggcttttgctttcttgaatatgaagatcacaaaacagctgcccaggtaaaagtgctgtttgtacgcaaccttgccaatactgtaacagaagagattttagaaaaggcatttagtcagtttgggaaactggaacgagtgaagaagttaaaagattatgcgttcattcattttgatgagcgagatggtgctgtcaagctatggaagaaatgaatggcaaacttggattacccatatgatgtttcacgccgggccgggcgggggg

SEQ ID NO: 365624 - DNA, 1413 bp, Homo sapiens
agagaggagccgactcggcagggactgggggaccgggccgagagtgcgagcgagcgagggagggagtgagggagcgtgcgagccagaaggggaaaggcggccactcgtgcctgagcgaccgcagaggggagtgggagcagtggggtaaaggagcggggggcgggaataagaaaggccgagagaaggcggacagaggctagtggtggtggtggtggtagggggagaaggaggagctggaggagggcaggggctgagggagtgagtgaagcggacgcgcgagggaggggagggaagggaagggaagggaagggggggtcacgcgggggcgcgcgcgcgcaccgggagcgcgctcggaggcgagtggaactggatcgggtttgctgccagcggcgtgagcttcggccgccattttacaacagctccactcgcgccggacacagggagcagcgagcacgcgtttcccgcaacccgataccatcggacaggatttctccgcctcagcccaacggggagatctctggaaacatggctacagaacatgttaatggaaatggtactgaagagcccatggatactacttctgcagttatccattcagaaaattttcagacattgcttgatgctggtttaccacagaaagttgctgaaaaactagatgaaatttacgttgcagggctagttgcacatagtgatttagatgaaagagctattgaagctttaaaagaattcaatgaagacggtgcattggcagttcttcaacagtttaaagacagtgatctctctcatgttcagaacaaaagtgcctttttatgtggagtcatgaagacttacaggcagagagaaaaacaagggaccaaagtagcagattctagtaaaggaccagatgaggcaaaaattaaggcactcttggaaagaacaggctacacacttgatgtgaccactggacagaggaagtatggaggaccacctccagattccgtttattcaggtcagcagccttctgttggcactgagatatttgtgggaaagatcccaagagatctatttgaggatgaacttgttccattatttgagaaagctggacctatatgggatcttcgtctaatgatggatccactcactggtctcaatagaggttatgcgtttgtcactttttgtacaaaagaagcagctcaggaggctgttaaactgtataataatcatgaaattcgttctggaaaacatattggtgtctgcatctcagttgccaacaataggctttttgtgggctctattcctaagagtaaaaccaaggaacagattcttgaagaatttagcaaagtaacagaggtcttcagcgtcatttatacaccaccggatgacagaaaaaacagagctttgcttctgatatgagtccaacactgccagcagcgt

SEQ ID NO: 365625 - DNA, 1442 bp, Homo sapiens
agagaggagccgactcggcagggactgggggaccgggccgagagtgcgagcgagcgagggagggagtgagggagcgtgcgagccagaaggggaaaggcggccactcgtgcctgagcgaccgcagaggggagtgggagcagtggggtaaaggagcggggggcgggaataagaaaggccgagagaaggcggacagaggctagtggtggtggtggtggtagggggagaaggaggagctggaggagggcaggggctgagggagtgagtgaagcggacgcgcgagggaggggagggaagggaagggaagggaagggggggtcacgcgggggcgcgcgcgcgcaccgggagcgcgctcggaggcgagtggaactggatcgggtttgctgccagcggcgtgagcttcggccgccattttacaacagctccactcgcgccggacacagggagcagcgagcacgcgtttcccgcaacccgataccatcggacaggatttctccgcctcagcccaacggggagatctctggaaacatggctacagaacatgttaatggaaatggtactgaagagcccatggatactacttctgcagttatccattcagaaaattttcagacattgcttgatgctggtttaccacagaaagttgctgaaaaactagatgaaatttacgttgcagggctagttgcacatagtgatttagatgaaagagctattgaagctttaaaagaattcaatgaagacggtgcattggcagttcttcaacagtttaaagacagtgatctctctcatgttcagaacaaaagtgcctttttatgtggagtcatgaagacttacaggcagagagaaaaacaagggaccaaagtagcagattctagtaaaggaccagatgaggcaaaaattaaggcactcttggaaagaacaggctacacacttgatgtgaccactggacagaggaagtatggaggaccacctccagattccgtttattcaggtcagcagccttctgttggcactgagtttgtgggcgaaaagatcccaagagatctatttgagggagtgaactttgtttccacttaatttggaggaaaagctgggaccctaattatgggaatctctcgcgctaaatggaggtggattcccacttcaccgtgggtctcccacattcagaagggtttaatagcaggttggtgccaccttttttgtggtgaccaaaaaaaggaaagccaagccgttcaacgagggaagagggcgtggttctaacaaaccgtgggtttattaaattatactctccttgcaacaactgtccgggtttccgtggggagaaaacccttatctgtgggcgggtccgggcacattcttcacaaggttgggcccaaaccacacattagggggccttttacatagggcggggggggccacactatttgccccttaaaaggaaggat

SEQ ID NO: 365626 - DNA, 2518 bp, Homo sapiens
agagaggagccgactcggcagggactgggggaccgggccgagagtgcgagcgagcgagggagggagtgagggagcgtgcgagccagaaggggaaaggcggccactcgtgcctgagcgaccgcagaggggagtgggagcagtggggtaaaggagcggggggcgggaataagaaaggccgagagaaggcggacagaggctagtggtggtggtggtggtagggggagaaggaggagctggaggagggcaggggctgagggagtgagtgaagcggacgcgcgagggaggggagggaagggaagggaagggaagggggggtcacgcgggggcgcgcgcgcgcaccgggagcgcgctcggaggcgagtggaactggatcgggtttgctgccagcggcgtgagcttcggccgccattttacaacagctccactcgcgccggacacagggagcagcgagcacgcgtttcccgcaacccgataccatcggacaggatttctccgcctcagcccaacggggagatctctggaaacatggctacagaacatgttaatggaaatggtactgaagagcccatggatactacttctgcagttatccattcagaaaattttcagacattgcttgatgctggtttaccacagaaagttgctgaaaaactagatgaaatttacgttgcagggctagttgcacatagtgatttagatgaaagagctattgaagctttaaaagaattcaatgaagacggtgcattggcagttcttcaacagtttaaagacagtgatctctctcatgttcagaacaaaagtgcctttttatgtggagtcatgaagacttacaggcagagagaaaaacaagggaccaaagtagcagattctagtaaaggaccagatgaggcaaaaattaaggcactcttggaaagaacaggctacacacttgatgtgaccactggacagaggaagtatggaggaccacctccagattccgtttattcaggtcagcagccttctgttggcactgagatatttgtgggaaagatcccaagagatctatttgaggatgaacttgttccattatttgagaaagctggacctatatgggatcttcgtctaatgatggatccactcactggtctcaatagaggttatgcgtttgtcactttttgtacaaaagaagcagctcaggaggctgttaaactgtataataatcatgaaattcgttctggaaaacatattggtgtctgcatctcagttgccaacaataggctttttgtgggctctattcctaagagtaaaaccaaggaacagattcttgaagaatttagcaaagtaacagagggtcttacagacgtcattttataccaccaaccggatgacaagaaaaaaaacagaggcttttgctttcttgaatatgaagatcacaaaacagctgcccaggcaaggcgtaggttaatgagtggtaaagtcaaggtctgggggaatgttggaactgttgaatgggctgatcctatagaagatcctgatcctgaggttatggcaaaggtaaaagtgctgtttgtacgcaaccttgccaatactgtaacagaagagattttagaaaaggcatttagtcagtttgggaaactggaacgagtgaagaagttaaaagattatgcgttcattcattttgatgagcgagatggtgctgtcaaggctatggaagaaatgaatggcaaagacttggagggagaaaatattgaaattgtttttgccaagccaccagatcagaaaaggaaagaaagaaaagctcagaggcaagcagcaaaaaatcaaatgtatgacgattactactattatggtccacctcatatgccccctccaacaagaggtcgagggcgtggaggtagaggtggttatggatatcctccagattattatggatatgaagattattatgattattatggttatgattaccataactatcgtggtggatatgaagatccatactatggttatgaagattttcaagttggagctagaggaaggggtggtagaggagcaaggggtgctgctccatccagaggtcgtggggctgctcctccccgcggtagagccggttattcacagagaggaggtcctggatcagcaagaggcgttcgaggtgcgagaggaggtgcccaacaacaaagaggccgcgggcagggaaaaggggtcgaggccggtcctgacctgttacaatgaagactgacttgctatgtgggattacaccagaagcttgcagtggagtaatggtaaggaaatcaagcaaccttaaatatgtcggctgtataggagcatattctattgcagaagaccttcctatgaagatcatggaatcaaatacgggacattgaactaatacttggactttgatatgaatttctttaacaattttctctgcagtgcaagttattaaactaaagctactctattttcaaaatgtgttccaacagaaatccttcataactcctagcatggtatcttaataaagaataaagttctttta

SEQ ID NO: 365627 - DNA, 763 bp, Homo sapiens
gcacgaggagagagagagagagagagagaaagagcagcaaaaaatcaaatgtatgacgattactactattatggtccacctcatatgccccctccaacaagaggtcgagggcgtggaggtagaggtggttatggatatcctccagattattatggatatgaagattattatgattattatggttatgattaccataactatcgtggtggatatgaagatccatactatggttatgaagattttcaagttggagctagaggaaggggtggtagaggagcaaggggtgctgctccatccagaggtcgtggggctgctcctccccgcggtagagccggttattcacagagaggaggtcctggatcagcaagaggcgttcgaggtgcgagaggaggtgcccaacaacaaagaggccgcgggcagggaaaaggggtcgaggccggtcctgacctgttacaatgaagactgacttgctatgtgggattacaccagaagcttgcagtggagtaatggtaaggaaatcaagcaaccttaaatatgtcggctgtataggagcatattctattgcagaagaccttcctatgaagatcatggaatcaaatacgggacattgaactaatacttggactttgatatgaatttctttaacaattttctctgcagtgcaagttattaaactaaagctactctattttcaaaatgtgttccaacagaaatccttcataactcctagcatggtatcttaataaagaataaagttctttta

SEQ ID NO: 365628 - DNA, 7371 bp, Homo sapiens
agagaggagccgactcggcagggactgggggaccgggccgagagtgcgagcgagcgagggagggagtgagggagcgtgcgagccagaaggggaaaggcggccactcgtgcctgagcgaccgcagaggggagtgggagcagtggggtaaaggagcggggggcgggaataagaaaggccgagagaaggcggacagaggctagtggtggtggtggtggtagggggagaaggaggagctggaggagggcaggggctgagggagtgagtgaagcggacgcgcgagggaggggagggaagggaagggaagggaagggggggtcacgcgggggcgcgcgcgcgcaccgggagcgcgctcggaggcgagtggaactggatcgggtttgctgccagcggcgtgagcttcggccgccattttacaacagctccactcgcgccggacacagggagcagcgagcacgcgtttcccgcaacccgataccatcggacaggatttctccgcctcagcccaacggggagatctctggaaacatggctacagaacatgttaatggaaatggtactgaagagcccatggatactacttctgcagttatccattcagaaaattttcagacattgcttgatgctggtttaccacagaaagttgctgaaaaactagatgaaatttacgttgcagggctagttgcacatagtgatttagatgaaagagctattgaagctttaaaagaattcaatgaagacggtgcattggcagttcttcaacagtttaaagacagtgatctctctcatgttcagaacaaaagtgcctttttatgtggagtcatgaagacttacaggcagagagaaaaacaagggaccaaagtagcagattctagtaaaggaccagatgaggcaaaaattaaggcactcttggaaagaacaggctacacacttgatgtgaccactggacagaggaagtatggaggaccacctccagattccgtttattcaggtcagcagccttctgttggcactgagatatttgtgggaaagatcccaagagatctatttgaggatgaacttgttccattatttgagaaagctggacctatatgggatcttcgtctaatgatggatccactcactggtctcaatagaggttatgcgtttgtcactttttgtacaaaagaagcagctcaggaggctgttaaactgtataataatcatgaaattcgttctggaaaacatattggtgtctgcatctcagttgccaacaataggctttttgtgggctctattcctaagagtaaaaccaaggaacagattcttgaagaatttagcaaagtaacagagggtcttacagacgtcattttataccaccaaccggatgacaagaaaaaaaacagaggcttttgctttcttgaatatgaagatcacaaaacagctgcccaggcaaggcgtaggttaatgagtggtaaagtcaaggtctgggggaatgttggaactgttgaatgggctgatcctatagaagatcctgatcctgaggttatggcaaaggtaaaagtgctgtttgtacgcaaccttgccaatactgtaacagaagagattttagaaaaggcatttagtcagtttgggaaactggaacgagtgaagaagttaaaagattatgcgttcattcattttgatgagcgagatggtgctgtcaaggctatggaagaaatgaatggcaaagacttggagggagaaaatattgaaattgtttttgccaagccaccagatcagaaaaggaaagaaagaaaagctcagaggcaagcagcaaaaaatcaaatgtatgacgattactactattatggtccacctcatatgccccctccaacaagaggtcgagggcgtggaggtagaggtggttatggatatcctccagattattatggatatgaagattattatgattattatggttatgattaccataactatcgtggtggatatgaagatccatactatggttatgaagattttcaagttggagctagaggaaggggtggtagaggagcaaggggtgctgctccatccagaggtcgtggggctgctcctccccgcggtagagccggttattcacagagaggaggtcctggatcagcaagaggcgttcgaggtgcgagaggaggtgcccaacaacaaagaggccgcgggcagggaaaaggggtcgaggccggtcctgacctgttacaatgaagactgacttgctatgtgggattacaccagaagcttgcagtggagtaatggtaaggaaatcaagcaaccttaaatatgtcggctgtataggagcatattctattgcagaagaccttcctatgaagatcatggaatcaaatacgggacattgaactaatacttggactttgatatgaatttctttaacaattttctctgcagtgcaagttattaaactaaagctactctattttcaaaatgtgttccaacagaaatccttcataactcctagcatggtatcttaataaagaataaagttcttttaaaaatctgctctaagtagatttttccccttttttaaattaaggatcccaacagtggtattttgaaatattctcttgaatttgtgcatttaaattttattgcagtggtatagatgaatgccactgatggtatccttaaattttatttctgctcaccaaggttaatcatgattgtctatatcttttttatagtgatcacttttgaattgtgttcagatatgcagtttcaggtgtaatcatcagagctggttagtcaggcattccagatagtggttcttttcagaacctttttaaaagggttggttaactacctcagtagcagaggattgaactataccctgtctgtactgtacatagaaaatgccttgcttttgtcgtattttgtggctgaaaaagcagccttgcttcttcagatattgtagttatttggatgtataatagtttagcaagatgttacttttgtaagacatcagatgttcaaaaaagtgcatccgaacttgtactaaatactgcagtgtccctttataaaaagtcagactaaaactgacaattgtacagcgaacctgacatttggatattttgaagttttttcataaatcatagaaattagtatatggctgtagtttagctttttaggtaaaaggtatgtttcattagtgcatttcttcctgctgatcactgtaaacatgtgaatcagctttccatttcttatgcaggtcatgataacttgtagagtagagtacaatcatttgtgctatgtttttaattttctaaagcaccttgatgacagtgagtgtccagtggtgaagcatcctctattgaaccaccctcaaaaatttttttgccaagtcctaagttgatagcttaaagtaaaaagtgaaaattatagtttcattaggacttggtgtaaagaaatcccctccccccttccccaaagggatactgcagttatatcacatacccaataggcaccacgatgaagatcagagcttatacttaattaaggttttatacacaccagttccccagtaaatgcaaatttaacaagaaaatcagacatgtcatatgttcaaaatgctcatggcaaacaatcattttgcattcctgcaaataaaattgttttatactgtaagctggaggcgagtgtaacttatttttgtaataaagtttttattttttttatgtgtcattaatataaatgtgtgttagtgtagaaatcttctggtttaaaaacttagaattgcacacatttcagtatgtttatttgtacttacataattttagaatagtggttgccaatagcctgtatgtttcacattaattggttttttgttatctaaataaatcattttagtatgttgtatgtcagttactgggatagctgggacatagagtgtaatttaaaatttgtcaataagtattcattggaatatatgtaaatgtgccttgccggttattgaaacttatctacaaaatgagtatggggtgacaaaaattagttcctggtgcttaatgaaactttctgccactgattttatatattaccccgtgcttttttaaagtacatctctctcaaaacttagtgtaagtttgagggctacacaaaacatttacatttcattctaacataatgaatataataggttgtggaaagtgggtaaactaaatgtagccttcagtaaaattgaatctcagtgtaatccttggtgctggcatttctcagttccgaggagttaaatgatcccatctaagaggtcattgccatgcctattggcactttactgtcatagcatttttaagggacactgtcaaggtgtttaagttctcagaattacttgttgggattttaggacaggtttgtttacttaaagtaagaactgcattgtcaaagttgaaagaggaacacttttgtgagttcacaaatgtgttcttaagaaaacattaaaatatggagctctgggttttcaagactatttggcattcttaatttggggacttgggagggaaactgataaaaagaaattgaagaattgatggttatacttaaagaagggtaatgtaaacagtggtgatgaaatatatacacatcaagtgaaattacttgacagtgttcatttgaatgactttgaattcaagccattataattacttttaaaattaaatatcatttgcactgttctgataatgggtgcagtttttgagcaatataatcagagctaaatatgcatgtagtgattagtgatgtgaacaattaacgttctgagaagaaatactaactgtggtattttcaaacttaaatttctgtagtaaaatcagtatcaaagtcttatcagatcaaggaaaaacaggcaatgcatataaacatacttttgaatgttgtgtggcctataaagcaataatgcaatttatatggaatgtcatgggatatgagaaatggaaatgcaaaaataactaatcctttagtaaaaatgtcaacatgttaaagggggaatgttaactaatgtaggttattgctatttgtgatttgtttatgggttcttggctttgacagcttcaaagaatggacagtgataagttaaaagaaattttgtatattgtcaaggaaagggtcttaaatccgagtcaagtcccttccttggggtaaaaaatgtattcttaaagcattctgatgttaaaaagaaaacttaagttatctaaccaaaacagacgcaagattttgtttctgcagactacttggcaatcaaaagtgatcataaatttaggttatcagttttcagaaagttgctttgtgagaaaattttgttagatatattctcccaagcatgctttttgtggaaggttttcagccattgccactgaatcagatgttaaaaatgaagggaaaattgagtgtgcacacacacaactgttgtacactcatgattgcagtttttagcttaagaaacttttctaccagttactgtgaatctgacttaaaatgtaaagtttcctcatgataaaataggaacaacatagaaatggattgatggggtgatctgagttattgtatataaaagtttttaaagaatagaatgaacatcaagctagataggcaaaaattgacacattcagaacagcttttttgactgcgaagccaaaagttgtcagaaacagcaaaagatcccttattattacagagtattttacgtagtctctattttaaggagagaaattaaatagaagggcttcatgcatttaggggagggtgctaaaacttctcaagttcgtcaaacttacaggaatacccaccatgatcattttctctctaattatgtataccacaaaattttcatctggccataggaattcactggtgggtgtaaaattaatgactaaagaaattaagtgacaaatacataaaagaaacagacttgtggggatattgttttaaggtgtattaattactcagtgatgataccactcaatagggcatgccactacttttcttaagatgctaattatgaagcagtgctcacaggcattttttaactagcaaattagtagatggacttttggggtctgtcactttttaaaagtatttaagacttaaattctattagcaccacagtctgccttcagtaatacacctaaaatatttttcaggaccagaagcattcagtttgaaaatttgcagatgcaaaccagtattattactaacgctctgggtcaaagattaggtttttaatattaacagtagtctggtaaatatttagaagtctggcattgagaaacaaaagcttgtacctgactagtatttttatttaaaaaaattagttctgttagcttatttaaattgtgttttatttatccgtagaatttatatttatttcattcctttcatctcactgaaaactgtctgcaggccctttgatttggattagatgtgtgaagtactgtcttttgccaaaaacctcaaattacctgttcttttcaacgtagtgggtttgtgcttgtttggagatcagttcaaaaactatctgtactatctgtactgcctctgatgttaagattttatgtatagcataaggaagctagctctgactatattttcctaagaataaagacctatttttgtagcatgtcttaggatctccaggagtccaagaattattgtgggtgtcctccaattcatcactcttcacttaacagcttttaagtagacacttggaatctttagaggtctgtcgccctttgattatccatacattcgaagtaactagccaatggtgaaaaattcctcaagatatcctcagttgcaatcacattactggaagatgaatagaataaatgtattaggctggtcttaatttttgatggaaatattctgttgtcccgtacttgccattggatttgataaagttagtggtaatttggaaagaatcggggacttgccaatatatttgtgggttttagcttatacccctaggatttcttggttgcgggacgagcagttttggccacttccatcaggacaagactttttaggtcacttagtgcaggttttagtttctattttggattaacaacatttatattgattatcgaaaagaagctttcatcatttcagaacagtcctggaagtttgactttgagtgtgggagaagtcctaataaaccattttggaaattagtgtctccaagtgttacagcttcctaaaatgggtttctaacacagtgggatcaaaataaggttattttaggataatatactgtaaacttaattgactgtctgattttctactttgtctataaagtggcttacaacaggttctaatctagaaaggagttataaaggttatctgtaatgtttatgaatt

SEQ ID NO: 365629 - DNA, 5053 bp, Homo sapiens
agagaggagccgactcggcagggactgggggaccgggccgagagtgcgagcgagcgagggagggagtgagggagcgtgcgagccagaaggggaaaggcggccactcgtgcctgagcgaccgcagaggggagtgggagcagtggggtaaaggagcggggggcgggaataagaaaggccgagagaaggcggacagaggctagtggtggtggtggtggtagggggagaaggaggagctggaggagggcaggggctgagggagtgagtgaagcggacgcgcgagggaggggagggaagggaagggaagggaagggggggtcacgcgggggcgcgcgcgcgcaccgggagcgcgctcggaggcgagtggaactggatcgggtttgctgccagcggcgtgagcttcggccgccattttacaacagctccactcgcgccggacacagggagcagcgagcacgcgtttcccgcaacccgataccatcggacaggatttctccgcctcagcccaacggggagatctctggaaacatggctacagaacatgttaatggaaatggtactgaagagcccatggatactacttctgcagttatccattcagaaaattttcagacattgcttgatgctggtttaccacagaaagttgctgaaaaactagatgaaatttacgttgcagggctagttgcacatagtgatttagatgaaagagctattgaagctttaaaagaattcaatgaagacggtgcattggcagttcttcaacagtttaaagacagtgatctctctcatgttcagaacaaaagtgcctttttatgtggagtcatgaagacttacaggcagagagaaaaacaagggaccaaagtagcagattctagtaaaggaccagatgaggcaaaaattaaggcactcttggaaagaacaggctacacacttgatgtgaccactggacagaggaagtatggaggaccacctccagattccgtttattcaggtcagcagccttctgttggcactgagatatttgtgggaaagatcccaagagatctatttgaggatgaacttgttccattatttgagaaagctggacctatatgggatcttcgtctaatgatggatccactcactggtctcaatagaggttatgcgtttgtcactttttgtacaaaagaagcagctcaggaggctgttaaactgtataataatcatgaaattcgttctggaaaacatattggtgtctgcatctcagttgccaacaataggctttttgtgggctctattcctaagagtaaaaccaaggaacagattcttgaagaatttagcaaagtaacagagggtcttacagacgtcattttataccaccaaccggatgacaagaaaaaaaacagaggcttttgctttcttgaatatgaagatcacaaaacagctgcccaggcaaggcgtaggttaatgagtggtaaagtcaaggtctgggggaatgttggaactgttgaatgggctgatcctatagaagatcctgatcctgaggttatggcaaaggtaaaagtgctgtttgtacgcaaccttgccaatactgtaacagaagagattttagaaaaggcatttagtcagtttgggaaactggaacgagtgaagaagttaaaagattatgcgttcattcattttgatgagcgagatggtgctgtcaaggctatggaagaaatgaatggcaaagacttggagggagaaaatattgaaattgtttttgccaagccaccagatcagaaaaggaaagaaagaaaagctcagaggcaagcagcaaaaaatcaaatgtatgacgattactactattatggtccacctcatatgccccctccaacaagaggtcgagggcgtggaggtagaggtggttatggatatcctccagattattatggatatgaagattattatgattattatggttatgattaccataactatcgtggtggatatgaagatccatactatggttatgaagattttcaagttggagctagaggaaggggtggtagaggagcaaggggtgctgctccatccagaggtcgtggggctgctcctccccgcggtagagccggttattcacagagaggaggtcctggatcagcaagaggcgttcgaggtgcgagaggaggtgcccaacaacaaagaggccgcgggcagggaaaaggggtcgaggccggtcctgacctgttacaatgaagactgacttgctatgtgggattacaccagaagcttgcagtggagtaatggtaaggaaatcaagcaaccttaaatatgtcggctgtataggagcatattctattgcagaagaccttcctatgaagatcatggaatcaaatacgggacattgaactaatacttggactttgatatgaatttctttaacaattttctctgcagtgcaagttattaaactaaagctactctattttcaaaatgtgttccaacagaaatccttcataactcctagcatggtatcttaataaagaataaagttcttttaaaaatctgctctaagtagatttttccccttttttaaattaaggatcccaacagtggtattttgaaatattctcttgaatttgtgcatttaaattttattgcagtggtatagatgaatgccactgatggtatccttaaattttatttctgctcaccaaggttaatcatgattgtctatatcttttttatagtgatcacttttgaattgtgttcagatatgcagtttcaggtgtaatcatcagagctggttagtcaggcattccagatagtggttcttttcagaacctttttaaaagggttggttaactacctcagtagcagaggattgaactataccctgtctgtactgtacatagaaaatctttgtagataaaagcaaggcttgttaaatatgatatgagggtaagattttaatataccaaatgtaacattcttagttgcctttagtttcagaggcttgtaagacttcctcatgaccatcataacaggccttgcttttgtcgtattttgtggctgaaaaagcagccttgcttcttcagatattgtagttatttggatgtataatagtttagcaagatgttacttttgtaagacatcagatgttcaaaaaagtgcatccgaacttgtactaaatactgcagtgtccctttataaaaagtcagactaaaactgacaattgtacagcgaacctgacatttggatattttgaagttttttcataaatcatagaaattagtatatggctgtagtttagctttttaggtaaaaggtatgtttcattagtgcatttcttcctgctgatcactgtaaacatgtgaatcagctttccatttcttatgcaggtcatgataacttgtagagtagagtacaatcatttgtgctatgtttttaattttctaaagcaccttgatgacagtgagtgtccagtggtgaagcatcctctattgaaccaccctcaaaaatttttttgccaagtcctaagttgatagcttaaagtaaaaagtgaaaattatagtttcattaggacttggtgtaaagaaatcccctccccccttccccaaagggatactgcagttatatcacatacccaataggcaccacgatgaagatcagagcttatacttaattaaggttttatacacaccagttccccagtaaatgcaaatttaacaagaaaatcagacatgtcatatgttcaaaatgctcatggcaaacaatcattttgcattcctgcaaataaaattgttttatactgtaagctggaggcgagtgtaacttatttttgtaataaagtttttattttttttatgtgtcattaatataaatgtgtgttagtgtagaaatcttctggtttaaaaacttagaattgcacacatttcagtatgtttatttgtacttacataattttagaatagtggttgccaatagcctgtatgtttcacattaattggttttttgttatctaaataaatcattttagtatgttgtatgtcagttactgggatagctgggacatagagtgtaatttaaaatttgtcaataagtattcattggaatatatgtaaatgtgccttgccggttattgaaacttatctacaaaatgagtatggggtgacaaaaattagttcctggtgcttaatgaaactttctgccactgattttatatattaccccgtgcttttttaaagtacatctctctcaaaacttagtgtaagtttgagggctacacaaaacatttacatttcattctaacataatgaatataataggttgtggaaagtgggtaaactaaatgtagccttcagtaaaattgaatctcagtgtaatccttggtgctggcatttctcagttccgaggagttaaatgatcccatctaagaggtcattgccatgcctattggcactttactgtcatagcatttttaagggacactgtcaaggtgtttaagttctcagaattacttgttgggattttaggacaggtttgtttacttaaagtaagaactgcattgtcaaagttgaaagaggaacacttttgtgagttcacaaatgtgttcttaagaaaacattaaaatatggagctctgggttttcaagactatttggcattcttaatttggggacttgggagggaaactgataaaaagaaattgaagaattgatggttatacttaaagaagggtaatgtaaacagtggtgatgaaatatatacacatcaagtgaaattacttgacagtgttcatttgaatgactttgaattcaagccattataattacttttaaaattaaatatcatttgcactgttctgataatgggtgcagtttttgagcaatataatcagagctaaatatgcatgtagtgattagtgatgtgaacaattaacgttctgagaagaaatactaactgtggtattttcaaacttaaatttctgtagtaaaatcagtatcaaaagggtcttttttaaaatttttcccccaaagagggggggaaaaattttttcccccaaaaaatgtggcctataaagcaataatgcaatg

SEQ ID NO: 365630 - DNA, 3370 bp, Homo sapiens
agagaggagccgactcggcagggactgggggaccgggccgagagtgcgagcgagcgagggagggagtgagggagcgtgcgagccagaaggggaaaggcggccactcgtgcctgagcgaccgcagaggggagtgggagcagtggggtaaaggagcggggggcgggaataagaaaggccgagagaaggcggacagaggctagtggtggtggtggtggtagggggagaaggaggagctggaggagggcaggggctgagggagtgagtgaagcggacgcgcgagggaggggagggaagggaagggaagggaagggggggtcacgcgggggcgcgcgcgcgcaccgggagcgcgctcggaggcgagtggaactggatcgggtttgctgccagcggcgtgagcttcggccgccattttacaacagctccactcgcgccggacacagggagcagcgagcacgcgtttcccgcaacccgataccatcggacaggatttctccgcctcagcccaacggggagatctctggaaacatggctacagaacatgttaatggaaatggtactgaagagcccatggatactacttctgcagttatccattcagaaaattttcagacattgcttgatgctggtttaccacagaaagttgctgaaaaactagatgaaatttacgttgcagggctagttgcacatagtgatttagatgaaagagctattgaagctttaaaagaattcaatgaagacggtgcattggcagttcttcaacagtttaaagacagtgatctctctcatgttcagaacaaaagtgcctttttatgtggagtcatgaagacttacaggcagagagaaaaacaagggaccaaagtagcagattctagtaaaggaccagatgaggcaaaaattaaggcactcttggaaagaacaggctacacacttgatgtgaccactggacagaggaagtatggaggaccacctccagattccgtttattcaggtcagcagccttctgttggcactgagatatttgtgggaaagatcccaagagatctatttgaggatgaacttgttccattatttgagaaagctggacctatatgggatcttcgtctaatgatggatccactcactggtctcaatagaggttatgcgtttgtcactttttgtacaaaagaagcagctcaggaggctgttaaactgtataataatcatgaaattcgttctggaaaacatattggtgtctgcatctcagttgccaacaataggctttttgtgggctctattcctaagagtaaaaccaaggaacagattcttgaagaatttagcaaagtaacagagggtcttacagacgtcattttataccaccaaccggatgacaagaaaaaaaacagaggcttttgctttcttgaatatgaagatcacaaaacagctgcccaggcaaggcgtaggttaatgagtggtaaagtcaaggtctgggggaatgttggaactgttgaatgggctgatcctatagaagatcctgatcctgaggttatggcaaaggtaaaagtgctgtttgtacgcaaccttgccaatactgtaacagaagagattttagaaaaggcatttagtcagtttgggaaactggaacgagtgaagaagttaaaagattatgcgttcattcattttgatgagcgagatggtgctgtcaaggctatggaagaaatgaatggcaaagacttggagggagaaaatattgaaattgtttttgccaagccaccagatcagaaaaggaaagaaagaaaagctcagaggcaagcagcaaaaaatcaaatgtatgacgattactactattatggtccacctcatatgccccctccaacaagaggtcgagggcgtggaggtagaggtggttatggatatcctccagattattatggatatgaagattattatgattattatggttatgattaccataactatcgtggtggatatgaagatccatactatggttatgaagattttcaagttggagctagaggaaggggtggtagaggagcaaggggtgctgctccatccagaggtcgtggggctgctcctccccgcggtagagccggttattcacagagaggaggtcctggatcagcaagaggcgttcgaggtgcgagaggaggtgcccaacaacaaagaggccgcggggtacgtggtgcgaggggtggccgcggtggaaatgtaggaggaaagcgcaaagctgatgggtacaaccagccagattccaagcggcgccagaccaataatcagaactggggctcccaacccattgctcagcaaccgctccaaggtggtgatcattctggtaactatggttacaaatctgaaaaccaggagttttatcaggatacttttgggcaacagtggaagtagaaacagtagggcctctgtaaaattggagactgataggttgatcagaaactcaccctaaatctgaacgggtgccgctataatttgtgacatctggcaagatttccctttatgtatatattttaacaatccgcttggacacgaacaaagccacacttctaactgcttctggcgaactgattttatttttaatttttttcaataaagatattcttagatactgaaagaaatagttaatgagtttgcatttgtgcttgagaaaatttggctcaagtccatttggctgtagtgtcaacgatgtttccagtagtgtttagatttggtgtcttcaaaggtagttgattaaaaccaagtgtgtctttaatatcttgtatcagaataactttgtatgttaccaacttaaattgctagaataaggtaaattgatacacaactgctatttttaatttagaactttgacctaatttgggttttcaaaaccattttggctacttgtattctttatgctgttgtttatttcaataaaaaattcacacctaaaaaaaaaaaaaaaaaaaaaaaaaaaaaaaaaaaaaaaaaaaaaaaaaaaaaaaaaaaaaaaaaaaaaaaaaaaaaaaaaaaaaacaaaaaaacgaacgaagacaaaaaaaaaaaaaaaaaaagaagaaaacaaagcgaagaaaacaaaaagcgagaaaatagaaacagagggggacgtgcagagataagatactgaggaggcagagagaaagagcagaaaagattagtaaggaagcaaggcacgcagaacggaaggggggagaagcaaaagaagagaggagcaaggagcaaaaaaaagagaagaggaagggaaaaaaaagaacagacagagagaagtagggacaagaaaacgaaggtgagggagaaagtggaaaacaaacacgagaggaacgcgcggagggataataaaggaggagagaagcgcccgaaaggggcg

SEQ ID NO: 365631 - DNA, 6718 bp, Homo sapiens
agagaggagccgactcggcagggactgggggaccgggccgagagtgcgagcgagcgagggagggagtgagggagcgtgcgagccagaaggggaaaggcggccactcgtgcctgagcgaccgcagaggggagtgggagcagtggggtaaaggagcggggggcgggaataagaaaggccgagagaaggcggacagaggctagtggtggtggtggtggtagggggagaaggaggagctggaggagggcaggggctgagggagtgagtgaagcggacgcgcgagggaggggagggaagggaagggaagggaagggggggtcacgcgggggcgcgcgcgcgcaccgggagcgcgctcggaggcgagtggaactggatcgggtttgctgccagcggcgtgagcttcggccgccattttacaacagctccactcgcgccggacacagggagcagcgagcacgcgtttcccgcaacccgataccatcggacaggatttctccgcctcagcccaacggggagatctctggaaacatggctacagaacatgttaatggaaatggtactgaagagcccatggatactacttctgcagttatccattcagaaaattttcagacattgcttgatgctggtttaccacagaaagttgctgaaaaactagatgaaatttacgttgcagggctagttgcacatagtgatttagatgaaagagctattgaagctttaaaagaattcaatgaagacggtgcattggcagttcttcaacagtttaaagacagtgatctctctcatgttcagaacaaaagtgcctttttatgtggagtcatgaagacttacaggcagagagaaaaacaagggaccaaagtagcagattctagtaaaggaccagatgaggcaaaaattaaggcactcttggaaagaacaggctacacacttgatgtgaccactggacagaggaagtatggaggaccacctccagattccgtttattcaggtcagcagccttctgttggcactgagatatttgtgggaaagatcccaagagatctatttgaggatgaacttgttccattatttgagaaagctggacctatatgggatcttcgtctaatgatggatccactcactggtctcaatagaggttatgcgtttgtcactttttgtacaaaagaagcagctcaggaggctgttaaactgtataataatcatgaaattcgttctggaaaacatattggtgtctgcatctcagttgccaacaataggctttttgtgggctctattcctaagagtaaaaccaaggaacagattcttgaagaatttagcaaagtaacagagggtcttacagacgtcattttataccaccaaccggatgacaagaaaaaaaacagaggcttttgctttcttgaatatgaagatcacaaaacagctgcccaggcaaggcgtaggttaatgagtggtaaagtcaaggtctgggggaatgttggaactgttgaatgggctgatcctatagaagatcctgatcctgaggttatggcaaaggtaaaagtgctgtttgtacgcaaccttgccaatactgtaacagaagagattttagaaaaggcatttagtcagtttgggaaacatggaatcaaatacgggacattgaactaatacttggactttgatatgaatttctttaacaattttctctgcagtgcaagttattaaactaaagctactctattttcaaaatgtgttccaacagaaatccttcataactcctagcatggtatcttaataaagaataaagttcttttatggtattttgaaatattctcttgaatttgtgcatttaaattttattgcagtggtatagatgaatgccactgatggtatccttaaattttatttctgctcaccaaggttaatcatgattgtctatatcttttttatagtgatcacttttgaattgtgttcagatatgcagtttcaggtgtaatcatcagagctggttagtcaggcattccagatagtggttcttttcagaacctttttaaaagggttggttaactacctcagtagcagaggattgaactataccctgtctgtactgtacatagaaaatctttgtagataaaagcaaggcttgttaaatatgatatgagggtaagattttaatataccaaatgtaacattcttagttgcctttagtttcagaggcttgtaagacttcctcatgaccatcataacaggccttgcttttgtcgtattttgtggctgaaaaagcagccttgcttcttcagatattgtagttatttggatgtataatagtttagcaagatgttacttttgtaagacatcagatgttcaaaaaagtgcatccgaacttgtactaaatactgcagtgtccctttataaaaagtcagactaaaactgacaattgtacagcgaacctgacatttggatattttgaagttttttcataaatcatagaaattagtatatggctgtagtttagctttttaggtaaaaggtatgtttcattagtgcatttcttcctgctgatcactgtaaacatgtgaatcagctttccatttcttatgcaggtcatgataacttgtagagtagagtacaatcatttgtgctatgtttttaattttctaaagcaccttgatgacagtgagtgtccagtggtgaagcatcctctattgaaccaccctcaaaaatttttttgccaagtcctaagttgatagcttaaagtaaaaagtgaaaattatagtttcattaggacttggtgtaaagaaatcccctccccccttccccaaagggatactgcagttatatcacatacccaataggcaccacgatgaagatcagagcttatacttaattaaggttttatacacaccagttccccagtaaatgcaaatttaacaagaaaatcagacatgtcatatgttcaaaatgctcatggcaaacaatcattttgcattcctgcaaataaaattgttttatactgtaagctggaggcgagtgtaacttatttttgtaataaagtttttattttttttatgtgtcattaatataaatgtgtgttagtgtagaaatcttctggtttaaaaacttagaattgcacacatttcagtatgtttatttgtacttacataattttagaatagtggttgccaatagcctgtatgtttcacattaattggttttttgttatctaaataaatcattttagtatgttgtatgtcagttactgggatagctgggacatagagtgtaatttaaaatttgtcaataagtattcattggaatatatgtaaatgtgccttgccggttattgaaacttatctacaaaatgagtatggggtgacaaaaattagttcctggtgcttaatgaaactttctgccactgattttatatattaccccgtgcttttttaaagtacatctctctcaaaacttagtgtaagtttgagggctacacaaaacatttacatttcattctaacataatgaatataataggttgtggaaagtgggtaaactaaatgtagccttcagtaaaattgaatctcagtgtaatccttggtgctggcatttctcagttccgaggagttaaatgatcccatctaagaggtcattgccatgcctattggcactttactgtcatagcatttttaagggacactgtcaaggtgtttaagttctcagaattacttgttgggattttaggacaggtttgtttacttaaagtaagaactgcattgtcaaagttgaaagaggaacacttttgtgagttcacaaatgtgttcttaagaaaacattaaaatatggagctctgggttttcaagactatttggcattcttaatttggggacttgggagggaaactgataaaaagaaattgaagaattgatggttatacttaaagaagggtaatgtaaacagtggtgatgaaatatatacacatcaagtgaaattacttgacagtgttcatttgaatgactttgaattcaagccattataattacttttaaaattaaatatcatttgcactgttctgataatgggtgcagtttttgagcaatataatcagagctaaatatgcatgtagtgattagtgatgtgaacaattaacgttctgagaagaaatactaactgtggtattttcaaacttaaatttctgtagtaaaatcagtatcaaagtcttatcagatcaaggaaaaacaggcaatgcatataaacatacttttgaatgttgtgtggcctataaagcaataatgcaatttatatggaatgtcatgggatatgagaaatggaaatgcaaaaataactaatcctttagtaaaaatgtcaacatgttaaagggggaatgttaactaatgtaggttattgctatttgtgatttgtttatgggttcttggctttgacagcttcaaagaatggacagtgataagttaaaagaaattttgtatattgtcaaggaaagggtcttaaatccgagtcaagtcccttccttggggtaaaaaatgtattcttaaagcattctgatgttaaaaagaaaacttaagttatctaaccaaaacagacgcaagattttgtttctgcagactacttggcaatcaaaagtgatcataaatttaggttatcagttttcagaaagttgctttgtgagaaaattttgttagatatattctcccaagcatgctttttgtggaaggttttcagccattgccactgaatcagatgttaaaaatgaagggaaaattgagtgtgcacacacacaactgttgtacactcatgattgcagtttttagcttaagaaacttttctaccagttactgtgaatctgacttaaaatgtaaagtttcctcatgataaaataggaacaacatagaaatggattgatggggtgatctgagttattgtatataaaagtttttaaagaatagaatgaacatcaagctagataggcaaaaattgacacattcagaacagcttttttgactgcgaagccaaaagttgtcagaaacagcaaaagatcccttattattacagagtattttacgtagtctctattttaaggagagaaattaaatagaagggcttcatgcatttaggggagggtgctaaaacttctcaagttcgtcaaacttacaggaatacccaccatgatcattttctctctaattatgtataccacaaaattttcatctggccataggaattcactggtgggtgtaaaattaatgactaaagaaattaagtgacaaatacataaaagaaacagacttgtggggatattgttttaaggtgtattaattactcagtgatgataccactcaatagggcatgccactacttttcttaagatgctaattatgaagcagtgctcacaggcattttttaactagcaaattagtagatggacttttggggtctgtcactttttaaaagtatttaagacttaaattctattagcaccacagtctgccttcagtaatacacctaaaatatttttcaggaccagaagcattcagtttgaaaatttgcagatgcaaaccagtattattactaacgctctgggtcaaagattaggtttttaatattaacagtagtctggtaaatatttagaagtctggcattgagaaacaaaagcttgtacctgactagtatttttatttaaaaaaattagttctgttagcttatttaaattgtgttttatttatccgtagaatttatatttatttcattcctttcatctcactgaaaactgtctgcaggccctttgatttggattagatgtgtgaagtactgtcttttgccaaaaacctcaaattacctgttcttttcaacgtagtgggtttgtgcttgtttggagatcagttcaaaaactatctgtactatctgtactgcctctgatgttaagattttatgtatagcataaggaagctagctctgactatattttcctaagaataaagacctatttttgtagcatgtcttaggatctccaggagtccaagaattattgtgggtgtcctccaattcatcactcttcacttaacagcttttaagtagacacttggaatctttagaggtctgtcgccctttgattatccatacattcgaagtaactagccaatggtgaaaaattcctcaagatatcctcagttgcaatcacattactggaagatgaatagaataaatgtattaggctggtcttaatttttgatggaaatattctgttgtcccgtacttgccattggatttgataaagttagtggtaatttggaaagaatcggggacttgccaatatatttgtgggttttagcttatacccctaggatttcttggttgcgggacgagcagttttggccacttccatcaggacaagactttttaggtcacttagtgcaggttttagtttctattttggattaacaacatttatattgattatcgaaaagaagctttcatcatttcagaacagtcctggaagtttgactttgagtgtgggagaagtcctaataaaccattttggaaattagtgtctccaagtgttacagcttcctaaaatgggtttctaacacagtgggatcaaaataaggttattttaggataatatactgtaaacttaattgactgtctgattttctactttgtctataaagtggcttacaacaggttctaatctagaaaggagttataaaggttatctgtaatgtttatgaatt

SEQ ID NO: 365632 - DNA, 2949 bp, Homo sapiens
agagaggagccgactcggcagggactgggggaccgggccgagagtgcgagcgagcgagggagggagtgagggagcgtgcgagccagaaggggaaaggcggccactcgtgcctgagcgaccgcagaggggagtgggagcagtggggtaaaggagcggggggcgggaataagaaaggccgagagaaggcggacagaggctagtggtggtggtggtggtagggggagaaggaggagctggaggagggcaggggctgagggagtgagtgaagcggacgcgcgagggaggggagggaagggaagggaagggaagggggggtcacgcgggggcgcgcgcgcgcaccgggagcgcgctcggaggcgagtggaactggatcgggtttgctgccagcggcgtgagcttcggccgccattttacaacagctccactcgcgccggacacagggagcagcgagcacgcgtttcccgcaacccgataccatcggacaggatttctccgcctcagcccaacggggagatctctggaaacatggctacagaacatgttaatggaaatggtactgaagagcccatggatactacttctgcagttatccattcagaaaattttcagacattgcttgatgctggtttaccacagaaagttgctgaaaaactagatgaaatttacgttgcagggctagttgcacatagtgatttagatgaaagagctattgaagctttaaaagaattcaatgaagacggtgcattggcagttcttcaacagtttaaagacagtgatctctctcatgttcagaacaaaagtgcctttttatgtggagtcatgaagacttacaggcagagagaaaaacaagggaccaaagtagcagattctagtaaaggaccagatgaggcaaaaattaaggcactcttggaaagaacaggctacacacttgatgtgaccactggacagaggaagtatggaggaccacctccagattccgtttattcaggtcagcagccttctgttggcactgagatatttgtgggaaagatcccaagagatctatttgaggatgaacttgttccattatttgagaaagctggacctatatgggatcttcgtctaatgatggatccactcactggtctcaatagaggttatgcgtttgtcactttttgtacaaaagaagcagctcaggaggctgttaaactgtataataatcatgaaattcgttctggaaaacatattggtgtctgcatctcagttgccaacaataggctttttgtgggctctattcctaagagtaaaaccaaggaacagattcttgaagaatttagcaaagtaacagagggtcttacagacgtcattttataccaccaaccggatgacaagaaaaaaaacagaggcttttgctttcttgaatatgaagatcacaaaacagctgcccaggtaaaagtgctgtttgtacgcaaccttgccaatactgtaacagaagagattttagaaaaggcatttagtcagtttgggaaactggaacgagtgaagaagttaaaagattatgcgttcattcattttgatgagcgagatggtgctgtcaaggctatggaagaaatgaatggcaaagacttggagggagaaaatattgaaattgtttttgccaagccaccagatcagaaaaggaaagaaagaaaagctcagaggcaagcagcaaaaaatcaaatgtatgacgattactactattatggtccacctcatatgccccctccaacaagaggtcgagggcgtggaggtagaggtggttatggatatcctccagattattatggatatgaagattattatgattattatggttatgattaccataactatcgtggtggatatgaagatccatactatggttatgaagattttcaagttggagctagaggaaggggtggtagaggagcaaggggtgctgctccatccagaggtcgtggggctgctcctccccgcggtagagccggttattcacagagaggaggtcctggatcagcaagaggcgttcgaggtgcgagaggaggtgcccaacaacaaagaggccgcggggtacgtggtgcgaggggtggccgcggtggaaatgtaggaggaaagcgcaaagctgatgggtacaaccagccagattccaagcggcgccagaccaataatcagaactggggctcccaacccattgctcagcaaccgctccaaggtggtgatcattctggtaactatggttacaaatctgaaaaccaggagttttatcaggatacttttgggcaacagtggaagtagaaacagtagggcctctgtaaaattggagactgataggttgatcagaaactcaccctaaatctgaacgggtgccgctataatttgtgacatctggcaagatttccctttatgtatatattttaacaatccgcttggacacgaacaaagccacacttctaactgcttctggcgaactgattttatttttaatttttttcaataaagatattcttagatactgaaagaaatagttaatgagtttgcatttgtgcttgagaaaatttggctcaagtccatttggctgtagtgtcaacgatgtttccagtagtgtttagatttggtgtcttcaaaggtagttgattaaaaccaagtgtgtctttaatatcttgtatcagaataactttgtatgttaccaacttaaattgctagaataaggtaaattgatacacaactgctatttttaatttagaactttgacctaatttgggttttcaaaaccattttggctacttgtattctttatgctgttgtttatttcaataaaaaattcacacctaaatgtatacttactaaaattgtgtttacaattcgtttttcacaaaatttcctgcaaatttggttcaaattgtatagcatgtcaaggccaattaaagggttttgtgccttgttaaaaaaagt

SEQ ID NO: 365633 - DNA, 2069 bp, Homo sapiens
agagaggagccgactcggcagggactgggggaccgggccgagagtgcgagcgagcgagggagggagtgagggagcgtgcgagccagaaggggaaaggcggccactcgtgcctgagcgaccgcagaggggagtgggagcagtggggtaaaggagcggggggcgggaataagaaaggccgagagaaggcggacagaggctagtggtggtggtggtggtagggggagaaggaggagctggaggagggcaggggctgagggagtgagtgaagcggacgcgcgagggaggggagggaagggaagggaagggaagggggggtcacgcgggggcgcgcgcgcgcaccgggagcgcgctcggaggcgagtggaactggatcgggtttgctgccagcggcgtgagcttcggccgccattttacaacagctccactcgcgccggacacagggagcagcgagcacgcgtttcccgcaacccgataccatcggacaggatttctccgcctcagcccaacggggagatctctggaaacatggctacagaacatgttaatggaaatggtactgaagagcccatggatactacttctgcagttatccattcagaaaattttcagacattgcttgatgctggtttaccacagaaagttgctgaaaaactagatgaaatttacgttgcagggctagttgcacatagtgatttagatgaaagagctattgaagctttaaaagaattcaatgaagacggtgcattggcagttcttcaacagtttaaagacagtgatctctctcatgttcagaacaaaagtgcctttttatgtggagtcatgaagacttacaggcagagagaaaaacaagggaccaaagtagcagattctagtaaaggaccagatgaggcaaaaattaaggcactcttggaaagaacaggctacacacttgatgtgaccactggacagaggaagtatggaggaccacctccagattccgtttattcaggtcagcagccttctgttggcactgagatatttgtgggaaagatcccaagagatctatttgaggatgaacttgttccattatttgagaaagctggacctatatgggatcttcgtctaatgatggatccactcactggtctcaatagaggttatgcgtttgtcactttttgtacaaaagaagcagctcaggaggctgttaaactgtataataatcatgaaattcgttctggaaaacatattggtgtctgcatctcagttgccaacaataggctttttgtgggctctattcctaagagtaaaaccaaggaacagattcttgaagaatttagcaaagtaacagagggtcttacagacgtcattttataccaccaaccggatgacaagaaaaaaaacagaggcttttgctttcttgaatatgaagatcacaaaacagctgcccaggcaaggcgtaggttaatgagtggtaaagtcaaggtctgggggaatgttggaactgttgaatgggctgatcctatagaagatcctgatcctgaggttatggcaaaggtaaaagtgctgtttgtacgcaaccttgccaatactgtaacagaagagattttagaaaaggcatttagtcagtttgggaaactggaacgagtgaagaagttaaaagattatgcgttcattcattttgatgagcgagatggtgctgtcaaggctatggaagaaatgaatggcaaagacttggagggagaaaatattgaaattgtttttgccaagccaccagatcagaaaaggaaagaaagaaaagctcagaggcaagcagcaaaaaatcaaatgtatgacgattactactattatggtccacctcatatgccccctccaacaagaggtcgagggcgtggaggtagaggtggttatggatatcctccagattattatggatatgaagattattatgattattatggttatgattaccataactatcgtggtggatatgaagatccatactatggttatgaagattttcaaaatgtgttccaacagaaatccttcataactcctagcatggtatcttaataaagaataaagttctttta

SEQ ID NO: 365634 - DNA, 1020 bp, Homo sapiens
agagaggagccgactcggcagggactgggggaccgggccgagagtgcgagcgagcgagggagggagtgagggagcgtgcgagccagaaggggaaaggcggccactcgtgcctgagcgaccgcagaggggagtgggagcagtggggtaaaggagcggggggcgggaataagaaaggccgagagaaggcggacagaggctagtggtggtggtggtggtagggggagaaggaggagctggaggagggcaggggctgagggagtgagtgaagcggacgcgcgagggaggggagggaagggaagggaagggaagggggggtcacgcgggggcgcgcgcgcgcaccgggagcgcgctcggaggcgagtggaactggatcgggtttgctgccagcggcgtgagcttcggccgccattttacaacagctccactcgcgccggacacagggagcagcgagcacgcgtttcccgcaacccgataccatcggacaggatttctccgcctcagcccaacggggagatctctggaaacatggctacagaacatgttaatggaaatggtactgaagagcccatggatactacttctgcagttatccattcagaaaattttcagacattgcttgatgctggtttaccacagaaagttgctgaaaaactagatgaaatttacgttgcagggctagttgcacatagtgatttagatgaaagagctattgaagctttaaaagaattcaatgaagacggtgcattggcagttcttcaacagtttaaagacagtgatctctctcatgttcagaacaaaagtgcctttttatgtggagtcatgaagacttacaggcagagagaaaaacaagggaccaaagtagcagattctagtaaaggaccagatgaggcaaaaattaaggtatgtctttctatactccctttagttttaaagtcattttaactgtttcctaattttggtaaatattccttgggtatgaaatggatgtatgttagatgttgagataattcatcaatcttt

SEQ ID NO: 365635 - DNA, 408 bp, Homo sapiens
taagtcatgctcggtccggcatgtgctgtaggccagcggcatgggcggctgccctgggctcgcctcttccagcccagcatccagctggcccgccagggcttccccgtgggcaagggcttggcggcagccctggaaaacaagcggaccgtcatcgagcagcagcctgtcttgtgtgaggtgttctgccgggatagaaaggtgcttcgggagggggagagactgaccctgccgcagctggctgacacctacgagacgctggcctacagcacatgccggccagcggtttaacaaatgacagtagggaacacagaaatcaaatattaagaatggatgatcaaaatcaccaatgcacatgtagtaatcaaatgtttggggctagatattatggttatacaaaaaacattaaaa

SEQ ID NO: 365636 - DNA, 2883 bp, Homo sapiens
gtgctgctggatgaccagaccgggcgtcgggtgagcccagaagtgagagcagttggctgtgccccagtgctgtgtgacccagaggcgccgctcaccctctctgagctggtggacatcatagcgggtgcagcccaaaactgtcttctgaggaagaggtgctctcctgggcccccactgtccccaggcctcagatgctgcatattgctggcccagctcctgaggctctttggacctccaggaatcggtgtctctatcaggaacccttaaccctgacccggactcccagctgggacccggggtgtcggagtggcaagagcgctgtcaggcctggtgaagggtgtgagctgtccaacggggcagggaggaggcagggcctgttctgcagttggacagacagagccctctagctgctttctggaagactgaagggcagcaaggcaagtgaggtgctgccgtcatccaggctggacagttcagtgatttgcctgaggccccacagcaggagaacgagaaggctgcctgatcagagagtccctgaagaagattctgtggctacaggcttcagcagagtgtgagggagaccccggttatttcctcagctatttccaccaaatcctcctgtctttcgtggccaacaccccaggcaaggcttggggcccccgtctgctgctggacgcagagccatgaagaagaagttagtggtgctgggcctgctggccgtggtcctggtgctggtcattgtcggcctctgtctctggctgccctcagcctccaaggaacctgacaaccatgtgtacaccagggctgccgtggccgcggatgccaagcagtgctcgaagattgggagggatgcactgcgggacggtggctctgcggtggatgcagccattgcagccctgttgtgtgtggggctcatgaatgcccacagcatgggcatcgggggtggcctcttcctcaccatctacaacagcaccacacgaaaagctgaggtcatcaacgcccgcgaggtggcccccaggctggcctttgccaccatgttcaacagctcggagcagtcccagaagggggggctgtcggtggcggtgcctggggagatccgaggctatgagctggcacaccagcggcatgggcggctgccctgggctcgcctcttccagcccagcatccagctggcccgccagggcttccccgtgggcaagggcttggcggcagccctggaaaacaagcggaccgtcatcgagcagcagcctgtcttgtgtgaggtgttctgccgggatagaaaggtgcttcgggagggggagagactgaccctgccgcagctggctgacacctacgagacgctggccatcgagggtgcccaggccttctacaacggcagcctcacggcccagattgtgaaggacatccaggcggccgggggcattgtgacagctgaggacctgaacaactaccgtgctgagctgatcgagcacccgctgaacatcagcctgggagacgcggtgctgtacatgcccagtgcgccgctcagcgggcccgtgctggccctcatcctcaacatcctcaaagggtacaacttctcccgggagagcgtggagagccccgagcagaagggcctgacgtaccaccgcatcgtagaggctttccggtttgcctacgccaagaggaccctgcttggggaccccaagtttgtggatgtgactgaggtggtccgcaacatgacctccgagttcttcgctgcccagctccgggcccagatctctgacgacaccactcacccgatctcctactacaagcccgagttctacacgccggatgacgggggcactgctcacctgtctgtcgtcgcagaggacggcagtgctgtgtccgccaccagcaccatcaacctctactttggctccaaggtccgctccccggtcagcgggatcctgttcaataatgaaatggacgacttcagctctcccagcatcaccaacgagtttggggtacccccctcacctgccaatttcatccagccagggaagcagccgctctcgtccatgtgcccgacgatcatggtgggccaggacggccaggtccggatggtggtgggagctgctgggggcacacagatcaccacggccactgcactggccatcatctacaacctctggttcggctatgacgtgaagcgggccgtggaggagccccggctgcacaaccagcttctgcccaacgtcacgacagtggagagaaacattgaccaggcagtgactgcagccctggagacccggcaccatcacacccagatcgcgtccaccttcatcgctgtggtgcaagccatcgtccgcacggctggtggctgggcagctgcctcggactccaggaaaggcggggagcctgccggctactgagtgctccaggaggacaaggctgacaagcaatccagggacaagatactcaccaggaccaggaaggggactctgggggaccggcttcccctgtgagcagcagagcagcacaataaatgaggccactgtgccaggctccaggtggcctccctggcctgtctccccaaaaaaaaaaaaaaaaaaaaaaaaaaaaaacaaaaaaaaaaacaaacaaacaaaaaaagacaaacaagaaaaaaaaaaaaaaaaaaaagaaaaagcagagaaggaacacagcgcacgcaagccagaaagagcagaaagagaagaaaaaaggaggagcgagaaagacagagagagacgagagcaagagacaaagtacacgaagaggaaagaggaaaaggaaaccagaggaggacaaagagaagggggacgcagaacaacagagacgcaaagacacaagaaaaacagagaaaaaaaaacgagacggaaggaagaaaagaaaagaaaggaa

SEQ ID NO: 365637 - DNA, 2678 bp, Homo sapiens
cactgtccgccggggctgctgggcacgccctggctggtctcttggactagcgggtgcagcccaaaactgtcttctgaggaagaggtgctctcctgggcccccactgtccccaggcctcagcaaggcaagtgaggtgctgccgtcatccaggctggacagttcagtgatttgcctgaggccccacagcagagttcaactggagacagagaaaccagctagaggcagagggaggtaacacggagtcccccagaaaggtctgggctgcgcgtgcttcaggtaacctcccttgaccttcaggagaacgagaaggctgcctgatcagagagtccctgaagaagattctgtggctacaggcttcagcagagtgtgagggagaccccggttatttcctcagctatttccaccaaatcctcctgtctttcgtggccaacaccccaggcaaggcttggggcccccgtctgctgctggacgcagagccatgaagaagaagttagtggtgctgggcctgctggccgtggtcctggtgctggtcattgtcggcctctgtctctggctgccctcagcctccaaggaacctgacaaccatgtgtacaccagggctgccgtggccgcggatgccaagcagtgctcgaagattgggagggatgcactgcgggacggtggctctgcggtggatgcagccattgcagccctgttgtgtgtggggctcatgaatgcccacagcatgggcatcgggggtggcctcttcctcaccatctacaacagcaccacacgaaaagctgaggtcatcaacgcccgcgaggtggcccccaggctggcctttgccaccatgttcaacagctcggagcagtcccagaagggggggctgtcggtggcggtgcctggggagatccgaggctatgagctggcacaccagcggcatgggcggctgccctgggctcgcctcttccagcccagcatccagctggcccgccagggcttccccgtgggcaagggcttggcggcagccctggaaaacaagcggaccgtcatcgagcagcagcctgtcttgtgtgaggtgttctgccgggatagaaaggtgcttcgggagggggagagactgaccctgccgcagctggctgacacctacgagacgctggccatcgagggtgcccaggccttctacaacggcagcctcacggcccagattgtgaaggacatccaggcggccgggggcattgtgacagctgaggacctgaacaactaccgtgctgagctgatcgagcacccgctgaacatcagcctgggagacgcggtgctgtacatgcccagtgcgccgctcagcgggcccgtgctggccctcatcctcaacatcctcaaagggtacaacttctcccgggagagcgtggagagccccgagcagaagggcctgacgtaccaccgcatcgtagaggctttccggtttgcctacgccaagaggaccctgcttggggaccccaagtttgtggatgtgactgaggtggtccgcaacatgacctccgagttcttcgctgcccagctccgggcccagatctctgacgacaccactcacccgatctcctactacaagcccgagttctacacgccggatgacgggggcactgctcacctgtctgtcgtcgcagaggacggcagtgctgtgtccgccaccagcaccatcaacctctactttggctccaaggtccgctccccggtcagcgggatcctgttcaataatgaaatggacgacttcagctctcccagcatcaccaacgagtttggggtacccccctcacctgccaatttcatccagccagggaagcagccgctctcgtccatgtgcccgacgatcatggtgggccaggacggccaggtccggatggtggtgggagctgctgggggcacacagatcaccacggccactgcactggccatcatctacaacctctggttcggctatgacgtgaagcgggccgtggaggagccccggctgcacaaccagcttctgcccaacgtcacgacagtggagagaaacattgaccaggcagtgactgcagccctggagacccggcaccatcacacccagatcgcgtccaccttcatcgctgtggtgcaagccatcgtccgcacggctggtggctgggcagctgcctcggactccaggaaaggcggggagcctgccggctactgagtgctccaggaggacaaggctgacaagcaatccagggacaagatactcaccaggaccaggaaggggactctgggggaccggcttcccctgtgagcagcagagcagcacaataaatgaggccactgtgccaggctccaggtggcctccctggcctgtctccccaaaaaaaaaaaaaaaaaaaaaaaaaaaaaacaaaaaaaaaaacaaacaaacaaaaaaagacaaacaagaaaaaaaaaaaaaaaaaaaagaaaaagcagagaaggaacacagcgcacgcaagccagaaagagcagaaagagaagaaaaaaggaggagcgagaaagacagagagagacgagagcaagagacaaagtacacgaagaggaaagaggaaaaggaaaccagaggaggacaaagagaagggggacgcagaacaacagagacgcaaagacacaagaaaaacagagaaaaaaaaacgagacggaaggaagaaaagaaaagaaaggaa

SEQ ID NO: 365638 - DNA, 2641 bp, Homo sapiens
gtgctgctggatgaccagaccgggcgtcgggtgagcccagaagtgagagcagttggctgtgccccagtgctgtgtgacccagaggcgccgctcaccctctctgagctggtggacatcatagcgggtgcagcccaaaactgtcttctgaggaagaggtgctctcctgggcccccactgtccccaggcctcagcaaggcaagtgaggtgctgccgtcatccaggctggacagttcagtgatttgcctgaggccccacagcaggagaacgagaaggctgcctgatcagagagtccctgaagaagattctgtggctacaggcttcagcagagtgtgagggagaccccggttatttcctcagctatttccaccaaatcctcctgtctttcgtggccaacaccccaggcaaggcttggggcccccgtctgctgctggacgcagagccatgaagaagaagttagtggtgctgggcctgctggccgtggtcctggtgctggtcattgtcggcctctgtctctggctgccctcagcctccaaggaacctgacaaccatgtgtacaccagggctgccgtggccgcggatgccaagcagtgctcgaagattgggagggatgcactgcgggacggtggctctgcggtggatgcagccattgcagccctgttgtgtgtggggctcatgaatgcccacagcatgggcatcgggggtggcctcttcctcaccatctacaacagcaccacacgaaaagctgaggtcatcaacgcccgcgaggtggcccccaggctggcctttgccaccatgttcaacagctcggagcagtcccagaagggggggctgtcggtggcggtgcctggggagatccgaggctatgagctggcacaccagcggcatgggcggctgccctgggctcgcctcttccagcccagcatccagctggcccgccagggcttccccgtgggcaagggcttggcggcagccctggaaaacaagcggaccgtcatcgagcagcagcctgtcttgtgtgaggtgttctgccgggatagaaaggtgcttcgggagggggagagactgaccctgccgcagctggctgacacctacgagacgctggccatcgagggtgcccaggccttctacaacggcagcctcacggcccagattgtgaaggacatccaggcggccgggggcattgtgacagctgaggacctgaacaactaccgtgctgagctgatcgagcacccgctgaacatcagcctgggagacgcggtgctgtacatgcccagtgcgccgctcagcgggcccgtgctggccctcatcctcaacatcctcaaagggtacaacttctcccgggagagcgtggagagccccgagcagaagggcctgacgtaccaccgcatcgtagaggctttccggtttgcctacgccaagaggaccctgcttggggaccccaagtttgtggatgtgactgaggtggtccgcaacatgacctccgagttcttcgctgcccagctccgggcccagatctctgacgacaccactcacccgatctcctactacaagcccgagttctacacgccggatgacgggggcactgctcacctgtctgtcgtcgcagaggacggcagtgctgtgtccgccaccagcaccatcaacctctactttggctccaaggtccgctccccggtcagcgggatcctgttcaataatgaaatggacgacttcagctctcccagcatcaccaacgagtttggggtacccccctcacctgccaatttcatccagccagggaagcagccgctctcgtccatgtgcccgacgatcatggtgggccaggacggccaggtccggatggtggtgggagctgctgggggcacacagatcaccacggccactgcactggccatcatctacaacctctggttcggctatgacgtgaagcgggccgtggaggagccccggctgcacaaccagcttctgcccaacgtcacgacagtggagagaaacattgaccaggcagtgactgcagccctggagacccggcaccatcacacccagatcgcgtccaccttcatcgctgtggtgcaagccatcgtccgcacggctggtggctgggcagctgcctcggactccaggaaaggcggggagcctgccggctactgagtgctccaggaggacaaggctgacaagcaatccagggacaagatactcaccaggaccaggaaggggactctgggggaccggcttcccctgtgagcagcagagcagcacaataaatgaggccactgtgccaggctccaggtggcctccctggcctgtctccccaaaaaaaaaaaaaaaaaaaaaaaaaaaaaacaaaaaaaaaaacaaacaaacaaaaaaagacaaacaagaaaaaaaaaaaaaaaaaaaagaaaaagcagagaaggaacacagcgcacgcaagccagaaagagcagaaagagaagaaaaaaggaggagcgagaaagacagagagagacgagagcaagagacaaagtacacgaagaggaaagaggaaaaggaaaccagaggaggacaaagagaagggggacgcagaacaacagagacgcaaagacacaagaaaaacagagaaaaaaaaacgagacggaaggaagaaaagaaaagaaaggaa

SEQ ID NO: 365639 - DNA, 2966 bp, Homo sapiens
cggcccaccaagcctggggaggtggccacccttccatgatggcatttggatgttccctgtgtgtggggagggcacagggactccattcgtagaccacctctgggacagtgtgtctgcctctgaggtcagacgctctgcactgggacagggtggagtggagggaaatccagcttggggctcattggaggggcttgctggcagacaccgccctttgtgggaaactgactgtgggagaggggaaccccaacctctgtcaccacatccctcttccctgttgtcacacctgtcacctgctgccatagccatgagacttcccaagggtcactgctgccactcactgcacagcctggaagggagtccacaggggacatacagtgagcaagagacctgtgccactcaggcctcctgggggtgtccccagtgcagccatgatgataatcacagctaccattcaccaagccctgcccacagtctaacctactctattcacaacactcccagcagcaaggcaagtgaggtgctgccgtcatccaggctggacagttcagtgatttgcctgaggccccacagcagagttcaactggagacagagaaaccagctagaggcagagggaggtaacacggagtcccccagaaaggtctgggctgcgcgtgcttcagctatttccaccaaatcctcctgtctttcgtggccaacaccccaggcaaggcttggggcccccgtctgctgctggacgcagagccatgaagaagaagttagtggtgctgggcctgctggccgtggtcctggtgctggtcattgtcggcctctgtctctggctgccctcagcctccaaggaacctgacaaccatgtgtacaccagggctgccgtggccgcggatgccaagcagtgctcgaagattgggagggatgcactgcgggacggtggctctgcggtggatgcagccattgcagccctgttgtgtgtggggctcatgaatgcccacagcatgggcatcgggggtggcctcttcctcaccatctacaacagcaccacacgaaaagctgaggtcatcaacgcccgcgaggtggcccccaggctggcctttgccaccatgttcaacagctcggagcagtcccagaagggggggctgtcggtggcggtgcctggggagatccgaggctatgagctggcacaccagcggcatgggcggctgccctgggctcgcctcttccagcccagcatccagctggcccgccagggcttccccgtgggcaagggcttggcggcagccctggaaaacaagcggaccgtcatcgagcagcagcctgtcttgtgtgaggtgttctgccgggatagaaaggtgcttcgggagggggagagactgaccctgccgcagctggctgacacctacgagacgctggccatcgagggtgcccaggccttctacaacggcagcctcacggcccagattgtgaaggacatccaggcggccgggggcattgtgacagctgaggacctgaacaactaccgtgctgagctgatcgagcacccgctgaacatcagcctgggagacgcggtgctgtacatgcccagtgcgccgctcagcgggcccgtgctggccctcatcctcaacatcctcaaagggtacaacttctcccgggagagcgtggagagccccgagcagaagggcctgacgtaccaccgcatcgtagaggctttccggtttgcctacgccaagaggaccctgcttggggaccccaagtttgtggatgtgactgaggccagctctggggtctcggcaggtggtccgcaacatgacctccgagttcttcgctgcccagctccgggcccagatctctgacgacaccactcacccgatctcctactacaagcccgagttctacacgccggatgacgggggcactgctcacctgtctgtcgtcgcagaggacggcagtgctgtgtccgccaccagcaccatcaacctctactttggctccaaggtccgctccccggtcagcgggatcctgttcaataatgaaatggacgacttcagctctcccagcatcaccaacgagtttggggtacccccctcacctgccaatttcatccagccagggaagcagccgctctcgtccatgtgcccgacgatcatggtgggccaggacggccaggtccggatggtggtgggagctgctgggggcacacagatcaccacggccactgcactggccatcatctacaacctctggttcggctatgacgtgaagcgggccgtggaggagccccggctgcacaaccagcttctgcccaacgtcacgacagtggagagaaacattgaccaggcagtgactgcagccctggagacccggcaccatcacacccagatcgcgtccaccttcatcgctgtggtgcaagccatcgtccgcacggctggtggctgggcagctgcctcggactccaggaaaggcggggagcctgccggctactgagtgctccaggaggacaaggctgacaagcaatccagggacaagatactcaccaggaccaggaaggggactctgggggaccggcttcccctgtgagcagcagagcagcacaataaatgaggccactgtgccaggctccaggtggcctccctggcctgtctccccaaaaaaaaaaaaaaaaaaaaaaaaaaaaaacaaaaaaaaaaacaaacaaacaaaaaaagacaaacaagaaaaaaaaaaaaaaaaaaaagaaaaagcagagaaggaacacagcgcacgcaagccagaaagagcagaaagagaagaaaaaaggaggagcgagaaagacagagagagacgagagcaagagacaaagtacacgaagaggaaagaggaaaaggaaaccagaggaggacaaagagaagggggacgcagaacaacagagacgcaaagacacaagaaaaacagagaaaaaaaaacgagacggaaggaagaaaagaaaagaaaggaa

SEQ ID NO: 365640 - DNA, 2808 bp, Homo sapiens
gtgctgctggatgaccagaccgggcgtcgggtgagcccagaagtgagagcagttggctgtgccccagtgctgtgtgacccagaggcgccgctcaccctctctgagctggtggacatcataggtggggaagctcaggtcagggcactcccatgagtgtctggaggcctgagtcccattctcagctctgccatatgcttgctgcgctctagaggagttcctcttcctctccaagcctcggtttatgtacccgtgcagtgggagtgagttgcacttcggggtgaagggggcaagacttgtgtgggcgcatcctgcagaaggatcccacagcaaggcaagtgaggtgctgccgtcatccaggctggacagttcagtgatttgcctgaggccccacagcagagttcaactggagacagagaaaccagctagaggcagagggaggtaacacggagtcccccagaaaggtctgggctgcgcgtgcttcaggcttcagcagagtgtgagggagaccccggttatttcctcagctatttccaccaaatcctcctgtctttcgtggccaacaccccaggcaaggcttggggcccccgtctgctgctggacgcagagccatgaagaagaagttagtggtgctgggcctgctggccgtggtcctggtgctggtcattgtcggcctctgtctctggctgccctcagcctccaaggaacctgacaaccatgtgtacaccagggctgccgtggccgcggatgccaagcagtgctcgaagattgggagggatgcactgcgggacggtggctctgcggtggatgcagccattgcagccctgttgtgtgtggggctcatgaatgcccacagcatgggcatcgggggtggcctcttcctcaccatctacaacagcaccacacgaaaagctgaggtcatcaacgcccgcgaggtggcccccaggctggcctttgccaccatgttcaacagctcggagcagtcccagaagggggggctgtcggtggcggtgcctggggagatccgaggctatgagctggcacaccagcggcatgggcggctgccctgggctcgcctcttccagcccagcatccagctggcccgccagggcttccccgtgggcaagggcttggcggcagccctggaaaacaagcggaccgtcatcgagcagcagcctgtcttgtgtgaggtgttctgccgggatagaaaggtgcttcgggagggggagagactgaccctgccgcagctggctgacacctacgagacgctggccatcgagggtgcccaggccttctacaacggcagcctcacggcccagattgtgaaggacatccaggcggccgggggcattgtgacagctgaggacctgaacaactaccgtgctgagctgatcgagcacccgctgaacatcagcctgggagacgcggtgctgtacatgcccagtgcgccgctcagcgggcccgtgctggccctcatcctcaacatcctcaaagggtacaacttctcccgggagagcgtggagagccccgagcagaagggcctgacgtaccaccgcatcgtagaggctttccggtttgcctacgccaagaggaccctgcttggggaccccaagtttgtggatgtgactgaggtggtccgcaacatgacctccgagttcttcgctgcccagctccgggcccagatctctgacgacaccactcacccgatctcctactacaagcccgagttctacacgccggatgacgggggcactgctcacctgtctgtcgtcgcagaggacggcagtgctgtgtccgccaccagcaccatcaacctctactttggctccaaggtccgctccccggtcagcgggatcctgttcaataatgaaatggacgacttcagctctcccagcatcaccaacgagtttggggtacccccctcacctgccaatttcatccagccagggaagcagccgctctcgtccatgtgcccgacgatcatggtgggccaggacggccaggtccggatggtggtgggagctgctgggggcacacagatcaccacggccactgcactggccatcatctacaacctctggttcggctatgacgtgaagcgggccgtggaggagccccggctgcacaaccagcttctgcccaacgtcacgacagtggagagaaacattgaccaggcagtgactgcagccctggagacccggcaccatcacacccagatcgcgtccaccttcatcgctgtggtgcaagccatcgtccgcacggctggtggctgggcagctgcctcggactccaggaaaggcggggagcctgccggctactgagtgctccaggaggacaaggctgacaagcaatccagggacaagatactcaccaggaccaggaaggggactctgggggaccggcttcccctgtgagcagcagagcagcacaataaatgaggccactgtgccaggctccaggtggcctccctggcctgtctccccaaaaaaaaaaaaaaaaaaaaaaaaaaaaaacaaaaaaaaaaacaaacaaacaaaaaaagacaaacaagaaaaaaaaaaaaaaaaaaaagaaaaagcagagaaggaacacagcgcacgcaagccagaaagagcagaaagagaagaaaaaaggaggagcgagaaagacagagagagacgagagcaagagacaaagtacacgaagaggaaagaggaaaaggaaaccagaggaggacaaagagaagggggacgcagaacaacagagacgcaaagacacaagaaaaacagagaaaaaaaaacgagacggaaggaagaaaagaaaagaaaggaa

SEQ ID NO: 365641 - DNA, 1251 bp, Homo sapiens
gtgctgctggatgaccagaccgggcgtcgggtgagcccagaagtgagagcagttggctgtgccccagtgctgtgtgacccagaggcgccgctcaccctctctgagctggtggacatcatagcgggtgcagcccaaaactgtcttctgaggaagaggtgctctcctgggcccccactgtccccaggcctcagcaaggcaagtgaggtgctgccgtcatccaggctggacagttcagtgatttgcctgaggccccacagcaggagaacgagaaggctgcctgatcagagagtccctgaagaagattctgtggctacaggcttcagcagagtgtgagggagaccccggttatttcctcagctatttccaccaaatcctcctgtctttcgtggccaacaccccaggcaaggcttggggcccccgtctgctgctggacgcagagccatgaagaagaagttagtggtgctgggcctgctggccgtggtcctggtgctggtcattgtcggcctctgtctctggctgccctcagcctccaaggaacctgacaaccatgtgtacaccagggctgccgtggccgcggatgccaagcagtgctcgaagattgggagggatgcactgcgggacggtggctctgcggtggatgcagccattgcagccctgttgtgtgtggggctcatgaatgcccacagcatgggcatcgggggtggcctcttcctcaccatctacaacagcaccacacgaaaagctgaggtcatcaacgcccgcgaggtggcccccaggctggcctttgccaccatgttcaacagctcggagcagtcccagaagggggggctgtcggtggcggtgcctggggagatccgaggctatgagctggcacaccagcggcatgggcggctgccctgggctcgcctcttccagcccagcatccagctggcccgccagggcttccccgtgggcaagggcttggcggcagccctggaaaacaagcggaccgtcatcgagcagcagcctgtcttgtgtgaggtgttctgccgggatagaaaggtgcttcgggagggggagagactgaccctgccgcagctggctgacacctacgagacgctggcctacagcacatgccggccagcggtttaacaaatgacagtagggaacacagaaatcaaatattaagaatggatgatcaaaatcaccaatgcacatgtagtaatcaaatgtttggggctagatattatggttatacaaaaaacattaaaa

SEQ ID NO: 365642 - DNA, 545 bp, Homo sapiens
gtcgacctcagtagccggcaggctccccgcctttcctggagtccgaggcagctgagtgctccaggaggacaaggctgacaagcaatccagggacaagatactcaccaggaccaggaaggggactctgggggaccggcttcccctgtgagcagcagagcagcacaataaatgaggccactgtgccaggctccaggtggcctccctggcctgtctccccaaaaaaaaaaaaaaaaaaaaaaaaaaaaaacaaaaaaaaaaacaaacaaacaaaaaaagacaaacaagaaaaaaaaaaaaaaaaaaaagaaaaagcagagaaggaacacagcgcacgcaagccagaaagagcagaaagagaagaaaaaaggaggagcgagaaagacagagagagacgagagcaagagacaaagtacacgaagaggaaagaggaaaaggaaaccagaggaggacaaagagaagggggacgcagaacaacagagacgcaaagacacaagaaaaacagagaaaaaaaaacgagacggaaggaagaaaagaaaagaaaggaa

SEQ ID NO: 365643 - DNA, 2776 bp, Homo sapiens
tctccgcttgatccgtttcaggctctggctccgctactgcatcgtgtgcttctgtccaagaggcagagagactgaaactatctgctgccgcctggattctcccagagattgcctggaacaccagctcgggtcctcgcacaccatcctgcgggtgcagcccaaaactgtcttctgaggaagaggtgctctcctgggcccccactgtccccaggcctcagcaaggcaagtgaggtgctgccgtcatccaggctggacagttcagtgatttgcctgaggccccacagcagagttcaactggagacagagaaaccagctagaggcagagggaggtaacacggagtcccccagaaaggtctgggctgcgcgtgcttcaggtaacctcccttgaccttcaggagaacgagaaggctgcctgatcagagagtccctgaagaagattctgtggctacaggcttcagcagagtgtgagggagaccccggttatttcctcagctatttccaccaaatcctcctgtctttcgtggccaacaccccaggcaaggcttggggcccccgtctgctgctggacgcagagccatgaagaagaagttagtggtgctgggcctgctggccgtggtcctggtgctggtcattgtcggcctctgtctctggctgccctcagcctccaaggaacctgacaaccatgtgtacaccagggctgccgtggccgcggatgccaagcagtgctcgaagattgggagggatgcactgcgggacggtggctctgcggtggatgcagccattgcagccctgttgtgtgtggggctcatgaatgcccacagcatgggcatcgggggtggcctcttcctcaccatctacaacagcaccacacgaaaagctgaggtcatcaacgcccgcgaggtggcccccaggctggcctttgccaccatgttcaacagctcggagcagtcccagaagggggggctgtcggtggcggtgcctggggagatccgaggctatgagctggcacaccagcggcatgggcggctgccctgggctcgcctcttccagcccagcatccagctggcccgccagggcttccccgtgggcaagggcttggcggcagccctggaaaacaagcggaccgtcatcgagcagcagcctgtcttgtgtgaggtgttctgccgggatagaaaggtgcttcgggagggggagagactgaccctgccgcagctggctgacacctacgagacgctggccatcgagggtgcccaggccttctacaacggcagcctcacggcccagattgtgaaggacatccaggcggccgggggcattgtgacagctgaggacctgaacaactaccgtgctgagctgatcgagcacccgctgaacatcagcctgggagacgcggtgctgtacatgcccagtgcgccgctcagcgggcccgtgctggccctcatcctcaacatcctcaaagggtacaacttctcccgggagagcgtggagagccccgagcagaagggcctgacgtaccaccgcatcgtagaggctttccggtttgcctacgccaagaggaccctgcttggggaccccaagtttgtggatgtgactgaggtggtccgcaacatgacctccgagttcttcgctgcccagctccgggcccagatctctgacgacaccactcacccgatctcctactacaagcccgagttctacacgccggatgacgggggcactgctcacctgtctgtcgtcgcagaggacggcagtgctgtgtccgccaccagcaccatcaacctctactttggctccaaggtccgctccccggtcagcgggatcctgttcaataatgaaatggacgacttcagctctcccagcatcaccaacgagtttggggtacccccctcacctgccaatttcatccagccagggaagcagccgctctcgtccatgtgcccgacgatcatggtgggccaggacggccaggtccggatggtggtgggagctgctgggggcacacagatcaccacggccactgcactggccatcatctacaacctctggttcggctatgacgtgaagcgggccgtggaggagccccggctgcacaaccagcttctgcccaacgtcacgacagtggagagaaacattgaccaggcagtgactgcagccctggagacccggcaccatcacacccagatcgcgtccaccttcatcgctgtggtgcaagccatcgtccgcacggctggtggctgggcagctgcctcggactccaggaaaggcggggagcctgccggctactgagtgctccaggaggacaaggctgacaagcaatccagggacaagatactcaccaggaccaggaaggggactctgggggaccggcttcccctgtgagcagcagagcagcacaataaatgaggccactgtgccaggctccaggtggcctccctggcctgtctccccaaaaaaaaaaaaaaaaaaaaaaaaaaaaaacaaaaaaaaaaacaaacaaacaaaaaaagacaaacaagaaaaaaaaaaaaaaaaaaaagaaaaagcagagaaggaacacagcgcacgcaagccagaaagagcagaaagagaagaaaaaaggaggagcgagaaagacagagagagacgagagcaagagacaaagtacacgaagaggaaagaggaaaaggaaaccagaggaggacaaagagaagggggacgcagaacaacagagacgcaaagacacaagaaaaacagagaaaaaaaaacgagacggaaggaagaaaagaaaagaaaggaa

SEQ ID NO: 365644 - DNA, 2885 bp, Homo sapiens
gtgctgctggatgaccagaccgggcgtcgggtgagcccagaagtgagagcagttggctgtgccccagtgctgtgtgacccagaggcgccgctcaccctctctgagctggtggacatcataggtggggaagctcaggtcagggcactcccatgagtgtctggaggcctgagtcccattctcagctctgccatatgcttgctgcgctctagaggagttcctcttcctctccaagcctcggtttatgtacccgtgcagtgggagtgagttgcacttcggggtgaagggggcaagacttgtgtgggcgcatcctgcagaaggatcccacagcaaggcaagtgaggtgctgccgtcatccaggctggacagttcagtgatttgcctgaggccccacagcagagttcaactggagacagagaaaccagctagaggcagagggaggtaacacggagtcccccagaaaggtctgggctgcgcgtgcttcaggtaacctcccttgaccttcaggagaacgagaaggctgcctgatcagagagtccctgaagaagattctgtggctacaggcttcagcagagtgtgagggagaccccggttatttcctcagctatttccaccaaatcctcctgtctttcgtggccaacaccccaggcaaggcttggggcccccgtctgctgctggacgcagagccatgaagaagaagttagtggtgctgggcctgctggccgtggtcctggtgctggtcattgtcggcctctgtctctggctgccctcagcctccaaggaacctgacaaccatgtgtacaccagggctgccgtggccgcggatgccaagcagtgctcgaagattgggagggatgcactgcgggacggtggctctgcggtggatgcagccattgcagccctgttgtgtgtggggctcatgaatgcccacagcatgggcatcgggggtggcctcttcctcaccatctacaacagcaccacacgaaaagctgaggtcatcaacgcccgcgaggtggcccccaggctggcctttgccaccatgttcaacagctcggagcagtcccagaagggggggctgtcggtggcggtgcctggggagatccgaggctatgagctggcacaccagcggcatgggcggctgccctgggctcgcctcttccagcccagcatccagctggcccgccagggcttccccgtgggcaagggcttggcggcagccctggaaaacaagcggaccgtcatcgagcagcagcctgtcttgtgtgaggtgttctgccgggatagaaaggtgcttcgggagggggagagactgaccctgccgcagctggctgacacctacgagacgctggccatcgagggtgcccaggccttctacaacggcagcctcacggcccagattgtgaaggacatccaggcggccgggggcattgtgacagctgaggacctgaacaactaccgtgctgagctgatcgagcacccgctgaacatcagcctgggagacgcggtgctgtacatgcccagtgcgccgctcagcgggcccgtgctggccctcatcctcaacatcctcaaagggtacaacttctcccgggagagcgtggagagccccgagcagaagggcctgacgtaccaccgcatcgtagaggctttccggtttgcctacgccaagaggaccctgcttggggaccccaagtttgtggatgtgactgaggtggtccgcaacatgacctccgagttcttcgctgcccagctccgggcccagatctctgacgacaccactcacccgatctcctactacaagcccgagttctacacgccggatgacgggggcactgctcacctgtctgtcgtcgcagaggacggcagtgctgtgtccgccaccagcaccatcaacctctactttggctccaaggtccgctccccggtcagcgggatcctgttcaataatgaaatggacgacttcagctctcccagcatcaccaacgagtttggggtacccccctcacctgccaatttcatccagccagggaagcagccgctctcgtccatgtgcccgacgatcatggtgggccaggacggccaggtccggatggtggtgggagctgctgggggcacacagatcaccacggccactgcactggccatcatctacaacctctggttcggctatgacgtgaagcgggccgtggaggagccccggctgcacaaccagcttctgcccaacgtcacgacagtggagagaaacattgaccaggcagtgactgcagccctggagacccggcaccatcacacccagatcgcgtccaccttcatcgctgtggtgcaagccatcgtccgcacggctggtggctgggcagctgcctcggactccaggaaaggcggggagcctgccggctactgagtgctccaggaggacaaggctgacaagcaatccagggacaagatactcaccaggaccaggaaggggactctgggggaccggcttcccctgtgagcagcagagcagcacaataaatgaggccactgtgccaggctccaggtggcctccctggcctgtctccccaaaaaaaaaaaaaaaaaaaaaaaaaaaaaacaaaaaaaaaaacaaacaaacaaaaaaagacaaacaagaaaaaaaaaaaaaaaaaaaagaaaaagcagagaaggaacacagcgcacgcaagccagaaagagcagaaagagaagaaaaaaggaggagcgagaaagacagagagagacgagagcaagagacaaagtacacgaagaggaaagaggaaaaggaaaccagaggaggacaaagagaagggggacgcagaacaacagagacgcaaagacacaagaaaaacagagaaaaaaaaacgagacggaaggaagaaaagaaaagaaaggaa

SEQ ID NO: 365645 - DNA, 1359 bp, Homo sapiens
gacagggagtcagactggtcatgcaaggtcctgggcctgccttgggtcctggggagccacggaaggttgtgggtgccagagggttgcggtcagagtcacagtcaagggccttctgagacctgtgccccctccccaccctccctccccacctcctcaggccagctctggggtctcggcaggtggtccgcaacatgacctccgagttcttcgctgcccagctccgggcccagatctctgacgacaccactcacccgatctcctactacaagcccgagttctacacgccggatgacgggggcactgctcacctgtctgtcgtcgcagaggacggcagtgctgtgtccgccaccagcaccatcaacctctactttggctccaaggtccgctccccggtcagcgggatcctgttcaataatgaaatggacgacttcagctctcccagcatcaccaacgagtttggggtacccccctcacctgccaatttcatccagccagggaagcagccgctctcgtccatgtgcccgacgatcatggtgggccaggacggccaggtccggatggtggtgggagctgctgggggcacacagatcaccacggccactgcactggccatcatctacaacctctggttcggctatgacgtgaagcgggccgtggaggagccccggctgcacaaccagcttctgcccaacgtcacgacagtggagagaaacattgaccaggcagtgactgcagccctggagacccggcaccatcacacccagatcgcgtccaccttcatcgctgtggtgcaagccatcgtccgcacggctggtggctgggcagctgcctcggactccaggaaaggcggggagcctgccggctactgagtgctccaggaggacaaggctgacaagcaatccagggacaagatactcaccaggaccaggaaggggactctgggggaccggcttcccctgtgagcagcagagcagcacaataaatgaggccactgtgccaggctccaggtggcctccctggcctgtctccccaaaaaaaaaaaaaaaaaaaaaaaaaaaaaacaaaaaaaaaaacaaacaaacaaaaaaagacaaacaagaaaaaaaaaaaaaaaaaaaagaaaaagcagagaaggaacacagcgcacgcaagccagaaagagcagaaagagaagaaaaaaggaggagcgagaaagacagagagagacgagagcaagagacaaagtacacgaagaggaaagaggaaaaggaaaccagaggaggacaaagagaagggggacgcagaacaacagagacgcaaagacacaagaaaaacagagaaaaaaaaacgagacggaaggaagaaaagaaaagaaaggaa

SEQ ID NO: 365646 - DNA, 1207 bp, Homo sapiens
gacagggagtcagactggtcatgcaaggtggtccgcaacatgacctccgagttcttcgctgcccagctccgggcccagatctctgacgacaccactcacccgatctcctactacaagcccgagttctacacgccggatgacgggggcactgctcacctgtctgtcgtcgcagaggacggcagtgctgtgtccgccaccagcaccatcaacctctactttggctccaaggtccgctccccggtcagcgggatcctgttcaataatgaaatggacgacttcagctctcccagcatcaccaacgagtttggggtacccccctcacctgccaatttcatccagccagggaagcagccgctctcgtccatgtgcccgacgatcatggtgggccaggacggccaggtccggatggtggtgggagctgctgggggcacacagatcaccacggccactgcactggccatcatctacaacctctggttcggctatgacgtgaagcgggccgtggaggagccccggctgcacaaccagcttctgcccaacgtcacgacagtggagagaaacattgaccaggcagtgactgcagccctggagacccggcaccatcacacccagatcgcgtccaccttcatcgctgtggtgcaagccatcgtccgcacggctggtggctgggcagctgcctcggactccaggaaaggcggggagcctgccggctactgagtgctccaggaggacaaggctgacaagcaatccagggacaagatactcaccaggaccaggaaggggactctgggggaccggcttcccctgtgagcagcagagcagcacaataaatgaggccactgtgccaggctccaggtggcctccctggcctgtctccccaaaaaaaaaaaaaaaaaaaaaaaaaaaaaacaaaaaaaaaaacaaacaaacaaaaaaagacaaacaagaaaaaaaaaaaaaaaaaaaagaaaaagcagagaaggaacacagcgcacgcaagccagaaagagcagaaagagaagaaaaaaggaggagcgagaaagacagagagagacgagagcaagagacaaagtacacgaagaggaaagaggaaaaggaaaccagaggaggacaaagagaagggggacgcagaacaacagagacgcaaagacacaagaaaaacagagaaaaaaaaacgagacggaaggaagaaaagaaaagaaaggaa

SEQ ID NO: 365647 - DNA, 4108 bp, Homo sapiens
ataataattaggccaagcgttgaatagtacggggggggggggggggcgagccccggcggctctggccgcggccgcactcagcgccacgcgtcgaaagcgcaggccccgaggacccgccgcactgacagtatgagccgcacagcctacacggtgggagccctgcttctcctcttggggaccctgctgccggctgctgaagggaaaaagaaagggtcccaaggtgccatccccccgccagacaaggcccagcacaatgactcagagcagactcagtcgccccagcagcctggctccaggaaccgggggcggggccaagggcggggcactgccatgcccggggaggaggtgctggagtccagccaagaggccctgcatgtgacggagcgcaaatacctgaagcgagactggtgcaaaacccagccgcttaagcagaccatccacgaggaaggctgcaacagtcgcaccatcatcaaccgcttctgttacggccagtgcaactctttctacatccccaggcacatccggaaggaggaaggttcctttcagtcctgctccttctgcaagcccaagaaattcactaccatgatggtcacactcaactgccctgaactacagccacctaccaagaagaagagagtcacacgtgtgaagcagtgtcgttgcatatccatcgatttggattaagccaaatccaggtgcacccagcatgtcctaggaatgcagccccaggaagtcccagacctaaaacaaccagattcttacttggcttaaacctagaggccagaagaacccccagctgcctcctggcaggagcctgcttgtgcgtagttcgtgtgcatgagtgtggatgggtgcctgtgggtgtttttagacaccagagaaaacacagtctctgctagagagcactccctattttgtaaacatatctgctttaatggggatgtaccagaaacccacctcaccccggctcacatctaaaggggcggggccgtggtctggttctgactttgtgtttttgtgccctcctggggaccagaatctcctttcggaatgaatgttcatggaagaggctcctctgagggcaagagacctgttttagtgctgcattcgacatggaaaagtccttttaacctgtgcttgcatcctcctttcctcctcctcctcacaatccatctcttcttaagttgatagtgactatgtcagtctaatctcttgtttgccaaggttcctaaattaattcacttaaccatgatgcaaatgtttttcattttgtgaagaccctccagactctgggagaggctggtgtgggcaaggacaagcaggatagtggagtgagaaagggagggtggagggtgaggccaaatcaggtccagcaaaagtcagtagggacattgcagaagcttgaaaggccaataccagaacacaggctgatgcttctgagaaagtcttttcctagtatttaacagaacccaagtgaacagaggagaaatgagattgccagaaagtgattaactttggccgttgcaatctgctcaaacctaacaccaaactgaaaacataaatactgaccactcctatgttcggacccaagcaagttagctaaaccaaaccaactcctctgctttgtccctcaggtggaaaagagaggtagtttagaactctctgcataggggtgggaattaatcaaaaacctcagaggctgaaattcctaatacctttcctttatcgtggttatagtcagctcatttccattccactatttcccataatgcttctgagagccactaacttgattgataaagatcctgcctctgctgagtgtacctgacagtagtctaagatgagagagtttagggactactctgttttagcaagagatattttgggggtctttttgttttaactattgtcaggagattgggctaaagagaagacgacgagagtaaggaaataaagggaattgcctctggctagagagtagttaggtgttaatacctggtagagatgtaagggatatgacctccctttctttatgtgctcactgaggatctgaggggaccctgttaggagagcatagcatcatgatgtattagctgttcatctgctactggttggatggacataactattgtaactattcagtatttactggtaggcactgtcctctgattaaacttggcctactggcaatggctacttaggattgatctaagggccaaagtgcagggtgggtgaactttattgtactttggatttggttaacctgttttcttcaagcctgaggttttatatacaaactccctgaatactctttttgccttgtatcttctcagcctcctagccaagtcctatgtaatatggaaaacaaacactgcagacttgagattcagttgccgatcaaggctctggcattcagagaacccttgcaactcgagaagctgtttttatttcgtttttgttttgatccagtgctctcccatctaacaactaaacaggagccatttcaaggcgggagatattttaaacacccaaaatgttgggtctgattttcaaacttttaaactcactactgatgattctcacgctaggcgaatttgtccaaacacatagtgtgtgtgttttgtatacactgtatgaccccaccccaaatctttgtattgtccacattctccaacaataaagcacagagtggatttaattaagcacacaaatgctaaggcagaattttgagggtgggagagaagaaaagggaaagaagctgaaaatgtaaaaccacaccagggaggaaaaatgacattcagaaccagcaaacactgaatttctcttgttgttttaactctgccacaagaatgcaatttcgttaatggagatgacttaagttggcagcagtaatcttcttttaggagcttgtaccacagtcttgcacataagtgcagatttggctcaagtaaagagaatttcctcaacactaacttcactgggataatcagcagcgtaactaccctaaaagcatatcactagccaaagagggaaatatctgttcttcttactgtgcctatattaagactagtacaaatgtggtgtgtcttccaactttcattgaaaatgccatatctataccatattttattcgagtcactgatgatgtaatgatatattttttcattattatagtagaatatttttatggcaagatatttgtggtcttgatcatacctattaaaataatgccaaacaccaaatatgaattttatgatgtacactttgtgcttggcattaaaagaaaaaaacacacatcctggaagtctgtaagttgttttttgttactgtaggtcttcaaagttaagagtgtaagtgaaaaatctggaggagaggataatttccactgtgtggaatgtgaatagttaaatgaaaagttatggttatttaatgtaattattacttcaaatcctttggtcactgtgatttcaagcatgttttctttttctcctttatatgactttctctgagttgggcaaagaagaagctgacacaccgtatgttgttagagtcttttatctggtcaggggaaacaaaatcttgacccagctgaacatgtcttcctgagtcagtgcctgaatctttattttttaaattgaatgttccttaaaggttaacatttctaaagcaatattaagaaagactttaaatgttattttggaagacttacgatgcatgtatacaaacgaatagcagataatgatgactagttcacacataaagtccttttaaggagaaaatctaaaatgaaaagtggataaacagaacatttataagtgatcagttaatgcctaagagtgaaagtagttctattgacattcctcaagatatttaatatcaactgcattatgtattatgtctgcttaaatcatttaaaaacggcaaagaattatatagactatgaggtaccttgctgtgtaggaggatgaaaggggagttgatagtctcataaaactaatttggcttcaagtttcatgaatctgtaactagaatttaattttcaccccaataatgttctatatagcctttgctaaagagcaactaataaattaaacctattctttctgtg

SEQ ID NO: 365648 - DNA, 3856 bp, Homo sapiens
ataataattaggccaagcgttgaatagtacggggggggggggggggcgagccccggcggctctggccgcggccgcactcagcgccacgcgtcgaaagcgcaggccccgaggacccgccgcactgacagggagcgcaaatacctgaagcgagactggtgcaaaacccagccgcttaagcagaccatccacgaggaaggctgcaacagtcgcaccatcatcaaccgcttctgttacggccagtgcaactctttctacatccccaggcacatccggaaggaggaaggttcctttcagtcctgctccttctgcaagcccaagaaattcactaccatgatggtcacactcaactgccctgaactacagccacctaccaagaagaagagagtcacacgtgtgaagcagtgtcgttgcatatccatcgatttggattaagccaaatccaggtgcacccagcatgtcctaggaatgcagccccaggaagtcccagacctaaaacaaccagattcttacttggcttaaacctagaggccagaagaacccccagctgcctcctggcaggagcctgcttgtgcgtagttcgtgtgcatgagtgtggatgggtgcctgtgggtgtttttagacaccagagaaaacacagtctctgctagagagcactccctattttgtaaacatatctgctttaatggggatgtaccagaaacccacctcaccccggctcacatctaaaggggcggggccgtggtctggttctgactttgtgtttttgtgccctcctggggaccagaatctcctttcggaatgaatgttcatggaagaggctcctctgagggcaagagacctgttttagtgctgcattcgacatggaaaagtccttttaacctgtgcttgcatcctcctttcctcctcctcctcacaatccatctcttcttaagttgatagtgactatgtcagtctaatctcttgtttgccaaggttcctaaattaattcacttaaccatgatgcaaatgtttttcattttgtgaagaccctccagactctgggagaggctggtgtgggcaaggacaagcaggatagtggagtgagaaagggagggtggagggtgaggccaaatcaggtccagcaaaagtcagtagggacattgcagaagcttgaaaggccaataccagaacacaggctgatgcttctgagaaagtcttttcctagtatttaacagaacccaagtgaacagaggagaaatgagattgccagaaagtgattaactttggccgttgcaatctgctcaaacctaacaccaaactgaaaacataaatactgaccactcctatgttcggacccaagcaagttagctaaaccaaaccaactcctctgctttgtccctcaggtggaaaagagaggtagtttagaactctctgcataggggtgggaattaatcaaaaacctcagaggctgaaattcctaatacctttcctttatcgtggttatagtcagctcatttccattccactatttcccataatgcttctgagagccactaacttgattgataaagatcctgcctctgctgagtgtacctgacagtagtctaagatgagagagtttagggactactctgttttagcaagagatattttgggggtctttttgttttaactattgtcaggagattgggctaaagagaagacgacgagagtaaggaaataaagggaattgcctctggctagagagtagttaggtgttaatacctggtagagatgtaagggatatgacctccctttctttatgtgctcactgaggatctgaggggaccctgttaggagagcatagcatcatgatgtattagctgttcatctgctactggttggatggacataactattgtaactattcagtatttactggtaggcactgtcctctgattaaacttggcctactggcaatggctacttaggattgatctaagggccaaagtgcagggtgggtgaactttattgtactttggatttggttaacctgttttcttcaagcctgaggttttatatacaaactccctgaatactctttttgccttgtatcttctcagcctcctagccaagtcctatgtaatatggaaaacaaacactgcagacttgagattcagttgccgatcaaggctctggcattcagagaacccttgcaactcgagaagctgtttttatttcgtttttgttttgatccagtgctctcccatctaacaactaaacaggagccatttcaaggcgggagatattttaaacacccaaaatgttgggtctgattttcaaacttttaaactcactactgatgattctcacgctaggcgaatttgtccaaacacatagtgtgtgtgttttgtatacactgtatgaccccaccccaaatctttgtattgtccacattctccaacaataaagcacagagtggatttaattaagcacacaaatgctaaggcagaattttgagggtgggagagaagaaaagggaaagaagctgaaaatgtaaaaccacaccagggaggaaaaatgacattcagaaccagcaaacactgaatttctcttgttgttttaactctgccacaagaatgcaatttcgttaatggagatgacttaagttggcagcagtaatcttcttttaggagcttgtaccacagtcttgcacataagtgcagatttggctcaagtaaagagaatttcctcaacactaacttcactgggataatcagcagcgtaactaccctaaaagcatatcactagccaaagagggaaatatctgttcttcttactgtgcctatattaagactagtacaaatgtggtgtgtcttccaactttcattgaaaatgccatatctataccatattttattcgagtcactgatgatgtaatgatatattttttcattattatagtagaatatttttatggcaagatatttgtggtcttgatcatacctattaaaataatgccaaacaccaaatatgaattttatgatgtacactttgtgcttggcattaaaagaaaaaaacacacatcctggaagtctgtaagttgttttttgttactgtaggtcttcaaagttaagagtgtaagtgaaaaatctggaggagaggataatttccactgtgtggaatgtgaatagttaaatgaaaagttatggttatttaatgtaattattacttcaaatcctttggtcactgtgatttcaagcatgttttctttttctcctttatatgactttctctgagttgggcaaagaagaagctgacacaccgtatgttgttagagtcttttatctggtcaggggaaacaaaatcttgacccagctgaacatgtcttcctgagtcagtgcctgaatctttattttttaaattgaatgttccttaaaggttaacatttctaaagcaatattaagaaagactttaaatgttattttggaagacttacgatgcatgtatacaaacgaatagcagataatgatgactagttcacacataaagtccttttaaggagaaaatctaaaatgaaaagtggataaacagaacatttataagtgatcagttaatgcctaagagtgaaagtagttctattgacattcctcaagatatttaatatcaactgcattatgtattatgtctgcttaaatcatttaaaaacggcaaagaattatatagactatgaggtaccttgctgtgtaggaggatgaaaggggagttgatagtctcataaaactaatttggcttcaagtttcatgaatctgtaactagaatttaattttcaccccaataatgttctatatagcctttgctaaagagcaactaataaattaaacctattctttctgtg

SEQ ID NO: 365649 - DNA, 1054 bp, Homo sapiens
acgcactctgaggatcccgagtgggtctgtgtcttccaactttcattgaaaatgccatatctataccatattttattcgagtcactgatgatgtaatgatatattttttcattattatagtagaatatttttatggcaagatatttgtggtcttgatcatacctattaaaataatgccaaacaccaaatatgaattttatgatgtacactttgtgcttggcattaaaagaaaaaaacacacatcctggaagtctgtaagttgttttttgttactgtaggtcttcaaagttaagagtgtaagtgaaaaatctggaggagaggataatttccactgtgtggaatgtgaatagttaaatgaaaagttatggttatttaatgtaattattacttcaaatcctttggtcactgtgatttcaagcatgttttctttttctcctttatatgactttctctgagttgggcaaagaagaagctgacacaccgtatgttgttagagtcttttatctggtcaggggaaacaaaatcttgacccagctgaacatgtcttcctgagtcagtgcctgaatctttattttttaaattgaatgttccttaaaggttaacatttctaaagcaatattaagaaagactttaaatgttattttggaagacttacgatgcatgtatacaaacgaatagcagataatgatgactagttcacacataaagtccttttaaggagaaaatctaaaatgaaaagtggataaacagaacatttataagtgatcagttaatgcctaagagtgaaagtagttctattgacattcctcaagatatttaatatcaactgcattatgtattatgtctgcttaaatcatttaaaaacggcaaagaattatatagactatgaggtaccttgctgtgtaggaggatgaaaggggagttgatagtctcataaaactaatttggcttcaagtttcatgaatctgtaactagaatttaattttcaccccaataatgttctatatagcctttgctaaagagcaactaataaattaaacctattctttctgtg

SEQ ID NO: 365650 - DNA, 2704 bp, Homo sapiens
ataataattaggccaagcgttgaatagtacggggggggggggggggcgagccccggcggctctggccgcggccgcactcagcgccacgcgtcgaaagcgcaggccccgaggacccgccgcactgacagtatgagccgcacagcctacacggtgggagccctgcttctcctcttggggaccctgctgccggctgctgaagggaaaaagaaagggtcccaaggtgccatccccccgccagacaaggcccagcacaatgactcagagcagactcagtcgccccagcagcctggctccaggaaccgggggcggggccaagggcggggcactgccatgcccggggaggaggtgctggagtccagccaagaggccctgcatgtgacggagcgcaaatacctgaagcgagactggtgcaaaacccagccgcttaagcagaccatccacgaggaaggctgcaacagtcgcaccatcatcaaccgcttctgttacggccagtgcaactctttctacatccccaggcacatccggaaggaggaaggttcctttcagtcctgctccttctgcaagcccaagaaattcactaccatgatggtcacactcaactgccctgaactacagccacctaccaagaagaagagagtcacacgtgtgaagcagtgtcgttgcatatccatcgatttggattaagccaaatccaggtgcacccagcatgtcctaggaatgcagccccaggaagtcccagacctaaaacaaccagattcttacttggcttaaacctagaggccagaagaacccccagctgcctcctggcaggagcctgcttgtgcgtagttcgtgtgcatgagtgtggatgggtgcctgtgggtgtttttagacaccagagaaaacacagtctctgctagagagcactccctattttgtaaacatatctgctttaatggggatgtaccagaaacccacctcaccccggctcacatctaaaggggcggggccgtggtctggttctgactttgtgtttttgtgccctcctggggaccagaatctcctttcggaatgaatgttcatggaagaggctcctctgagggcaagagacctgttttagtgctgcattcgacatggaaaagtccttttaacctgtgcttgcatcctcctttcctcctcctcctcacaatccatctcttcttaagttgatagtgactatgtcagtctaatctcttgtttgccaaggttcctaaattaattcacttaaccatgatgcaaatgtttttcattttgtgaagaccctccagactctgggagaggctggtgtgggcaaggacaagcaggatagtggagtgagaaagggagggtggagggtgaggccaaatcaggtccagcaaaagtcagtagggacattgcagaagcttgaaaggccaataccagaacacaggctgatgcttctgagaaagtcttttcctagtatttaacagaacccaagtgaacagaggagaaatgagattgccagaaagtgattaactttggccgttgcaatctgctcaaacctaacaccaaactgaaaacataaatactgaccactcctatgttcggacccaagcaagttagctaaaccaaaccaactcctctgctttgtccctcaggtggaaaagagaggtagtttagaactctctgcataggggtgggaattaatcaaaaacctcagaggctgaaattcctaatacctttcctttatcgtggttatagtcagctcatttccattccactatttcccataatgcttctgagagccactaacttgattgataaagatcctgcctctgctgagtgtacctgacagtagtctaagatgagagagtttagggactactctgttttagcaagagatattttgggggtctttttgttttaactattgtcaggagattgggctaaagagaagacgacgagagtaaggaaataaagggaattgcctctggctagagagtagttaggtgttaatacctggtagagatgtaagggatatgacctccctttctttatgtgctcactgaggatctgaggggaccctgttaggagagcatagcatcatgatgtattagctgttcatctgctactggttggatggacataactattgtaactattcagtatttactggtaggcactgtcctctgattaaacttggcctactggcaatggctacttaggattgatctaagggccaaagtgcagggtgggtgaactttattgtactttggatttggttaacctgttttcttcaagcctgaggttttatatacaaactccctgaatactctttttgccttgtatcttctcagcctcctagccaagtcctatgtaatatggaaaacaaacactgcagacttgagattcagttgccgatcaaggctctggcattcagagaacccttgcaactcgagaagctgtttttatttcgtttttgttttgatccagtgctctcccatctaacaactaaacaggagccatttcaaggcgggagatattttaaacacccaaaatgttgggtctgattttcaaacttttaaactcactactgatgattctcacgctaggcgaatttgtccaaacacatagtgtgtgtgttttgtatacactgtatgaccccaccccaaatctttgtattgtccacattctccaacaataaagcacagagtggatttaattaagc

SEQ ID NO: 365651 - DNA, 494 bp, Homo sapiens
aagcgcaggccccgaggacccgccgcactgacagggtgagcgcggacgcacccggcagggatgtgagtgggcggagggaagagggccgcaaaccaacccaggacccgctcagttccacgcgcggcagccctccgtgcgcgcaggctcgggtgcgttgttcgcgggggtgaattgtgaagaaccatcgcggggtccttcctgctgaggccgcggacaccgtgacctcgctgctctgggtctgcagggaaacgtaggaaaaaaagttgtcaggagcgggcaggatgacccccacatcccgtttccacctcccggaggcccccgaacacgctcctggtgctggtggcagcagcgcctggcagacgcgcccgcttagcgagggcgcgaagtccaggccgccagagcgcaggagcatccggacctgctagtcggccgctgactgcgcggcgagttgccttgagagggtcccatgtgcttggggcgccgcgctgggtctg

SEQ ID NO: 365652 - DNA, 3296 bp, Homo sapiens
ataataattaggccaagcgttgaatagtacggggggggggggggggcgagccccggcggctctggccgcggccgcactcagcgccacgcgtcgaaagcgcaggccccgaggacccgccgcactgacagtatgagccgcacagcctacacggtgggagccctgcttctcctcttggggaccctgctgccggctgctgaagggaaaaagaaagggtcccaaggtgccatccccccgccagacaaggcccagcacaatgactcagagcagactcagtcgccccagcagcctggctccaggaaccgggggcggggccaagggcggggcactgccatgcccggggaggaggtgctggagtccagccaagaggccctgcatgtgacggagcgcaaatacctgaagcgagactggtgcaaaacccagccgcttaagcagaccatccacgaggaaggctgcaacagtcgcaccatcatcaaccgcttctgttacggccagtgcaactctttctacatccccaggcacatccggaaggaggaaggttcctttcagtcctgctccttctgcaagcccaagaaattcactaccatgatggtcacactcaactgccctgaactacagccacctaccaagaagaagagagtcacacgtgtgaagcagtgtcgttgcatatccatcgatttggattaagccaaatccaggtgcacccagcatgtcctaggaatgcagccccaggaagtcccagacctaaaacaaccagattcttacttggcttaaacctagaggccagaagaacccccagctgcctcctggcaggagcctgcttgtgcgtagttcgtgtgcatgagtgtggatgggtgcctgtgggtgtttttagacaccagagaaaacacagtctctgctagagagcactccctattttgtaaacatatctgctttaatggggatgtaccagaaacccacctcaccccggctcacatctaaaggggcggggccgtggtctggttctgactttgtgtttttgtgccctcctggggaccagaatctcctttcggaatgaatgttcatggaagaggctcctctgagggcaagagacctgttttagtgctgcattcgacatggaaaagtccttttaacctgtgcttgcatcctcctttcctcctcctcctcacaatccatctcttcttaagttgatagtgactatgtcagtctaatctcttgtttgccaaggttcctaaattaattcacttaaccatgatgcaaatgtttttcattttgtgaagaccctccagactctgggagaggctggtgtgggcaaggacaagcaggatagtggagtgagaaagggagggtggagggtgaggccaaatcaggtccagcaaaagtcagtagggacattgcagaagcttgaaaggccaataccagaacacaggctgatgcttctgagaaagtcttttcctagtatttaacagaacccaagtgaacagaggagaaatgagattgccagaaagtgattaactttggccgttgcaatctgctcaaacctaacaccaaactgaaaacataaatactgaccactcctatgttcggacccaagcaagttagctaaaccaaaccaactcctctgctttgtccctcaggtggaaaagagaggtagtttagaactctctgcataggggtgggaattaatcaaaaacctcagaggctgaaattcctaatacctttcctttatcgtggttatagtcagctcatttccattccactatttcccataatgcttctgagagccactaacttgattgataaagatcctgcctctgctgagtgtacctgacagtagtctaagatgagagagtttagggactactctgttttagcaagagatattttgggggtctttttgttttaactattgtcaggagattgggctaaagagaagacgacgagagtaaggaaataaagggaattgcctctggctagagagtagttaggtgttaatacctggtagagatgtaagggatatgacctccctttctttatgtgctcactgaggatctgaggggaccctgttaggagagcatagcatcatgatgtattagctgttcatctgctactggttggatggacataactattgtaactattcagtatttactggtaggcactgtcctctgattaaacttggcctactggcaatggctacttaggattgatctaagggccaaagtgcagggtgggtgaactttattgtactttggatttggttaacctgttttcttcaagcctgaggttttatatacaaactccctgaatactctttttgccttgtatcttctcagcctcctagccaagtcctatgtaatatggaaaacaaacactgcagacttgagattcagttgccgatcaaggctctggcattcagagaacccttgcaactcgagaagctgtttttatttcgtttttgttttgatccagtgctctcccatctaacaactaaacaggagccatttcaaggcgggagatattttaaacacccaaaatgttgggtctgattttcaaacttttaaactcactactgatgattctcacgctaggcgaatttgtccaaacacatagtgtgtgtgttttgtatacactgtatgaccccaccccaaatctttgtattgtccacattctccaacaataaagcacagagtggatttaattaagcacacaaatgctaaggcagaattttgagggtgggagagaagaaaagggaaagaagctgaaaatgtaaaaccacaccagggaggaaaaatgacattcagaaccagcaaacactgaatttctcttgttgttttaactctgccacaagaatgcaatttcgttaatggagatgacttaagttggcagcagtaatcttcttttaggagcttgtaccacagtcttgcacataagtgcagatttggctcaagtaaagagaatttcctcaacactaacttcactgggataatcagcagcgtaactaccctaaaagcatatcactagccaaagagggaaatatctgttcttcttactgtgcctatattaagactagtacaaatgtggtgtgtcttccaactttcattgaaaatgccatatctataccatattttattcgagtcactgatgatgtaatgatatattttttcattattatagtagaatatttttatggcaagatatttgtggtcttgatcatacctattaaaataatgccaaacaccaaatatgaattttatgatgtacactttgtgcttggcattaaaagaaaaaaacacaca

SEQ ID NO: 365653 - DNA, 1039 bp, Homo sapiens
tccgctccggcctcggcttcgacgtaggccaacgcttcctccccagtagctcctaggccttctcgtggccgttgttttgaaaacggcgctctgattggctaggtttccgggcccgcgcccgttgccccacgcactgaccaattggcactcatgtaacatcggacgaggcacgagtgaggggggaggcggtggcggcggccattttgagccgctgccgccattggagtgggccccccccctttcccccttcgcctcctgacaggaaaggtttaagggggacagagccctgggaggccgggccgggctcgggggccaccccgggggcccgggccatggatgtgcgccgtctgaaggtgaacgaacttcgcgaggagctgcagcgccgcggcctggacactcgaggcctcaaggccgagcttgctgagcggctgcaggcggcgttggaggccgaggagcctgacgacgagcgggagctcgacgccgacgacgaaccggggcgacccgggcacatcaacgaggaggtcgagaccgaggggggctccgagctggaggggaccgcgcagccaccgccgcccgggctgcagccgcacgcggagcccggcggctactcggggccggacggacattatgccatggacaatattaccaggcagaaccaattctacgatacccaagtcatcaaacaagaaaacgagtcaggctacgagaggagaccactggaaatggagcagcagcaggcctatcgtccagaaatgaagacagagatgaagcaaggagcacccaccagcttcctcccgcctgaagcttctcaactcaagccagacaggcagcaattccagagtcgaaagaggccttatgaagaaaaccggggacgggggtactttgagcaccgagaggataggaggtgggtgtatgaggcagcagtcacccttgctctggtaggtttctatatccatagcctcgtgcttgctggggacatttgcactaacctagaggggctgagtaaagattccctctgctttcacactcttcctgtccc

SEQ ID NO: 365654 - DNA, 795 bp, Homo sapiens
  misc_feature (726)..(726): n is a, c, g, or t
  misc_feature (733)..(734): n is a, c, g, or t
  misc_feature (737)..(738): n is a, c, g, or t
  misc_feature (742)..(742): n is a, c, g, or t
  misc_feature (745)..(745): n is a, c, g, or t
  misc_feature (747)..(747): n is a, c, g, or t
  misc_feature (754)..(754): n is a, c, g, or t
aaactataggctaggtacgaggctgggtgttaatcggccgaggcctgggtaccaatgctatcatggataagatgcgggtgatgggcctacgccggcagcggaactatgctggccgctgggatgtcctgatccagcaggccacccagtgcctcaaccgcctcatccagattgctgcccgcaagaaacgcaactatatcctagatcagacaaatgtttatgggtcagcccagagacgaaaaatgagaccatttgaaggcttccagcgcaaagctattgtaatttgtcccactgacgaggacctaaaagaccgaacaataaagcgaaccgacgaggaagggaaggatgtcccagatcatgcggtcttagaaatgaaagccaacttcacgttgccagatgttggggacttcctggatgaggttctgttcattgagctgcagcgggaggaagcggacaagctagtgaggcagtacaacgaggaaggccgcaaggctgggccaccccctgaaaagcgctttgacaaccgaggtggtggtggcttccggggccgcgggggtggtggtggcttccagcgctatgaaaaccgaggaccccctggaggcaaccgtggcggcttccagaaccgagggggaggcagcggtggaggaggcaactaccgaggaggtttcaaccgcagcggaggtggtggctatagccagaaccgctggggtaacaacaacacatccacanagagcgnncannggcnccngnaagcgcncaaagctcgcacaggccaccagccgccacatagccgtcgcc

SEQ ID NO: 365655 - DNA, 635 bp, Homo sapiens
  misc_feature (3)..(3): n is a, c, g, or t
  misc_feature (6)..(6): n is a, c, g, or t
  misc_feature (17)..(17): n is a, c, g, or t
  misc_feature (45)..(45): n is a, c, g, or t
  misc_feature (48)..(48): n is a, c, g, or t
  misc_feature (68)..(68): n is a, c, g, or t
tgngcnccccccggtgnggccgctctagaactagtggtccccccnggntgaggaattcggcccgaganaaaacacaacaaaaccaaaccacagaatcatctttaacccaactttttatacgatgccccagttccccataactttgcacacaagcttctgtgttcagttgaattgtaactgctttttgtatttggagagagtgactattgaacttgaaaccttttattccgggcgtcttggtagtttctggtgggattcagtgggtgagagggaagaaggggaggttggggggctccttcccttcagaacttgaagtttctcccactgcctcctctccagtggtctcccaggtgccagacccaaaagcttttcctacagtgataccctttatttttacttccccttgactcatatgttttaacatgattttaacaaactgcacttattaagaaatgtgtttgccctgttttgtttggtttcgttttgttttctttgaataaatgacatggcacctcctagcaggaaggaagcagggttgaaaccctgaagtgttactgcagttggccgttaattggggtgggggcctctttaaagggaaattatttactcattcattaaacaacttaactgaggga

SEQ ID NO: 365656 - DNA, 736 bp, Homo sapiens
tccgctccggcctcggcttcgacgtaggccaacgcttcctccccagtagctcctaggccttctcgtggccgttgttttgaaaacggcgctctgattggctaggtttccgggcccgcgcccgttgccccacgcactgaccaattggcactcatgtaacatcggacgaggcacgagtgaggggggaggcggtggcggcggccattttgagccgctgccgccattggagtgggccccccccctttcccccttcgcctcctgacaggaaaggtttaagggggacagagccctgggaggccgggccgggctcgggggccaccccgggggcccgggccatggatgtgcgccgtctgaaggtgaacgaacttcgcgaggagctgcagcgccgcggcctggacactcgaggcctcaaggccgagcttgctgagcggctgcaggcggcgttggaggccgaggagcctgacgacgagcgggagctcgacgccgacgacgaaccggggcgacccgggcacatcaacgaggaggtcgagaccgaggggggctccgagctggaggggaccgcgcagccaccgccgcccgggctgcagccgcacgcggagcccggcggctactcggggccggacggacattatgccatggacaatattaccaggcagaaccaattctacgatacccaagtcatcaaacaagaaaacgagtccatggttgtgcgtgcctgtaatcccagctactcggaggc

SEQ ID NO: 365657 - DNA, 4125 bp, Homo sapiens
tccgctccggcctcggcttcgacgtaggccaacgcttcctccccagtagctcctaggccttctcgtggccgttgttttgaaaacggcgctctgattggctaggtttccgggcccgcgcccgttgccccacgcactgaccaattggcactcatgtaacatcggacgaggcacgagtgaggggggaggcggtggcggcggccattttgagccgctgccgccattggagtgggccccccccctttcccccttcgcctcctgacaggaaaggtttaagggggacagagccctgggaggccgggccgggctcgggggccaccccgggggcccgggccatggatgtgcgccgtctgaaggtgaacgaacttcgcgaggagctgcagcgccgcggcctggacactcgaggcctcaaggccgagcttgctgagcggctgcaggcggcgttggaggccgaggagcctgacgacgagcgggagctcgacgccgacgacgaaccggggcgacccgggcacatcaacgaggaggtcgagaccgaggggggctccgagctggaggggaccgcgcagccaccgccgcccgggctgcagccgcacgcggagcccggcggctactcggggccggacggacattatgccatggacaatattaccaggcagaaccaattctacgatacccaagtcatcaaacaagaaaacgagtcaggctacgagaggagaccactggaaatggagcagcagcaggcctatcgtccagaaatgaagacagagatgaagcaaggagcacccaccagcttcctcccgcctgaagcttctcaactcaagccagacaggcagcaattccagagtcgaaagaggccttatgaagaaaaccggggacgggggtactttgagcaccgagaggataggaggggccgctctcctcagcctcctgctgaagaggatgaagatgactttgatgatacccttgttgctattgacacctataactgcgacctccacttcaaggtggcccgagatcggagtagtggctatccgctcacaattgagggctttgcatacctgtggtcaggagcccgtgccagctatggggtcagaaggggccgtgtatgcttcgagatgaagatcaatgaggaaatctccgtgaagcaccttccgtctacagagcctgacccccacgtggtccgtatcggctggtccctggactcctgcagcacccagctaggcgaagagcctttctcctatggctatggaggcactgggaagaagtccaccaatagccggtttgaaaactacggagacaagtttgcagagaacgatgtgattggctgctttgcggattttgaatgtggaaatgacgtggaactgtcttttaccaagaatggaaagtggatgggcattgctttccgaatccagaaggaagccttggggggtcaggccctctatcctcatgtcctggtgaagaattgcgcagtggagttcaacttcggacagagagcagagccctactgttctgtcctcccggggtttaccttcatccagcaccttccccttagtgagcgtatccggggcaccgttggaccaaagagcaaggcagaatgtgagattctgatgatggtgggcctgcctgctgctggcaagaccacatgggccatcaaacatgcagcctccaacccttccaagaagtacaacatcctgggtaccaatgccatcatggataagatgcgggtgatgggcctacgccggcagcggaactatgctggccgctgggatgtcctgatccagcaggccacccagtgcctcaaccgcctcatccagattgctgcccgcaagaaacgcaactatatcctagatcagacaaatgtttatgggtcagcccagagacgaaaaatgagaccatttgaaggcttccagcgcaaagctattgtaatttgtcccactgacgaggacctaaaagaccgaacaataaagcgaaccgacgaggaagggaaggatgtcccagatcatgcggtcttagaaatgaaagccaacttcacgttgccagatgttggggacttcctggatgaggttctgttcattgagctgcagcgggaggaagcggacaagctagtgaggcagtacaacgaggaaggccgcaaggctgggccaccccctgaaaagcgctttgacaaccgaggtggtggtggcttccggggccgcgggggtggtggtggcttccagcgctatgaaaaccgaggaccccctggaggcaaccgtggcggcttccagaaccgagggggaggcagcggtggaggaggcaactaccgaggaggtttcaaccgcagcggaggtggtggctatagccagaaccgctggggtaacaacaaccgggataacaacaactccaacaacagaggcagctacaaccgggctccccagcaacagccgccaccacagcagcctccgccaccacagccaccaccccagcagccaccgccaccacccagctacagccctgctcggaaccccccaggggccagcacctacaataagaacagcaacatccctggctcaagcgccaataccagcacccccaccgtcagcagctacagccctccacagccgagttacagccagccaccctacaaccagggaggttacagccagggctacacagccccaccgcctccacctccaccaccacctgcctacaactatgggagctacggcggttacaacccggccccctataccccaccgccaccccccaccgcacagacctaccctcagcccagctataaccagtatcagcagtatgcccagcagtggaaccagtactatcagaaccagggccagtggccgccatactacgggaactacgactacgggagctactccgggaacacacagggtggcacaagtacacagtagccagtgtgacccagaggctcccggaggcccctgccggcttcctccaccagcgcctgcctcggcccctcctctgcccccgccagatcccgtggtgctggggatggggtcatcccagggctgcctccctccagcccactgcctcccctctgaggggcttccttcccctccatagggccaggcatttttttctggattcaaacaggcaacaatgaccttttattttctgtttgtccccacctccccagccttccacctcctgttcttcctaccttcttcctttttgactaaataatccccacctcccttgatcatacagtgaggctacagtgactgaggggagaatcccctcctgttcactctcccaaccctgctccagcccctcagcttcccagaccctcatgcagttggttgtaaattctcccaggagctgttttactgtctacttttcaggattaaaaaaaaaatcaaaacttaaaaaaaaaaaagtttaaaaagcaaaatggggagggggaggaagcagtgacttttttttggtaattatgcgcttttttttaatttttagaatttgtctttttactgtgggtgggctgttgatatttcatcaagataagcatttctttcctgagttcaggtgactgaggaagagccacaaaacaaaacacaacaaaaccaaaccacagaatcatctttaacccaactttttatacgatgccccagttccccataactttgcacacaagcttctgtgttcagttgaattgtaactgctttttgtatttggagagagtgactattgaacttgaaaccttttattccgggcgtcttggtagtttctggtgggattcagtgggtgagagggaagaaggggaggttggggggctccttcccttcagaacttgaagtttctcccactgcctcctctccagtggtctcccaggtgccagacccaaaagcttttcctacagtgataccctttatttttacttccccttgactcatatgttttaacatgattttaacaaactgcacttattaagaaatgtgtttgccctgttttgtttggtttcgttttgttttctttgaataaatgacatggcacctcctagcaggaaggaagcagggttgaaaccctgaagtgttactgcagttggccgttaattggggtgggggcctctttaaagggaaattatttactcattcattaaacaacttaactgaggga

SEQ ID NO: 365658 - DNA, 4019 bp, Homo sapiens
tccgctccggcctcggcttcgacgtaggccaacgcttcctccccagtagctcctaggccttctcgtggccgttgttttgaaaacggcgctctgattggctaggtttccgggcccgcgcccgttgccccacgcactgaccaattggcactcatgtaacatcggacgaggcacgagtgaggggggaggcggtggcggcggccattttgagccgctgccgccattggagtgggccccccccctttcccccttcgcctcctgacaggaaaggtttaagggggacagagccctgggaggccgggccgggctcgggggccaccccgggggcccgggccatggatgtgcgccgtctgaaggtgaacgaacttcgcgaggagctgcagcgccgcggcctggacactcgaggcctcaaggccgagcttgctgagcggctgcaggcggcgttggaggccgaggagcctgacgacgagcgggagctcgacgccgacgacgaaccggggcgacccgggcacatcaacgaggagatgccatggacaatattaccaggcagaaccaattctacgatacccaagtcatcaaacaagaaaacgagtcaggctacgagaggagaccactggaaatggagcagcagcaggcctatcgtccagaaatgaagacagagatgaagcaaggagcacccaccagcttcctcccgcctgaagcttctcaactcaagccagacaggcagcaattccagagtcgaaagaggccttatgaagaaaaccggggacgggggtactttgagcaccgagaggataggaggggccgctctcctcagcctcctgctgaagaggatgaagatgactttgatgatacccttgttgctattgacacctataactgcgacctccacttcaaggtggcccgagatcggagtagtggctatccgctcacaattgagggctttgcatacctgtggtcaggagcccgtgccagctatggggtcagaaggggccgtgtatgcttcgagatgaagatcaatgaggaaatctccgtgaagcaccttccgtctacagagcctgacccccacgtggtccgtatcggctggtccctggactcctgcagcacccagctaggcgaagagcctttctcctatggctatggaggcactgggaagaagtccaccaatagccggtttgaaaactacggagacaagtttgcagagaacgatgtgattggctgctttgcggattttgaatgtggaaatgacgtggaactgtcttttaccaagaatggaaagtggatgggcattgctttccgaatccagaaggaagccttggggggtcaggccctctatcctcatgtcctggtgaagaattgcgcagtggagttcaacttcggacagagagcagagccctactgttctgtcctcccggggtttaccttcatccagcaccttccccttagtgagcgtatccggggcaccgttggaccaaagagcaaggcagaatgtgagattctgatgatggtgggcctgcctgctgctggcaagaccacatgggccatcaaacatgcagcctccaacccttccaagaagtacaacatcctgggtaccaatgccatcatggataagatgcgggtgatgggcctacgccggcagcggaactatgctggccgctgggatgtcctgatccagcaggccacccagtgcctcaaccgcctcatccagattgctgcccgcaagaaacgcaactatatcctagatcagacaaatgtttatgggtcagcccagagacgaaaaatgagaccatttgaaggcttccagcgcaaagctattgtaatttgtcccactgacgaggacctaaaagaccgaacaataaagcgaaccgacgaggaagggaaggatgtcccagatcatgcggtcttagaaatgaaagccaacttcacgttgccagatgttggggacttcctggatgaggttctgttcattgagctgcagcgggaggaagcggacaagctagtgaggcagtacaacgaggaaggccgcaaggctgggccaccccctgaaaagcgctttgacaaccgaggtggtggtggcttccggggccgcgggggtggtggtggcttccagcgctatgaaaaccgaggaccccctggaggcaaccgtggcggcttccagaaccgagggggaggcagcggtggaggaggcaactaccgaggaggtttcaaccgcagcggaggtggtggctatagccagaaccgctggggtaacaacaaccgggataacaacaactccaacaacagaggcagctacaaccgggctccccagcaacagccgccaccacagcagcctccgccaccacagccaccaccccagcagccaccgccaccacccagctacagccctgctcggaaccccccaggggccagcacctacaataagaacagcaacatccctggctcaagcgccaataccagcacccccaccgtcagcagctacagccctccacagccgagttacagccagccaccctacaaccagggaggttacagccagggctacacagccccaccgcctccacctccaccaccacctgcctacaactatgggagctacggcggttacaacccggccccctataccccaccgccaccccccaccgcacagacctaccctcagcccagctataaccagtatcagcagtatgcccagcagtggaaccagtactatcagaaccagggccagtggccgccatactacgggaactacgactacgggagctactccgggaacacacagggtggcacaagtacacagtagccagtgtgacccagaggctcccggaggcccctgccggcttcctccaccagcgcctgcctcggcccctcctctgcccccgccagatcccgtggtgctggggatggggtcatcccagggctgcctccctccagcccactgcctcccctctgaggggcttccttcccctccatagggccaggcatttttttctggattcaaacaggcaacaatgaccttttattttctgtttgtccccacctccccagccttccacctcctgttcttcctaccttcttcctttttgactaaataatccccacctcccttgatcatacagtgaggctacagtgactgaggggagaatcccctcctgttcactctcccaaccctgctccagcccctcagcttcccagaccctcatgcagttggttgtaaattctcccaggagctgttttactgtctacttttcaggattaaaaaaaaaatcaaaacttaaaaaaaaaaaagtttaaaaagcaaaatggggagggggaggaagcagtgacttttttttggtaattatgcgcttttttttaatttttagaatttgtctttttactgtgggtgggctgttgatatttcatcaagataagcatttctttcctgagttcaggtgactgaggaagagccacaaaacaaaacacaacaaaaccaaaccacagaatcatctttaacccaactttttatacgatgccccagttccccataactttgcacacaagcttctgtgttcagttgaattgtaactgctttttgtatttggagagagtgactattgaacttgaaaccttttattccgggcgtcttggtagtttctggtgggattcagtgggtgagagggaagaaggggaggttggggggctccttcccttcagaacttgaagtttctcccactgcctcctctccagtggtctcccaggtgccagacccaaaagcttttcctacagtgataccctttatttttacttccccttgactcatatgttttaacatgattttaacaaactgcacttattaagaaatgtgtttgccctgttttgtttggtttcgttttgttttctttgaataaatgacatggcacctcctagcaggaaggaagcagggttgaaaccctgaagtgttactgcagttggccgttaattggggtgggggcctctttaaagggaaattatttactcattcattaaacaacttaactgaggga

SEQ ID NO: 365659 - DNA, 3840 bp, Homo sapiens
caggtactcacaaccccgaacgttcagactgacatagaaacacaggcacagaacacctccgatcatcacggacccacaaagggcctccagcgaagaccagcccaccgtgtctggcacgcactcgcgagcgggcgttcgcgggtgtggccggcagcaaatggagaaacccttggcagcgcccggacgccctccagtggcggctcctgagaaccggggacagttcaatccgggccacaaacttttttagaacaaatcattgtgggaagctgggaggagagagagagagaggaagtcggacgtgggcgaggggcggggtgtctggactggaacctctgggcccacatgccatggacaatattaccaggcagaaccaattctacgatacccaagtcatcaaacaagaaaacgagtcaggctacgagaggagaccactggaaatggagcagcagcaggcctatcgtccagaaatgaagacagagatgaagcaaggagcacccaccagcttcctcccgcctgaagcttctcaactcaagccagacaggcagcaattccagagtcgaaagaggccttatgaagaaaaccggggacgggggtactttgagcaccgagaggataggaggggccgctctcctcagcctcctgctgaagaggatgaagatgactttgatgatacccttgttgctattgacacctataactgcgacctccacttcaaggtggcccgagatcggagtagtggctatccgctcacaattgagggctttgcatacctgtggtcaggagcccgtgccagctatggggtcagaaggggccgtgtatgcttcgagatgaagatcaatgaggaaatctccgtgaagcaccttccgtctacagagcctgacccccacgtggtccgtatcggctggtccctggactcctgcagcacccagctaggcgaagagcctttctcctatggctatggaggcactgggaagaagtccaccaatagccggtttgaaaactacggagacaagtttgcagagaacgatgtgattggctgctttgcggattttgaatgtggaaatgacgtggaactgtcttttaccaagaatggaaagtggatgggcattgctttccgaatccagaaggaagccttggggggtcaggccctctatcctcatgtcctggtgaagaattgcgcagtggagttcaacttcggacagagagcagagccctactgttctgtcctcccggggtttaccttcatccagcaccttccccttagtgagcgtatccggggcaccgttggaccaaagagcaaggcagaatgtgagattctgatgatggtgggcctgcctgctgctggcaagaccacatgggccatcaaacatgcagcctccaacccttccaagaagtacaacatcctgggtaccaatgccatcatggataagatgcgggtgatgggcctacgccggcagcggaactatgctggccgctgggatgtcctgatccagcaggccacccagtgcctcaaccgcctcatccagattgctgcccgcaagaaacgcaactatatcctagatcagacaaatgtttatgggtcagcccagagacgaaaaatgagaccatttgaaggcttccagcgcaaagctattgtaatttgtcccactgacgaggacctaaaagaccgaacaataaagcgaaccgacgaggaagggaaggatgtcccagatcatgcggtcttagaaatgaaagccaacttcacgttgccagatgttggggacttcctggatgaggttctgttcattgagctgcagcgggaggaagcggacaagctagtgaggcagtacaacgaggaaggccgcaaggctgggccaccccctgaaaagcgctttgacaaccgaggtggtggtggcttccggggccgcgggggtggtggtggcttccagcgctatgaaaaccgaggaccccctggaggcaaccgtggcggcttccagaaccgagggggaggcagcggtggaggaggcaactaccgaggaggtttcaaccgcagcggaggtggtggctatagccagaaccgctggggtaacaacaaccgggataacaacaactccaacaacagaggcagctacaaccgggctccccagcaacagccgccaccacagcagcctccgccaccacagccaccaccccagcagccaccgccaccacccagctacagccctgctcggaaccccccaggggccagcacctacaataagaacagcaacatccctggctcaagcgccaataccagcacccccaccgtcagcagctacagccctccacagccgagttacagccagccaccctacaaccagggaggttacagccagggctacacagccccaccgcctccacctccaccaccacctgcctacaactatgggagctacggcggttacaacccggccccctataccccaccgccaccccccaccgcacagacctaccctcagcccagctataaccagtatcagcagtatgcccagcagtggaaccagtactatcagaaccagggccagtggccgccatactacgggaactacgactacgggagctactccgggaacacacagggtggcacaagtacacagtagccagtgtgacccagaggctcccggaggcccctgccggcttcctccaccagcgcctgcctcggcccctcctctgcccccgccagatcccgtggtgctggggatggggtcatcccagggctgcctccctccagcccactgcctcccctctgaggggcttccttcccctccatagggccaggcatttttttctggattcaaacaggcaacaatgaccttttattttctgtttgtccccacctccccagccttccacctcctgttcttcctaccttcttcctttttgactaaataatccccacctcccttgatcatacagtgaggctacagtgactgaggggagaatcccctcctgttcactctcccaaccctgctccagcccctcagcttcccagaccctcatgcagttggttgtaaattctcccaggagctgttttactgtctacttttcaggattaaaaaaaaaatcaaaacttaaaaaaaaaaaagtttaaaaagcaaaatggggagggggaggaagcagtgacttttttttggtaattatgcgcttttttttaatttttagaatttgtctttttactgtgggtgggctgttgatatttcatcaagataagcatttctttcctgagttcaggtgactgaggaagagccacaaaacaaaacacaacaaaaccaaaccacagaatcatctttaacccaactttttatacgatgccccagttccccataactttgcacacaagcttctgtgttcagttgaattgtaactgctttttgtatttggagagagtgactattgaacttgaaaccttttattccgggcgtcttggtagtttctggtgggattcagtgggtgagagggaagaaggggaggttggggggctccttcccttcagaacttgaagtttctcccactgcctcctctccagtggtctcccaggtgccagacccaaaagcttttcctacagtgataccctttatttttacttccccttgactcatatgttttaacatgattttaacaaactgcacttattaagaaatgtgtttgccctgttttgtttggtttcgttttgttttctttgaataaatgacatggcacctcctagcaggaaggaagcagggttgaaaccctgaagtgttactgcagttggccgttaattggggtgggggcctctttaaagggaaattatttactcattcattaaacaacttaactgaggga

SEQ ID NO: 365660 - DNA, 4152 bp, Homo sapiens
tccgctccggcctcggcttcgacgtaggccaacgcttcctccccagtagctcctaggccttctcgtggccgttgttttgaaaacggcgctctgattggctaggtttccgggcccgcgcccgttgccccacgcactgaccaattggcactcatgtaacatcggacgaggcacgagtgaggggggaggcggtggcggcggccattttgagccgctgccgccattggagtgggccccccccctttcccccttcgcctcctgacaggaaaggtttaagggggacagagccctgggaggccgggccgggctcgggggccaccccgggggcccgggccatggatgtgcgccgtctgaaggtgaacgaacttcgcgaggagctgcagcgccgcggcctggacactcgaggcctcaaggccgagcttgctgagcggctgcaggcggcgttggaggccgaggagcctgacgacgagcgggagctcgacgccgacgacgaaccggggcgacccgggcacatcaacgaggaggtcgagaccgaggggggctccgagctggaggggaccgcgcagccaccgccgcccgggctgcagccgcacgcggagcccggcggctactcggggccggacggacattatgccatggacaatattaccaggcagaaccaattctacgatacccaagtcatcaaacaagaaaacgagtcaggctacgagaggagaccactggaaatggagcagcagcaggcctatcgtccagaaatgaagacagagatgaagcaaggagcacccaccagcttcctcccgcctgaagcttctcaactcaagccagacaggcagcaattccagagtcgaaagaggccttatgaagaaaaccggggacgggggtactttgagcaccgagaggataggaggggccgctctcctcagcctcctgctgaagaggatgaagatgactttgatgatacccttgttgctattgacacctataactgcgacctccacttcaaggtggcccgagatcggagtagtggctatccgctcacaattgagggctttgcatacctgtggtcaggagcccgtgccagctatggggtcagaaggggccgtgtatgcttcgagatgaagatcaatgaggaaatctccgtgaagcaccttccgtctacagagcctgacccccacgtggtccgtatcggctggtccctggactcctgcagcacccagctaggcgaagagcctttctcctatggctatggaggcactgggaagaagtccaccaatagccggtttgaaaactacggagacaagtttgcagagaacgatgtgattggctgctttgcggattttgaatgtggaaatgacgtggaactgtcttttaccaagaatggaaagtggatgggcattgctttccgaatccagaaggaagccttggggggtcaggccctctatcctcatgtcctggtgaagaattgcgcagtggagttcaacttcggacagagagcagagccctactgttctgtcctcccggggtttaccttcatccagcaccttccccttagtgagcgtatccggggcaccgttggaccaaagagcaaggcagaatgtgagattctgatgatggtgggcctgcctgctgctggcaagaccacatgggccatcaaacatgcagcctccaacccttccaagaagtacaacatcctgggtaccaatgccatcatggataagatgcgggtgatgggcctacgccggcagcggaactatgctggccgctgggatgtcctgatccagcaggccacccagtgcctcaaccgcctcatccagattgctgcccgcaagaaacgcaactatatcctagatcagacaaatgtttatgggtcagcccagagacgaaaaatgagaccatttgaaggcttccagcgcaaagctattgtaatttgtcccactgacgaggacctaaaagaccgaacaataaagcgaaccgacgaggaagggaaggatgtcccagatcatgcggtcttagaaatgaaagccaacttcacgttgccagatgttggggacttcctggatgaggttctgttcattgagctgcagcgggaggaagcggacaagctagtgaggcagtacaacgaggaaggccgcaaggctgggccaccccctgaaaagcgctttgacaaccgaggtggtggtggcttccggggccgcgggggtggtggtggcttccagcgctatgaaaaccgaggaccccctggaggcaaccgtggcggcttccagaaccgagggggaggcagcggtggaggaggcaactaccgaggaggtttcaaccgcagcggaggtggtggctatagccagaaccgctggggtaacaacaaccgggataacaacaactccaacaacagaggcagctacaaccgggctccccagcaacagccgccaccacagcagcctccgccaccacagccaccaccccagcagccaccgccaccacccagctacagccctgctcggaaccccccaggggccagcacctacaataagaacagcaacatccctggctcaagcgccaataccagcacccccaccgtcagcagctacagccctccacagccgagttacagccagccaccctacaaccagggaggttacagccagggctacacagccccaccgcctccacctccaccaccacctgcctacaactatgggagctacggcggttacaacccggccccctataccccaccgccaccccccaccgcacagacctaccctcagcccagctataaccagtatcagcagtatgcccagcagtggaaccagtactatcagaaccagggccagtggccgccatactacgggaactacgactacgggagctactccgggaacacacagggtggcacaagtacacagtagccagtgtgacccagaggctcccggaggcccctgccggcttcctccaccagcgcctgcctcggcccctcctctgcccccgccagatcccgtggtgctggggatggggtcatcccagggctgcctccctccagcccactgcctcccctctgaggggcttccttcccctccatagggccaggcatttttttctggattcaaacaggcaacaatgaccttttattttctgtttgtccccacctccccagccttccacctcctgttcttcctaccttcttcctttttgactaaataatccccacctcccttgatcatacagtgaggctacagtgactgaggggagaatcccctcctgttcactctcccaaccctgctccagcccctcagcttcccagaccctcatgcagttggttgtaaattctcccaggagctgttttactgtctacttttcaggattaaaaaaaaaatcaaaacttaaaaaaaaaaaagtttaaaaagcaaaatggggagggggaggaagcagtgacttttttttggtaattatgcgcttttttttaatttttagaatttgtctttttactgtgggtgggctgttgatatttcatcaagataagcatttctttgaactcagggaaagaaatgcttatcttcctgagttcaggtgactgaggaagagccacaaaacaaaacacaacaaaaccaaaccacagaatcatctttaacccaactttttatacgatgccccagttccccataactttgcacacaagcttctgtgttcagttgaattgtaactgctttttgtatttggagagagtgactattgaacttgaaaccttttattccgggcgtcttggtagtttctggtgggattcagtgggtgagagggaagaaggggaggttggggggctccttcccttcagaacttgaagtttctcccactgcctcctctccagtggtctcccaggtgccagacccaaaagcttttcctacagtgataccctttatttttacttccccttgactcatatgttttaacatgattttaacaaactgcacttattaagaaatgtgtttgccctgttttgtttggtttcgttttgttttctttgaataaatgacatggcacctcctagcaggaaggaagcagggttgaaaccctgaagtgttactgcagttggccgttaattggggtgggggcctctttaaagggaaattatttactcattcattaaacaacttaactgaggga

SEQ ID NO: 365661 - DNA, 4066 bp, Homo sapiens
tccgctccggcctcggcttcgacgtaggccaacgcttcctccccagtagctcctaggccttctcgtggccgttgttttgaaaacggcgctctgattggctaggtttccgggcccgcgcccgttgccccacgcactgaccaattggcactcatgtaacatcggacgaggcacgagtgaggggggaggcggtggcggcggccattttgagccgctgccgccattggagtgggccccccccctttcccccttcgcctcctgacaggaaaggtttaagggggacagagccctgggaggccgggccgggctcgggggccaccccgggggcccgggccatggatgtgcgccgtctgaaggtgaacgaacttcgcgaggagctgcagcgccgcggcctggacactcgaggcctcaaggccgagcttgctgagcggctgcaggcggcgttggaggccgaggagcctgacgacgagcgggagctcgacgccgacgacgaaccggggcgacccgggcacatcaacgaggaggtcgagaccgaggggggctccgagctggaggggaccgcgcagccaccgccgcccgggctgcagccgcacgcggagcccggcggctactcggggccggacggacattatgccatggacaatattaccaggcagaaccaattctacgatacccaagtcatcaaacaagaaaacgagtcaggctacgagaggagaccactggaaatggagcagcagcaggcctatcgtccagaaatgaagacagagatgaagcaaggagcacccaccagcttcctcccgcctgaagcttctcaactcaagccagacaggcagcaattccagagtcgaaagaggccttatgaagaaaaccggggacgggggtactttgagcaccgagaggataggaggggccgctctcctcagcctcctgctgaagaggatgaagatgactttgatgatacccttgttgctattgacacctataactgcgacctccacttcaaggtggcccgagatcggagtagtggctatccgctcacaattgagggctttgcatacctgtggtcaggagcccgtgccagctatggggtcagaaggggccgtgtatgcttcgagatgaagatcaatgaggaaatctccgtgaagcaccttccgtctacagagcctgacccccacgtggtccgtatcggctggtccctggactcctgcagcacccagctaggcgaagagcctttctcctatggctatggaggcactgggaagaagtccaccaatagccggtttgaaaactacggagacaagtttgcagagaacgatgtgattggctgctttgcggattttgaatgtggaaatgacgtggaactgtcttttaccaagaatggaaagtggatgggcattgctttccgaatccagaaggaagccttggggggtcaggccctctatcctcatgtcctggtgaagaattgcgcagtggagttcaacttcggacagagagcagagccctactgttctgtcctcccggggtttaccttcatccagcaccttccccttagtgagcgtatccggggcaccgttggaccaaagagcaaggcagaatgtgagattctgatgatggtgggcctgcctgctgctggcaagaccacatgggccatcaaacatgcagcctccaacccttccaagaagtacaacatcctgggtaccaatgccatcatggataagatgcgggtgatgggcctacgccggcagcggaactatgctggccgctgggatgtcctgatccagcaggccacccagtgcctcaaccgcctcatccagattgctgcccgcaagaaacgcaactatatcctagatcagacaaatgtttatgggtcagcccagagacgaaaaatgagaccatttgaaggcttccagcgcaaagctattgtaatttgtcccactgacgaggacctaaaagaccgaacaataaagcgaaccgacgaggaagggaaggatgtcccagatcatgcggtcttagaaatgaaagccaacttcacgttgccagatgttggggacttcctggatgaggttctgttcattgagctgcagcgggaggaagcggacaagctagtgaggcagtacaacgaggaaggccgcaaggctgggccaccccctgaaaagcgctttgacaaccgaggtggtggtggcttccggggccgcgggggtggtggtggcttccagcgctatgaaaaccgaggaccccctggaggcaaccgtggcggcttccagaaccgagggggaggcagcggtggaggaggcaactaccgaggaggtttcaaccgcagcggaggtggtggctatagccagaaccgctggggtaacaacaaccgggataacaacaactccaacaacagaggcagctacaaccgggctccccagcaacagccgccaccacagcagcctccgccaccacagccaccaccccagcagccaccgccaccacccagctacagccctgctcggaaccccccaggggccagcacctacaataagaacagcaacatccctggctcaagcgccaataccagcacccccaccgtcagcagctacagccctccacagccgagttacagccagccaccctacaaccagggaggttacagccagggctacacagccccaccgcctccacctccaccaccacctgcctacaactatgggagctacggcggttacaacccggccccctataccccaccgccaccccccaccgcacagacctaccctcagcccagctataaccagtatcagcagtatgcccagcagtggaaccagtactatcagaaccagggccagtggccgccatactacgggaactacgactacgggagctactccgggaacacacagggtggcacaagtacacagtagccagtgtgacccagaggctcccggaggcccctgccggcttcctccaccagcgcctgcctcggcccctcctctgcccccgccagatcccgtggtgctggggatggggtcatcccagggctgcctccctccagcccactgcctcccctctgaggggcttccttcccctccatagggccaggcatttttttctggattcaaacaggcaacaatgaccttttattttctgtttgtccccacctccccagccttccacctcctgttcttcctaccttcttcctttttgactaaataatccccacctcccttgatcatacagtgaggctacagtgactgaggggagaatcccctcctgttcactctcccaaccctgctccagcccctcagcttcccagaccctcatgcagttggttgtaaattctcccaggagctgttttactgtctacttttcaggattaaaaaaaaaatcaaaacttaaaaaaaaaaaagtttaaaaagcaaaatggggagggggaggaagcagtgacttttttttggtaattatgcgcttttttttaatttttagaatttgtctttttactgtgggtgggctgttgatatttcatcaagataagcatttctttcctgagttcaggtgactgaggaagagccacaaaacaaaacccccataactttgcacacaagcttctgtgttcagttgaattgtaactgctttttgtatttggagagagtgactattgaacttgaaaccttttattccgggcgtcttggtagtttctggtgggattcagtgggtgagagggaagaaggggaggttggggggctccttcccttcagaacttgaagtttctcccactgcctcctctccagtggtctcccaggtgccagacccaaaagcttttcctacagtgataccctttatttttacttccccttgactcatatgttttaacatgattttaacaaactgcacttattaagaaatgtgtttgccctgttttgtttggtttcgttttgttttctttgaataaatgacatggcacctcctagcaggaaggaagcagggttgaaaccctgaagtgttactgcagttggccgttaattggggtgggggcctctttaaagggaaattatttactcattcattaaacaacttaactgaggga

SEQ ID NO: 365662 - DNA, 3347 bp, Homo sapiens
aaactataggctaggtacgaggctgggtgttaatcggccgaggcacaggcagcaattccagagtcgaaagaggccttatgaagaaaaccggggacgggggtactttgagcaccgagaggataggaggggccgctctcctcagcctcctgctgaagaggatgaagatgactttgatgatacccttgttgctattgacacctataactgcgacctccacttcaaggtggcccgagatcggagtagtggctatccgctcacaattgagggctttgcatacctgtggtcaggagcccgtgccagctatggggtcagaaggggccgtgtatgcttcgagatgaagatcaatgaggaaatctccgtgaagcaccttccgtctacagagcctgacccccacgtggtccgtatcggctggtccctggactcctgcagcacccagctaggcgaagagcctttctcctatggctatggaggcactgggaagaagtccaccaatagccggtttgaaaactacggagacaagtttgcagagaacgatgtgattggctgctttgcggattttgaatgtggaaatgacgtggaactgtcttttaccaagaatggaaagtggatgggcattgctttccgaatccagaaggaagccttggggggtcaggccctctatcctcatgtcctggtgaagaattgcgcagtggagttcaacttcggacagagagcagagccctactgttctgtcctcccggggtttaccttcatccagcaccttccccttagtgagcgtatccggggcaccgttggaccaaagagcaaggcagaatgtgagattctgatgatggtgggcctgcctgctgctggcaagaccacatgggccatcaaacatgcagcctccaacccttccaagaagtacaacatcctgggtaccaatgccatcatggataagatgcgggtgatgggcctacgccggcagcggaactatgctggccgctgggatgtcctgatccagcaggccacccagtgcctcaaccgcctcatccagattgctgcccgcaagaaacgcaactatatcctagatcagacaaatgtttatgggtcagcccagagacgaaaaatgagaccatttgaaggcttccagcgcaaagctattgtaatttgtcccactgacgaggacctaaaagaccgaacaataaagcgaaccgacgaggaagggaaggatgtcccagatcatgcggtcttagaaatgaaagccaacttcacgttgccagatgttggggacttcctggatgaggttctgttcattgagctgcagcgggaggaagcggacaagctagtgaggcagtacaacgaggaaggccgcaaggctgggccaccccctgaaaagcgctttgacaaccgaggtggtggtggcttccggggccgcgggggtggtggtggcttccagcgctatgaaaaccgaggaccccctggaggcaaccgtggcggcttccagaaccgagggggaggcagcggtggaggaggcaactaccgaggaggtttcaaccgcagcggaggtggtggctatagccagaaccgctggggtaacaacaaccgggataacaacaactccaacaacagaggcagctacaaccgggctccccagcaacagccgccaccacagcagcctccgccaccacagccaccaccccagcagccaccgccaccacccagctacagccctgctcggaaccccccaggggccagcacctacaataagaacagcaacatccctggctcaagcgccaataccagcacccccaccgtcagcagctacagccctccacagccgagttacagccagccaccctacaaccagggaggttacagccagggctacacagccccaccgcctccacctccaccaccacctgcctacaactatgggagctacggcggttacaacccggccccctataccccaccgccaccccccaccgcacagacctaccctcagcccagctataaccagtatcagcagtatgcccagcagtggaaccagtactatcagaaccagggccagtggccgccatactacgggaactacgactacgggagctactccgggaacacacagggtggcacaagtacacagtagccagtgtgacccagaggctcccggaggcccctgccggcttcctccaccagcgcctgcctcggcccctcctctgcccccgccagatcccgtggtgctggggatggggtcatcccagggctgcctccctccagcccactgcctcccctctgaggggcttccttcccctccatagggccaggcatttttttctggattcaaacaggcaacaatgaccttttattttctgtttgtccccacctccccagccttccacctcctgttcttcctaccttcttcctttttgactaaataatccccacctcccttgatcatacagtgaggctacagtgactgaggggagaatcccctcctgttcactctcccaaccctgctccagcccctcagcttcccagaccctcatgcagttggttgtaaattctcccaggagctgttttactgtctacttttcaggattaaaaaaaaaatcaaaacttaaaaaaaaaaaagtttaaaaagcaaaatggggagggggaggaagcagtgacttttttttggtaattatgcgcttttttttaatttttagaatttgtctttttactgtgggtgggctgttgatatttcatcaagataagcatttctttcctgagttcaggtgactgaggaagagccacaaaacaaaacacaacaaaaccaaaccacagaatcatctttaacccaactttttatacgatgccccagttccccataactttgcacacaagcttctgtgttcagttgaattgtaactgctttttgtatttggagagagtgactattgaacttgaaaccttttattccgggcgtcttggtagtttctggtgggattcagtgggtgagagggaagaaggggaggttggggggctccttcccttcagaacttgaagtttctcccactgcctcctctccagtggtctcccaggtgccagacccaaaagcttttcctacagtgataccctttatttttacttccccttgactcatatgttttaacatgattttaacaaactgcacttattaagaaatgtgtttgccctgttttgtttggtttcgttttgttttctttgaataaatgacatggcacctcctagcaggaaggaagcagggttgaaaccctgaagtgttactgcagttggccgttaattggggtgggggcctctttaaagggaaattatttactcattcattaaacaacttaactgaggga

SEQ ID NO: 365663 - DNA, 3519 bp, Homo sapiens
tccgctccggcctcggcttcgacgtaggccaacgcttcctccccagtagctcctaggccttctcgtggccgttgttttgaaaacggcgctctgattggctaggtttccgggcccgcgcccgttgccccacgcactgaccaattggcactcatgtaacatcggacgaggcacgagtgaggggggaggcggtggcggcggccattttgagccgctgccgccattggagtgggccccccccctttcccccttcgcctcctgacaggaaaggtttaagggggacagagccctgggaggccgggccgggctcgggggccaccccgggggcccgggccatggatgtgcgccgtctgaaggtgaacgaacttcgcgaggagctgcagcgccgcggcctggacactcgaggcctcaaggccgagcttgctgagcggctgcaggcggcgttggaggccgaggagcctgacgacgagcgggagctcgacgccgacgacgaaccggggcgacccgggcacatcaacgaggaggtcgagaccgaggggggctccgagctggaggggaccgcgcagccaccgccgcccgggctgcagccgcacgcggagcccggcggctactcggggccggacggacattatgccatggacaatattaccaggcagaaccaattctacgatacccaagtcatcaaacaagaaaacgagtcaggctacgagaggagaccactggaaatggagcagcagcaggcctatcgtccagaaatgaagacagagatgaagcaaggagcacccaccagcttcctcccgcctgaagcttctcaactcaagccagacaggcagcaattccagagtcgaaagaggccttatgaagaaaaccggggacgggggtactttgagcaccgagaggataggaggggccgctctcctcagcctcctgctgaagaggatgaagatgactttgatgatacccttgttgctattgacacctataactgcgacctccacttcaaggtggcccgagatcggagtagtggctatccgctcacaattgagggctttgcatacctgtggtcaggagcccgtgccagctatggggtcagaaggggccgtgtatgcttcgagatgaagatcaatgaggaaatctccgtgaagcaccttccgtctacagagcctgacccccacgtggtccgtatcggctggtccctggactcctgcagcacccagctaggcgaagagcctttctcctatggctatggaggcactgggaagaagtccaccaatagccggtttgaaaactacggagacaagtttgcagagaacgatgtgattggctgctttgcggattttgaatgtggaaatgacgtggaactgtcttttaccaagaatggaaagtggatgggcattgctttccgaatccagaaggaagccttggggggtcaggccctctatcctcatgtcctggtgaagaattgcgcagtggagttcaacttcggacagagagcagagccctactgttctgtcctcccggggtttaccttcatccagcaccttccccttagtgagcgtatccggggcaccgttggaccaaagagcaaggcagaatgtgagattctgatgatggtgggcctgcctgctgctggcaagaccacatgggccatcaaacatgcagcctccaacccttccaagaagtacaacatcctgggtaccaatgccatcatggataagatgcgggtgatgggcctacgccggcagcggaactatgctggccgctgggatgtcctgatccagcaggccacccagtgcctcaaccgcctcatccagattgctgcccgcaagaaacgcaactatatcctagatcagacaaatgtttatgggtcagcccagagacgaaaaatgagaccatttgaaggcttccagcgcaaagctattgtaatttgtcccactgacgaggacctaaaagaccgaacaataaagcgaaccgacgaggaagggaaggatgtcccagatcatgcggtcttagaaatgaaagccaacttcacgttgccagatgttggggacttcctggatgaggttctgttcattgagctgcagcgggaggaagcggacaagctagtgaggcagtacaacgaggaaggccgcaaggctgggccaccccctgaaaagcgctttgacaaccgaggtggtggtggcttccggggccgcgggggtggtggtggcttccagcgctatgaaaaccgaggaccccctggaggcaaccgtggcggcttccagaaccgagggggaggcagcggtggaggaggcaactaccgaggaggtttcaaccgcagcggaggtggtggctatagccagaaccgctggggtaacaacaaccgggataacaacaactccaacaacagaggcagctacaaccgggctccccagcaacagccgccaccacagcagcctccgccaccacagccaccaccccagcagccaccgccaccacccagctacagccctgctcggaaccccccaggggccagcacctacaataagaacagcaacatccctggctcaagcgccaataccagcacccccaccgtcagcagctacagccctccacagccgagttacagccagccaccctacaaccagggaggttacagccagggctacacagccccaccgcctccacctccaccaccacctgcctacaactatgggagctacggcggttacaacccggccccctataccccaccgccaccccccaccgcacagacctaccctcagcccagctataaccagtatcagcagtatgcccagcagtggaaccagtactatcagaaccagggccagtggccgccatactacgggaactacgactacgggagctactccgggaacacacagggtggcacaagtacacagtagccagtgtgacccagaggctcccggaggcccctgccggcttcctccaccagcgcctgcctcggcccctcctctgcccccgccagatcccgtggtgctggggatggggtcatcccagggctgcctccctccagcccactgcctcccctctgaggggcttccttcccctccatagggccaggcatttttttctggattcaaacaggcaacaatgaccttttattttctgtttgtccccacctccccagccttccacctcctgttcttcctaccttcttcctttttgactaaataatccccacctcccttgatcatacagtgaggctacagtgactgaggggagaatcccctcctgttcactctcccaaccctgctccagcccctcagcttcccagaccctcatgcagttggttgtaaattctcccaggagctgttttactgtctacttttcaggattaaaaaaaaaatcaaaacttaaaaaaaaaaaaaaaaaaaaaaactcgaggggggcccgacccaatcccccttaagagtcgtttcccatcactggccgcggtttaaacccctgacgggaaaccctggcttccccaataaatgccttggaaacatccccttttcc

SEQ ID NO: 365664 - DNA, 3475 bp, Homo sapiens
agcactagactaacttcaaattaaaccacccctgcagcaaaactcaattcttggctgcagacactgcccatcccagcttctacttgctggtattaatggctcaacacccccaagggaacatttatgggtctcctcccctggccctacctaggatcccatcccccaactcacgtgccatggctggggggatgttgcaggtcctgacctgagaagatggggtgaagtagtgggtgaaggtgaagtgcagtggcagctgctgcagcaggccgtggagcaagtagggtggggtagagggcagcatgtgggacagggtgaaaggtgaagggcccaggatggatggctgaggcgggaatgatgtggatgggatggctagcgagaaaggtggcagggtggccagggatgattgagtgagtgaggtgggacaaagaaataggggtcagatggggccgtgtatgcttcgagatgaagatcaatgaggaaatctccgtgaagcaccttccgtctacagagcctgacccccacgtggtccgtatcggctggtccctggactcctgcagcacccagctaggcgaagagcctttctcctatggctatggaggcactgggaagaagtccaccaatagccggtttgaaaactacggagacaagtttgcagagaacgatgtgattggctgctttgcggattttgaatgtggaaatgacgtggaactgtcttttaccaagaatggaaagtggatgggcattgctttccgaatccagaaggaagccttggggggtcaggccctctatcctcatgtcctggtgaagaattgcgcagtggagttcaacttcggacagagagcagagccctactgttctgtcctcccggggtttaccttcatccagcaccttccccttagtgagcgtatccggggcaccgttggaccaaagagcaaggcagaatgtgagattctgatgatggtgggcctgcctgctgctggcaagaccacatgggccatcaaacatgcagcctccaacccttccaagaagtacaacatcctgggtaccaatgccatcatggataagatgcgggtgatgggcctacgccggcagcggaactatgctggccgctgggatgtcctgatccagcaggccacccagtgcctcaaccgcctcatccagattgctgcccgcaagaaacgcaactatatcctagatcagacaaatgtttatgggtcagcccagagacgaaaaatgagaccatttgaaggcttccagcgcaaagctattgtaatttgtcccactgacgaggacctaaaagaccgaacaataaagcgaaccgacgaggaagggaaggatgtcccagatcatgcggtcttagaaatgaaagccaacttcacgttgccagatgttggggacttcctggatgaggttctgttcattgagctgcagcgggaggaagcggacaagctagtgaggcagtacaacgaggaaggccgcaaggctgggccaccccctgaaaagcgctttgacaaccgaggtggtggtggcttccggggccgcgggggtggtggtggcttccagcgctatgaaaaccgaggaccccctggaggcaaccgtggcggcttccagaaccgagggggaggcagcggtggaggaggcaactaccgaggaggtttcaaccgcagcggaggtggtggctatagccagaaccgctggggtaacaacaaccgggataacaacaactccaacaacagaggcagctacaaccgggctccccagcaacagccgccaccacagcagcctccgccaccacagccaccaccccagcagccaccgccaccacccagctacagccctgctcggaaccccccaggggccagcacctacaataagaacagcaacatccctggctcaagcgccaataccagcacccccaccgtcagcagctacagccctccacagccgagttacagccagccaccctacaaccagggaggttacagccagggctacacagccccaccgcctccacctccaccaccacctgcctacaactatgggagctacggcggttacaacccggccccctataccccaccgccaccccccaccgcacagacctaccctcagcccagctataaccagtatcagcagtatgcccagcagtggaaccagtactatcagaaccagggccagtggccgccatactacgggaactacgactacgggagctactccgggaacacacagggtggcacaagtacacagtagccagtgtgacccagaggctcccggaggcccctgccggcttcctccaccagcgcctgcctcggcccctcctctgcccccgccagatcccgtggtgctggggatggggtcatcccagggctgcctccctccagcccactgcctcccctctgaggggcttccttcccctccatagggccaggcatttttttctggattcaaacaggcaacaatgaccttttattttctgtttgtccccacctccccagccttccacctcctgttcttcctaccttcttcctttttgactaaataatccccacctcccttgatcatacagtgaggctacagtgactgaggggagaatcccctcctgttcactctcccaaccctgctccagcccctcagcttcccagaccctcatgcagttggttgtaaattctcccaggagctgttttactgtctacttttcaggattaaaaaaaaaatcaaaacttaaaaaaaaaaaagtttaaaaagcaaaatggggagggggaggaagcagtgacttttttttggtaattatgcgcttttttttaatttttagaatttgtctttttactgtgggtgggctgttgatatttcatcaagataagcatttctttcctgagttcaggtgactgaggaagagccacaaaacaaaacacaacaaaaccaaaccacagaatcatctttaacccaactttttatacgatgccccagttccccataactttgcacacaagcttctgtgttcagttgaattgtaactgctttttgtatttggagagagtgactattgaacttgaaaccttttattccgggcgtcttggtagtttctggtgggattcagtgggtgagagggaagaaggggaggttggggggctccttcccttcagaacttgaagtttctcccactgcctcctctccagtggtctcccaggtgccagacccaaaagcttttcctacagtgataccctttatttttacttccccttgactcatatgttttaacatgattttaacaaactgcacttattaagaaatgtgtttgccctgttttgtttggtttcgttttgttttctttgaataaatgacatggcacctcctagcaggaaggaagcagggttgaaaccctgaagtgttactgcagttggccgttaattggggtgggggcctctttaaagggaaattatttactcattcattaaacaacttaactgaggga

SEQ ID NO: 365665 - DNA, 3970 bp, Homo sapiens
tccgctccggcctcggcttcgacgtaggccaacgcttcctccccagtagctcctaggccttctcgtggccgttgttttgaaaacggcgctctgattggctaggtttccgggcccgcgcccgttgccccacgcactgaccaattggcactcatgtaacatcggacgaggcacgagtgaggggggaggcggtggcggcggccattttgagccgctgccgccattggagtgggccccccccctttcccccttcgcctcctgacaggaaaggtttaagggggacagagccctgggaggccgggccgggctcgggggccaccccgggggcccgggccatggatgtgcgccgtctgaaggtgaacgaacttcgcgaggagctgcagcgccgcggcctggacactcgaggcctcaaggccgagcttgctgagcggctgcaggcggcgttggaggccgaggagcctgacgacgagcgggagctcgacgccgacgacgaaccggggcgacccgggcacatcaacgaggaggtcgagaccgaggggggctccgagctggaggggaccgcgcagccaccgccgcccgggctgcagccgcacgcggagcccggcggctactcggggccggacggacattatgccatggacaatattaccaggcagaaccaattctacgatacccaagtcatcaaacaagaaaacgagtcaggctacgagaggagaccactggaaatggagcagcagcaggcctatcgtccagaaatgaagacagagatgaagcaaggagcacccaccagcttcctcccgcctgaagcttctcaactcaagccagacaggcagcaattccagagtcgaaagaggccttatgaagaaaaccggggacgggggtactttgagcaccgagaggataggaggggccgctctcctcagcctcctgctgaagaggatgaagatgactttgatgatacccttgttgctattgacacctataactgcgacctccacttcaaggtggcccgagatcggagtagtggctatccgctcacaattgagggctttgcatacctgtggtcaggagcccgtgccagctatggggtcagaaggggccgtgtatgcttcgagatgaagatcaatgaggaaatctccgtgaagcaccttccgtctacagagcctgacccccacgtggtccgtatcggctggtccctggactcctgcagcacccagctaggcgaagagcctttctcctatggctatggaggcactgggaagaagtccaccaatagccggtttgaaaactacggagacaagtttgcagagaacgatgtgattggctgctttgcggattttgaatgtggaaatgacgtggaactgtcttttaccaagaatggaaagtggatgggcattgctttccgaatccagaaggaagccttggggggtcaggccctctatcctcatgtcctggtgaagaattgcgcagtggagttcaacttcggacagagagcagagccctactgttctgtcctcccggggtttaccttcatccagcaccttccccttagtgagcgtatccggggcaccgttggaccaaagagcaaggcagaatgtgagattctgatgatggtgggcctgcctgctgctggcaagaccacatgggccatcaaacatgcagcctccaacccttccaagaagtacaacatcctgggtaccaatgccatcatggataagatgcgggtgatgggcctacgccggcagcggaactatgctggccgctgggatgtcctgatccagcaggccacccagtgcctcaaccgcctcatccagattgctgcccgcaagaaacgcaactatatcctagatcagacaaatgtttatgggtcagcccagagacgaaaaatgagaccatttgaaggcttccagcgcaaagctattgtaatttgtcccactgacgaggacctaaaagaccgaacaataaagcgaaccgacgaggaagggaaggatgtcccagatcatgcggtcttagaaatgaaagccaacttcacgttgccagatgttggggacttcctggatgaggttctgttcattgagctgcagcgggaggaagcggacaagctagtgaggcagtacaacgaggaaggccgcaaggctgggccaccccctgaaaagcgctttgacaaccgaggtggtggtggcttccggggccgcgggggtggtggtggcttccagcgctatgaaaaccgaggaccccctggaggcaaccgtggcggcttccagaaccgagggggaggcagcggtggaggaggcaactaccgaggaggtttcaaccgcagcggaggtggtggctatagccagaaccgctggggtaacaacaaccgggataacaacaactccaacaacagaggcagctacaaccgggctccccagcaacagccgccaccacagcagcctccgcccgagttacagccagccaccctacaaccagggaggttacagccagggctacacagccccaccgcctccacctccaccaccacctgcctacaactatgggagctacggcggttacaacccggccccctataccccaccgccaccccccaccgcacagacctaccctcagcccagctataaccagtatcagcagtatgcccagcagtggaaccagtactatcagaaccagggccagtggccgccatactacgggaactacgactacgggagctactccgggaacacacagggtggcacaagtacacagtagccagtgtgacccagaggctcccggaggcccctgccggcttcctccaccagcgcctgcctcggcccctcctctgcccccgccagatcccgtggtgctggggatggggtcatcccagggctgcctccctccagcccactgcctcccctctgaggggcttccttcccctccatagggccaggcatttttttctggattcaaacaggcaacaatgaccttttattttctgtttgtccccacctccccagccttccacctcctgttcttcctaccttcttcctttttgactaaataatccccacctcccttgatcatacagtgaggctacagtgactgaggggagaatcccctcctgttcactctcccaaccctgctccagcccctcagcttcccagaccctcatgcagttggttgtaaattctcccaggagctgttttactgtctacttttcaggattaaaaaaaaaatcaaaacttaaaaaaaaaaaagtttaaaaagcaaaatggggagggggaggaagcagtgacttttttttggtaattatgcgcttttttttaatttttagaatttgtctttttactgtgggtgggctgttgatatttcatcaagataagcatttctttcctgagttcaggtgactgaggaagagccacaaaacaaaacacaacaaaaccaaaccacagaatcatctttaacccaactttttatacgatgccccagttccccataactttgcacacaagcttctgtgttcagttgaattgtaactgctttttgtatttggagagagtgactattgaacttgaaaccttttattccgggcgtcttggtagtttctggtgggattcagtgggtgagagggaagaaggggaggttggggggctccttcccttcagaacttgaagtttctcccactgcctcctctccagtggtctcccaggtgccagacccaaaagcttttcctacagtgataccctttatttttacttccccttgactcatatgttttaacatgattttaacaaactgcacttattaagaaatgtgtttgccctgttttgtttggtttcgttttgttttctttgaataaatgacatggcacctcctagcaggaaggaagcagggttgaaaccctgaagtgttactgcagttggccgttaattggggtgggggcctctttaaagggaaattatttactcattcattaaacaacttaactgaggga

SEQ ID NO: 365666 - DNA, 3844 bp, Homo sapiens
caggtactcacaaccccgaacgttcagactgacatagaaacacaggcacagaacacctccgatcatcacggacccacaaagggcctccagcgaagaccagcccaccgtgtctggcacgcactcgcgagcgggcgttcgcgggtgtggccggcagcaaatggagaaacccttggcagcgcccggacgccctccagtggcggctcctgagaaccggggacagttcaatccgggccacaaacttttttagaacaaatcattgtgggaagctgggaggagagagagagagaggaagtcggacgtgggcgaggggcggggtgtctggactggaacctctgggcccacatgccatggacaatattaccaggcagaaccaattctacgatacccaagtcatcaaacaagaaaacgagtcaggctacgagaggagaccactggaaatggagcagcagcaggcctatcgtccagaaatgaagacagagatgaagcaaggagcacccaccagcttcctcccgcctgaagcttctcaactcaagccagacaggcagcaattccagagtcgaaagaggccttatgaagaaaaccggggacgggggtactttgagcaccgagaggataggaggggccgctctcctcagcctcctgctgaagaggatgaagatgactttgatgatacccttgttgctattgacacctataactgcgacctccacttcaaggtggcccgagatcggagtagtggctatccgctcacaattgagggctttgcatacctgtggtcaggagcccgtgccagctatggggtcagaaggggccgtgtatgcttcgagatgaagatcaatgaggaaatctccgtgaagcaccttccgtctacagagcctgacccccacgtggtccgtatcggctggtccctggactcctgcagcacccagctaggcgaagagcctttctcctatggctatggaggcactgggaagaagtccaccaatagccggtttgaaaactacggagacaagtttgcagagaacgatgtgattggctgctttgcggattttgaatgtggaaatgacgtggaactgtcttttaccaagaatggaaagtggatgggcattgctttccgaatccagaaggaagccttggggggtcaggccctctatcctcatgtcctggtgaagaattgcgcagtggagttcaacttcggacagagagcagagccctactgttctgtcctcccggggtttaccttcatccagcaccttccccttagtgagcgtatccggggcaccgttggaccaaagagcaaggcagaatgtgagattctgatgatggtgggcctgcctgctgctggcaagaccacatgggccatcaaacatgcagcctccaacccttccaagaagtacaacatcctgggtaccaatgccatcatggataagatgcgggtgatgggcctacgccggcagcggaactatgctggccgctgggatgtcctgatccagcaggccacccagtgcctcaaccgcctcatccagattgctgcccgcaagaaacgcaactatatcctagatcagacaaatgtttatgggtcagcccagagacgaaaaatgagaccatttgaaggcttccagcgcaaagctattgtaatttgtcccactgacgaggacctaaaagaccgaacaataaagcgaaccgacgaggaagggaaggatgtcccagatcatgcggtcttagaaatgaaagaaagccaacttcacgttgccagatgttggggacttcctggatgaggttctgttcattgagctgcagcgggaggaagcggacaagctagtgaggcagtacaacgaggaaggccgcaaggctgggccaccccctgaaaagcgctttgacaaccgaggtggtggtggcttccggggccgcgggggtggtggtggcttccagcgctatgaaaaccgaggaccccctggaggcaaccgtggcggcttccagaaccgagggggaggcagcggtggaggaggcaactaccgaggaggtttcaaccgcagcggaggtggtggctatagccagaaccgctggggtaacaacaaccgggataacaacaactccaacaacagaggcagctacaaccgggctccccagcaacagccgccaccacagcagcctccgccaccacagccaccaccccagcagccaccgccaccacccagctacagccctgctcggaaccccccaggggccagcacctacaataagaacagcaacatccctggctcaagcgccaataccagcacccccaccgtcagcagctacagccctccacagccgagttacagccagccaccctacaaccagggaggttacagccagggctacacagccccaccgcctccacctccaccaccacctgcctacaactatgggagctacggcggttacaacccggccccctataccccaccgccaccccccaccgcacagacctaccctcagcccagctataaccagtatcagcagtatgcccagcagtggaaccagtactatcagaaccagggccagtggccgccatactacgggaactacgactacgggagctactccgggaacacacagggtggcacaagtacacagtagccagtgtgacccagaggctcccggaggcccctgccggcttcctccaccagcgcctgcctcggcccctcctctgcccccgccagatcccgtggtgctggggatggggtcatcccagggctgcctccctccagcccactgcctcccctctgaggggcttccttcccctccatagggccaggcatttttttctggattcaaacaggcaacaatgaccttttattttctgtttgtccccacctccccagccttccacctcctgttcttcctaccttcttcctttttgactaaataatccccacctcccttgatcatacagtgaggctacagtgactgaggggagaatcccctcctgttcactctcccaaccctgctccagcccctcagcttcccagaccctcatgcagttggttgtaaattctcccaggagctgttttactgtctacttttcaggattaaaaaaaaaatcaaaacttaaaaaaaaaaaagtttaaaaagcaaaatggggagggggaggaagcagtgacttttttttggtaattatgcgcttttttttaatttttagaatttgtctttttactgtgggtgggctgttgatatttcatcaagataagcatttctttcctgagttcaggtgactgaggaagagccacaaaacaaaacacaacaaaaccaaaccacagaatcatctttaacccaactttttatacgatgccccagttccccataactttgcacacaagcttctgtgttcagttgaattgtaactgctttttgtatttggagagagtgactattgaacttgaaaccttttattccgggcgtcttggtagtttctggtgggattcagtgggtgagagggaagaaggggaggttggggggctccttcccttcagaacttgaagtttctcccactgcctcctctccagtggtctcccaggtgccagacccaaaagcttttcctacagtgataccctttatttttacttccccttgactcatatgttttaacatgattttaacaaactgcacttattaagaaatgtgtttgccctgttttgtttggtttcgttttgttttctttgaataaatgacatggcacctcctagcaggaaggaagcagggttgaaaccctgaagtgttactgcagttggccgttaattggggtgggggcctctttaaagggaaattatttactcattcattaaacaacttaactgaggga

SEQ ID NO: 365667 - DNA, 3528 bp, Homo sapiens
tccgctccggcctcggcttcgacgtaggccaacgcttcctccccagtagctcctaggccttctcgtggccgttgttttgaaaacggcgctctgattggctaggtttccgggcccgcgcccgttgccccacgcactgaccaattggcactcatgtaacatcggacgaggcacgagtgaggggggaggcggtggcggcggccattttgagccgctgccgccattggagtgggccccccccctttcccccttcgcctcctgacaggaaaggtttaagggggacagagccctgggaggccgggccgggctcgggggccaccccgggggcccgggccatggatgtgcgccgtctgaaggtgaacgaacttcgcgaggagctgcagcgccgcggcctggacactcgaggcctcaaggccgagcttgctgagcggctgcaggcggcgttggaggccgaggagcctgacgacgagcgggagctcgacgccgacgacgaaccggggcgacccgggcacatcaacgaggaggtcgagaccgaggggggctccgagctggaggggaccgcgcagccaccgccgcccgggctgcagccgcacgcggagcccggcggctactcggggccggacggacattatgccatggacaatattaccaggcagaaccaattctacgatacccaagtcatcaaacaagaaaacgagtcaggctacgagaggagaccactggaaatggagcagcagcaggcctatcgtccagaaatgaagacagagatgaagcaaggagcacccaccagcttcctcccgcctgaagcttctcaactcaagccagacaggcagcaattccagagtcgaaagaggccttatgaagaaaaccggggacgggggtactttgagcaccgagaggataggaggggccgctctcctcagcctcctgctgaagaggatgaagatgactttgatgatacccttgttgctattgacacctataactgcgacctccacttcaaggtggcccgagatcggagtagtggctatccgctcacaattgagggctttgcatacctgtggtcaggagcccgtgccagctatggggtcagaaggggccgtgtatgcttcgagatgaagatcaatgaggaaatctccgtgaagcaccttccgtctacagagcctgacccccacgtggtccgtatcggctggtccctggactcctgcagcacccagctaggcgaagagcctttctcctatggctatggaggcactgggaagaagtccaccaatagccggtttgaaaactacggagacaagtttgcagagaacgatgtgattggctgctttgcggattttgaatgtggaaatgacgtggaactgtcttttaccaagaatggaaagtggatgggcattgctttccgaatccagaaggaagccttggggggtcaggccctctatcctcatgtcctggtgaagaattgcgcagtggagttcaacttcggacagagagcagagccctactgttctgtcctcccggggtttaccttcatccagcaccttccccttagtgagcgtatccggggcaccgttggaccaaagagcaaggcagaatgtgagattctgatgatggtgggcctgcctgctgctggcaagaccacatgggccatcaaacatgcagcctccaacccttccaagaagtacaacatcctgggtaccaatgccatcatggataagatgcgggtgatgggcctacgccggcagcggaactatgctggccgctgggatgtcctgatccagcaggccacccagtgcctcaaccgcctcatccagattgctgcccgcaagaaacgcaactatatcctagatcagacaaatgtttatgggtcagcccagagacgaaaaatgagaccatttgaaggcttccagcgcaaagctattgtaatttgtcccactgacgaggacctaaaagaccgaacaataaagcgaaccgacgaggaagggaaggatgtcccagatcatgcggtcttagaaatgaaagccaacttcacgttgccagatgttggggacttcctggatgaggttctgttcattgagctgcagcgggaggaagcggacaagctagtgaggcagtacaacgaggaaggccgcaaggctgggccaccccctgaaaagcgctttgacaaccgaggtggtggtggcttccggggccgcgggggtggtggtggcttccagcgctatgaaaaccgaggaccccctggaggcaaccgtggcggcttccagaaccgagggggaggcagcggtggaggaggcaactaccgaggaggtttcaaccgcagcggaggtggtggctatagccagaaccgctggggtaacaacaaccgggataacaacaactccaacaacagaggcagctacaaccgggctccccagcaacagccgccaccacagcagcctccgccaccacagccaccaccccagcagccaccgccaccacccagctacagccctgctcggaaccccccaggggccagcacctacaataagaacagcaacatccctggctcaagcgccaataccagcacccccaccgtcagcagctacagccctccacagccgagttacagccagccaccctacaaccagggaggttacagccagggctacacagccccaccgcctccacctccaccaccacctgcctacaactatgggagctacggcggttacaacccggccccctatacccacaaagaacaaacaaaagaaaagaatactaagacagcttcaactccttgtagttcactacaattctttcatattttgacataaaataaattcagacaccttcccattgcattcatacacgatgacggcataacaggtgcgtgaaggggaggagtcaggtcaagtgtgtaatacttcacaaaacaatgttcaaggcaaaatcagattacacaaagaaaacagaactgagatggatttgtagattatccatggagctgttttactgtctacttttcaggattaaaaaaaaaatcaaaacttaaaaaaaaaaaagtttaaaaagcaaaatggggagggggaggaagcagtgacttttttttggtaattatgcgcttttttttaatttttagaatttgtctttttactgtgggtgggctgttgatatttcatcaagataagcatttctttcctgagttcaggtgactgaggaagagccacaaaacaaaacacaacaaaaccaaaccacagaatcatctttaacccaactttttatacgatgccccagttccccataactttgcacacaagcttctgtgttcagttgaattgtaactgctttttgtatttggagagagtgactattgaacttgaaaccttttattccgggcgtcttggtagtttctggtgggattcagtgggtgagagggaagaaggggaggttgtcttatagggttatttaccctgaattcctttttaatatctttattgctacttgttaaccctgcctggggcccataccctttgtaatatcctagtttttccc

SEQ ID NO: 365668 - DNA, 2797 bp, Homo sapiens
tccgctccggcctcggcttcgacgtaggccaacgcttcctccccagtagctcctaggccttctcgtggccgttgttttgaaaacggcgctctgattggctaggtttccgggcccgcgcccgttgccccacgcactgaccaattggcactcatgtaacatcggacgaggcacgagtgaggggggaggcggtggcggcggccattttgagccgctgccgccattggagtgggccccccccctttcccccttcgcctcctgacaggaaaggtttaagggggacagagccctgggaggccgggccgggctcgggggccaccccgggggcccgggccatggatgtgcgccgtctgaaggtgaacgaacttcgcgaggagctgcagcgccgcggcctggacactcgaggcctcaaggccgagcttgctgagcggctgcaggcggcgttggaggccgaggagcctgacgacgagcgggagctcgacgccgacgacgaaccggggcgacccgggcacatcaacgaggaggtcgagaccgaggggggctccgagctggaggggaccgcgcagccaccgccgcccgggctgcagccgcacgcggagcccggcggctactcggggccggacggacattatgccatggacaatattaccaggcagaaccaattctacgatacccaagtcatcaaacaagaaaacgagtcaggctacgagaggagaccactggaaatggagcagcagcaggcctatcgtccagaaatgaagacagagatgaagcaaggagcacccaccagcttcctcccgcctgaagcttctcaactcaagccagacaggcagcaattccagagtcgaaagaggccttatgaagaaaaccggggacgggggtactttgagcaccgagaggataggaggggccgctctcctcagcctcctgctgaagaggatgaagatgactttgatgatacccttgttgctattgacacctataactgcgacctccacttcaaggtggcccgagatcggagtagtggctatccgctcacaattgagggctttgcatacctgtggtcaggagcccgtgccagctatggggtcagaaggggccgtgtatgcttcgagatgaagatcaatgaggaaatctccgtgaagcaccttccgtctacagagcctgacccccacgtggtccgtatcggctggtccctggactcctgcagcacccagctaggcgaagagcctttctcctatggctatggaggcactgggaagaagtccaccaatagccggtttgaaaactacggagacaagtttgcagagaacgatgtgattggctgctttgcggattttgaatgtggaaatgacgtggaactgtcttttaccaagaatggaaagtggatgggcattgctttccgaatccagaaggaagccttggggggtcaggccctctatcctcatgtcctggtgaagaattgcgcagtggagttcaacttcggacagagagcagagccctactgttctgtcctcccggggtttaccttcatccagcaccttccccttagtgagcgtatccggggcaccgttggaccaaagagcaaggcagaatgtgagattctgatgatggtgggcctgcctgctgctggcaagaccacatgggccatcaaacatgcagcctccaacccttccaagaagtacaacatcctgggtaccaatgccatcatggataagatgcgggtgatgggcctacgccggcagcggaactatgctggccgctgggatgtcctgatccagcaggccacccagtgcctcaaccgcctcatccagattgctgcccgcaagaaacgcaactatatcctagatcagacaaatgtttatgggtcagcccagagacgaaaaatgagaccatttgaaggcttccagcgcaaagctattgtaatttgtcccactgacgaggacctaaaagaccgaacaataaagcgaaccgacgaggaagggaaggatgtcccagatcatgcggtcttagaaatgaaagccaacttcacgttgccagatgttggggacttcctggatgaggttctgttcattgagctgcagcgggaggaagcggacaagctagtgaggcagtacaacgaggaaggccgcaaggctgggccaccccctgaaaagcgctttgacaaccgaggtggtggtggcttccggggccgcgggggtggtggtggcttccagcgctatgaaaaccgaggaccccctggaggcaaccgtggcggcttccagaaccgagggggaggcagcggtggaggaggcaactaccgaggaggtttcaaccgcagcggaggtggtggctatagccagaaccgctggggtaacaacaaccgggataacaacaactccaacaacagaggcagctacaaccgggctccccagcaacagccgccaccacagcagcctccgccaccacagccaccaccccagcagccaccgccaccacccagctacagccctgctcggaacccccggtctcccaggtgccagacccaaaagcttttcctacagtgataccctttatttttacttccccttgactcatatgttttaacatgattttaacaaactgcacttattaagaaatgtgtttgccctgttttgtttggtttcgttttgttttctttgaataaatgacatggcacctcctagcaggaaggaagcagggttgaaaccctgaagtgttactgcagttggccgttaattggggtgggggcctctttaaagggaaattatttactcattcattaaacaacttaactgaggga

SEQ ID NO: 365669 - DNA, 2784 bp, Homo sapiens
tccgctccggcctcggcttcgacgtaggccaacgcttcctccccagtagctcctaggccttctcgtggccgttgttttgaaaacggcgctctgattggctaggtttccgggcccgcgcccgttgccccacgcactgaccaattggcactcatgtaacatcggacgaggcacgagtgaggggggaggcggtggcggcggccattttgagccgctgccgccattggagtgggccccccccctttcccccttcgcctcctgacaggaaaggtttaagggggacagagccctgggaggccgggccgggctcgggggccaccccgggggcccgggccatggatgtgcgccgtctgaaggtgaacgaacttcgcgaggagctgcagcgccgcggcctggacactcgaggcctcaaggccgagcttgctgagcggctgcaggcggcgttggaggccgaggagcctgacgacgagcgggagctcgacgccgacgacgaaccggggcgacccgggcacatcaacgaggaggtcgagaccgaggggggctccgagctggaggggaccgcgcagccaccgccgcccgggctgcagccgcacgcggagcccggcggctactcggggccggacggacattatgccatggacaatattaccaggcagaaccaattctacgatacccaaaaagccaacttcacgttgccagatgttggggacttcctggatgaggttctgttcattgagctgcagcgggaggaagcggacaagctagtgaggcagtacaacgaggaaggccgcaaggctgggccaccccctgaaaagcgctttgacaaccgaggtggtggtggcttccggggccgcgggggtggtggtggcttccagcgctatgaaaaccgaggaccccctggaggcaaccgtggcggcttccagaaccgagggggaggcagcggtggaggaggcaactaccgaggaggtttcaaccgcagcggaggtggtggctatagccagaaccgctggggtaacaacaaccgggataacaacaactccaacaacagaggcagctacaaccgggctccccagcaacagccgccaccacagcagcctccgccaccacagccaccaccccagcagccaccgccaccacccagctacagccctgctcggaaccccccaggggccagcacctacaataagaacagcaacatccctggctcaagcgccaataccagcacccccaccgtcagcagctacagccctccacagccgagttacagccagccaccctacaaccagggaggttacagccagggctacacagccccaccgcctccacctccaccaccacctgcctacaactatgggagctacggcggttacaacccggccccctataccccaccgccaccccccaccgcacagacctaccctcagcccagctataaccagtatcagcagtatgcccagcagtggaaccagtactatcagaaccagggccagtggccgccatactacgggaactacgactacgggagctactccgggaacacacagggtggcacaagtacacagtagccagtgtgacccagaggctcccggaggcccctgccggcttcctccaccagcgcctgcctcggcccctcctctgcccccgccagatcccgtggtgctggggatggggtcatcccagggctgcctccctccagcccactgcctcccctctgaggggcttccttcccctccatagggccaggcatttttttctggattcaaacaggcaacaatgaccttttattttctgtttgtccccacctccccagccttccacctcctgttcttcctaccttcttcctttttgactaaataatccccacctcccttgatcatacagtgaggctacagtgactgaggggagaatcccctcctgttcactctcccaaccctgctccagcccctcagcttcccagaccctcatgcagttggttgtaaattctcccaggagctgttttactgtctacttttcaggattaaaaaaaaaatcaaaacttaaaaaaaaaaaagtttaaaaagcaaaatggggagggggaggaagcagtgacttttttttggtaattatgcgcttttttttaatttttagaatttgtctttttactgtgggtgggctgttgatatttcatcaagataagcatttctttcctgagttcaggtgactgaggaagagccacaaaacaaaacacaacaaaaccaaaccacagaatcatctttaacccaactttttatacgatgccccagttccccataactttgcacacaagcttctgtgttcagttgaattgtaactgctttttgtatttggagagagtgactattgaacttgaaaccttttattccgggcgtcttggtagtttctggtgggattcagtgggtgagagggaagaaggggaggttggggggctccttcccttcagaacttgaagtttctcccactgcctcctctccagtggtctcccaggtgccagacccaaaagcttttcctacagtgataccctttatttttacttccccttgactcatatgttttaacatgattttaacaaactgcacttattaagaaatgtgtttgccctgttttgtttggtttcgttttgttttctttgaataaatgacatggcacctcctagcaggaaggaagcagggttgaaaccctgaagtgttactgcagttggccgttaattggggtgggggcctctttaaagggaaattatttactcattcattaaacaacttaactgaggga

SEQ ID NO: 365670 - DNA, 2526 bp, Homo sapiens
tccgctccggcctcggcttcgacgtaggccaacgcttcctccccagtagctcctaggccttctcgtggccgttgttttgaaaacggcgctctgattggctaggtttccgggcccgcgcccgttgccccacgcactgaccaattggcactcatgtaacatcggacgaggcacgagtgaggggggaggcggtggcggcggccattttgagccgctgccgccattggagtgggccccccccctttcccccttcgcctcctgacaggaaaggtttaagggggacagagccctgggaggccgggccgggctcgggggccaccccgggggcccgggccatggatgtgcgccgtctgaaggtgaacgaacttcgcgaggagctgcagcgccgcggcctggacactcgaggcctcaaggccgagcttgctgagcggctgcaggcggcgttggaggccgaggagcctgacgacgagcgggagctcgacgccgacgacgaaccggggcgacccgggcacatcaacgaggaggtcgagaccgaggggggctccgagctggaggggaccgcgcagccaccgccgcccgggctgcaccggggccgcgggggtggtggtggcttccagcgctatgaaaaccgaggaccccctggaggcaaccgtggcggcttccagaaccgagggggaggcagcggtggaggaggcaactaccgaggaggtttcaaccgcagcggaggtggtggctatagccagaaccgctggggtaacaacaaccgggataacaacaactccaacaacagaggcagctacaaccgggctccccagcaacagccgccaccacagcagcctccgccaccacagccaccaccccagcagccaccgccaccacccagctacagccctgctcggaaccccccaggggccagcacctacaataagaacagcaacatccctggctcaagcgccaataccagcacccccaccgtcagcagctacagccctccacagccgagttacagccagccaccctacaaccagggaggttacagccagggctacacagccccaccgcctccacctccaccaccacctgcctacaactatgggagctacggcggttacaacccggccccctataccccaccgccaccccccaccgcacagacctaccctcagcccagctataaccagtatcagcagtatgcccagcagtggaaccagtactatcagaaccagggccagtggccgccatactacgggaactacgactacgggagctactccgggaacacacagggtggcacaagtacacagtagccagtgtgacccagaggctcccggaggcccctgccggcttcctccaccagcgcctgcctcggcccctcctctgcccccgccagatcccgtggtgctggggatggggtcatcccagggctgcctccctccagcccactgcctcccctctgaggggcttccttcccctccatagggccaggcatttttttctggattcaaacaggcaacaatgaccttttattttctgtttgtccccacctccccagccttccacctcctgttcttcctaccttcttcctttttgactaaataatccccacctcccttgatcatacagtgaggctacagtgactgaggggagaatcccctcctgttcactctcccaaccctgctccagcccctcagcttcccagaccctcatgcagttggttgtaaattctcccaggagctgttttactgtctacttttcaggattaaaaaaaaaatcaaaacttaaaaaaaaaaaagtttaaaaagcaaaatggggagggggaggaagcagtgacttttttttggtaattatgcgcttttttttaatttttagaatttgtctttttactgtgggtgggctgttgatatttcatcaagataagcatttctttcctgagttcaggtgactgaggaagagccacaaaacaaaacacaacaaaaccaaaccacagaatcatctttaacccaactttttatacgatgccccagttccccataactttgcacacaagcttctgtgttcagttgaattgtaactgctttttgtatttggagagagtgactattgaacttgaaaccttttattccgggcgtcttggtagtttctggtgggattcagtgggtgagagggaagaaggggaggttggggggctccttcccttcagaacttgaagtttctcccactgcctcctctccagtggtctcccaggtgccagacccaaaagcttttcctacagtgataccctttatttttacttccccttgactcatatgttttaacatgattttaacaaactgcacttattaagaaatgtgtttgccctgttttgtttggtttcgttttgttttctttgaataaatgacatggcacctcctagcaggaaggaagcagggttgaaaccctgaagtgttactgcagttggccgttaattggggtgggggcctctttaaagggaaattatttactcattcattaaacaacttaactgaggga

SEQ ID NO: 365671 - DNA, 2408 bp, Homo sapiens
atttttagtagagatggggttttgccatgttggccaggctggtcttgaactcctgacctcaggtgatccacccgcctcggcctcccaaagtgctgggattacaggcgtgagccaccgcgcccgcccttctgtctttgtctttcttattcactattccagttttcttcaccttctcccttctggaaggccactcttctgggtggaggggaccagacttcagaaggtactgacctcttcttcttgttctctttggggcacttccttcctcctagccaacttcacgttgccagatgttggggacttcctggatgaggttctgttcattgagctgcagcgggaggaagcggacaagctagtgaggcagtacaacgaggaaggccgcaaggctgggccaccccctgaaaagcgctttgacaaccgaggtggtggtggcttccggggccgcgggggtggtggtggcttccagcgctatgaaaaccgaggaccccctggaggcaaccgtggcggcttccagaaccgagggggaggcagcggtggaggaggcaactaccgaggaggtttcaaccgcagcggaggtggtggctatagccagaaccgctggggtaacaacaaccgggataacaacaactccaacaacagaggcagctacaaccgggctccccagcaacagccgccaccacagcagcctccgccaccacagccaccaccccagcagccaccgccaccacccagctacagccctgctcggaaccccccaggggccagcacctacaataagaacagcaacatccctggctcaagcgccaataccagcacccccaccgtcagcagctacagccctccacagagctttggcttttttccctccactttccagccgagttacagccagccaccctacaaccagggaggttacagccagggctacacagccccaccgcctccacctccaccaccacctgcctacaactatgggagctacggcggttacaacccggccccctataccccaccgccaccccccaccgcacagacctaccctcagcccagctataaccagtatcagcagtatgcccagcagtggaaccagtactatcagaaccagggccagtggccgccatactacgggaactacgactacgggagctactccgggaacacacagggtggcacaagtacacagtagccagtgtgacccagaggctcccggaggcccctgccggcttcctccaccagcgcctgcctcggcccctcctctgcccccgccagatcccgtggtgctggggatggggtcatcccagggctgcctccctccagcccactgcctcccctctgaggggcttccttcccctccatagggccaggcatttttttctggattcaaacaggcaacaatgaccttttattttctgtttgtccccacctccccagccttccacctcctgttcttcctaccttcttcctttttgactaaataatccccacctcccttgatcatacagtgaggctacagtgactgaggggagaatcccctcctgttcactctcccaaccctgctccagcccctcagcttcccagaccctcatgcagttggttgtaaattctcccaggagctgttttactgtctacttttcaggattaaaaaaaaaatcaaaacttaaaaaaaaaaaagtttaaaaagcaaaatggggagggggaggaagcagtgacttttttttggtaattatgcgcttttttttaatttttagaatttgtctttttactgtgggtgggctgttgatatttcatcaagataagcatttctttcctgagttcaggtgactgaggaagagccacaaaacaaaacacaacaaaaccaaaccacagaatcatctttaacccaactttttatacgatgccccagttccccataactttgcacacaagcttctgtgttcagttgaattgtaactgctttttgtatttggagagagtgactattgaacttgaaaccttttattccgggcgtcttggtagtttctggtgggattcagtgggtgagagggaagaaggggaggttggggggctccttcccttcagaacttgaagtttctcccactgcctcctctccagtggtctcccaggtgccagacccaaaagcttttcctacagtgataccctttatttttacttccccttgactcatatgttttaacatgattttaacaaactgcacttattaagaaatgtgtttgccctgttttgtttggtttcgttttgttttctttgaataaatgacatggcacctcctagcaggaaggaagcagggttgaaaccctgaagtgttactgcagttggccgttaattggggtgggggcctctttaaagggaaattatttactcattcattaaacaacttaactgaggga

SEQ ID NO: 365672 - DNA, 3317 bp, Homo sapiens
tccgctccggcctcggcttcgacgtaggccaacgcttcctccccagtagctcctaggccttctcgtggccgttgttttgaaaacggcgctctgattggctaggtttccgggcccgcgcccgttgccccacgcactgaccaattggcactcatgtaacatcggacgaggcacgagtgaggggggaggcggtggcggcggccattttgagccgctgccgccattggagtgggccccccccctttcccccttcgcctcctgacaggaaaggtttaagggggacagagccctgggaggccgggccgggctcgggggccaccccgggggcccgggccatggatgtgcgccgtctgaaggtgaacgaacttcgcgaggagctgcagcgccgcggcctggacactcgaggcctcaaggccgagcttgctgagcggctgcaggcggcgttggaggccgaggagcctgacgacgagcgggagctcgacgccgacgacgaaccggggcgacccgggcacatcaacgaggaggtcgagaccgaggggggctccgagctggaggggaccgcgcagccaccgccgcccgggctgcagccgcacgcggagcccggcggctactcggggccggacggacattatgccatggacaatattaccaggcagaaccaattctacgatacccaagtcatcaaacaagaaaacgagtcaggctacgagaggagaccactggaaatggagcagcagcaggcctatcgtccagaaatgaagacagagatgaagcaaggagcacccaccagcttcctcccgcctgaagcttctcaactcaagccagacaggcagcaattccagagtcgaaagaggccttatgaagaaaaccggggacgggggtactttgagcaccgagaggataggaggggccgctctcctcagcctcctgctgaagaggatgaagatgactttgatgatacccttgttgctattgacacctataactgcgacctccacttcaaggtggcccgagatcggagtagtggctatccgctcacaattgagggctttgcatacctgtggtcaggagcccgtgccagctatggggtcagaaggggccgtgtatgcttcgagatgaagatcaatgaggaaatctccgtgaagcaccttccgtctacagagcctgacccccacgtggtccgtatcggctggtccctggactcctgcagcacccagctaggcgaagagcctttctcctatggctatggaggcactgggaagaagtccaccaatagccggtttgaaaactacggagacaagtttgcagagaacgatgtgattggctgctttgcggattttgaatgtggaaatgacgtggaactgtcttttaccaagaatggaaagtggatgggcattgctttccgaatccagaaggaagccttggggggtcaggccctctatcctcatgtcctggtgaagaattgcgcagtggagttcaacttcggacagagagcagagccctactgttctgtcctcccggggtttaccttcatccagcaccttccccttagtgagcgtatccggggcaccgttggaccaaagagcaaggcagaatgtgagattctgatgatggtgggcctgcctgctgctggcaagaccacatgggccatcaaacatgcagcctccaacccttccaagaagtacaacatcctgggtaccaatgccatcatggataagatgcgggtgatgggcctacgccggcagcggaactatgctggccgctgggatgtcctgatccagcaggccacccagtgcctcaaccgcctcatccagattgctgcccgcaagaaacgcaactatatcctagatcagacaaatgtttatgggtcagcccagagacgaaaaatgagaccatttgaaggcttccagcgcaaagctattgtaatttgtcccactgacgaggacctaaaagaccgaacaataaagcgaaccgacgaggaagggaaggatgtcccagatcatgcggtcttagaaatgaaagaaaggtaggaaatgagtgcttcccagaggaacgtcaatgcagggtcctggagagaagaagctctttactcagtttgtccttccctggctccccagtgatttcttttttgatcttactctttctttgcttctgctttgtcccttccttgtctaccacagctgtgaatggaaaagctacccatctgtcttatgttggggttttcaggctggatggggctggggcagcacaagggaaaggatgtatgggagctaaagctgaaagtcctgtgtgctcaccctgcctctggtcccagatgggctgactgtgggcaggcctcagtttgtttctctgtaaatatagggatggtgatgccatctgtctgacccattccctggggtgaggcctgagggagctgtgcactgtgtctaggtgggtcttagccacctcttcagaaaacggaggagtctttgttacccctcagcttcccagaccctcatgcagttggttgtaaattctcccaggagctgttttactgtctacttttcaggattaaaaaaaaaatcaaaacttaaaaaaaaaaaagtttaaaaagcaaaatggggagggggaggaagcagtgacttttttttggtaattatgcgcttttttttaatttttagaatttgtctttttactgtgggtgggctgttgatatttcatcaagataagcatttctttcctgagttcaggtgactgaggaagagccacaaaacaaaacacaacaaaaccaaaccacagaatcatctttaacccaactttttatacgatgccccagttccccataactttgcacacaagcttctgtgttcagttgaattgtaactgctttttgtatttggagagagtgactattgaacttgaaaccttttattccgggcgtcttggtagtttctggtgggattcagtgggtgagagggaagaaggggaggttggggggctccttcccttcagaacttgaagtttctcccactgcctcctctccagtggtctcccaggtgccagacccaaaagcttttcctacagtgataccctttatttttacttccccttgactcatatgttttaacatgattttaacaaactgcacttattaagaaatgtgtttgccctgttttgtttggtttcgttttgttttctttgaataaatgacatggcacctcctagcaggaaggaagcagggttgaaaccctgaagtgttactgcagttggccgttaattggggtgggggcctctttaaagggaaattatttactcattcattaaacaacttaactgaggga

SEQ ID NO: 365673 - DNA, 2079 bp, Homo sapiens
gtattactgttggtgatgtggttggtagtattactgttggtggtgatggtggtggttggtagtattactgttggtggtgatggtggtggttggtagtattactgttccggggccgcgggggtggtggtggcttccagcgctatgaaaaccgaggaccccctggaggcaaccgtggcggcttccagaaccgagggggaggcagcggtggaggaggcaactaccgaggaggtttcaaccgcagcggaggtggtggctatagccagaaccgctggggtaacaacaaccgggataacaacaactccaacaacagaggcagctacaaccgggctccccagcaacagccgccaccacagcagcctccgccaccacagccaccaccccagcagccaccgccaccacccagctacagccctgctcggaaccccccaggggccagcacctacaataagaacagcaacatccctggctcaagcgccaataccagcacccccaccgtcagcagctacagccctccacagagctttggcttttttccctccactttccagccgagttacagccagccaccctacaaccagggaggttacagccagggctacacagccccaccgcctccacctccaccaccacctgcctacaactatgggagctacggcggttacaacccggccccctataccccaccgccaccccccaccgcacagacctaccctcagcccagctataaccagtatcagcagtatgcccagcagtggaaccagtactatcagaaccagggccagtggccgccatactacgggaactacgactacgggagctactccgggaacacacagggtggcacaagtacacagtagccagtgtgacccagaggctcccggaggcccctgccggcttcctccaccagcgcctgcctcggcccctcctctgcccccgccagatcccgtggtgctggggatggggtcatcccagggctgcctccctccagcccactgcctcccctctgaggggcttccttcccctccatagggccaggcatttttttctggattcaaacaggcaacaatgaccttttattttctgtttgtccccacctccccagccttccacctcctgttcttcctaccttcttcctttttgactaaataatccccacctcccttgatcatacagtgaggctacagtgactgaggggagaatcccctcctgttcactctcccaaccctgctccagcccctcagcttcccagaccctcatgcagttggttgtaaattctcccaggagctgttttactgtctacttttcaggattaaaaaaaaaatcaaaacttaaaaaaaaaaaagtttaaaaagcaaaatggggagggggaggaagcagtgacttttttttggtaattatgcgcttttttttaatttttagaatttgtctttttactgtgggtgggctgttgatatttcatcaagataagcatttctttcctgagttcaggtgactgaggaagagccacaaaacaaaacacaacaaaaccaaaccacagaatcatctttaacccaactttttatacgatgccccagttccccataactttgcacacaagcttctgtgttcagttgaattgtaactgctttttgtatttggagagagtgactattgaacttgaaaccttttattccgggcgtcttggtagtttctggtgggattcagtgggtgagagggaagaaggggaggttggggggctccttcccttcagaacttgaagtttctcccactgcctcctctccagtggtctcccaggtgccagacccaaaagcttttcctacagtgataccctttatttttacttccccttgactcatatgttttaacatgattttaacaaactgcacttattaagaaatgtgtttgccctgttttgtttggtttcgttttgttttctttgaataaatgacatggcacctcctagcaggaaggaagcagggttgaaaccctgaagtgttactgcagttggccgttaattggggtgggggcctctttaaagggaaattatttactcattcattaaacaacttaactgaggga

SEQ ID NO: 365674 - DNA, 2310 bp, Homo sapiens
tccgctccggcctcggcttcgacgtaggccaacgcttcctccccagtagctcctaggccttctcgtggccgttgttttgaaaacggcgctctgattggctaggtttccgggcccgcgcccgttgccccacgcactgaccaattggcactcatgtaacatcggacgaggcacgagtgaggggggaggcggtggcggcggccattttgagccgctgccgccattggagtgggccccccccctttcccccttcgcctcctgacaggaaaggtttaagggggacagagccctgggaggccgggccgggctcgggggccaccccgggggcccgggccatggatgtgcgccgtctgaaggtgaacgaacttcgcgaggagctgcagcgccgcggcctggacactcgaggcctcaaggccgagcttgctgagcggctgcaggcggcgttggaggccgaggagcctgacgacgagcgggagctcgacgccgacgacgaaccggggcgacccgggcacatcaacgaggaggtcgagaccgaggggggctccgagctggaggggaccgcgcagccaccgccgcccgggctgcagccgcacgcggagcccggcggctactcggggccggacggacattatgccatggacaatattaccaggcagaaccaattctacgatacccaagtcatcaaacaagaaaacgagtcaggctacgagaggagaccactggaaatggagcagcagcaggcctatcgtccagaaatgaagacagagatgaagcaaggagcacccaccagcttcctcccgcctgaagcttctcaactcaagccagacaggcagcaattccagacgcctccacctccaccaccacctgcctacaactatgggagctacggcggttacaacccggccccctataccccaccgccaccccccaccgcacagacctaccctcagcccagctataaccagtatcagcagtatgcccagcagtggaaccagtactatcagaaccagggccagtggccgccatactacgggaactacgactacgggagctactccgggaacacacagggtggcacaagtacacagtagccagtgtgacccagaggctcccggaggcccctgccggcttcctccaccagcgcctgcctcggcccctcctctgcccccgccagatcccgtggtgctggggatggggtcatcccagggctgcctccctccagcccactgcctcccctctgaggggcttccttcccctccatagggccaggcatttttttctggattcaaacaggcaacaatgaccttttattttctgtttgtccccacctccccagccttccacctcctgttcttcctaccttcttcctttttgactaaataatccccacctcccttgatcatacagtgaggctacagtgactgaggggagaatcccctcctgttcactctcccaaccctgctccagcccctcagcttcccagaccctcatgcagttggttgtaaattctcccaggagctgttttactgtctacttttcaggattaaaaaaaaaatcaaaacttaaaaaaaaaaaagtttaaaaagcaaaatggggagggggaggaagcagtgacttttttttggtaattatgcgcttttttttaatttttagaatttgtctttttactgtgggtgggctgttgatatttcatcaagataagcatttctttcctgagttcaggtgactgaggaagagccacaaaacaaaacacaacaaaaccaaaccacagaatcatctttaacccaactttttatacgatgccccagttccccataactttgcacacaagcttctgtgttcagttgaattgtaactgctttttgtatttggagagagtgactattgaacttgaaaccttttattccgggcgtcttggtagtttctggtgggattcagtgggtgagagggaagaaggggaggttggggggctccttcccttcagaacttgaagtttctcccactgcctcctctccagtggtctcccaggtgccagacccaaaagcttttcctacagtgataccctttatttttacttccccttgactcatatgttttaacatgattttaacaaactgcacttattaagaaatgtgtttgccctgttttgtttggtttcgttttgttttctttgaataaatgacatggcacctcctagcaggaaggaagcagggttgaaaccctgaagtgttactgcagttggccgttaattggggtgggggcctctttaaagggaaattatttactcattcattaaacaacttaactgaggga

SEQ ID NO: 365675 - DNA, 1942 bp, Homo sapiens
gctcggttctcggtattggcgcttgagccagggatgttgctgttcttattgtaggtgctggcccctgtggggttccgagcagggctgtagctgggtggtggcggtggctgctggggtggtggctgtggtggcttccacgctatgaaccgggataacaacaactccaacaacagaggcagctacaaccgggctccccagcaacagccgccaccacagcagcctccgccaccacagccaccaccccagcagccaccgccaccacccagctacagccctgctcggaaccccccaggggccagcacctacaataagaacagcaacatccctggctcaagcgccaataccagcacccccaccgtcagcagctacagccctccacagagctttggcttttttccctccactttccagccgagttacagccagccaccctacaaccagggaggttacagccagggctacacagccccaccgcctccacctccaccaccacctgcctacaactatgggagctacggcggttacaacccggccccctataccccaccgccaccccccaccgcacagacctaccctcagcccagctataaccagtatcagcagtatgcccagcagtggaaccagtactatcagaaccagggccagtggccgccatactacgggaactacgactacgggagctactccgggaacacacagggtggcacaagtacacagtagccagtgtgacccagaggctcccggaggcccctgccggcttcctccaccagcgcctgcctcggcccctcctctgcccccgccagatcccgtggtgctggggatggggtcatcccagggctgcctccctccagcccactgcctcccctctgaggggcttccttcccctccatagggccaggcatttttttctggattcaaacaggcaacaatgaccttttattttctgtttgtccccacctccccagccttccacctcctgttcttcctaccttcttcctttttgactaaataatccccacctcccttgatcatacagtgaggctacagtgactgaggggagaatcccctcctgttcactctcccaaccctgctccagcccctcagcttcccagaccctcatgcagttggttgtaaattctcccaggagctgttttactgtctacttttcaggattaaaaaaaaaatcaaaacttaaaaaaaaaaaagtttaaaaagcaaaatggggagggggaggaagcagtgacttttttttggtaattatgcgcttttttttaatttttagaatttgtctttttactgtgggtgggctgttgatatttcatcaagataagcatttctttcctgagttcaggtgactgaggaagagccacaaaacaaaacacaacaaaaccaaaccacagaatcatctttaacccaactttttatacgatgccccagttccccataactttgcacacaagcttctgtgttcagttgaattgtaactgctttttgtatttggagagagtgactattgaacttgaaaccttttattccgggcgtcttggtagtttctggtgggattcagtgggtgagagggaagaaggggaggttggggggctccttcccttcagaacttgaagtttctcccactgcctcctctccagtggtctcccaggtgccagacccaaaagcttttcctacagtgataccctttatttttacttccccttgactcatatgttttaacatgattttaacaaactgcacttattaagaaatgtgtttgccctgttttgtttggtttcgttttgttttctttgaataaatgacatggcacctcctagcaggaaggaagcagggttgaaaccctgaagtgttactgcagttggccgttaattggggtgggggcctctttaaagggaaattatttactcattcattaaacaacttaactgaggga

SEQ ID NO: 365676 - DNA, 1418 bp, Homo sapiens
  misc_feature (21)..(21): n is a, c, g, or t
  misc_feature (44)..(44): n is a, c, g, or t
  misc_feature (46)..(46): n is a, c, g, or t
  misc_feature (48)..(48): n is a, c, g, or t
  misc_feature (57)..(57): n is a, c, g, or t
agtactgatacaatcagctcngtaccccaggtagacctaactanancntaccctcancagctataaccagtatcagcagtatgcccagcagtggaaccagtactatcagaaccagggccagtggccgccatactacgggaactacgactacgggagctactccgggaacacacagggtggcacaagtacacagtagccagtgtgacccagaggctcccggaggcccctgccggcttcctccaccagcgcctgcctcggcccctcctctgcccccgccagatcccgtggtgctggggatggggtcatcccagggctgcctccctccagcccactgcctcccctctgaggggcttccttcccctccatagggccaggcatttttttctggattcaaacaggcaacaatgaccttttattttctgtttgtccccacctccccagccttccacctcctgttcttcctaccttcttcctttttgactaaataatccccacctcccttgatcatacagtgaggctacagtgactgaggggagaatcccctcctgttcactctcccaaccctgctccagcccctcagcttcccagaccctcatgcagttggttgtaaattctcccaggagctgttttactgtctacttttcaggattaaaaaaaaaatcaaaacttaaaaaaaaaaaagtttaaaaagcaaaatggggagggggaggaagcagtgacttttttttggtaattatgcgcttttttttaatttttagaatttgtctttttactgtgggtgggctgttgatatttcatcaagataagcatttctttcctgagttcaggtgactgaggaagagccacaaaacaaaacacaacaaaaccaaaccacagaatcatctttaacccaactttttatacgatgccccagttccccataactttgcacacaagcttctgtgttcagttgaattgtaactgctttttgtatttggagagagtgactattgaacttgaaaccttttattccgggcgtcttggtagtttctggtgggattcagtgggtgagagggaagaaggggaggttggggggctccttcccttcagaacttgaagtttctcccactgcctcctctccagtggtctcccaggtgccagacccaaaagcttttcctacagtgataccctttatttttacttccccttgactcatatgttttaacatgattttaacaaactgcacttattaagaaatgtgtttgccctgttttgtttggtttcgttttgttttctttgaataaatgacatggcacctcctagcaggaaggaagcagggttgaaaccctgaagtgttactgcagttggccgttaattggggtgggggcctctttaaagggaaattatttactcattcattaaacaacttaactgaggga

SEQ ID NO: 365677 - DNA, 1235 bp, Homo sapiens
gggacgggggtggcggggaggattccgtaccgtagggatcggagaccggaaactgctttctggagccgaagagagtcggaagaacaagagatgccatggacaatattaccaggcagaaccaattctacgatacccaagtcatcaaacaagaaaacgagtctgaggggcttccttcccctccatagggccaggcatttttttctggattcaaacaggcaacaatgaccttttattttctgtttgtccccacctccccagccttccacctcctgttcttcctaccttcttcctttttgactaaataatccccacctcccttgatcatacagtgaggctacagtgactgaggggagaatcccctcctgttcactctcccaaccctgctccagcccctcagcttcccagaccctcatgcagttggttgtaaattctcccaggagctgttttactgtctacttttcaggattaaaaaaaaaatcaaaacttaaaaaaaaaaaagtttaaaaagcaaaatggggagggggaggaagcagtgacttttttttggtaattatgcgcttttttttaatttttagaatttgtctttttactgtgggtgggctgttgatatttcatcaagataagcatttctttcctgagttcaggtgactgaggaagagccacaaaacaaaacacaacaaaaccaaaccacagaatcatctttaacccaactttttatacgatgccccagttccccataactttgcacacaagcttctgtgttcagttgaattgtaactgctttttgtatttggagagagtgactattgaacttgaaaccttttattccgggcgtcttggtagtttctggtgggattcagtgggtgagagggaagaaggggaggttggggggctccttcccttcagaacttgaagtttctcccactgcctcctctccagtggtctcccaggtgccagacccaaaagcttttcctacagtgataccctttatttttacttccccttgactcatatgttttaacatgattttaacaaactgcacttattaagaaatgtgtttgccctgttttgtttggtttcgttttgttttctttgaataaatgacatggcacctcctagcaggaaggaagcagggttgaaaccctgaagtgttactgcagttggccgttaattggggtgggggcctctttaaagggaaattatttactcattcattaaacaacttaactgaggga

SEQ ID NO: 365678 - DNA, 1325 bp, Homo sapiens
acacacgagcacacagcacacaaacgcacagcaccgcacacacatgcacacacaggggccagcacctacaataagaacagcaacatccctggctcaagcgccaataccagcacccccaccgtcagcagctacagccctccacagccgagttacagccagccaccctacaaccagggaggttacagccagggctacacagccccaccgcctccacctccaccaccacctgcctacaactatgggagctacggcggttacaacccggccccctatacccacaaagaacaaacaaaagaaaagaatactaagacagcttcaactccttgtagttcactacaattctttcatattttgacataaaataaattcagacaccttcccattgcattcatacacgatgacggcataacaggtgcgtgaaggggaggagtcaggtcaagtgtgtaatacttcacaaaacaatgttcaaggcaaaatcagattacacaaagaaaacagaactgagatggatttgtagattatccatggagctgttttactgtctacttttcaggattaaaaaaaaaatcaaaacttaaaaaaaaaaaagtttaaaaagcaaaatggggagggggaggaagcagtgacttttttttggtaattatgcgcttttttttaatttttagaatttgtctttttactgtgggtgggctgttgatatttcatcaagataagcatttctttcctgagttcaggtgactgaggaagagccacaaaacaaaacacaacaaaaccaaaccacagaatcatctttaacccaactttttatacgatgccccagttccccataactttgcacacaagcttctgtgttcagttgaattgtaactgctttttgtatttggagagagtgactattgaacttgaaaccttttattccgggcgtcttggtagtttctggtgggattcagtgggtgagagggaagaaggggaggttggggggctccttcccttcagaacttgaagtttctcccactgcctcctctccagtggtctcccaggtgccagacccaaaagcttttcctacagtgataccctttatttttacttccccttgactcatatgttttaacatgattttaacaaactgcacttattaagaaatgtgtttgccctgttttgtttggtttcgttttgttttctttgaataaatgacatggcacctcctagcaggaaggaagcagggttgaaaccctgaagtgttactgcagttggccgttaattggggtgggggcctctttaaagggaaattatttactcattcattaaacaacttaactgaggga

SEQ ID NO: 365679 - DNA, 272 bp, Homo sapiens
cattaggaatcctttgccctgtgcctgtctgcagccacttacctaagtcaattcatttgctgagggtgactcaagaatcttctaagtaaagaagagctgtttcctgagtttctctgcttacaaggagcactgatatccttttctcagtccctggcctacataatacccctcagaggaaaaaaccaactcttaatgtaccatctcttgcctcttctgttaccttacccttagacaaatgtttatgggtcagcccagagacgaaaaatgagacc

SEQ ID NO: 365680 - DNA, 331 bp, Homo sapiens
gttttttgtttttgttttcccccgaaagtcctgggattataggcgtgagctaccgtgcctggccagcacttgacttaatgctcaccctgtcccaggcactgtgctcagagtctgacaagcctgatctttttgaatcccgataccagtactgtgaggtagatggtattactgcttccgctttgtagaggcagccacagctcagaggtccagagtcacactcacagtcaccaccgagccaagtggtgccataccaccatgccgcaacaccttccctgtcttgttcttgtagattctgatgatggtgggcctgcctgctgctggcaagaccaca

SEQ ID NO: 365681 - DNA, 424 bp, Homo sapiens
ctgggaagaagtccaccaatagccggtttgaaaactacggagacaagtttgcagagaacgatgtgattggctgctttgcggtgagtgctagcagcctgtgggagttggcagaaccagatgttgggctacagacttctttttcaggatacctctatccattgtctgccccatatccagccactctcgccatacttctttgtctctgcttgacagactggaatgtttactgtcattttgtgggaaattctgtcattccatctcctctggtcttgtgtgcaaagttttcagatgacaccctgaagaggtttggggacttcaggtgtgcatagccttcctccgttcctaggtaccagagtaacattttctaaacaaacctaggaatttcttatctttcattgctaggaaatagcctgtctgctcctga

SEQ ID NO: 365682 - DNA, 1188 bp, Homo sapiens
gcgtgagctggcgtatgttgacactattgcgttgtgtcgttggtcacgctggtattcgtgcaccatcctccatggcttgtgtgcatgttgatcgtggccgctgtcttggttgtgctgcgcgtgtgcatgtttatgagtcgcgtggactgttcagtccattggcgcctccatctttctgcgtcccgtatgatcgctgctgtacctacgccacgtcgttttctgtgctggggcgggtgctctcatcgtctgtgtaaatattgtttcatcaacggcgtcgaaaagagtggttccaaaacaaacgccggtggccagaccttcaccccaaacaaatccccctggggtaacacaatacacgctgaaggtaaattttgcccccacaccttaaatctcttataggagtgtgcccaacatatgtcaccccccccaaaatatgggtccttctcccccaagagtccccaacgaagcccggtttcccacctcaaccttgttacaaccaaggcgcgcccctcccgcttgctttcatattatctccccctcctcctttatggggcccccttttgtaccaaaacaaagggggccccaatgggcccccccggggaattttttgcccccccccccttttttttttttttttttttttttttttttttttttttaacccaactttttatacgatgccccagttccccataactttgcacacaagcttctgtgttcagttgaattgtaactgctttttgtatttggagagagtgactattgaacttgaaaccttttattccgggcgtcttggtagtttctggtgggattcagtgggtgagagggaagaaggggaggttggggggctccttcccttcagaacttgaagtttctcccactgcctcctctccagtggtctcccaggtgccagacccaaaagcttttcctacagtgataccctttatttttacttccccttgactcatatgttttaacatgattttaacaaactgcacttattaagaaatgtgtttgccctgttttgtttggtttcgttttgttttctttgaataaatgacatggcacctcctagcaggaaggaagcagggttgaaaccctgaagtgttactgcagttggccgttaattggggtgggggcctctttaaagggaaattatttactcattcattaaacaacttaactgaggga

SEQ ID NO: 365683 - DNA, 677 bp, Homo sapiens
gggacgggggtggcggggaggattccgtaccgtagggatcggagaccggaaactgctttctggagccgaagagagtcggaagaacaagaggttttccgtttgggttggggagggtctcgaaaatggggatcctagggtacggagctccgtgggcttggcggtcgtgctagcccagcgtgtgggctggggggtggggagccgtgtttccagggtggggaaggaatgtccaggtgtgcggggctgcgagagttctgaggaaggaggatcctggaatatgccgctggatgcgatcctgggcgttctcctatttggatgccatggacaatattaccaggcagaaccaattctacgatacccaagtcatcaaacaagaaaacgagtcggtctcccaggtgccagacccaaaagcttttcctacagtgataccctttatttttacttccccttgactcatatgttttaacatgattttaacaaactgcacttattaagaaatgtgtttgccctgttttgtttggtttcgttttgttttctttgaataaatgacatggcacctcctagcaggaaggaagcagggttgaaaccctgaagtgttactgcagttggccgttaattggggtgggggcctctttaaagggaaattatttactcattcattaaacaacttaactgaggga

SEQ ID NO: 365684 - DNA, 3818 bp, Homo sapiens
aagacaagaatgattgaacagtcgagccgtgtttcaatcatgcacgagggcctcctgacaggaaaggtttaagggggacagagccctgggaggccgggccgggctcgggggccaccccgggggcccgggccatggatgtgcgccgtctgaaggtgaacgaacttcgcgaggagctgcagcgccgcggcctggacactcgaggcctcaaggccgagcttgctgagcggctgcaggcggcgttggaggccgaggagcctgacgacgagcgggagctcgacgccgacgacgaaccggggcgacccgggcacatcaacgaggagatgccatggacaatattaccaggcagaaccaattctacgatacccaagtcatcaaacaagaaaacgagtcaggctacgagaggagaccactggaaatggagcagcagcaggcctatcgtccagaaatgaagacagagatgaagcaaggagcacccaccagcttcctcccgcctgaagcttctcaactcaagccagacaggcagcaattccagagtcgaaagaggccttatgaagaaaaccggggacgggggtactttgagcaccgagaggataggaggggccgctctcctcagcctcctgctgaagaggatgaagatgactttgatgatacccttgttgctattgacacctataactgcgacctccacttcaaggtggcccgagatcggagtagtggctatccgctcacaattgagggctttgcatacctgtggtcaggagcccgtgccagctatggggtcagaaggggccgtgtatgcttcgagatgaagatcaatgaggaaatctccgtgaagcaccttccgtctacagagcctgacccccacgtggtccgtatcggctggtccctggactcctgcagcacccagctaggcgaagagcctttctcctatggctatggaggcactgggaagaagtccaccaatagccggtttgaaaactacggagacaagtttgcagagaacgatgtgattggctgctttgcggattttgaatgtggaaatgacgtggaactgtcttttaccaagaatggaaagtggatgggcattgctttccgaatccagaaggaagccttggggggtcaggccctctatcctcatgtcctggtgaagaattgcgcagtggagttcaacttcggacagagagcagagccctactgttctgtcctcccggggtttaccttcatccagcaccttccccttagtgagcgtatccggggcaccgttggaccaaagagcaaggcagaatgtgagattctgatgatggtgggcctgcctgctgctggcaagaccacatgggccatcaaacatgcagcctccaacccttccaagaagtacaacatcctgggtaccaatgccatcatggataagatgcgggtgatgggcctacgccggcagcggaactatgctggccgctgggatgtcctgatccagcaggccacccagtgcctcaaccgcctcatccagattgctgcccgcaagaaacgcaactatatcctagatcagacaaatgtttatgggtcagcccagagacgaaaaatgagaccatttgaaggcttccagcgcaaagctattgtaatttgtcccactgacgaggacctaaaagaccgaacaataaagcgaaccgacgaggaagggaaggatgtcccagatcatgcggtcttagaaatgaaagccaacttcacgttgccagatgttggggacttcctggatgaggttctgttcattgagctgcagcgggaggaagcggacaagctagtgaggcagtacaacgaggaaggccgcaaggctgggccaccccctgaaaagcgctttgacaaccgaggtggtggtggcttccggggccgcgggggtggtggtggcttccagcgctatgaaaaccgaggaccccctggaggcaaccgtggcggcttccagaaccgagggggaggcagcggtggaggaggcaactaccgaggaggtttcaaccgcagcggaggtggtggctatagccagaaccgctggggtaacaacaaccgggataacaacaactccaacaacagaggcagctacaaccgggctccccagcaacagccgccaccacagcagcctccgccaccacagccaccaccccagcagccaccgccaccacccagctacagccctgctcggaaccccccaggggccagcacctacaataagaacagcaacatccctggctcaagcgccaataccagcacccccaccgtcagcagctacagccctccacagccgagttacagccagccaccctacaaccagggaggttacagccagggctacacagccccaccgcctccacctccaccaccacctgcctacaactatgggagctacggcggttacaacccggccccctataccccaccgccaccccccaccgcacagacctaccctcagcccagctataaccagtatcagcagtatgcccagcagtggaaccagtactatcagaaccagggccagtggccgccatactacgggaactacgactacgggagctactccgggaacacacagggtggcacaagtacacagtagccagtgtgacccagaggctcccggaggcccctgccggcttcctccaccagcgcctgcctcggcccctcctctgcccccgccagatcccgtggtgctggggatggggtcatcccagggctgcctccctccagcccactgcctcccctctgaggggcttccttcccctccatagggccaggcatttttttctggattcaaacaggcaacaatgaccttttattttctgtttgtccccacctccccagccttccacctcctgttcttcctaccttcttcctttttgactaaataatccccacctcccttgatcatacagtgaggctacagtgactgaggggagaatcccctcctgttcactctcccaaccctgctccagcccctcagcttcccagaccctcatgcagttggttgtaaattctcccaggagctgttttactgtctacttttcaggattaaaaaaaaaatcaaaacttaaaaaaaaaaaagtttaaaaagcaaaatggggagggggaggaagcagtgacttttttttggtaattatgcgcttttttttaatttttagaatttgtctttttactgtgggtgggctgttgatatttcatcaagataagcatttctttcctgagttcaggtgactgaggaagagccacaaaacaaaacacaacaaaaccaaaccacagaatcatctttaacccaactttttatacgatgccccagttccccataactttgcacacaagcttctgtgttcagttgaattgtaactgctttttgtatttggagagagtgactattgaacttgaaaccttttattccgggcgtcttggtagtttctggtgggattcagtgggtgagagggaagaaggggaggttggggggctccttcccttcagaacttgaagtttctcccactgcctcctctccagtggtctcccaggtgccagacccaaaagcttttcctacagtgataccctttatttttacttccccttgactcatatgttttaacatgattttaacaaactgcacttattaagaaatgtgtttgccctgttttgtttggtttcgttttgttttctttgaataaatgacatggcacctcctagcaggaaggaagcagggttgaaaccctgaagtgttactgcagttggccgttaattggggtgggggcctctttaaagggaaattatttactcattcattaaacaacttaactgaggga

SEQ ID NO: 365685 - DNA, 3588 bp, Homo sapiens
gggacgggggtggcggggaggattccgtaccgtagggatcggagaccggaaactgctttctggagccgaagagagtcggaagaacaagagatgccatggacaatattaccaggcagaaccaattctacgatacccaagtcatcaaacaagaaaacgagtcaggctacgagaggagaccactggaaatggagcagcagcaggcctatcgtccagaaatgaagacagagatgaagcaaggagcacccaccagcttcctcccgcctgaagcttctcaactcaagccagacaggcagcaattccagagtcgaaagaggccttatgaagaaaaccggggacgggggtactttgagcaccgagaggataggaggggccgctctcctcagcctcctgctgaagaggatgaagatgactttgatgatacccttgttgctattgacacctataactgcgacctccacttcaaggtggcccgagatcggagtagtggctatccgctcacaattgagggctttgcatacctgtggtcaggagcccgtgccagctatggggtcagaaggggccgtgtatgcttcgagatgaagatcaatgaggaaatctccgtgaagcaccttccgtctacagagcctgacccccacgtggtccgtatcggctggtccctggactcctgcagcacccagctaggcgaagagcctttctcctatggctatggaggcactgggaagaagtccaccaatagccggtttgaaaactacggagacaagtttgcagagaacgatgtgattggctgctttgcggattttgaatgtggaaatgacgtggaactgtcttttaccaagaatggaaagtggatgggcattgctttccgaatccagaaggaagccttggggggtcaggccctctatcctcatgtcctggtgaagaattgcgcagtggagttcaacttcggacagagagcagagccctactgttctgtcctcccggggtttaccttcatccagcaccttccccttagtgagcgtatccggggcaccgttggaccaaagagcaaggcagaatgtgagattctgatgatggtgggcctgcctgctgctggcaagaccacatgggccatcaaacatgcagcctccaacccttccaagaagtacaacatcctgggtaccaatgccatcatggataagatgcgggtgatgggcctacgccggcagcggaactatgctggccgctgggatgtcctgatccagcaggccacccagtgcctcaaccgcctcatccagattgctgcccgcaagaaacgcaactatatcctagatcagacaaatgtttatgggtcagcccagagacgaaaaatgagaccatttgaaggcttccagcgcaaagctattgtaatttgtcccactgacgaggacctaaaagaccgaacaataaagcgaaccgacgaggaagggaaggatgtcccagatcatgcggtcttagaaatgaaagccaacttcacgttgccagatgttggggacttcctggatgaggttctgttcattgagctgcagcgggaggaagcggacaagctagtgaggcagtacaacgaggaaggccgcaaggctgggccaccccctgaaaagcgctttgacaaccgaggtggtggtggcttccggggccgcgggggtggtggtggcttccagcgctatgaaaaccgaggaccccctggaggcaaccgtggcggcttccagaaccgagggggaggcagcggtggaggaggcaactaccgaggaggtttcaaccgcagcggaggtggtggctatagccagaaccgctggggtaacaacaaccgggataacaacaactccaacaacagaggcagctacaaccgggctccccagcaacagccgccaccacagcagcctccgccaccacagccaccaccccagcagccaccgccaccacccagctacagccctgctcggaaccccccaggggccagcacctacaataagaacagcaacatccctggctcaagcgccaataccagcacccccaccgtcagcagctacagccctccacagccgagttacagccagccaccctacaaccagggaggttacagccagggctacacagccccaccgcctccacctccaccaccacctgcctacaactatgggagctacggcggttacaacccggccccctataccccaccgccaccccccaccgcacagacctaccctcagcccagctataaccagtatcagcagtatgcccagcagtggaaccagtactatcagaaccagggccagtggccgccatactacgggaactacgactacgggagctactccgggaacacacagggtggcacaagtacacagtagccagtgtgacccagaggctcccggaggcccctgccggcttcctccaccagcgcctgcctcggcccctcctctgcccccgccagatcccgtggtgctggggatggggtcatcccagggctgcctccctccagcccactgcctcccctctgaggggcttccttcccctccatagggccaggcatttttttctggattcaaacaggcaacaatgaccttttattttctgtttgtccccacctccccagccttccacctcctgttcttcctaccttcttcctttttgactaaataatccccacctcccttgatcatacagtgaggctacagtgactgaggggagaatcccctcctgttcactctcccaaccctgctccagcccctcagcttcccagaccctcatgcagttggttgtaaattctcccaggagctgttttactgtctacttttcaggattaaaaaaaaaatcaaaacttaaaaaaaaaaaagtttaaaaagcaaaatggggagggggaggaagcagtgacttttttttggtaattatgcgcttttttttaatttttagaatttgtctttttactgtgggtgggctgttgatatttcatcaagataagcatttctttcctgagttcaggtgactgaggaagagccacaaaacaaaacacaacaaaaccaaaccacagaatcatctttaacccaactttttatacgatgccccagttccccataactttgcacacaagcttctgtgttcagttgaattgtaactgctttttgtatttggagagagtgactattgaacttgaaaccttttattccgggcgtcttggtagtttctggtgggattcagtgggtgagagggaagaaggggaggttggggggctccttcccttcagaacttgaagtttctcccactgcctcctctccagtggtctcccaggtgccagacccaaaagcttttcctacagtgataccctttatttttacttccccttgactcatatgttttaacatgattttaacaaactgcacttattaagaaatgtgtttgccctgttttgtttggtttcgttttgttttctttgaataaatgacatggcacctcctagcaggaaggaagcagggttgaaaccctgaagtgttactgcagttggccgttaattggggtgggggcctctttaaagggaaattatttactcattcattaaacaacttaactgaggga

SEQ ID NO: 365686 - DNA, 3643 bp, Homo sapiens
tagtatgcatgccatgaatagttaatattattattcttaccactcttagttgagctcctggacctgcagatgccttctggatgctttggtccagggttcttcatgaaccgcccctctaattggccatttttaattttgttttaagatgccatggacaatattaccaggcagaaccaattctacgatacccaagtcatcaaacaagaaaacgagtcaggctacgagaggagaccactggaaatggagcagcagcaggcctatcgtccagaaatgaagacagagatgaagcaaggagcacccaccagcttcctcccgcctgaagcttctcaactcaagccagacaggcagcaattccagagtcgaaagaggccttatgaagaaaaccggggacgggggtactttgagcaccgagaggataggaggggccgctctcctcagcctcctgctgaagaggatgaagatgactttgatgatacccttgttgctattgacacctataactgcgacctccacttcaaggtggcccgagatcggagtagtggctatccgctcacaattgagggctttgcatacctgtggtcaggagcccgtgccagctatggggtcagaaggggccgtgtatgcttcgagatgaagatcaatgaggaaatctccgtgaagcaccttccgtctacagagcctgacccccacgtggtccgtatcggctggtccctggactcctgcagcacccagctaggcgaagagcctttctcctatggctatggaggcactgggaagaagtccaccaatagccggtttgaaaactacggagacaagtttgcagagaacgatgtgattggctgctttgcggattttgaatgtggaaatgacgtggaactgtcttttaccaagaatggaaagtggatgggcattgctttccgaatccagaaggaagccttggggggtcaggccctctatcctcatgtcctggtgaagaattgcgcagtggagttcaacttcggacagagagcagagccctactgttctgtcctcccggggtttaccttcatccagcaccttccccttagtgagcgtatccggggcaccgttggaccaaagagcaaggcagaatgtgagattctgatgatggtgggcctgcctgctgctggcaagaccacatgggccatcaaacatgcagcctccaacccttccaagaagtacaacatcctgggtaccaatgccatcatggataagatgcgggtgatgggcctacgccggcagcggaactatgctggccgctgggatgtcctgatccagcaggccacccagtgcctcaaccgcctcatccagattgctgcccgcaagaaacgcaactatatcctagatcagacaaatgtttatgggtcagcccagagacgaaaaatgagaccatttgaaggcttccagcgcaaagctattgtaatttgtcccactgacgaggacctaaaagaccgaacaataaagcgaaccgacgaggaagggaaggatgtcccagatcatgcggtcttagaaatgaaagccaacttcacgttgccagatgttggggacttcctggatgaggttctgttcattgagctgcagcgggaggaagcggacaagctagtgaggcagtacaacgaggaaggccgcaaggctgggccaccccctgaaaagcgctttgacaaccgaggtggtggtggcttccggggccgcgggggtggtggtggcttccagcgctatgaaaaccgaggaccccctggaggcaaccgtggcggcttccagaaccgagggggaggcagcggtggaggaggcaactaccgaggaggtttcaaccgcagcggaggtggtggctatagccagaaccgctggggtaacaacaaccgggataacaacaactccaacaacagaggcagctacaaccgggctccccagcaacagccgccaccacagcagcctccgccaccacagccaccaccccagcagccaccgccaccacccagctacagccctgctcggaaccccccaggggccagcacctacaataagaacagcaacatccctggctcaagcgccaataccagcacccccaccgtcagcagctacagccctccacagccgagttacagccagccaccctacaaccagggaggttacagccagggctacacagccccaccgcctccacctccaccaccacctgcctacaactatgggagctacggcggttacaacccggccccctataccccaccgccaccccccaccgcacagacctaccctcagcccagctataaccagtatcagcagtatgcccagcagtggaaccagtactatcagaaccagggccagtggccgccatactacgggaactacgactacgggagctactccgggaacacacagggtggcacaagtacacagtagccagtgtgacccagaggctcccggaggcccctgccggcttcctccaccagcgcctgcctcggcccctcctctgcccccgccagatcccgtggtgctggggatggggtcatcccagggctgcctccctccagcccactgcctcccctctgaggggcttccttcccctccatagggccaggcatttttttctggattcaaacaggcaacaatgaccttttattttctgtttgtccccacctccccagccttccacctcctgttcttcctaccttcttcctttttgactaaataatccccacctcccttgatcatacagtgaggctacagtgactgaggggagaatcccctcctgttcactctcccaaccctgctccagcccctcagcttcccagaccctcatgcagttggttgtaaattctcccaggagctgttttactgtctacttttcaggattaaaaaaaaaatcaaaacttaaaaaaaaaaaagtttaaaaagcaaaatggggagggggaggaagcagtgacttttttttggtaattatgcgcttttttttaatttttagaatttgtctttttactgtgggtgggctgttgatatttcatcaagataagcatttctttcctgagttcaggtgactgaggaagagccacaaaacaaaacacaacaaaaccaaaccacagaatcatctttaacccaactttttatacgatgccccagttccccataactttgcacacaagcttctgtgttcagttgaattgtaactgctttttgtatttggagagagtgactattgaacttgaaaccttttattccgggcgtcttggtagtttctggtgggattcagtgggtgagagggaagaaggggaggttggggggctccttcccttcagaacttgaagtttctcccactgcctcctctccagtggtctcccaggtgccagacccaaaagcttttcctacagtgataccctttatttttacttccccttgactcatatgttttaacatgattttaacaaactgcacttattaagaaatgtgtttgccctgttttgtttggtttcgttttgttttctttgaataaatgacatggcacctcctagcaggaaggaagcagggttgaaaccctgaagtgttactgcagttggccgttaattggggtgggggcctctttaaagggaaattatttactcattcattaaacaacttaactgaggga

SEQ ID NO: 365687 - DNA, 4155 bp, Homo sapiens
tccgctccggcctcggcttcgacgtaggccaacgcttcctccccagtagctcctaggccttctcgtggccgttgttttgaaaacggcgctctgattggctaggtttccgggcccgcgcccgttgccccacgcactgaccaattggcactcatgtaacatcggacgaggcacgagtgaggggggaggcggtggcggcggccattttgagccgctgccgccattggagtgggccccccccctttcccccttcgcctcctgacaggaaaggtttaagggggacagagccctgggaggccgggccgggctcgggggccaccccgggggcccgggccatggatgtgcgccgtctgaaggtgaacgaacttcgcgaggagctgcagcgccgcggcctggacactcgaggcctcaaggccgagcttgctgagcggctgcaggcggcgttggaggccgaggagcctgacgacgagcgggagctcgacgccgacgacgaaccggggcgacccgggcacatcaacgaggaggtcgagaccgaggggggctccgagctggaggggaccgcgcagccaccgccgcccgggctgcagccgcacgcggagcccggcggctactcggggccggacggacattatgccatggacaatattaccaggcagaaccaattctacgatacccaagtcatcaaacaagaaaacgagtcaggctacgagaggagaccactggaaatggagcagcagcaggcctatcgtccagaaatgaagacagagatgaagcaaggagcacccaccagcttcctcccgcctgaagcttctcaactcaagccagacaggcagcaattccagagtcgaaagaggccttatgaagaaaaccggggacgggggtactttgagcaccgagaggataggaggggccgctctcctcagcctcctgctgaagaggatgaagatgactttgatgatacccttgttgctattgacacctataactgcgacctccacttcaaggtggcccgagatcggagtagtggctatccgctcacaattgagggctttgcatacctgtggtcaggagcccgtgccagctatggggtcagaaggggccgtgtatgcttcgagatgaagatcaatgaggaaatctccgtgaagcaccttccgtctacagagcctgacccccacgtggtccgtatcggctggtccctggactcctgcagcacccagctaggcgaagagcctttctcctatggctatggaggcactgggaagaagtccaccaatagccggtttgaaaactacggagacaagtttgcagagaacgatgtgattggctgctttgcggattttgaatgtggaaatgacgtggaactgtcttttaccaagaatggaaagtggatgggcattgctttccgaatccagaaggaagccttggggggtcaggccctctatcctcatgtcctggtgaagaattgcgcagtggagttcaacttcggacagagagcagagccctactgttctgtcctcccggggtttaccttcatccagcaccttccccttagtgagcgtatccggggcaccgttggaccaaagagcaaggcagaatgtgagattctgatgatggtgggcctgcctgctgctggcaagaccacatgggccatcaaacatgcagcctccaacccttccaagaagtacaacatcctgggtaccaatgccatcatggataagatgcgggtgatgggcctacgccggcagcggaactatgctggccgctgggatgtcctgatccagcaggccacccagtgcctcaaccgcctcatccagattgctgcccgcaagaaacgcaactatatcctagatcagacaaatgtttatgggtcagcccagagacgaaaaatgagaccatttgaaggcttccagcgcaaagctattgtaatttgtcccactgacgaggacctaaaagaccgaacaataaagcgaaccgacgaggaagggaaggatgtcccagatcatgcggtcttagaaatgaaagccaacttcacgttgccagatgttggggacttcctggatgaggttctgttcattgagctgcagcgggaggaagcggacaagctagtgaggcagtacaacgaggaaggccgcaaggctgggccaccccctgaaaagcgctttgacaaccgaggtggtggtggcttccggggccgcgggggtggtggtggcttccagcgctatgaaaaccgaggaccccctggaggcaaccgtggcggcttccagaaccgagggggaggcagcggtggaggaggcaactaccgaggaggtttcaaccgcagcggaggtggtggctatagccagaaccgctggggtaacaacaaccgggataacaacaactccaacaacagaggcagctacaaccgggctccccagcaacagccgccaccacagcagcctccgccaccacagccaccaccccagcagccaccgccaccacccagctacagccctgctcggaaccccccaggggccagcacctacaataagaacagcaacatccctggctcaagcgccaataccagcacccccaccgtcagcagctacagccctccacagagctttggcttttttccctccactttccagccgagttacagccagccaccctacaaccagggaggttacagccagggctacacagccccaccgcctccacctccaccaccacctgcctacaactatgggagctacggcggttacaacccggccccctataccccaccgccaccccccaccgcacagacctaccctcagcccagctataaccagtatcagcagtatgcccagcagtggaaccagtactatcagaaccagggccagtggccgccatactacgggaactacgactacgggagctactccgggaacacacagggtggcacaagtacacagtagccagtgtgacccagaggctcccggaggcccctgccggcttcctccaccagcgcctgcctcggcccctcctctgcccccgccagatcccgtggtgctggggatggggtcatcccagggctgcctccctccagcccactgcctcccctctgaggggcttccttcccctccatagggccaggcatttttttctggattcaaacaggcaacaatgaccttttattttctgtttgtccccacctccccagccttccacctcctgttcttcctaccttcttcctttttgactaaataatccccacctcccttgatcatacagtgaggctacagtgactgaggggagaatcccctcctgttcactctcccaaccctgctccagcccctcagcttcccagaccctcatgcagttggttgtaaattctcccaggagctgttttactgtctacttttcaggattaaaaaaaaaatcaaaacttaaaaaaaaaaaagtttaaaaagcaaaatggggagggggaggaagcagtgacttttttttggtaattatgcgcttttttttaatttttagaatttgtctttttactgtgggtgggctgttgatatttcatcaagataagcatttctttcctgagttcaggtgactgaggaagagccacaaaacaaaacacaacaaaaccaaaccacagaatcatctttaacccaactttttatacgatgccccagttccccataactttgcacacaagcttctgtgttcagttgaattgtaactgctttttgtatttggagagagtgactattgaacttgaaaccttttattccgggcgtcttggtagtttctggtgggattcagtgggtgagagggaagaaggggaggttggggggctccttcccttcagaacttgaagtttctcccactgcctcctctccagtggtctcccaggtgccagacccaaaagcttttcctacagtgataccctttatttttacttccccttgactcatatgttttaacatgattttaacaaactgcacttattaagaaatgtgtttgccctgttttgtttggtttcgttttgttttctttgaataaatgacatggcacctcctagcaggaaggaagcagggttgaaaccctgaagtgttactgcagttggccgttaattggggtgggggcctctttaaagggaaattatttactcattcattaaacaacttaactgaggga

SEQ ID NO: 365688 - DNA, 3181 bp, Homo sapiens
  misc_feature (12)..(12): n is a, c, g, or t
  misc_feature (25)..(27): n is a, c, g, or t
aactggctaggnacgaggctgggtnnngtgaactataactgcgacctccacttcaaggtggcccgagatcggagtagtggctatccgctcacaattgagggctttgcatacctgtggtcaggagcccgtgccagctatggggtcagaaggggccgtgtatgcttcgagatgaagatcaatgaggaaatctccgtgaagcaccttccgtctacagagcctgacccccacgtggtccgtatcggctggtccctggactcctgcagcacccagctaggcgaagagcctttctcctatggctatggaggcactgggaagaagtccaccaatagccggtttgaaaactacggagacaagtttgcagagaacgatgtgattggctgctttgcggattttgaatgtggaaatgacgtggaactgtcttttaccaagaatggaaagtggatgggcattgctttccgaatccagaaggaagccttggggggtcaggccctctatcctcatgtcctggtgaagaattgcgcagtggagttcaacttcggacagagagcagagccctactgttctgtcctcccggggtttaccttcatccagcaccttccccttagtgagcgtatccggggcaccgttggaccaaagagcaaggcagaatgtgagattctgatgatggtgggcctgcctgctgctggcaagaccacatgggccatcaaacatgcagcctccaacccttccaagaagtacaacatcctgggtaccaatgccatcatggataagatgcgggtgatgggcctacgccggcagcggaactatgctggccgctgggatgtcctgatccagcaggccacccagtgcctcaaccgcctcatccagattgctgcccgcaagaaacgcaactatatcctagatcagacaaatgtttatgggtcagcccagagacgaaaaatgagaccatttgaaggcttccagcgcaaagctattgtaatttgtcccactgacgaggacctaaaagaccgaacaataaagcgaaccgacgaggaagggaaggatgtcccagatcatgcggtcttagaaatgaaagccaacttcacgttgccagatgttggggacttcctggatgaggttctgttcattgagctgcagcgggaggaagcggacaagctagtgaggcagtacaacgaggaaggccgcaaggctgggccaccccctgaaaagcgctttgacaaccgaggtggtggtggcttccggggccgcgggggtggtggtggcttccagcgctatgaaaaccgaggaccccctggaggcaaccgtggcggcttccagaaccgagggggaggcagcggtggaggaggcaactaccgaggaggtttcaaccgcagcggaggtggtggctatagccagaaccgctggggtaacaacaaccgggataacaacaactccaacaacagaggcagctacaaccgggctccccagcaacagccgccaccacagcagcctccgccaccacagccaccaccccagcagccaccgccaccacccagctacagccctgctcggaaccccccaggggccagcacctacaataagaacagcaacatccctggctcaagcgccaataccagcacccccaccgtcagcagctacagccctccacagccgagttacagccagccaccctacaaccagggaggttacagccagggctacacagccccaccgcctccacctccaccaccacctgcctacaactatgggagctacggcggttacaacccggccccctataccccaccgccaccccccaccgcacagacctaccctcagcccagctataaccagtatcagcagtatgcccagcagtggaaccagtactatcagaaccagggccagtggccgccatactacgggaactacgactacgggagctactccgggaacacacagggtggcacaagtacacagtagccagtgtgacccagaggctcccggaggcccctgccggcttcctccaccagcgcctgcctcggcccctcctctgcccccgccagatcccgtggtgctggggatggggtcatcccagggctgcctccctccagcccactgcctcccctctgaggggcttccttcccctccatagggccaggcatttttttctggattcaaacaggcaacaatgaccttttattttctgtttgtccccacctccccagccttccacctcctgttcttcctaccttcttcctttttgactaaataatccccacctcccttgatcatacagtgaggctacagtgactgaggggagaatcccctcctgttcactctcccaaccctgctccagcccctcagcttcccagaccctcatgcagttggttgtaaattctcccaggagctgttttactgtctacttttcaggattaaaaaaaaaatcaaaacttaaaaaaaaaaaagtttaaaaagcaaaatggggagggggaggaagcagtgacttttttttggtaattatgcgcttttttttaatttttagaatttgtctttttactgtgggtgggctgttgatatttcatcaagataagcatttctttcctgagttcaggtgactgaggaagagccacaaaacaaaacacaacaaaaccaaaccacagaatcatctttaacccaactttttatacgatgccccagttccccataactttgcacacaagcttctgtgttcagttgaattgtaactgctttttgtatttggagagagtgactattgaacttgaaaccttttattccgggcgtcttggtagtttctggtgggattcagtgggtgagagggaagaaggggaggttggggggctccttcccttcagaacttgaagtttctcccactgcctcctctccagtggtctcccaggtgccagacccaaaagcttttcctacagtgataccctttatttttacttccccttgactcatatgttttaacatgattttaacaaactgcacttattaagaaatgtgtttgccctgttttgtttggtttcgttttgttttctttgaataaatgacatggcacctcctagcaggaaggaagcagggttgaaaccctgaagtgttactgcagttggccgttaattggggtgggggcctctttaaagggaaattatttactcattcattaaacaacttaactgaggga

SEQ ID NO: 365689 - DNA, 3016 bp, Homo sapiens
ttttaaacgggcccccctcgaggccgaggtattataactgatcagacagcggatgacccccacgtggtccgtatcggctggtccctggactcctgcagcacccagctaggcgaagagcctttctcctatggctatggaggcactgggaagaagtccaccaatagccggtttgaaaactacggagacaagtttgcagagaacgatgtgattggctgctttgcggattttgaatgtggaaatgacgtggaactgtcttttaccaagaatggaaagtggatgggcattgctttccgaatccagaaggaagccttggggggtcaggccctctatcctcatgtcctggtgaagaattgcgcagtggagttcaacttcggacagagagcagagccctactgttctgtcctcccggggtttaccttcatccagcaccttccccttagtgagcgtatccggggcaccgttggaccaaagagcaaggcagaatgtgagattctgatgatggtgggcctgcctgctgctggcaagaccacatgggccatcaaacatgcagcctccaacccttccaagaagtacaacatcctgggtaccaatgccatcatggataagatgcgggtgatgggcctacgccggcagcggaactatgctggccgctgggatgtcctgatccagcaggccacccagtgcctcaaccgcctcatccagattgctgcccgcaagaaacgcaactatatcctagatcagacaaatgtttatgggtcagcccagagacgaaaaatgagaccatttgaaggcttccagcgcaaagctattgtaatttgtcccactgacgaggacctaaaagaccgaacaataaagcgaaccgacgaggaagggaaggatgtcccagatcatgcggtcttagaaatgaaagccaacttcacgttgccagatgttggggacttcctggatgaggttctgttcattgagctgcagcgggaggaagcggacaagctagtgaggcagtacaacgaggaaggccgcaaggctgggccaccccctgaaaagcgctttgacaaccgaggtggtggtggcttccggggccgcgggggtggtggtggcttccagcgctatgaaaaccgaggaccccctggaggcaaccgtggcggcttccagaaccgagggggaggcagcggtggaggaggcaactaccgaggaggtttcaaccgcagcggaggtggtggctatagccagaaccgctggggtaacaacaaccgggataacaacaactccaacaacagaggcagctacaaccgggctccccagcaacagccgccaccacagcagcctccgccaccacagccaccaccccagcagccaccgccaccacccagctacagccctgctcggaaccccccaggggccagcacctacaataagaacagcaacatccctggctcaagcgccaataccagcacccccaccgtcagcagctacagccctccacagccgagttacagccagccaccctacaaccagggaggttacagccagggctacacagccccaccgcctccacctccaccaccacctgcctacaactatgggagctacggcggttacaacccggccccctataccccaccgccaccccccaccgcacagacctaccctcagcccagctataaccagtatcagcagtatgcccagcagtggaaccagtactatcagaaccagggccagtggccgccatactacgggaactacgactacgggagctactccgggaacacacagggtggcacaagtacacagtagccagtgtgacccagaggctcccggaggcccctgccggcttcctccaccagcgcctgcctcggcccctcctctgcccccgccagatcccgtggtgctggggatggggtcatcccagggctgcctccctccagcccactgcctcccctctgaggggcttccttcccctccatagggccaggcatttttttctggattcaaacaggcaacaatgaccttttattttctgtttgtccccacctccccagccttccacctcctgttcttcctaccttcttcctttttgactaaataatccccacctcccttgatcatacagtgaggctacagtgactgaggggagaatcccctcctgttcactctcccaaccctgctccagcccctcagcttcccagaccctcatgcagttggttgtaaattctcccaggagctgttttactgtctacttttcaggattaaaaaaaaaatcaaaacttaaaaaaaaaaaagtttaaaaagcaaaatggggagggggaggaagcagtgacttttttttggtaattatgcgcttttttttaatttttagaatttgtctttttactgtgggtgggctgttgatatttcatcaagataagcatttctttcctgagttcaggtgactgaggaagagccacaaaacaaaacacaacaaaaccaaaccacagaatcatctttaacccaactttttatacgatgccccagttccccataactttgcacacaagcttctgtgttcagttgaattgtaactgctttttgtatttggagagagtgactattgaacttgaaaccttttattccgggcgtcttggtagtttctggtgggattcagtgggtgagagggaagaaggggaggttggggggctccttcccttcagaacttgaagtttctcccactgcctcctctccagtggtctcccaggtgccagacccaaaagcttttcctacagtgataccctttatttttacttccccttgactcatatgttttaacatgattttaacaaactgcacttattaagaaatgtgtttgccctgttttgtttggtttcgttttgttttctttgaataaatgacatggcacctcctagcaggaaggaagcagggttgaaaccctgaagtgttactgcagttggccgttaattggggtgggggcctctttaaagggaaattatttactcattcattaaacaacttaactgaggga

SEQ ID NO: 365690 - DNA, 4129 bp, Homo sapiens
tccgctccggcctcggcttcgacgtaggccaacgcttcctccccagtagctcctaggccttctcgtggccgttgttttgaaaacggcgctctgattggctaggtttccgggcccgcgcccgttgccccacgcactgaccaattggcactcatgtaacatcggacgaggcacgagtgaggggggaggcggtggcggcggccattttgagccgctgccgccattggagtgggccccccccctttcccccttcgcctcctgacaggaaaggtttaagggggacagagccctgggaggccgggccgggctcgggggccaccccgggggcccgggccatggatgtgcgccgtctgaaggtgaacgaacttcgcgaggagctgcagcgccgcggcctggacactcgaggcctcaaggccgagcttgctgagcggctgcaggcggcgttggaggccgaggagcctgacgacgagcgggagctcgacgccgacgacgaaccggggcgacccgggcacatcaacgaggaggtcgagaccgaggggggctccgagctggaggggaccgcgcagccaccgccgcccgggctgcagccgcacgcggagcccggcggctactcggggccggacggacattatgccatggacaatattaccaggcagaaccaattctacgatacccaagtcatcaaacaagaaaacgagtcaggctacgagaggagaccactggaaatggagcagcagcaggcctatcgtccagaaatgaagacagagatgaagcaaggagcacccaccagcttcctcccgcctgaagcttctcaactcaagccagacaggcagcaattccagagtcgaaagaggccttatgaagaaaaccggggacgggggtactttgagcaccgagaggataggaggggccgctctcctcagcctcctgctgaagaggatgaagatgactttgatgatacccttgttgctattgacacctataactgcgacctccacttcaaggtggcccgagatcggagtagtggctatccgctcacaattgagggctttgcatacctgtggtcaggagcccgtgccagctatggggtcagaaggggccgtgtatgcttcgagatgaagatcaatgaggaaatctccgtgaagcaccttccgtctacagagcctgacccccacgtggtccgtatcggctggtccctggactcctgcagcacccagctaggcgaagagcctttctcctatggctatggaggcactgggaagaagtccaccaatagccggtttgaaaactacggagacaagtttgcagagaacgatgtgattggctgctttgcggattttgaatgtggaaatgacgtggaactgtcttttaccaagaatggaaagtggatgggcattgctttccgaatccagaaggaagccttggggggtcaggccctctatcctcatgtcctggtgaagaattgcgcagtggagttcaacttcggacagagagcagagccctactgttctgtcctcccggggtttaccttcatccagcaccttccccttagtgagcgtatccggggcaccgttggaccaaagagcaaggcagaatgtgagattctgatgatggtgggcctgcctgctgctggcaagaccacatgggccatcaaacatgcagcctccaacccttccaagaagtacaacatcctgggtaccaatgccatcatggataagatgcgggtgatgggcctacgccggcagcggaactatgctggccgctgggatgtcctgatccagcaggccacccagtgcctcaaccgcctcatccagattgctgcccgcaagaaacgcaactatatcctagatcagacaaatgtttatgggtcagcccagagacgaaaaatgagaccatttgaaggcttccagcgcaaagctattgtaatttgtcccactgacgaggacctaaaagaccgaacaataaagcgaaccgacgaggaagggaaggatgtcccagatcatgcggtcttagaaatgaaagaaagccaacttcacgttgccagatgttggggacttcctggatgaggttctgttcattgagctgcagcgggaggaagcggacaagctagtgaggcagtacaacgaggaaggccgcaaggctgggccaccccctgaaaagcgctttgacaaccgaggtggtggtggcttccggggccgcgggggtggtggtggcttccagcgctatgaaaaccgaggaccccctggaggcaaccgtggcggcttccagaaccgagggggaggcagcggtggaggaggcaactaccgaggaggtttcaaccgcagcggaggtggtggctatagccagaaccgctggggtaacaacaaccgggataacaacaactccaacaacagaggcagctacaaccgggctccccagcaacagccgccaccacagcagcctccgccaccacagccaccaccccagcagccaccgccaccacccagctacagccctgctcggaaccccccaggggccagcacctacaataagaacagcaacatccctggctcaagcgccaataccagcacccccaccgtcagcagctacagccctccacagccgagttacagccagccaccctacaaccagggaggttacagccagggctacacagccccaccgcctccacctccaccaccacctgcctacaactatgggagctacggcggttacaacccggccccctataccccaccgccaccccccaccgcacagacctaccctcagcccagctataaccagtatcagcagtatgcccagcagtggaaccagtactatcagaaccagggccagtggccgccatactacgggaactacgactacgggagctactccgggaacacacagggtggcacaagtacacagtagccagtgtgacccagaggctcccggaggcccctgccggcttcctccaccagcgcctgcctcggcccctcctctgcccccgccagatcccgtggtgctggggatggggtcatcccagggctgcctccctccagcccactgcctcccctctgaggggcttccttcccctccatagggccaggcatttttttctggattcaaacaggcaacaatgaccttttattttctgtttgtccccacctccccagccttccacctcctgttcttcctaccttcttcctttttgactaaataatccccacctcccttgatcatacagtgaggctacagtgactgaggggagaatcccctcctgttcactctcccaaccctgctccagcccctcagcttcccagaccctcatgcagttggttgtaaattctcccaggagctgttttactgtctacttttcaggattaaaaaaaaaatcaaaacttaaaaaaaaaaaagtttaaaaagcaaaatggggagggggaggaagcagtgacttttttttggtaattatgcgcttttttttaatttttagaatttgtctttttactgtgggtgggctgttgatatttcatcaagataagcatttctttcctgagttcaggtgactgaggaagagccacaaaacaaaacacaacaaaaccaaaccacagaatcatctttaacccaactttttatacgatgccccagttccccataactttgcacacaagcttctgtgttcagttgaattgtaactgctttttgtatttggagagagtgactattgaacttgaaaccttttattccgggcgtcttggtagtttctggtgggattcagtgggtgagagggaagaaggggaggttggggggctccttcccttcagaacttgaagtttctcccactgcctcctctccagtggtctcccaggtgccagacccaaaagcttttcctacagtgataccctttatttttacttccccttgactcatatgttttaacatgattttaacaaactgcacttattaagaaatgtgtttgccctgttttgtttggtttcgttttgttttctttgaataaatgacatggcacctcctagcaggaaggaagcagggttgaaaccctgaagtgttactgcagttggccgttaattggggtgggggcctctttaaagggaaattatttactcattcattaaacaacttaactgaggga

SEQ ID NO: 365691 - DNA, 2832 bp, Homo sapiens
  misc_feature (2761)..(2761): n is a, c, g, or t
  misc_feature (2764)..(2764): n is a, c, g, or t
  misc_feature (2767)..(2767): n is a, c, g, or t
  misc_feature (2830)..(2830): n is a, c, g, or t
tccgctccggcctcggcttcgacgtaggccaacgcttcctccccagtagctcctaggccttctcgtggccgttgttttgaaaacggcgctctgattggctaggtttccgggcccgcgcccgttgccccacgcactgaccaattggcactcatgtaacatcggacgaggcacgagtgaggggggaggcggtggcggcggccattttgagccgctgccgccattggagtgggccccccccctttcccccttcgcctcctgacaggaaaggtttaagggggacagagccctgggaggccgggccgggctcgggggccaccccgggggcccgggccatggatgtgcgccgtctgaaggtgaacgaacttcgcgaggagctgcagcgccgcggcctggacactcgaggcctcaaggccgagcttgctgagcggctgcaggcggcgttggaggccgaggagcctgacgacgagcgggagctcgacgccgacgacgaaccggggcgacccgggcacatcaacgaggaggtcgagaccgaggggggctccgagctggaggggaccgcgcagccaccgccgcccgggctgcagccgcacgcggagcccggcggctactcggggccggacggacattatgccatggacaatattaccaggcagaaccaattctacgatacccaagtcatcaaacaagaaaacgagtcaggctacgagaggagaccactggaaatggagcagcagcaggcctatcgtccagaaatgaagacagagatgaagcaaggagcacccaccagcttcctcccgcctgaagcttctcaactcaagccagacaggcagcaattccagagtcgaaagaggccttatgaagaaaaccggggacgggggtactttgagcaccgagaggataggaggggccgctctcctcagcctcctgctgaagaggatgaagatgactttgatgatacccttgttgctattgacacctataactgcgacctccacttcaaggtggcccgagatcggagtagtggctatccgctcacaattgagggctttgcatacctgtggtcaggagcccgtgccagctatggggtcagaaggggccgtgtatgcttcgagatgaagatcaatgaggaaatctccgtgaagcaccttccgtctacagagcctgacccccacgtggtccgtatcggctggtccctggactcctgcagcacccagctaggcgaagagcctttctcctatggctatggaggcactgggaagaagtccaccaatagccggtttgaaaactacggagacaagtttgcagagaacgatgtgattggctgctttgcggattttgaatgtggaaatgacgtggaactgtcttttaccaagaatggaaagtggatgggcattgctttccgaatccagaaggaagccttggggggtcaggccctctatcctcatgtcctggtgaagaattgcgcagtggagttcaacttcggacagagagcagagccctactgttctgtcctcccggggtttaccttcatccagcaccttccccttagtgagcgtatccggggcaccgttggaccaaagagcaaggcagaatgtgagattctgatgatggtgggcctgcctgctgctggcaagaccacatgggccatcaaacatgcagcctccaacccttccaagaagtacaacatcctgggtaccaatgccatcatggataagatgcgggtgatgggcctacgccggcagcggaactatgctggccgctgggatgtcctgatccagcaggccacccagtgcctcaaccgcctcatccagattgctgcccgcaagaaacgcaactatatcctagatcagacaaatgtttatgggtcagcccagagacgaaaaatgagaccatttgaaggcttccagcgcaaagctattgtaatttgtcccactgacgaggacctaaaagaccgaacaataaagcgaaccgacgaggaagggaaggatgtcccagatcatgcggtcttagaaatgaaagccaacttcacgttgccagatgttggggacttcctggatgaggttctgttcattgagctgcagcgggaggaagcggacaagctagtgaggcagtacaacgaggaaggccgcaaggctgggccaccccctgaaaagcgctttgacaaccgaggtggtggtggcttccggggccgcgggggtggtggtggcttccagcgctatgaaaaccgaggaccccctggaggcaaccgtggcggcttccagaaccgagggggaggcagcggtggaggaggcaactaccgaggaggtttcaaccgcagcggaggtggtggctatagccagaaccgctggggtaacaacaaccgggataacaacaactccaacaacagaggcagctacaaccgggctccccagcaacagccgccaccacagcagcctccgccaccacagccaccaccccagcagccaccgccaccacccagctacagccctgctcggaaccccccaggggccagcacctacaataagaacagcaacatccctggctcaagcgccaataccagcacccccaccgtcagcagctacagccctccacagccgagttacagccagccaccctacaaccagggaggttacagccagggctacacagccccaccgcctccacctccaccaccacctgcctacaactatgggagctacggcggttacaacccggccccctataccccaccgccaccccccaccgcacagacctacccctntcnccngccctgactaaactaccacctcaggtgacttttaaaaaatgctggtttaagaaagtaaccaanaa

SEQ ID NO: 365692 - DNA, 2579 bp, Homo sapiens
tccgctccggcctcggcttcgacgtaggccaacgcttcctccccagtagctcctaggccttctcgtggccgttgttttgaaaacggcgctctgattggctaggtttccgggcccgcgcccgttgccccacgcactgaccaattggcactcatgtaacatcggacgaggcacgagtgaggggggaggcggtggcggcggccattttgagccgctgccgccattggagtgggccccccccctttcccccttcgcctcctgacaggaaaggtttaagggggacagagccctgggaggccgggccgggctcgggggccaccccgggggcccgggccatggatgtgcgccgtctgaaggtgaacgaacttcgcgaggagctgcagcgccgcggcctggacactcgaggcctcaaggccgagcttgctgagcggctgcaggcggcgttggaggccgaggagcctgacgacgagcgggagctcgacgccgacgacgaaccggggcgacccgggcacatcaacgaggaggtcgagaccgaggggggctccgagctggaggggaccgcgcagccaccgccgcccgggctgcagccgcacgcggagcccggcggctactcggggccggacggacattatgccatggacaatattaccaggcagaaccaattctacgatacccaagtcatcaaacaagaaaacgagtcaggctacgagaggagaccactggaaatggagcagcagcaggcctatcgtccagaaatgaagacagagatgaagcaaggagcacccaccagcttcctcccgcctgaagcttctcaactcaagccagacaggcagcaattccagagtcgaaagaggccttatgaagaaaaccggggacgggggtactttgagcaccgagaggataggaggggccgctctcctcagcctcctgctgaagaggatgaagatgactttgatgatacccttgttgctattgacacctataactgcgacctccacttcaaggtggcccgagatcggagtagtggctatccgctcacaattgagggctttgcatacctgtggtcaggagcccgtgccagctatggggtcagaaggggccgtgtatgcttcgagatgaagatcaatgaggaaatctccgtgaagcaccttccgtctacagagcctgacccccacgtggtccgtatcggctggtccctggactcctgcagcacccagctaggcgaagagcctttctcctatggctatggaggcactgggaagaagtccaccaatagccggtttgaaaactacggagacaagtttgcagagaacgatgtgattggctgctttgcggattttgaatgtggaaatgacgtggaactgtcttttaccaagaatggaaagtggatgggcattgctttccgaatccagaaggaagccttggggggtcaggccctctatcctcatgtcctggtgaagaattgcgcagtggagttcaacttcggacagagagcagagccctactgttctgtcctcccggggtttaccttcatccagcaccttccccttagtgagcgtatccggggcaccgttggaccaaagagcaaggcagaatgtgagattctgatgatggtgggcctgcctgctgctggcaagaccacatgggccatcaaacatgcagcctccaacccttccaagaagtacaacatcctgggtaccaatgccatcatggataagatgcgggtgatgggcctacgccggcagcggaactatgctggccgctgggatgtcctgatccagcaggccacccagtgcctcaaccgcctcatccagattgctgcccgcaagaaacgcaactatatcctagatcagacaaatgtttatgggtcagcccagagacgaaaaatgagaccatttgaaggcttccagcgcaaagctattgtaatttgtcccactgacgaggacctaaaagaccgaacaataaagcgaaccgacgaggaagggaaggatgtcccagatcatgcggtcttagaaatgaaagccaacttcacgttgccagatgttggggacttcctggatgaggttctgttcattgagctgcagcgggaggaagcggacaagctagtgaggcagtacaacgaggaaggccgcaaggctgggccaccccctgaaaagcgctttgacaaccgaggtggtggtggcttccggggccgcgggggtggtggtggcttccagcgctatgaaaaccgaggaccccctggaggcaaccgtggcggcttccagaaccgagggggaggcagcggtggaggaggcaactaccgaggaggtttcaaccgcagcggaggtggtggctatagccagaaccgctggggtaacaacaaccgggataacaacaactccaacaacagaggcagctacaaccgggctccccagcaacagccgccaccacagcagcctccgccaccacagccaccaccccagcagccaccgccaccacccagctacagccctgctcggaacccccagggcagactacaatagacagacatcctggtcaggcatacaggacccacgagagtaagctcaagagttgttttcctc

SEQ ID NO: 365693 - DNA, 2378 bp, Homo sapiens
atttttagtagagatggggttttgccatgttggccaggctggtcttgaactcctgacctcaggtgatccacccgcctcggcctcccaaagtgctgggattacaggcgtgagccaccgcgcccgcccttctgtctttgtctttcttattcactattccagttttcttcaccttctcccttctggaaggccactcttctgggtggaggggaccagacttcagaaggtactgacctcttcttcttgttctctttggggcacttccttcctcctagccaacttcacgttgccagatgttggggacttcctggatgaggttctgttcattgagctgcagcgggaggaagcggacaagctagtgaggcagtacaacgaggaaggccgcaaggctgggccaccccctgaaaagcgctttgacaaccgaggtggtggtggcttccggggccgcgggggtggtggtggcttccagcgctatgaaaaccgaggaccccctggaggcaaccgtggcggcttccagaaccgagggggaggcagcggtggaggaggcaactaccgaggaggtttcaaccgcagcggaggtggtggctatagccagaaccgctggggtaacaacaaccgggataacaacaactccaacaacagaggcagctacaaccgggctccccagcaacagccgccaccacagcagcctccgccaccacagccaccaccccagcagccaccgccaccacccagctacagccctgctcggaaccccccaggggccagcacctacaataagaacagcaacatccctggctcaagcgccaataccagcacccccaccgtcagcagctacagccctccacagccgagttacagccagccaccctacaaccagggaggttacagccagggctacacagccccaccgcctccacctccaccaccacctgcctacaactatgggagctacggcggttacaacccggccccctataccccaccgccaccccccaccgcacagacctaccctcagcccagctataaccagtatcagcagtatgcccagcagtggaaccagtactatcagaaccagggccagtggccgccatactacgggaactacgactacgggagctactccgggaacacacagggtggcacaagtacacagtagccagtgtgacccagaggctcccggaggcccctgccggcttcctccaccagcgcctgcctcggcccctcctctgcccccgccagatcccgtggtgctggggatggggtcatcccagggctgcctccctccagcccactgcctcccctctgaggggcttccttcccctccatagggccaggcatttttttctggattcaaacaggcaacaatgaccttttattttctgtttgtccccacctccccagccttccacctcctgttcttcctaccttcttcctttttgactaaataatccccacctcccttgatcatacagtgaggctacagtgactgaggggagaatcccctcctgttcactctcccaaccctgctccagcccctcagcttcccagaccctcatgcagttggttgtaaattctcccaggagctgttttactgtctacttttcaggattaaaaaaaaaatcaaaacttaaaaaaaaaaaagtttaaaaagcaaaatggggagggggaggaagcagtgacttttttttggtaattatgcgcttttttttaatttttagaatttgtctttttactgtgggtgggctgttgatatttcatcaagataagcatttctttcctgagttcaggtgactgaggaagagccacaaaacaaaacacaacaaaaccaaaccacagaatcatctttaacccaactttttatacgatgccccagttccccataactttgcacacaagcttctgtgttcagttgaattgtaactgctttttgtatttggagagagtgactattgaacttgaaaccttttattccgggcgtcttggtagtttctggtgggattcagtgggtgagagggaagaaggggaggttggggggctccttcccttcagaacttgaagtttctcccactgcctcctctccagtggtctcccaggtgccagacccaaaagcttttcctacagtgataccctttatttttacttccccttgactcatatgttttaacatgattttaacaaactgcacttattaagaaatgtgtttgccctgttttgtttggtttcgttttgttttctttgaataaatgacatggcacctcctagcaggaaggaagcagggttgaaaccctgaagtgttactgcagttggccgttaattggggtgggggcctctttaaagggaaattatttactcattcattaaacaacttaactgaggga

SEQ ID NO: 365694 - DNA, 2052 bp, Homo sapiens
tccgctccggcctcggcttcgacgtaggccaacgcttcctccccagtagctcctaggccttctcgtggccgttgttttgaaaacggcgctctgattggctaggtttccgggcccgcgcccgttgccccacgcactgaccaattggcactcatgtaacatcggacgaggcacgagtgaggggggaggcggtggcggcggccattttgagccgctgccgccattggagtgggccccccccctttcccccttcgcctcctgacaggaaaggtttaagggggacagagccctgggaggccgggccgggctcgggggccaccccgggggcccgggccatggatgtgcgccgtctgaaggtgaacgaacttcgcgaggagctgcagcgccgcggcctggacactcgaggcctcaaggccgagcttgctgagcggctgcaggcggcgttggaggccgaggagcctgacgacgagcgggagctcgacgccgacgacgaaccggggcgacccgggcacatcaacgaggagccgagttacagccagccaccctacaaccagggaggttacagccagggctacacagccccaccgcctccacctccaccaccacctgcctacaactatgggagctacggcggttacaacccggccccctataccccaccgccaccccccaccgcacagacctaccctcagcccagctataaccagtatcagcagtatgcccagcagtggaaccagtactatcagaaccagggccagtggccgccatactacgggaactacgactacgggagctactccgggaacacacagggtggcacaagtacacagtagccagtgtgacccagaggctcccggaggcccctgccggcttcctccaccagcgcctgcctcggcccctcctctgcccccgccagatcccgtggtgctggggatggggtcatcccagggctgcctccctccagcccactgcctcccctctgaggggcttccttcccctccatagggccaggcatttttttctggattcaaacaggcaacaatgaccttttattttctgtttgtccccacctccccagccttccacctcctgttcttcctaccttcttcctttttgactaaataatccccacctcccttgatcatacagtgaggctacagtgactgaggggagaatcccctcctgttcactctcccaaccctgctccagcccctcagcttcccagaccctcatgcagttggttgtaaattctcccaggagctgttttactgtctacttttcaggattaaaaaaaaaatcaaaacttaaaaaaaaaaaagtttaaaaagcaaaatggggagggggaggaagcagtgacttttttttggtaattatgcgcttttttttaatttttagaatttgtctttttactgtgggtgggctgttgatatttcatcaagataagcatttctttcctgagttcaggtgactgaggaagagccacaaaacaaaacacaacaaaaccaaaccacagaatcatctttaacccaactttttatacgatgccccagttccccataactttgcacacaagcttctgtgttcagttgaattgtaactgctttttgtatttggagagagtgactattgaacttgaaaccttttattccgggcgtcttggtagtttctggtgggattcagtgggtgagagggaagaaggggaggttggggggctccttcccttcagaacttgaagtttctcccactgcctcctctccagtggtctcccaggtgccagacccaaaagcttttcctacagtgataccctttatttttacttccccttgactcatatgttttaacatgattttaacaaactgcacttattaagaaatgtgtttgccctgttttgtttggtttcgttttgttttctttgaataaatgacatggcacctcctagcaggaaggaagcagggttgaaaccctgaagtgttactgcagttggccgttaattggggtgggggcctctttaaagggaaattatttactcattcattaaacaacttaactgaggga

SEQ ID NO: 365695 - DNA, 1797 bp, Homo sapiens
  misc_feature (29)..(29): n is a, c, g, or t
aataaggtctaggtacgaggctgggtggngcccgggataacaacaactccaacaacagaggcagctacaaccgggctccccagcaacagccgccaccacagcagcctccgccaccacagccaccaccccagcagccaccgccaccacccagctacagccctgctcggaaccccccaggggccagcacctacaataagaacagcaacatccctggctcaagcgccaataccagcacccccaccgtcagcagctacagccctccacagccgagttacagccagccaccctacaaccagggaggttacagccagggctacacagccccaccgcctccacctccaccaccacctgcctacaactatgggagctacggcggttacaacccggccccctataccccaccgccaccccccaccgcacagacctaccctcagcccagctataaccagtatcagcagtatgcccagcagtggaaccagtactatcagaaccagggccagtggccgccatactacgggaactacgactacgggagctactccgggaacacacagggtggcacaagtacacagtagccagtgtgacccagaggctcccggaggcccctgccggcttcctccaccagcgcctgcctcggcccctcctctgcccccgccagatcccgtggtgctggggatggggtcatcccagggctgcctccctccagcccactgcctcccctctgaggggcttccttcccctccatagggccaggcatttttttctggattcaaacaggcaacaatgaccttttattttctgtttgtccccacctccccagccttccacctcctgttcttcctaccttcttcctttttgactaaataatccccacctcccttgatcatacagtgaggctacagtgactgaggggagaatcccctcctgttcactctcccaaccctgctccagcccctcagcttcccagaccctcatgcagttggttgtaaattctcccaggagctgttttactgtctacttttcaggattaaaaaaaaaatcaaaacttaaaaaaaaaaaagtttaaaaagcaaaatggggagggggaggaagcagtgacttttttttggtaattatgcgcttttttttaatttttagaatttgtctttttactgtgggtgggctgttgatatttcatcaagataagcatttctttcctgagttcaggtgactgaggaagagccacaaaacaaaacacaacaaaaccaaaccacagaatcatctttaacccaactttttatacgatgccccagttccccataactttgcacacaagcttctgtgttcagttgaattgtaactgctttttgtatttggagagagtgactattgaacttgaaaccttttattccgggcgtcttggtagtttctggtgggattcagtgggtgagagggaagaaggggaggttggggggctccttcccttcagaacttgaagtttctcccactgcctcctctccagtggtctcccaggtgccagacccaaaagcttttcctacagtgataccctttatttttacttccccttgactcatatgttttaacatgattttaacaaactgcacttattaagaaatgtgtttgccctgttttgtttggtttcgttttgttttctttgaataaatgacatggcacctcctagcaggaaggaagcagggttgaaaccctgaagtgttactgcagttggccgttaattggggtgggggcctctttaaagggaaattatttactcattcattaaacaacttaactgaggga

SEQ ID NO: 365696 - DNA, 1802 bp, Homo sapiens
aaactataggctaggtacgaggctgggtgttaatcggccgaggcccggggccgcgggggtggtggtggcttccagcgctatgaaaaccgaggaccccctggaggcaaccgtggcggcaccacagccaccaccccagcagccaccgccaccacccagctacagccctgctcggaaccccccaggggccagcacctacaataagaacagcaacatccctggctcaagcgccaataccagcacccccaccgtcagcagctacagccctccacagccgagttacagccagccaccctacaaccagggaggttacagccagggctacacagccccaccgcctccacctccaccaccacctgcctacaactatgggagctacggcggttacaacccggccccctataccccaccgccaccccccaccgcacagacctaccctcagcccagctataaccagtatcagcagtatgcccagcagtggaaccagtactatcagaaccagggccagtggccgccatactacgggaactacgactacgggagctactccgggaacacacagggtggcacaagtacacagtagccagtgtgacccagaggctcccggaggcccctgccggcttcctccaccagcgcctgcctcggcccctcctctgcccccgccagatcccgtggtgctggggatggggtcatcccagggctgcctccctccagcccactgcctcccctctgaggggcttccttcccctccatagggccaggcatttttttctggattcaaacaggcaacaatgaccttttattttctgtttgtccccacctccccagccttccacctcctgttcttcctaccttcttcctttttgactaaataatccccacctcccttgatcatacagtgaggctacagtgactgaggggagaatcccctcctgttcactctcccaaccctgctccagcccctcagcttcccagaccctcatgcagttggttgtaaattctcccaggagctgttttactgtctacttttcaggattaaaaaaaaaatcaaaacttaaaaaaaaaaaagtttaaaaagcaaaatggggagggggaggaagcagtgacttttttttggtaattatgcgcttttttttaatttttagaatttgtctttttactgtgggtgggctgttgatatttcatcaagataagcatttctttcctgagttcaggtgactgaggaagagccacaaaacaaaacacaacaaaaccaaaccacagaatcatctttaacccaactttttatacgatgccccagttccccataactttgcacacaagcttctgtgttcagttgaattgtaactgctttttgtatttggagagagtgactattgaacttgaaaccttttattccgggcgtcttggtagtttctggtgggattcagtgggtgagagggaagaaggggaggttggggggctccttcccttcagaacttgaagtttctcccactgcctcctctccagtggtctcccaggtgccagacccaaaagcttttcctacagtgataccctttatttttacttccccttgactcatatgttttaacatgattttaacaaactgcacttattaagaaatgtgtttgccctgttttgtttggtttcgttttgttttctttgaataaatgacatggcacctcctagcaggaaggaagcagggttgaaaccctgaagtgttactgcagttggccgttaattggggtgggggcctctttaaagggaaattatttactcattcattaaacaacttaactgaggga

SEQ ID NO: 365697 - DNA, 1718 bp, Homo sapiens
gctcggttctcggtattggcgcttgagccagggatgttgctgttcttattgtaggtgctggcccctgtggggttccgagcagggctgtagctgggtggtggcggtggctgctggggtggtggctgtggtggcttccacgctatgaaaaccgagcacccccaccgtcagcagctacagccctccacagccgagttacagccagccaccctacaaccagggaggttacagccagggctacacagccccaccgcctccacctccaccaccacctgcctacaactatgggagctacggcggttacaacccggccccctataccccaccgccaccccccaccgcacagacctaccctcagcccagctataaccagtatcagcagtatgcccagcagtggaaccagtactatcagaaccagggccagtggccgccatactacgggaactacgactacgggagctactccgggaacacacagggtggcacaagtacacagtagccagtgtgacccagaggctcccggaggcccctgccggcttcctccaccagcgcctgcctcggcccctcctctgcccccgccagatcccgtggtgctggggatggggtcatcccagggctgcctccctccagcccactgcctcccctctgaggggcttccttcccctccatagggccaggcatttttttctggattcaaacaggcaacaatgaccttttattttctgtttgtccccacctccccagccttccacctcctgttcttcctaccttcttcctttttgactaaataatccccacctcccttgatcatacagtgaggctacagtgactgaggggagaatcccctcctgttcactctcccaaccctgctccagcccctcagcttcccagaccctcatgcagttggttgtaaattctcccaggagctgttttactgtctacttttcaggattaaaaaaaaaatcaaaacttaaaaaaaaaaaagtttaaaaagcaaaatggggagggggaggaagcagtgacttttttttggtaattatgcgcttttttttaatttttagaatttgtctttttactgtgggtgggctgttgatatttcatcaagataagcatttctttcctgagttcaggtgactgaggaagagccacaaaacaaaacacaacaaaaccaaaccacagaatcatctttaacccaactttttatacgatgccccagttccccataactttgcacacaagcttctgtgttcagttgaattgtaactgctttttgtatttggagagagtgactattgaacttgaaaccttttattccgggcgtcttggtagtttctggtgggattcagtgggtgagagggaagaaggggaggttggggggctccttcccttcagaacttgaagtttctcccactgcctcctctccagtggtctcccaggtgccagacccaaaagcttttcctacagtgataccctttatttttacttccccttgactcatatgttttaacatgattttaacaaactgcacttattaagaaatgtgtttgccctgttttgtttggtttcgttttgttttctttgaataaatgacatggcacctcctagcaggaaggaagcagggttgaaaccctgaagtgttactgcagttggccgttaattggggtgggggcctctttaaagggaaattatttactcattcattaaacaacttaactgaggga

SEQ ID NO: 365698 - DNA, 2314 bp, Homo sapiens
tccgctccggcctcggcttcgacgtaggccaacgcttcctccccagtagctcctaggccttctcgtggccgttgttttgaaaacggcgctctgattggctaggtttccgggcccgcgcccgttgccccacgcactgaccaattggcactcatgtaacatcggacgaggcacgagtgaggggggaggcggtggcggcggccattttgagccgctgccgccattggagtgggccccccccctttcccccttcgcctcctgacaggaaaggtttaagggggacagagccctgggaggccgggccgggctcgggggccaccccgggggcccgggccatggatgtgcgccgtctgaaggtgaacgaacttcgcgaggagctgcagcgccgcggcctggacactcgaggcctcaaggccgagcttgctgagcggctgcaggcggcgttggaggccgaggagcctgacgacgagcgggagctcgacgccgacgacgaaccggggcgacccgggcacatcaacgaggaggtcgagaccgaggggggctccgagctggaggggaccgcgcagccaccgccgcccgggctgcagccgcacgcggagcccggcggctactcggggccggacggacattatgccatggacaatattaccaggcagaaccaattctacgatacccaagtcatcaaacaagaaaacgagtcaggctacgagaggagaccactggaaatggagcagcagcaggcctatcgtccagaaatgaagacagagatgaagcaaggagcacccaccagcttcctcccgcctgaagcttctcaactcaagccagacaggcagcaattccagagtcgaaagaggccttatgaagaaaaccggggacgggggtactttgagcaccgagaggataggaggggccgctctcctcagcctcctgctgaagaggatgaagatgactttgatgatacccttgttgctattgacacctataactgcgacctccacttcaaggtggcccgagatcggagtagtggctatccgctcacaattgagggctttgcatacctgtggtcaggagcccgtgccagctatggggtcagaaggggccgtgtatgcttcgagatgaagatcaatgaggaaatctccgtgaagcaccttccgtctacagagcctgacccccacgtggtccgtatcggctggtccctggactcctgcagcacccagctaggcgaagagcctttctcctatggctatggaggcactgggaagaagtccaccaatagccggtttgaaaactacggagacaagtttgcagagaacgatgtgattggctgctttgcggattttgaatgtggaaatgacgtggaactgtcttttaccaagaatggaaagtggatgggcattgctttccgaatccagaaggaagccttggggggtcaggccctctatcctcatgtcctggtgaagaattgcgcagtggagttcaacttcggacagagagcagagccctactgttctgtcctcccggggtttaccttcatccagcaccttccccttagtgagcgtatccggggcaccgttggaccaaagagcaaggcagaatgtgagattctgatgatggtgggcctgcctgctgctggcaagaccacatgggccatcaaacatgcagcctccaacccttccaagaagtacaacatcctgggtaccaatgccatcatggataagatgcgggtgatgggcctacgccggcagcggaactatgctggccgctgggatgtcctgatccagcaggccacccagtgcctcaaccgcctcatccagattgctgcccgcaagaaacgcaactatatcctagatcagacaaatgtttatgggtcagcccagagacgaaaaatgagaccatttgaaggcttccagcgcaaagctattgtaatttgtcccactgacgaggacctaaaagaccgaacaataaagcgaaccgacgaggaagggaaggatgtcccagatcatgcggtcttagaaatgaaagggtctcccaggtgccagacccaaaagcttttcctacagtgataccctttatttttacttccccttgactcatatgttttaacatgattttaacaaactgcacttattaagaaatgtgtttgccctgttttgtttggtttcgttttgttttctttgaataaatgacatggcacctcctagcaggaaggaagcagggttgaaaccctgaagtgttactgcagttggccgttaattggggtgggggcctctttaaagggaaattatttactcattcattaaacaacttaactgaggga

SEQ ID NO: 365699 - DNA, 992 bp, Homo sapiens
tccgctccggcctcggcttcgacgtaggccaacgcttcctccccagtagctcctaggccttctcgtggccgttgttttgaaaacggcgctctgattggctaggtttccgggcccgcgcccgttgccccacgcactgaccaattggcactcatgtaacatcggacgaggcacgagtgaggggggaggcggtggcggcggccattttgagccgctgccgccattggagtgggccccccccctttcccccttcgcctcctgacaggaaaggtttaagggggacagagccctgggaggccgggccgggctcgggggccaccccgggggcccgggccatggatgtgcgccgtctgaaggtgaacgaacttcgcgaggagctgcagcgccgcggcctggacactcgaggcctcaaggccgagcttgctgagcggctgcaggcggcgttggaggccgaggagcctgacgacgagcgggagctcgacgccgacgacgaaccggggcgacccgggcacatcaacgaggaggtcgagaccgaggggggctccgagctggaggggaccgcgcagccaccgccgcccgggctgcagccgcacgcggagcccggcggctactcggggccggacggacattatgccatggacaatattaccaggcagaaccaattctacgatacccaagtcatcaaacaagaaaacgagtcggtctcccaggtgccagacccaaaagcttttcctacagtgataccctttatttttacttccccttgactcatatgttttaacatgattttaacaaactgcacttattaagaaatgtgtttgccctgttttgtttggtttcgttttgttttctttgaataaatgacatggcacctcctagcaggaaggaagcagggttgaaaccctgaagtgttactgcagttggccgttaattggggtgggggcctctttaaagggaaattatttactcattcattaaacaacttaactgaggga

SEQ ID NO: 365700 - DNA, 346 bp, Homo sapiens
ggatgactagcaaccgagcctttttcgaggttcttagagatgattttaacagcactggcttgacagtgtctttgcctcagagattttcttcattttcccaccagctcagtcatgcatatcaaaagaagtttatgcacaattgaaggacaccaactaaaatttgaacaaataagagatttgtaactggggatcccctggaagaatcgtctggaaattacgaccttcatctggcgattgcagctgttaaagtctccaaagaagccattcttacattgtgttgtgaaattattactctatctcaaatctgtgccagaaagaaaataaaatgtgtgtttatgtgtaaaaa

SEQ ID NO: 365701 - DNA, 366 bp, Homo sapiens
ctaaaaccgcaatgctgtggggaaacccagcctagccgcatggagaggctatgtggccatcccagctgtcccagccatttcagcccagtgtctttgcctcagagattttcttcattttcccaccagctcagtcatgcatatcaaaagaagtttatgcacaattgaaggacaccaactaaaatttgaacaaataagaggtgtgtaatcatgttgaatagaaaaactcaacatcatgaagattttaattctccctaatttaatttataaatttgtctcagtaccaataaagtttttttttttaattttagaatgagacaaactagttttgagttcagatggaaaaataaaatagcctggaaagcttta

SEQ ID NO: 365702 - DNA, 772 bp, Homo sapiens
caggatggagacccgggaccctttgagaacatcccagacgttgatagtgtaatcattgtatccagcaaacagcaggcgaccttgaagcaggaaaagttccctttggggcatgaagagaagcaaaggctggggagaaaatgcctgagagcattgtggaagtgaatttctgacacttcattgccttgaaggacagcattaggtcatagaggcgacactggggagcaaataaataaagaagcacttacttctggcttcagtttggtgacgtgatgaccacagagctacagggaaggaacaaattacaaggaggggaatctgctcccgccctggtgttgcacccactggctgtccacaggaccccctccagccttgacttccctcaggaggcctgcatacatccaacaagatgacttaagctagcaaagtagcttatggacacacaaaacctgaaccgaggctgaaatttgggtactcatattttgttggatgctcaaattccctcaatctctcctggcccacacccactagtggctgttccaactcactgctttcctaataacacttgcagtaacttacagtttattttgagacaccaggtccaaacaattttctttaagcaactaccccagtcttgctctttaatttaggaaattttcataccatactgtttgatcaaagaaatgaatagtttttaaaagttaaaagtagatttctaatacttttcaattttgtgtttctgatcttcattataatataagtaaaaataaagttt

SEQ ID NO: 365703 - DNA, 1489 bp, Homo sapiens
caggatggagacccgggaccctttgagaacatcccagacgttgatagtgtaatcattgtatccagcaaacagcaggcgaccttgaagcaggaaaagttccctttggggcatgaagagaagcaaaggctggggagaaaatgcctgagagcattgtggaagtgaatttctgacacttcattgccttgaaggacagcattaggtcatagaggcgacactggggagcaaataaataaagaagcacttacttctggcttcagtttggtgacgtgatgaccacagagctacagggaaggaacaaattacaaggaggggaatctgctcccgccctggtgttgcacccactggctgtccacaggaccccctccagccttgacttccctcaggaggcctgcatacatccaacaagatgacttaagctagcaaagtagcttatggacacacaaaacctgaaccgaggctgaaatttgggtgagaaaaatgaagcacgcagaaattcaaacgctgtctaggatcaccagctagaacacagcggagccaagatccaatcctgctgtctgcctccagagccacccttgacctaccctgcctcccaggccgcgtccccgccgaggtagccagctgtgacttccctttatctccggctaagctgcttgttggaaaagaaagcactttctcacctactggtgccccctttcatccccaaccctgccccggggcaacacagagcgagtctgatgggtctccacagaggggcttcagatgcctgatggtcgtggtagccccctgagcctgccttcatccagcctaaatgtcctctgttgctttggtttgcctcaggcccaaagacatctcattttggccactgcaccagtcagtggccacagcgccccctggtgaacaagtctgcaagattcctgggtaggctcaaataataggtgtaaacaacaggggcacaatggtgacactgcaagtcccaacattcctccagtcagcaattgaacaattacccagccacctgacctccctgcctctaacctccccatccctcctgacatcaattcactgaagccagagtaaactatggaaggctttaatctaactcagacacttttctcttttaaacaaaccaaaatctgactcacccctgcaagggctcccgtcacctacagggtccagcccaggcactcagggagccctgggatctggccccacccacctctcggctgcctgcctcccactgtgctccctcacactctgtggccgcctggagtggcagcggtccctcttcactggcagcagcaagtctgtgaccaacccctcctgctcggagctccccagttcccccactgtccaaccattattggttttcatgaaggtccctgagggccaagactgagcttttggccccagagccacgtggtatctggcaatatgggtagtaggtactgagaaggtttgctgaataagtgtgaataaataaccgatgcgg

SEQ ID NO: 365704 - DNA, 264 bp, Homo sapiens
aatcttaccactgagggagaagtccacgctggatgctccaaatatgatgctttctttggaatagatggcaacctccctatctgcccgcaggtcatagaggcgacactggggagcaaataaataaagaagcacttacttctggcttcagtttggtgacgtgatgaccacagagctacaggtaggtgctagtgacttgcgtagtttaaaagatgaaggaaaaacttcttagttttccctactgttatttcatcctttagtcccgac

SEQ ID NO: 365705 - DNA, 365 bp, Homo sapiens
  misc_feature (1)..(1): n is a, c, g, or t
  misc_feature (67)..(67): n is a, c, g, or t
naccccttagcaggaaaaaggggggggggggggttttggggttttccccccctttccccaaccactnatttctttacaaagccactttgcttgcattttattttatttttttaagagtccttcatagagctcagtcaggaaggggatggggcaccaagccaagcccccagcattgggagcggccaggccacagctgctgctcccgtagtcctcaggctgtaagcaagagacagcactggcccttggccagcgtcctaccctgcccaactccaaggactgggtatggattgctgggccctaggctcttgcttctggggctattggagggtcagtgtctgtgactgaataaagttccattttgtggt

SEQ ID NO: 365706 - DNA, 2123 bp, Homo sapiens
cccgaagtttgaggggtgtggacggtttgtgacccccttagccgaccctactcctcactggccgggacaactggtcttatcacggaggctggggccaggcagcccttcggttcgggtgggcccatggaccccagtccaacgccgagggaataggaccatccaaaagcggaaccttcgcctcagaaaaagggtgcgggacccctcctcaccgtgcggtcacggtacggacagggtagatcacaggctgagggacagagcaaagacccctgaggccggacacctggggtcctgccgggcccctccccacgagagttccctgtgtctgtgccaatcgttttcgtctttctttgccgcagtttcttttcctgtaaatcatggttaatgacattaaccttcttaccatcaggggttagttgtggttgtgataaataattactaccgttattaagcaattgcaatttgcagtgtgccaggcactgtgccaagtattttgcttcgatgatttcacgtcatcttcaaaacaacctcatgagggctgggtcagttagaacctaaacaaactagagacctggttgcaacccctcaggctctgctgatgctgtccccctttgttcctgcagcgtggaccctgccagcagccaggccatggagctctctgatgtcaccctcattgagggtgtgggtaatgaggtgatggtggtggcaggtgtggtggtgctgattctagccttggtcctagcttggctctctacctacgtagcagacagcggtagcaaccagctcctgggcgctattgtgtcagcaggcgacacatccgtcctccacctggggcatgtggaccacctggtggcaggccaaggcaaccccgagccaactgaactcccccatccatcagaggcaaatacttccctggacaagaaagccagatgaaactgatctaccagggccgcctgctacaagacccagcccgcacactgcgttctctgaacattaccgacaactgtgtgattcactgccaccgctcacccccagggtcagctgttccaggcccctcagcctccttggccccctcggccactgagccacccagccttggtgtcaatgtgggcagcctcatggtgcctgtctttgtggtgctgttgggtgtggtctggtacttccgaatcaattaccgccaattcttcacagcacctgccactgtctccctggtgggagtcaccgtcttcttcagcttcctagtatttgggatgtatggacgataaggacataggaagaaaatgaaaggcatggtctttctcctttatggcctccccacttttcctggccagagctgggcccaagggccggggagggaggggtggaaaggatgtgatggaaatctcctccataggacacaggaggcaagtatgcggcctccccttctcatccacaggagtacagatgtccctcccgtgcgagcacaactcaggtagaaatgaggatgtcatcttccttcacttttagggtcctctgaaggagttcaaagctgctggccaagctcagtggggagcctgggctctgagattccctcccacctgtggttctgactcttcccagtgtcctgcatgtctgcccccagcacccagggctgcctgcaagggcagctcagcatggccccagcacaactccgtagggagcctggagtatccttccatttctcagccaaatactcatcttttgagactgaaatcacactggcgggaatgaagattgtgccagccttctcttatgggcacctagccgccttcaccttcttcctctaccccttagcaggaatagggtgtcctcccttctttcaaagcactttgcttgcattttattttatttttttaagagtccttcatagagctcagtcaggaaggggatggggcaccaagccaagcccccagcattgggagcggccaggccacagctgctgctcccgtagtcctcaggctgtaagcaagagacagcactggcccttggccagcgtcctaccctgcccaactccaaggactgggtatggattgctgggccctaggctcttgcttctggggctattggagggtcagtgtctgtgactgaataaagttccattttgtggt

SEQ ID NO: 365707 - DNA, 2394 bp, Homo sapiens
cccgaagtttgaggggtgtggacggtttgtgacccccttagccgaccctactcctcactggccgggacaactggtcttatcacggaggctggggccaggcagcccttcggttcgggtgggcccatggaccccagtccaacgccgagggaataggaccatccaaaagcggaaccttcgcctcagaaaaagggtgcgggacccctcctcaccgtgcggtcacggtacggacagggtagatcacaggctgagggacagagcaaagacccctgaggccggacacctggggtcctgccgggcccctccccacgagagttccctgtgtctgtgccaatcgttttcgtctttctttgccgcagtttcttttcctgtaaatcatggttaatgacattaaccttcttaccatcaggggttagttgtggttgtgataaataattactaccgttattaagcaattgcaatttgcagtgtgccaggcactgtgccaagtattttgcttcgatgatttcacgtcatcttcaaaacaacctcatgagataattctttgagcaactactggggcattatattggacacttcagtaccaagagaaatacatacgatccttgtctaccaggagtctaatagaaagatggacagggctgggtcagttagaacctaaacaaactagagacctggttgcaacccctcaggctctgctgatgctgtccccctttgttcctgcagcgtggaccctgccagcagccaggccatggagctctctgatgtcaccctcattgagggtgtgggtaatgaggtgatggtggtggcaggtgtggtggtgctgattctagccttggtcctagcttggctctctacctacgtagcagacagcggtagcaaccagctcctgggcgctattgtgtcagcaggcgacacatccgtcctccacctggggcatgtggaccacctggtggcaggccaaggcaaccccgagccaactgaactcccccatccatcagaggaagacaagcaggtgcaggcagcagcagtccagaggcccccctgagatctgaggatagcacctgcctccctcccagccctggcctcatcactgtgcggctcaaattcctcaatgataccgaggagctggctgtggctaggccagaggataccgtgggtgccctgaagagcaaatacttccctggacaagaaagccagatgaaactgatctaccagggccgcctgctacaagacccagcccgcacactgcgttctctgaacattaccgacaactgtgtgattcactgccaccgctcacccccagggtcagctgttccaggcccctcagcctccttggccccctcggccactgagccacccagccttggtgtcaatgtgggcagcctcatggtgcctgtctttgtggtgctgttgggtgtggtctggtacttccgaatcaattaccgccaattcttcacagcacctgccactgtctccctggtgggagtcaccgtcttcttcagcttcctagtatttgggatgtatggacgataaggacataggaagaaaatgaaaggcatggtctttctcctttatggcctccccacttttcctggccagagctgggcccaagggccggggagggaggggtggaaaggatgtgatggaaatctcctccataggacacaggaggcaagtatgcggcctccccttctcatccacaggagtacagatgtccctcccgtgcgagcacaactcaggtagaaatgaggatgtcatcttccttcacttttagggtcctctgaaggagttcaaagctgctggccaagctcagtggggagcctgggctctgagattccctcccacctgtggttctgactcttcccagtgtcctgcatgtctgcccccagcacccagggctgcctgcaagggcagctcagcatggccccagcacaactccgtagggagcctggagtatccttccatttctcagccaaatactcatcttttgagactgaaatcacactggcgggaatgaagattgtgccagccttctcttatgggcacctagccgccttcaccttcttcctctaccccttagcaggaatagggtgtcctcccttctttcaaagcactttgcttgcattttattttatttttttaagagtccttcatagagctcagtcaggaaggggatggggcaccaagccaagcccccagcattgggagcggccaggccacagctgctgctcccgtagtcctcaggctgtaagcaagagacagcactggcccttggccagcgtcctaccctgcccaactccaaggactgggtatggattgctgggccctaggctcttgcttctggggctattggagggtcagtgtctgtgactgaataaagttccattttgtggt

SEQ ID NO: 365708 - DNA, 2412 bp, Homo sapiens
cccgaagtttgaggggtgtggacggtttgtgacccccttagccgaccctactcctcactggccgggacaactggtcttatcacggaggctggggccaggcagcccttcggttcgggtgggcccatggaccccagtccaacgccgagggaataggaccatccaaaagcggaaccttcgcctcagaaaaagggtgcgggacccctcctcaccgtgcggtcacggtacggacagggtagatcacaggctgagggacagagcaaagacccctgaggccggacacctggggtcctgccgggcccctccccacgagagttccctgtgtctgtgccaatcgttttcgtctttctttgccgcagtttcttttcctgtaaatcatggttaatgacattaaccttcttaccatcaggggttagttgtggttgtgataaataattactaccgttattaagcaattgcaatttgcagtgtgccaggcactgtgccaagtattttgcttcgatgatttcacgtcatcttcaaaacaacctcatgagggctgggtcagttagaacctaaacaaactagagacctggttgcaacccctcaggctctgctgatgctgtccccctttgttcctgcagcgtggaccctgccagcagccaggccatggagctctctgatgtcaccctcattgagggtgtgggtaatgaggtgatggtggtggcaggtgtggtggtgctgattctagccttggtcctagcttggctctctacctacgtagcagacagcggtagcaaccagctcctgggcgctattgtgtcagcaggcgacacatccgtcctccacctggggcatgtggaccacctggtggcaggccaaggcaaccccgagccaactgaactcccccatccatcagagggtaatgatgagaaggctgaagaggcgggtgaaggtcggggagactccactggggaggctggagctgggggtggtgttgagcccagccttgagcatctccttgacatccaaggcctgcccaaaagacaagcaggtgcaggcagcagcagtccagaggcccccctgagatctgaggatagcacctgcctccctcccagccctggcctcatcactgtgcggctcaaattcctcaatgataccgaggagctggctgtggctaggccagaggataccgtgggtgccctgaagagcaaatacttccctggacaagaaagccagatgaaactgatctaccagggccgcctgctacaagacccagcccgcacactgcgttctctgaacattaccgacaactgtgtgattcactgccaccgctcacccccagggtcagctgttccaggcccctcagcctccttggccccctcggccactgagccacccagccttggtgtcaatgtgggcagcctcatggtgcctgtctttgtggtgctgttgggtgtggtctggtacttccgaatcaattaccgccaattcttcacagcacctgccactgtctccctggtgggagtcaccgtcttcttcagcttcctagtatttgggatgtatggacgataaggacataggaagaaaatgaaaggcatggtctttctcctttatggcctccccacttttcctggccagagctgggcccaagggccggggagggaggggtggaaaggatgtgatggaaatctcctccataggacacaggaggcaagtatgcggcctccccttctcatccacaggagtacagatgtccctcccgtgcgagcacaactcaggtagaaatgaggatgtcatcttccttcacttttagggtcctctgaaggagttcaaagctgctggccaagctcagtggggagcctgggctctgagattccctcccacctgtggttctgactcttcccagtgtcctgcatgtctgcccccagcacccagggctgcctgcaagggcagctcagcatggccccagcacaactccgtagggagcctggagtatccttccatttctcagccaaatactcatcttttgagactgaaatcacactggcgggaatgaagattgtgccagccttctcttatgggcacctagccgccttcaccttcttcctctaccccttagcaggaatagggtgtcctcccttctttcaaagcactttgcttgcattttattttatttttttaagagtccttcatagagctcagtcaggaaggggatggggcaccaagccaagcccccagcattgggagcggccaggccacagctgctgctcccgtagtcctcaggctgtaagcaagagacagcactggcccttggccagcgtcctaccctgcccaactccaaggactgggtatggattgctgggccctaggctcttgcttctggggctattggagggtcagtgtctgtgactgaataaagttccattttgtggt

SEQ ID NO: 365709 - DNA, 1982 bp, Homo sapiens
cccgaagtttgaggggtgtggacggtttgtgacccccttagccgaccctactcctcactggccgggacaactggtcttatcacggaggctggggccaggcagcccttcggttcgggtgggcccatggaccccagtccaacgccgagggaataggaccatccaaaagcggaaccttcgcctcagaaaaaggcgtggaccctgccagcagccaggccatggagctctctgatgtcaccctcattgagggtgtgggtaatgaggtgatggtggtggcaggtgtggtggtgctgattctagccttggtcctagcttggctctctacctacgtagcagacagcggtagcaaccagctcctgggcgctattgtgtcagcaggcgacacatccgtcctccacctggggcatgtggaccacctggtggcaggccaaggcaaccccgagccaactgaactcccccatccatcagagggtaatgatgagaaggctgaagaggcgggtgaaggtcggggagactccactggggaggctggagctgggggtggtgttgagcccagccttgagcatctccttgacatccaaggcctgcccaaaagacaagcaggtgcaggcagcagcagtccagaggcccccctgagatctgaggatagcacctgcctccctcccagccctggcctcatcactgtgcggctcaaattcctcaatgataccgaggagctggctgtggctaggccagaggataccgtgggtgccctgaagagcaaatacttccctggacaagaaagccagatgaaactgatctaccagggccgcctgctacaagacccagcccgcacactgcgttctctgaacattaccgacaactgtgtgattcactgccaccgctcacccccagggtcagctgttccaggcccctcagcctccttggccccctcggccactgagccacccagccttggtgtcaatgtgggcagcctcatggtgcctgtctttgtggtgctgttgggtgtggtctggtacttccgaatcaattaccgccaattcttcacagcacctgccactgtctccctggtgggagtcaccgtcttcttcagcttcctagtatttgggatgtatggacgataaggacataggaagaaaatgaaaggcatggtctttctcctttatggcctccccacttttcctggccagagctgggcccaagggccggggagggaggggtggaaaggatgtgatggaaatctcctccataggacacaggaggcaagtatgcggcctccccttctcatccacaggagtacagatgtccctcccgtgcgagcacaactcaggtagaaatgaggatgtcatcttccttcacttttagggtcctctgaaggagttcaaagctgctggccaagctcagtggggagcctgggctctgagattccctcccacctgtggttctgactcttcccagtgtcctgcatgtctgcccccagcacccagggctgcctgcaagggcagctcagcatggccccagcacaactccgtagggagcctggagtatccttccatttctcagccaaatactcatcttttgagactgaaatcacactggcgggaatgaagattgtgccagccttctcttatgggcacctagccgccttcaccttcttcctctaccccttagcaggaatagggtgtcctcccttctttcaaagcactttgcttgcattttattttatttttttaagagtccttcatagagctcagtcaggaaggggatggggcaccaagccaagcccccagcattgggagcggccaggccacagctgctgctcccgtagtcctcaggctgtaagcaagagacagcactggcccttggccagcgtcctaccctgcccaactccaaggactgggtatggattgctgggccctaggctcttgcttctggggctattggagggtcagtgtctgtgactgaataaagttccattttgtggt

SEQ ID NO: 365710 - DNA, 1921 bp, Homo sapiens
cgggagaagccggaagagaccggaccctgaacagaatcgcagattgccagcccttttcccgacccctacggaaagacgagtccaggggccgtcctggcgaggtcaaaacatttagtctggtcttttcagcgtggaccctgccagcagccaggccatggagctctctgatgtcaccctcattgagggtgtgggtaatgaggtgatggtggtggcaggtgtggtggtgctgattctagccttggtcctagcttggctctctacctacgtagcagacagcggtagcaaccagctcctgggcgctattgtgtcagcaggcgacacatccgtcctccacctggggcatgtggaccacctggtggcaggccaaggcaaccccgagccaactgaactcccccatccatcagagggtaatgatgagaaggctgaagaggcgggtgaaggtcggggagactccactggggaggctggagctgggggtggtgttgagcccagccttgagcatctccttgacatccaaggcctgcccaaaagacaagcaggtgcaggcagcagcagtccagaggcccccctgagatctgaggatagcacctgcctccctcccagccctggcctcatcactgtgcggctcaaattcctcaatgataccgaggagctggctgtggctaggccagaggataccgtgggtgccctgaagagcaaatacttccctggacaagaaagccagatgaaactgatctaccagggccgcctgctacaagacccagcccgcacactgcgttctctgaacattaccgacaactgtgtgattcactgccaccgctcacccccagggtcagctgttccaggcccctcagcctccttggccccctcggccactgagccacccagccttggtgtcaatgtgggcagcctcatggtgcctgtctttgtggtgctgttgggtgtggtctggtacttccgaatcaattaccgccaattcttcacagcacctgccactgtctccctggtgggagtcaccgtcttcttcagcttcctagtatttgggatgtatggacgataaggacataggaagaaaatgaaaggcatggtctttctcctttatggcctccccacttttcctggccagagctgggcccaagggccggggagggaggggtggaaaggatgtgatggaaatctcctccataggacacaggaggcaagtatgcggcctccccttctcatccacaggagtacagatgtccctcccgtgcgagcacaactcaggtagaaatgaggatgtcatcttccttcacttttagggtcctctgaaggagttcaaagctgctggccaagctcagtggggagcctgggctctgagattccctcccacctgtggttctgactcttcccagtgtcctgcatgtctgcccccagcacccagggctgcctgcaagggcagctcagcatggccccagcacaactccgtagggagcctggagtatccttccatttctcagccaaatactcatcttttgagactgaaatcacactggcgggaatgaagattgtgccagccttctcttatgggcacctagccgccttcaccttcttcctctaccccttagcaggaatagggtgtcctcccttctttcaaagcactttgcttgcattttattttatttttttaagagtccttcatagagctcagtcaggaaggggatggggcaccaagccaagcccccagcattgggagcggccaggccacagctgctgctcccgtagtcctcaggctgtaagcaagagacagcactggcccttggccagcgtcctaccctgcccaactccaaggactgggtatggattgctgggccctaggctcttgcttctggggctattggagggtcagtgtctgtgactgaataaagttccattttgtggt

SEQ ID NO: 365711 - DNA, 2325 bp, Homo sapiens
cccgaagtttgaggggtgtggacggtttgtgacccccttagccgaccctactcctcactggccgggacaactggtcttatcacggaggctggggccaggcagcccttcggttcgggtgggcccatggaccccagtccaacgccgagggaataggaccatccaaaagcggaaccttcgcctcagaaaaagggtgcgggacccctcctcaccgtgcggtcacggtacggacagggtagatcacaggctgagggacagagcaaagacccctgaggccggacacctggggtcctgccgggcccctccccacgagagttccctgtgtctgtgccaatcgttttcgtctttctttgccgcagtttcttttcctgtaaatcatggttaatgacattaaccttcttaccatcaggggttagttgtggttgtgataaataattactaccgttattaagcaattgcaatttgcagtgtgccaggcactgtgccaagtattttgcttcgatgatttcacgtcatcttcaaaacaacctcatgagcgtggaccctgccagcagccaggccatggagctctctgatgtcaccctcattgagggtgtgggtaatgaggtgatggtggtggcaggtgtggtggtgctgattctagccttggtcctagcttggctctctacctacgtagcagacagcggtagcaaccagctcctgggcgctattgtgtcagcaggcgacacatccgtcctccacctggggcatgtggaccacctggtggcaggccaaggcaaccccgagccaactgaactcccccatccatcagagggtaatgatgagaaggctgaagaggcgggtgaaggtcggggagactccactggggaggctggagctgggggtggtgttgagcccagccttgagcatctccttgacatccaaggcctgcccaaaagacaagcaggtgcaggcagcagcagtccagaggcccccctgagatctgaggatagcacctgcctccctcccagccctggcctcatcactgtgcggctcaaattcctcaatgataccgaggagctggctgtggctaggccagaggataccgtgggtgccctgaagagcaaatacttccctggacaagaaagccagatgaaactgatctaccagggccgcctgctacaagacccagcccgcacactgcgttctctgaacattaccgacaactgtgtgattcactgccaccgctcacccccagggtcagctgttccaggcccctcagcctccttggccccctcggccactgagccacccagccttggtgtcaatgtgggcagcctcatggtgcctgtctttgtggtgctgttgggtgtggtctggtacttccgaatcaattaccgccaattcttcacagcacctgccactgtctccctggtgggagtcaccgtcttcttcagcttcctagtatttgggatgtatggacgataaggacataggaagaaaatgaaaggcatggtctttctcctttatggcctccccacttttcctggccagagctgggcccaagggccggggagggaggggtggaaaggatgtgatggaaatctcctccataggacacaggaggcaagtatgcggcctccccttctcatccacaggagtacagatgtccctcccgtgcgagcacaactcaggtagaaatgaggatgtcatcttccttcacttttagggtcctctgaaggagttcaaagctgctggccaagctcagtggggagcctgggctctgagattccctcccacctgtggttctgactcttcccagtgtcctgcatgtctgcccccagcacccagggctgcctgcaagggcagctcagcatggccccagcacaactccgtagggagcctggagtatccttccatttctcagccaaatactcatcttttgagactgaaatcacactggcgggaatgaagattgtgccagccttctcttatgggcacctagccgccttcaccttcttcctctaccccttagcaggaatagggtgtcctcccttctttcaaagcactttgcttgcattttattttatttttttaagagtccttcatagagctcagtcaggaaggggatggggcaccaagccaagcccccagcattgggagcggccaggccacagctgctgctcccgtagtcctcaggctgtaagcaagagacagcactggcccttggccagcgtcctaccctgcccaactccaaggactgggtatggattgctgggccctaggctcttgcttctggggctattggagggtcagtgtctgtgactgaataaagttccattttgtggt

SEQ ID NO: 365712 - DNA, 2013 bp, Homo sapiens
cccgaagtttgaggggtgtggacggtttgtgacccccttagccgaccctactcctcactggccgggacaactggtcttatcacggaggctggggccaggcagcccttcggttcgggtgggcccatggaccccagtccaacgccgagggaataggaccatccaaaagcggaaccttcgcctcagaaaaagggtgcgggacccctcctcaccgtgcggtcacgcgtggaccctgccagcagccaggccatggagctctctgatgtcaccctcattgagggtgtgggtaatgaggtgatggtggtggcaggtgtggtggtgctgattctagccttggtcctagcttggctctctacctacgtagcagacagcggtagcaaccagctcctgggcgctattgtgtcagcaggcgacacatccgtcctccacctggggcatgtggaccacctggtggcaggccaaggcaaccccgagccaactgaactcccccatccatcagagggtaatgatgagaaggctgaagaggcgggtgaaggtcggggagactccactggggaggctggagctgggggtggtgttgagcccagccttgagcatctccttgacatccaaggcctgcccaaaagacaagcaggtgcaggcagcagcagtccagaggcccccctgagatctgaggatagcacctgcctccctcccagccctggcctcatcactgtgcggctcaaattcctcaatgataccgaggagctggctgtggctaggccagaggataccgtgggtgccctgaagagcaaatacttccctggacaagaaagccagatgaaactgatctaccagggccgcctgctacaagacccagcccgcacactgcgttctctgaacattaccgacaactgtgtgattcactgccaccgctcacccccagggtcagctgttccaggcccctcagcctccttggccccctcggccactgagccacccagccttggtgtcaatgtgggcagcctcatggtgcctgtctttgtggtgctgttgggtgtggtctggtacttccgaatcaattaccgccaattcttcacagcacctgccactgtctccctggtgggagtcaccgtcttcttcagcttcctagtatttgggatgtatggacgataaggacataggaagaaaatgaaaggcatggtctttctcctttatggcctccccacttttcctggccagagctgggcccaagggccggggagggaggggtggaaaggatgtgatggaaatctcctccataggacacaggaggcaagtatgcggcctccccttctcatccacaggagtacagatgtccctcccgtgcgagcacaactcaggtagaaatgaggatgtcatcttccttcacttttagggtcctctgaaggagttcaaagctgctggccaagctcagtggggagcctgggctctgagattccctcccacctgtggttctgactcttcccagtgtcctgcatgtctgcccccagcacccagggctgcctgcaagggcagctcagcatggccccagcacaactccgtagggagcctggagtatccttccatttctcagccaaatactcatcttttgagactgaaatcacactggcgggaatgaagattgtgccagccttctcttatgggcacctagccgccttcaccttcttcctctaccccttagcaggaatagggtgtcctcccttctttcaaagcactttgcttgcattttattttatttttttaagagtccttcatagagctcagtcaggaaggggatggggcaccaagccaagcccccagcattgggagcggccaggccacagctgctgctcccgtagtcctcaggctgtaagcaagagacagcactggcccttggccagcgtcctaccctgcccaactccaaggactgggtatggattgctgggccctaggctcttgcttctggggctattggagggtcagtgtctgtgactgaataaagttccattttgtggt

SEQ ID NO: 365713 - DNA, 2428 bp, Homo sapiens
cccgaagtttgaggggtgtggacggtttgtgacccccttagccgaccctactcctcactggccgggacaactggtcttatcacggaggctggggccaggcagcccttcggttcgggtgggcccatggaccccagtccaacgccgagggaataggaccatccaaaagcggaaccttcgcctcagaaaaagggtgcgggacccctcctcaccgtgcggtcacggtacggacagggtagatcacaggctgagggacagagcaaagacccctgaggccggacacctggggtcctgccgggcccctccccacgagagttccctgtgtctgtgccaatcgttttcgtctttctttgccgcagtttcttttcctgtaaatcatggttaatgacattaaccttcttaccatcaggggttagttgtggttgtgataaataattactaccgttattaagcaattgcaatttgcagtgtgccaggcactgtgccaagtattttgcttcgatgatttcacgtcatcttcaaaacaacctcatgagataattctttgagcaactactggggcattatattggacacttcagtaccaagagaaatacatacgatccttgtctaccaggagtctaatagaaagatggacagcgtggaccctgccagcagccaggccatggagctctctgatgtcaccctcattgagggtgtgggtaatgaggtgatggtggtggcaggtgtggtggtgctgattctagccttggtcctagcttggctctctacctacgtagcagacagcggtagcaaccagctcctgggcgctattgtgtcagcaggcgacacatccgtcctccacctggggcatgtggaccacctggtggcaggccaaggcaaccccgagccaactgaactcccccatccatcagagggtaatgatgagaaggctgaagaggcgggtgaaggtcggggagactccactggggaggctggagctgggggtggtgttgagcccagccttgagcatctccttgacatccaaggcctgcccaaaagacaagcaggtgcaggcagcagcagtccagaggcccccctgagatctgaggatagcacctgcctccctcccagccctggcctcatcactgtgcggctcaaattcctcaatgataccgaggagctggctgtggctaggccagaggataccgtgggtgccctgaagagcaaatacttccctggacaagaaagccagatgaaactgatctaccagggccgcctgctacaagacccagcccgcacactgcgttctctgaacattaccgacaactgtgtgattcactgccaccgctcacccccagggtcagctgttccaggcccctcagcctccttggccccctcggccactgagccacccagccttggtgtcaatgtgggcagcctcatggtgcctgtctttgtggtgctgttgggtgtggtctggtacttccgaatcaattaccgccaattcttcacagcacctgccactgtctccctggtgggagtcaccgtcttcttcagcttcctagtatttgggatgtatggacgataaggacataggaagaaaatgaaaggcatggtctttctcctttatggcctccccacttttcctggccagagctgggcccaagggccggggagggaggggtggaaaggatgtgatggaaatctcctccataggacacaggaggcaagtatgcggcctccccttctcatccacaggagtacagatgtccctcccgtgcgagcacaactcaggtagaaatgaggatgtcatcttccttcacttttagggtcctctgaaggagttcaaagctgctggccaagctcagtggggagcctgggctctgagattccctcccacctgtggttctgactcttcccagtgtcctgcatgtctgcccccagcacccagggctgcctgcaagggcagctcagcatggccccagcacaactccgtagggagcctggagtatccttccatttctcagccaaatactcatcttttgagactgaaatcacactggcgggaatgaagattgtgccagccttctcttatgggcacctagccgccttcaccttcttcctctaccccttagcaggaatagggtgtcctcccttctttcaaagcactttgcttgcattttattttatttttttaagagtccttcatagagctcagtcaggaaggggatggggcaccaagccaagcccccagcattgggagcggccaggccacagctgctgctcccgtagtcctcaggctgtaagcaagagacagcactggcccttggccagcgtcctaccctgcccaactccaaggactgggtatggattgctgggccctaggctcttgcttctggggctattggagggtcagtgtctgtgactgaataaagttccattttgtggt

SEQ ID NO: 365714 - DNA, 2092 bp, Homo sapiens
cgggagaagccggaagagaccggaccctgaacagaatcgcagattgccagcccttttcccgacccctacggaaagacgagtccaggggccgtcctggcgaggtcaaaacatttagtctggtcttttcagtgtgccaggcactgtgccaagtattttgcttcgatgatttcacgtcatcttcaaaacaacctcatgagataattctttgagcaactactggggcattatattggacacttcagtaccaagagaaatacatacgatccttgtctaccaggagtctaatagaaagatggacagcgtggaccctgccagcagccaggccatggagctctctgatgtcaccctcattgagggtgtgggtaatgaggtgatggtggtggcaggtgtggtggtgctgattctagccttggtcctagcttggctctctacctacgtagcagacagcggtagcaaccagctcctgggcgctattgtgtcagcaggcgacacatccgtcctccacctggggcatgtggaccacctggtggcaggccaaggcaaccccgagccaactgaactcccccatccatcagagggtaatgatgagaaggctgaagaggcgggtgaaggtcggggagactccactggggaggctggagctgggggtggtgttgagcccagccttgagcatctccttgacatccaaggcctgcccaaaagacaagcaggtgcaggcagcagcagtccagaggcccccctgagatctgaggatagcacctgcctccctcccagccctggcctcatcactgtgcggctcaaattcctcaatgataccgaggagctggctgtggctaggccagaggataccgtgggtgccctgaagagcaaatacttccctggacaagaaagccagatgaaactgatctaccagggccgcctgctacaagacccagcccgcacactgcgttctctgaacattaccgacaactgtgtgattcactgccaccgctcacccccagggtcagctgttccaggcccctcagcctccttggccccctcggccactgagccacccagccttggtgtcaatgtgggcagcctcatggtgcctgtctttgtggtgctgttgggtgtggtctggtacttccgaatcaattaccgccaattcttcacagcacctgccactgtctccctggtgggagtcaccgtcttcttcagcttcctagtatttgggatgtatggacgataaggacataggaagaaaatgaaaggcatggtctttctcctttatggcctccccacttttcctggccagagctgggcccaagggccggggagggaggggtggaaaggatgtgatggaaatctcctccataggacacaggaggcaagtatgcggcctccccttctcatccacaggagtacagatgtccctcccgtgcgagcacaactcaggtagaaatgaggatgtcatcttccttcacttttagggtcctctgaaggagttcaaagctgctggccaagctcagtggggagcctgggctctgagattccctcccacctgtggttctgactcttcccagtgtcctgcatgtctgcccccagcacccagggctgcctgcaagggcagctcagcatggccccagcacaactccgtagggagcctggagtatccttccatttctcagccaaatactcatcttttgagactgaaatcacactggcgggaatgaagattgtgccagccttctcttatgggcacctagccgccttcaccttcttcctctaccccttagcaggaatagggtgtcctcccttctttcaaagcactttgcttgcattttattttatttttttaagagtccttcatagagctcagtcaggaaggggatggggcaccaagccaagcccccagcattgggagcggccaggccacagctgctgctcccgtagtcctcaggctgtaagcaagagacagcactggcccttggccagcgtcctaccctgcccaactccaaggactgggtatggattgctgggccctaggctcttgcttctggggctattggagggtcagtgtctgtgactgaataaagttccattttgtggt

SEQ ID NO: 365715 - DNA, 2024 bp, Homo sapiens
cgggagaagccggaagagaccggaccctgaacagaatcgcagattgccagcccttttcccgacccctacggaaagacgagtccaggggccgtcctggcgaggtcaaaacatttagtctggtcttttcagataattctttgagcaactactggggcattatattggacacttcagtaccaagagaaatacatacgatccttgtctaccaggagtctaatagaaagatggacagcgtggaccctgccagcagccaggccatggagctctctgatgtcaccctcattgagggtgtgggtaatgaggtgatggtggtggcaggtgtggtggtgctgattctagccttggtcctagcttggctctctacctacgtagcagacagcggtagcaaccagctcctgggcgctattgtgtcagcaggcgacacatccgtcctccacctggggcatgtggaccacctggtggcaggccaaggcaaccccgagccaactgaactcccccatccatcagagggtaatgatgagaaggctgaagaggcgggtgaaggtcggggagactccactggggaggctggagctgggggtggtgttgagcccagccttgagcatctccttgacatccaaggcctgcccaaaagacaagcaggtgcaggcagcagcagtccagaggcccccctgagatctgaggatagcacctgcctccctcccagccctggcctcatcactgtgcggctcaaattcctcaatgataccgaggagctggctgtggctaggccagaggataccgtgggtgccctgaagagcaaatacttccctggacaagaaagccagatgaaactgatctaccagggccgcctgctacaagacccagcccgcacactgcgttctctgaacattaccgacaactgtgtgattcactgccaccgctcacccccagggtcagctgttccaggcccctcagcctccttggccccctcggccactgagccacccagccttggtgtcaatgtgggcagcctcatggtgcctgtctttgtggtgctgttgggtgtggtctggtacttccgaatcaattaccgccaattcttcacagcacctgccactgtctccctggtgggagtcaccgtcttcttcagcttcctagtatttgggatgtatggacgataaggacataggaagaaaatgaaaggcatggtctttctcctttatggcctccccacttttcctggccagagctgggcccaagggccggggagggaggggtggaaaggatgtgatggaaatctcctccataggacacaggaggcaagtatgcggcctccccttctcatccacaggagtacagatgtccctcccgtgcgagcacaactcaggtagaaatgaggatgtcatcttccttcacttttagggtcctctgaaggagttcaaagctgctggccaagctcagtggggagcctgggctctgagattccctcccacctgtggttctgactcttcccagtgtcctgcatgtctgcccccagcacccagggctgcctgcaagggcagctcagcatggccccagcacaactccgtagggagcctggagtatccttccatttctcagccaaatactcatcttttgagactgaaatcacactggcgggaatgaagattgtgccagccttctcttatgggcacctagccgccttcaccttcttcctctaccccttagcaggaatagggtgtcctcccttctttcaaagcactttgcttgcattttattttatttttttaagagtccttcatagagctcagtcaggaaggggatggggcaccaagccaagcccccagcattgggagcggccaggccacagctgctgctcccgtagtcctcaggctgtaagcaagagacagcactggcccttggccagcgtcctaccctgcccaactccaaggactgggtatggattgctgggccctaggctcttgcttctggggctattggagggtcagtgtctgtgactgaataaagttccattttgtggt

SEQ ID NO: 365716 - DNA, 2008 bp, Homo sapiens
cgggagaagccggaagagaccggaccctgaacagaatcgcagattgccagcccttttcccgacccctacggaaagacgagtccaggggccgtcctggcgaggtcaaaacatttagtctggtcttttcagggctgggtcagttagaacctaaacaaactagagacctggttgcaacccctcaggctctgctgatgctgtccccctttgttcctgcagcgtggaccctgccagcagccaggccatggagctctctgatgtcaccctcattgagggtgtgggtaatgaggtgatggtggtggcaggtgtggtggtgctgattctagccttggtcctagcttggctctctacctacgtagcagacagcggtagcaaccagctcctgggcgctattgtgtcagcaggcgacacatccgtcctccacctggggcatgtggaccacctggtggcaggccaaggcaaccccgagccaactgaactcccccatccatcagagggtaatgatgagaaggctgaagaggcgggtgaaggtcggggagactccactggggaggctggagctgggggtggtgttgagcccagccttgagcatctccttgacatccaaggcctgcccaaaagacaagcaggtgcaggcagcagcagtccagaggcccccctgagatctgaggatagcacctgcctccctcccagccctggcctcatcactgtgcggctcaaattcctcaatgataccgaggagctggctgtggctaggccagaggataccgtgggtgccctgaagagcaaatacttccctggacaagaaagccagatgaaactgatctaccagggccgcctgctacaagacccagcccgcacactgcgttctctgaacattaccgacaactgtgtgattcactgccaccgctcacccccagggtcagctgttccaggcccctcagcctccttggccccctcggccactgagccacccagccttggtgtcaatgtgggcagcctcatggtgcctgtctttgtggtgctgttgggtgtggtctggtacttccgaatcaattaccgccaattcttcacagcacctgccactgtctccctggtgggagtcaccgtcttcttcagcttcctagtatttgggatgtatggacgataaggacataggaagaaaatgaaaggcatggtctttctcctttatggcctccccacttttcctggccagagctgggcccaagggccggggagggaggggtggaaaggatgtgatggaaatctcctccataggacacaggaggcaagtatgcggcctccccttctcatccacaggagtacagatgtccctcccgtgcgagcacaactcaggtagaaatgaggatgtcatcttccttcacttttagggtcctctgaaggagttcaaagctgctggccaagctcagtggggagcctgggctctgagattccctcccacctgtggttctgactcttcccagtgtcctgcatgtctgcccccagcacccagggctgcctgcaagggcagctcagcatggccccagcacaactccgtagggagcctggagtatccttccatttctcagccaaatactcatcttttgagactgaaatcacactggcgggaatgaagattgtgccagccttctcttatgggcacctagccgccttcaccttcttcctctaccccttagcaggaatagggtgtcctcccttctttcaaagcactttgcttgcattttattttatttttttaagagtccttcatagagctcagtcaggaaggggatggggcaccaagccaagcccccagcattgggagcggccaggccacagctgctgctcccgtagtcctcaggctgtaagcaagagacagcactggcccttggccagcgtcctaccctgcccaactccaaggactgggtatggattgctgggccctaggctcttgcttctggggctattggagggtcagtgtctgtgactgaataaagttccattttgtggt

SEQ ID NO: 365717 - DNA, 2521 bp, Homo sapiens
cccgaagtttgaggggtgtggacggtttgtgacccccttagccgaccctactcctcactggccgggacaactggtcttatcacggaggctggggccaggcagcccttcggttcgggtgggcccatggaccccagtccaacgccgagggaataggaccatccaaaagcggaaccttcgcctcagaaaaagggtgcgggacccctcctcaccgtgcggtcacggtacggacagggtagatcacaggctgagggacagagcaaagacccctgaggccggacacctggggtcctgccgggcccctccccacgagagttccctgtgtctgtgccaatcgttttcgtctttctttgccgcagtttcttttcctgtaaatcatggttaatgacattaaccttcttaccatcaggggttagttgtggttgtgataaataattactaccgttattaagcaattgcaatttgcagtgtgccaggcactgtgccaagtattttgcttcgatgatttcacgtcatcttcaaaacaacctcatgagggctgggtcagttagaacctaaacaaactagagacctggttgcaacccctcaggctctgctgatgctgtccccctttgttcctgcagcgtggaccctgccagcagccaggccatggagctctctgatgtcaccctcattgagggtgtgggtaatgaggtgatggtggtggcaggtgtggtggtgctgattctagccttggtcctagcttggctctctacctacgtagcagacagcggtagcaaccagctcctgggcgctattgtgtcagcaggcgacacatccgtcctccacctggggcatgtggaccacctggtggcaggccaaggcaaccccgagccaactgaactcccccatccatcagagggtaatgatgagaaggctgaagaggcgggtgaaggtcggggagactccactggggaggctggagctgggggtggtgttgagcccagccttgagcatctccttgacatccaaggcctgcccaaaagacaagcaggtgcaggcagcagcagtccagaggcccccctgagatctgaggatagcacctgcctccctcccagccctggcctcatcactgtgcggctcaaattcctcaatgataccgaggagctggctgtggctaggccagaggataccgtgggtgccctgaagagcaaatacttccctggacaagaaagccagatgaaactgatctaccagggccgcctgctacaagacccagcccgcacactgcgttctctgaacattaccgacaactgtgtgattcactgccaccgctcacccccagggtcagctgttccaggcccctcagcctccttggccccctcggccactgagccacccagccttggtgtcaatgtgggcagcctcatggtgcctgtctttgtggtgctgttgggtgtggtctggtacttccgaatcaattaccgccaattcttcacagcacctgccactgtctccctggtgggagtcaccgtcttcttcagcttcctagtatttgggatgtatggacgataaggacataggaagaaaatgaaaggcatggtctttctcctttatggcctccccacttttcctggccagagctgggcccaagggccggggagggaggggtggaaaggatgtgatggaaatctcctccataggacacaggaggcaagtatgcggcctccccttctcatccacaggagtacagatgtccctcccgtgcgagcacaactcaggtagaaatgaggatgtcatcttccttcacttttagggtcctctgaaggagttcaaagctgctggccaagctcagtggggagcctgggctctgagattccctcccacctgtggttctgactcttcccagtgtcctgcatgtctgcccccagcacccagggctgcctgcaagggcagctcagcatggccccagcacaactccgtagggagcctggagtatccttccatttctcagccaaatactcatcttttgagactgaaatcacactggcgggaatgaagattgtgccagccttctcttatgggcacctagccgccttcaccttcttcctctaccccttagcaggaatagggtgtcctcccttctttcaaagcactttgcttgcattttattttatttttttaagagtccttcatagagctcagtcaggaaggggatggggcaccaagccaagcccccagcattgggagcggccaggccacagctgctgctcccgtagtcctcaggctgtaagcaagagacagcactggcccttggccagcgtcctaccctgcccaactccaaggactgggtatggattgctgggccctaggctcttgcttctggggctattggagggtcagtgtctgtgactgaataaagttccattttgtggtcctgcagcctctttctgtgacagagaatggctttgcgctgcccccaggaaaatggtaatgagagtaggtaggccggggctaccaacgggagatgcagtttatttacacc

SEQ ID NO: 365718 - DNA, 1868 bp, Homo sapiens
cgggagaagccggaagagaccggaccctgaacagaatcgcagattgccagcccttttcccgacccctacggaaagacgagtccaggggccgtcctggcgaggtcaaaacatttagtctggtcttttcagtgtgccaggcactgtgccaagtattttgcttcgatgatttcacgtcatcttcaaaacaacctcatgagcgtggaccctgccagcagccaggccatggagctctctgatgtcaccctcattgagggtgtgggtaatgaggtgatggtggtggcaggtgtggtggtgctgattctagccttggtcctagcttggctctctacctacgtagcagacagcggtagcaaccagctcctgggcgctattgtgtcagcaggcgacacatccgtcctccacctggggcatgtggaccacctggtggcaggccaaggcaaccccgagccaactgaactcccccatccatcagaggaagacaagcaggtgcaggcagcagcagtccagaggcccccctgagatctgaggatagcacctgcctccctcccagccctggcctcatcactgtgcggctcaaattcctcaatgataccgaggagctggctgtggctaggccagaggataccgtgggtgccctgaagagcaaatacttccctggacaagaaagccagatgaaactgatctaccagggccgcctgctacaagacccagcccgcacactgcgttctctgaacattaccgacaactgtgtgattcactgccaccgctcacccccagggtcagctgttccaggcccctcagcctccttggccccctcggccactgagccacccagccttggtgtcaatgtgggcagcctcatggtgcctgtctttgtggtgctgttgggtgtggtctggtacttccgaatcaattaccgccaattcttcacagcacctgccactgtctccctggtgggagtcaccgtcttcttcagcttcctagtatttgggatgtatggacgataaggacataggaagaaaatgaaaggcatggtctttctcctttatggcctccccacttttcctggccagagctgggcccaagggccggggagggaggggtggaaaggatgtgatggaaatctcctccataggacacaggaggcaagtatgcggcctccccttctcatccacaggagtacagatgtccctcccgtgcgagcacaactcaggtagaaatgaggatgtcatcttccttcacttttagggtcctctgaaggagttcaaagctgctggccaagctcagtggggagcctgggctctgagattccctcccacctgtggttctgactcttcccagtgtcctgcatgtctgcccccagcacccagggctgcctgcaagggcagctcagcatggccccagcacaactccgtagggagcctggagtatccttccatttctcagccaaatactcatcttttgagactgaaatcacactggcgggaatgaagattgtgccagccttctcttatgggcacctagccgccttcaccttcttcctctaccccttagcaggaatagggtgtcctcccttctttcaaagcactttgcttgcattttattttatttttttaagagtccttcatagagctcagtcaggaaggggatggggcaccaagccaagcccccagcattgggagcggccaggccacagctgctgctcccgtagtcctcaggctgtaagcaagagacagcactggcccttggccagcgtcctaccctgcccaactccaaggactgggtatggattgctgggccctaggctcttgcttctggggctattggagggtcagtgtctgtgactgaataaagttccattttgtggt

SEQ ID NO: 365719 - DNA, 1903 bp, Homo sapiens
cgggagaagccggaagagaccggaccctgaacagaatcgcagattgccagcccttttcccgacccctacggaaagacgagtccaggggccgtcctggcgaggtcaaaacatttagtctggtcttttcagataattctttgagcaactactggggcattatattggacacttcagtaccaagagaaatacatacgatccttgtctaccaggagtctaatagaaagatggacagcgtggaccctgccagcagccaggccatggagctctctgatgtcaccctcattgagggtgtgggtaatgaggtgatggtggtggcaggtgtggtggtgctgattctagccttggtcctagcttggctctctacctacgtagcagacagcggtagcaaccagctcctgggcgctattgtgtcagcaggcgacacatccgtcctccacctggggcatgtggaccacctggtggcaggccaaggcaaccccgagccaactgaactcccccatccatcagaggaagacaagcaggtgcaggcagcagcagtccagaggcccccctgagatctgaggatagcacctgcctccctcccagccctggcctcatcactgtgcggctcaaattcctcaatgataccgaggagctggctgtggctaggccagaggataccgtgggtgccctgaagagcaaatacttccctggacaagaaagccagatgaaactgatctaccagggccgcctgctacaagacccagcccgcacactgcgttctctgaacattaccgacaactgtgtgattcactgccaccgctcacccccagggtcagctgttccaggcccctcagcctccttggccccctcggccactgagccacccagccttggtgtcaatgtgggcagcctcatggtgcctgtctttgtggtgctgttgggtgtggtctggtacttccgaatcaattaccgccaattcttcacagcacctgccactgtctccctggtgggagtcaccgtcttcttcagcttcctagtatttgggatgtatggacgataaggacataggaagaaaatgaaaggcatggtctttctcctttatggcctccccacttttcctggccagagctgggcccaagggccggggagggaggggtggaaaggatgtgatggaaatctcctccataggacacaggaggcaagtatgcggcctccccttctcatccacaggagtacagatgtccctcccgtgcgagcacaactcaggtagaaatgaggatgtcatcttccttcacttttagggtcctctgaaggagttcaaagctgctggccaagctcagtggggagcctgggctctgagattccctcccacctgtggttctgactcttcccagtgtcctgcatgtctgcccccagcacccagggctgcctgcaagggcagctcagcatggccccagcacaactccgtagggagcctggagtatccttccatttctcagccaaatactcatcttttgagactgaaatcacactggcgggaatgaagattgtgccagccttctcttatgggcacctagccgccttcaccttcttcctctaccccttagcaggaatagggtgtcctcccttctttcaaagcactttgcttgcattttattttatttttttaagagtccttcatagagctcagtcaggaaggggatggggcaccaagccaagcccccagcattgggagcggccaggccacagctgctgctcccgtagtcctcaggctgtaagcaagagacagcactggcccttggccagcgtcctaccctgcccaactccaaggactgggtatggattgctgggccctaggctcttgcttctggggctattggagggtcagtgtctgtgactgaataaagttccattttgtggt

SEQ ID NO: 365720 - DNA, 1782 bp, Homo sapiens
cccgaagtttgaggggtgtggacggtttgtgacccccttagccgaccctactcctcactggccgggacaactggtcttatcacggaggctggggccaggcagcccttcggttcgggtgggcccatggaccccagtccaacgccgagggaataggaccatccaaaagcggaaccttcgcctcagaaaaagggtgcgggacccctcctcaccgtgcggtcacgcgtggaccctgccagcagccaggccatggagctctctgatgtcaccctcattgagggtgtgggtaatgaggtgatgcgacacatccgtcctccacctggggcatgtggaccacctggtggcaggccaaggcaaccccgagccaactgaactcccccatccatcagaggaagacaagcaggtgcaggcagcagcagtccagaggcccccctgagatctgaggatagcacctgcctccctcccagccctggcctcatcactgtgcggctcaaattcctcaatgataccgaggagctggctgtggctaggccagaggataccgtgggtgccctgaagagcaaatacttccctggacaagaaagccagatgaaactgatctaccagggccgcctgctacaagacccagcccgcacactgcgttctctgaacattaccgacaactgtgtgattcactgccaccgctcacccccagggtcagctgttccaggcccctcagcctccttggccccctcggccactgagccacccagccttggtgtcaatgtgggcagcctcatggtgcctgtctttgtggtgctgttgggtgtggtctggtacttccgaatcaattaccgccaattcttcacagcacctgccactgtctccctggtgggagtcaccgtcttcttcagcttcctagtatttgggatgtatggacgataaggacataggaagaaaatgaaaggcatggtctttctcctttatggcctccccacttttcctggccagagctgggcccaagggccggggagggaggggtggaaaggatgtgatggaaatctcctccataggacacaggaggcaagtatgcggcctccccttctcatccacaggagtacagatgtccctcccgtgcgagcacaactcaggtagaaatgaggatgtcatcttccttcacttttagggtcctctgaaggagttcaaagctgctggccaagctcagtggggagcctgggctctgagattccctcccacctgtggttctgactcttcccagtgtcctgcatgtctgcccccagcacccagggctgcctgcaagggcagctcagcatggccccagcacaactccgtagggagcctggagtatccttccatttctcagccaaatactcatcttttgagactgaaatcacactggcgggaatgaagattgtgccagccttctcttatgggcacctagccgccttcaccttcttcctctaccccttagcaggaatagggtgtcctcccttctttcaaagcactttgcttgcattttattttatttttttaagagtccttcatagagctcagtcaggaaggggatggggcaccaagccaagcccccagcattgggagcggccaggccacagctgctgctcccgtagtcctcaggctgtaagcaagagacagcactggcccttggccagcgtcctaccctgcccaactccaaggactgggtatggattgctgggccctaggctcttgcttctggggctattggagggtcagtgtctgtgactgaataaagttccattttgtggt

SEQ ID NO: 365721 - DNA, 1693 bp, Homo sapiens
cccgaagtttgaggggtgtggacggtttgtgacccccttagccgaccctactcctcactggccgggacaactggtcttatcacggaggctggggccaggcagcccttcggttcgggtgggcccatggaccccagtccaacgccgagggaataggaccatccaaaagcggaaccttcgcctcagaaaaaggcgtggaccctgccagcagccaggccatggagctctctgatgtcaccctcattgagggtgtgggtaatgaggtgatggtggtggcaggtgtggtggtgctgattctagccttggtcctagcttggctctctacctacgtagcagacagcggtagcaaccagctcctgggcgctattgtgtcagcaggcgacacatccgtcctccacctggggcatgtggaccacctggtggcaggccaaggcaaccccgagccaactgaactcccccatccatcagaggcaaatacttccctggacaagaaagccagatgaaactgatctaccagggccgcctgctacaagacccagcccgcacactgcgttctctgaacattaccgacaactgtgtgattcactgccaccgctcacccccagggtcagctgttccaggcccctcagcctccttggccccctcggccactgagccacccagccttggtgtcaatgtgggcagcctcatggtgcctgtctttgtggtgctgttgggtgtggtctggtacttccgaatcaattaccgccaattcttcacagcacctgccactgtctccctggtgggagtcaccgtcttcttcagcttcctagtatttgggatgtatggacgataaggacataggaagaaaatgaaaggcatggtctttctcctttatggcctccccacttttcctggccagagctgggcccaagggccggggagggaggggtggaaaggatgtgatggaaatctcctccataggacacaggaggcaagtatgcggcctccccttctcatccacaggagtacagatgtccctcccgtgcgagcacaactcaggtagaaatgaggatgtcatcttccttcacttttagggtcctctgaaggagttcaaagctgctggccaagctcagtggggagcctgggctctgagattccctcccacctgtggttctgactcttcccagtgtcctgcatgtctgcccccagcacccagggctgcctgcaagggcagctcagcatggccccagcacaactccgtagggagcctggagtatccttccatttctcagccaaatactcatcttttgagactgaaatcacactggcgggaatgaagattgtgccagccttctcttatgggcacctagccgccttcaccttcttcctctaccccttagcaggaatagggtgtcctcccttctttcaaagcactttgcttgcattttattttatttttttaagagtccttcatagagctcagtcaggaaggggatggggcaccaagccaagcccccagcattgggagcggccaggccacagctgctgctcccgtagtcctcaggctgtaagcaagagacagcactggcccttggccagcgtcctaccctgcccaactccaaggactgggtatggattgctgggccctaggctcttgcttctggggctattggagggtcagtgtctgtgactgaataaagttccattttgtggt

SEQ ID NO: 365722 - DNA, 1565 bp, Homo sapiens
cccgaagtttgaggggtgtggacggtttgtgacccccttagccgaccctactcctcactggccgggacaactggtcttatcacggaggctggggccaggcagcccttcggttcgggtgggcccatggaccccagtccaacgccgagggaataggaccatccaaaagcggaaccttcgcctcagaaaaagggtgcgggacccctcctcaccgtgcggtcacggtacggacagggtagatcacaggctgagggacagagcaaagacccctgaggccggacacctggggtcctgccgggcccctccccacgagagttccctgtgtctgtgccaatcgttttcgtctttctttgccgcagtttcttttcctgtaaatcatggttaatgacattaaccttcttaccatcaggggttagttgtggttgtgataaataattactaccgttattaagcaattgcaatttgcagtgtgccaggcactgtgccaagtattttgcttcgatgatttcacgtcatcttcaaaacaacctcatgagcttggtgtcaatgtgggcagcctcatggtgcctgtctttgtggtgctgttgggtgtggtctggtacttccgaatcaattaccgccaattcttcacagcacctgccactgtctccctggtgggagtcaccgtcttcttcagcttcctagtatttgggatgtatggacgataaggacataggaagaaaatgaaaggcatggtctttctcctttatggcctccccacttttcctggccagagctgggcccaagggccggggagggaggggtggaaaggatgtgatggaaatctcctccataggacacaggaggcaagtatgcggcctccccttctcatccacaggagtacagatgtccctcccgtgcgagcacaactcaggtagaaatgaggatgtcatcttccttcacttttagggtcctctgaaggagttcaaagctgctggccaagctcagtggggagcctgggctctgagattccctcccacctgtggttctgactcttcccagtgtcctgcatgtctgcccccagcacccagggctgcctgcaagggcagctcagcatggccccagcacaactccgtagggagcctggagtatccttccatttctcagccaaatactcatcttttgagactgaaatcacactggcgggaatgaagattgtgccagccttctcttatgggcacctagccgccttcaccttcttcctctaccccttagcaggaatagggtgtcctcccttctttcaaagcactttgcttgcattttattttatttttttaagagtccttcatagagctcagtcaggaaggggatggggcaccaagccaagcccccagcattgggagcggccaggccacagctgctgctcccgtagtcctcaggctgtaagcaagagacagcactggcccttggccagcgtcctaccctgcccaactccaaggactgggtatggattgctgggccctaggctcttgcttctggggctattggagggtcagtgtctgtgactgaataaagttccattttgtggt

SEQ ID NO: 365723 - DNA, 2193 bp, Homo sapiens
cccgaagtttgaggggtgtggacggtttgtgacccccttagccgaccctactcctcactggccgggacaactggtcttatcacggaggctggggccaggcagcccttcggttcgggtgggcccatggaccccagtccaacgccgagggaataggaccatccaaaagcggaaccttcgcctcagaaaaagggtgcgggacccctcctcaccgtgcggtcacggtacggacagggtagatcacaggctgagggacagagcaaagacccctgaggccggacacctggggtcctgccgggcccctccccacgagagttccctgtgtctgtgccaatcgttttcgtctttctttgccgcagtttcttttcctgtaaatcatggttaatgacattaaccttcttaccatcaggggttagttgtggttgtgataaataattactaccgttattaagcaattgcaatttgcagtgtgccaggcactgtgccaagtattttgcttcgatgatttcacgtcatcttcaaaacaacctcatgagggctgggtcagttagaacctaaacaaactagagacctggttgcaacccctcaggctctgctgatgctgtccccctttgttcctgcagcgtggaccctgccagcagccaggccatggagctctctgatgtcaccctcattgagggtgtgggtaatgaggtgatggtggtggcaggtgtggtggtgctgattctagccttggtcctagcttggctctctacctacgtagcagacagcggtagcaaccagctcctgggcgctattgtgtcagcaggcgacacatccgtcctccacctggggcatgtggaccacctggtggcaggccaaggcaaccccgagccaactgaactcccccatccatcagagggtaatgatgagaaggctgaagaggcgggtgaaggtcggggagactccactggggaggctggagctgggggtggtgttgagcccagccttgagcatctccttgacatccaaggcctgcccaaaagacaagcaggtgcaggcagcagcagtccagaggcccccctgagatctgaggatagcacctgcctccctcccagccctggcctcatcactgtgcggctcaaattcctcaatgataccgaggagctggctgtggctaggccagaggataccgtgggtgccctgaagagcaaatacttccctggacaagaaagccagatgaaactgatctaccagggccgcctgctacaagacccagcccgcacactgcgttctctgaacattaccgacaactgtgtgattcactgccaccgctcacccccagggtcagctgttccaggcccctcagcctccttggccccctcggccactgagccacccagccttggtgtcaatgtgggcagcctcatggtgcctgtctttgtggtgctgttgggtgtggtctggtacttccgaatcaattaccgccaattcttcacagcacctgccactgtctccctggtgggagtcaccgtcttcttcagcttcctagtatttgggatgtatggacgataaggacataggaagaaaatgaaagggtcctctgaaggagttcaaagctgctggccaagctcagtggggagcctgggctctgagattccctcccacctgtggttctgactcttcccagtgtcctgcatgtctgcccccagcacccagggctgcctgcaagggcagctcagcatggccccagcacaactccgtagggagcctggagtatccttccatttctcagccaaatactcatcttttgagactgaaatcacactggcgggaatgaagattgtgccagccttctcttatgggcacctagccgccttcaccttcttcctctaccccttagcaggaatagggtgtcctcccttctttcaaagcactttgcttgcattttattttatttttttaagagtccttcatagagctcagtcaggaaggggatggggcaccaagccaagcccccagcattgggagcggccaggccacagctgctgctcccgtagtcctcaggctgtaagcaagagacagcactggcccttggccagcgtcctaccctgcccaactccaaggactgggtatggattgctgggccctaggctcttgcttctggggctattggagggtcagtgtctgtgactgaataaagttccattttgtggt

SEQ ID NO: 365724 - DNA, 1949 bp, Homo sapiens
cccgaagtttgaggggtgtggacggtttgtgacccccttagccgaccctactcctcactggccgggacaactggtcttatcacggaggctggggccaggcagcccttcggttcgggtgggcccatggaccccagtccaacgccgagggaataggaccatccaaaagcggaaccttcgcctcagaaaaagggtgcgggacccctcctcaccgtgcggtcacggtacggacagggtagatcacaggctgagggacagagcaaagacccctgaggccggacacctggggtcctgccgggcccctccccacgagagttccctgtgtctgtgccaatcgttttcgtctttctttgccgcagtttcttttcctgtaaatcatggttaatgacattaaccttcttaccatcaggggttagttgtggttgtgataaataattactaccgttattaagcaattgcaatttgcagtgtgccaggcactgtgccaagtattttgcttcgatgatttcacgtcatcttcaaaacaacctcatgagggctgggtcagttagaacctaaacaaactagagacctggttgcaacccctcaggctctgctgatgctgtccccctttgttcctgcagcgtggaccctgccagcagccaggccatggagctctctgatgtcaccctcattgagggtgtgggtaatgaggtgatggtggtggcaggtgtggtggtgctgattctagccttggtcctagcttggctctctacctacgtagcagacagcggtagcaaccagctcctgggcgctattgtgtcagcaggcgacacatccgtcctccacctggggcatgtggaccacctggtggcaggccaaggcaaccccgagccaactgaactcccccatccatcagagggtaatgatgagaaggctgaagaggcgggtgaaggtcggggagactccactggggaggctggagctgggggtggtgttgagcccagccttgagcatctccttgacatccaaggcctgcccaaaagacaagcaggtgcaggcagcagcagtccagaggcccccctgagatctgaggatagcacctgcctccctcccagccctggcctcatcactgtgcggctcaaattcctcaatgataccgaggagctggctgtggctaggccagaggataccgtgggtgccctgaagagggtgagtggcctgggaagtgggaagctgcttgtgctcatcccccagcccttggttgcctctaaggaggctggtgcagacatgggagctgcagcaaagtgtaagatccagcccctaccaagggcaggtagatactttcttagaaatacacccttcaggccgggtgcagtggctcccgggactttgggaggccgaggcgggtgcatcacgaggttaggagttcgagaccagcctgaccaacatggtgaaaccccatctctactaaacatacaaaaatcagccgggcgtggtggcgcacgcctgcaatcccagctactcaggaggctgaggcaggagaatcgcttgaacccaggaggtggaggttgcagtgagccgagattgcgccactgcactccagcctgggcgacagagtgagactccatctaaaaaaacaaaacaaacaaatacacccctcattagttaaggataaagatgaggggggcctgtcgcggtggctcacgcctgtaatcccagcactttgggaggccaaggcgggcagatcacaaggtcaagatatcaagaccatcctggccagcatggtgaaaccctgtctctactaaaaaaaaaaatacaaaaattagctgggcatggtggcgcactcctgtagtcccagctactcgggagggtgaggcaggagaattgcttgaacccgggaggcagaggttgcagtgagccgagatcgcgccactgcactccagcctggcaacagagtgagactccgtctc

SEQ ID NO: 365725 - DNA, 1088 bp, Homo sapiens
cccgaagtttgaggggtgtggacggtttgtgacccccttagccgaccctactcctcactggccgggacaactggtcttatcacggaggctggggccaggcagcccttcggttcgggtgggcccatggaccccagtccaacgccgagggaataggaccatccaaaagcggaaccttcgcctcagaaaaaggcgtggaccctgccagcagccaggccatggagctctctgatgtcaccctcattgagggtgtgggtaatgaggtgatggtggtggcaggtgtggtggtgctgattctagccttggtcctagcttggctctctacctacgtagcagacagcggtagcaaccagctcctgggcgctattgtgtcagcaggcgacacatccgtcctccacctggggcatgtggaccacctggtggcaggccaaggcaaccccgagccaactgaactcccccatccatcagaggggtcctctgaaggagttcaaagctgctggccaagctcagtggggagcctgggctctgagattccctcccacctgtggttctgactcttcccagtgtcctgcatgtctgcccccagcacccagggctgcctgcaagggcagctcagcatggccccagcacaactccgtagggagcctggagtatccttccatttctcagccaaatactcatcttttgagactgaaatcacactggcgggaatgaagattgtgccagccttctcttatgggcacctagccgccttcaccttcttcctctaccccttagcaggaatagggtgtcctcccttctttcaaagcactttgcttgcattttattttatttttttaagagtccttcatagagctcagtcaggaaggggatggggcaccaagccaagcccccagcattgggagcggccaggccacagctgctgctcccgtagtcctcaggctgtaagcaagagacagcactggcccttggccagcgtcctaccctgcccaactccaaggactgggtatggattgctgggccctaggctcttgcttctggggctattggagggtcagtgtctgtgactgaataaagttccattttgtggt

SEQ ID NO: 365726 - DNA, 560 bp, Homo sapiens
cccgaagtttgaggggtgtggacggtttgtgacccccttagccgaccctactcctcactggccgggacaactggtcttatcacggaggctggggccaggcagcccttcggttcgggtgggcccatggaccccagtccaacgccgagggaataggaccatccaaaagcggaaccttcgcctcagaaaaagggtgcgggacccctcctcaccgtgcggtcacggtacggacagggtagatcacaggctgagggacagagcaaagacccctgaggccggacacctggggtcctgccgggcccctccccacgagagttccctgtgtctgtgccaatcgttttcgtctttctttgccgcagtttcttttcctgtaaatcatggttaatgacattaaccttcttaccatcaggggttagttgtggttgtgataaataattactaccgttattaagcaattgcaatttgcagtgtgccaggcactgtgccaagtattttgcttcgatgatttcacgtcatcttcaaaacaacctcatgaggtaggtactgtttttaaccccatttta

SEQ ID NO: 365727 - DNA, 611 bp, Homo sapiens
ctagtaagacgcaagactggggttataattagttgtttttctaactccagggccggtatattaaataaggatgttgatgtgttccacagataattctttgagcaactactggggcattatattggacacttcagtaccaagagaaatacatacgatccttgtctaccaggagtctaatagaaagatggacaggtacataagtataatgaagttttataggtgctgtgagaatagtctgataatggtaatcaccagactggatttgcccagggacagctgtgaaagcagcagattctccaagggaaatagtaggtactccaaggagcaagcagggacccttcctgcctttctaagaaactgcagcagcagaaccttcacagtgaaagaagagagactgagatatggattgtgagagctgttatggaatctttttcaaatcactccacttggggagtggtcattgcaggagtgggcccatggtgacccaggaaggtggtgcttctggtgtctgtcccaagttgctccccagggcttgccagaagtttcagaggcggcacataatgtctgctgcatagtatctgcccgcggtccctacagagttatcgttttag

SEQ ID NO: 365728 - DNA, 2150 bp, Homo sapiens
cccgaagtttgaggggtgtggacggtttgtgacccccttagccgaccctactcctcactggccgggacaactggtcttatcacggaggctggggccaggcagcccttcggttcgggtgggcccatggaccccagtccaacgccgagggaataggaccatccaaaagcggaaccttcgcctcagaaaaagggtgcgggacccctcctcaccgtgcggtcacgtgtgccaggcactgtgccaagtattttgcttcgatgatttcacgtcatcttcaaaacaacctcatgagataattctttgagcaactactggggcattatattggacacttcagtaccaagagaaatacatacgatccttgtctaccaggagtctaatagaaagatggacagggctgggtcagttagaacctaaacaaactagagacctggttgcaacccctcaggctctgctgatgctgtccccctttgttcctgcagcgtggaccctgccagcagccaggccatggagctctctgatgtcaccctcattgagggtgtgggtaatgaggtgatggtggtggcaggtgtggtggtgctgattctagccttggtcctagcttggctctctacctacgtagcagacagcggtagcaaccagctcctgggcgctattgtgtcagcaggcgacacatccgtcctccacctggggcatgtggaccacctggtggcaggccaaggcaaccccgagccaactgaactcccccatccatcagaggaagacaagcaggtgcaggcagcagcagtccagaggcccccctgagatctgaggatagcacctgcctccctcccagccctggcctcatcactgtgcggctcaaattcctcaatgataccgaggagctggctgtggctaggccagaggataccgtgggtgccctgaagagcaaatacttccctggacaagaaagccagatgaaactgatctaccagggccgcctgctacaagacccagcccgcacactgcgttctctgaacattaccgacaactgtgtgattcactgccaccgctcacccccagggtcagctgttccaggcccctcagcctccttggccccctcggccactgagccacccagccttggtgtcaatgtgggcagcctcatggtgcctgtctttgtggtgctgttgggtgtggtctggtacttccgaatcaattaccgccaattcttcacagcacctgccactgtctccctggtgggagtcaccgtcttcttcagcttcctagtatttgggatgtatggacgataaggacataggaagaaaatgaaaggcatggtctttctcctttatggcctccccacttttcctggccagagctgggcccaagggccggggagggaggggtggaaaggatgtgatggaaatctcctccataggacacaggaggcaagtatgcggcctccccttctcatccacaggagtacagatgtccctcccgtgcgagcacaactcaggtagaaatgaggatgtcatcttccttcacttttagggtcctctgaaggagttcaaagctgctggccaagctcagtggggagcctgggctctgagattccctcccacctgtggttctgactcttcccagtgtcctgcatgtctgcccccagcacccagggctgcctgcaagggcagctcagcatggccccagcacaactccgtagggagcctggagtatccttccatttctcagccaaatactcatcttttgagactgaaatcacactggcgggaatgaagattgtgccagccttctcttatgggcacctagccgccttcaccttcttcctctaccccttagcaggaatagggtgtcctcccttctttcaaagcactttgcttgcattttattttatttttttaagagtccttcatagagctcagtcaggaaggggatggggcaccaagccaagcccccagcattgggagcggccaggccacagctgctgctcccgtagtcctcaggctgtaagcaagagacagcactggcccttggccagcgtcctaccctgcccaactccaaggactgggtatggattgctgggccctaggctcttgcttctggggctattggagggtcagtgtctgtgactgaataaagttccattttgtggt

SEQ ID NO: 365729 - DNA, 2058 bp, Homo sapiens
cgggagaagccggaagagaccggaccctgaacagaatcgcagattgccagcccttttcccgacccctacggaaagacgagtccaggggccgtcctggcgaggtcaaaacatttagtctggtcttttcagtgtgccaggcactgtgccaagtattttgcttcgatgatttcacgtcatcttcaaaacaacctcatgagataattctttgagcaactactggggcattatattggacacttcagtaccaagagaaatacatacgatccttgtctaccaggagtctaatagaaagatggacagggctgggtcagttagaacctaaacaaactagagacctggttgcaacccctcaggctctgctgatgctgtccccctttgttcctgcagcgtggaccctgccagcagccaggccatggagctctctgatgtcaccctcattgagggtgtgggtaatgaggtgatggtggtggcaggtgtggtggtgctgattctagccttggtcctagcttggctctctacctacgtagcagacagcggtagcaaccagctcctgggcgctattgtgtcagcaggcgacacatccgtcctccacctggggcatgtggaccacctggtggcaggccaaggcaaccccgagccaactgaactcccccatccatcagaggaagacaagcaggtgcaggcagcagcagtccagaggcccccctgagatctgaggatagcacctgcctccctcccagccctggcctcatcactgtgcggctcaaattcctcaatgataccgaggagctggctgtggctaggccagaggataccgtgggtgccctgaagagcaaatacttccctggacaagaaagccagatgaaactgatctaccagggccgcctgctacaagacccagcccgcacactgcgttctctgaacattaccgacaactgtgtgattcactgccaccgctcacccccagggtcagctgttccaggcccctcagcctccttggccccctcggccactgagccacccagccttggtgtcaatgtgggcagcctcatggtgcctgtctttgtggtgctgttgggtgtggtctggtacttccgaatcaattaccgccaattcttcacagcacctgccactgtctccctggtgggagtcaccgtcttcttcagcttcctagtatttgggatgtatggacgataaggacataggaagaaaatgaaaggcatggtctttctcctttatggcctccccacttttcctggccagagctgggcccaagggccggggagggaggggtggaaaggatgtgatggaaatctcctccataggacacaggaggcaagtatgcggcctccccttctcatccacaggagtacagatgtccctcccgtgcgagcacaactcaggtagaaatgaggatgtcatcttccttcacttttagggtcctctgaaggagttcaaagctgctggccaagctcagtggggagcctgggctctgagattccctcccacctgtggttctgactcttcccagtgtcctgcatgtctgcccccagcacccagggctgcctgcaagggcagctcagcatggccccagcacaactccgtagggagcctggagtatccttccatttctcagccaaatactcatcttttgagactgaaatcacactggcgggaatgaagattgtgccagccttctcttatgggcacctagccgccttcaccttcttcctctaccccttagcaggaatagggtgtcctcccttctttcaaagcactttgcttgcattttattttatttttttaagagtccttcatagagctcagtcaggaaggggatggggcaccaagccaagcccccagcattgggagcggccaggccacagctgctgctcccgtagtcctcaggctgtaagcaagagacagcactggcccttggccagcgtcctaccctgcccaactccaaggactgggtatggattgctgggccctaggctcttgcttctggggctattggagggtcagtgtctgtgactgaataaagttccattttgtggt

SEQ ID NO: 365730 - DNA, 1632 bp, Homo sapiens
cgggagaagccggaagagaccggaccctgaacagaatcgcagattgccagcccttttcccgacccctacggaaagacgagtccaggggccgtcctggcgaggtcaaaacatttagtctggtcttttcagcgtggaccctgccagcagccaggccatggagctctctgatgtcaccctcattgagggtgtgggtaatgaggtgatggtggtggcaggtgtggtggtgctgattctagccttggtcctagcttggctctctacctacgtagcagacagcggtagcaaccagctcctgggcgctattgtgtcagcaggcgacacatccgtcctccacctggggcatgtggaccacctggtggcaggccaaggcaaccccgagccaactgaactcccccatccatcagaggcaaatacttccctggacaagaaagccagatgaaactgatctaccagggccgcctgctacaagacccagcccgcacactgcgttctctgaacattaccgacaactgtgtgattcactgccaccgctcacccccagggtcagctgttccaggcccctcagcctccttggccccctcggccactgagccacccagccttggtgtcaatgtgggcagcctcatggtgcctgtctttgtggtgctgttgggtgtggtctggtacttccgaatcaattaccgccaattcttcacagcacctgccactgtctccctggtgggagtcaccgtcttcttcagcttcctagtatttgggatgtatggacgataaggacataggaagaaaatgaaaggcatggtctttctcctttatggcctccccacttttcctggccagagctgggcccaagggccggggagggaggggtggaaaggatgtgatggaaatctcctccataggacacaggaggcaagtatgcggcctccccttctcatccacaggagtacagatgtccctcccgtgcgagcacaactcaggtagaaatgaggatgtcatcttccttcacttttagggtcctctgaaggagttcaaagctgctggccaagctcagtggggagcctgggctctgagattccctcccacctgtggttctgactcttcccagtgtcctgcatgtctgcccccagcacccagggctgcctgcaagggcagctcagcatggccccagcacaactccgtagggagcctggagtatccttccatttctcagccaaatactcatcttttgagactgaaatcacactggcgggaatgaagattgtgccagccttctcttatgggcacctagccgccttcaccttcttcctctaccccttagcaggaatagggtgtcctcccttctttcaaagcactttgcttgcattttattttatttttttaagagtccttcatagagctcagtcaggaaggggatggggcaccaagccaagcccccagcattgggagcggccaggccacagctgctgctcccgtagtcctcaggctgtaagcaagagacagcactggcccttggccagcgtcctaccctgcccaactccaaggactgggtatggattgctgggccctaggctcttgcttctggggctattggagggtcagtgtctgtgactgaataaagttccattttgtggt

SEQ ID NO: 365731 - DNA, 1989 bp, Homo sapiens
cgggagaagccggaagagaccggaccctgaacagaatcgcagattgccagcccttttcccgacccctacggaaagacgagtccaggggccgtcctggcgaggtcaaaacatttagtctggtcttttcagtgtgccaggcactgtgccaagtattttgcttcgatgatttcacgtcatcttcaaaacaacctcatgagcgtggaccctgccagcagccaggccatggagctctctgatgtcaccctcattgagggtgtgggtaatgaggtgatggtggtggcaggtgtggtggtgctgattctagccttggtcctagcttggctctctacctacgtagcagacagcggtagcaaccagctcctgggcgctattgtgtcagcaggcgacacatccgtcctccacctggggcatgtggaccacctggtggcaggccaaggcaaccccgagccaactgaactcccccatccatcagagggtaatgatgagaaggctgaagaggcgggtgaaggtcggggagactccactggggaggctggagctgggggtggtgttgagcccagccttgagcatctccttgacatccaaggcctgcccaaaagacaagcaggtgcaggcagcagcagtccagaggcccccctgagatctgaggatagcacctgcctccctcccagccctggcctcatcactgtgcggctcaaattcctcaatgataccgaggagctggctgtggctaggccagaggataccgtgggtgccctgaagagcaaatacttccctggacaagaaagccagatgaaactgatctaccagggccgcctgctacaagacccagcccgcacactgcgttctctgaacattaccgacaactgtgtgattcactgccaccgctcacccccagggtcagctgttccaggcccctcagcctccttggccccctcggccactgagccacccagccttggtgtcaatgtgggcagcctcatggtgcctgtctttgtggtgctgttgggtgtggtctggtacttccgaatcaattaccgccaattcttcacagcacctgccactgtctccctggtgggagtcaccgtcttcttcagcttcctagtatttgggatgtatggacgataaggacataggaagaaaatgaaaggcatggtctttctcctttatggcctccccacttttcctggccagagctgggcccaagggccggggagggaggggtggaaaggatgtgatggaaatctcctccataggacacaggaggcaagtatgcggcctccccttctcatccacaggagtacagatgtccctcccgtgcgagcacaactcaggtagaaatgaggatgtcatcttccttcacttttagggtcctctgaaggagttcaaagctgctggccaagctcagtggggagcctgggctctgagattccctcccacctgtggttctgactcttcccagtgtcctgcatgtctgcccccagcacccagggctgcctgcaagggcagctcagcatggccccagcacaactccgtagggagcctggagtatccttccatttctcagccaaatactcatcttttgagactgaaatcacactggcgggaatgaagattgtgccagccttctcttatgggcacctagccgccttcaccttcttcctctaccccttagcaggaatagggtgtcctcccttctttcaaagcactttgcttgcattttattttatttttttaagagtccttcatagagctcagtcaggaaggggatggggcaccaagccaagcccccagcattgggagcggccaggccacagctgctgctcccgtagtcctcaggctgtaagcaagagacagcactggcccttggccagcgtcctaccctgcccaactccaaggactgggtatggattgctgggccctaggctcttgcttctggggctattggagggtcagtgtctgtgactgaataaagttccattttgtggt

SEQ ID NO: 365732 - DNA, 2048 bp, Homo sapiens
cgggagaagccggaagagaccggaccctgaacagaatcgcagattgccagcccttttcccgacccctacggaaagacgagtccaggggccgtcctggcgaggtcaaaacatttagtctggtcttttcaggggttagttgtggttgtgataaataattactaccgttattaagcaattgcaatttgcagtgtgccaggcactgtgccaagtattttgcttcgatgatttcacgtcatcttcaaaacaacctcatgagcgtggaccctgccagcagccaggccatggagctctctgatgtcaccctcattgagggtgtgggtaatgaggtgatggtggtggcaggtgtggtggtgctgattctagccttggtcctagcttggctctctacctacgtagcagacagcggtagcaaccagctcctgggcgctattgtgtcagcaggcgacacatccgtcctccacctggggcatgtggaccacctggtggcaggccaaggcaaccccgagccaactgaactcccccatccatcagagggtaatgatgagaaggctgaagaggcgggtgaaggtcggggagactccactggggaggctggagctgggggtggtgttgagcccagccttgagcatctccttgacatccaaggcctgcccaaaagacaagcaggtgcaggcagcagcagtccagaggcccccctgagatctgaggatagcacctgcctccctcccagccctggcctcatcactgtgcggctcaaattcctcaatgataccgaggagctggctgtggctaggccagaggataccgtgggtgccctgaagagcaaatacttccctggacaagaaagccagatgaaactgatctaccagggccgcctgctacaagacccagcccgcacactgcgttctctgaacattaccgacaactgtgtgattcactgccaccgctcacccccagggtcagctgttccaggcccctcagcctccttggccccctcggccactgagccacccagccttggtgtcaatgtgggcagcctcatggtgcctgtctttgtggtgctgttgggtgtggtctggtacttccgaatcaattaccgccaattcttcacagcacctgccactgtctccctggtgggagtcaccgtcttcttcagcttcctagtatttgggatgtatggacgataaggacataggaagaaaatgaaaggcatggtctttctcctttatggcctccccacttttcctggccagagctgggcccaagggccggggagggaggggtggaaaggatgtgatggaaatctcctccataggacacaggaggcaagtatgcggcctccccttctcatccacaggagtacagatgtccctcccgtgcgagcacaactcaggtagaaatgaggatgtcatcttccttcacttttagggtcctctgaaggagttcaaagctgctggccaagctcagtggggagcctgggctctgagattccctcccacctgtggttctgactcttcccagtgtcctgcatgtctgcccccagcacccagggctgcctgcaagggcagctcagcatggccccagcacaactccgtagggagcctggagtatccttccatttctcagccaaatactcatcttttgagactgaaatcacactggcgggaatgaagattgtgccagccttctcttatgggcacctagccgccttcaccttcttcctctaccccttagcaggaatagggtgtcctcccttctttcaaagcactttgcttgcattttattttatttttttaagagtccttcatagagctcagtcaggaaggggatggggcaccaagccaagcccccagcattgggagcggccaggccacagctgctgctcccgtagtcctcaggctgtaagcaagagacagcactggcccttggccagcgtcctaccctgcccaactccaaggactgggtatggattgctgggccctaggctcttgcttctggggctattggagggtcagtgtctgtgactgaataaagttccattttgtggt

SEQ ID NO: 365733 - DNA, 2151 bp, Homo sapiens
cgggagaagccggaagagaccggaccctgaacagaatcgcagattgccagcccttttcccgacccctacggaaagacgagtccaggggccgtcctggcgaggtcaaaacatttagtctggtcttttcaggggttagttgtggttgtgataaataattactaccgttattaagcaattgcaatttgcagtgtgccaggcactgtgccaagtattttgcttcgatgatttcacgtcatcttcaaaacaacctcatgagataattctttgagcaactactggggcattatattggacacttcagtaccaagagaaatacatacgatccttgtctaccaggagtctaatagaaagatggacagcgtggaccctgccagcagccaggccatggagctctctgatgtcaccctcattgagggtgtgggtaatgaggtgatggtggtggcaggtgtggtggtgctgattctagccttggtcctagcttggctctctacctacgtagcagacagcggtagcaaccagctcctgggcgctattgtgtcagcaggcgacacatccgtcctccacctggggcatgtggaccacctggtggcaggccaaggcaaccccgagccaactgaactcccccatccatcagagggtaatgatgagaaggctgaagaggcgggtgaaggtcggggagactccactggggaggctggagctgggggtggtgttgagcccagccttgagcatctccttgacatccaaggcctgcccaaaagacaagcaggtgcaggcagcagcagtccagaggcccccctgagatctgaggatagcacctgcctccctcccagccctggcctcatcactgtgcggctcaaattcctcaatgataccgaggagctggctgtggctaggccagaggataccgtgggtgccctgaagagcaaatacttccctggacaagaaagccagatgaaactgatctaccagggccgcctgctacaagacccagcccgcacactgcgttctctgaacattaccgacaactgtgtgattcactgccaccgctcacccccagggtcagctgttccaggcccctcagcctccttggccccctcggccactgagccacccagccttggtgtcaatgtgggcagcctcatggtgcctgtctttgtggtgctgttgggtgtggtctggtacttccgaatcaattaccgccaattcttcacagcacctgccactgtctccctggtgggagtcaccgtcttcttcagcttcctagtatttgggatgtatggacgataaggacataggaagaaaatgaaaggcatggtctttctcctttatggcctccccacttttcctggccagagctgggcccaagggccggggagggaggggtggaaaggatgtgatggaaatctcctccataggacacaggaggcaagtatgcggcctccccttctcatccacaggagtacagatgtccctcccgtgcgagcacaactcaggtagaaatgaggatgtcatcttccttcacttttagggtcctctgaaggagttcaaagctgctggccaagctcagtggggagcctgggctctgagattccctcccacctgtggttctgactcttcccagtgtcctgcatgtctgcccccagcacccagggctgcctgcaagggcagctcagcatggccccagcacaactccgtagggagcctggagtatccttccatttctcagccaaatactcatcttttgagactgaaatcacactggcgggaatgaagattgtgccagccttctcttatgggcacctagccgccttcaccttcttcctctaccccttagcaggaatagggtgtcctcccttctttcaaagcactttgcttgcattttattttatttttttaagagtccttcatagagctcagtcaggaaggggatggggcaccaagccaagcccccagcattgggagcggccaggccacagctgctgctcccgtagtcctcaggctgtaagcaagagacagcactggcccttggccagcgtcctaccctgcccaactccaaggactgggtatggattgctgggccctaggctcttgcttctggggctattggagggtcagtgtctgtgactgaataaagttccattttgtggt

SEQ ID NO: 365734 - DNA, 2179 bp, Homo sapiens
cgggagaagccggaagagaccggaccctgaacagaatcgcagattgccagcccttttcccgacccctacggaaagacgagtccaggggccgtcctggcgaggtcaaaacatttagtctggtcttttcagtgtgccaggcactgtgccaagtattttgcttcgatgatttcacgtcatcttcaaaacaacctcatgagataattctttgagcaactactggggcattatattggacacttcagtaccaagagaaatacatacgatccttgtctaccaggagtctaatagaaagatggacagggctgggtcagttagaacctaaacaaactagagacctggttgcaacccctcaggctctgctgatgctgtccccctttgttcctgcagcgtggaccctgccagcagccaggccatggagctctctgatgtcaccctcattgagggtgtgggtaatgaggtgatggtggtggcaggtgtggtggtgctgattctagccttggtcctagcttggctctctacctacgtagcagacagcggtagcaaccagctcctgggcgctattgtgtcagcaggcgacacatccgtcctccacctggggcatgtggaccacctggtggcaggccaaggcaaccccgagccaactgaactcccccatccatcagagggtaatgatgagaaggctgaagaggcgggtgaaggtcggggagactccactggggaggctggagctgggggtggtgttgagcccagccttgagcatctccttgacatccaaggcctgcccaaaagacaagcaggtgcaggcagcagcagtccagaggcccccctgagatctgaggatagcacctgcctccctcccagccctggcctcatcactgtgcggctcaaattcctcaatgataccgaggagctggctgtggctaggccagaggataccgtgggtgccctgaagagcaaatacttccctggacaagaaagccagatgaaactgatctaccagggccgcctgctacaagacccagcccgcacactgcgttctctgaacattaccgacaactgtgtgattcactgccaccgctcacccccagggtcagctgttccaggcccctcagcctccttggccccctcggccactgagccacccagccttggtgtcaatgtgggcagcctcatggtgcctgtctttgtggtgctgttgggtgtggtctggtacttccgaatcaattaccgccaattcttcacagcacctgccactgtctccctggtgggagtcaccgtcttcttcagcttcctagtatttgggatgtatggacgataaggacataggaagaaaatgaaaggcatggtctttctcctttatggcctccccacttttcctggccagagctgggcccaagggccggggagggaggggtggaaaggatgtgatggaaatctcctccataggacacaggaggcaagtatgcggcctccccttctcatccacaggagtacagatgtccctcccgtgcgagcacaactcaggtagaaatgaggatgtcatcttccttcacttttagggtcctctgaaggagttcaaagctgctggccaagctcagtggggagcctgggctctgagattccctcccacctgtggttctgactcttcccagtgtcctgcatgtctgcccccagcacccagggctgcctgcaagggcagctcagcatggccccagcacaactccgtagggagcctggagtatccttccatttctcagccaaatactcatcttttgagactgaaatcacactggcgggaatgaagattgtgccagccttctcttatgggcacctagccgccttcaccttcttcctctaccccttagcaggaatagggtgtcctcccttctttcaaagcactttgcttgcattttattttatttttttaagagtccttcatagagctcagtcaggaaggggatggggcaccaagccaagcccccagcattgggagcggccaggccacagctgctgctcccgtagtcctcaggctgtaagcaagagacagcactggcccttggccagcgtcctaccctgcccaactccaaggactgggtatggattgctgggccctaggctcttgcttctggggctattggagggtcagtgtctgtgactgaataaagttccattttgtggt

SEQ ID NO: 365735 - DNA, 2175 bp, Homo sapiens
gtctagaagtaatcccggtgcacccgtggaacagaatctgaagattgcccggcctttctttgctgaaccccgtacgtgactgacgatgtccacgtgtagtccagtaccgtgtggacggacggctcgagaacagcactattattactaggctgctttttccaagtggggtataagatctggtgtgatcgtgagtaaactaatgtacaaccgactcattaatcctgttgcagtgagctaatgtgcccgagccacagcttaccagaaggtatttatgacgtcttccgaataggagttatcactgtcaatactctcatacaagcagatcacttacattgtagtctgtgagatacgcttggccatactagctcagggtcgcatggaaggacgtctctgcatgatctgccctactgtatgagagtggagatggtattaatgacggctgataggctggttggaaaggtggtggcaggtgtggtggtgctgattctagccttggtcctagcttggctctctacctacgtagcagacagcggtagcaaccagctcctgggcgctattgtgtcagcaggcgacacatccgtcctccacctggggcatgtggaccacctggtggcaggccaaggcaaccccgagccaactgaactcccccatccatcagagggtaatgatgagaaggctgaagaggcgggtgaaggtcggggagactccactggggaggctggagctgggggtggtgttgagcccagccttgagcatctccttgacatccaaggcctgcccaaaagacaagcaggtgcaggcagcagcagtccagaggcccccctgagatctgaggatagcacctgcctccctcccagccctggcctcatcactgtgcggctcaaattcctcaatgataccgaggagctggctgtggctaggccagaggataccgtgggtgccctgaagagcaaatacttccctggacaagaaagccagatgaaactgatctaccagggccgcctgctacaagacccagcccgcacactgcgttctctgaacattaccgacaactgtgtgattcactgccaccgctcacccccagggtcagctgttccaggcccctcagcctccttggccccctcggccactgagccacccagccttggtgtcaatgtgggcagcctcatggtgcctgtctttgtggtgctgttgggtgtggtctggtacttccgaatcaattaccgccaattcttcacagcacctgccactgtctccctggtgggagtcaccgtcttcttcagcttcctagtatttgggatgtatggacgataaggacataggaagaaaatgaaaggcatggtctttctcctttatggcctccccacttttcctggccagagctgggcccaagggccggggagggaggggtggaaaggatgtgatggaaatctcctccataggacacaggaggcaagtatgcggcctccccttctcatccacaggagtacagatgtccctcccgtgcgagcacaactcaggtagaaatgaggatgtcatcttccttcacttttagggtcctctgaaggagttcaaagctgctggccaagctcagtggggagcctgggctctgagattccctcccacctgtggttctgactcttcccagtgtcctgcatgtctgcccccagcacccagggctgcctgcaagggcagctcagcatggccccagcacaactccgtagggagcctggagtatccttccatttctcagccaaatactcatcttttgagactgaaatcacactggcgggaatgaagattgtgccagccttctcttatgggcacctagccgccttcaccttcttcctctaccccttagcaggaatagggtgtcctcccttctttcaaagcactttgcttgcattttattttatttttttaagagtccttcatagagctcagtcaggaaggggatggggcaccaagccaagcccccagcattgggagcggccaggccacagctgctgctcccgtagtcctcaggctgtaagcaagagacagcactggcccttggccagcgtcctaccctgcccaactccaaggactgggtatggattgctgggccctaggctcttgcttctggggctattggagggtcagtgtctgtgactgaataaagttccattttgtggt

SEQ ID NO: 365736 - DNA, 1892 bp, Homo sapiens
cccgaagtttgaggggtgtggacggtttgtgacccccttagccgaccctactcctcactggccgggacaactggtcttatcacggaggctggggccaggcagcccttcggttcgggtgggcccatggaccccagtccaacgccgagggaataggaccatccaaaagcggaaccttcgcctcagaaaaagggtgcgggacccctcctcaccgtgcggtcacgcgtggaccctgccagcagccaggccatggagctctctgatgtcaccctcattgagggtgtgggtaatgaggtgatggtggtggcaggtgtggtggtgctgattctagccttggtcctagcttggctctctacctacgtagcagacagcggtagcaaccagctcctgggcgctattgtgtcagcaggcgacacatccgtcctccacctggggcatgtggaccacctggtggcaggccaaggcaaccccgagccaactgaactcccccatccatcagaggaagacaagcaggtgcaggcagcagcagtccagaggcccccctgagatctgaggatagcacctgcctccctcccagccctggcctcatcactgtgcggctcaaattcctcaatgataccgaggagctggctgtggctaggccagaggataccgtgggtgccctgaagagcaaatacttccctggacaagaaagccagatgaaactgatctaccagggccgcctgctacaagacccagcccgcacactgcgttctctgaacattaccgacaactgtgtgattcactgccaccgctcacccccagggtcagctgttccaggcccctcagcctccttggccccctcggccactgagccacccagccttggtgtcaatgtgggcagcctcatggtgcctgtctttgtggtgctgttgggtgtggtctggtacttccgaatcaattaccgccaattcttcacagcacctgccactgtctccctggtgggagtcaccgtcttcttcagcttcctagtatttgggatgtatggacgataaggacataggaagaaaatgaaaggcatggtctttctcctttatggcctccccacttttcctggccagagctgggcccaagggccggggagggaggggtggaaaggatgtgatggaaatctcctccataggacacaggaggcaagtatgcggcctccccttctcatccacaggagtacagatgtccctcccgtgcgagcacaactcaggtagaaatgaggatgtcatcttccttcacttttagggtcctctgaaggagttcaaagctgctggccaagctcagtggggagcctgggctctgagattccctcccacctgtggttctgactcttcccagtgtcctgcatgtctgcccccagcacccagggctgcctgcaagggcagctcagcatggccccagcacaactccgtagggagcctggagtatccttccatttctcagccaaatactcatcttttgagactgaaatcacactggcgggaatgaagattgtgccagccttctcttatgggcacctagccgccttcaccttcttcctctaccccttagcaggaatagggtgtcctcccttctttcaaagcactttgcttgcattttattttatttttttaagagtccttcatagagctcagtcaggaaggggatggggcaccaagccaagcccccagcattgggagcggccaggccacagctgctgctcccgtagtcctcaggctgtaagcaagagacagcactggcccttggccagcgtcctaccctgcccaactccaaggactgggtatggattgctgggccctaggctcttgcttctggggctattggagggtcagtgtctgtgactgaataaagttccattttgtggt

SEQ ID NO: 365737 - DNA, 2284 bp, Homo sapiens
cccgaagtttgaggggtgtggacggtttgtgacccccttagccgaccctactcctcactggccgggacaactggtcttatcacggaggctggggccaggcagcccttcggttcgggtgggcccatggaccccagtccaacgccgagggaataggaccatccaaaagcggaaccttcgcctcagaaaaagggtgcgggacccctcctcaccgtgcggtcacggtacggacagggtagatcacaggctgagggacagagcaaagacccctgaggccggacacctggggtcctgccgggcccctccccacgagagttccctgtgtctgtgccaatcgttttcgtctttctttgccgcagtttcttttcctgtaaatcatggttaatgacattaaccttcttaccatcaggggttagttgtggttgtgataaataattactaccgttattaagcaattgcaatttgcagtgtgccaggcactgtgccaagtattttgcttcgatgatttcacgtcatcttcaaaacaacctcatgagataattctttgagcaactactggggcattatattggacacttcagtaccaagagaaatacatacgatccttgtctaccaggagtctaatagaaagatggacagggctgggtcagttagaacctaaacaaactagagacctggttgcaacccctcaggctctgctgatgctgtccccctttgttcctgcagcgtggaccctgccagcagccaggccatggagctctctgatgtcaccctcattgagggtgtgggtaatgaggtgatgcgacacatccgtcctccacctggggcatgtggaccacctggtggcaggccaaggcaaccccgagccaactgaactcccccatccatcagaggaagacaagcaggtgcaggcagcagcagtccagaggcccccctgagatctgaggatagcacctgcctccctcccagccctggcctcatcactgtgcggctcaaattcctcaatgataccgaggagctggctgtggctaggccagaggataccgtgggtgccctgaagagcaaatacttccctggacaagaaagccagatgaaactgatctaccagggccgcctgctacaagacccagcccgcacactgcgttctctgaacattaccgacaactgtgtgattcactgccaccgctcacccccagggtcagctgttccaggcccctcagcctccttggccccctcggccactgagccacccagccttggtgtcaatgtgggcagcctcatggtgcctgtctttgtggtgctgttgggtgtggtctggtacttccgaatcaattaccgccaattcttcacagcacctgccactgtctccctggtgggagtcaccgtcttcttcagcttcctagtatttgggatgtatggacgataaggacataggaagaaaatgaaaggcatggtctttctcctttatggcctccccacttttcctggccagagctgggcccaagggccggggagggaggggtggaaaggatgtgatggaaatctcctccataggacacaggaggcaagtatgcggcctccccttctcatccacaggagtacagatgtccctcccgtgcgagcacaactcaggtagaaatgaggatgtcatcttccttcacttttagggtcctctgaaggagttcaaagctgctggccaagctcagtggggagcctgggctctgagattccctcccacctgtggttctgactcttcccagtgtcctgcatgtctgcccccagcacccagggctgcctgcaagggcagctcagcatggccccagcacaactccgtagggagcctggagtatccttccatttctcagccaaatactcatcttttgagactgaaatcacactggcgggaatgaagattgtgccagccttctcttatgggcacctagccgccttcaccttcttcctctaccccttagcaggaatagggtgtcctcccttctttcaaagcactttgcttgcattttattttatttttttaagagtccttcatagagctcagtcaggaaggggatggggcaccaagccaagcccccagcattgggagcggccaggccacagctgctgctcccgtagtcctcaggctgtaagcaagagacagcactggcccttggccagcgtcctaccctgcccaactccaaggactgggtatggattgctgggccctaggctcttgcttctggggctattggagggtcagtgtctgtgactgaataaagttccattttgtggt

SEQ ID NO: 365738 - DNA, 2226 bp, Homo sapiens
cccgaagtttgaggggtgtggacggtttgtgacccccttagccgaccctactcctcactggccgggacaactggtcttatcacggaggctggggccaggcagcccttcggttcgggtgggcccatggaccccagtccaacgccgagggaataggaccatccaaaagcggaaccttcgcctcagaaaaagggtgcgggacccctcctcaccgtgcggtcacggtacggacagggtagatcacaggctgagggacagagcaaagacccctgaggccggacacctggggtcctgccgggcccctccccacgagagttccctgtgtctgtgccaatcgttttcgtctttctttgccgcagtttcttttcctgtaaatcatggttaatgacattaaccttcttaccatcaggggttagttgtggttgtgataaataattactaccgttattaagcaattgcaatttgcagtgtgccaggcactgtgccaagtattttgcttcgatgatttcacgtcatcttcaaaacaacctcatgagataattctttgagcaactactggggcattatattggacacttcagtaccaagagaaatacatacgatccttgtctaccaggagtctaatagaaagatggacagggctgggtcagttagaacctaaacaaactagagacctggttgcaacccctcaggctctgctgatgctgtccccctttgttcctgcagcgtggaccctgccagcagccaggccatggagctctctgatgtcaccctcattgagggtgtgggtaatgaggtgatggtggtggcaggtgtggtggtgctgattctagccttggtcctagcttggctctctacctacgtagcagacagcggtagcaaccagctcctgggcgctattgtgtcagcaggcgacacatccgtcctccacctggggcatgtggaccacctggtggcaggccaaggcaaccccgagccaactgaactcccccatccatcagaggcaaatacttccctggacaagaaagccagatgaaactgatctaccagggccgcctgctacaagacccagcccgcacactgcgttctctgaacattaccgacaactgtgtgattcactgccaccgctcacccccagggtcagctgttccaggcccctcagcctccttggccccctcggccactgagccacccagccttggtgtcaatgtgggcagcctcatggtgcctgtctttgtggtgctgttgggtgtggtctggtacttccgaatcaattaccgccaattcttcacagcacctgccactgtctccctggtgggagtcaccgtcttcttcagcttcctagtatttgggatgtatggacgataaggacataggaagaaaatgaaaggcatggtctttctcctttatggcctccccacttttcctggccagagctgggcccaagggccggggagggaggggtggaaaggatgtgatggaaatctcctccataggacacaggaggcaagtatgcggcctccccttctcatccacaggagtacagatgtccctcccgtgcgagcacaactcaggtagaaatgaggatgtcatcttccttcacttttagggtcctctgaaggagttcaaagctgctggccaagctcagtggggagcctgggctctgagattccctcccacctgtggttctgactcttcccagtgtcctgcatgtctgcccccagcacccagggctgcctgcaagggcagctcagcatggccccagcacaactccgtagggagcctggagtatccttccatttctcagccaaatactcatcttttgagactgaaatcacactggcgggaatgaagattgtgccagccttctcttatgggcacctagccgccttcaccttcttcctctaccccttagcaggaatagggtgtcctcccttctttcaaagcactttgcttgcattttattttatttttttaagagtccttcatagagctcagtcaggaaggggatggggcaccaagccaagcccccagcattgggagcggccaggccacagctgctgctcccgtagtcctcaggctgtaagcaagagacagcactggcccttggccagcgtcctaccctgcccaactccaaggactgggtatggattgctgggccctaggctcttgcttctggggctattggagggtcagtgtctgtgactgaataaagttccattttgtggt

SEQ ID NO: 365739 - DNA, 1295 bp, Homo sapiens
gttggtccaggcctgtttgccttctcattcctcaccctctatcttttcttccatgtctttcatccttacacaaatacttccctggacaagaaagccagatgaaactgatctaccagggccgcctgctacaagacccagcccgcacactgcgttctctgaacattaccgacaactgtgtgattcactgccaccgctcacccccagggtcagctgttccaggcccctcagcctccttggccccctcggccactgagccacccagccttggtgtcaatgtgggcagcctcatggtgcctgtctttgtggtgctgttgggtgtggtctggtacttccgaatcaattaccgccaattcttcacagcacctgccactgtctccctggtgggagtcaccgtcttcttcagcttcctagtatttgggatgtatggacgataaggacataggaagaaaatgaaaggcatggtctttctcctttatggcctccccacttttcctggccagagctgggcccaagggccggggagggaggggtggaaaggatgtgatggaaatctcctccataggacacaggaggcaagtatgcggcctccccttctcatccacaggagtacagatgtccctcccgtgcgagcacaactcaggtagaaatgaggatgtcatcttccttcacttttagggtcctctgaaggagttcaaagctgctggccaagctcagtggggagcctgggctctgagattccctcccacctgtggttctgactcttcccagtgtcctgcatgtctgcccccagcacccagggctgcctgcaagggcagctcagcatggccccagcacaactccgtagggagcctggagtatccttccatttctcagccaaatactcatcttttgagactgaaatcacactggcgggaatgaagattgtgccagccttctcttatgggcacctagccgccttcaccttcttcctctaccccttagcaggaatagggtgtcctcccttctttcaaagcactttgcttgcattttattttatttttttaagagtccttcatagagctcagtcaggaaggggatggggcaccaagccaagcccccagcattgggagcggccaggccacagctgctgctcccgtagtcctcaggctgtaagcaagagacagcactggcccttggccagcgtcctaccctgcccaactccaaggactgggtatggattgctgggccctaggctcttgcttctggggctattggagggtcagtgtctgtgactgaataaagttccattttgtggt

SEQ ID NO: 365740 - DNA, 2555 bp, Homo sapiens
  misc_feature (2413)..(2413): n is a, c, g, or t
cccgaagtttgaggggtgtggacggtttgtgacccccttagccgaccctactcctcactggccgggacaactggtcttatcacggaggctggggccaggcagcccttcggttcgggtgggcccatggaccccagtccaacgccgagggaataggaccatccaaaagcggaaccttcgcctcagaaaaagggtgcgggacccctcctcaccgtgcggtcacggtacggacagggtagatcacaggctgagggacagagcaaagacccctgaggccggacacctggggtcctgccgggcccctccccacgagagttccctgtgtctgtgccaatcgttttcgtctttctttgccgcagtttcttttcctgtaaatcatggttaatgacattaaccttcttaccatcaggggttagttgtggttgtgataaataattactaccgttattaagcaattgcaatttgcagtgtgccaggcactgtgccaagtattttgcttcgatgatttcacgtcatcttcaaaacaacctcatgagggctgggtcagttagaacctaaacaaactagagacctggttgcaacccctcaggctctgctgatgctgtccccctttgttcctgcagcgtggaccctgccagcagccaggccatggagctctctgatgtcaccctcattgagggtgtgggtaatgaggtgatggtggtggcaggtgtggtggtgctgattctagccttggtcctagcttggctctctacctacgtagcagacagcggtagcaaccagctcctgggcgctattgtgtcagcaggcgacacatccgtcctccacctggggcatgtggaccacctggtggcaggccaaggcaaccccgagccaactgaactcccccatccatcagagggtaatgatgagaaggctgaagaggcgggtgaaggtcggggagactccactggggaggctggagctgggggtggtgttgagcccagccttgagcatctccttgacatccaaggcctgcccaaaagacaagcaggtgcaggcagcagcagtccagaggcccccctgagatctgaggatagcacctgcctccctcccagccctggcctcatcactgtgcggctcaaattcctcaatgataccgaggagctggctgtggctaggccagaggataccgtgggtgccctgaagagcaaatacttccctggacaagaaagccagatgaaactgatctaccagggccgcctgctacaagacccagcccgcacactgcgttctctgaacattaccgacaactgtgtgattcactgccaccgctcacccccagggtcagctgttccaggcccctcagcctccttggccccctcggccactgagccacccagccttggtgtcaatgtgggcagcctcatggtgcctgtctttgtggtgctgttgggtgtggtctggtacttccgaatcaattaccgccaattcttcacagcacctgccactgtctccctggtgggagtcaccgtcttcttcagcttcctagtatttgggatgtatggacgataaggacataggaagaaaatgaaaggcatggtctttctcctttatggcctccccacttttcctggccagagctgggcccaagggccggggagggaggggtggaaaggatgtgatggaaatctcctccataggacacaggaggcaagtatgcggcctccccttctcatccacaggagtacagatgtccctcccgtgcgagcacaactcaggtagaaatgaggatgtcatcttccttcacttttagggtcctctgaaggagttcaaagctgctggccaagctcagtggggagcctgggctctgagattccctcccacctgtggttctgactcttcccagtgtcctgcatgtctgcccccagcacccagggctgcctgcaagggcagctcagcatggccccagcacaactccgtagggagcctggagtatccttccatttctcagccaaatactcatcttttgagactgaaatcacactggcgggaatgaagattgtgccagccttctcttatgggcacctagccgccttcaccttcttcctctaccccttagcaggaatagggtgtcctcccttctttcaaagcactttgcttgcattttattttatttttttaagagtccttcatagagctcagtcaggaaggggatggggcaccaagccaagcccccagcattgggagcggccaggccacagctgctgctcccgtagtcctcaggctgtaagcaagagacagcactggcccttggccagcgtcctaccctgcccaactccaaggactgggtatggattgctgggccctaggctcttgcttctggggctattggagggtcagtgtctgtgactgaataaagttccattttgtggtngaaagcatttaaaccaaaaatctggatcataacgtggcagccaacagttccccgctggggcggccaaccaccccgtgaaaccctttcgggggggggcgcgatcccaattccggccttttgcgagaccttttcaaagaaagtg

SEQ ID NO: 365741 - DNA, 1950 bp, Homo sapiens
cccgaagtttgaggggtgtggacggtttgtgacccccttagccgaccctactcctcactggccgggacaactggtcttatcacggaggctggggccaggcagcccttcggttcgggtgggcccatggaccccagtccaacgccgagggaataggaccatccaaaagcggaaccttcgcctcagaaaaagggtgcgggacccctcctcaccgtgcggtcacggtacggacagggtagatcacaggctgagggacagagcaaagacccctgaggccggacacctggggtcctgccgggcccctccccacgagagttccctgtgtctgtgccaatcgttttcgtctttctttgccgcagtttcttttcctgtaaatcatggttaatgacattaaccttcttaccatcaggggttagttgtggttgtgataaataattactaccgttattaagcaattgcaatttgcagtgtgccaggcactgtgccaagtattttgcttcgatgatttcacgtcatcttcaaaacaacctcatgagggctgggtcagttagaacctaaacaaactagagacctggttgcaacccctcaggctctgctgatgctgtccccctttgttcctgcagcgtggaccctgccagcagccaggccatggagctctctgatgtcaccctcattgagggtgtgggtaatgaggtgatggtggtggcaggtgtggtggtgctgattctagccttggtcctagcttggctctctacctacgtagcagacagcggtagcaaccagctcctgggcgctattgtgtcagcaggcgacacatccgtcctccacctggggcatgtggaccacctggtggcaggccaaggcaaccccgagccaactgaactcccccatccatcagagggtaatgatgagaaggctgaagaggcgggtgaaggtcggggagactccactggggaggctggagctgggggtggtgttgagcccagccttgagcatctccttgacatccaaggcctgcccaaaagacaagcaggtgcaggcagcagcagtccagaggcccccctgagatctgaggatagcacctgcctccctcccagccctggcctcatcactgtgcggctcaaattcctcaatgataccgaggagctggctgtggctaggccagaggataccgtgggtgccctgaagagcaaatacttccctggacaagaaagccagatgaaactgatctaccagggccgcctgctacaagacccagcccgcacactgcgttctctgaacattaccgacaactgtgtgattcactgccaccgctcacccccagggtcagctgggtcctctgaaggagttcaaagctgctggccaagctcagtggggagcctgggctctgagattccctcccacctgtggttctgactcttcccagtgtcctgcatgtctgcccccagcacccagggctgcctgcaagggcagctcagcatggccccagcacaactccgtagggagcctggagtatccttccatttctcagccaaatactcatcttttgagactgaaatcacactggcgggaatgaagattgtgccagccttctcttatgggcacctagccgccttcaccttcttcctctaccccttagcaggaatagggtgtcctcccttctttcaaagcactttgcttgcattttattttatttttttaagagtccttcatagagctcagtcaggaaggggatggggcaccaagccaagcccccagcattgggagcggccaggccacagctgctgctcccgtagtcctcaggctgtaagcaagagacagcactggcccttggccagcgtcctaccctgcccaactccaaggactgggtatggattgctgggccctaggctcttgcttctggggctattggagggtcagtgtctgtgactgaataaagttccattttgtggt

SEQ ID NO: 365742 - DNA, 1554 bp, Homo sapiens
cccgaagtttgaggggtgtggacggtttgtgacccccttagccgaccctactcctcactggccgggacaactggtcttatcacggaggctggggccaggcagcccttcggttcgggtgggcccatggaccccagtccaacgccgagggaataggaccatccaaaagcggaaccttcgcctcagaaaaagggtgcgggacccctcctcaccgtgcggtcacggtacggacagggtagatcacaggctgagggacagagcaaagacccctgaggccggacacctggggtcctgccgggcccctccccacgagagttccctgtgtctgtgccaatcgttttcgtctttctttgccgcagtttcttttcctgtaaatcatggttaatgacattaaccttcttaccatcaggggttagttgtggttgtgataaataattactaccgttattaagcaattgcaatttgcagtgtgccaggcactgtgccaagtattttgcttcgatgatttcacgtcatcttcaaaacaacctcatgagggctgggtcagttagaacctaaacaaactagagacctggttgcaacccctcaggctctgctgatgctgtccccctttgttcctgcagcgtggaccctgccagcagccaggccatggagctctctgatgtcaccctcattgagggtgtgggtaatgaggtgatggtggtggcaggtgtggtggtgctgattctagccttggtcctagcttggctctctacctacgtagcagacagcggtagcaaccagctcctgggcgctattgtgtcagcaggcgacacatccgtcctccacctggggcatgtggaccacctggtggcaggccaaggcaaccccgagccaactgaactcccccatccatcagagggtaatgatgagaaggctgaagaggcgggtgaaggtcggggagactccactggggaggctggagctgggggtggtgttgagcccagccttgagcatctccttgacatccaaggcctgcccaaaagacaagcaggtgcaggcagcagcagtccagaggcccccctgagatctgaggatagcacctgcctccctcccagccctggcctcatcactgtgcggctcaaattcctcaatgataccgaggagctggctgtggctaggccagaggataccgtgggtgccctgaagagcaaatacttccctggacaagaaagccagatgaaactgatctaccagggccgcctgctacaagacccagcccgcacactgcgttctctgaacattaccgacaactgtgtgattcactgccaccgctcacccccagggtcagctgagcagcagtccagaggcccccctgagatctgaggatagcacctgcctccctcccagccctggcctcatcactgtgcggctcaaattcctcaatgataccgaggagctggctgtggctaggccagaggataccgtgggtgccctgaagagcaaatactcccctggacaagaaagccagatgaaactgatctaccaggggagtatttgctctgcaaggcacccacg

SEQ ID NO: 365743 - DNA, 1055 bp, Homo sapiens
cccgaagtttgaggggtgtggacggtttgtgacccccttagccgaccctactcctcactggccgggacaactggtcttatcacggaggctggggccaggcagcccttcggttcgggtgggcccatggaccccagtccaacgccgagggaataggaccatccaaaagcggaaccttcgcctcagaaaaagggtgcgggacccctcctcaccgtgcggtcacggtacggacagggtagatcacaggctgagggacagagcaaagacccctgaggccggacacctggggtcctgccgggcccctccccacgagagttccctgtgtctgtgccaatcgttttcgtctttctttgccgcagtttcttttcctgtaaatcatggttaatgacattaaccttcttaccatcaggggttagttgtggttgtgataaataattactaccgttattaagcaattgcaatttgcagtgtgccaggcactgtgccaagtattttgcttcgatgatttcacgtcatcttcaaaacaacctcatgagataattctttgagcaactactggggcattatattggacacttcagtaccaagagaaatacatacgatccttgtctaccaggagtctaatagaaagatggacaggtacataagtataatgaagttttataggtgctgtgagaatagtctgataatggtaatcaccagactggatttgcccagggacagctgtgaaagcagcagattctccaagggaaatagtaggtactccaaggagcaagcagggacccttcctgcctttctaagaaactgcagcagcagaaccttcacagtgaaagaagagagactgagatatggattgtgagagctgttatggaatctttttcaaatcactccacttggggagtggtcattgcaggagtgggcccatggtgacccaggaaggtggtgcttctggtgtctgtcccaagttgctccccagggcttgccagaagtttcagaggcggcacataatgtctgctgcatagtatctgcccgcggtccctacagagttatcgttttag

SEQ ID NO: 365744 - DNA, 289 bp, Homo sapiens
tccttccttgcagtcaactcttgctaaccctatgattgcccacaagcaatacatttaaaccagggacccagctgaaatgctttaatggacaacacaaagtgggagactaaatatgtgaagctatagcaagtacaagtgactcaccaacctatttgcatctggatctcttgcccactatctactaacatttttcctatcaaagctgcttaatgattccttaattgccaaatcagataactggttctgttctccatgcatcctgactgtgctgcaacatttggagcacttt

SEQ ID NO: 365745 - DNA, 363 bp, Homo sapiens
ggttttaccgtgttggccaggatcgtctcaatctcctgaccttgtggtccacccgccttggcctcccaaagtgttaggattacaggcgtgagccaccacgcttggccaatatgtgcaatttaaaaaatatttataccccaaagcatttagaaaattccattgtctaaatgcatcatcacagttaactcactcggtaaaggtcgtcttggctgcgtccattctgtggcaattacgaataaagctgccataaactcaattttgagactcctttactgatagtgacgttattttaggtgatagcagtggtgtgatctcagctcaccgcgctccgcctcctgggttcatgccattctcctgcctcag

SEQ ID NO: 365746 - DNA, 283 bp, Homo sapiens
caagagaaagctccatggctgacatacttgctattggctcctaggcatgctcccttcctttcataagtgcttacagaataattaaaggctgttttatcagtgatgattatagctatgtttactgagcttgccacacgctgggcactgcggctctgcattttacaattccttcattcttatttactgttaggcctctaggtggggacagagttccagaaactctgggtcagtttttaagcaggcttggagactcagaaccagaagctgcgacccggtggaaggt

SEQ ID NO: 365747 - DNA, 354 bp, Homo sapiens
tgagaaaactgatgtggacaaaatgactccttaatctgacaaacaagtctttgtgatccagcctctgcctgtctcttagactttatctcctacaacttttcacttttattttgtcccagccgcactgggccccatgctattccatggacacagtaataaactcgtttttgcactggcatctactttggaatgctctttgcccagagcttcctaacatttagtgctccctgtagtctctattctagtgtcattttcaaggaggcctgtctccctcacctccctctccttctttcctctcccatttacactccccactcccctccctccctctctccctcactcccttccttccat

SEQ ID NO: 365748 - DNA, 392 bp, Homo sapiens
ttaaaaaatgattttagggacagtccctctgagcccaggctagccagcatggacacagaaatcactgactataatgccaagtatgagcttggcaaagataaaattactcacagcctacatgcgccacacacatggtctaatttcttgtaagattagagaacaaattagtaaaactggaatgaaaaccaaagtctgttcaaggctggaatttccccagtagtccaatgtttcagctactgtggctgtttagaaagtatcatgaatcacccttaaagatgagctgtaatgtttttggaaaaaagaagccagtgtggtttagggatgggaaaggaggggaggtactaggctgcttgtcaaccagctgacccggaaccctgacgactggctgatgc

SEQ ID NO: 365749 - DNA, 390 bp, Homo sapiens
ggagaagctgaggcagcaggattgctagaacctgggagatcaaggctgcagtgagctattatctcaccactctaccctacagcctgggcaacaaagtaagaaacttgtctccaaaaaaaaaaaaagtgagtttattcacacaacctttagaagattgacaaagtctcttttttttaaactcttctctttcagggtaaatatcatctctttactaaaaaaatctaaactgggccacccagaaaagtttaaaagtatcatgaatcacccttaaagatgagctgtaatgtttttggaaaaaagaagccagtgtggtttagggatgggaaaggaggggaggtactaggctgcttgtcaaccagctgacccggaaccctgacgactggctgatgc

SEQ ID NO: 365750 - DNA, 125 bp, Homo sapiens
caaaagcaaccacataccaggcacagtggctcatacctgtaatttcaacacttctggaggctgagggaggaagagagcctcagtccaggagtttgagaccagtctgggcaacatagtaagccaaa

SEQ ID NO: 365751 - DNA, 296 bp, Homo sapiens
ctagaatgcagtggcataatcccagctcgctgcaacctcaatctccagggctcaagcgaccctcccaccttggactcccaaagagtgctaagattacaggcatgagccactatgcccagctggaatttattttcttaaagaaaaaaaaaatctaaatacttgggggaaatgggagttgagcaaaagactgacactaacagcagaatgaatcatttttatatcttctttaccttctttactgggaaaggtggctggctcagcagggaaggagtgtatgaggagactgtgtaaaatgt

SEQ ID NO: 365752 - DNA, 450 bp, Homo sapiens
aacaatgttactattataagataaatatttaatttaactatatatttagaaataattatttctgatgtttatttaataactcttagggcatacgccaacaataaatcaataaattatttccccccagtccattgtgtgaggtaatcttttaaaagtactacaatggaccgggcgcggtggctcaagcctgtaatcccagcactttgggaggccgagacgggcggatcatgaggtcaggagatcgagaccatcctggctaacacagtgaaaccccgtctctactaaaaatacaaaaaattagctgggcgcggtggcgggcgcctgtagtcccagctactcgggaggctgaggcaggagaatggcgtgaacccgggaggcagagcttgcagtgagctgagatcgtgccactgcactccagcctgggtgacagagcgagactccgtctcaaaa

SEQ ID NO: 365753 - DNA, 454 bp, Homo sapiens
tttaagcactcactttccttattgaaatgttttgtgacaaggtaagtgtaatattaaacgtgcatgcagttcctcatcatgtttctcctttgtgccaattatgtatcttgacttagtcttttgtggcacagggaactattgtattcctaactcacacagaccctcttctccagcaaaactgaatatctggagcaccagccagtgccctgcaaaaaatggtctctctcctgtctattaaggtgcaaatttagttatagactttccctttttcatcttgcttagaaattctataccatccagtgtctgtgttctttctagaagatgtccaataaatacctgctgaatttaaatgtgtatttccttcatcaaaatactgcttcattatgctatgtgaaataagccagacacagaaagaaagataacgcatggcctcacttttatatggaatctgaaa

SEQ ID NO: 365754 - DNA, 322 bp, Homo sapiens
ctaatttgtgtatttttagtagagatgggatttctccatgttggtcagtctggtctggaactcccaacctcaggtgatccacccacctcggcctcccaaagtgcgggattacagacatgagccaccgtgcctgacctgtagtcttttttccattcctttatttgttcattcatatttgagagaggtactaaaagactgggagccgaggtgtggtggctcacacctataatctcagtgctttgggagaccgaagtgggaggatcacttgagcccaggagctcaagactagtttgggcaacatagtgagaccccatctttacaa

SEQ ID NO: 365755 - DNA, 552 bp, Homo sapiens
cagtgtcaaaaagattttctaagacagaggagcactacggccaagtgtccttttatgatatccacagaattcaaaattgcagagcctaaaaggcactaactttatcctgtcgtatgtcactgtggaaagcactcttcagagccatgttcccacacttgttttctcactgtggagtacatctgtgttggtgacttcagctaaacctgttccccagggataaatgcaacagcccatacaaaatcaggcatgaggacacagtccaacaacttcgtgtataaataaagttacacattcatcgccagttgcttgttttaaaaataaaaaaaaaaagtctccccacagatttactgactttcatgtaggatctgtgtttgtgtaatttgaagtaggcttgatttataaggtttgctatagctaacatttaaagaaatgtttaaattaggcacagtggtgcatgcctgtagtcctagctacacagaaggctaaggcaagaggactgtttgaggccaggagttcaagttcagattggacttcataagatcccatccatta

SEQ ID NO: 365756 - DNA, 1262 bp, Homo sapiens
ctcatggattggtggttggtatcagctgctccaccttttctaccatttactgaacgagttgaggaaaaagggaaggagtctcgtctttacatccttattttctttttttattggttggcacctatgccactcacgtggtggagaggcggggcaatagttggagatgattggttctgagaattggctgtgaaagcggcattgctgaccagtgagagagacctaatgaggagcaggccggggcaaccaatgaaatcggagaagagcgcttgggggcgtgtccgcctgctttcagcctttggcaagttggtgggaggtgaaagtgacttggcctcttaaaagcgtttttttcacgtgggtgtgatgtcgtgttccgtttttctgaataagaacttcgtagcttcttgttaggaagaacctggaggacagagtaactctcggcagtcagcccccgcctgaggctctcttgaaggacccccttctaactcgaagctggatacccagattccaggggtgcccagaagtagcttttccagccccttcctggatccatggtccccctagttcccttccctgtttgctctttatcgcccaacaccccttgtgtcttgattctagactgtcatatgcctataccgattctgtccccttcagaagtagattcgcgaggacctgactttatgtgtctcttccagacctaaaggcccttggttttagcatcataggtgccatgtatatgcttaactttgaacagaaaattattattttttgtatctttaaactgatatatcgtagttgtacatatttaactttggacagaaaattttttttatatctttaaactgatatagttgtacatattttcagggatacatctgatattgtgatacatgtattcaatgtataattatcaaatcagtgtaattgggatatccatcatctcaaacattatctttgtgttgggaacattttctgctatgcgttctcttgtagcaggaaatcgttatttttgatcaactgactattcacacatttgtgaagattacaaattcagtaactaatgtaacatttagatgtaagctattgttgcaaatgtaacctaaagcgccgtactttagggaatctagcatctgttacattttgctagtttgaacaggcaatagaaatagctattagatactgtaaaagaaattgactttctttgccaatgtgcttcccagtgtcaataaattaaagtatcctttttaagaaaaaaaaaaataaaa

SEQ ID NO: 365757 - DNA, 1043 bp, Homo sapiens
ctcatggattggtggttggtatcagctgctccaccttttctaccatttactgaacgagttgaggaaaaagggaaggagtctcgtctttacatccttattttctttttttattggttggcacctatgccactcacgtggtggagaggcggggcaatagttggagatgattggttctgagaattggctgtgaaagcggcattgctgaccagtgagagagacctaatgaggagcaggccggggcaaccaatgaaatcggagaagagcgcttgggggcgtgtccgcctgctttcagcctttggcaagttggtgggagctaaaatcagtcatcttcctgcgaaggcatgaggaggaaaagagaggaagtaactgagcgataatatgctgtatgagcctcctgctctgctgcccattacctgcgtcacctccacaagctactgaacctcaaggaacccatctcctcatcaggaaaaaaaataagctttatcagggtctgaactctgtaggtcttcaccacggctcaggaggatgaggagcagtgacaggccaaactacgagaaaagacagagggaatcaaactcaacactgtgtctaaacctcctccaccactgttgaagggatcctggcatcagatggggaacagctctaaatcaaaataacctcactactgtgcttttctgtaaaaccaggtaaagatcagacaagcatgagttgaaaggctatgtctctctccaggctttattctgccatagcagtgaccaggcgcagccaacagaaacggaaagtcatggtgtccaacacgcctctctgttccccatgctgaggttaaaagatggtttttccttgccatggataatgtagaatttgacttttctcctatttatgagaacagaaataggctaaaaaagaaagtaaatgaagaccaattttggtacagaaattaaaaatcaggaaaaaataagaaaaaagcattacagtaagatattttgaattaagaaacaaggtgtaaactgtaggaaaatatacaaataaacacaactgaaata

SEQ ID NO: 365758 - DNA, 1160 bp, Homo sapiens
ctcatggattggtggttggtatcagctgctccaccttttctaccatttactgaacgagttgaggaaaaagggaaggagtctcgtctttacatccttattttctttttttattggttggcacctatgccactcacgtggtggagaggcggggcaatagttggagatgattggttctgagaattggctgtgaaagcggcattgctgaccagtgagagagacctaatgaggagcaggccggggcaaccaatgaaatcggagaagagcgcttgggggcgtgtccgcctgctttcagcctttggcaagttggtgggagctaaaatcagtcatcttcctgcgaaggcatgaggaggaaaagagaggaagtaactgagcgataatatgctgtatgagcctcctgctctgctgcccattacctgcgtcacctccacaagctactgaacctcaaggaacccatctcctcatcaggaaaaaaaataagctttatcagggtctgaactctgtaggtcttcaccacggctcaggaggatgaggagcagtgacaggccaaactacgagaaaagacagagggaatcaaactcaacactgtgtctaaacctcctccaccactgttgaagggatcctggcatcagatggggaacagctctaaatcaaaataacctcactactgtgcttttctgtaaaaccaggtaaagatcagacaagcatgagttgaaaggctatgtctctctccaggctttattctgccatagcagtgaccaggcgcagccaacagaaacggaaagtcatggtgtccaacacgcctctctgttccccatgctgaggttaaaagatggtttttccttgccatggataatgtagaatttgacttttctcctatttatgagaacagaaataggctaaaaaagaaagtaaatgaagaccaattttggtacagaaattaaaaatcaggaaaaaataagaaaaaagcattacagtaagatattttgaattaagaaacaaggtgtaaactgtaggaaaatatacaaataaacacaactgaaataaacatggtataaagagaaactttccattaaaaagcacatctctatctggaaatacaaagtcttagacagaatgttaataaaaatctaaaaaataaaaagagagaaagggtaaacaga

SEQ ID NO: 365759 - DNA, 296 bp, Homo sapiens
cacactgaccactgattattttgtgttgattctgtagcagggtctgaactctgtaggtcttcaccacggctcaggaggatgaggagcagtgacaggccaaactacgagaaaagacagagggaatcaaactcaacactgtgtctaaacctcctccaccactgttgaagggatcctggcatcagatggggaacagctctaaatcaaaataacctcactactgtgcttttctgtaaaaccaggtaaagatcagacaagcatgagttgaaaggctatgtctctctccaggctttattctg

SEQ ID NO: 365760 - DNA, 1349 bp, Homo sapiens
  misc_feature (5)..(5): n is a, c, g, or t
  misc_feature (11)..(11): n is a, c, g, or t
  misc_feature (21)..(21): n is a, c, g, or t
  misc_feature (24)..(24): n is a, c, g, or t
taggntaggtngaggctgggngtnaatcggccgaggcggcgccggaagtggtcgcgggtcgttctgcttcctgcccgaggggcgtgcgcgggtcaggggcggccgcggaggcggaagcatccatggcggagggcggcagcccagacgggcgggcagggccgggctccgcaggtcgtaatctgaaggagtggctgagggagcaattttgtgatcatccgctggagcactgtgaggacacgaggctccatgatgcagcttacgtcggggacctccagaccctcaggagcctattgcaagaggagagctaccggagccgcatcaacgagaagtctgtctggtgctgtggctggctcccctgcacaccgttgcgaatcgcggccactgcaggccatgggagctgtgtggacttcctcatccggaagggggccgaggtggatctggtggacgtaaaaggacagacggccctgtatgtggctgtggtgaacgggcacctagagagtacccagatccttctcgaagctggcgcggaccccaacggaagccggcaccatcgcagcacccctgtctaccacgcctctcgcgtgggccgggcagacatcctgaaggccctcatcaggtacggggctgatgttgacgtcaaccaccacctgactcctgatgtccagcctcgattctcccggcggctcacctccttggtggtctgccccttgtacatcagcgcagcctaccacaacctccagtgcttccggctgctcctcctggctggcgcgaaccctgacttcaactgcaatggtcctgtcaacacacagggattctacaggggctcccctgggtgcgtcatggatgctgttctgcgccacggctgtgaggcagccttcgtgagcctgctggtagaatttggagccaacctgaatctagtgaagtgggaatcgctgggcccagagtcgagaggaagaagaaaagtggaccctgaggccttgcaggtctttaaagaggccagaagtgttcccagaaccttgctgtgtctgtgccgtgtggctgtgagaagagctcttggcaaacaccggcttcatctgattccttcgctgcctctgccagaccccataaagaagtttctactccatgagtagactccaagtgctgcggttgattccagtgagggagaaagtgatctgcagggaggtggacaccgagccctgagtgctgtgctgctgctggtctcctgatggctgttgctgcagaagatgtcctcgtagactgtcattgctcctcaggtgcctgggccgctgaacagtccttgggtcattgtcagctgagaggcttatactaaagttattattgtttttccc

SEQ ID NO: 365761 - DNA, 7386 bp, Homo sapiens
  misc_feature (3510)..(3510): n is a, c, g, or t
  misc_feature (4514)..(4514): n is a, c, g, or t
  misc_feature (4874)..(4874): n is a, c, g, or t
ggttgttcacgaatgcattcatttattcaatgaacttcgcgtcagccactggctgtcatcagttaccgacctgattgagggcttcatggaagggatttggaggagcattcatctaaaaccacagcacgctgcgacgctcagccctgcagtgggccctcaccagtccccgcgcctccgaatccaccctcccggggctgctcgtggctagcggggggcacctgcggggaccaagccagcccggccgaggcccgggtcccgcccgccacggccctcggggccccgcccacatctggcagaagccacgccccgtccgtgtgggtggggacggcccgccggaccgaaattcccagactgctgcctcaggcaacgggctttccgactccttggcttcttatgtgaggaaaccacagcgcggccggcatccagagagtcggttagtcgcgaagttcccgccggacgaagggaccagccagcgccctgctagacagcgaggccggaagcggaggcgtggcccctgcgcggccccggaaaccagtgaggccggcgcgcgcccgccggaagccgcgaccccgacgcgccccccattgccctcggcgccggaagtggtcgcgggtcgttctgcttcctgcccgaggggcgtgcgcgggtcaggggcggccgcggaggcggaagcatccatggcggagggcggcagcccagacgggcgggcagggccgggctccgcaggtcgtaatctgaaggagtggctgagggagcaattttgtgatcatccgctggagcactgtgaggacacgaggctccatgatgcagcttacgtcggggacctccagaccctcaggagcctattgcaagaggagagctaccggagccgcatcaacgagaagtctgtctggtgctgtggctggctcccctgcacaccgttgcgaatcgcggccactgcaggccatgggagctgtgtggacttcctcatccggaagggggccgaggtggatctggtggacgtaaaaggacagacggccctgtatgtggctgtggtgaacgggcacctagagagtacccagatccttctcgaagctggcgcggaccccaacggaagccggcaccatcgcagcacccctgtctaccacgcctctcgcgtgggccgggcagacatcctgaaggccctcatcaggtacggggctgatgttgacgtcaaccaccacctgactcctgatgtccagcctcgattctcccggcggctcacctccttggtggtctgccccttgtacatcagcgcagcctaccacaacctccagtgcttccggctgctcctcctggctggcgcgaaccctgacttcaactgcaatggtcctgtcaacacacagggattctacaggggctcccctgggtgcgtcatggatgctgttctgcgccacggctgtgaggcagccttcgtgagcctgctggtagaatttggagccaacctgaatctagtgaagtgggaatcgctgggcccagagtcgagaggaagaagaaaagtggaccctgaggccttgcaggtctttaaagaggccagaagtgttcccagaaccttgctgtgtctgtgccgtgtggctgtgagaagagctcttggcaaacaccggcttcatctgattccttcgctgcctctgccagaccccataaagaagtttctactccatgagtagactccaagtgctgcggttgattccagtgagggagaaagtgatctgcagggaggtggacaccgagccctgagtgctgtgctgctgctggtctcctgatggctgttgctgcagaagatgtcctcgtagactgtcattgctcctcaggtgcctgggccgctgaacagtccttgggtcattgtcagctgagaggcttatactaaagttattattgtttttcccaagttctctgttctggattttcagttgcatattaatgtaacgggccatggggtatgtacatgtaggggctgaggttggaggcctactaatttccctgtagggaagactcccagcacttctggaactgtgcttctctttatttttctacttctcaatttgatggttcgattaaagccttctagtatctcaatgaaaagggagtttcgtaagcaaaatagaggacagaaatgcagttcatgaacttgctggttggtttttcctgctcctggggtaacacatgcgcttgtcatacacgccccttccttgccccttcagtattctctctttgcgatggaggtctcatagtgagtgtcttcactcaagggtggtttcctggctgcacggcacctgttccaacacctactgtgcctctcatcaggtgtcacgatttttctgccacttcaccttagggagcttccagtgattgattttaggaggcccacaccaaactccccaggaaatgactgccttccttgggaccaaggaccgttccaacagcattcactgccagttctaataggcgaggaaaatgcccgaggcgctgtcttctgtcccccacacgtaccagaaagtgaaaaatgcagcgagtcctctgggtggttatgagcctccaggcgcatgctgtccagtggacagaacatctggcggttggttgattgctctcttttgtcttggtcgctgcttctagaatctatgcaggggatagcagtgaggtcagaagtctttcccgggagagagatggcctgggttatcattgctgatagctttggctgcatgagttgggcttccccttacccagggctgcacagccaggtgtgagggtcaccggcaggtgggctggtggctgcagcctcagagccctcccaggttgctgctgtttccagtgaatcacatttcgtcatttgaagcccatgaggaccattgtgtggatccatggtgattctagacttcagatatatttaggaaggcgcagatttcaaatctgtgtttgattttctgtaataagagaaatccaatttgtaaaacttgaacaatgataccgttttatttacttagtagcatcactgtgtgtcttagcaggcaggcagtgtctggccattattgcgttctacagccagaggatagaattctatacccccaaccccttgtgtcacaaatgggctctgtgtgggtcaccccagctgacccgtgtatgtgcagatgcagttccgaagggaagaacagtcctcgggtgattcagaggggaaaatgcaatccgggaggtgtttcctcagctgaggtgacactgttagaagctgtgatggttgtgtaaatgtgggctgtgtgctgttcccgaggggagcttgggattgggtcctgctgaagccaggagggtcttcccaagataggagaggaaccgcaggtggtgagcggctggggagggccaggacagccggggctgggtgctgcaggggcttcagcccgggagagggggtgggcgtgttctttgtggtaccaaagtgggactaggacaaaaattgggctgtggctggggcaggagctatagggagttaaggaatgatgatanggaagttggagccaccaccgtggactgggccttgtcactggaggtcgtaggcagtggctcatcaccctggtagggctgataggggctttcagggaggctggttagctccctgcactctggctctttactggcttactgtttagctcctcccacctcgaggctcttcttcctgccaccctttgggctcagaggagggtggcttttttcgaggtgagccatgttgtagacacatgatacgctctgcgtctgctctactgagtactttctgcaggggcctgttaaggacgaggcctccccagccctgcccggtgcaggaggtggctcagttattgaaccttttgggaagcagcacctgggaatgctgcctcgtgggagtcccatgcgtgagtgtggtggtgtgaccttcaggctgcacagaggcaaggacccagatgtggcagcatgggcgtcatgctcctttgcacagcccagggcctgttttggagggaccaggtcactgcccctggtctctctaggaggagtggactgaatggatcgttgcagagaagactcacccagacctggccagggaatgatgtatctggggagagaatgagctggaggagggggcctctcatggcccttccctggcctgtggcccagcctggctggcctgcaggtgtctagggtctcagcttttcatttgcagaggacatgttcaacttcctctctgttcaagccagcctttgccaattttttcagaatccaaacaatttggaggtttggtatcttgtttcatagctgccaaatatgaatctgaaaacagggtgggtagctaaggtcattcctcctgggttttagtggcattgccttccttcactaaagctcccttttttttctgttggcaaggacaggttacagaataggaagagtagcactttccgcctaagcactttaggaaatcacctttctaagccctggggcgcccaagtcccatgggacagggaaacgtggtcctcagtgangctgctgcctggctggcccggagtcctccctaggagaggggctcgatgggctgggggaaggagcctgaaggttgcccctggttgcatcccagaagcatctgactgtcaccactgccagtggctgtggaacagtcctgggccctgggccttggctgctgtcaacagatgggctgggctgggctgtggtggggtgggggacaacgttggtaactctgagaattcagctttggagtcccgggtgaggggttttagataaacccatcaatatcacccacattctgtgactctttgcatcactcgtgttatttatttatttatttatattctgccttgttccagaaaagtgtttaaggcaacaangcttgttttttggtgttttcttttgacatttgaaaatttagtacattgttaaaatgtacttgttaaacaggtaattttaaagagaaggaacaattgtttttagtaagttttctttttcctttttcaatgaattgattcttcaaattaaaagttcttgagagaaggagaggaagatacagcagacataggactgagccaaggaagagtctgcctgagagagacgcttggcctgtgctttgctgccatccgtgcggccttggccacatccctattaacagaggcagctccacttcagacagggacaaggcttcctgctgtgcctttctggcagggtttgtggggtcacatgggaagcaatgtgttacgcaagcagtctccatgtgtgtgtaaactgctgtcctggtgacttgtccctcttcttagtggaaatgcatttgagatggtgacagggctggatgaacgtgtgaccctgggagatccgggctggactgtggaccccgatgggccagagtccttgtggcccacagcatagcactggggacagagcgctctatgcaggtgaggcgtatgagaacagcatggtaaataattgatgaagtcacatttgttcaacttaaaggattgttctttattctgaagttattttcttccttatttggatgataaaatttccttttatgtaatgaaggtaaaagtagagggcaatatttttgctttttgaaatgctcttggttgcaaaacaaaatgttggttgctgtttgtcagccccagaatttcttcttaagttcgcctgtctctgaaatcccaaagtcacggaaccgcagtctagctgtggtgcatgtttacgtattggtgagaaattcctcttgggttcttgaacagcctgtacgctggcaggcagcactgcagcatttctgctgctcatggccaagaacgagtctggagatcgctgcgtgcggttttaggaagtgccaacacccgtggtgatgggcctctggccacccctggatccatgggacacactcacaggaagctgatgtggccttctcggtgaggactgcaccttaacctgggcactgggagcctgtggcccccctgtatgttggtgatgacactagtgtgggtcttctggctctggggctacagcttctgcctcctcacctggccgtcggtactcggcaagcaggcctggcctcccggggcctggatccctaccggctgggattggcctcctggaagtacctgtttgggccatgtgacctcctttctcacttatgcctcactcccctcctcccgctccaaacccgaacctctcagtgtggaatgaacgctccaaacccgaacctctcagtgtggaatgaaacagtttagatgtgtacatgatgcacgtgggtgggattcacatcccaggagaattccacggagaggaatgtgcagattttgaagtgtacagtgatgtgtggaataaatactagaaattctcagcagacagtgggatggagaagtgagtgggggcaggagggggatttctgttgccttgacatgtcgttgctcagtgcctggattgcaggcgagtctctcttttttatgttgctttgatttcaagatctcttagatatactaggtagtgtatgaatgtgcataaatccagtttgagaatggtgtttatgaagaagctgtttcgtgtgtacagttgctgctgtaatttagccagcagtgccctgccctgccctgcagtgtctgctcagctcccactgcttctctttgctgttgggcatgtgaggcatgacttggaggggggcctggtgcctggggacctgctgaagagaatgctcaccaccagctctctgtttccctttctgctttggtaatcaacacgtgtttgcctgcagtggccgggaccgtgactgtttctgcccttgtgcctagttaagagccttcaaaagcataatgaacacttttgatatgatattgtaactttagtaaatgctttacttccctctaattgcccccaaatgccttaattttgtggactgtttatttcaacaggtggaagtgttggtcgtgcgaaatcttggtattcgcatttcaagaagggagttcttttttctttcttctttctatggaacgtttcaagtgattggatagaaagaagggctctgaagcagttttcacctgctctgagggaacttggggctccagggacgtaccccaaatgttgcccaggttgaaactccctgacagcctgttctacgtagtggctcgtggtttccagtttgaagagagttgtgcccctaaaagtgtttgaaacctgtggctttcaagcaaggtaccgttgtccccacagtgttccgtggggtagggggtgatggagactgtgggcaagcctgttgtttttggccccctgttgttacatgggacctgttttgacggtgggagggtgagatgtgaagatgtgggatgaacctggaatgaacgaattaaataaagacatgcatccatctgtcagcga

SEQ ID NO: 365762 - DNA, 6831 bp, Homo sapiens
  misc_feature (5)..(5): n is a, c, g, or t
  misc_feature (11)..(11): n is a, c, g, or t
  misc_feature (21)..(21): n is a, c, g, or t
  misc_feature (24)..(24): n is a, c, g, or t
  misc_feature (2955)..(2955): n is a, c, g, or t
  misc_feature (3959)..(3959): n is a, c, g, or t
  misc_feature (4319)..(4319): n is a, c, g, or t
taggntaggtngaggctgggngtnaatcggccgaggcggcgccggaagtggtcgcgggtcgttctgcttcctgcccgaggggcgtgcgcgggtcaggggcggccgcggaggcggaagcatccatggcggagggcggcagcccagacgggcgggcagggccgggctccgcaggtcgtaatctgaaggagtggctgagggagcaattttgtgatcatccgctggagcactgtgaggacacgaggctccatgatgcagcttacgtcggggacctccagaccctcaggagcctattgcaagaggagagctaccggagccgcatcaacgagaagtctgtctggtgctgtggctggctcccctgcacaccgttgcgaatcgcggccactgcaggccatgggagctgtgtggacttcctcatccggaagggggccgaggtggatctggtggacgtaaaaggacagacggccctgtatgtggctgtggtgaacgggcacctagagagtacccagatccttctcgaagctggcgcggaccccaacggaagccggcaccatcgcagcacccctgtctaccacgcctctcgcgtgggccgggcagacatcctgaaggccctcatcaggtacggggctgatgttgacgtcaaccaccacctgactcctgatgtccagcctcgattctcccggcggctcacctccttggtggtctgccccttgtacatcagcgcagcctaccacaacctccagtgcttccggctgctcctcctggctggcgcgaaccctgacttcaactgcaatggtcctgtcaacacacagggattctacaggggctcccctgggtgcgtcatggatgctgttctgcgccacggctgtgaggcagccttcgtgagcctgctggtagaatttggagccaacctgaatctagtgaagtgggaatcgctgggcccagagtcgagaggaagaagaaaagtggaccctgaggccttgcaggtctttaaagaggccagaagtgttcccagaaccttgctgtgtctgtgccgtgtggctgtgagaagagctcttggcaaacaccggcttcatctgattccttcgctgcctctgccagaccccataaagaagtttctactccatgagtagactccaagtgctgcggttgattccagtgagggagaaagtgatctgcagggaggtggacaccgagccctgagtgctgtgctgctgctggtctcctgatggctgttgctgcagaagatgtcctcgtagactgtcattgctcctcaggtgcctgggccgctgaacagtccttgggtcattgtcagctgagaggcttatactaaagttattattgtttttcccaagttctctgttctggattttcagttgcatattaatgtaacgggccatggggtatgtacatgtaggggctgaggttggaggcctactaatttccctgtagggaagactcccagcacttctggaactgtgcttctctttatttttctacttctcaatttgatggttcgattaaagccttctagtatctcaatgaaaagggagtttcgtaagcaaaatagaggacagaaatgcagttcatgaacttgctggttggtttttcctgctcctggggtaacacatgcgcttgtcatacacgccccttccttgccccttcagtattctctctttgcgatggaggtctcatagtgagtgtcttcactcaagggtggtttcctggctgcacggcacctgttccaacacctactgtgcctctcatcaggtgtcacgatttttctgccacttcaccttagggagcttccagtgattgattttaggaggcccacaccaaactccccaggaaatgactgccttccttgggaccaaggaccgttccaacagcattcactgccagttctaataggcgaggaaaatgcccgaggcgctgtcttctgtcccccacacgtaccagaaagtgaaaaatgcagcgagtcctctgggtggttatgagcctccaggcgcatgctgtccagtggacagaacatctggcggttggttgattgctctcttttgtcttggtcgctgcttctagaatctatgcaggggatagcagtgaggtcagaagtctttcccgggagagagatggcctgggttatcattgctgatagctttggctgcatgagttgggcttccccttacccagggctgcacagccaggtgtgagggtcaccggcaggtgggctggtggctgcagcctcagagccctcccaggttgctgctgtttccagtgaatcacatttcgtcatttgaagcccatgaggaccattgtgtggatccatggtgattctagacttcagatatatttaggaaggcgcagatttcaaatctgtgtttgattttctgtaataagagaaatccaatttgtaaaacttgaacaatgataccgttttatttacttagtagcatcactgtgtgtcttagcaggcaggcagtgtctggccattattgcgttctacagccagaggatagaattctatacccccaaccccttgtgtcacaaatgggctctgtgtgggtcaccccagctgacccgtgtatgtgcagatgcagttccgaagggaagaacagtcctcgggtgattcagaggggaaaatgcaatccgggaggtgtttcctcagctgaggtgacactgttagaagctgtgatggttgtgtaaatgtgggctgtgtgctgttcccgaggggagcttgggattgggtcctgctgaagccaggagggtcttcccaagataggagaggaaccgcaggtggtgagcggctggggagggccaggacagccggggctgggtgctgcaggggcttcagcccgggagagggggtgggcgtgttctttgtggtaccaaagtgggactaggacaaaaattgggctgtggctggggcaggagctatagggagttaaggaatgatgatanggaagttggagccaccaccgtggactgggccttgtcactggaggtcgtaggcagtggctcatcaccctggtagggctgataggggctttcagggaggctggttagctccctgcactctggctctttactggcttactgtttagctcctcccacctcgaggctcttcttcctgccaccctttgggctcagaggagggtggcttttttcgaggtgagccatgttgtagacacatgatacgctctgcgtctgctctactgagtactttctgcaggggcctgttaaggacgaggcctccccagccctgcccggtgcaggaggtggctcagttattgaaccttttgggaagcagcacctgggaatgctgcctcgtgggagtcccatgcgtgagtgtggtggtgtgaccttcaggctgcacagaggcaaggacccagatgtggcagcatgggcgtcatgctcctttgcacagcccagggcctgttttggagggaccaggtcactgcccctggtctctctaggaggagtggactgaatggatcgttgcagagaagactcacccagacctggccagggaatgatgtatctggggagagaatgagctggaggagggggcctctcatggcccttccctggcctgtggcccagcctggctggcctgcaggtgtctagggtctcagcttttcatttgcagaggacatgttcaacttcctctctgttcaagccagcctttgccaattttttcagaatccaaacaatttggaggtttggtatcttgtttcatagctgccaaatatgaatctgaaaacagggtgggtagctaaggtcattcctcctgggttttagtggcattgccttccttcactaaagctcccttttttttctgttggcaaggacaggttacagaataggaagagtagcactttccgcctaagcactttaggaaatcacctttctaagccctggggcgcccaagtcccatgggacagggaaacgtggtcctcagtgangctgctgcctggctggcccggagtcctccctaggagaggggctcgatgggctgggggaaggagcctgaaggttgcccctggttgcatcccagaagcatctgactgtcaccactgccagtggctgtggaacagtcctgggccctgggccttggctgctgtcaacagatgggctgggctgggctgtggtggggtgggggacaacgttggtaactctgagaattcagctttggagtcccgggtgaggggttttagataaacccatcaatatcacccacattctgtgactctttgcatcactcgtgttatttatttatttatttatattctgccttgttccagaaaagtgtttaaggcaacaangcttgttttttggtgttttcttttgacatttgaaaatttagtacattgttaaaatgtacttgttaaacaggtaattttaaagagaaggaacaattgtttttagtaagttttctttttcctttttcaatgaattgattcttcaaattaaaagttcttgagagaaggagaggaagatacagcagacataggactgagccaaggaagagtctgcctgagagagacgcttggcctgtgctttgctgccatccgtgcggccttggccacatccctattaacagaggcagctccacttcagacagggacaaggcttcctgctgtgcctttctggcagggtttgtggggtcacatgggaagcaatgtgttacgcaagcagtctccatgtgtgtgtaaactgctgtcctggtgacttgtccctcttcttagtggaaatgcatttgagatggtgacagggctggatgaacgtgtgaccctgggagatccgggctggactgtggaccccgatgggccagagtccttgtggcccacagcatagcactggggacagagcgctctatgcaggtgaggcgtatgagaacagcatggtaaataattgatgaagtcacatttgttcaacttaaaggattgttctttattctgaagttattttcttccttatttggatgataaaatttccttttatgtaatgaaggtaaaagtagagggcaatatttttgctttttgaaatgctcttggttgcaaaacaaaatgttggttgctgtttgtcagccccagaatttcttcttaagttcgcctgtctctgaaatcccaaagtcacggaaccgcagtctagctgtggtgcatgtttacgtattggtgagaaattcctcttgggttcttgaacagcctgtacgctggcaggcagcactgcagcatttctgctgctcatggccaagaacgagtctggagatcgctgcgtgcggttttaggaagtgccaacacccgtggtgatgggcctctggccacccctggatccatgggacacactcacaggaagctgatgtggccttctcggtgaggactgcaccttaacctgggcactgggagcctgtggcccccctgtatgttggtgatgacactagtgtgggtcttctggctctggggctacagcttctgcctcctcacctggccgtcggtactcggcaagcaggcctggcctcccggggcctggatccctaccggctgggattggcctcctggaagtacctgtttgggccatgtgacctcctttctcacttatgcctcactcccctcctcccgctccaaacccgaacctctcagtgtggaatgaacgctccaaacccgaacctctcagtgtggaatgaaacagtttagatgtgtacatgatgcacgtgggtgggattcacatcccaggagaattccacggagaggaatgtgcagattttgaagtgtacagtgatgtgtggaataaatactagaaattctcagcagacagtgggatggagaagtgagtgggggcaggagggggatttctgttgccttgacatgtcgttgctcagtgcctggattgcaggcgagtctctcttttttatgttgctttgatttcaagatctcttagatatactaggtagtgtatgaatgtgcataaatccagtttgagaatggtgtttatgaagaagctgtttcgtgtgtacagttgctgctgtaatttagccagcagtgccctgccctgccctgcagtgtctgctcagctcccactgcttctctttgctgttgggcatgtgaggcatgacttggaggggggcctggtgcctggggacctgctgaagagaatgctcaccaccagctctctgtttccctttctgctttggtaatcaacacgtgtttgcctgcagtggccgggaccgtgactgtttctgcccttgtgcctagttaagagccttcaaaagcataatgaacacttttgatatgatattgtaactttagtaaatgctttacttccctctaattgcccccaaatgccttaattttgtggactgtttatttcaacaggtggaagtgttggtcgtgcgaaatcttggtattcgcatttcaagaagggagttcttttttctttcttctttctatggaacgtttcaagtgattggatagaaagaagggctctgaagcagttttcacctgctctgagggaacttggggctccagggacgtaccccaaatgttgcccaggttgaaactccctgacagcctgttctacgtagtggctcgtggtttccagtttgaagagagttgtgcccctaaaagtgtttgaaacctgtggctttcaagcaaggtaccgttgtccccacagtgttccgtggggtagggggtgatggagactgtgggcaagcctgttgtttttggccccctgttgttacatgggacctgttttgacggtgggagggtgagatgtgaagatgtgggatgaacctggaatgaacgaattaaataaagacatgcatccatctgtcagcga

SEQ ID NO: 365763 - DNA, 7974 bp, Homo sapiens
  misc_feature (4098)..(4098): n is a, c, g, or t
  misc_feature (5102)..(5102): n is a, c, g, or t
  misc_feature (5462)..(5462): n is a, c, g, or t
ggttgttcacgaatgcattcatttattcaatgaacttcgcgtcagccactggctgtcatcagttaccgacctgattgagggcttcatggaagggatttggaggagcattcatctaaaaccacagcacgctgcgacgctcagccctgcagtgggccctcaccagtccccgcgcctccgaatccaccctcccggggctgctcgtggctagcggggggcacctgcggggaccaagccagcccggccgaggcccgggtcccgcccgccacggccctcggggccccgcccacatctggcagaagccacgccccgtccgtgtgggtggggacggcccgccggaccgaaattcccagactgctgcctcaggcaacgggctttccgactccttggcttcttatgtgaggaaaccacagcgcggccggcatccagagagtcggttagtcgcgaagttcccgccggacgaagggaccagccagcgccctgctagacagcgaggccggaagcggaggcgtggcccctgcgcggccccggaaaccagtgaggccggcgcgcgcccgccggaagccgcgaccccgacgcgccccccattgccctcggcgccggaagtggtcgcgggtcgttctgcttcctgcccgaggggcgtgcgcgggtcaggggcggccgcggaggcggaagcatccatggcggagggcggcagcccagacgggcgggcagggccgggctccgcaggtaacgtgcgcgcggccactgggccgcggggcgtgtggggatggcgaagggctggctccggcgtccctgccgaggtcctgcgtcctcgtcccgggctggccgggtccacggggcagccagggagccgcaccctgcaggccgggggtggggttcagcgcggctcgcagtgctgggcgaccccaccacggacgcgctgccctctcctcggcctcgagtgcagtccccgcgctagattttctttccggtggaacttgctcgtaacttccttcccgttagccgatacaaatttgatatgacccaaccgcaaaagtaggacgtgggccaccttccagctctgagcgcacggatcagggtcttgctgtgttgcccaggctgatcttgaactcctggcctcaagtgatcctgcctcagcctcctgagtagctgggattacaggcgtgccaccatgcccagcttgtgatttatttcttgagcatttgaaggtgccccgtagctgggagagggaaggctcgctgcagatggcacccccttttggttagtcttggcagggcctccatgagctaacaggagcccctctcttcagtgcaggtcgtaatctgaaggagtggctgagggagcaattttgtgatcatccgctggagcactgtgaggacacgaggctccatgatgcagcttacgtcggggacctccagaccctcaggagcctattgcaagaggagagctaccggagccgcatcaacgagaagtctgtctggtgctgtggctggctcccctgcacaccgttgcgaatcgcggccactgcaggccatgggagctgtgtggacttcctcatccggaagggggccgaggtggatctggtggacgtaaaaggacagacggccctgtatgtggctgtggtgaacgggcacctagagagtacccagatccttctcgaagctggcgcggaccccaacggaagccggcaccatcgcagcacccctgtctaccacgcctctcgcgtgggccgggcagacatcctgaaggccctcatcaggtacggggctgatgttgacgtcaaccaccacctgactcctgatgtccagcctcgattctcccggcggctcacctccttggtggtctgccccttgtacatcagcgcagcctaccacaacctccagtgcttccggctgctcctcctggctggcgcgaaccctgacttcaactgcaatggtcctgtcaacacacagggattctacaggggctcccctgggtgcgtcatggatgctgttctgcgccacggctgtgaggcagccttcgtgagcctgctggtagaatttggagccaacctgaatctagtgaagtgggaatcgctgggcccagagtcgagaggaagaagaaaagtggaccctgaggccttgcaggtctttaaagaggccagaagtgttcccagaaccttgctgtgtctgtgccgtgtggctgtgagaagagctcttggcaaacaccggcttcatctgattccttcgctgcctctgccagaccccataaagaagtttctactccatgagtagactccaagtgctgcggttgattccagtgagggagaaagtgatctgcagggaggtggacaccgagccctgagtgctgtgctgctgctggtctcctgatggctgttgctgcagaagatgtcctcgtagactgtcattgctcctcaggtgcctgggccgctgaacagtccttgggtcattgtcagctgagaggcttatactaaagttattattgtttttcccaagttctctgttctggattttcagttgcatattaatgtaacgggccatggggtatgtacatgtaggggctgaggttggaggcctactaatttccctgtagggaagactcccagcacttctggaactgtgcttctctttatttttctacttctcaatttgatggttcgattaaagccttctagtatctcaatgaaaagggagtttcgtaagcaaaatagaggacagaaatgcagttcatgaacttgctggttggtttttcctgctcctggggtaacacatgcgcttgtcatacacgccccttccttgccccttcagtattctctctttgcgatggaggtctcatagtgagtgtcttcactcaagggtggtttcctggctgcacggcacctgttccaacacctactgtgcctctcatcaggtgtcacgatttttctgccacttcaccttagggagcttccagtgattgattttaggaggcccacaccaaactccccaggaaatgactgccttccttgggaccaaggaccgttccaacagcattcactgccagttctaataggcgaggaaaatgcccgaggcgctgtcttctgtcccccacacgtaccagaaagtgaaaaatgcagcgagtcctctgggtggttatgagcctccaggcgcatgctgtccagtggacagaacatctggcggttggttgattgctctcttttgtcttggtcgctgcttctagaatctatgcaggggatagcagtgaggtcagaagtctttcccgggagagagatggcctgggttatcattgctgatagctttggctgcatgagttgggcttccccttacccagggctgcacagccaggtgtgagggtcaccggcaggtgggctggtggctgcagcctcagagccctcccaggttgctgctgtttccagtgaatcacatttcgtcatttgaagcccatgaggaccattgtgtggatccatggtgattctagacttcagatatatttaggaaggcgcagatttcaaatctgtgtttgattttctgtaataagagaaatccaatttgtaaaacttgaacaatgataccgttttatttacttagtagcatcactgtgtgtcttagcaggcaggcagtgtctggccattattgcgttctacagccagaggatagaattctatacccccaaccccttgtgtcacaaatgggctctgtgtgggtcaccccagctgacccgtgtatgtgcagatgcagttccgaagggaagaacagtcctcgggtgattcagaggggaaaatgcaatccgggaggtgtttcctcagctgaggtgacactgttagaagctgtgatggttgtgtaaatgtgggctgtgtgctgttcccgaggggagcttgggattgggtcctgctgaagccaggagggtcttcccaagataggagaggaaccgcaggtggtgagcggctggggagggccaggacagccggggctgggtgctgcaggggcttcagcccgggagagggggtgggcgtgttctttgtggtaccaaagtgggactaggacaaaaattgggctgtggctggggcaggagctatagggagttaaggaatgatgatanggaagttggagccaccaccgtggactgggccttgtcactggaggtcgtaggcagtggctcatcaccctggtagggctgataggggctttcagggaggctggttagctccctgcactctggctctttactggcttactgtttagctcctcccacctcgaggctcttcttcctgccaccctttgggctcagaggagggtggcttttttcgaggtgagccatgttgtagacacatgatacgctctgcgtctgctctactgagtactttctgcaggggcctgttaaggacgaggcctccccagccctgcccggtgcaggaggtggctcagttattgaaccttttgggaagcagcacctgggaatgctgcctcgtgggagtcccatgcgtgagtgtggtggtgtgaccttcaggctgcacagaggcaaggacccagatgtggcagcatgggcgtcatgctcctttgcacagcccagggcctgttttggagggaccaggtcactgcccctggtctctctaggaggagtggactgaatggatcgttgcagagaagactcacccagacctggccagggaatgatgtatctggggagagaatgagctggaggagggggcctctcatggcccttccctggcctgtggcccagcctggctggcctgcaggtgtctagggtctcagcttttcatttgcagaggacatgttcaacttcctctctgttcaagccagcctttgccaattttttcagaatccaaacaatttggaggtttggtatcttgtttcatagctgccaaatatgaatctgaaaacagggtgggtagctaaggtcattcctcctgggttttagtggcattgccttccttcactaaagctcccttttttttctgttggcaaggacaggttacagaataggaagagtagcactttccgcctaagcactttaggaaatcacctttctaagccctggggcgcccaagtcccatgggacagggaaacgtggtcctcagtgangctgctgcctggctggcccggagtcctccctaggagaggggctcgatgggctgggggaaggagcctgaaggttgcccctggttgcatcccagaagcatctgactgtcaccactgccagtggctgtggaacagtcctgggccctgggccttggctgctgtcaacagatgggctgggctgggctgtggtggggtgggggacaacgttggtaactctgagaattcagctttggagtcccgggtgaggggttttagataaacccatcaatatcacccacattctgtgactctttgcatcactcgtgttatttatttatttatttatattctgccttgttccagaaaagtgtttaaggcaacaangcttgttttttggtgttttcttttgacatttgaaaatttagtacattgttaaaatgtacttgttaaacaggtaattttaaagagaaggaacaattgtttttagtaagttttctttttcctttttcaatgaattgattcttcaaattaaaagttcttgagagaaggagaggaagatacagcagacataggactgagccaaggaagagtctgcctgagagagacgcttggcctgtgctttgctgccatccgtgcggccttggccacatccctattaacagaggcagctccacttcagacagggacaaggcttcctgctgtgcctttctggcagggtttgtggggtcacatgggaagcaatgtgttacgcaagcagtctccatgtgtgtgtaaactgctgtcctggtgacttgtccctcttcttagtggaaatgcatttgagatggtgacagggctggatgaacgtgtgaccctgggagatccgggctggactgtggaccccgatgggccagagtccttgtggcccacagcatagcactggggacagagcgctctatgcaggtgaggcgtatgagaacagcatggtaaataattgatgaagtcacatttgttcaacttaaaggattgttctttattctgaagttattttcttccttatttggatgataaaatttccttttatgtaatgaaggtaaaagtagagggcaatatttttgctttttgaaatgctcttggttgcaaaacaaaatgttggttgctgtttgtcagccccagaatttcttcttaagttcgcctgtctctgaaatcccaaagtcacggaaccgcagtctagctgtggtgcatgtttacgtattggtgagaaattcctcttgggttcttgaacagcctgtacgctggcaggcagcactgcagcatttctgctgctcatggccaagaacgagtctggagatcgctgcgtgcggttttaggaagtgccaacacccgtggtgatgggcctctggccacccctggatccatgggacacactcacaggaagctgatgtggccttctcggtgaggactgcaccttaacctgggcactgggagcctgtggcccccctgtatgttggtgatgacactagtgtgggtcttctggctctggggctacagcttctgcctcctcacctggccgtcggtactcggcaagcaggcctggcctcccggggcctggatccctaccggctgggattggcctcctggaagtacctgtttgggccatgtgacctcctttctcacttatgcctcactcccctcctcccgctccaaacccgaacctctcagtgtggaatgaacgctccaaacccgaacctctcagtgtggaatgaaacagtttagatgtgtacatgatgcacgtgggtgggattcacatcccaggagaattccacggagaggaatgtgcagattttgaagtgtacagtgatgtgtggaataaatactagaaattctcagcagacagtgggatggagaagtgagtgggggcaggagggggatttctgttgccttgacatgtcgttgctcagtgcctggattgcaggcgagtctctcttttttatgttgctttgatttcaagatctcttagatatactaggtagtgtatgaatgtgcataaatccagtttgagaatggtgtttatgaagaagctgtttcgtgtgtacagttgctgctgtaatttagccagcagtgccctgccctgccctgcagtgtctgctcagctcccactgcttctctttgctgttgggcatgtgaggcatgacttggaggggggcctggtgcctggggacctgctgaagagaatgctcaccaccagctctctgtttccctttctgctttggtaatcaacacgtgtttgcctgcagtggccgggaccgtgactgtttctgcccttgtgcctagttaagagccttcaaaagcataatgaacacttttgatatgatattgtaactttagtaaatgctttacttccctctaattgcccccaaatgccttaattttgtggactgtttatttcaacaggtggaagtgttggtcgtgcgaaatcttggtattcgcatttcaagaagggagttcttttttctttcttctttctatggaacgtttcaagtgattggatagaaagaagggctctgaagcagttttcacctgctctgagggaacttggggctccagggacgtaccccaaatgttgcccaggttgaaactccctgacagcctgttctacgtagtggctcgtggtttccagtttgaagagagttgtgcccctaaaagtgtttgaaacctgtggctttcaagcaaggtaccgttgtccccacagtgttccgtggggtagggggtgatggagactgtgggcaagcctgttgtttttggccccctgttgttacatgggacctgttttgacggtgggagggtgagatgtgaagatgtgggatgaacctggaatgaacgaattaaataaagacatgcatccatctgtcagcga

SEQ ID NO: 365764 - DNA, 7868 bp, Homo sapiens
  misc_feature (3992)..(3992): n is a, c, g, or t
  misc_feature (4996)..(4996): n is a, c, g, or t
  misc_feature (5356)..(5356): n is a, c, g, or t
ggttgttcacgaatgcattcatttattcaatgaacttcgcgtcagccactggctgtcatcagttaccgacctgattgagggcttcatggaagggatttggaggagcattcatctaaaaccacagcacgctgcgacgctcagccctgcagtgggccctcaccagtccccgcgcctccgaatccaccctcccggggctgctcgtggctagcggggggcacctgcggggaccaagccagcccggccgaggcccgggtcccgcccgccacggccctcggggccccgcccacatctggcagaagccacgccccgtccgtgtgggtggggacggcccgccggaccgaaattcccagactgctgcctcaggcaacgggctttccgactccttggcttcttatgtgaggaaaccacagcgcggccggcatccagagagtcggttagtcgcgaagttcccgccggacgaagggaccagccagcgccctgctagacagcgaggccggaagcggaggcgtggcccctgcgcggccccggaaaccagtgaggccggcgcgcgcccgccggaagccgcgaccccgacgcgccccccattgccctcggcgccggaagtggtcgcgggtcgttctgcttcctgcccgaggggcgtgcgcgggtcaggggcggccgcggaggcggaagcatccatggcggagggcggcagcccagacgggcgggcagggccgggctccgcaggtaacgtgcgcgcggccactgggccgcggggcgtgtggggatggcgaagggctggctccggcgtccctgccgaggtcctgcgtcctcgtcccgggctggccgggtccacggggcagccagggagccgcaccctgcaggccgggggtggggttcagcgcggctcgcagtgctgggcgaccccaccacggacgcgctgccctctcctcggcctcgagtgcagtccccgcgctagattttctttccggtggaacttgctcgtaacttccttcccgttagccgatacaaatttgatatgacccaaccgcaaaagtaggacgtgggccaccttccagctctgagcgcacggatcagggtcttgctgtgttgcccaggctgatcttgaactcctggcctcaagtgatcctgcctcagcctcctgagtagctgggattacaggcgtgccaccatgcccagcttgtgatttatttcttgagcatttgaaggtcgtaatctgaaggagtggctgagggagcaattttgtgatcatccgctggagcactgtgaggacacgaggctccatgatgcagcttacgtcggggacctccagaccctcaggagcctattgcaagaggagagctaccggagccgcatcaacgagaagtctgtctggtgctgtggctggctcccctgcacaccgttgcgaatcgcggccactgcaggccatgggagctgtgtggacttcctcatccggaagggggccgaggtggatctggtggacgtaaaaggacagacggccctgtatgtggctgtggtgaacgggcacctagagagtacccagatccttctcgaagctggcgcggaccccaacggaagccggcaccatcgcagcacccctgtctaccacgcctctcgcgtgggccgggcagacatcctgaaggccctcatcaggtacggggctgatgttgacgtcaaccaccacctgactcctgatgtccagcctcgattctcccggcggctcacctccttggtggtctgccccttgtacatcagcgcagcctaccacaacctccagtgcttccggctgctcctcctggctggcgcgaaccctgacttcaactgcaatggtcctgtcaacacacagggattctacaggggctcccctgggtgcgtcatggatgctgttctgcgccacggctgtgaggcagccttcgtgagcctgctggtagaatttggagccaacctgaatctagtgaagtgggaatcgctgggcccagagtcgagaggaagaagaaaagtggaccctgaggccttgcaggtctttaaagaggccagaagtgttcccagaaccttgctgtgtctgtgccgtgtggctgtgagaagagctcttggcaaacaccggcttcatctgattccttcgctgcctctgccagaccccataaagaagtttctactccatgagtagactccaagtgctgcggttgattccagtgagggagaaagtgatctgcagggaggtggacaccgagccctgagtgctgtgctgctgctggtctcctgatggctgttgctgcagaagatgtcctcgtagactgtcattgctcctcaggtgcctgggccgctgaacagtccttgggtcattgtcagctgagaggcttatactaaagttattattgtttttcccaagttctctgttctggattttcagttgcatattaatgtaacgggccatggggtatgtacatgtaggggctgaggttggaggcctactaatttccctgtagggaagactcccagcacttctggaactgtgcttctctttatttttctacttctcaatttgatggttcgattaaagccttctagtatctcaatgaaaagggagtttcgtaagcaaaatagaggacagaaatgcagttcatgaacttgctggttggtttttcctgctcctggggtaacacatgcgcttgtcatacacgccccttccttgccccttcagtattctctctttgcgatggaggtctcatagtgagtgtcttcactcaagggtggtttcctggctgcacggcacctgttccaacacctactgtgcctctcatcaggtgtcacgatttttctgccacttcaccttagggagcttccagtgattgattttaggaggcccacaccaaactccccaggaaatgactgccttccttgggaccaaggaccgttccaacagcattcactgccagttctaataggcgaggaaaatgcccgaggcgctgtcttctgtcccccacacgtaccagaaagtgaaaaatgcagcgagtcctctgggtggttatgagcctccaggcgcatgctgtccagtggacagaacatctggcggttggttgattgctctcttttgtcttggtcgctgcttctagaatctatgcaggggatagcagtgaggtcagaagtctttcccgggagagagatggcctgggttatcattgctgatagctttggctgcatgagttgggcttccccttacccagggctgcacagccaggtgtgagggtcaccggcaggtgggctggtggctgcagcctcagagccctcccaggttgctgctgtttccagtgaatcacatttcgtcatttgaagcccatgaggaccattgtgtggatccatggtgattctagacttcagatatatttaggaaggcgcagatttcaaatctgtgtttgattttctgtaataagagaaatccaatttgtaaaacttgaacaatgataccgttttatttacttagtagcatcactgtgtgtcttagcaggcaggcagtgtctggccattattgcgttctacagccagaggatagaattctatacccccaaccccttgtgtcacaaatgggctctgtgtgggtcaccccagctgacccgtgtatgtgcagatgcagttccgaagggaagaacagtcctcgggtgattcagaggggaaaatgcaatccgggaggtgtttcctcagctgaggtgacactgttagaagctgtgatggttgtgtaaatgtgggctgtgtgctgttcccgaggggagcttgggattgggtcctgctgaagccaggagggtcttcccaagataggagaggaaccgcaggtggtgagcggctggggagggccaggacagccggggctgggtgctgcaggggcttcagcccgggagagggggtgggcgtgttctttgtggtaccaaagtgggactaggacaaaaattgggctgtggctggggcaggagctatagggagttaaggaatgatgatanggaagttggagccaccaccgtggactgggccttgtcactggaggtcgtaggcagtggctcatcaccctggtagggctgataggggctttcagggaggctggttagctccctgcactctggctctttactggcttactgtttagctcctcccacctcgaggctcttcttcctgccaccctttgggctcagaggagggtggcttttttcgaggtgagccatgttgtagacacatgatacgctctgcgtctgctctactgagtactttctgcaggggcctgttaaggacgaggcctccccagccctgcccggtgcaggaggtggctcagttattgaaccttttgggaagcagcacctgggaatgctgcctcgtgggagtcccatgcgtgagtgtggtggtgtgaccttcaggctgcacagaggcaaggacccagatgtggcagcatgggcgtcatgctcctttgcacagcccagggcctgttttggagggaccaggtcactgcccctggtctctctaggaggagtggactgaatggatcgttgcagagaagactcacccagacctggccagggaatgatgtatctggggagagaatgagctggaggagggggcctctcatggcccttccctggcctgtggcccagcctggctggcctgcaggtgtctagggtctcagcttttcatttgcagaggacatgttcaacttcctctctgttcaagccagcctttgccaattttttcagaatccaaacaatttggaggtttggtatcttgtttcatagctgccaaatatgaatctgaaaacagggtgggtagctaaggtcattcctcctgggttttagtggcattgccttccttcactaaagctcccttttttttctgttggcaaggacaggttacagaataggaagagtagcactttccgcctaagcactttaggaaatcacctttctaagccctggggcgcccaagtcccatgggacagggaaacgtggtcctcagtgangctgctgcctggctggcccggagtcctccctaggagaggggctcgatgggctgggggaaggagcctgaaggttgcccctggttgcatcccagaagcatctgactgtcaccactgccagtggctgtggaacagtcctgggccctgggccttggctgctgtcaacagatgggctgggctgggctgtggtggggtgggggacaacgttggtaactctgagaattcagctttggagtcccgggtgaggggttttagataaacccatcaatatcacccacattctgtgactctttgcatcactcgtgttatttatttatttatttatattctgccttgttccagaaaagtgtttaaggcaacaangcttgttttttggtgttttcttttgacatttgaaaatttagtacattgttaaaatgtacttgttaaacaggtaattttaaagagaaggaacaattgtttttagtaagttttctttttcctttttcaatgaattgattcttcaaattaaaagttcttgagagaaggagaggaagatacagcagacataggactgagccaaggaagagtctgcctgagagagacgcttggcctgtgctttgctgccatccgtgcggccttggccacatccctattaacagaggcagctccacttcagacagggacaaggcttcctgctgtgcctttctggcagggtttgtggggtcacatgggaagcaatgtgttacgcaagcagtctccatgtgtgtgtaaactgctgtcctggtgacttgtccctcttcttagtggaaatgcatttgagatggtgacagggctggatgaacgtgtgaccctgggagatccgggctggactgtggaccccgatgggccagagtccttgtggcccacagcatagcactggggacagagcgctctatgcaggtgaggcgtatgagaacagcatggtaaataattgatgaagtcacatttgttcaacttaaaggattgttctttattctgaagttattttcttccttatttggatgataaaatttccttttatgtaatgaaggtaaaagtagagggcaatatttttgctttttgaaatgctcttggttgcaaaacaaaatgttggttgctgtttgtcagccccagaatttcttcttaagttcgcctgtctctgaaatcccaaagtcacggaaccgcagtctagctgtggtgcatgtttacgtattggtgagaaattcctcttgggttcttgaacagcctgtacgctggcaggcagcactgcagcatttctgctgctcatggccaagaacgagtctggagatcgctgcgtgcggttttaggaagtgccaacacccgtggtgatgggcctctggccacccctggatccatgggacacactcacaggaagctgatgtggccttctcggtgaggactgcaccttaacctgggcactgggagcctgtggcccccctgtatgttggtgatgacactagtgtgggtcttctggctctggggctacagcttctgcctcctcacctggccgtcggtactcggcaagcaggcctggcctcccggggcctggatccctaccggctgggattggcctcctggaagtacctgtttgggccatgtgacctcctttctcacttatgcctcactcccctcctcccgctccaaacccgaacctctcagtgtggaatgaacgctccaaacccgaacctctcagtgtggaatgaaacagtttagatgtgtacatgatgcacgtgggtgggattcacatcccaggagaattccacggagaggaatgtgcagattttgaagtgtacagtgatgtgtggaataaatactagaaattctcagcagacagtgggatggagaagtgagtgggggcaggagggggatttctgttgccttgacatgtcgttgctcagtgcctggattgcaggcgagtctctcttttttatgttgctttgatttcaagatctcttagatatactaggtagtgtatgaatgtgcataaatccagtttgagaatggtgtttatgaagaagctgtttcgtgtgtacagttgctgctgtaatttagccagcagtgccctgccctgccctgcagtgtctgctcagctcccactgcttctctttgctgttgggcatgtgaggcatgacttggaggggggcctggtgcctggggacctgctgaagagaatgctcaccaccagctctctgtttccctttctgctttggtaatcaacacgtgtttgcctgcagtggccgggaccgtgactgtttctgcccttgtgcctagttaagagccttcaaaagcataatgaacacttttgatatgatattgtaactttagtaaatgctttacttccctctaattgcccccaaatgccttaattttgtggactgtttatttcaacaggtggaagtgttggtcgtgcgaaatcttggtattcgcatttcaagaagggagttcttttttctttcttctttctatggaacgtttcaagtgattggatagaaagaagggctctgaagcagttttcacctgctctgagggaacttggggctccagggacgtaccccaaatgttgcccaggttgaaactccctgacagcctgttctacgtagtggctcgtggtttccagtttgaagagagttgtgcccctaaaagtgtttgaaacctgtggctttcaagcaaggtaccgttgtccccacagtgttccgtggggtagggggtgatggagactgtgggcaagcctgttgtttttggccccctgttgttacatgggacctgttttgacggtgggagggtgagatgtgaagatgtgggatgaacctggaatgaacgaattaaataaagacatgcatccatctgtcagcga

SEQ ID NO: 365765 - DNA, 7420 bp, Homo sapiens
  misc_feature (3510)..(3510): n is a, c, g, or t
  misc_feature (4514)..(4514): n is a, c, g, or t
  misc_feature (4874)..(4874): n is a, c, g, or t
ggttgttcacgaatgcattcatttattcaatgaacttcgcgtcagccactggctgtcatcagttaccgacctgattgagggcttcatggaagggatttggaggagcattcatctaaaaccacagcacgctgcgacgctcagccctgcagtgggccctcaccagtccccgcgcctccgaatccaccctcccggggctgctcgtggctagcggggggcacctgcggggaccaagccagcccggccgaggcccgggtcccgcccgccacggccctcggggccccgcccacatctggcagaagccacgccccgtccgtgtgggtggggacggcccgccggaccgaaattcccagactgctgcctcaggcaacgggctttccgactccttggcttcttatgtgaggaaaccacagcgcggccggcatccagagagtcggttagtcgcgaagttcccgccggacgaagggaccagccagcgccctgctagacagcgaggccggaagcggaggcgtggcccctgcgcggccccggaaaccagtgaggccggcgcgcgcccgccggaagccgcgaccccgacgcgccccccattgccctcggcgccggaagtggtcgcgggtcgttctgcttcctgcccgaggggcgtgcgcgggtcaggggcggccgcggaggcggaagcatccatggcggagggcggcagcccagacgggcgggcagggccgggctccgcaggtcgtaatctgaaggagtggctgagggagcaattttgtgatcatccgctggagcactgtgaggacacgaggctccatgatgcagcttacgtcggggacctccagaccctcaggagcctattgcaagaggagagctaccggagccgcatcaacgagaagtctgtctggtgctgtggctggctcccctgcacaccgttgcgaatcgcggccactgcaggccatgggagctgtgtggacttcctcatccggaagggggccgaggtggatctggtggacgtaaaaggacagacggccctgtatgtggctgtggtgaacgggcacctagagagtacccagatccttctcgaagctggcgcggaccccaacggaagccggcaccatcgcagcacccctgtctaccacgcctctcgcgtgggccgggcagacatcctgaaggccctcatcaggtacggggctgatgttgacgtcaaccaccacctgactcctgatgtccagcctcgattctcccggcggctcacctccttggtggtctgccccttgtacatcagcgcagcctaccacaacctccagtgcttccggctgctcctcctggctggcgcgaaccctgacttcaactgcaatggtcctgtcaacacacagggattctacaggggctcccctgggtgcgtcatggatgctgttctgcgccacggctgtgaggcagccttcgtgagcctgctggtagaatttggagccaacctgaatctagtgaagtgggaatcgctgggcccagagtcgagaggaagaagaaaagtggaccctgaggccttgcaggtctttaaagaggccagaagtgttcccagaaccttgctgtgtctgtgccgtgtggctgtgagaagagctcttggcaaacaccggcttcatctgattccttcgctgcctctgccagaccccataaagaagtttctactccatgagtagactccaagtgctgcggttgattccagtgagggagaaagtgatctgcagggaggtggacaccgagccctgagtgctgtgctgctgctggtctcctgatggctgttgctgcagaagatgtcctcgtagactgtcattgctcctcaggtgcctgggccgctgaacagtccttgggtcattgtcagctgagaggcttatactaaagttattattgtttttcccaagttctctgttctggattttcagttgcatattaatgtaacgggccatggggtatgtacatgtaggggctgaggttggaggcctactaatttccctgtagggaagactcccagcacttctggaactgtgcttctctttatttttctacttctcaatttgatggttcgattaaagccttctagtatctcaatgaaaagggagtttcgtaagcaaaatagaggacagaaatgcagttcatgaacttgctggttggtttttcctgctcctggggtaacacatgcgcttgtcatacacgccccttccttgccccttcagtattctctctttgcgatggaggtctcatagtgagtgtcttcactcaagggtggtttcctggctgcacggcacctgttccaacacctactgtgcctctcatcaggtgtcacgatttttctgccacttcaccttagggagcttccagtgattgattttaggaggcccacaccaaactccccaggaaatgactgccttccttgggaccaaggaccgttccaacagcattcactgccagttctaataggcgaggaaaatgcccgaggcgctgtcttctgtcccccacacgtaccagaaagtgaaaaatgcagcgagtcctctgggtggttatgagcctccaggcgcatgctgtccagtggacagaacatctggcggttggttgattgctctcttttgtcttggtcgctgcttctagaatctatgcaggggatagcagtgaggtcagaagtctttcccgggagagagatggcctgggttatcattgctgatagctttggctgcatgagttgggcttccccttacccagggctgcacagccaggtgtgagggtcaccggcaggtgggctggtggctgcagcctcagagccctcccaggttgctgctgtttccagtgaatcacatttcgtcatttgaagcccatgaggaccattgtgtggatccatggtgattctagacttcagatatatttaggaaggcgcagatttcaaatctgtgtttgattttctgtaataagagaaatccaatttgtaaaacttgaacaatgataccgttttatttacttagtagcatcactgtgtgtcttagcaggcaggcagtgtctggccattattgcgttctacagccagaggatagaattctatacccccaaccccttgtgtcacaaatgggctctgtgtgggtcaccccagctgacccgtgtatgtgcagatgcagttccgaagggaagaacagtcctcgggtgattcagaggggaaaatgcaatccgggaggtgtttcctcagctgaggtgacactgttagaagctgtgatggttgtgtaaatgtgggctgtgtgctgttcccgaggggagcttgggattgggtcctgctgaagccaggagggtcttcccaagataggagaggaaccgcaggtggtgagcggctggggagggccaggacagccggggctgggtgctgcaggggcttcagcccgggagagggggtgggcgtgttctttgtggtaccaaagtgggactaggacaaaaattgggctgtggctggggcaggagctatagggagttaaggaatgatgatanggaagttggagccaccaccgtggactgggccttgtcactggaggtcgtaggcagtggctcatcaccctggtagggctgataggggctttcagggaggctggttagctccctgcactctggctctttactggcttactgtttagctcctcccacctcgaggctcttcttcctgccaccctttgggctcagaggagggtggcttttttcgaggtgagccatgttgtagacacatgatacgctctgcgtctgctctactgagtactttctgcaggggcctgttaaggacgaggcctccccagccctgcccggtgcaggaggtggctcagttattgaaccttttgggaagcagcacctgggaatgctgcctcgtgggagtcccatgcgtgagtgtggtggtgtgaccttcaggctgcacagaggcaaggacccagatgtggcagcatgggcgtcatgctcctttgcacagcccagggcctgttttggagggaccaggtcactgcccctggtctctctaggaggagtggactgaatggatcgttgcagagaagactcacccagacctggccagggaatgatgtatctggggagagaatgagctggaggagggggcctctcatggcccttccctggcctgtggcccagcctggctggcctgcaggtgtctagggtctcagcttttcatttgcagaggacatgttcaacttcctctctgttcaagccagcctttgccaattttttcagaatccaaacaatttggaggtttggtatcttgtttcatagctgccaaatatgaatctgaaaacagggtgggtagctaaggtcattcctcctgggttttagtggcattgccttccttcactaaagctcccttttttttctgttggcaaggacaggttacagaataggaagagtagcactttccgcctaagcactttaggaaatcacctttctaagccctggggcgcccaagtcccatgggacagggaaacgtggtcctcagtgangctgctgcctggctggcccggagtcctccctaggagaggggctcgatgggctgggggaaggagcctgaaggttgcccctggttgcatcccagaagcatctgactgtcaccactgccagtggctgtggaacagtcctgggccctgggccttggctgctgtcaacagatgggctgggctgggctgtggtggggtgggggacaacgttggtaactctgagaattcagctttggagtcccgggtgaggggttttagataaacccatcaatatcacccacattctgtgactctttgcatcactcgtgttatttatttatttatttatattctgccttgttccagaaaagtgtttaaggcaacaangcttgttttttggtgttttcttttgacatttgaaaatttagtacattgttaaaatgtacttgttaaacaggtaattttaaagagaaggaacaattgtttttagtaagttttctttttcctttttcaatgaattgattcttcaaattaaaagttcttgagagaaggagaggaagatacagcagacataggactgagccaaggaagagtctgcctgagagagacgcttggcctgtgctttgctgccatccgtgcggccttggccacatccctattaacagaggcagctccacttcagacagggacaaggcttcctgctgtgcctttctggcagggtttgtggggtcacatgggaagcaatgtgttacgcaagcagtctccatgtgtgtgtaaactgctgtcctggtgacttgtccctcttcttagtggaaatgcatttgagatggtgacagggctggatgaacgtgtgaccctgggagatccgggctggactgtggaccccgatgggccagagtccttgtggcccacagcatagcactggggacagagcgctctatgcaggtgaggcgtatgagaacagcatggtaaataattgatgaagtcacatttgttcaacttaaaggattgttctttattctgaagttattttcttccttatttggatgataaaatttccttttatgtaatgaaggtaaaagtagagggcaatatttttgctttttgaaatgctcttggttgcaaaacaaaatgttggttgctgtttgtcagccccagaatttcttcttaagttcgcctgtctctgaaatcccaaagtcacggaaccgcagtctagctgtggtgcatgtttacgtattggtgagaaattcctcttgggttcttgaacagcctgtacgctggcaggcagcactgcagcatttctgctgctcatggccaagaacgagtctggagatcgctgcgtgcggttttaggaagtgccaacacccgtggtgatgggcctctggccacccctggatccatgggacacactcacaggaagctgatgtggccttctcggtgaggactgcaccttaacctgggcactgggagcctgtggcccccctgtatgttggtgatgacactagtgtgggtcttctggctctggggctacagcttctgcctcctcacctggccgtcggtactcggcaagcaggcctggcctcccggggcctggatccctaccggctgggattggcctcctggaagtacctgtttgggccatgtgacctcctttctcacttatgcctcactcccctcctcccgctccaaacccgaacctctcagtgtggaatgaacgctccaaacccgaacctctcagtgtggaatgaacgctccaaacccgaacctctcagtgtggaatgaaacagtttagatgtgtacatgatgcacgtgggtgggattcacatcccaggagaattccacggagaggaatgtgcagattttgaagtgtacagtgatgtgtggaataaatactagaaattctcagcagacagtgggatggagaagtgagtgggggcaggagggggatttctgttgccttgacatgtcgttgctcagtgcctggattgcaggcgagtctctcttttttatgttgctttgatttcaagatctcttagatatactaggtagtgtatgaatgtgcataaatccagtttgagaatggtgtttatgaagaagctgtttcgtgtgtacagttgctgctgtaatttagccagcagtgccctgccctgccctgcagtgtctgctcagctcccactgcttctctttgctgttgggcatgtgaggcatgacttggaggggggcctggtgcctggggacctgctgaagagaatgctcaccaccagctctctgtttccctttctgctttggtaatcaacacgtgtttgcctgcagtggccgggaccgtgactgtttctgcccttgtgcctagttaagagccttcaaaagcataatgaacacttttgatatgatattgtaactttagtaaatgctttacttccctctaattgcccccaaatgccttaattttgtggactgtttatttcaacaggtggaagtgttggtcgtgcgaaatcttggtattcgcatttcaagaagggagttcttttttctttcttctttctatggaacgtttcaagtgattggatagaaagaagggctctgaagcagttttcacctgctctgagggaacttggggctccagggacgtaccccaaatgttgcccaggttgaaactccctgacagcctgttctacgtagtggctcgtggtttccagtttgaagagagttgtgcccctaaaagtgtttgaaacctgtggctttcaagcaaggtaccgttgtccccacagtgttccgtggggtagggggtgatggagactgtgggcaagcctgttgtttttggccccctgttgttacatgggacctgttttgacggtgggagggtgagatgtgaagatgtgggatgaacctggaatgaacgaattaaataaagacatgcatccatctgtcagcga

SEQ ID NO: 365766 - DNA, 7083 bp, Homo sapiens
  misc_feature (3207)..(3207): n is a, c, g, or t
  misc_feature (4211)..(4211): n is a, c, g, or t
  misc_feature (4571)..(4571): n is a, c, g, or t
ggttgttcacgaatgcattcatttattcaatgaacttcgcgtcagccactggctgtcatcagttaccgacctgattgagggcttcatggaagggatttggaggagcattcatctaaaaccacagcacgctgcgacgctcagccctgcagtgggccctcaccagtccccgcgcctccgaatccaccctcccggggctgctcgtggctagcggggggcacctgcggggaccaagccagcccggccgaggcccgggtcccgcccgccacggccctcggggccccgcccacatctggcagaagccacgccccgtccgtgtgggtggggacggcccgccggaccgaaattcccagactgctgcctcaggcaacgggctttccgactccttggcttcttatgtgaggaaaccacagcgcggccggcatccagagagtcggttagtcgcgaagttcccgccggacgaagggaccagccagcgccctgctagacagcgaggccggaagcggaggcgtggcccctgcgcggccccggaaaccagtgaggccggcgcgcgcccgccggaagccgcgaccccgacgcgccccccattgccctcggcgccggaagtggtcgcgggtcgttctgcttcctgcccgaggggcgtgcgcgggtcaggggcggccgcggaggcggaagcatccatggcggagggcggcagcccagacgggcgggcagggccgggctccgcaggtcgtaatctgaaggagtggctgagggagcaattttgtgatcatccgctggagcactgtgaggacacgaggctccatgatgcagcttacgtcggggacctccagaccctcaggagcctattgcaagaggagagctaccggaggtacggggctgatgttgacgtcaaccaccacctgactcctgatgtccagcctcgattctcccggcggctcacctccttggtggtctgccccttgtacatcagcgcagcctaccacaacctccagtgcttccggctgctcctcctggctggcgcgaaccctgacttcaactgcaatggtcctgtcaacacacagggattctacaggggctcccctgggtgcgtcatggatgctgttctgcgccacggctgtgaggcagccttcgtgagcctgctggtagaatttggagccaacctgaatctagtgaagtgggaatcgctgggcccagagtcgagaggaagaagaaaagtggaccctgaggccttgcaggtctttaaagaggccagaagtgttcccagaaccttgctgtgtctgtgccgtgtggctgtgagaagagctcttggcaaacaccggcttcatctgattccttcgctgcctctgccagaccccataaagaagtttctactccatgagtagactccaagtgctgcggttgattccagtgagggagaaagtgatctgcagggaggtggacaccgagccctgagtgctgtgctgctgctggtctcctgatggctgttgctgcagaagatgtcctcgtagactgtcattgctcctcaggtgcctgggccgctgaacagtccttgggtcattgtcagctgagaggcttatactaaagttattattgtttttcccaagttctctgttctggattttcagttgcatattaatgtaacgggccatggggtatgtacatgtaggggctgaggttggaggcctactaatttccctgtagggaagactcccagcacttctggaactgtgcttctctttatttttctacttctcaatttgatggttcgattaaagccttctagtatctcaatgaaaagggagtttcgtaagcaaaatagaggacagaaatgcagttcatgaacttgctggttggtttttcctgctcctggggtaacacatgcgcttgtcatacacgccccttccttgccccttcagtattctctctttgcgatggaggtctcatagtgagtgtcttcactcaagggtggtttcctggctgcacggcacctgttccaacacctactgtgcctctcatcaggtgtcacgatttttctgccacttcaccttagggagcttccagtgattgattttaggaggcccacaccaaactccccaggaaatgactgccttccttgggaccaaggaccgttccaacagcattcactgccagttctaataggcgaggaaaatgcccgaggcgctgtcttctgtcccccacacgtaccagaaagtgaaaaatgcagcgagtcctctgggtggttatgagcctccaggcgcatgctgtccagtggacagaacatctggcggttggttgattgctctcttttgtcttggtcgctgcttctagaatctatgcaggggatagcagtgaggtcagaagtctttcccgggagagagatggcctgggttatcattgctgatagctttggctgcatgagttgggcttccccttacccagggctgcacagccaggtgtgagggtcaccggcaggtgggctggtggctgcagcctcagagccctcccaggttgctgctgtttccagtgaatcacatttcgtcatttgaagcccatgaggaccattgtgtggatccatggtgattctagacttcagatatatttaggaaggcgcagatttcaaatctgtgtttgattttctgtaataagagaaatccaatttgtaaaacttgaacaatgataccgttttatttacttagtagcatcactgtgtgtcttagcaggcaggcagtgtctggccattattgcgttctacagccagaggatagaattctatacccccaaccccttgtgtcacaaatgggctctgtgtgggtcaccccagctgacccgtgtatgtgcagatgcagttccgaagggaagaacagtcctcgggtgattcagaggggaaaatgcaatccgggaggtgtttcctcagctgaggtgacactgttagaagctgtgatggttgtgtaaatgtgggctgtgtgctgttcccgaggggagcttgggattgggtcctgctgaagccaggagggtcttcccaagataggagaggaaccgcaggtggtgagcggctggggagggccaggacagccggggctgggtgctgcaggggcttcagcccgggagagggggtgggcgtgttctttgtggtaccaaagtgggactaggacaaaaattgggctgtggctggggcaggagctatagggagttaaggaatgatgatanggaagttggagccaccaccgtggactgggccttgtcactggaggtcgtaggcagtggctcatcaccctggtagggctgataggggctttcagggaggctggttagctccctgcactctggctctttactggcttactgtttagctcctcccacctcgaggctcttcttcctgccaccctttgggctcagaggagggtggcttttttcgaggtgagccatgttgtagacacatgatacgctctgcgtctgctctactgagtactttctgcaggggcctgttaaggacgaggcctccccagccctgcccggtgcaggaggtggctcagttattgaaccttttgggaagcagcacctgggaatgctgcctcgtgggagtcccatgcgtgagtgtggtggtgtgaccttcaggctgcacagaggcaaggacccagatgtggcagcatgggcgtcatgctcctttgcacagcccagggcctgttttggagggaccaggtcactgcccctggtctctctaggaggagtggactgaatggatcgttgcagagaagactcacccagacctggccagggaatgatgtatctggggagagaatgagctggaggagggggcctctcatggcccttccctggcctgtggcccagcctggctggcctgcaggtgtctagggtctcagcttttcatttgcagaggacatgttcaacttcctctctgttcaagccagcctttgccaattttttcagaatccaaacaatttggaggtttggtatcttgtttcatagctgccaaatatgaatctgaaaacagggtgggtagctaaggtcattcctcctgggttttagtggcattgccttccttcactaaagctcccttttttttctgttggcaaggacaggttacagaataggaagagtagcactttccgcctaagcactttaggaaatcacctttctaagccctggggcgcccaagtcccatgggacagggaaacgtggtcctcagtgangctgctgcctggctggcccggagtcctccctaggagaggggctcgatgggctgggggaaggagcctgaaggttgcccctggttgcatcccagaagcatctgactgtcaccactgccagtggctgtggaacagtcctgggccctgggccttggctgctgtcaacagatgggctgggctgggctgtggtggggtgggggacaacgttggtaactctgagaattcagctttggagtcccgggtgaggggttttagataaacccatcaatatcacccacattctgtgactctttgcatcactcgtgttatttatttatttatttatattctgccttgttccagaaaagtgtttaaggcaacaangcttgttttttggtgttttcttttgacatttgaaaatttagtacattgttaaaatgtacttgttaaacaggtaattttaaagagaaggaacaattgtttttagtaagttttctttttcctttttcaatgaattgattcttcaaattaaaagttcttgagagaaggagaggaagatacagcagacataggactgagccaaggaagagtctgcctgagagagacgcttggcctgtgctttgctgccatccgtgcggccttggccacatccctattaacagaggcagctccacttcagacagggacaaggcttcctgctgtgcctttctggcagggtttgtggggtcacatgggaagcaatgtgttacgcaagcagtctccatgtgtgtgtaaactgctgtcctggtgacttgtccctcttcttagtggaaatgcatttgagatggtgacagggctggatgaacgtgtgaccctgggagatccgggctggactgtggaccccgatgggccagagtccttgtggcccacagcatagcactggggacagagcgctctatgcaggtgaggcgtatgagaacagcatggtaaataattgatgaagtcacatttgttcaacttaaaggattgttctttattctgaagttattttcttccttatttggatgataaaatttccttttatgtaatgaaggtaaaagtagagggcaatatttttgctttttgaaatgctcttggttgcaaaacaaaatgttggttgctgtttgtcagccccagaatttcttcttaagttcgcctgtctctgaaatcccaaagtcacggaaccgcagtctagctgtggtgcatgtttacgtattggtgagaaattcctcttgggttcttgaacagcctgtacgctggcaggcagcactgcagcatttctgctgctcatggccaagaacgagtctggagatcgctgcgtgcggttttaggaagtgccaacacccgtggtgatgggcctctggccacccctggatccatgggacacactcacaggaagctgatgtggccttctcggtgaggactgcaccttaacctgggcactgggagcctgtggcccccctgtatgttggtgatgacactagtgtgggtcttctggctctggggctacagcttctgcctcctcacctggccgtcggtactcggcaagcaggcctggcctcccggggcctggatccctaccggctgggattggcctcctggaagtacctgtttgggccatgtgacctcctttctcacttatgcctcactcccctcctcccgctccaaacccgaacctctcagtgtggaatgaacgctccaaacccgaacctctcagtgtggaatgaaacagtttagatgtgtacatgatgcacgtgggtgggattcacatcccaggagaattccacggagaggaatgtgcagattttgaagtgtacagtgatgtgtggaataaatactagaaattctcagcagacagtgggatggagaagtgagtgggggcaggagggggatttctgttgccttgacatgtcgttgctcagtgcctggattgcaggcgagtctctcttttttatgttgctttgatttcaagatctcttagatatactaggtagtgtatgaatgtgcataaatccagtttgagaatggtgtttatgaagaagctgtttcgtgtgtacagttgctgctgtaatttagccagcagtgccctgccctgccctgcagtgtctgctcagctcccactgcttctctttgctgttgggcatgtgaggcatgacttggaggggggcctggtgcctggggacctgctgaagagaatgctcaccaccagctctctgtttccctttctgctttggtaatcaacacgtgtttgcctgcagtggccgggaccgtgactgtttctgcccttgtgcctagttaagagccttcaaaagcataatgaacacttttgatatgatattgtaactttagtaaatgctttacttccctctaattgcccccaaatgccttaattttgtggactgtttatttcaacaggtggaagtgttggtcgtgcgaaatcttggtattcgcatttcaagaagggagttcttttttctttcttctttctatggaacgtttcaagtgattggatagaaagaagggctctgaagcagttttcacctgctctgagggaacttggggctccagggacgtaccccaaatgttgcccaggttgaaactccctgacagcctgttctacgtagtggctcgtggtttccagtttgaagagagttgtgcccctaaaagtgtttgaaacctgtggctttcaagcaaggtaccgttgtccccacagtgttccgtggggtagggggtgatggagactgtgggcaagcctgttgtttttggccccctgttgttacatgggacctgttttgacggtgggagggtgagatgtgaagatgtgggatgaacctggaatgaacgaattaaataaagacatgcatccatctgtcagcga

SEQ ID NO: 365767 - DNA, 7236 bp, Homo sapiens
  misc_feature (3360)..(3360): n is a, c, g, or t
  misc_feature (4364)..(4364): n is a, c, g, or t
  misc_feature (4724)..(4724): n is a, c, g, or t
ggttgttcacgaatgcattcatttattcaatgaacttcgcgtcagccactggctgtcatcagttaccgacctgattgagggcttcatggaagggatttggaggagcattcatctaaaaccacagcacgctgcgacgctcagccctgcagtgggccctcaccagtccccgcgcctccgaatccaccctcccggggctgctcgtggctagcggggggcacctgcggggaccaagccagcccggccgaggcccgggtcccgcccgccacggccctcggggccccgcccacatctggcagaagccacgccccgtccgtgtgggtggggacggcccgccggaccgaaattcccagactgctgcctcaggcaacgggctttccgactccttggcttcttatgtgaggaaaccacagcgcggccggcatccagagagtcggttagtcgcgaagttcccgccggacgaagggaccagccagcgccctgctagacagcgaggccggaagcggaggcgtggcccctgcgcggccccggaaaccagtgaggccggcgcgcgcccgccggaagccgcgaccccgacgcgccccccattgccctcggcgccggaagtggtcgcgggtcgttctgcttcctgcccgaggggcgtgcgcgggtcaggggcggccgcggaggcggaagcatccatggcggagggcggcagcccagacgggcgggcagggccgggctccgcaggtcgtaatctgaaggagtggctgagggagcaattttgtgatcatccgctggagcactgtgaggacacgaggctccatgatgcagcttacgtcggggacctccagaccctcaggagcctattgcaagaggagagctaccggagccgcatcaacgagaagtctgtctggtgctgtggctggctcccctgcacaccgttgcgaatcgcggccactgcaggccatgggagctgtgtggacttcctcatccggaagggggccgaggtggatctggtggacgtaaaaggacagacggccctgtacggggctgatgttgacgtcaaccaccacctgactcctgatgtccagcctcgattctcccggcggctcacctccttggtggtctgccccttgtacatcagcgcagcctaccacaacctccagtgcttccggctgctcctcctggctggcgcgaaccctgacttcaactgcaatggtcctgtcaacacacagggattctacaggggctcccctgggtgcgtcatggatgctgttctgcgccacggctgtgaggcagccttcgtgagcctgctggtagaatttggagccaacctgaatctagtgaagtgggaatcgctgggcccagagtcgagaggaagaagaaaagtggaccctgaggccttgcaggtctttaaagaggccagaagtgttcccagaaccttgctgtgtctgtgccgtgtggctgtgagaagagctcttggcaaacaccggcttcatctgattccttcgctgcctctgccagaccccataaagaagtttctactccatgagtagactccaagtgctgcggttgattccagtgagggagaaagtgatctgcagggaggtggacaccgagccctgagtgctgtgctgctgctggtctcctgatggctgttgctgcagaagatgtcctcgtagactgtcattgctcctcaggtgcctgggccgctgaacagtccttgggtcattgtcagctgagaggcttatactaaagttattattgtttttcccaagttctctgttctggattttcagttgcatattaatgtaacgggccatggggtatgtacatgtaggggctgaggttggaggcctactaatttccctgtagggaagactcccagcacttctggaactgtgcttctctttatttttctacttctcaatttgatggttcgattaaagccttctagtatctcaatgaaaagggagtttcgtaagcaaaatagaggacagaaatgcagttcatgaacttgctggttggtttttcctgctcctggggtaacacatgcgcttgtcatacacgccccttccttgccccttcagtattctctctttgcgatggaggtctcatagtgagtgtcttcactcaagggtggtttcctggctgcacggcacctgttccaacacctactgtgcctctcatcaggtgtcacgatttttctgccacttcaccttagggagcttccagtgattgattttaggaggcccacaccaaactccccaggaaatgactgccttccttgggaccaaggaccgttccaacagcattcactgccagttctaataggcgaggaaaatgcccgaggcgctgtcttctgtcccccacacgtaccagaaagtgaaaaatgcagcgagtcctctgggtggttatgagcctccaggcgcatgctgtccagtggacagaacatctggcggttggttgattgctctcttttgtcttggtcgctgcttctagaatctatgcaggggatagcagtgaggtcagaagtctttcccgggagagagatggcctgggttatcattgctgatagctttggctgcatgagttgggcttccccttacccagggctgcacagccaggtgtgagggtcaccggcaggtgggctggtggctgcagcctcagagccctcccaggttgctgctgtttccagtgaatcacatttcgtcatttgaagcccatgaggaccattgtgtggatccatggtgattctagacttcagatatatttaggaaggcgcagatttcaaatctgtgtttgattttctgtaataagagaaatccaatttgtaaaacttgaacaatgataccgttttatttacttagtagcatcactgtgtgtcttagcaggcaggcagtgtctggccattattgcgttctacagccagaggatagaattctatacccccaaccccttgtgtcacaaatgggctctgtgtgggtcaccccagctgacccgtgtatgtgcagatgcagttccgaagggaagaacagtcctcgggtgattcagaggggaaaatgcaatccgggaggtgtttcctcagctgaggtgacactgttagaagctgtgatggttgtgtaaatgtgggctgtgtgctgttcccgaggggagcttgggattgggtcctgctgaagccaggagggtcttcccaagataggagaggaaccgcaggtggtgagcggctggggagggccaggacagccggggctgggtgctgcaggggcttcagcccgggagagggggtgggcgtgttctttgtggtaccaaagtgggactaggacaaaaattgggctgtggctggggcaggagctatagggagttaaggaatgatgatanggaagttggagccaccaccgtggactgggccttgtcactggaggtcgtaggcagtggctcatcaccctggtagggctgataggggctttcagggaggctggttagctccctgcactctggctctttactggcttactgtttagctcctcccacctcgaggctcttcttcctgccaccctttgggctcagaggagggtggcttttttcgaggtgagccatgttgtagacacatgatacgctctgcgtctgctctactgagtactttctgcaggggcctgttaaggacgaggcctccccagccctgcccggtgcaggaggtggctcagttattgaaccttttgggaagcagcacctgggaatgctgcctcgtgggagtcccatgcgtgagtgtggtggtgtgaccttcaggctgcacagaggcaaggacccagatgtggcagcatgggcgtcatgctcctttgcacagcccagggcctgttttggagggaccaggtcactgcccctggtctctctaggaggagtggactgaatggatcgttgcagagaagactcacccagacctggccagggaatgatgtatctggggagagaatgagctggaggagggggcctctcatggcccttccctggcctgtggcccagcctggctggcctgcaggtgtctagggtctcagcttttcatttgcagaggacatgttcaacttcctctctgttcaagccagcctttgccaattttttcagaatccaaacaatttggaggtttggtatcttgtttcatagctgccaaatatgaatctgaaaacagggtgggtagctaaggtcattcctcctgggttttagtggcattgccttccttcactaaagctcccttttttttctgttggcaaggacaggttacagaataggaagagtagcactttccgcctaagcactttaggaaatcacctttctaagccctggggcgcccaagtcccatgggacagggaaacgtggtcctcagtgangctgctgcctggctggcccggagtcctccctaggagaggggctcgatgggctgggggaaggagcctgaaggttgcccctggttgcatcccagaagcatctgactgtcaccactgccagtggctgtggaacagtcctgggccctgggccttggctgctgtcaacagatgggctgggctgggctgtggtggggtgggggacaacgttggtaactctgagaattcagctttggagtcccgggtgaggggttttagataaacccatcaatatcacccacattctgtgactctttgcatcactcgtgttatttatttatttatttatattctgccttgttccagaaaagtgtttaaggcaacaangcttgttttttggtgttttcttttgacatttgaaaatttagtacattgttaaaatgtacttgttaaacaggtaattttaaagagaaggaacaattgtttttagtaagttttctttttcctttttcaatgaattgattcttcaaattaaaagttcttgagagaaggagaggaagatacagcagacataggactgagccaaggaagagtctgcctgagagagacgcttggcctgtgctttgctgccatccgtgcggccttggccacatccctattaacagaggcagctccacttcagacagggacaaggcttcctgctgtgcctttctggcagggtttgtggggtcacatgggaagcaatgtgttacgcaagcagtctccatgtgtgtgtaaactgctgtcctggtgacttgtccctcttcttagtggaaatgcatttgagatggtgacagggctggatgaacgtgtgaccctgggagatccgggctggactgtggaccccgatgggccagagtccttgtggcccacagcatagcactggggacagagcgctctatgcaggtgaggcgtatgagaacagcatggtaaataattgatgaagtcacatttgttcaacttaaaggattgttctttattctgaagttattttcttccttatttggatgataaaatttccttttatgtaatgaaggtaaaagtagagggcaatatttttgctttttgaaatgctcttggttgcaaaacaaaatgttggttgctgtttgtcagccccagaatttcttcttaagttcgcctgtctctgaaatcccaaagtcacggaaccgcagtctagctgtggtgcatgtttacgtattggtgagaaattcctcttgggttcttgaacagcctgtacgctggcaggcagcactgcagcatttctgctgctcatggccaagaacgagtctggagatcgctgcgtgcggttttaggaagtgccaacacccgtggtgatgggcctctggccacccctggatccatgggacacactcacaggaagctgatgtggccttctcggtgaggactgcaccttaacctgggcactgggagcctgtggcccccctgtatgttggtgatgacactagtgtgggtcttctggctctggggctacagcttctgcctcctcacctggccgtcggtactcggcaagcaggcctggcctcccggggcctggatccctaccggctgggattggcctcctggaagtacctgtttgggccatgtgacctcctttctcacttatgcctcactcccctcctcccgctccaaacccgaacctctcagtgtggaatgaacgctccaaacccgaacctctcagtgtggaatgaaacagtttagatgtgtacatgatgcacgtgggtgggattcacatcccaggagaattccacggagaggaatgtgcagattttgaagtgtacagtgatgtgtggaataaatactagaaattctcagcagacagtgggatggagaagtgagtgggggcaggagggggatttctgttgccttgacatgtcgttgctcagtgcctggattgcaggcgagtctctcttttttatgttgctttgatttcaagatctcttagatatactaggtagtgtatgaatgtgcataaatccagtttgagaatggtgtttatgaagaagctgtttcgtgtgtacagttgctgctgtaatttagccagcagtgccctgccctgccctgcagtgtctgctcagctcccactgcttctctttgctgttgggcatgtgaggcatgacttggaggggggcctggtgcctggggacctgctgaagagaatgctcaccaccagctctctgtttccctttctgctttggtaatcaacacgtgtttgcctgcagtggccgggaccgtgactgtttctgcccttgtgcctagttaagagccttcaaaagcataatgaacacttttgatatgatattgtaactttagtaaatgctttacttccctctaattgcccccaaatgccttaattttgtggactgtttatttcaacaggtggaagtgttggtcgtgcgaaatcttggtattcgcatttcaagaagggagttcttttttctttcttctttctatggaacgtttcaagtgattggatagaaagaagggctctgaagcagttttcacctgctctgagggaacttggggctccagggacgtaccccaaatgttgcccaggttgaaactccctgacagcctgttctacgtagtggctcgtggtttccagtttgaagagagttgtgcccctaaaagtgtttgaaacctgtggctttcaagcaaggtaccgttgtccccacagtgttccgtggggtagggggtgatggagactgtgggcaagcctgttgtttttggccccctgttgttacatgggacctgttttgacggtgggagggtgagatgtgaagatgtgggatgaacctggaatgaacgaattaaataaagacatgcatccatctgtcagcga

SEQ ID NO: 365768 - DNA, 2464 bp, Homo sapiens
  misc_feature (5)..(5): n is a, c, g, or t
  misc_feature (11)..(11): n is a, c, g, or t
  misc_feature (21)..(21): n is a, c, g, or t
  misc_feature (24)..(24): n is a, c, g, or t
taggntaggtngaggctgggngtnaatcggccgaggaaggaacaattgtttttagtaagttttctttttcctttttcaatgaattgattcttcaaattaaaagttcttgagagaaggagaggaagatacagcagacataggactgagccaaggaagagtctgcctgagagagacgcttggcctgtgctttgctgccatccgtgcggccttggccacatccctattaacagaggcagctccacttcagacagggacaaggcttcctgctgtgcctttctggcagggtttgtggggtcacatgggaagcaatgtgttacgcaagcagtctccatgtgtgtgtaaactgctgtcctggtgacttgtccctcttcttagtggaaatgcatttgagatggtgacagggctggatgaacgtgtgaccctgggagatccgggctggactgtggaccccgatgggccagagtccttgtggcccacagcatagcactggggacagagcgctctatgcaggtgaggcgtatgagaacagcatggtaaataattgatgaagtcacatttgttcaacttaaaggattgttctttattctgaagttattttcttccttatttggatgataaaatttccttttatgtaatgaaggtaaaagtagagggcaatatttttgctttttgaaatgctcttggttgcaaaacaaaatgttggttgctgtttgtcagccccagaatttcttcttaagttcgcctgtctctgaaatcccaaagtcacggaaccgcagtctagctgtggtgcatgtttacgtattggtgagaaattcctcttgggttcttgaacagcctgtacgctggcaggcagcactgcagcatttctgctgctcatggccaagaacgagtctggagatcgctgcgtgcggttttaggaagtgccaacacccgtggtgatgggcctctggccacccctggatccatgggacacactcacaggaagctgatgtggccttctcggtgaggactgcaccttaacctgggcactgggagcctgtggcccccctgtatgttggtgatgacactagtgtgggtcttctggctctggggctacagcttctgcctcctcacctggccgtcggtactcggcaagcaggcctggcctcccggggcctggatccctaccggctgggattggcctcctggaagtacctgtttgggccatgtgacctcctttctcacttatgcctcactcccctcctcccgctccaaacccgaacctctcagtgtggaatgaacgctccaaacccgaacctctcagtgtggaatgaaacagtttagatgtgtacatgatgcacgtgggtgggattcacatcccaggagaattccacggagaggaatgtgcagattttgaagtgtacagtgatgtgtggaataaatactagaaattctcagcagacagtgggatggagaagtgagtgggggcaggagggggatttctgttgccttgacatgtcgttgctcagtgcctggattgcaggcgagtctctcttttttatgttgctttgatttcaagatctcttagatatactaggtagtgtatgaatgtgcataaatccagtttgagaatggtgtttatgaagaagctgtttcgtgtgtacagttgctgctgtaatttagccagcagtgccctgccctgccctgcagtgtctgctcagctcccactgcttctctttgctgttgggcatgtgaggcatgacttggaggggggcctggtgcctggggacctgctgaagagaatgctcaccaccagctctctgtttccctttctgctttggtaatcaacacgtgtttgcctgcagtggccgggaccgtgactgtttctgcccttgtgcctagttaagagccttcaaaagcataatgaacacttttgatatgatattgtaactttagtaaatgctttacttccctctaattgcccccaaatgccttaattttgtggactgtttatttcaacaggtggaagtgttggtcgtgcgaaatcttggtattcgcatttcaagaagggagttcttttttctttcttctttctatggaacgtttcaagtgattggatagaaagaagggctctgaagcagttttcacctgctctgagggaacttggggctccagggacgtaccccaaatgttgcccaggttgaaactccctgacagcctgttctacgtagtggctcgtggtttccagtttgaagagagttgtgcccctaaaagtgtttgaaacctgtggctttcaagcaaggtaccgttgtccccacagtgttccgtggggtagggggtgatggagactgtgggcaagcctgttgtttttggccccctgttgttacatgggacctgttttgacggtgggagggtgagatgtgaagatgtgggatgaacctggaatgaacgaattaaataaagacatgcatccatctgtcagcga

SEQ ID NO: 365769 - DNA, 1475 bp, Homo sapiens
ctccggtaccgccgaatgacaaactagtgtcatcaccaacatacaggggggcacaggctcccagtgcccaggttaaggtgcagtcctcacctggccgtcggtactcggcaagcaggcctggcctcccggggcctggatccctaccggctgggattggcctcctggaagtacctgtttgggccatgtgacctcctttctcacttatgcctcactcccctcctcccgctccaaacccgaacctctcagtgtggaatgaacgctccaaacccgaacctctcagtgtggaatgaacgctccaaacccgaacctctcagtgtggaatgaaacagtttagatgtgtacatgatgcacgtgggtgggattcacatcccaggagaattccacggagaggaatgtgcagattttgaagtgtacagtgatgtgtggaataaatactagaaattctcagcagacagtgggatggagaagtgagtgggggcaggagggggatttctgttgccttgacatgtcgttgctcagtgcctggattgcaggcgagtctctcttttttatgttgctttgatttcaagatctcttagatatactaggtagtgtatgaatgtgcataaatccagtttgagaatggtgtttatgaagaagctgtttcgtgtgtacagttgctgctgtaatttagccagcagtgccctgccctgccctgcagtgtctgctcagctcccactgcttctctttgctgttgggcatgtgaggcatgacttggaggggggcctggtgcctggggacctgctgaagagaatgctcaccaccagctctctgtttccctttctgctttggtaatcaacacgtgtttgcctgcagtggccgggaccgtgactgtttctgcccttgtgcctagttaagagccttcaaaagcataatgaacacttttgatatgatattgtaactttagtaaatgctttacttccctctaattgcccccaaatgccttaattttgtggactgtttatttcaacaggtggaagtgttggtcgtgcgaaatcttggtattcgcatttcaagaagggagttcttttttctttcttctttctatggaacgtttcaagtgattggatagaaagaagggctctgaagcagttttcacctgctctgagggaacttggggctccagggacgtaccccaaatgttgcccaggttgaaactccctgacagcctgttctacgtagtggctcgtggtttccagtttgaagagagttgtgcccctaaaagtgtttgaaacctgtggctttcaagcaaggtaccgttgtccccacagtgttccgtggggtagggggtgatggagactgtgggcaagcctgttgtttttggccccctgttgttacatgggacctgttttgacggtgggagggtgagatgtgaagatgtgggatgaacctggaatgaacgaattaaataaagacatgcatccatctgtcagcga

SEQ ID NO: 365770 - DNA, 559 bp, Homo sapiens
tgaaccttcctctatccctctctttcttcccacggccttcaggtgttcccagaaccttgctgtgtctgtgccgtgtggctgtgagaagagctcttggcaaacaccggcttcatctgattccttcgctgcctctgccagaccccataaagaagtttctactccatgagtagactccaagtgctgcggttgattccagtgagggagaaagtgatctgcagggaggtggacaccgagccctgagtgctgtgctgctgctggtctcctgatggctgttgctgcagaagatgtcctcgtagactgtcattgctcctcaggtgcctgggccgctgaacagtccttgggtcattgtcagctgagaggcttatactaaagttattattgtttttcccaagttctctgttctggattttcagttgcatattaatgtaacgggccatggggtatgtacatgtaggggctgaggttggaggcctactaatttccctgtagggaagactcccagcacttctggaactgtgcttctctttatttttctacttctcaatttgatggttcgatt

SEQ ID NO: 365771 - DNA, 6180 bp, Homo sapiens
  misc_feature (3510)..(3510): n is a, c, g, or t
  misc_feature (4514)..(4514): n is a, c, g, or t
  misc_feature (4874)..(4874): n is a, c, g, or t
ggttgttcacgaatgcattcatttattcaatgaacttcgcgtcagccactggctgtcatcagttaccgacctgattgagggcttcatggaagggatttggaggagcattcatctaaaaccacagcacgctgcgacgctcagccctgcagtgggccctcaccagtccccgcgcctccgaatccaccctcccggggctgctcgtggctagcggggggcacctgcggggaccaagccagcccggccgaggcccgggtcccgcccgccacggccctcggggccccgcccacatctggcagaagccacgccccgtccgtgtgggtggggacggcccgccggaccgaaattcccagactgctgcctcaggcaacgggctttccgactccttggcttcttatgtgaggaaaccacagcgcggccggcatccagagagtcggttagtcgcgaagttcccgccggacgaagggaccagccagcgccctgctagacagcgaggccggaagcggaggcgtggcccctgcgcggccccggaaaccagtgaggccggcgcgcgcccgccggaagccgcgaccccgacgcgccccccattgccctcggcgccggaagtggtcgcgggtcgttctgcttcctgcccgaggggcgtgcgcgggtcaggggcggccgcggaggcggaagcatccatggcggagggcggcagcccagacgggcgggcagggccgggctccgcaggtcgtaatctgaaggagtggctgagggagcaattttgtgatcatccgctggagcactgtgaggacacgaggctccatgatgcagcttacgtcggggacctccagaccctcaggagcctattgcaagaggagagctaccggagccgcatcaacgagaagtctgtctggtgctgtggctggctcccctgcacaccgttgcgaatcgcggccactgcaggccatgggagctgtgtggacttcctcatccggaagggggccgaggtggatctggtggacgtaaaaggacagacggccctgtatgtggctgtggtgaacgggcacctagagagtacccagatccttctcgaagctggcgcggaccccaacggaagccggcaccatcgcagcacccctgtctaccacgcctctcgcgtgggccgggcagacatcctgaaggccctcatcaggtacggggctgatgttgacgtcaaccaccacctgactcctgatgtccagcctcgattctcccggcggctcacctccttggtggtctgccccttgtacatcagcgcagcctaccacaacctccagtgcttccggctgctcctcctggctggcgcgaaccctgacttcaactgcaatggtcctgtcaacacacagggattctacaggggctcccctgggtgcgtcatggatgctgttctgcgccacggctgtgaggcagccttcgtgagcctgctggtagaatttggagccaacctgaatctagtgaagtgggaatcgctgggcccagagtcgagaggaagaagaaaagtggaccctgaggccttgcaggtctttaaagaggccagaagtgttcccagaaccttgctgtgtctgtgccgtgtggctgtgagaagagctcttggcaaacaccggcttcatctgattccttcgctgcctctgccagaccccataaagaagtttctactccatgagtagactccaagtgctgcggttgattccagtgagggagaaagtgatctgcagggaggtggacaccgagccctgagtgctgtgctgctgctggtctcctgatggctgttgctgcagaagatgtcctcgtagactgtcattgctcctcaggtgcctgggccgctgaacagtccttgggtcattgtcagctgagaggcttatactaaagttattattgtttttcccaagttctctgttctggattttcagttgcatattaatgtaacgggccatggggtatgtacatgtaggggctgaggttggaggcctactaatttccctgtagggaagactcccagcacttctggaactgtgcttctctttatttttctacttctcaatttgatggttcgattaaagccttctagtatctcaatgaaaagggagtttcgtaagcaaaatagaggacagaaatgcagttcatgaacttgctggttggtttttcctgctcctggggtaacacatgcgcttgtcatacacgccccttccttgccccttcagtattctctctttgcgatggaggtctcatagtgagtgtcttcactcaagggtggtttcctggctgcacggcacctgttccaacacctactgtgcctctcatcaggtgtcacgatttttctgccacttcaccttagggagcttccagtgattgattttaggaggcccacaccaaactccccaggaaatgactgccttccttgggaccaaggaccgttccaacagcattcactgccagttctaataggcgaggaaaatgcccgaggcgctgtcttctgtcccccacacgtaccagaaagtgaaaaatgcagcgagtcctctgggtggttatgagcctccaggcgcatgctgtccagtggacagaacatctggcggttggttgattgctctcttttgtcttggtcgctgcttctagaatctatgcaggggatagcagtgaggtcagaagtctttcccgggagagagatggcctgggttatcattgctgatagctttggctgcatgagttgggcttccccttacccagggctgcacagccaggtgtgagggtcaccggcaggtgggctggtggctgcagcctcagagccctcccaggttgctgctgtttccagtgaatcacatttcgtcatttgaagcccatgaggaccattgtgtggatccatggtgattctagacttcagatatatttaggaaggcgcagatttcaaatctgtgtttgattttctgtaataagagaaatccaatttgtaaaacttgaacaatgataccgttttatttacttagtagcatcactgtgtgtcttagcaggcaggcagtgtctggccattattgcgttctacagccagaggatagaattctatacccccaaccccttgtgtcacaaatgggctctgtgtgggtcaccccagctgacccgtgtatgtgcagatgcagttccgaagggaagaacagtcctcgggtgattcagaggggaaaatgcaatccgggaggtgtttcctcagctgaggtgacactgttagaagctgtgatggttgtgtaaatgtgggctgtgtgctgttcccgaggggagcttgggattgggtcctgctgaagccaggagggtcttcccaagataggagaggaaccgcaggtggtgagcggctggggagggccaggacagccggggctgggtgctgcaggggcttcagcccgggagagggggtgggcgtgttctttgtggtaccaaagtgggactaggacaaaaattgggctgtggctggggcaggagctatagggagttaaggaatgatgatanggaagttggagccaccaccgtggactgggccttgtcactggaggtcgtaggcagtggctcatcaccctggtagggctgataggggctttcagggaggctggttagctccctgcactctggctctttactggcttactgtttagctcctcccacctcgaggctcttcttcctgccaccctttgggctcagaggagggtggcttttttcgaggtgagccatgttgtagacacatgatacgctctgcgtctgctctactgagtactttctgcaggggcctgttaaggacgaggcctccccagccctgcccggtgcaggaggtggctcagttattgaaccttttgggaagcagcacctgggaatgctgcctcgtgggagtcccatgcgtgagtgtggtggtgtgaccttcaggctgcacagaggcaaggacccagatgtggcagcatgggcgtcatgctcctttgcacagcccagggcctgttttggagggaccaggtcactgcccctggtctctctaggaggagtggactgaatggatcgttgcagagaagactcacccagacctggccagggaatgatgtatctggggagagaatgagctggaggagggggcctctcatggcccttccctggcctgtggcccagcctggctggcctgcaggtgtctagggtctcagcttttcatttgcagaggacatgttcaacttcctctctgttcaagccagcctttgccaattttttcagaatccaaacaatttggaggtttggtatcttgtttcatagctgccaaatatgaatctgaaaacagggtgggtagctaaggtcattcctcctgggttttagtggcattgccttccttcactaaagctcccttttttttctgttggcaaggacaggttacagaataggaagagtagcactttccgcctaagcactttaggaaatcacctttctaagccctggggcgcccaagtcccatgggacagggaaacgtggtcctcagtgangctgctgcctggctggcccggagtcctccctaggagaggggctcgatgggctgggggaaggagcctgaaggttgcccctggttgcatcccagaagcatctgactgtcaccactgccagtggctgtggaacagtcctgggccctgggccttggctgctgtcaacagatgggctgggctgggctgtggtggggtgggggacaacgttggtaactctgagaattcagctttggagtcccgggtgaggggttttagataaacccatcaatatcacccacattctgtgactctttgcatcactcgtgttatttatttatttatttatattctgccttgttccagaaaagtgtttaaggcaacaangcttgttttttggtgttttcttttgacatttgaaaatttagtacattgttaaaatgtacttgttaaacaggtaattttaaagagaaggaacaattgtttttagtaagttttctttttcctttttcaatgaattgattcttcaaattaaaagttcttgagagaaggagaggaagatacagcagacataggactgagccaaggaagagtctgcctgagagagacgcttggcctgtgctttgctgccatccgtgcggccttggccacatccctattaacagaggcagctccacttcagacagggacaaggcttcctgctgtgcctttctggcagggtttgtggggtcacatgggaagcaatgtgttacgcaagcagtctccatgtgtgtgtaaactgctgtcctggtgacttgtccctcttcttagtggaaatgcatttgagatggtgacagggctggatgaacgtgtgaccctgggagatccgggctggactgtggaccccgatgggccagagtccttgtggcccacagcatagcactggggacagagcgctctatgcaggtgaggcgtatgagaacagcatggtaaataattgatgaagtcacatttgttcaacttaaaggattgttctttattctgaagttattttcttccttatttggatgataaaatttccttttatgtaatgaaggtaaaagtagagggcaatatttttgctttttgaaatgctcttggttgcaaaacaaaatgttggttgctgtttgtcagccccagaatttcttcttaagttcgcctgtctctgaaatcccaaagtcacggaaccgcagtctagctgtggtgcatgtttacgtattggtgagaaattcctcttgggttcttgaacagcctgtacgctggcaggcagcactgcagcatttctgctgctcatggccaagaacgagtctggagatcgctgcgtgcggttttaggaagtgccaacacccgtggtgatgggcctctggccacccctggatccatgggacacactcacaggaagctgatgtggccttctcggtgaggactgcaccttaacctgggcactgggagcctgtggcccccctgtatgttggtgatgacactagtgtgggtcttctggctctggggctacagcttctgcctcctcacctggccgtcggtactcggcaagcaggcctggcctcccggggcctggatccctaccggctgggattggcctcctggaagtccgagaaacaactatgcgtgattaccactcactacagacactctacgattttggccactgtgccga

SEQ ID NO: 365772 - DNA, 1817 bp, Homo sapiens
ggatcacagcaaaacatcaattatggatgacaaaagtcttaagacagccataaagacacagttgacaaatgtggctatttctgtggcttacaacaatttaacataatcattacaacatatattaagacatatcagaattttagaactctcatacaatcctggaacacatattaacaacaaatctctatcagtataacccaaaggaagctaaacaccacctcacacttgacaatgtttcctgtataattcaaacattacaaataagcctaatataagcctaatatgtcactcttgaacttcaggaagcctaatatccaaaaagttagtttaaggtcaaaagtttttgaattaacttttttccattagtatggtcatatctttcttactaatttgtaagttatgtaatttatcaatttttttttgttgttctgtttcccaacctctatgtcagataaagaatcacccaggccagacacaatggctcatgcttgtgatcccaacactttgggaagccaaggtgggagaattgcttgaagccaggaatctgagcccagcctgggcgacaaagcaatacccctatctctacaaaaaataaaaaatagccaggtgtagcgacacacacctgtagtcccagctgctcaggaggctgagcaggaggatggcttgggcccaggagttcaacgctgcagtgagctatgattgcaccactgcactccagcctgggcaacagagtaagaactgtctcaaaaaaaataaaaaatagaaataaattttaaaaaaagaattacccatattctctttgttttgtttattcacattaacctttattctatctggaatttatttgagtatacttttttctcaaataatcaattgtcctagaaccatgtgtttctcatttatttgaaaggccatctagtgagagatttctccaaatgttggggtagggaagggaggggaagcactttaaagtctgagcctttagaggtgattcctcaagaccctgcttaatcctaacaattttcctcattagtaaaagtcagcccaaactgggggcttgttaagatccttaccagccacatccatctgaaattatgaatttcaaagtatcttacaaatttggtgccacattatcttttttaagtttgttttgttttgtttttttgggacagagtctcgctctgtcacccaggctggagtgcagtggcgcgatctcagctcactgcaagctccgcctcctgggttcacaccattctcttgcctcagcctcccaagtatctgggactacagtcgcccgccaccacgcccggctaatttttttgtatttttaatagagacggggtttcactttgttagccaggatggtctcaatctcctgacctcatgatccacctgcctcggcctcccaaagtgctgggattacaggcaggagccaccgcgcctgggcctttttttaagttttaagtacctataaagaacactgaaaggtgatgtgtgtggatgagctaggaagacctgaaataggctctctctaaattaatcaaattaatcctgaagccattctgcaatactgtctttaatgtatactcacttgttatagaagccagggttttttcccctaatttgtatcattgctatatgtgttattgtaccaaactacactgttttaattgctgtaaattttaatatgtcttagtatctgggtgtgggaatcttgaaagcatggagtttgtgttattcaccactgtattctcaaatatcagaagagtatctggcctactaagtgcacaataaacatagttaaaatgaaaaaaaaa

SEQ ID NO: 365773 - DNA, 483 bp, Homo sapiens
aaaagaagaagaaaagtacttctacagccatgtcctattccttgatcatccaaagcacctgcctcggcctcccaaagtgctgggattacaggcaggagccaccgcgcctgggcctttttttaagttttaagtacctataaagaacactgaaaggtgatgtgtgtggatgagctaggaagacctgaaataggctctctctaaattaatcaaattaatcctgaagccattctgcaatactgtctttaatgtatactcacttgttatagaagccagggttttttcccctaatttgtatcattgctatatgtgttattgtaccaaactacactgttttaattgctgtaaattttaatatgtcttagtatctgggtgtgggaatcttgaaagcatggagtttgtgttattcaccactgtattctcaaatatcagaagagtatctggcctactaagtgcacaataaacatagttaaaatgaaaaaaaaa

SEQ ID NO: 365774 - DNA, 496 bp, Homo sapiens
ccacttccaccaaagacaaatcacagcagaaccgacctaacttcaaaataaactgcagtcccatatactgggcctgattacccacacaaatgctgggattacaggcaggagccaccgcgcctgggcctttttttaagttttaagtacctataaagaacactgaaaggtgatgtgtgtggatgagctaggaagacctgaaataggctctctctaaattaatcaaattaatcctgaagccattctgcaatactgtctttaatgtatactcacttgttatagaagccagggttttttcccctaatttgtatcattgctatatgtgttattgtaccaaactacactgttttaattgctgtaaattttaatatgtcttagtatctgggtgtgggaatcttgaaagcatggagtttgtgttattcaccactgtattctcaaatatcagaagagtatctggcctactaagtgcacaataaacatagttaaaatgaaaaaaaaa

SEQ ID NO: 365775 - DNA, 793 bp, Homo sapiens
ggatcacagcaaaacatcaattatggatgacaaaagtcttaagacagccataaagacacagttgacaaatgtggctatttctgtggcttacaacaatttaacataatcattacaacatatattaagacatatcagaattttagaactctcatacaatcctggaacacatattaacaacaaatctctatcagtataacccaaaggaagctaaacaccacctcacacttgacaatgtttcctgtataattcaaacattacaaataagcctaatataagcctaatatgtcactcttgaacttcaggaagcctaatatccaaaaagttagtttaaggtcaaaagtttttgaattaacttttttccattagtatggtcatatctttcttactaatttgtaagttatgtaatttatcaatttttttttgttgttctgtttcccaacctctatgtcagataaagaatcacccaggccagacacaatggctcatgcttgtgatcccaacactttgggaagccaaggtgggagaattgcttgaagccaggaatctgagcccagcctgggcgacaaagcaatacccctatctctacaaaaaataaaaaatagccaggtgtagcgacacacacctgtagtcccagctgctcaggaggctgagcaggaggatggcttgggcccaggagttcaacgctgcagtgagctatgattgcaccactgcactccagcctgggcaacagagtaagaactgtctcaaaaaaaaagtcgacgcggccgcgaatttagtagtagtaggcggccgc

SEQ ID NO: 365776 - DNA, 617 bp, Homo sapiens
ggatcacagcaaaacatcaattatggatgacaaaagtcttaagacagccataaagacacagttgacaaatgtggctatttctgtggcttacaacaatttaacataatcattacaacatatattaagacatatcagaattttagaactctcatacaatcctggaacacatattaacaacaaatctctatcagtataacccaaaggaagctaaacaccacctcacacttgacaatgtttcctgtataattcaaacattacaaataagcctaatataagcctaatatgtcactcttgaacttcaggaagcctaatatccaaaaagttagtttaaggtcaaaagtttttgaattaacttttttccattagtatggtcatatctttcttactaatttgtaagttatgtaatttatcaatttttttttgttgttctgtttcccaacctctatgtcagataaagaatcacccaggccagacacaatggctcatgcttgtgatcccaacactttgggaagccaaggtgggagaattgcttgaagccaggaatctgagcccagcctgggcgacaaagcaataccccagtcgacgcggccgcgaatttagtagtagtaggcggccgc

SEQ ID NO: 365777 - DNA, 562 bp, Homo sapiens
ggatcacagcaaaacatcaattatggatgacaaaagtcttaagacagccataaagacacagttgacaaatgtggctatttctgtggcttacaacaatttaacataatcattacaacatatattaagacatatcagaattttagaactctcatacaatcctggaacacatattaacaacaaatctctatcagtataacccaaaggaagctaaacaccacctcacacttgacaatgtttcctgtataattcaaacattacaaataagcctaatataagcctaatatgtcactcttgaacttcaggaagcctaatatccaaaaagttagtttaaggtcaaaagtttttgaattaacttttttccattagtatggtcatatctttcttactaatttgtaagttatgtaatttatcaatttttttttgttgttctgtttcccaacctctatgtcagataaagaatcacccaggccagacacaatggctcatgcttgtgatcccaacactttgggaagccaaggtgggagtcgacgcggccgcgaatttagtagtagtaggcggccgc

SEQ ID NO: 365778 - DNA, 470 bp, Homo sapiens
ggatcacagcaaaacatcaattatggatgacaaaagtcttaagacagccataaagacacagttgacaaatgtggctatttctgtggcttacaacaatttaacataatcattacaacatatattaagacatatcagaattttagaactctcatacaatcctggaacacatattaacaacaaatctctatcagtataacccaaaggaagctaaacaccacctcacacttgacaatgtttcctgtataattcaaacattacaaataagcctaatataagcctaatatgtcactcttgaacttcaggaagcctaatatccaaaaagttagtttaaggtcaaaagtttttgaattaacttttttccattagtatggtcatatctttcttactaatttgtaagttatgtaatttatcaatttttttttgttgttctgtttcccaacatggtgaaaccccgtctctaataaaaatac

SEQ ID NO: 365779 - DNA, 534 bp, Homo sapiens
ggatcacagcaaaacatcaattatggatgacaaaagtcttaagacagccataaagacacagttgacaaatgtggctatttctgtggcttacaacaatttaacataatcattacaacatatattaagacatatcagaattttagaactctcatacaatcctggaacacatattaacaacaaatctctatcagtataacccaaaggaagctaaacaccacctcacacttgacaatgtttcctgtataattcaaacattacaaataagcctaatataagcctaatatgtcactcttgaacttcaggaagcctaatatccaaaaagttagtttaaggtcaaaagtttttgaattaacttttttccattagtatggtcatatctttcttactaatttgtaagttatgtaatttatcaatttttttttgttgttctgtttcccaacctctatgtcagataaagaatcacccaggccagacacaatggccgacattagacacaccggcattagacacaccgacattagacaccccgacatt

SEQ ID NO: 365780 - DNA, 887 bp, Homo sapiens
ggatcacagcaaaacatcaattatggatgacaaaagtcttaagacagccataaagacacagttgacaaatgtggctatttctgtggcttacaacaatttaacataatcattacaacatatattaagacatatcagaattttagaactctcatacaatcctggaacacatattaacaacaaatctctatcagtataacccaaaggaagctaaacaccacctcacacttgacaatgtttcctgtataattcaaacattacaaataagcctaatataagcctaatatgtcactcttgaacttcaggaagcctaatatccaaaaagttagtttaaggtcaaaagtttttgaattaacttttttccattagtatggtcatatctttcttactaatttgtaagttatgtaatttatcaatttttttttgttgttctgtttcccaacctctatgtcagataaagaatcacccaggccagacacaatggtgctgggattacaggcaggagccaccgcgcctgggcctttttttaagttttaagtacctataaagaacactgaaaggtgatgtgtgtggatgagctaggaagacctgaaataggctctctctaaattaatcaaattaatcctgaagccattctgcaatactgtctttaatgtatactcacttgttatagaagccagggttttttcccctaatttgtatcattgctatatgtgttattgtaccaaactacactgttttaattgctgtaaattttaatatgtcttagtatctgggtgtgggaatcttgaaagcatggagtttgtgttattcaccactgtattctcaaatatcagaagagtatctggcctactaagtgcacaataaacatagttaaaatgaaaaaaaaa

SEQ ID NO: 365781 - DNA, 528 bp, Homo sapiens
ccacttccaccaaagacaaatcacagcagaaccgacctaacttcaaaataaactgcagtcccatatactgggcctgattacccacacaaagtgcaacaagaatcattgtccatatagactctcctagattggctttgctagaacatttcacaaggccatttcagtcaaagtcctgagaaagtaaccggtttcaattgtgccctattacaaaagaaaacgtggttattaactttatacagacaaatgccatgaattaagaatattcataaatagtttacaaattctggagaaattagaatactcaatacacttaaagtgtatttcaaggctataaatagctcaaaataaaaagattattcagactctgaaaaaacaaaaagaagtagcaatatttcaaacaacaaaagccatacaaattatttcagtcttccattagttcatttcagtccatgtaatcaactcctgctctacttcatattcatctttatgaacacatcagcctttcaattagtgccttggaagttttct

SEQ ID NO: 365782 - DNA, 474 bp, Homo sapiens
ccacttccaccaaagacaaatcacagcagaaccgacctaacttcaaaataaactgcagtcccatatactgggcctgattacccacacaaagtgcaacaagaatcattgtccatatagactctcctagattggctttgctagaacatttcacaaggccatttcagtcaaagtcctgagaaagtaaccggtttcaattgtgccctattacaaaagaaaacgtggttattaactttatacagacaaatgccatgaattaagaatattcataaatagtttacaaattctggagaaattagaatactcaatacacttaaagtgtatttcaaggctataaatagctcaaaataaaaagattattcagactctgaaaaaacaaaaagaagtagcaatatttcaaacaaccaactcctgctctacttcatattcatctttatgaacacatcagcctttcaattagtgccttggaagttttct

SEQ ID NO: 365783 - DNA, 233 bp, Homo sapiens
ggcctacttcaaggatatagagacaggaagttatcaggacctgagaacagagattactagaaagtagaaattaaatattgcacacttagagaaggcaataaggggccatttaggttatgaactataagaatataggactctcatcttttctttgctctattatccagataaactgcttagatattttcatattatggtaaaaagaataaggaagtcagaggttacatcttctt

SEQ ID NO: 365784 - DNA, 479 bp, Homo sapiens
gttcattattgttactacatattttgagtttgctgcctctcaaaatgtcctaaaaatatactgtatgtatcgttgaaatgaaaggtaatagtgcatgcagaaaggcatgggaacagagaagtgaggcctatatttgacattgtaatgagtatttcctatgagataaatgacctcaattatctatttcttgcacaaccataaccaagtcttgaagaagacttaaaagggaaatacccacaggtagataaatttgtgctatgttgtttcttagatgcatgaaaaaaacactgcttttcacttcccagtcaatacaaccagaggtaaaagcagttgccaaatcacccggaagtgaatgaatacactcagtattaactatcataagtccaccccttgtcaacttaaacccatatacatctcctgaaatcatacataatcttcaaataaagacaataataaggtcataattatgcctaacataa

SEQ ID NO: 365785 - DNA, 4255 bp, Homo sapiens
tgagccgcgccctgcgtcctcacgccgaggcggctgggcgatgcgcttgcgcactgagaactgacaccatatgtgtcctgttccagtgcgcgggtctgtggagagccgggtgcgagcggcggcagcacgaggggaaaagagctgagcggagaccaaagtcagccgggagacagtgggtctgtgagagaccgaatagaggggctggggccacgagcgccattgacaagcaatggggaagaaacagaaaaacaagagcgaagacagcaccaaggatgacattgatcttgatgccttggctgcagaaatagaaggagctggtgctgccaaagaacaggagcctcaaaagtcaaaagggaaaaagaaaaaagagaaaaaaaagcaggactttgatgaagatgatatcctgaaagaactggaagaattgtctttggaagctcaaggcatcaaagctgacagagaaactgttgcagtgaagccaacagaaaacaatgaagaggaattcacctcaaaagataaaaaaaagaaaggacagaagggcaaaaaacagagttttgatgataatgatagcgaagaattggaagataaagattcaaaatcaaaaaagactgcaaaaccgaaagtggaaatgtactctgggagtgatgatgatgatgattttaacaaacttcctaaaaaagctaaagggaaagctcaaaaatcaaataagaagtgggatgggtcagaggaggatgaggataacagtaaaaaaattaaagagcgttcaagaataaattcttctggtgaaagtggtgatgaatcagatgaatttttgcaatctagaaaaggacagaaaaaaaatcagaaaaacaagccaggtcctaacatagaaagtgggaatgaagatgatgacgcctccttcaaaattaagacagtggcccaaaagaaggcagaaaagaaggagcgcgagagaaaaaagcgagatgaagaaaaagcgaaactgcggaagctgaaagaaaaagaagagttagaaacaggtaaaaaggatcagagtaaacaaaaggaatctcaaaggaaatttgaagaagaaactgtaaaatccaaagtgactgttgatactggagtaattcctgcctctgaagagaaagcagagactcccacagctgcagaagacgacagaaggggacaaaaagaagaaagataagaagaaaaagaaaggagaaaaggaagaaaaagagaaagagaagaaaaaaggacctagcaaagccactgttaaagctatgcaagaagctctggctaagcttaaagaggaagaagaaagacagaagagagaagaggaagaacgtataaaacggcttgaagaattagaagccaagcgtaaagaagaggaacgattggaacaagaaaaaagagaaaggaaaaagcaaaaagaaaaagaaagaaaagaacgcttgaaaaaagaagggaaacttttaactaaatcccagagagaagccagagccagagccgaagctactcttaaactgctacaagctcagggtgttgaagtgccatcaaaagactctttgccaaagaagaggccaatttatgaagataaaaagaggaaaaaaataccacagcagctagaaagtaaagaagtgtctgaatcaatggaattatgtgctgctgtagaagttatggaacaaggagtaccagaaaaggaagagacaccacctcctgttgaaccagaagaagaagaagatactgaggatgctggattggatgattgggaagctatggccagtgatgaggagacagaaaaagtagaaggaaacacagttcatatagaagtaaaagaaaaccctgaagaggaggaggaggaggaagaagaggaagaagaagatgaagaaagtgaagaagaggaggaagaggagggagaaagtgaaggcagtgaaggtgatgaggaagatgaaaaggtgtcagatgagaaggattcagggaagacattagataaaaagccaagtaaagaaatgagctcagattctgaatatgactctgatgatgatcggactaaagaagaaagggcttatgacaaagcaaaacggaggattgagaaacggcgacttgaacatagtaaaaatgtaaacaccgaaaagctaagagcccctattatctgcgtacttgggcatgtggacacagggaagacaaaaattctagataagctccgtcacacacatgtacaagacggtgaagcaggtggtatcacacaacaaattggggccaccaatgttcctcttgaagctattaatgaacagactaagatgattaaaaattttgatagagagaatgtacggattccaggaatgctaattattgatactcctgggcatgaatctttcagtaatctgagaaatagaggaagctctctttgtgacattgccattttagttgttgatattatgcatggtttggagccccagacaattgagtctatcaaccttctcaaatctaaaaaatgtcccttcattgttgcactcaataagattgataggttatatgattggaaaaagagtcctgactctgatgtggctgctactttaaagaagcagaaaaagaatacaaaagatgaatttgaggagcgagcaaaggctattattgtagaatttgcacagcagggtttgaatgctgctttgttttatgagaataaagatccccgcacttttgtgtctttggtacctacctctgcacatactggtgatggcatgggaagtctgatctaccttcttgtagagttaactcagaccatgttgagcaagagacttgcacactgtgaagagctgagagcacaggtgatggaggttaaagctctcccggggatgggcaccactatagatgtcatcttgatcaatgggcgtttgaaggaaggagatacaatcattgttcctggagtagaagggcccattgtaactcagattcgaggcctcctgttacctcctcctatgaaggaattacgagtgaagaaccagtatgaaaagcataaagaagtagaagcagctcagggggtaaagattcttggaaaagacctggagaaaacattggctggtttacccctccttgtggcttataaagaagatgaaatccctgttcttaaagatgaattgatccatgagttaaagcagacactaaatgctatcaaattagaagaaaaaggagtctatgtccaggcatctacactgggttctttggaagctctactggaatttctgaaaacatcagaagtgccctatgcaggaattaacattggcccagtgcataaaaaagatgttatgaaggcttcagtgatgttggaacatgaccctcagtatgcagtaattttggccttcgatgtgagaattgaacgagatgcacaagaaatggctgatagtttaggagttagaatttttagtgcagaaattatttatcatttatttgatgcctttacaaaatatagacaagactacaagaaacagaaacaagaagaatttaagcacatagcagtatttccctgcaagataaaaatcctccctcagtacatttttaattctcgagatccgatagtgatgggggtgacggtggaagcaggtcaggtgaaacaggggacacccatgtgtgtcccaagcaaaaattttgttgacatcggaatagtaacaagtattgaaataaaccataaacaagtggatgttgcaaaaaaaggacaagaagtttgtgtaaaaatagaacctatccctggtgagtcacccaaaatgtttggaagacattttgaagctacagatattcttgttagtaagatcagccggcagtccattgatgcactcaaagactggttcagagatgaaatgcagaagagtgactggcagcttattgtggagctgaagaaagtatttgaaatcatctaattttttcacatggagcaggaactggagtaaatgcaatactgtgttgtaatatcccaacaaaaatcagacaaaaaatggaacagacgtatttggacactgatggacttaagtatggaaggaagaaaaataggtgtataaaatgttttccatgagaaaccaagaaacttacactggtttgacagtggtcagttacatgtccccacagttccaatgtgcctgttcactcacctctcccttccccaacccttctctacttggctgctgttttaaagtttgcccttccccaaatttggatttttattacagatctaaagctctttcgattttatactgattaaatcagtactgcagtatttgattaacca

SEQ ID NO: 365786 - DNA, 507 bp, Homo sapiens
tgagccgcgccctgcgtcctcacgccgaggcggctgggcgatgcgcttgcgcactgagaactgacaccatatgtgtcctgttccagtgcgcgggtctgtggagagccgggtgcgagcggcggcagcacgaggggaaaagagctgagcggagaccaaagtcagccgggagacagtgggtctgtgagagaccgaatagaggggctggggccacgagcgccattgacaagcaatggggaagaaacagaaaaacaagagcgaagacagcaccaaggatgacattgatcttgatgccttggctgcagaaatagaaggagctggtgctgccaaagaacaggagcctcaaaagtcaaaagggaaaaagaaaaaagagaaaaaaaagcaggactttgatgaagatgatatcctgaaagaactggaagaattgtctttggaagctcaaggcatcaaagctgacagagaaactgttgcagtgaagccaacagaaaacaatgaagaggaattcacctc

SEQ ID NO: 365787 - DNA, 443 bp, Homo sapiens
gactctttttccaatcatataacctatcaatcttattgagtgcaacaatgagtggacattttttagatttgagaaggttgataggttatatgattggaactggagtaaatgcaatactgtgttgtaatatcccaacaaaaatcagacaaaaaatggaacagacgtatttggacactgatggacttaagtatggaaggaagaaaaataggtgtataaaatgttttccatgagaaaccaagaaacttacactggtttgacagtggtcagttacatgtccccacagttccaatgtgcctgttcactcacctctcccttccccaacccttctctacttggctgctgttttaaagtttgcccttccccaaatttggatttttattacagatctaaagctctttcgattttatactgattaaatcagtactgcagtatttgattaacca

SEQ ID NO: 365788 - DNA, 459 bp, Homo sapiens
ccaagcagttatacagactcagatgattaaaaattttgatagagagaatgtacggattccaggaatgctaattattgatactcctgggcatgaatctttcagtaatctgagaaatagaggaagctctctttgtgacattgccattttagttgttgatattatgcatggtttggagccccagacaattgagtctgtattaactgcttgaaagcggtaaatacagacctccaggttggtgattgatgcaggagcactcgccggtctttcccaggctggtcaccaagcccaaaaataacattcaggaagggaagctaacgtggacccatgtcaaacatcacatgcgggcggcagggcccagattccggcaagttgtggatcatggataaggtccattccttgtaagtgtctctcctaggcaggatttaaagacaccaaaagggagctgtgtgggccgttacc

SEQ ID NO: 365789 - DNA, 294 bp, Homo sapiens
  misc_feature (294)..(294): n is a, c, g, or t
ctgttgaaccagaagaagaagaagatactgaggatgctggattggatgattgggaagctatggccagtgatgaggagaagaaaaagagaaagagaagaaaaaaggacctagcaaagccactgttaaagctatgcaagaagctctggctaagcttaaagaggaagaagaaagacagaagagagaagaggaagaacgtataaaacggcttgaagaattagaagccaagcgtaaagaagaggaacgagtgtacaagaaaaaagagaaagtgaagcgtgaagtgatgaggagatgaan

SEQ ID NO: 365790 - DNA, 5302 bp, Homo sapiens
tgagccgcgccctgcgtcctcacgccgaggcggctgggcgatgcgcttgcgcactgagaactgacaccatatgtgtcctgttccagtgcgcgggtctgtggagagccgggtgcgagcggcggcagcacgaggggaaaagagctgagcggagaccaaagtcagccgggagacagtgggtctgtgagagaccgaatagaggggctggggccacgagcgccattgacaagcaatggggaagaaacagaaaaacaagagcgaagacagcaccaaggatgacattgatcttgatgccttggctgcagaaatagaaggagctggtgctgccaaagaacaggagcctcaaaagtcaaaagggaaaaagaaaaaagagaaaaaaaagcaggactttgatgaagatgatatcctgaaagaactggaagaattgtctttggaagctcaaggcatcaaagctgacagagaaactgttgcagtgaagccaacagaaaacaatgaagaggaattcacctcaaaagataaaaaaaagaaaggacagaagggcaaaaaacagagttttgatgataatgatagcgaagaattggaagataaagattcaaaatcaaaaaagactgcaaaaccgaaagtggaaatgtactctgggagtgatgatgatgatgattttaacaaacttcctaaaaaagctaaagggaaagctcaaaaatcaaataagaagtgggatgggtcagaggaggatgaggataacagtaaaaaaattaaagagcgttcaagaataaattcttctggtgaaagtggtgatgaatcagatgaatttttgcaatctagaaaaggacagaaaaaaaatcagaaaaacaagccaggtcctaacatagaaagtgggaatgaagatgatgacgcctccttcaaaattaagacagtggcccaaaagaaggcagaaaagaaggagcgcgagagaaaaaagcgagatgaagaaaaagcgaaactgcggaagctgaaagaaaaagaagagttagaaacaggtaaaaaggatcagagtaaacaaaaggaatctcaaaggaaatttgaagaagaaactgtaaaatccaaagtgactgttgatactggagtaattcctgcctctgaagagaaagcagagactcccacagctgcagaagacgacagaaggggacaaaaagaagaaagataagaagaaaaagaaaggagaaaaggaagaaaaagagaaagagaagaaaaaaggacctagcaaagccactgttaaagctatgcaagaagctctggctaagcttaaagaggaagaagaaagacagaagagagaagaggaagaacgtataaaacggcttgaagaattagaagccaagcgtaaagaagaggaacgattggaacaagaaaaaagagaaaggaaaaagcaaaaagaaaaagaaagaaaagaacgcttgaaaaaagaagggaaacttttaactaaatcccagagagaagccagagccagagccgaagctactcttaaactgctacaagctcagggtgttgaagtgccatcaaaagactctttgccaaagaagaggccaatttatgaagataaaaagaggaaaaaaataccacagcagctagaaagtaaagaagtgtctgaatcaatggaattatgtgctgctgtagaagttatggaacaaggagtaccagaaaaggaagagacaccacctcctgttgaaccagaagaagaagaagatactgaggatgctggattggatgattgggaagctatggccagtgatgaggagacagaaaaagtagaaggaaacacagttcatatagaagtaaaagaaaaccctgaagaggaggaggaggaggaagaagaggaagaagaagatgaagaaagtgaagaagaggaggaagaggagggagaaagtgaaggcagtgaaggtgatgaggaagatgaaaaggtgtcagatgagaaggattcagggaagacattagataaaaagccaagtaaagaaatgagctcagattctgaatatgactctgatgatgatcggactaaagaagaaagggcttatgacaaagcaaaacggaggattgagaaacggcgacttgaacatagtaaaaatgtaaacaccgaaaagctaagagcccctattatctgcgtacttgggcatgtggacacagggaagacaaaaattctagataagctccgtcacacacatgtacaagacggtgaagcaggtggtatcacacaacaaattggggccaccaatgttcctcttgaagctattaatgaacagactaagatgattaaaaattttgatagagagaatgtacggattccaggaatgctaattattgatactcctgggcatgaatctttcagtaatctgagaaatagaggaagctctctttgtgacattgccattttagttgttgatattatgcatggtttggagccccagacaattgagtctatcaaccttctcaaatctaaaaaatgtcccttcattgttgcactcaataagattgataggttatatgattggaaaaagagtcctgactctgatgtggctgctactttaaagaagcagaaaaagaatacaaaagatgaatttgaggagcgagcaaaggctattattgtagaatttgcacagcagggtttgaatgctgctttgttttatgagaataaagatccccgcacttttgtgtctttggtacctacctctgcacatactggtgatggcatgggaagtctgatctaccttcttgtagagttaactcagaccatgttgagcaagagacttgcacactgtgaagagctgagagcacaggtgatggaggttaaagctctcccggggatgggcaccactatagatgtcatcttgatcaatgggcgtttgaaggaaggagatacaatcattgttcctggagtagaagggcccattgtaactcagattcgaggcctcctgttacctcctcctatgaaggaattacgagtgaagaaccagtatgaaaagcataaagaagtagaagcagctcagggggtaaagattcttggaaaagacctggagaaaacattggctggtttacccctccttgtggcttataaagaagatgaaatccctgttcttaaagatgaattgatccatgagttaaagcagacactaaatgctatcaaattagaagaaaaaggagtctatgtccaggcatctacactgggttctttggaagctctactggaatttctgaaaacatcagaagtgccctatgcaggaattaacattggcccagtgcataaaaaagatgttatgaaggcttcagtgatgttggaacatgaccctcagtatgcagtaattttggccttcgatgtgagaattgaacgagatgcacaagaaatggctgatagtttaggagttagaatttttagtgcagaaattatttatcatttatttgatgcctttacaaaatatagacaagactacaagaaacagaaacaagaagaatttaagcacatagcagtatttccctgcaagataaaaatcctccctcagtacatttttaattctcgagatccgatagtgatgggggtgacggtggaagcaggtcaggtgaaacaggggacacccatgtgtgtcccaagcaaaaattttgttgacatcggaatagtaacaagtattgaaataaaccataaacaagtggatgttgcaaaaaaaggacaagaagtttgtgtaaaaatagaacctatccctggtgagtcacccaaaatgtttggaagacattttgaagctacagatattcttgttagtaagatcagccggcagtccattgatgcactcaaagactggttcagagatgaaatgcagaagagtgactggcagcttattgtggagctgaagaaagtatttgaaatcatctaattttttcacatggagcaggaactggagtaaatgcaatactgtgttgtaatatcccaacaaaaatcagacaaaaaatggaacagacgtatttggacactgatggacttaagtatggaaggaagaaaaataggtgtataaaatgttttccatgagaaaccaagaaacttacactggtttgacagtggtcagttacatgtccccacagttccaatgtgcctgttcactcacctctcccttccccaacccttctctacttggctgctgttttaaagtttgcccttccccaaatttggatttttattacagatctaaagctctttcgattttatactgattaaatcagtactgcagtatttgattaaccaagcttctgcagattttgtgattcttgggacttttttgacgtaagaaatacttctttatttatgcatattcttcccacagtgatttttccagcattcttctgccatatgcctttagggcttttataaaatagaaaattaggcattctgatatttctttagctgctttgtgtgaaaccatggtgtaaaagcacagctggctgctttttactgcttgtgtagtcacgagtccattgtaatcatcacaattctaaaccaaactaccaataaagaaaacagacatccaccagtaagcaagctctgttaggcttccatgttagtgtagcttctctcccacaagttgtcctcctaggacaagaattatcttacaaactaaactatcatcacactaccttgtatgccagcacctggtaacagtagagatttttatacattaatcttgatctgttttaatcttgatctgttttagtagacatttttatacattaatcttgatctgttttaatcttgatctgttttgtcctagaaaattccatcatacacacatttcctgatatttgggcttagtgcttctaaattgttgcagacacaaaacttaatgattcattcgtagtagtaatctgtagctagttttagggttttgctgaagtcagtgtggggtgtttgtttgaggaaaaagttccaaatatccactagcatagaattttaaactatttttattttaaagttatggcataacatataacataaaaatattttatatacgtttgaaaaatctataccgttcttttttatcatcaaagtttctcaatggccagtagaagcaaaaagacaacaccacctctgatctacgggacataatgttcccaggaaaaaaatcttcaagtgggtgtgagggtgtttctaattcaaaatatgtagatttctccgcatggaagaagtagtaaagattttcttaacatgctcctgtgttcatgcttggagacaagaataagatggtttagaagctttaccctttcttggaacaagtagaatcccggtctgagacct

SEQ ID NO: 365791 - DNA, 4258 bp, Homo sapiens
tgagccgcgccctgcgtcctcacgccgaggcggctgggcgatgcgcttgcgcactgagaactgacaccatatgtgtcctgttccagtgcgcgggtctgtggagagccgggtgcgagcggcggcagcacgaggggaaaagagctgagcggagaccaaagtcagccgggagacagtgggtctgtgagagaccgaatagaggggctggggccacgagcgccattgacaagcaatggggaagaaacagaaaaacaagagcgaagacagcaccaaggatgacattgatcttgatgccttggctgcagaaatagaaggagctggtgctgccaaagaacaggagcctcaaaagtcaaaagggaaaaagaaaaaagagaaaaaaaagcaggactttgatgaagatgatatcctgaaagaactggaagaattgtctttggaagctcaaggcatcaaagctgacagagaaactgttgcagtgaagccaacagaaaacaatgaagaggaattcacctcaaaagataaaaaaaagaaaggacagaagggcaaaaaacagagttttgatgataatgatagcgaagaattggaagataaagattcaaaatcaaaaaagactgcaaaaccgaaagtggaaatgtactctgggagtgatgatgatgatgattttaacaaacttcctaaaaaagctaaagggaaagctcaaaaatcaaataagaagtgggatgggtcagaggaggatgaggataacagtaaaaaaattaaagagcgttcaagaataaattcttctggtgaaagtggtgatgaatcagatgaatttttgcaatctagaaaaggacagaaaaaaaatcagaaaaacaagccaggtcctaacatagaaagtgggaatgaagatgatgacgcctccttcaaaattaagacagtggcccaaaagaaggcagaaaagaaggagcgcgagagaaaaaagcgagatgaagaaaaagcgaaactgcggaagctgaaagaaaaagaagagttagaaacaggtaaaaaggatcagagtaaacaaaaggaatctcaaaggaaatttgaagaagaaactgtaaaatccaaagtgactgttgatactggagtaattcctgcctctgaagagaaagcagagactcccacagctgcagaagacgacagaaggggacaaaaagaagaaagataagaagaaaaagaaaggagaaaaggaagaaaaagagaaagagaagaaaaaaggacctagcaaagccactgttaaagctatgcaagaagctctggctaagcttaaagaggaagaagaaagacagaagagagaagaggaagaacgtataaaacggcttgaagaattagaagccaagcgtaaagaagaggaacgattggaacaagaaaaaagagaaaggaaaaagcaaaaagaaaaagaaagaaaagaacgcttgaaaaaagaagggaaacttttaactaaatcccagagagaagccagagccagagccgaagctactcttaaactgctacaagctcagggtgttgaagtgccatcaaaagactctttgccaaagaagaggccaatttatgaagataaaaagaggaaaaaaataccacagcagctagaaagtaaagaagtgtctgaatcaatggaattatgtgctgctgtagaagttatggaacaaggagtaccagaaaaggaagagacaccacctcctgttgaaccagaagaagaagaagatactgaggatgctggattggatgattgggaagctatggccagtgatgaggagacagaaaaagtagaaggaaacacagttcatatagaagtaaaagaaaaccctgaagaggaggaggaggaggaagaagaggaagaagaagatgaagaaagtgaagaagaggaggaagaggagggagaaagtgaaggcagtgaaggtgatgaggaagatgaaaaggtgtcagatgagaaggattcagggaagacattagataaaaagccaagtaaagaaatgagctcagattctgaatatgactctgatgatgatcggactaaagaagaaagggcttatgacaaagcaaaacggaggattgagaaacggcgacttgaacatagtaaaaatgtaaacaccgaaaagctaagagcccctattatctgcgtacttgggcatgtggacacagggaagacaaaaattctagataagctccgtcacacacatgtacaagacggtgaagcaggtggtatcacacaacaaattggggccaccaatgttcctcttgaagctattaatgaacagactaagatgattaaaaattttgatagagagaatgtacggattccaggaatgctaattattgatactcctgggcatgaatctttcagtaatctgagaaatagaggaagctctctttgtgacattgccattttagttgttgatattatgcatggtttggagccccagacaattgagtctatcaaccttctcaaatctaaaaaatgtcccttcattgttgcactcaataagattgataggttatatgattggaaaaagagtcctgactctgatgtggctgctactttaaagaagcagaaaaagaatacaaaagatgaatttgaggagcgagcaaaggctattattgtagaatttgcacagcagggtttgaatgctgctttgttttatgagaataaagatccccgcacttttgtgtctttggtacctacctctgcacatactggtgatggcatgggaagtctgatctaccttcttgtagagttaactcagaccatgttgagcaagagacttgcacactgtgaagagctgagagcacaggtgatggaggttaaagctctcccggggatgggcaccactatagatgtcatcttgatcaatgggcgtttgaaggaaggagatacaatcattgttcctggagtagaagggcccattgtaactcagattcgaggcctcctgttacctcctcctatgaaggaattacgagtgaagaaccagtatgaaaagcataaagaagtagaagcagctcagggggtaaagattcttggaaaagacctggagaaaacattggctggtttacccctccttgtggcttataaagaagatgaaatccctgttcttaaagatgaattgatccatgagttaaagcagacactaaatgctatcaaattagaagaaaaaggagtctatgtccaggcatctacactgggttctttggaagctctactggaatttctgaaaacatcagaagtgccctatgcaggaattaacattggcccagtgcataaaaaagatgttatgaaggcttcagtgatgttggaacatgaccctcagtatgcagtaattttggccttcgatgtgagaattgaacgagatgcacaagaaatggctgatagtttaggagttagaatttttagtgcagaaattatttatcatttatttgatgcctttacaaaatatagacaagactacaagaaacagaaacaagaagaatttaagcacatagcagtatttccctgcaagataaaaatcctccctcagtacatttttaattctcgagatccgatagtgatgggggtgacggtggaagcaggtcaggtgaaacaggggacacccatgtgtgtcccaagcaaaaattttgttgacatcggaatagtaacaagtattgaaataaaccataaacaagtggatgttgcaaaaaaaggacaagaagtttgtgtaaaaatagaacctatccctggtgagtcacccaaaatgtttggaagacattttgaagctacagatattcttgttagtaagatcagccggcagtccattgatgcactcaaagactggttcagagatgaaatgcagaagagtgactggcagcttattgtggagctgaagaaagtatttgaaatcatctaattttttcacatggagcaggaactggagtaaatgcaatactgtgttgtaatatcccaacaaaaatcagacaaaaaatggaacagacgtatttggacactgatggacttaagtatggaaggaagaaaaataggtgtataaaatgttttccatgagaaaccaagaaacttacactggtttgacagtggtcagttacatgtccccacagttccaatgtgcctgttcactcacctctcccttccccaacccttctctacttggctgctgttttaaagtttgcccttccccaaatttggatttttattacagatctaagaacgtagaaataagaatgacagtttgaacatacataaccctaccccattcctctt

SEQ ID NO: 365792 - DNA, 4197 bp, Homo sapiens
tgagccgcgccctgcgtcctcacgccgaggcggctgggcgatgcgcttgcgcactgagaactgacaccatatgtgtcctgttccagtgcgcgggtctgtggagagccgggtgcgagcggcggcagcacgaggggaaaagagctgagcggagaccaaagtcagccgggagacagtgggtctgtgagagaccgaatagaggggctggggccacgagcgccattgacaagcaatggggaagaaacagaaaaacaagagcgaagacagcaccaaggatgacattgatcttgatgccttggctgcagaaatagaaggagctggtgctgccaaagaacaggagcctcaaaagtcaaaagggaaaaagaaaaaagagaaaaaaaagcaggactttgatgaagatgatatcctgaaagaactggaagaattgtctttggaagctcaaggcatcaaagctgacagagaaactgttgcagtgaagccaacagaaaacaatgaagaggaattcacctcaaaagataaaaaaaagaaaggacagaagggcaaaaaacagagttttgatgataatgatagcgaagaattggaagataaagattcaaaatcaaaaaagactgcaaaaccgaaagtggaaatgtactctgggagtgatgatgatgatgattttaacaaacttcctaaaaaagctaaagggaaagctcaaaaatcaaataagaagtgggatgggtcagaggaggatgaggataacagtaaaaaaattaaagagcgttcaagaataaattcttctggtgaaagtggtgatgaatcagatgaatttttgcaatctagaaaaggacagaagcctccttcaaaattaagacagtggcccaaaagaaggcagaaaagaaggagcgcgagagaaaaaagcgagatgaagaaaaagcgaaactgcggaagctgaaagaaaaagaagagttagaaacaggtaaaaaggatcagagtaaacaaaaggaatctcaaaggaaatttgaagaagaaactgtaaaatccaaagtgactgttgatactggagtaattcctgcctctgaagagaaagcagagactcccacagctgcagaagacgacagaaggggacaaaaagaagaaagataagaagaaaaagaaaggagaaaaggaagaaaaagagaaagagaagaaaaaaggacctagcaaagccactgttaaagctatgcaagaagctctggctaagcttaaagaggaagaagaaagacagaagagagaagaggaagaacgtataaaacggcttgaagaattagaagccaagcgtaaagaagaggaacgattggaacaagaaaaaagagaaaggaaaaagcaaaaagaaaaagaaagaaaagaacgcttgaaaaaagaagggaaacttttaactaaatcccagagagaagccagagccagagccgaagctactcttaaactgctacaagctcagggtgttgaagtgccatcaaaagactctttgccaaagaagaggccaatttatgaagataaaaagaggaaaaaaataccacagcagctagaaagtaaagaagtgtctgaatcaatggaattatgtgctgctgtagaagttatggaacaaggagtaccagaaaaggaagagacaccacctcctgttgaaccagaagaagaagaagatactgaggatgctggattggatgattgggaagctatggccagtgatgaggagacagaaaaagtagaaggaaacacagttcatatagaagtaaaagaaaaccctgaagaggaggaggaggaggaagaagaggaagaagaagatgaagaaagtgaagaagaggaggaagaggagggagaaagtgaaggcagtgaaggtgatgaggaagatgaaaaggtgtcagatgagaaggattcagggaagacattagataaaaagccaagtaaagaaatgagctcagattctgaatatgactctgatgatgatcggactaaagaagaaagggcttatgacaaagcaaaacggaggattgagaaacggcgacttgaacatagtaaaaatgtaaacaccgaaaagctaagagcccctattatctgcgtacttgggcatgtggacacagggaagacaaaaattctagataagctccgtcacacacatgtacaagacggtgaagcaggtggtatcacacaacaaattggggccaccaatgttcctcttgaagctattaatgaacagactaagatgattaaaaattttgatagagagaatgtacggattccaggaatgctaattattgatactcctgggcatgaatctttcagtaatctgagaaatagaggaagctctctttgtgacattgccattttagttgttgatattatgcatggtttggagccccagacaattgagtctatcaaccttctcaaatctaaaaaatgtcccttcattgttgcactcaataagattgataggttatatgattggaaaaagagtcctgactctgatgtggctgctactttaaagaagcagaaaaagaatacaaaagatgaatttgaggagcgagcaaaggctattattgtagaatttgcacagcagggtttgaatgctgctttgttttatgagaataaagatccccgcacttttgtgtctttggtacctacctctgcacatactggtgatggcatgggaagtctgatctaccttcttgtagagttaactcagaccatgttgagcaagagacttgcacactgtgaagagctgagagcacaggtgatggaggttaaagctctcccggggatgggcaccactatagatgtcatcttgatcaatgggcgtttgaaggaaggagatacaatcattgttcctggagtagaagggcccattgtaactcagattcgaggcctcctgttacctcctcctatgaaggaattacgagtgaagaaccagtatgaaaagcataaagaagtagaagcagctcagggggtaaagattcttggaaaagacctggagaaaacattggctggtttacccctccttgtggcttataaagaagatgaaatccctgttcttaaagatgaattgatccatgagttaaagcagacactaaatgctatcaaattagaagaaaaaggagtctatgtccaggcatctacactgggttctttggaagctctactggaatttctgaaaacatcagaagtgccctatgcaggaattaacattggcccagtgcataaaaaagatgttatgaaggcttcagtgatgttggaacatgaccctcagtatgcagtaattttggccttcgatgtgagaattgaacgagatgcacaagaaatggctgatagtttaggagttagaatttttagtgcagaaattatttatcatttatttgatgcctttacaaaatatagacaagactacaagaaacagaaacaagaagaatttaagcacatagcagtatttccctgcaagataaaaatcctccctcagtacatttttaattctcgagatccgatagtgatgggggtgacggtggaagcaggtcaggtgaaacaggggacacccatgtgtgtcccaagcaaaaattttgttgacatcggaatagtaacaagtattgaaataaaccataaacaagtggatgttgcaaaaaaaggacaagaagtttgtgtaaaaatagaacctatccctggtgagtcacccaaaatgtttggaagacattttgaagctacagatattcttgttagtaagatcagccggcagtccattgatgcactcaaagactggttcagagatgaaatgcagaagagtgactggcagcttattgtggagctgaagaaagtatttgaaatcatctaattttttcacatggagcaggaactggagtaaatgcaatactgtgttgtaatatcccaacaaaaatcagacaaaaaatggaacagacgtatttggacactgatggacttaagtatggaaggaagaaaaataggtgtataaaatgttttccatgagaaaccaagaaacttacactggtttgacagtggtcagttacatgtccccacagttccaatgtgcctgttcactcacctctcccttccccaacccttctctacttggctgctgttttaaagtttgcccttccccaaatttggatttttattacagatctaaagctctttcgattttatactgattaaatcagtactgcagtatttgattaacca

SEQ ID NO: 365793 - DNA, 5242 bp, Homo sapiens
tgagccgcgccctgcgtcctcacgccgaggcggctgggcgatgcgcttgcgcactgagaactgacaccatatgtgtcctgttccagtgcgcgggtctgtggagagccgggtgcgagcggcggcagcacgaggggaaaagagctgagcggagaccaaagtcagccgggagacagtgggtctgtgagagaccgaatagaggggctggggccacgagcgccattgacaagcaatggggaagaaacagaaaaacaagagcgaagacagcaccaaggatgacattgatcttgatgccttggctgcagaaatagaaggagctggtgctgccaaagaacaggagcctcaaaagtcaaaagggaaaaagaaaaaagagaaaaaaaagcaggactttgatgaagatgatatcctgaaagaactggaagaattgtctttggaagctcaaggcatcaaagctgacagagaaactgttgcagtgaagccaacagaaaacaatgaagaggaattcacctcaaaagataaaaaaaagaaaggacagaagggcaaaaaacagagttttgatgataatgatagcgaagaattggaagataaagattcaaaatcaaaaaagactgcaaaaccgaaagtggaaatgtactctgggagtgatgatgatgatgattttaacaaacttcctaaaaaagctaaagggaaagctcaaaaatcaaataagaagtgggatgggtcagaggaggatgaggataacagtaaaaaaattaaagagcgttcaagaataaattcttctggtgaaagtggtgatgaatcagatgaatttttgcaatctagaaaaggacagaaaaaaaatcagaaaaacaagccaggtcctaacatagaaagtgggaatgaagatgatgacgcctccttcaaaattaagacagtggcccaaaagaaggcagaaaagaaggagcgcgagagaaaaaagcgagatgaagaaaaagcgaaactgcggaagctgaaagaaaaagaagagttagaaacaggtaaaaaggatcagagtaaacaaaaggaatctcaaaggaaatttgaagaagaaactgtaaaatccaaagtgactgttgatactggagtaattcctgcctctgaagagaaagcagagactcccacagctgcagaagacgacagaaggggacaaaaagaagaaagataagaagaaaaagaaaggagaaaaggaagaaaaagagaaagagaagaaaaaaggacctagcaaagccactgttaaagctatgcaagaagctctggctaagcttaaagaggaagaagaaagacagaagagagaagaggaagaacgtataaaacggcttgaagaattagaagccaagcgtaaagaagaggaacgattggaacaagaaaaaagagaaaggaaaaagcaaaaagaaaaagaaagaaaagaacgcttgaaaaaagaagggaaacttttaactaaatcccagagagaagccagagccagagccgaagctactcttaaactgctacaagctcagggtgttgaagtgccatcaaaagactctttgccaaagaagaggccaatttatgaagataaaaagaggaaaaaaataccacagcagctagaaagtaaagaagtgtctgaatcaatggaattatgtgctgctgtagaagttatggaacaaggagtaccagaaaaggaagagacaccacctcctgttgaaccagaagaagaagaagatactgaggatgctggattggatgattgggaagctatggccagtgatgaggagacagaaaaagtagaaggaaacacagttcatatagaagtaaaagaaaaccctgaagaggaggaggaggaggaagaagaggaagaagaagatgaagaaagtgaagaagaggaggaagaggagggagaaagtgaaggcagtgaaggtgatgaggaagatgaaaaggtgtcagatgagaaggattcagggaagacattagataaaaagccaagtaaagaaatgagctcagattctgaatatgactctgatgatgatcggactaaagaagaaagggcttatgacaaagcaaaacggaggattgagaaacggcgacttgaacatagtaaaaatgtaaacaccgaaaagctaagagcccctattatctgcgtacttgggcatgtggacacagggaagacaaaaattctagataagctccgtcacacacatgtacaagacggtgaagcaggtggtatcacacaacaaattggggccaccaatgttcctcttgaagctattaatgaacagactaagatgattaaaaattttgatagagagaatgtacggattccaggaatgctaattattgatactcctgggcatgaatctttcagtaatctgagaaatagaggaagctctctttgtgacattgccattttagttgttgatattatgcatggtttggagccccagacaattgagtctatcaaccttctcaaatctaaaaaatgtcccttcattgttgcactcaataagattgataggttatatgattggaaaaagagtcctgactctgatgtggctgctactttaaagaagcagaaaaagaatacaaaagatgaatttgaggagcgagcaaaggctattattgtagaatttgcacagcagggtttgaatgctgctttgttttatgagaataaagatccccgcacttttgtgtctttggtacctacctctgcacatactggtgatggcatgggaagtctgatctaccttcttgtagagttaactcagaccatgttgagcaagagacttgcacactgtgaagagctgagagcacaggtgatggaggttaaagctctcccggggatgggcaccactatagatgtcatcttgatcaatgggcgtttgaaggaaggagatacaatcattgttcctggagtagaagggcccattgtaactcagattcgaggcctcctgttacctcctcctatgaaggaattacgagtgaagaaccagtatgaaaagcataaagaagtagaagcagctcagggggtaaagattcttggaaaagacctggagaaaacattggctggtttacccctccttgtggcttataaagaagatgaaatccctgttcttaaagatgaattgatccatgagttaaagcagacactaaatgctatcaaattagaagaaaaaggagtctatgtccaggcatctacactgggttctttggaagctctactggaatttctgaaaacatcagaagtgccctatgcaggaattaacattggcccagtgcataaaaaagatgttatgaaggcttcagtgatgttggaacatgaccctcagtatgcagtaattttggccttcgatgtgagaattgaacgagatgcacaagaaatggctgatagtttaggagttagaatttttagtgcagaaattatttatcatttatttgatgcctttacaaaatatagacaagactacaagaaacagaaacaagaagaatttaagcacatagcagtatttccctgcaagataaaaatcctccctcagtacatttttaattctcgagatccgatagtgatgggggtgacggtggaagcaggtcaggtgaaacaggggacacccatgtgtgtcccaagcaaaaattttgttgacatcggaatagtaacaagtattgaaataaaccataaacaagtggatgttgcaaaaaaaggacaagaagtttgtgtaaaaatagaacctatccctatcagccggcagtccattgatgcactcaaagactggttcagagatgaaatgcagaagagtgactggcagcttattgtggagctgaagaaagtatttgaaatcatctaattttttcacatggagcaggaactggagtaaatgcaatactgtgttgtaatatcccaacaaaaatcagacaaaaaatggaacagacgtatttggacactgatggacttaagtatggaaggaagaaaaataggtgtataaaatgttttccatgagaaaccaagaaacttacactggtttgacagtggtcagttacatgtccccacagttccaatgtgcctgttcactcacctctcccttccccaacccttctctacttggctgctgttttaaagtttgcccttccccaaatttggatttttattacagatctaaagctctttcgattttatactgattaaatcagtactgcagtatttgattaaccaagcttctgcagattttgtgattcttgggacttttttgacgtaagaaatacttctttatttatgcatattcttcccacagtgatttttccagcattcttctgccatatgcctttagggcttttataaaatagaaaattaggcattctgatatttctttagctgctttgtgtgaaaccatggtgtaaaagcacagctggctgctttttactgcttgtgtagtcacgagtccattgtaatcatcacaattctaaaccaaactaccaataaagaaaacagacatccaccagtaagcaagctctgttaggcttccatgttagtgtagcttctctcccacaagttgtcctcctaggacaagaattatcttacaaactaaactatcatcacactaccttgtatgccagcacctggtaacagtagagatttttatacattaatcttgatctgttttaatcttgatctgttttagtagacatttttatacattaatcttgatctgttttaatcttgatctgttttgtcctagaaaattccatcatacacacatttcctgatatttgggcttagtgcttctaaattgttgcagacacaaaacttaatgattcattcgtagtagtaatctgtagctagttttagggttttgctgaagtcagtgtggggtgtttgtttgaggaaaaagttccaaatatccactagcatagaattttaaactatttttattttaaagttatggcataacatataacataaaaatattttatatacgtttgaaaaatctataccgttcttttttatcatcaaagtttctcaatggccagtagaagcaaaaagacaacaccacctctgatctacgggacataatgttcccaggaaaaaaatcttcaagtgggtgtgagggtgtttctaattcaaaatatgtagatttctccgcatggaagaagtagtaaagattttcttaacatgctcctgtgttcatgcttggagacaagaataagatggtttagaagctttaccctttcttggaacaagtagaatcccggtctgagacct

SEQ ID NO: 365794 - DNA, 3476 bp, Homo sapiens
  misc_feature (3201)..(3201): n is a, c, g, or t
tgagccgcgccctgcgtcctcacgccgaggcggctgggcgatgcgcttgcgcactgagaactgacaccatatgtgtcctgttccagtgcgcgggtctgtggagagccgggtgcgagcggcggcagcacgaggggaaaagagctgagcggagaccaaagtcagccgggagacagtgggtctgtgagagaccgaatagaggggctggggccacgagcgccattgacaagcaatggggaagaaacagaaaaacaagagcgaagacagcaccaaggatgacattgatcttgatgccttggctgcagaaatagaaggagctggtgctgccaaagaacaggagcctcaaaagtcaaaagggaaaaagaaaaaagagaaaaaaaagcaggactttgatgaagatgatatcctgaaagaactggaagaattgtctttggaagctcaaggcatcaaagctgacagagaaactgttgcagtgaagccaacagaaaacaatgaagaggaattcacctcaaaagataaaaaaaagaaaggacagaagggcaaaaaacagagttttgatgataatgatagcgaagaattggaagataaagattcaaaatcaaaaaagactgcaaaaccgaaagtggaaatgtactctgggagtgatgatgatgatgattttaacaaacttcctaaaaaagctaaagggaaagctcaaaaatcaaataagaagtgggatgggtcagaggaggatgaggataacagtaaaaaaattaaagagcgttcaagaataaattcttctggtgaaagtggtgatgaatcagatgaatttttgcaatctagaaaaggacagaaaaaaaatcagaaaaacaagccaggtcctaacatagaaagtgggaatgaagatgatgacgcctccttcaaaattaagacagtggcccaaaagaaggcagaaaagaaggagcgcgagagaaaaaagcgagatgaagaaaaagcgaaactgcggaagctgaaagaaaaagaagagttagaaacaggtaaaaaggatcagagtaaacaaaaggaatctcaaaggaaatttgaagaagaaactgtaaaatccaaagtgactgttgatactggagtaattcctgcctctgaagagaaagcagagactcccacagctgcagaagacgacagaaggggacaaaaagaagaaagataagaagaaaaagaaaggagaaaaggaagaaaaagagaaagagaagaaaaaaggacctagcaaagccactgttaaagctatgcaagaagctctggctaagcttaaagaggaagaagaaagacagaagagagaagaggaagaacgtataaaacggcttgaagaattagaagccaagcgtaaagaagaggaacgattggaacaagaaaaaagagaaaggaaaaagcaaaaagaaaaagaaagaaaagaacgcttgaaaaaagaagggaaacttttaactaaatcccagagagaagccagagccagagccgaagctactcttaaactgctacaagctcagggtgttgaagtgccatcaaaagactctttgccaaagaagaggccaatttatgaagataaaaagaggaaaaaaataccacagcagctagaaagtaaagaagtgtctgaatcaatggaattatgtgctgctgtagaagttatggaacaaggagtaccagaaaaggaagagacaccacctcctgttgaaccagaagaagaagaagatactgaggatgctggattggatgattgggaagctatggccagtgatgaggagacagaaaaagtagaaggaaacacagttcatatagaagtaaaagaaaaccctgaagaggaggaggaggaggaagaagaggaagaagaagatgaagaaagtgaagaagaggaggaagaggagggagaaagtgaaggcagtgaaggtgatgaggaagatgaaaaggtgtcagatgagaaggattcagggaagacattagataaaaagccaagtaaagaaatgagctcagattctgaatatgactctgatgatgatcggactaaagaagaaagggcttatgacaaagcaaaacggaggattgagaaacggcgacttgaacatagtaaaaatgtaaacaccgaaaagctaagagcccctattatctgcgtacttgggcatgtggacacagggaagacaaaaattctagataagctccgtcacacacatgtacaagacggtgaagcaggtggtatcacacaacaaattggggccaccaatgttcctcttgaagctattaatgaacagactaagatgattaaaaattttgatagagagaatgtacggattccaggaatgctaattattgatactcctgggcatgaatctttcagtaatctgagaaatagaggaagctctctttgtgacattgccattttagttgttgatattatgcatggtttggagccccagacaattgagtctatcaaccttctcaaatctaaaaaatgtcccttcattgttgcactcaataagattgataggttatatgattggaaaaagagtcctgactctgatgtggctgctactttaaagaagcagaaaaagaatacaaaagatgaatttgaggagcgagcaaaggctattattgtagaatttgcacagcagggtttgaatgctgctttgttttatgagaataaagatccccgcacttttgtgtctttggtacctacctctgcacatactggtgatggcatgggaagtctgatctaccttcttgtagagttaactcagaccatgttgagcaagagacttgcacactgtgaagagctgagagcacaggtgatggaggttaaagctctcccggggatgggcaccactatagatgtcatcttgatcaatgggcgtttgaaggaaggagatacaatcattgttcctggagtagaagggcccattgtaactcagattcgaggcctcctgttacctcctcctatgaaggaattacgagtgaagaaccagtatgaaaagcttgaagaattagaagccaagcgtaaagaagaggaacgattggaacaagaaaaaagagaaaggaaaaagcaaaaagaaaaagaaagaaaagaacgcttgaaaaaagaagggaaacttttaactaaatcccagagagaagccagagccagagccgaagctactcttaaactgctacaagctcagggtgttgaagtgccatcaaaagactctntgccaaagaagaggccaatttatgaagccaaaaagaagaaagataagaagaaaaagaaaggagaaaaggaagaaaaagagaaagagaagaaaaaaggacctagcaaagccactgttaaagctatgcaagaagctctggctaagcttaaagaggaagaagaaagacagaagagagaagaggaagaacgtataaaacggcttgaagaattagaagccaagcgtaaagaagaggaacgattggaacaagaaaaaagagaaaggaaaaagcaaaaaaaa

SEQ ID NO: 365795 - DNA, 2541 bp, Homo sapiens
  misc_feature (2490)..(2490): n is a, c, g, or t
  misc_feature (2494)..(2494): n is a, c, g, or t
  misc_feature (2519)..(2519): n is a, c, g, or t
  misc_feature (2535)..(2535): n is a, c, g, or t
tgagccgcgccctgcgtcctcacgccgaggcggctgggcgatgcgcttgcgcactgagaactgacaccatatgtgtcctgttccagtgcgcgggtctgtggagagccgggtgcgagcggcggcagcacgaggggaaaagagctgagcggagaccaaagtcagccgggagacagtgggtctgtgagagaccgaatagaggggctggggccacgagcgccattgacaagcaatggggaagaaacagaaaaacaagagcgaagacagcaccaaggatgacattgatcttgatgccttggctgcagaaatagaaggagctggtgctgccaaagaacaggagcctcaaaagtcaaaagggaaaaagaaaaaagagaaaaaaaagcaggactttgatgaagatgatatcctgaaagaactggaagaattgtctttggaagctcaaggcatcaaagctgacagagaaactgttgcagtgaagccaacagaaaacaatgaagaggaattcacctcaaaagataaaaaaaagaaaggacagaagggcaaaaaacagagttttgatgataatgatagcgaagaattggaagataaagattcaaaatcaaaaaagactgcaaaaccgaaagtggaaatgtactctgggagtgatgatgatgatgattttaacaaacttcctaaaaaagctaaagggaaagctcaaaaatcaaataagaagtgggatgggtcagaggaggatgaggataacagtaaaaaaattaaagagcgttcaagaataaattcttctggtgaaagtggtgatgaatcagatgaatttttgcaatctagaaaaggacagaaaaaaaatcagaaaaacaagccaggtcctaacatagaaagtgggaatgaagatgatgacgcctccttcaaaattaagacagtggcccaaaagaaggcagaaaagaaggagcgcgagagaaaaaagcgagatgaagaaaaagcgaaactgcggaagctgaaagaaaaagaagagttagaaacaggtaaaaaggatcagagtaaacaaaaggaatctcaaaggaaatttgaagaagaaactgtaaaatccaaagtgactgttgatactggagtaattcctgcctctgaagagaaagcagagactcccacagctgcagaagacgacagaaggggacaaaaagaagaaagataagaagaaaaagaaaggagaaaaggaagaaaaagagaaagagaagaaaaaaggacctagcaaagccactgttaaagctatgcaagaagctctggctaagcttaaagaggaagaagaaagacagaagagagaagaggaagaacgtataaaacggcttgaagaattagaagccaagcgtaaagaagaggaacgattggaacaagaaaaaagagaaaggaaaaagcaaaaagaaaaagaaagaaaagaacgcttgaaaaaagaagggaaacttttaactaaatcccagagagaagccagagccagagccgaagctactcttaaactgctacaagctcagggtgttgaagtgccatcaaaagactctttgccaaagaagaggccaatttatgaagataaaaagaggaaaaaaataccacagcagctagaaagtaaagaagtgtctgaatcaatggaattatgtgctgctgtagaagttatggaacaaggagtaccagaaaaggaagagacaccacctcctgttgaaccagaagaagaagaagatactgaggatgctggattggatgattgggaagctatggccagtgatgaggagacagaaaaagtagaaggaaacacagttcatatagaagtaaaagaaaaccctgaagaggaggaggaggaggaagaagaggaagaagaagatgaagaaagtgaagaagaggaggaagaggagggagaaagtgaaggcagtgaaggtgatgaggaagatgaaaaggtgtcagatgagaaggattcagggaagacattagataaaaagccaagtaaagaaatgagctcagattctgaatatgactctgatgatgatcggactaaagaagaaagggcttatgacaaagcaaaacggaggattgagaaacggcgacttgaacatagtaaaaatgtaaacaccgaaaagctaagagcccctattatctgcgtacttgggcatgtggacacagggaagacaaaaattctagataagctccgtcacacacatgtacaagacggtgaagcaggtggtatcacacaacaaattggggccaccaatgttcctcttgaagctattaatgaacagactaagatgattaaaaattttgatagagagaatgtacggattccaggaatgctaattattgatactcctgggcatgaatctttcagtaatctgagaaatagaggaagctctctttgtgacattgccattttagttgttgatattatgcatggtttggagccccagacaattgagtctatcaaccttctcaaatctaaaaaaattttccctccttgtttgncccnccattaaaaattgattaggtttttntgaattgggaaaaaanaattcc

SEQ ID NO: 365796 - DNA, 2125 bp, Homo sapiens
tgagccgcgccctgcgtcctcacgccgaggcggctgggcgatgcgcttgcgcactgagaactgacaccatatgtgtcctgttccagtgcgcgggtctgtggagagccgggtgcgagcggcggcagcacgaggggaaaagagctgagcggagaccaaagtcagccgggagacagtgggtctgtgagagaccgaatagaggggctggggccacgagcgccattgacaagcaatggggaagaaacagaaaaacaagagcgaagacagcaccaaggatgacattgatcttgatgccttggctgcagaaatagaaggagctggtgctgccaaagaacaggagcctcaaaagtcaaaagggaaaaagaaaaaagagaaaaaaaagcaggactttgatgaagatgatatcctgaaagaactggaagaattgtctttggaagctcaaggcatcaaagctgacagagaaactgttgcagtgaagccaacagaaaacaatgaagaggaattcacctcaaaagataaaaaaaagaaaggacagaagggcaaaaaacagagttttgatgataatgatagcgaagaattggaagataaagattcaaaatcaaaaaagactgcaaaaccgaaagtggaaatgtactctgggagtgatgatgatgatgattttaacaaacttcctaaaaaagctaaagggaaagctcaaaaatcaaataagaagtgggatgggtcagaggaggatgaggataacagtaaaaaaattaaagagcgttcaagaataaattcttctggtgaaagtggtgatgaatcagatgaatttttgcaatctagaaaaggacagaaaaaaaatcagaaaaacaagccaggtcctaacatagaaagtgggaatgaagatgatgacgcctccttcaaaattaagacagtggcccaaaagaaggcagaaaagaaggagcgcgagagaaaaaagcgagatgaagaaaaagcgaaactgcggaagctgaaagaaaaagaagagttagaaacaggtaaaaaggatcagagtaaacaaaaggaatctcaaaggaaatttgaagaagaaactgtaaaatccaaagtgactgttgatactggagtaattcctgcctctgaagagaaagcagagactcccacagctgcagaagacgacagaaggggacaaaaagaagaaagataagaagaaaaagaaaggagaaaaggaagaaaaagagaaagagaagaaaaaaggacctagcaaagccactgttaaagctatgcaagaagctctggctaagcttaaagaggaagaagaaagacagaagagagaagaggaagaacgtataaaacggcttgaagaattagaagccaagcgtaaagaagaggaacgattggaacaagaaaaaagagaaaggaaaaagcaaaaagaaaaagaaagaaaagaacgcttgaaaaaagaagggaaacttttaactaaatcccagagagaagccagagccagagccgaagctactcttaaactgctacaagctcagggtgttgaagtgccatcaaaagactctttgccaaagaagaggccaatttatgaagataaaaagaggaaaaaaataccacagcagctagaaagtaaagaagtgtctgaatcaatggaattatgtgctgctgtagaagttatggaacaaggagtaccagaaaaggaagagacaccacctcctgttgaaccagaagaagaagaagatactgaggatgctggattggatgattgggaagctatggccagtgatgaggagacagaaaaagaagagcgaagacagcaccaaggatgacattgatcttgatgccttggctgcagaaatagaaggagctggtgctgccaaagaacaggagcctcaaaagtcaaaagggaaaaagagataagagaaataaaagcaggactttgatgaagatgatatcctgaaagaactggaagaattgtctttggaagctcaaggcatcaaagctgacagagaaactgttgcagtgaagccaacagaaaacaatgaagaggaattcacctcaaaagataaaaaaaagagacagaagggcaaacagagtttgatgataatgatgcgaattggcctgttgtagaaggtatcacaacacgatt

SEQ ID NO: 365797 - DNA, 3440 bp, Homo sapiens
tgagccgcgccctgcgtcctcacgccgaggcggctgggcgatgcgcttgcgcactgagaactgacaccatatgtgtcctgttccagtgcgcgggtctgtggagagccgggtgcgagcggcggcagcgcgagagaaaaaagcgagatgaagaaaaagcgaaactgcggaagctgaaagaaaaagaagagttagaaacaggtaaaaaggatcagagtaaacaaaaggaatctcaaaggaaatttgaagaagaaactgtaaaatccaaagtgactgttgatactggagtaattcctgcctctgaagagaaagcagagactcccacagctgcagaagacgacagaaggggacaaaaagaagaaagataagaagaaaaagaaaggagaaaaggaagaaaaagagaaagagaagaaaaaaggacctagcaaagccactgttaaagctatgcaagaagctctggctaagcttaaagaggaagaagaaagacagaagagagaagaggaagaacgtataaaacggcttgaagaattagaagccaagcgtaaagaagaggaacgattggaacaagaaaaaagagaaaggaaaaagcaaaaagaaaaagaaagaaaagaacgcttgaaaaaagaagggaaacttttaactaaatcccagagagaagccagagccagagccgaagctactcttaaactgctacaagctcagggtgttgaagtgccatcaaaagactctttgccaaagaagaggccaatttatgaagataaaaagaggaaaaaaataccacagcagctagaaagtaaagaagtgtctgaatcaatggaattatgtgctgctgtagaagttatggaacaaggagtaccagaaaaggaagagacaccacctcctgttgaaccagaagaagaagaagatactgaggatgctggattggatgattgggaagctatggccagtgatgaggagacagaaaaagtagaaggaaacacagttcatatagaagtaaaagaaaaccctgaagaggaggaggaggaggaagaagaggaagaagaagatgaagaaagtgaagaagaggaggaagaggagggagaaagtgaaggcagtgaaggtgatgaggaagatgaaaaggtgtcagatgagaaggattcagggaagacattagataaaaagccaagtaaagaaatgagctcagattctgaatatgactctgatgatgatcggactaaagaagaaagggcttatgacaaagcaaaacggaggattgagaaacggcgacttgaacatagtaaaaatgtaaacaccgaaaagctaagagcccctattatctgcgtacttgggcatgtggacacagggaagacaaaaattctagataagctccgtcacacacatgtacaagacggtgaagcaggtggtatcacacaacaaattggggccaccaatgttcctcttgaagctattaatgaacagactaagatgattaaaaattttgatagagagaatgtacggattccaggaatgctaattattgatactcctgggcatgaatctttcagtaatctgagaaatagaggaagctctctttgtgacattgccattttagttgttgatattatgcatggtttggagccccagacaattgagtctatcaaccttctcaaatctaaaaaatgtcccttcattgttgcactcaataagattgataggttatatgattggaaaaagagtcctgactctgatgtggctgctactttaaagaagcagaaaaagaatacaaaagatgaatttgaggagcgagcaaaggctattattgtagaatttgcacagcagggtttgaatgctgctttgttttatgagaataaagatccccgcacttttgtgtctttggtacctacctctgcacatactggtgatggcatgggaagtctgatctaccttcttgtagagttaactcagaccatgttgagcaagagacttgcacactgtgaagagctgagagcacaggtgatggaggttaaagctctcccggggatgggcaccactatagatgtcatcttgatcaatgggcgtttgaaggaaggagatacaatcattgttcctggagtagaagggcccattgtaactcagattcgaggcctcctgttacctcctcctatgaaggaattacgagtgaagaaccagtatgaaaagcataaagaagtagaagcagctcagggggtaaagattcttggaaaagacctggagaaaacattggctggtttacccctccttgtggcttataaagaagatgaaatccctgttcttaaagatgaattgatccatgagttaaagcagacactaaatgctatcaaattagaagaaaaaggagtctatgtccaggcatctacactgggttctttggaagctctactggaatttctgaaaacatcagaagtgccctatgcaggaattaacattggcccagtgcataaaaaagatgttatgaaggcttcagtgatgttggaacatgaccctcagtatgcagtaattttggccttcgatgtgagaattgaacgagatgcacaagaaatggctgatagtttaggagttagaatttttagtgcagaaattatttatcatttatttgatgcctttacaaaatatagacaagactacaagaaacagaaacaagaagaatttaagcacatagcagtatttccctgcaagataaaaatcctccctcagtacatttttaattctcgagatccgatagtgatgggggtgacggtggaagcaggtcaggtgaaacaggggacacccatgtgtgtcccaagcaaaaattttgttgacatcggaatagtaacaagtattgaaataaaccataaacaagtggatgttgcaaaaaaaggacaagaagtttgtgtaaaaatagaacctatccctggtgagtcacccaaaatgtttggaagacattttgaagctacagatattcttgttagtaagatcagccggcagtccattgatgcactcaaagactggttcagagatgaaatgcagaagagtgactggcagcttattgtggagctgaagaaagtatttgaaatcatctaattttttcacatggagcaggaactggagtaaatgcaatactgtgttgtaatatcccaacaaaaatcagacaaaaaatggaacagacgtatttggacactgatggacttaagtatggaaggaagaaaaataggtgtataaaatgttttccatgagaaaccaagaaacttacactggtttgacagtggtcagttacatgtccccacagttccaatgtgcctgttcactcacctctcccttccccaacccttctctacttggctgctgttttaaagtttgcccttccccaaatttggatttttattacagatctaaagctctttcgattttatactgattaaatcagtactgcagtatttgattaacca

SEQ ID NO: 365798 - DNA, 3993 bp, Homo sapiens
tgagccgcgccctgcgtcctcacgccgaggcggctgggcgatgcgcttgcgcactgagaactgacaccatatgtgtcctgttccagtgcgcgggtctgtggagagccgggtgcgagcggcggcagcacgaggggaaaagagctgagcggagaccaaagtcagccgggagacagtgggtctgtgagagaccgaatagaggggctggggccacgagcgccattgacaagcaatggggaagaaacagaaaaacaagagcgaagacagcaccaaggatgacattgatcttgatgccttggctgcagaaatagaaggagctggtgctgccaaagaacaggagcctcaaaagtcaaaagggaaaaagaaaaaagagaaaaaaaagcaggactttgatgaagatgatatcctgaaagaactggaagaattgtctttggaagctcaaggcatcaaagctgacagagaaactgttgcagtgaagccaacagaaaacaatgaagaggaattcacctcaaaagataaaaaaaagaaaggacagaagggcaaaaaacagagttttgatgataatgatagcgaagaattggaagataaagattcaaaatcaaaaaagactgcaaaaccgaaagtggaaatgtactctgggagtgatgatgatgatgattttaacaaacttcctaaaaaagctaaagggaaagctcaaaaatcaaataagaagtgggatgggtcagaggaggatgaggataacagtaaaaaaattaaagagcgttcaagaataaattcttctggtgaaagtggtgatgaatcagatgaatttttgcaatctagaaaaggacagaaaaaaaatcagaaaaacaagccaggtcctaacatagaaagtgggaatgaagatgatgacgcctccttcaaaattaagacagtggcccaaaagaaggcagaaaagaaggaggaagaaaaagagaaagagaagaaaaaaggacctagcaaagccactgttaaagctatgcaagaagctctggctaagcttaaagaggaagaagaaagacagaagagagaagaggaagaacgtataaaacggcttgaagaattagaagccaagcgtaaagaagaggaacgattggaacaagaaaaaagagaaaggaaaaagcaaaaagaaaaagaaagaaaagaacgcttgaaaaaagaagggaaacttttaactaaatcccagagagaagccagagccagagccgaagctactcttaaactgctacaagctcagggtgttgaagtgccatcaaaagactctttgccaaagaagaggccaatttatgaagataaaaagaggaaaaaaataccacagcagctagaaagtaaagaagtgtctgaatcaatggaattatgtgctgctgtagaagttatggaacaaggagtaccagaaaaggaagagacaccacctcctgttgaaccagaagaagaagaagatactgaggatgctggattggatgattgggaagctatggccagtgatgaggagacagaaaaagtagaaggaaacacagttcatatagaagtaaaagaaaaccctgaagaggaggaggaggaggaagaagaggaagaagaagatgaagaaagtgaagaagaggaggaagaggagggagaaagtgaaggcagtgaaggtgatgaggaagatgaaaaggtgtcagatgagaaggattcagggaagacattagataaaaagccaagtaaagaaatgagctcagattctgaatatgactctgatgatgatcggactaaagaagaaagggcttatgacaaagcaaaacggaggattgagaaacggcgacttgaacatagtaaaaatgtaaacaccgaaaagctaagagcccctattatctgcgtacttgggcatgtggacacagggaagacaaaaattctagataagctccgtcacacacatgtacaagacggtgaagcaggtggtatcacacaacaaattggggccaccaatgttcctcttgaagctattaatgaacagactaagatgattaaaaattttgatagagagaatgtacggattccaggaatgctaattattgatactcctgggcatgaatctttcagtaatctgagaaatagaggaagctctctttgtgacattgccattttagttgttgatattatgcatggtttggagccccagacaattgagtctatcaaccttctcaaatctaaaaaatgtcccttcattgttgcactcaataagattgataggttatatgattggaaaaagagtcctgactctgatgtggctgctactttaaagaagcagaaaaagaatacaaaagatgaatttgaggagcgagcaaaggctattattgtagaatttgcacagcagggtttgaatgctgctttgttttatgagaataaagatccccgcacttttgtgtctttggtacctacctctgcacatactggtgatggcatgggaagtctgatctaccttcttgtagagttaactcagaccatgttgagcaagagacttgcacactgtgaagagctgagagcacaggtgatggaggttaaagctctcccggggatgggcaccactatagatgtcatcttgatcaatgggcgtttgaaggaaggagatacaatcattgttcctggagtagaagggcccattgtaactcagattcgaggcctcctgttacctcctcctatgaaggaattacgagtgaagaaccagtatgaaaagcataaagaagtagaagcagctcagggggtaaagattcttggaaaagacctggagaaaacattggctggtttacccctccttgtggcttataaagaagatgaaatccctgttcttaaagatgaattgatccatgagttaaagcagacactaaatgctatcaaattagaagaaaaaggagtctatgtccaggcatctacactgggttctttggaagctctactggaatttctgaaaacatcagaagtgccctatgcaggaattaacattggcccagtgcataaaaaagatgttatgaaggcttcagtgatgttggaacatgaccctcagtatgcagtaattttggccttcgatgtgagaattgaacgagatgcacaagaaatggctgatagtttaggagttagaatttttagtgcagaaattatttatcatttatttgatgcctttacaaaatatagacaagactacaagaaacagaaacaagaagaatttaagcacatagcagtatttccctgcaagataaaaatcctccctcagtacatttttaattctcgagatccgatagtgatgggggtgacggtggaagcaggtcaggtgaaacaggggacacccatgtgtgtcccaagcaaaaattttgttgacatcggaatagtaacaagtattgaaataaaccataaacaagtggatgttgcaaaaaaaggacaagaagtttgtgtaaaaatagaacctatccctggtgagtcacccaaaatgtttggaagacattttgaagctacagatattcttgttagtaagatcagccggcagtccattgatgcactcaaagactggttcagagatgaaatgcagaagagtgactggcagcttattgtggagctgaagaaagtatttgaaatcatctaattttttcacatggagcaggaactggagtaaatgcaatactgtgttgtaatatcccaacaaaaatcagacaaaaaatggaacagacgtatttggacactgatggacttaagtatggaaggaagaaaaataggtgtataaaatgttttccatgagaaaccaagaaacttacactggtttgacagtggtcagttacatgtccccacagttccaatgtgcctgttcactcacctctcccttccccaacccttctctacttggctgctgttttaaagtttgcccttccccaaatttggatttttattacagatctaaagctctttcgattttatactgattaaatcagtactgcagtatttgattaacca

SEQ ID NO: 365799 - DNA, 3552 bp, Homo sapiens
aaagtggacatcattctcattaactccatcttgtagaagtgaaattagctacagaacttacgtgggtgttagttcattctgattgttagaacttcatataagcatctgttggacaccagccactcaggtaccatggatttagagatacattaggtacaggattgcccttttgctgctgacagtatccttctgtcttactgtattcctcaggacatctgagaccaacatcagtattgcagacttctcaggaggccatctgtgagttattctgagctattctagttaccaaagtgctcaggatgccttgatgcctgtagaacttagcctgctgctggcatcggccttggcccattatggtccttgaattgtggttgggttttgctcgtcatcaccacagggaattgttttttcatttcaatgctttgcctttattctttttggtagaacgacagaaggggacaaaaagaagaaagataagaagaaaaagaaaggagaaaaggaagaaaaagagaaagagaagaaaaaaggacctagcaaagccactgttaaagctatgcaagaagctctggctaagcttaaagaggaagaagaaagacagaagagagaagaggaagaacgtataaaacggcttgaagaattagaagccaagcgtaaagaagaggaacgattggaacaagaaaaaagagaaaggaaaaagcaaaaagaaaaagaaagaaaagaacgcttgaaaaaagaagggaaacttttaactaaatcccagagagaagccagagccagagccgaagctactcttaaactgctacaagctcagggtgttgaagtgccatcaaaagactctttgccaaagaagaggccaatttatgaagataaaaagaggaaaaaaataccacagcagctagaaagtaaagaagtgtctgaatcaatggaattatgtgctgctgtagaagttatggaacaaggagtaccagaaaaggaagagacaccacctcctgttgaaccagaagaagaagaagatactgaggatgctggattggatgattgggaagctatggccagtgatgaggagacagaaaaagtagaaggaaacacagttcatatagaagtaaaagaaaaccctgaagaggaggaggaggaggaagaagaggaagaagaagatgaagaaagtgaagaagaggaggaagaggagggagaaagtgaaggcagtgaaggtgatgaggaagatgaaaaggtgtcagatgagaaggattcagggaagacattagataaaaagccaagtaaagaaatgagctcagattctgaatatgactctgatgatgatcggactaaagaagaaagggcttatgacaaagcaaaacggaggattgagaaacggcgacttgaacatagtaaaaatgtaaacaccgaaaagctaagagcccctattatctgcgtacttgggcatgtggacacagggaagacaaaaattctagataagctccgtcacacacatgtacaagacggtgaagcaggtggtatcacacaacaaattggggccaccaatgttcctcttgaagctattaatgaacagactaagatgattaaaaattttgatagagagaatgtacggattccaggaatgctaattattgatactcctgggcatgaatctttcagtaatctgagaaatagaggaagctctctttgtgacattgccattttagttgttgatattatgcatggtttggagccccagacaattgagtctatcaaccttctcaaatctaaaaaatgtcccttcattgttgcactcaataagattgataggttatatgattggaaaaagagtcctgactctgatgtggctgctactttaaagaagcagaaaaagaatacaaaagatgaatttgaggagcgagcaaaggctattattgtagaatttgcacagcagggtttgaatgctgctttgttttatgagaataaagatccccgcacttttgtgtctttggtacctacctctgcacatactggtgatggcatgggaagtctgatctaccttcttgtagagttaactcagaccatgttgagcaagagacttgcacactgtgaagagctgagagcacaggtgatggaggttaaagctctcccggggatgggcaccactatagatgtcatcttgatcaatgggcgtttgaaggaaggagatacaatcattgttcctggagtagaagggcccattgtaactcagattcgaggcctcctgttacctcctcctatgaaggaattacgagtgaagaaccagtatgaaaagcataaagaagtagaagcagctcagggggtaaagattcttggaaaagacctggagaaaacattggctggtttacccctccttgtggcttataaagaagatgaaatccctgttcttaaagatgaattgatccatgagttaaagcagacactaaatgctatcaaattagaagaaaaaggagtctatgtccaggcatctacactgggttctttggaagctctactggaatttctgaaaacatcagaagtgccctatgcaggaattaacattggcccagtgcataaaaaagatgttatgaaggcttcagtgatgttggaacatgaccctcagtatgcagtaattttggccttcgatgtgagaattgaacgagatgcacaagaaatggctgatagtttaggagttagaatttttagtgcagaaattatttatcatttatttgatgcctttacaaaatatagacaagactacaagaaacagaaacaagaagaatttaagcacatagcagtatttccctgcaagataaaaatcctccctcagtacatttttaattctcgagatccgatagtgatgggggtgacggtggaagcaggtcaggtgaaacaggggacacccatgtgtgtcccaagcaaaaattttgttgacatcggaatagtaacaagtattgaaataaaccataaacaagtggatgttgcaaaaaaaggacaagaagtttgtgtaaaaatagaacctatccctggtgagtcacccaaaatgtttggaagacattttgaagctacagatattcttgttagtaagatcagccggcagtccattgatgcactcaaagactggttcagagatgaaatgcagaagagtgactggcagcttattgtggagctgaagaaagtatttgaaatcatctaattttttcacatggagcaggaactggagtaaatgcaatactgtgttgtaatatcccaacaaaaatcagacaaaaaatggaacagacgtatttggacactgatggacttaagtatggaaggaagaaaaataggtgtataaaatgttttccatgagaaaccaagaaacttacactggtttgacagtggtcagttacatgtccccacagttccaatgtgcctgttcactcacctctcccttccccaacccttctctacttggctgctgttttaaagtttgcccttccccaaatttggatttttattacagatctaaagctctttcgattttatactgattaaatcagtactgcagtatttgattaacca

SEQ ID NO: 365800 - DNA, 3758 bp, Homo sapiens
tgagccgcgccctgcgtcctcacgccgaggcggctgggcgatgcgcttgcgcactgagaactgacaccatatgtgtcctgttccagtgcgcgggtctgtggagagccgggtgcgagcggcggcagcacgaggggaaaagagctgagcggagaccaaagtcagccgggagacagtgggtctgtgagagaccgaatagaggggctggggccacgagcgccattgacaagcaatggggaagaaacagaaaaacaagagcgaagacagcaccaaggatgacattgatcttgatgccttggctgcagaaatagaaggagctggtgctgccaaagaacaggagcctcaaaagtcaaaagggaaaaagaaaaaagagaaaaaaaagcaggactttgatgaagatgatatcctgaaagaactggaagaattgtctttggaagctcaaggcatcaaagctgacagagaaactgttgcagtgaagccaacagaaaacaatgaagaggaattcacctcaaaagataaaaaaaagaaaggacagaagggcaaaaaacagagttttgatgataatgatagcgaagaattggaagataaagattcaaaatcaaaaaagactgcaaaaccgaaagtggaaatgtactctgggagtgatgatgatgatgattttaacaaacttcctaaaaaagctaaagggaaagctcaaaaatcaaataagaagtgggatgggtcagaggaggatgaggataacagtaaaaaaattaaagagcgttcaagaataaattcttctggtgaaagtggtgatgaatcagatgaatttttgcaatctagaaaaggacagaaaaaaaatcagaaaaacaagccaggtcctaacatagaaagtgggaatgaagatgatgacgcctccttcaaaattaagacagtggcccaaaagaaggcagaaaagaaggagaagggaaacttttaactaaatcccagagagaagccagagccagagccgaagctactcttaaactgctacaagctcagggtgttgaagtgccatcaaaagactctttgccaaagaagaggccaatttatgaagataaaaagaggaaaaaaataccacagcagctagaaagtaaagaagtgtctgaatcaatggaattatgtgctgctgtagaagttatggaacaaggagtaccagaaaaggaagagacaccacctcctgttgaaccagaagaagaagaagatactgaggatgctggattggatgattgggaagctatggccagtgatgaggagacagaaaaagtagaaggaaacacagttcatatagaagtaaaagaaaaccctgaagaggaggaggaggaggaagaagaggaagaagaagatgaagaaagtgaagaagaggaggaagaggagggagaaagtgaaggcagtgaaggtgatgaggaagatgaaaaggtgtcagatgagaaggattcagggaagacattagataaaaagccaagtaaagaaatgagctcagattctgaatatgactctgatgatgatcggactaaagaagaaagggcttatgacaaagcaaaacggaggattgagaaacggcgacttgaacatagtaaaaatgtaaacaccgaaaagctaagagcccctattatctgcgtacttgggcatgtggacacagggaagacaaaaattctagataagctccgtcacacacatgtacaagacggtgaagcaggtggtatcacacaacaaattggggccaccaatgttcctcttgaagctattaatgaacagactaagatgattaaaaattttgatagagagaatgtacggattccaggaatgctaattattgatactcctgggcatgaatctttcagtaatctgagaaatagaggaagctctctttgtgacattgccattttagttgttgatattatgcatggtttggagccccagacaattgagtctatcaaccttctcaaatctaaaaaatgtcccttcattgttgcactcaataagattgataggttatatgattggaaaaagagtcctgactctgatgtggctgctactttaaagaagcagaaaaagaatacaaaagatgaatttgaggagcgagcaaaggctattattgtagaatttgcacagcagggtttgaatgctgctttgttttatgagaataaagatccccgcacttttgtgtctttggtacctacctctgcacatactggtgatggcatgggaagtctgatctaccttcttgtagagttaactcagaccatgttgagcaagagacttgcacactgtgaagagctgagagcacaggtgatggaggttaaagctctcccggggatgggcaccactatagatgtcatcttgatcaatgggcgtttgaaggaaggagatacaatcattgttcctggagtagaagggcccattgtaactcagattcgaggcctcctgttacctcctcctatgaaggaattacgagtgaagaaccagtatgaaaagcataaagaagtagaagcagctcagggggtaaagattcttggaaaagacctggagaaaacattggctggtttacccctccttgtggcttataaagaagatgaaatccctgttcttaaagatgaattgatccatgagttaaagcagacactaaatgctatcaaattagaagaaaaaggagtctatgtccaggcatctacactgggttctttggaagctctactggaatttctgaaaacatcagaagtgccctatgcaggaattaacattggcccagtgcataaaaaagatgttatgaaggcttcagtgatgttggaacatgaccctcagtatgcagtaattttggccttcgatgtgagaattgaacgagatgcacaagaaatggctgatagtttaggagttagaatttttagtgcagaaattatttatcatttatttgatgcctttacaaaatatagacaagactacaagaaacagaaacaagaagaatttaagcacatagcagtatttccctgcaagataaaaatcctccctcagtacatttttaattctcgagatccgatagtgatgggggtgacggtggaagcaggtcaggtgaaacaggggacacccatgtgtgtcccaagcaaaaattttgttgacatcggaatagtaacaagtattgaaataaaccataaacaagtggatgttgcaaaaaaaggacaagaagtttgtgtaaaaatagaacctatccctggtgagtcacccaaaatgtttggaagacattttgaagctacagatattcttgttagtaagatcagccggcagtccattgatgcactcaaagactggttcagagatgaaatgcagaagagtgactggcagcttattgtggagctgaagaaagtatttgaaatcatctaattttttcacatggagcaggaactggagtaaatgcaatactgtgttgtaatatcccaacaaaaatcagacaaaaaatggaacagacgtatttggacactgatggacttaagtatggaaggaagaaaaataggtgtataaaatgttttccatgagaaaccaagaaacttacactggtttgacagtggtcagttacatgtccccacagttccaatgtgcctgttcactcacctctcccttccccaacccttctctacttggctgctgttttaaagtttgcccttccccaaatttggatttttattacagatctaaagctctttcgattttatactgattaaatcagtactgcagtatttgattaacca

SEQ ID NO: 365801 - DNA, 3845 bp, Homo sapiens
tgagccgcgccctgcgtcctcacgccgaggcggctgggcgatgcgcttgcgcactgagaactgacaccatatgtgtcctgttccagtgcgcgggtctgtggagagccgggtgcgagcggcggcagcacgaggggaaaagagctgagcggagaccaaagtcagccgggagacagtgggtctgtgagagaccgaatagaggggctggggccacgagcgccattgacaagcaatggggaagaaacagaaaaacaagagcgaagacagcaccaaggatgacattgatcttgatgccttggctgcagaaatagaaggagctggtgctgccaaagaacaggagcctcaaaagtcaaaagggaaaaagaaaaaagagaaaaaaaagcaggactttgaaaaaaacagagttttgatgataatgatagcgaagaattggaagataaagattcaaaatcaaaaaagactgcaaaaccgaaagtggaaatgtactctgggagtgatgatgatgatgattttaacaaacttcctaaaaaagctaaagggaaagctcaaaaatcaaataagaagtgggatgggtcagaggaggatgaggataacagtaaaaaaattaaagagcgttcaagaataaattcttctggtgaaagtggtgatgaatcagatgaatttttgcaatctagaaaaggacagaaaaaaaatcagaaaaacaagccaggtcctaacatagaaagtgggaatgaagatgatgacgcctccttcaaaattaagacagtggcccaaaagaaggcagaaaagaaggaggaagaaaaagagaaagagaagaaaaaaggacctagcaaagccactgttaaagctatgcaagaagctctggctaagcttaaagaggaagaagaaagacagaagagagaagaggaagaacgtataaaacggcttgaagaattagaagccaagcgtaaagaagaggaacgattggaacaagaaaaaagagaaaggaaaaagcaaaaagaaaaagaaagaaaagaacgcttgaaaaaagaagggaaacttttaactaaatcccagagagaagccagagccagagccgaagctactcttaaactgctacaagctcagggtgttgaagtgccatcaaaagactctttgccaaagaagaggccaatttatgaagataaaaagaggaaaaaaataccacagcagctagaaagtaaagaagtgtctgaatcaatggaattatgtgctgctgtagaagttatggaacaaggagtaccagaaaaggaagagacaccacctcctgttgaaccagaagaagaagaagatactgaggatgctggattggatgattgggaagctatggccagtgatgaggagacagaaaaagtagaaggaaacacagttcatatagaagtaaaagaaaaccctgaagaggaggaggaggaggaagaagaggaagaagaagatgaagaaagtgaagaagaggaggaagaggagggagaaagtgaaggcagtgaaggtgatgaggaagatgaaaaggtgtcagatgagaaggattcagggaagacattagataaaaagccaagtaaagaaatgagctcagattctgaatatgactctgatgatgatcggactaaagaagaaagggcttatgacaaagcaaaacggaggattgagaaacggcgacttgaacatagtaaaaatgtaaacaccgaaaagctaagagcccctattatctgcgtacttgggcatgtggacacagggaagacaaaaattctagataagctccgtcacacacatgtacaagacggtgaagcaggtggtatcacacaacaaattggggccaccaatgttcctcttgaagctattaatgaacagactaagatgattaaaaattttgatagagagaatgtacggattccaggaatgctaattattgatactcctgggcatgaatctttcagtaatctgagaaatagaggaagctctctttgtgacattgccattttagttgttgatattatgcatggtttggagccccagacaattgagtctatcaaccttctcaaatctaaaaaatgtcccttcattgttgcactcaataagattgataggttatatgattggaaaaagagtcctgactctgatgtggctgctactttaaagaagcagaaaaagaatacaaaagatgaatttgaggagcgagcaaaggctattattgtagaatttgcacagcagggtttgaatgctgctttgttttatgagaataaagatccccgcacttttgtgtctttggtacctacctctgcacatactggtgatggcatgggaagtctgatctaccttcttgtagagttaactcagaccatgttgagcaagagacttgcacactgtgaagagctgagagcacaggtgatggaggttaaagctctcccggggatgggcaccactatagatgtcatcttgatcaatgggcgtttgaaggaaggagatacaatcattgttcctggagtagaagggcccattgtaactcagattcgaggcctcctgttacctcctcctatgaaggaattacgagtgaagaaccagtatgaaaagcataaagaagtagaagcagctcagggggtaaagattcttggaaaagacctggagaaaacattggctggtttacccctccttgtggcttataaagaagatgaaatccctgttcttaaagatgaattgatccatgagttaaagcagacactaaatgctatcaaattagaagaaaaaggagtctatgtccaggcatctacactgggttctttggaagctctactggaatttctgaaaacatcagaagtgccctatgcaggaattaacattggcccagtgcataaaaaagatgttatgaaggcttcagtgatgttggaacatgaccctcagtatgcagtaattttggccttcgatgtgagaattgaacgagatgcacaagaaatggctgatagtttaggagttagaatttttagtgcagaaattatttatcatttatttgatgcctttacaaaatatagacaagactacaagaaacagaaacaagaagaatttaagcacatagcagtatttccctgcaagataaaaatcctccctcagtacatttttaattctcgagatccgatagtgatgggggtgacggtggaagcaggtcaggtgaaacaggggacacccatgtgtgtcccaagcaaaaattttgttgacatcggaatagtaacaagtattgaaataaaccataaacaagtggatgttgcaaaaaaaggacaagaagtttgtgtaaaaatagaacctatccctggtgagtcacccaaaatgtttggaagacattttgaagctacagatattcttgttagtaagatcagccggcagtccattgatgcactcaaagactggttcagagatgaaatgcagaagagtgactggcagcttattgtggagctgaagaaagtatttgaaatcatctaattttttcacatggagcaggaactggagtaaatgcaatactgtgttgtaatatcccaacaaaaatcagacaaaaaatggaacagacgtatttggacactgatggacttaagtatggaaggaagaaaaataggtgtataaaatgttttccatgagaaaccaagaaacttacactggtttgacagtggtcagttacatgtccccacagttccaatgtgcctgttcactcacctctcccttccccaacccttctctacttggctgctgttttaaagtttgcccttccccaaatttggatttttattacagatctaaagctctttcgattttatactgattaaatcagtactgcagtatttgattaacca

SEQ ID NO: 365802 - DNA, 1431 bp, Homo sapiens
tgagccgcgccctgcgtcctcacgccgaggcggctgggcgatgcgcttgcgcactgagaactgacaccatatgtgtcctgttccagtgcgcgggtctgtggagagccgggtgcgagcggcggcagcacgaggggaaaagagctgagcggagaccaaagtcagccgggagacagtgggtctgtgagagaccgaatagaggggctggggccacgagcgccattgacaagcaatggggaagaaacagaaaaacaagagcgaagacagcaccaaggatgacattgatcttgatgccttggctgcagaaatagaaggagctggtgctgccaaagaacaggagcctcaaaagtcaaaagggaaaaagaaaaaagagaaaaaaaagcaggactttgatgaagatgatatcctgaaagaactggaagaattgtctttggaagctcaaggcatcaaagctgacagagaaactgttgcagtgaagccaacagaaaacaatgaagaggaattcacctcaaaagataaaaaaaagaaaggacagaagggcaaaaaacagagttttgatgataatgatagcgaagaattggaagataaagattcaaaatcaaaaaagactgcaaaaccgaaagtggaaatgtactctgggagtgatgatgatgatgattttaacaaacttcctaaaaaagctaaagggaaagctcaaaaatcaaataagaagtgggatgggtcagaggaggatgaggataacagtaaaaaaattaaagagcgttcaagaataaattcttctggtgaaagtggtgatgaatcagatgaatttttgcaatctagaaaaggacagaaaaaaaatcagaaaaacaagccaggtcctaacatagaaagtgggaatgaagatgatgacgcctccttcaaaattaagacagtggcccaaaagaaggcagaaaagaaggagcgcgagagaaaaaagcgagatgaagaaaaagcgaaactgcggaagctgaaagaaaaagaagagttagaaacaggtaaaaaggatcagagtaaacaaaaggaatctcaaaggaaatttgaagaagaaactgtaaaatccaaagtgactgttgatactggagtaattcctgcctctgaagagaaagcagagactcccacagctgcagaagacgacagaaggggacaaaaagaagaaagataagaagaaaaagaaaggagaaaaggaagaaaaagagaaagagaagaaaaaaggacctagcaaagccactgttaaagctatgcaagaagctctggctaagcttaaagaggaagaagaaagacagaagagagaagaggaagaacgtataaaacggcttgaagaattagaagccaagcgtaaagaagaggaacgattggaacatgatattataatagataaaaaataaaaaaaggtcgtatcgatgtcgagctatc

SEQ ID NO: 365803 - DNA, 2540 bp, Homo sapiens
accacgcgtcgcggacgcgtgggtcgacccacgcggtcggccagtgatgaggagacagaaaaagtagaaggaaacacagttcatatagaagtaaaagaaaaccctgaagaggaggaggaggaggaagaagaggaagaagaagatgaagaaagtgaagaagaggaggaagaggagggagaaagtgaaggcagtgaaggtgatgaggaagatgaaaaggtgtcagatgagaaggattcagggaagacattagataaaaagccaagtaaagaaatgagctcagattctgaatatgactctgatgatgatcggactaaagaagaaagggcttatgacaaagcaaaacggaggattgagaaacggcgacttgaacatagtaaaaatgtaaacaccgaaaagctaagagcccctattatctgcgtacttgggcatgtggacacagggaagacaaaaattctagataagctccgtcacacacatgtacaagacggtgaagcaggtggtatcacacaacaaattggggccaccaatgttcctcttgaagctattaatgaacagactaagatgattaaaaattttgatagagagaatgtacggattccaggaatgctaattattgatactcctgggcatgaatctttcagtaatctgagaaatagaggaagctctctttgtgacattgccattttagttgttgatattatgcatggtttggagccccagacaattgagtctatcaaccttctcaaatctaaaaaatgtcccttcattgttgcactcaataagattgataggttatatgattggaaaaagagtcctgactctgatgtggctgctactttaaagaagcagaaaaagaatacaaaagatgaatttgaggagcgagcaaaggctattattgtagaatttgcacagcagggtttgaatgctgctttgttttatgagaataaagatccccgcacttttgtgtctttggtacctacctctgcacatactggtgatggcatgggaagtctgatctaccttcttgtagagttaactcagaccatgttgagcaagagacttgcacactgtgaagagctgagagcacaggtgatggaggttaaagctctcccggggatgggcaccactatagatgtcatcttgatcaatgggcgtttgaaggaaggagatacaatcattgttcctggagtagaagggcccattgtaactcagattcgaggcctcctgttacctcctcctatgaaggaattacgagtgaagaaccagtatgaaaagcataaagaagtagaagcagctcagggggtaaagattcttggaaaagacctggagaaaacattggctggtttacccctccttgtggcttataaagaagatgaaatccctgttcttaaagatgaattgatccatgagttaaagcagacactaaatgctatcaaattagaagaaaaaggagtctatgtccaggcatctacactgggttctttggaagctctactggaatttctgaaaacatcagaagtgccctatgcaggaattaacattggcccagtgcataaaaaagatgttatgaaggcttcagtgatgttggaacatgaccctcagtatgcagtaattttggccttcgatgtgagaattgaacgagatgcacaagaaatggctgatagtttaggagttagaatttttagtgcagaaattatttatcatttatttgatgcctttacaaaatatagacaagactacaagaaacagaaacaagaagaatttaagcacatagcagtatttccctgcaagataaaaatcctccctcagtacatttttaattctcgagatccgatagtgatgggggtgacggtggaagcaggtcaggtgaaacaggggacacccatgtgtgtcccaagcaaaaattttgttgacatcggaatagtaacaagtattgaaataaaccataaacaagtggatgttgcaaaaaaaggacaagaagtttgtgtaaaaatagaacctatccctggtgagtcacccaaaatgtttggaagacattttgaagctacagatattcttgttagtaagatcagccggcagtccattgatgcactcaaagactggttcagagatgaaatgcagaagagtgactggcagcttattgtggagctgaagaaagtatttgaaatcatctaattttttcacatggagcaggaactggagtaaatgcaatactgtgttgtaatatcccaacaaaaatcagacaaaaaatggaacagacgtatttggacactgatggacttaagtatggaaggaagaaaaataggtgtataaaatgttttccatgagaaaccaagaaacttacactggtttgacagtggtcagttacatgtccccacagttccaatgtgcctgttcactcacctctcccttccccaacccttctctacttggctgctgttttaaagtttgcccttccccaaatttggatttttattacagatctaaagctctttcgattttatactgattaaatcagtactgcagtatttgattaacca

SEQ ID NO: 365804 - DNA, 2187 bp, Homo sapiens
ttagtagagactgggtttcaccatgttggtcaggctggtctcgaactcctgacctcaagtgatcctcctgcctcggcctcccaaagtgctgggattacaggcgtgagccaccgtgcccggcccatgtctgtctgtcttgatgtgtgagcagcagctgtggtcattaaaccattagtttacccctctagaactggggtctgcaaactcccacctgcagccaaatctggcccacctcctttttaatgtaagggctgtgagagtggtttttactttttttatgaatctttctaatctgagaaatagaggaagctctctttgtgacattgccattttagttgttgatattatgcatggtttggagccccagacaattgagtctatcaaccttctcaaatctaaaaaatgtcccttcattgttgcactcaataagattgataggttatatgattggaaaaagagtcctgactctgatgtggctgctactttaaagaagcagaaaaagaatacaaaagatgaatttgaggagcgagcaaaggctattattgtagaatttgcacagcagggtttgaatgctgctttgttttatgagaataaagatccccgcacttttgtgtctttggtacctacctctgcacatactggtgatggcatgggaagtctgatctaccttcttgtagagttaactcagaccatgttgagcaagagacttgcacactgtgaagagctgagagcacaggtgatggaggttaaagctctcccggggatgggcaccactatagatgtcatcttgatcaatgggcgtttgaaggaaggagatacaatcattgttcctggagtagaagggcccattgtaactcagattcgaggcctcctgttacctcctcctatgaaggaattacgagtgaagaaccagtatgaaaagcataaagaagtagaagcagctcagggggtaaagattcttggaaaagacctggagaaaacattggctggtttacccctccttgtggcttataaagaagatgaaatccctgttcttaaagatgaattgatccatgagttaaagcagacactaaatgctatcaaattagaagaaaaaggagtctatgtccaggcatctacactgggttctttggaagctctactggaatttctgaaaacatcagaagtgccctatgcaggaattaacattggcccagtgcataaaaaagatgttatgaaggcttcagtgatgttggaacatgaccctcagtatgcagtaattttggccttcgatgtgagaattgaacgagatgcacaagaaatggctgatagtttaggagttagaatttttagtgcagaaattatttatcatttatttgatgcctttacaaaatatagacaagactacaagaaacagaaacaagaagaatttaagcacatagcagtatttccctgcaagataaaaatcctccctcagtacatttttaattctcgagatccgatagtgatgggggtgacggtggaagcaggtcaggtgaaacaggggacacccatgtgtgtcccaagcaaaaattttgttgacatcggaatagtaacaagtattgaaataaaccataaacaagtggatgttgcaaaaaaaggacaagaagtttgtgtaaaaatagaacctatccctggtgagtcacccaaaatgtttggaagacattttgaagctacagatattcttgttagtaagatcagccggcagtccattgatgcactcaaagactggttcagagatgaaatgcagaagagtgactggcagcttattgtggagctgaagaaagtatttgaaatcatctaattttttcacatggagcaggaactggagtaaatgcaatactgtgttgtaatatcccaacaaaaatcagacaaaaaatggaacagacgtatttggacactgatggacttaagtatggaaggaagaaaaataggtgtataaaatgttttccatgagaaaccaagaaacttacactggtttgacagtggtcagttacatgtccccacagttccaatgtgcctgttcactcacctctcccttccccaacccttctctacttggctgctgttttaaagtttgcccttccccaaatttggatttttattacagatctaaagctctttcgattttatactgattaaatcagtactgcagtatttgattaacca

SEQ ID NO: 365805 - DNA, 789 bp, Homo sapiens
cagagaaatcaatacaatagagattatattaataagagtaacatacaaagctataattaagatgaagtaatgaaagccaaaacattaaaattttaaaacttgcttgttacttgttagaaccagtactacactagaagttaggtaatatatacaactattttcaagtagtttacttatgttgctctaacatgtcctcttcaccagtgcactgttaaactaatcaaaaactctacacacgtatattccacacgtcataggtgagtcacccaaaatgtttggaagacattttgaagctacagatattcttgttagtaagatcagccggcagtccattgatgcactcaaagactggttcagagatgaaatgcagaagagtgactggcagcttattgtggagctgaagaaagtatttgaaatcatctaattttttcacatggagcaggaactggagtaaatgcaatactgtgttgtaatatcccaacaaaaatcagacaaaaaatggaacagacgtatttggacactgatggacttaagtatggaaggaagaaaaataggtgtataaaatgttttccatgagaaaccaagaaacttacactggtttgacagtggtcagttacatgtccccacagttccaatgtgcctgttcactcacctctcccttccccaacccttctctacttggctgctgttttaaagtttgcccttccccaaatttggatttttattacagatctaaagctctttcgattttatactgattaaatcagtactgcagtatttgattaacca

SEQ ID NO: 365806 - DNA, 664 bp, Homo sapiens
tttctttttcccttttgacttttgaggctactcttaaactgctacaagctcagggtgttgaagtgccatcaaaagactctttgccaaagaagaggccaatttatgaagataaaaagaggaaaaaaataccacagcagctagaaagtaaagaagtgtctgaatcaatggaattatgtgctgctgtagaagttatggaacaaggagtaccagaaaaggaagagacaccacctcctgttgaaccagaagaagaagaagatactgaggatgctggattggatgattgggaagctatggccagtgatgaggagacagaaaaagaagagcgaagacagcaccaaggatgacattgatcttgatgccttggctgcagaaatagaaggagctggtgctgccaaagaacaggagcctcaaaagtcaaaagggaaaaagagataagagaaataaaagcaggactttgatgaagatgatatcctgaaagaactggaagaattgtctttggaagctcaaggcatcaaagctgacagagaaactgttgcagtgaagccaacagaaaacaatgaagaggaattcacctcaaaagataaaaaaaagagacagaagggcaaacagagtttgatgataatgatgcgaattggcctgttgtagaaggtatcacaacacgatt

SEQ ID NO: 365807 - DNA, 101 bp, Homo sapiens
acacaacaaattggggccaccaatgttcctcttgaagctattaatgaacagactaagatgattaaaaatgtaagtacattgtatttcatgtattttaatct

SEQ ID NO: 365808 - DNA, 135 bp, Homo sapiens
gaaaaagcaaaaagaaaaagaaagaaaagaacgcttgaaaaaagaagggaaacttttaactaaatcccagagagaagccagagccagagccgaagctactcttaaactgctacaagctcagggtgagtggtactc

SEQ ID NO: 365809 - DNA, 593 bp, Homo sapiens
cctgaatctttttctccacaaaggagtcagggttttttgccccaaactctgagatcacatcactcatctgctcacaggccatcattcttaaaatttcaggattggtcctcactctgacttcattcccatcagccacttcaagctcattcctgactcagaccctttgtgcctgctgatccctcctattacggcacctgtcacgtgaaatggtagagcaaaaataggaaatgacattgggtcaacagggcacttggaatgttttgcaaagcacattatctcctgtcattcttacaaccatcatgaagggaatagggtgttggtggtgccagcctagtttaccaaaatgttacaccgtgagtgatgaaaggatcgcactgccatgacttttaaaacaggcttttgctctagttcttacttcagctatccagccatggcgcctgtgattggcatgaattcttctgcatgcattttaatttgttcttattttatagtttgttgacatcggaatagtaacaagtattgaaataaaccataaacaagtggatgttgcaaaaaaaggacaagaagtttgtgtaaaaatagaacctatccct

SEQ ID NO: 365810 - DNA, 934 bp, Homo sapiens
  misc_feature (910)..(910): n is a, c, g, or t
  misc_feature (934)..(934): n is a, c, g, or t
tgagccgcgccctgcgtcctcacgccgaggcggctgggcgatgcgcttgcgcactgagaactgacaccatatgtgtcctgttccagtgcgcgggtctgtggagagccgggtgcgagcggcggcagcacgaggggaaaagagctgagcggagaccaaagtcagccgggagacagtgggtctgtgagagaccgaatagaggggctggggccacgagcgccattgacaagcaatggggaagaaacagaaaaacaagagcgaagacagcaccaaggatgacattgatcttgatgccttggctgcagaaatagaaggagctggtgctgccaaagaacaggagcctcaaaagtcaaaagggaaaaagaaaaaagagaaaaaaaagcaggactttgatgaagatgatatcctgaaagaactggaagaattgtctttggaagctcaaggcatcaaagctgacagagaaactgttgcagtgaagccaacagaaaacaatgaagaggaattcacctcaaaagataaaaaaaagaaaggacagaagggcaaaaaacagagttttgatgataatgatagcgaagaattggaagataaagattcaaaatcaaaaaagactgcaaaaccgaaagtggaaatgtactctgggagtgatgatgatgatgattttaacaaacttcctaaaaaagctaaagggaaagctcaaaaatcaaataagaagtgggatgggtcagaggaggatgaggataacagtaaaaaaattaaagagcgttcaagaataaattcttctggtgaaagtggtgatgaatcagatgaatttttgcaatctagaaaaggacagaaaatcggaaaaaggcggctaataagggatgagatatgagcccttaataaaggggcagagggaaaaggggggaaagggganaaggacggcggtgaaaagtaacgn

SEQ ID NO: 365811 - DNA, 439 bp, Homo sapiens
caatcgacaaccgagttctcatgactgggaagatagttttcttcaggtgtcaatggcgttagactcccagctgactgaaaacaaggacagtcagccgggagacagtgggtctgtgagagaccgaatagaggggctggggccacgagcgccattgacaagcaatggggaagaaacagaaaaacaagagcgaagacagcaccaaggatgacattgatcttgatgccttggctgcagaaatagaaggagctggtgctgccaaagaacaggagcctcaaaagtcaaaagggaaaaagaaaaaagagaaaaaaaagcaggactttgatgaagatgatatcctgaaagaactggaagaattgtctttggaagctcaaggcatcaaagctgacagagaaactgttgcagtgaagccaacagaaaacaatgaagaggaattcacctc

SEQ ID NO: 365812 - DNA, 188 bp, Homo sapiens
atatatatcgaaaatcatattcaccacttcctacactgggttctttggaagctctactggaatttctgaaaacatcagaagtgccctatgcaggaattaacattggcccagtgcataaaaaagatgttatgaaggcttcagtgatgttggaacatgaccctcagtatgcagtaattttggccttcgat

SEQ ID NO: 365813 - DNA, 1854 bp, Homo sapiens
  misc_feature (1806)..(1806): n is a, c, g, or t
  misc_feature (1809)..(1809): n is a, c, g, or t
tgagccgcgccctgcgtcctcacgccgaggcggctgggcgatgcgcttgcgcactgagaactgacaccatatgtgtcctgttccagtgcgcgggtctgtggagagccgggtgcgagcggcggcagcacgaggggaaaagagctgagcggagaccaaagtcagccgggagacagtgggtctgtgagagaccgaatagaggggctggggccacgagcgccattgacaagcaatggggaagaaacagaaaaacaagagcgaagacagcaccaaggatgacattgatcttgatgccttggctgcagaaatagaaggagctggtgctgccaaagaacaggagcctcaaaagtcaaaagggaaaaagaaaaaagagaaaaaaaagcaggactttgatgaagatgatatcctgaaagaactggaagaattgtctttggaagctcaaggcatcaaagctgacagagaaactgttgcagtgaagccaacagaaaacaatgaagaggaattcacctcaaaagataaaaaaaagaaaggacagaagggcaaaaaacagagttttgatgataatgatagcgaagaattggaagataaagattcaaaatcaaaaaagactgcaaaaccgaaagtggaaatgtactctgggagtgatgatgatgatgattttaacaaacttcctaaaaaagctaaagggaaagctcaaaaatcaaataagaagtgggatgggtcagaggaggatgaggataacagtaaaaaaattaaagagcgttcaagaataaattcttctggtgaaagtggtgatgaatcagatgaatttttgcaatctagaaaaggacagaaaaaaaatcagaaaaacaagccaggtcctaacatagaaagtgggaatgaagatgatgacgcctccttcaaaattaagacagtggcccaaaagaaggcagaaaagaaggagcgcgagagaaaaaagcgagatgaagaaaaagcgaaactgcggaagctgaaagaaaaagaagagttagaaacaggtaaaaaggatcagagtaaacaaaaggaatctcaaaggaaatttgaagaagaaactgtaaaatccaaagtgactgttgatactggagtaattcctgcctctgaagagaaagcagagactcccacagctgcagaagacgacagaaggggacaaaaagaagaaagataagaagaaaaagaaaggagaaaaggaagaaaaagagaaagagaagaaaaaaggacctagcaaagccactgttaaagctatgcaagaagctctggctaagcttaaagaggaagaagaaagacagaagagagaagaggaagaacgtataaaacggcttgaagaattagaagccaagcgtaaagaagaggaacgattggaacaagaaaaaagagaaaggaaaaagcaaaaagaaaaagaaagaaaagaacgcttgaaaaaagaagggaaacttttaactaaatcccagagagaagccagagccagagccgaagctactcttaaactgctacaagctcagggtgttgaagtgccatcaaaagactctttgccaaagaagaggccaatttatgaagataaaaagaggaaaaaaataccacagcagctagaaagtaaagaagtgtctgaatcaatggaattatgtgctgctgtagaagttatggaacaaggagtaccagaaaaggaagagacaccacctcctgttgaaccagaagaagaagaagatactgaggatgctggattggatgattgggaagctatggccagtgatgaggagacagaaaaagtagaaggaaacacagttcatatagaanatnaagcgttgagggggatacctctagagatcgaccatcagccaatca

SEQ ID NO: 365814 - DNA, 3564 bp, Homo sapiens
  misc_feature (2993)..(2993): n is a, c, g, or t
  misc_feature (3201)..(3201): n is a, c, g, or t
tgagccgcgccctgcgtcctcacgccgaggcggctgggcgatgcgcttgcgcactgagaactgacaccatatgtgtcctgttccagtgcgcgggtctgtggagagccgggtgcgagcggcggcagcacgaggggaaaagagctgagcggagaccaaagtcagccgggagacagtgggtctgtgagagaccgaatagaggggctggggccacgagcgccattgacaagcaatggggaagaaacagaaaaacaagagcgaagacagcaccaaggatgacattgatcttgatgccttggctgcagaaatagaaggagctggtgctgccaaagaacaggagcctcaaaagtcaaaagggaaaaagaaaaaagagaaaaaaaagcaggactttgatgaagatgatatcctgaaagaactggaagaattgtctttggaagctcaaggcatcaaagctgacagagaaactgttgcagtgaagccaacagaaaacaatgaagaggaattcacctcaaaagataaaaaaaagaaaggacagaagggcaaaaaacagagttttgatgataatgatagcgaagaattggaagataaagattcaaaatcaaaaaagactgcaaaaccgaaagtggaaatgtactctgggagtgatgatgatgatgattttaacaaacttcctaaaaaagctaaagggaaagctcaaaaatcaaataagaagtgggatgggtcagaggaggatgaggataacagtaaaaaaattaaagagcgttcaagaataaattcttctggtgaaagtggtgatgaatcagatgaatttttgcaatctagaaaaggacagaaaaaaaatcagaaaaacaagccaggtcctaacatagaaagtgggaatgaagatgatgacgcctccttcaaaattaagacagtggcccaaaagaaggcagaaaagaaggagcgcgagagaaaaaagcgagatgaagaaaaagcgaaactgcggaagctgaaagaaaaagaagagttagaaacaggtaaaaaggatcagagtaaacaaaaggaatctcaaaggaaatttgaagaagaaactgtaaaatccaaagtgactgttgatactggagtaattcctgcctctgaagagaaagcagagactcccacagctgcagaagacgacagaaggggacaaaaagaagaaagataagaagaaaaagaaaggagaaaaggaagaaaaagagaaagagaagaaaaaaggacctagcaaagccactgttaaagctatgcaagaagctctggctaagcttaaagaggaagaagaaagacagaagagagaagaggaagaacgtataaaacggcttgaagaattagaagccaagcgtaaagaagaggaacgattggaacaagaaaaaagagaaaggaaaaagcaaaaagaaaaagaaagaaaagaacgcttgaaaaaagaagggaaacttttaactaaatcccagagagaagccagagccagagccgaagctactcttaaactgctacaagctcagggtgttgaagtgccatcaaaagactctttgccaaagaagaggccaatttatgaagataaaaagaggaaaaaaataccacagcagctagaaagtaaagaagtgtctgaatcaatggaattatgtgctgctgtagaagttatggaacaaggagtaccagaaaaggaagagacaccacctcctgttgaaccagcaagaagacagaagcatactgcaggatgcaggcatcacaccagctcacacacacaccattcaacacgagccgttcgacagcacatcaaacttccttcctgcgtgcaacagctgcgtgcatgcacatccaggatgcaatctgcgagcaaaatcataggcgacacagcgcaccagaaaacaacacagagcaaacacacacacacagtggcagcgccagcgtcccccttatatataaccagcctcatccttctatgaatatctatccatgacacacaaatatgcgcccacacatatctctcatatcgagaccacagccgaaccatgtcgcccgcaccctgacacgcgcgcacctcagcacacaccacctcaccaccacgcacccccacacgacataacaccctggagacgccaagaacaccaccgtctggcccccaccctccggagacacaacaaaagatcacaccgccgacggcctcaacgtaccaccagcacgatgcaacacccatcacccacgccacagcacagacagcccgacgaacccatagaccacaccgagctaagcaaccaaccgcgcacagaaagaaccaggtaataggaagcagccgataagcactagaaacaccggcaacgagcgacccaggagaaacaaagccgcaatttccatagccagaagataggtaagcaagagcagggagacacgcgaggccgagcacacagcagatcctactatgacagaggacaagaagcggcaacgcacacgaacgacaaccgaaacggaggagacagccgagtgcgtcgcgtagccaccgaacgtttaggcgtatgcagtagtccgcggcctcaaccaacaagcagctagcaggaacaagagacgagcaccgacaacatatattcatacgacatcacatgaatactcaagacttccagctaaaatctatgagactctcgctaacatcaccatacatcactcgctatcggtcaatgcaactacacaacacaattataaaataccaatgacaacatactaacatcatcaacttcacactactcatcaacaccactccacgcacatcaacccagatactccacagcactaatagagctcacatccacaagccacagatctatcatttcactactcaacacacagaaatcaccatacaacgtacacagcatcttgcatcgaactccgatcagtctcaccggcgcagcataccacatcatcaaactcacgaactgctctccagcaaagatacatacgacacacacaatacgatcactcacaccacnactcgacacaatccagtaaattgctacacacgaccgagtgacagatcatcacaccacttcatcatcatagatctacacgatcaacgacggctacgcaaccacgacaagactagatcacaaccaccacatacatcactaacatacaccagcagcatacagtcactaggtgactaccatcaagatcactcgctcgttacagcgtaccagncgcatgtgtcgactcgagactaacagtcatagaaccattacagaggacgaagctcacgcacactcacctgcaagcgttaccagcactatcgactctcattctatgcaatgtgtaatctaaccacttcaatgtcaactattacactacgcgctaattcgatactcaactcaacgtgactacagctgtgatccaaacagcatctactcgatgcactcttcatcacactagctatacagtccacctacagctcgcagtcactactcgacttaccactattcagctcagagtctatgctgcctaacacgcataacatccgtctagaacatatatcgagcgagaaagcacagccaatgaacccacatg

SEQ ID NO: 365815 - DNA, 3148 bp, Homo sapiens
cctactactactatacgggggcgagaagacgacagaaggggacgacagaaggggacaaaaagaagaaagataagaagaaaaagaaaggagaaaaggaagaaaaagagaaagagaagaaaaaaggacctagcaaagccactgttaaagctatgcaagaagctctggctaagcttaaagaggaagaagaaagacagaagagagaagaggaagaacgtataaaacggcttgaagaattagaagccaagcgtaaagaagaggaacgattggaacaagaaaaaagagaaaggaaaaagcaaaaagaaaaagaaagaaaagaacgcttgaaaaaagaagggaaacttttaactaaatcccagagagaagccagagccagagccgaagctactcttaaactgctacaagctcagggtgttgaagtgccatcaaaagactctttgccaaagaagaggccaatttatgaagataaaaagaggaaaaaaataccacagcagctagaaagtaaagaagtgtctgaatcaatggaattatgtgctgctgtagaagttatggaacaaggagtaccagaaaaggaagagacaccacctcctgttgaaccagaagaagaagaagatactgaggatgctggattggatgattgggaagctatggccagtgatgaggagacagaaaaagtagaaggaaacacagttcatatagaagtaaaagaaaaccctgaagaggaggaggaggaggaagaagaggaagaagaagatgaagaaagtgaagaagaggaggaagaggagggagaaagtgaaggcagtgaaggtgatgaggaagatgaaaaggtgtcagatgagaaggattcagggaagacattagataaaaagccaagtaaagaaatgagctcagattctgaatatgactctgatgatgatcggactaaagaagaaagggcttatgacaaagcaaaacggaggattgagaaacggcgacttgaacatagtaaaaatgtaaacaccgaaaagctaagagcccctattatctgcgtacttgggcatgtggacacagggaagacaaaaattctagataagctccgtcacacacatgtacaagacggtgaagcaggtggtatcacacaacaaattggggccaccaatgttcctcttgaagctattaatgaacagactaagatgattaaaaattttgatagagagaatgtacggattccaggaatgctaattattgatactcctgggcatgaatctttcagtaatctgagaaatagaggaagctctctttgtgacattgccattttagttgttgatattatgcatggtttggagccccagacaattgagtctatcaaccttctcaaatctaaaaaatgtcccttcattgttgcactcaataagattgataggttatatgattggaaaaagagtcctgactctgatgtggctgctactttaaagaagcagaaaaagaatacaaaagatgaatttgaggagcgagcaaaggctattattgtagaatttgcacagcagggtttgaatgctgctttgttttatgagaataaagatccccgcacttttgtgtctttggtacctacctctgcacatactggtgatggcatgggaagtctgatctaccttcttgtagagttaactcagaccatgttgagcaagagacttgcacactgtgaagagctgagagcacaggtgatggaggttaaagctctcccggggatgggcaccactatagatgtcatcttgatcaatgggcgtttgaaggaaggagatacaatcattgttcctggagtagaagggcccattgtaactcagattcgaggcctcctgttacctcctcctatgaaggaattacgagtgaagaaccagtatgaaaagcataaagaagtagaagcagctcagggggtaaagattcttggaaaagacctggagaaaacattggctggtttacccctccttgtggcttataaagaagatgaaatccctgttcttaaagatgaattgatccatgagttaaagcagacactaaatgctatcaaattagaagaaaaaggagtctatgtccaggcatctacactgggttctttggaagctctactggaatttctgaaaacatcagaagtgccctatgcaggaattaacattggcccagtgcataaaaaagatgttatgaaggcttcagtgatgttggaacatgaccctcagtatgcagtaattttggccttcgatgtgagaattgaacgagatgcacaagaaatggctgatagtttaggagttagaatttttagtgcagaaattatttatcatttatttgatgcctttacaaaatatagacaagactacaagaaacagaaacaagaagaatttaagcacatagcagtatttccctgcaagataaaaatcctccctcagtacatttttaattctcgagatccgatagtgatgggggtgacggtggaagcaggtcaggtgaaacaggggacacccatgtgtgtcccaagcaaaaattttgttgacatcggaatagtaacaagtattgaaataaaccataaacaagtggatgttgcaaaaaaaggacaagaagtttgtgtaaaaatagaacctatccctggtgagtcacccaaaatgtttggaagacattttgaagctacagatattcttgttagtaagatcagccggcagtccattgatgcactcaaagactggttcagagatgaaatgcagaagagtgactggcagcttattgtggagctgaagaaagtatttgaaatcatctaattttttcacatggagcaggaactggagtaaatgcaatactgtgttgtaatatcccaacaaaaatcagacaaaaaatggaacagacgtatttggacactgatggacttaagtatggaaggaagaaaaataggtgtataaaatgttttccatgagaaaccaagaaacttacactggtttgacagtggtcagttacatgtccccacagttccaatgtgcctgttcactcacctctcccttccccaacccttctctacttggctgctgttttaaagtttgcccttccccaaatttggatttttattacagatctaaagctctttcgattttatactgattaaatcagtactgcagtatttgattaacca

SEQ ID NO: 365816 - DNA, 3371 bp, Homo sapiens
tgagccgcgccctgcgtcctcacgccgaggcggctgggcgatgcgcttgcgcactgagaactgacaccatatgtgtcctgttccagtgcgcgggtctgtggagagccgggtgcgagcggcggcagcacgaggggaaaagagctgagcggagaccaaagtcagccgggagacagtgggtctgtgagagaccgaatagaggggctggggccacgagcgccattgacaagcaatggggaagaaacagaaaaacaagagcgaagacagacgacagaaggggacaaaaagaagaaagataagaagaaaaagaaaggagaaaaggaagaaaaagagaaagagaagaaaaaaggacctagcaaagccactgttaaagctatgcaagaagctctggctaagcttaaagaggaagaagaaagacagaagagagaagaggaagaacgtataaaacggcttgaagaattagaagccaagcgtaaagaagaggaacgattggaacaagaaaaaagagaaaggaaaaagcaaaaagaaaaagaaagaaaagaacgcttgaaaaaagaagggaaacttttaactaaatcccagagagaagccagagccagagccgaagctactcttaaactgctacaagctcagggtgttgaagtgccatcaaaagactctttgccaaagaagaggccaatttatgaagataaaaagaggaaaaaaataccacagcagctagaaagtaaagaagtgtctgaatcaatggaattatgtgctgctgtagaagttatggaacaaggagtaccagaaaaggaagagacaccacctcctgttgaaccagaagaagaagaagatactgaggatgctggattggatgattgggaagctatggccagtgatgaggagacagaaaaagtagaaggaaacacagttcatatagaagtaaaagaaaaccctgaagaggaggaggaggaggaagaagaggaagaagaagatgaagaaagtgaagaagaggaggaagaggagggagaaagtgaaggcagtgaaggtgatgaggaagatgaaaaggtgtcagatgagaaggattcagggaagacattagataaaaagccaagtaaagaaatgagctcagattctgaatatgactctgatgatgatcggactaaagaagaaagggcttatgacaaagcaaaacggaggattgagaaacggcgacttgaacatagtaaaaatgtaaacaccgaaaagctaagagcccctattatctgcgtacttgggcatgtggacacagggaagacaaaaattctagataagctccgtcacacacatgtacaagacggtgaagcaggtggtatcacacaacaaattggggccaccaatgttcctcttgaagctattaatgaacagactaagatgattaaaaattttgatagagagaatgtacggattccaggaatgctaattattgatactcctgggcatgaatctttcagtaatctgagaaatagaggaagctctctttgtgacattgccattttagttgttgatattatgcatggtttggagccccagacaattgagtctatcaaccttctcaaatctaaaaaatgtcccttcattgttgcactcaataagattgataggttatatgattggaaaaagagtcctgactctgatgtggctgctactttaaagaagcagaaaaagaatacaaaagatgaatttgaggagcgagcaaaggctattattgtagaatttgcacagcagggtttgaatgctgctttgttttatgagaataaagatccccgcacttttgtgtctttggtacctacctctgcacatactggtgatggcatgggaagtctgatctaccttcttgtagagttaactcagaccatgttgagcaagagacttgcacactgtgaagagctgagagcacaggtgatggaggttaaagctctcccggggatgggcaccactatagatgtcatcttgatcaatgggcgtttgaaggaaggagatacaatcattgttcctggagtagaagggcccattgtaactcagattcgaggcctcctgttacctcctcctatgaaggaattacgagtgaagaaccagtatgaaaagcataaagaagtagaagcagctcagggggtaaagattcttggaaaagacctggagaaaacattggctggtttacccctccttgtggcttataaagaagatgaaatccctgttcttaaagatgaattgatccatgagttaaagcagacactaaatgctatcaaattagaagaaaaaggagtctatgtccaggcatctacactgggttctttggaagctctactggaatttctgaaaacatcagaagtgccctatgcaggaattaacattggcccagtgcataaaaaagatgttatgaaggcttcagtgatgttggaacatgaccctcagtatgcagtaattttggccttcgatgtgagaattgaacgagatgcacaagaaatggctgatagtttaggagttagaatttttagtgcagaaattatttatcatttatttgatgcctttacaaaatatagacaagactacaagaaacagaaacaagaagaatttaagcacatagcagtatttccctgcaagataaaaatcctccctcagtacatttttaattctcgagatccgatagtgatgggggtgacggtggaagcaggtcaggtgaaacaggggacacccatgtgtgtcccaagcaaaaattttgttgacatcggaatagtaacaagtattgaaataaaccataaacaagtggatgttgcaaaaaaaggacaagaagtttgtgtaaaaatagaacctatccctggtgagtcacccaaaatgtttggaagacattttgaagctacagatattcttgttagtaagatcagccggcagtccattgatgcactcaaagactggttcagagatgaaatgcagaagagtgactggcagcttattgtggagctgaagaaagtatttgaaatcatctaattttttcacatggagcaggaactggagtaaatgcaatactgtgttgtaatatcccaacaaaaatcagacaaaaaatggaacagacgtatttggacactgatggacttaagtatggaaggaagaaaaataggtgtataaaatgttttccatgagaaaccaagaaacttacactggtttgacagtggtcagttacatgtccccacagttccaatgtgcctgttcactcacctctcccttccccaacccttctctacttggctgctgttttaaagtttgcccttccccaaatttggatttttattacagatctaaagctctttcgattttatactgattaaatcagtactgcagtatttgattaacca

SEQ ID NO: 365817 - DNA, 1456 bp, Homo sapiens
  misc_feature (1367)..(1367): n is a, c, g, or t
  misc_feature (1370)..(1370): n is a, c, g, or t
tgagccgcgccctgcgtcctcacgccgaggcggctgggcgatgcgcttgcgcactgagaactgacaccatatgtgtcctgttccagtgcgcgggtctgtggagagccgggtgcgagcggcggcagcacgaggggaaaagagctgagcggagaccaaagtcagccgggagacagtgggtctgtgagagaccgaatagaggggctggggccacgagcgccattgacaagcaatggggaagaaacagaaaaacaagagcgaagacagcaccaaggatgacattgatcttgatgccttggctgcagaaatagaaggagctggtgctgccaaagaacaggagcctcaaaagtcaaaagggaaaaagaaaaaagagaaaaaaaagcaggactttgatgaagatgatatcctgaaagaactggaagaattgtctttggaagctcaaggcatcaaagctgacagagaaactgttgcagtgaagccaacagaaaacaatgaagaggaattcacctcaaaagataaaaaaaagaaaggacagaagggcaaaaaacagagttttgatgataatgatagcgaagaattggaagataaagattcaaaatcaaaaaagactgcaaaaccgaaagtggaaatgtactctgggagtgatgatgatgatgattttaacaaacttcctaaaaaagctaaagggaaagctcaaaaatcaaataagaagtgggatgggtcagaggaggatgaggataacagtaaaaaaattaaagagcgttcaagaataaattcttctggtgaaagtggtgatgaatcagatgaatttttgcaatctagaaaaggacagaaaaaaaatcagaaaaacaagccaggtcctaacatagaaagtgggaatgaagatgatgacgcctccttcaaaattaagacagtggcccaaaagaaggcagaaaagaaggagcgcgagagaaaaaagcgagatgaagaaaaagcgaaactgcggaagctgaaagaaaaagaagagttagaaacaggtaaaaaggatcagagtaaacaaaaggaatctcaaaggaaatttgaagaagaaactgtaaaatccaaagtgactgttgatactggagtaattcctgcctctgaagagaaagcagagactcccacagctgcagaagacgacagaaggggacaaaaagaagaaagataagaagaaaaagaaaggagaaaaggaagaaaaagagaaagagaagaaaaaaggacctagcaaagccactgttaaagctatgcaagaagctctggctaagcttaaagaggaagaagaaagacagaagagagaagaggaagaacgtataaaacggcttgaagaattagaagccaagcgtaaagaagaggancgntggaacaacgaaaacagagaacaggcacacagcaaacacagaaaaaagaaaagaaaagaccgcttgacagaaaacaaaaacaacag

SEQ ID NO: 365818 - DNA, 1417 bp, Homo sapiens
  misc_feature (1379)..(1379): n is a, c, g, or t
tgagccgcgccctgcgtcctcacgccgaggcggctgggcgatgcgcttgcgcactgagaactgacaccatatgtgtcctgttccagtgcgcgggtctgtggagagccgggtgcgagcggcggcagcacgaggggaaaagagctgagcggagaccaaagtcagccgggagacagtgggtctgtgagagaccgaatagaggggctggggccacgagcgccattgacaagcaatggggaagaaacagaaaaacaagagcgaagacagcaccaaggatgacattgatcttgatgccttggctgcagaaatagaaggagctggtgctgccaaagaacaggagcctcaaaagtcaaaagggaaaaagaaaaaagagaaaaaaaagcaggactttgatgaagatgatatcctgaaagaactggaagaattgtctttggaagctcaaggcatcaaagctgacagagaaactgttgcagtgaagccaacagaaaacaatgaagaggaattcacctcaaaagataaaaaaaagaaaggacagaagggcaaaaaacagagttttgatgataatgatagcgaagaattggaagataaagattcaaaatcaaaaaagactgcaaaaccgaaagtggaaatgtactctgggagtgatgatgatgatgattttaacaaacttcctaaaaaagctaaagggaaagctcaaaaatcaaataagaagtgggatgggtcagaggaggatgaggataacagtaaaaaaattaaagagcgttcaagaataaattcttctggtgaaagtggtgatgaatcagatgaatttttgcaatctagaaaaggacagaaaaaaaatcagaaaaacaagccaggtcctaacatagaaagtgggaatgaagatgatgacgcctccttcaaaattaagacagtggcccaaaagaaggcagaaaagaaggagcgcgagagaaaaaagcgagatgaagaaaaagcgaaactgcggaagctgaaagaaaaagaagagttagaaacaggtaaaaaggatcagagtaaacaaaaggaatctcaaaggaaatttgaagaagaaactgtaaaatccaaagtgactgttgatactggagtaattcctgcctctgaagagaaagcagagactcccacagctgcagaagacgacagaaggggacaaaaagaagaaagataagaagaaaaagaaaggagaaaaggaagaaaaagagaaagagaagaaaaaaggacctagcaaagccactgttaaagctatgcaagaagctctggctaagcttaaagaggaagaagaaagacagaagagagaagaggaagaacgtataaaacggcttgaagaattagaagccaagcgtaaagaagaggaacgattggaacanacaaaacaaaacgatataaacatttgtcgtatcgatgt

SEQ ID NO: 365819 - DNA, 2001 bp, Homo sapiens
ccaagcagttatacagactcagatgattaaaaattttgatagagagaatgtacggattccaggaatgctaattattgatactcctgggcatgaatctttcagtaatctgagaaatagaggaagctctctttgtgacattgccattttagttgttgatattatgcatggtttggagccccagacaattgagtctatcaaccttctcaaatctaaaaaatgtcccttcattgttgcactcaataagattgataggttatatgattggaaaaagagtcctgactctgatgtggctgctactttaaagaagcagaaaaagaatacaaaagatgaatttgaggagcgagcaaaggctattattgtagaatttgcacagcagggtttgaatgctgctttgttttatgagaataaagatccccgcacttttgtgtctttggtacctacctctgcacatactggtgatggcatgggaagtctgatctaccttcttgtagagttaactcagaccatgttgagcaagagacttgcacactgtgaagagctgagagcacaggtgatggaggttaaagctctcccggggatgggcaccactatagatgtcatcttgatcaatgggcgtttgaaggaaggagatacaatcattgttcctggagtagaagggcccattgtaactcagattcgaggcctcctgttacctcctcctatgaaggaattacgagtgaagaaccagtatgaaaagcataaagaagtagaagcagctcagggggtaaagattcttggaaaagacctggagaaaacattggctggtttacccctccttgtggcttataaagaagatgaaatccctgttcttaaagatgaattgatccatgagttaaagcagacactaaatgctatcaaattagaagaaaaaggagtctatgtccaggcatctacactgggttctttggaagctctactggaatttctgaaaacatcagaagtgccctatgcaggaattaacattggcccagtgcataaaaaagatgttatgaaggcttcagtgatgttggaacatgaccctcagtatgcagtaattttggccttcgatgtgagaattgaacgagatgcacaagaaatggctgatagtttaggagttagaatttttagtgcagaaattatttatcatttatttgatgcctttacaaaatatagacaagactacaagaaacagaaacaagaagaatttaagcacatagcagtatttccctgcaagataaaaatcctccctcagtacatttttaattctcgagatccgatagtgatgggggtgacggtggaagcaggtcaggtgaaacaggggacacccatgtgtgtcccaagcaaaaattttgttgacatcggaatagtaacaagtattgaaataaaccataaacaagtggatgttgcaaaaaaaggacaagaagtttgtgtaaaaatagaacctatccctggtgagtcacccaaaatgtttggaagacattttgaagctacagatattcttgttagtaagatcagccggcagtccattgatgcactcaaagactggttcagagatgaaatgcagaagagtgactggcagcttattgtggagctgaagaaagtatttgaaatcatctaattttttcacatggagcaggaactggagtaaatgcaatactgtgttgtaatatcccaacaaaaatcagacaaaaaatggaacagacgtatttggacactgatggacttaagtatggaaggaagaaaaataggtgtataaaatgttttccatgagaaaccaagaaacttacactggtttgacagtggtcagttacatgtccccacagttccaatgtgcctgttcactcacctctcccttccccaacccttctctacttggctgctgttttaaagtttgcccttccccaaatttggatttttattacagatctaaagctctttcgattttatactgattaaatcagtactgcagtatttgattaacca

SEQ ID NO: 365820 - DNA, 750 bp, Homo sapiens
tgagccgcgccctgcgtcctcacgccgaggcggctgggcgatgcgcttgcgcactgagaactgacaccatatgtgtcctgttccagtgcgcgggtctgtggagagccgggtgcgagcggcggcagcacgaggggaaaagagctgagcggagaccaaagtcagccgggagacagtgggtctgtgagagaccgaatagaggggctggggccacgagcgccattgacaagcaatggggaagaaacagaaaaacaagagcgaagacagcaccaaggatgacattgatcttgatgccttggctgcagaaatagaaggagctggtgctgccaaagaacaggagcctcaaaagtcaaaagggaaaaagaaaaaagagaaaaaaaagcaggactttgatgaagatgatatcctgaaagaactggaagaattgtctttggaagctcaaggcatcaaagctgacagagaaactgttgcagtgaagccaacagaaaacaatgaagaggaattcacctcaaaagataaaaaaaagaaaggacagaagggcaaaaaacagagttttgatgatatcctgaaagaactggaagaattgtctttggaagctcaaggcatcaaagctgacagagaaactgttgcagtgaagccaacagaaaacaatgaagaggaattcacctcaaaagataaaaaaaagaaaggacagaaggagctggtgctgccaaagaacaggagcctcaaaagtcaaaagggaaaaaaaaaaaa

SEQ ID NO: 365821 - DNA, 746 bp, Homo sapiens
gtaggccctgaggacccagcataggcggactcgggactgctgctaaagtggggttcctgccgttccacttggctgcgggtccgcaaggcccggccccagctcatcctcagccgccggccccgccgccggctcgggagcctgcgctggtgcggtcggcggcgcctacggcggcggttactgcaagcccaggcggccggcgtggactggagggagggagcccgccaggtgtcgcgcgcggcggcggcccggagacccaacaccgcgacccccagcccgatccctagcccgaccccggcctccgaacccgagtccgaacccgaactcgaatccgcctcgagttgccaccggcctctcctcatcccaccggtgcggcccgtgggccccggccgcgcgttgctgctgctgccggtcgagcagatgacaggcgttggtcgatgcagaatttttctcctcagtgttccattgtgttgctagaacatctgaaaactgccactgtaaacttcataaccagctatccgggttcatcctacatttttgtgcaagaggtagaacccgttttcattcagagttttgctaattacttgcaccaaaacagtgatttcaaatgactatgtaggatgttgtcttggaagaacagttggtctatctagtgctctcagtcctacagaatgtaatacgtgtatacggaaactattatagaaaggtgtatcgtgaaaaatgttcatcctcccctccttagtttcata

SEQ ID NO: 365822 - DNA, 404 bp, Homo sapiens
gagatggcagtcctaaagggcgtggaatgtaatgaagttaactgcttctaaggtggtttatttttctctttacagatgacaggcgttggtcgatgcagaatttttctcctcagtgttccattgtgttgctagaacatctgaaaactgccactgtaaacttcataaccagctatccgggttcatcctacatttttgtgcaagaggtagaacccgttttcattcagagttttgctaattacttgcaccaaaacagtgatttcaaatgactatgtaggatgttgtcttggaagaacagttggtctatctagtgctctcagtcctacagaatgtaatacgtgtatacggaaactattatagaaaggtgtatcgtgaaaaatgttcatcctcccctccttagtttcata

SEQ ID NO: 365823 - DNA, 2414 bp, Homo sapiens
gtaggccctgaggacccagcataggcggactcgggactgctgctaaagtggggttcctgccgttccacttggctgcgggtccgcaaggcccggccccagctcatcctcagccgccggccccgccgccggctcgggagcctgcgctggtgcggtcggcggcgcctacggcggcggttactgcaagcccaggcggccggcgtggactggagggagggagcccgccaggtgtcgcgcgcggcggcggcccggagacccaacaccgcgacccccagcccgatccctagcccgaccccggcctccgaacccgagtccgaacccgaactcgaatccgcctcgagttgccaccggcctctcctcatcccaccggtgcggcccgtgggccccggccgcgcgttgctgctgctgccggtcgagcagggttttacttttagtgggatctgtcgtgtgacttgcctctatggccaggtgcaggtatttggttttaccatcagccaaggccagcctgcccaagacatcttctctgtgtatacccactcttgcttgagtatccatgcacttcactactcacagcctgagaaaagcaagaaggaactgaaaagggaagcccggaatttgctcaaatctcatcttaaccttgatgacaggcgttggtcgatgcagaatttttctcctcagtgttccattgtgttgctagaacatctgaaaactgccactgtaaacttcataaccagctatccgggttcatcctacatttttgtgcaagagagtccaactccccagattaaacctgaatatttagccttgaggtctgttggcatcagaagagagaaaaaaaggaaaggccttcagttaactgagagtaccctttcagccctggaagagttagtcaatgtttcctgtgaagaagtagatggctgccctgtcattctagtttgtggatcccaggatgttggaaagtcaacatttaatagatacctgattaaccatttgttaaatagtcttccctgcgttgactatttggaatgtgatctgggacagacagaatttacccctcctggttgcatttctttgcttaatattacagaaccagttctgggaccacctttcactcacctgaggactccacagaagatggtatattatgggaaaccttcttgtaaaaacaactatgagaattatattgacatagtgaaatatgtgttcagcgcttacaagagagagtcccctctcatcgtcaacactatgggatgggtttcagaccaggggctcctgcttctcattgatctgatccgattgctgtctcccagccacgtggttcagttccgctctgaccacagtaaatatatgccagaccttaccccgcagtatgtagatgacatggatggcttgtacacaaaaagcaagaccaagatgagaaatcgacgtttcagactcgcagcatttgcagatgctttggaatttgctgatgaagaaaaagagagtccagttgagttcactggacataaactgataggtgtttatacagactttgcattcagaataactccaagaaatagagagtcacataacaaaattcttcgagatctgtccatcttgagttaccttagccagctgcagcccccgatgcccaaaccactttctcctttacatagcctgacaccctatcaggtccctttcaatgcagtcgcactccggattacccactctgatgtcgcccctacccatatactatatgctgtaaacgccagctgggttggtctttgcaagatccaggatgacgtcagaggatacacgaatgggcccatcctgcttgcccagactccaatctgtgactgcttgggctttggcatctgtagaggcattgacatggagaagcggctgtaccacatcctcacccctgtgcccccggaagagctaaggaccgtgaattgtctgctcgttggagctattgccattccacattgtgtccttaagtgccagcgtgggatcgaagggacagtaccttatgtcacaacggattacaattttaaacttcctggagcatcagagaaaattggagcaagagaacctgaggaggcacataaagagaaaccataccgaagacctaagttctgtcgaaaaatgaagtgatgctcgcgtttttaataagggaagaaactttcctaccagaaagctttgtctcaagcctgaccacaagagacatgatggagtttcatggccatgaatggtgcccttattaacaacagtgttttttgtgtaattcgtgaatgtcatatagtagtcttaagtttctcttttaaagctgcatgagctagaatttgttctagtcttctgtgtgatactcatacttgctgtccagagggagtaaaacagcagagaacagtttgtgtgccattaaaacagagattcctcag

SEQ ID NO: 365824 - DNA, 3222 bp, Homo sapiens
gtaggccctgaggacccagcataggcggactcgggactgctgctaaagtggggttcctgccgttccacttggctgcgggtccgcaaggcccggccccagctcatcctcagccgccggccccgccgccggctcgggagcctgcgctggtgcggtcggcggcgcctacggcggcggttactgcaagcccaggcggccggcgtggactggagggagggagcccgccaggtgtcgcgcgcggcggcggcccggagacccaacaccgcgacccccagcccgatccctagcccgaccccggcctccgaacccgagtccgaacccgaactcgaatccgcctcgagttgccaccggcctctcctcatcccaccggtgcggcccgtgggccccggccgcgcgttgctgctgctgccggtcgagcagggttttacttttagtgggatctgtcgtgtgacttgcctctatggccaggtgcaggtatttggttttaccatcagccaaggccagcctgcccaagacatcttctctgtgtatacccactcttgcttgagtatccatgcacttcactactcacagcctgagaaaagcaagaaggaactgaaaagggaagcccggaatttgctcaaatctcatcttaaccttgatgacaggcgttggtcgatgcagaatttttctcctcagtgttccattgtgttgctagaacatctgaaaactgccactgtaaacttcataaccagctatccgggttcatcctacatttttgtgcaagagagtccaactccccagattaaacctgaatatttagccttgaggtctgttggcatcagaagagagaaaaaaaggaaaggccttcagttaactgagagtaccctttcagccctggaagagttagtcaatgtttcctgtgaagaagtagatggctgccctgtcattctagtttgtggatcccaggatgttggaaagtcaacatttaatagatacctgattaaccatttgttaaatagtcttccctgcgttgactatttggaatgtgatctgggacagacagaatttacccctcctggttgcatttctttgcttaatattacagaaccagttctgggaccacctttcactcacctgaggactccacagaagatggtatattatgggaaaccttcttgtaaaaacaactatgagaattatattgacatagtgaaatatgtgttcagcgcttacaagagagagtcccctctcatcgtcaacactatgggatgggtttcagaccaggggctcctgcttctcattgatctgatccgattgctgtctcccagccacgtggttcagttccgctctgaccacagtaaatatatgccagaccttaccccgcagtatgtagatgacatggatggcttgtacacaaaaagcaagaccaagatgagaaatcgacgtttcagactcgcagcatttgcagatgctttggaatttgctgatgaagaaaaagagagtccagttgagttcactggacataaactgataggtgtttatacagactttgcattcagaataactccaagaaatagagagtcacataacaaaattcttcgagatctgtccatcttgagttaccttagccagctgcagcccccgatgcccaaaccactttctcctttacatagcctgacaccctatcaggtccctttcaatgcagtcgcactccggattacccactctgatgtcgcccctacccatatactatatgctgtaaacgccagctgggttggtctttgcaagatccaggatgacgtcagaggatacacgaatgggcccatcctgcttgcccagactccaatctgtgactgcttgggctttggcatctgtagaggcattgacatggagaagcggctgtaccacatcctcacccctgtgcccccggaagagctaaggaccgtgaattgtctgctcgttggagctattgccattccacattgtgtccttaagtgccagcgtgggatcgaagggacagtaccttatgtcacaacggattacaattttaaacttcctggagcatcagagaaaattggagcaagagaacctgaggaggcacataaagagaaaccataccgaagacctaagttctgtcgaaaaatgaagtgatgctcgcgtttttaataagggaagaaactttcctaccagaaagctttgtctcaagcctgaccacaagagacatgatggagtttcatggccatgaatggtgcccttattaacaacagtgttttttgtgtaattcgtgaatgtcatatagtagtcttaagtttctcttttaaagctgcatgagctagaatttgttctagtcttctgtgtgatactcatacttgctgtccagagggagtaaaacagcagagaacagtttgtgtgccattaaaacagagattcctcagaaagttcttcagggacctggttattagaatcaggataaaaataaggaaactggggccattacaatgtaccgagaaggaaggaagaaggccaacctgcaggatctcaagcataatggatacaagggctcgccacgggccttgcctgagccatgtgcagagctggggtccagcggtctgcttccttggagccagtgtggatggttacagcccatccatttggtgcagttgtacttggtctgttatattcaatcaaggtttaatagatagggctgggcatggtggctcatgcacacctgtaatcctagcactttgggaggctgaggcgggaggattgcttgagcctcggagttccaggctggagtacaccaactactccagcctgagcgacagagtaagaccttatcttttaaaaaagaaaagaaaaatttaaacgggtttgatagatataaatttggacccaagagcccttccttttttttaatcctgaggttttatgctgaggaaatttctttcaaatctggaaaacctcggggccaggcgcagtggctcacgcctgtaattccagcactttgggaggccaaggcaggcggttcacgaggtcaggagattgagaccatcctggctaacacagtgaaactccgtctctactaaaaatacaaaaaactagctgggcgtggtggtgggcgcctatagtcccagctactcaggaggctgaggcaggagaatggcatgaacccaggaggcggagcttgcagtgagccgaggtcacgccactgcactccagcctgggcaacaagagcaagactcc

SEQ ID NO: 365825 - DNA, 3472 bp, Homo sapiens
gtaggccctgaggacccagcataggcggactcgggactgctgctaaagtggggttcctgccgttccacttggctgcgggtccgcaaggcccggccccagctcatcctcagccgccggccccgccgccggctcgggagcctgcgctggtgcggtcggcggcgcctacggcggcggttactgcaagcccaggcggccggcgtggactggagggagggagcccgccaggtgtcgcgcgcggcggcggcccggagacccaacaccgcgacccccagcccgatccctagcccgaccccggcctccgaacccgagtccgaacccgaactcgaatccgcctcgagttgccaccggcctctcctcatcccaccggtgcggcccgtgggccccggccgcgcgttgctgctgctgccggtcgagcagggttttacttttagtgggatctgtcgtgtgacttgcctctatggccaggtgcaggtatttggttttaccatcagccaaggccagcctgcccaagacatcttctctgtgtatacccactcttgcttgagtatccatgcacttcactactcacagcctgagaaaagcaagaaggaactgaaaagggaagcccggaatttgctcaaatctcatcttaaccttgatgacaggcgttggtcgatgcagaatttttctcctcagtgttccattgtgttgctagaacatctgaaaactgccactgtaaacttcataaccagctatccgggttcatcctacatttttgtgcaagagagtccaactccccagattaaacctgaatatttagccttgaggtctgttggcatcagaagagagaaaaaaaggaaaggccttcagttaactgagagtaccctttcagccctggaagagttagtcaatgtttcctgtgaagaagtagatggctgccctgtcattctagtttgtggatcccaggatgttggaaagtcaacatttaatagatacctgattaaccatttgttaaatagtcttccctgcgttgactatttggaatgtgatctgggacagacagaatttacccctcctggttgcatttctttgcttaatattacagaaccagttctgggaccacctttcactcacctgaggactccacagaagatggtatattatgggaaaccttcttgtaaaaacaactatgagaattatattgacatagtgaaatatgtgttcagcgcttacaagagagagtcccctctcatcgtcaacactatgggatgggtttcagaccaggggctcctgcttctcattgatctgatccgattgctgtctcccagccacgtggttcagttccgctctgaccacagtaaatatatgccagaccttaccccgcagtatgtagatgacatggatggcttgtacacaaaaagcaagaccaagatgagaaatcgacgtttcagactcgcagcatttgcagatgctttggaatttgctgatgaagaaaaagagagtccagttgagttcactggacataaactgataggtgtttatacagactttgcattcagaataactccaagaaatagagagtcacataacaaaattcttcgagatctgtccatcttgagttaccttagccagctgcagcccccgatgcccaaaccactttctcctttacatagcctgacaccctatcaggtccctttcaatgcagtcgcactccggattacccactctgatgtcgcccctacccatatactatatgctgtaaacgccagctgggttggtctttgcaagatccaggatgacgtcagaggatacacgaatgggcccatcctgcttgcccagactccaatctgtgactgcttgggctttggcatctgtagaggcattgacatggagaagcggctgtaccacatcctcacccctgtgcccccggaagagctaaggaccgtgaattgtctgctcgttggagctattgccattccacattgtgtccttaagtgccagcgtgggatcgaagggacagtaccttatgtcacaacggattacaattttaaacttcctggagcatcagagaaaattggagcaagagaacctgaggaggcacataaagagaaaccataccgaagacctaagttctgtcgaaaaatgaagtgatgctcgcgtttttaataagggaagaaactttcctaccagaaagctttgtctcaagcctgaccacaagagacatgatggagtttcatggccatgaatggtgcccttattaacaacagtgttttttgtgtaattcgtgaatgtcatatagtagtcttaagtttctcttttaaagctgcatgagctagaatttgttctagtcttctgtgtgatactcatacttgctgtccagagggagtaaaacagcagagaacagtttgtgtgccattaaaacagagattcctcagaaagttcttcagggacctggttattagaatcaggataaaaataaggaaactggggccattacaatgtaccgagaaggaaggaagaaggccaacctgcaggatctcaagcataatggatacaagggctcgccacgggccttgcctgagccatgtgcagagctggggtccagcggtctgcttccttggagccagtgtggatggttacagcccatccatttggtgcagttgtacttggtctgttatattcaatcaaggtttaatagatagggctgggcatggtggctcatgcacacctgtaatcccaaagtgctgggattacaggcgtgagccaccgcgcccggcctaggtcatttgtttttgggtttggatggcaagatcatggataagacagcaggctttgattatagagctctgagttcaaatcctggctctaccacttgtcagtggtgtaacttggaggaagatgcttagcctgagcctgttttatgttttgaagattgggtaattgtccttccttcagtgttcctgggtgaggagtaagtgaagtcatgtctataagagatgtagcacagtctccggcatgtagaaatggtcagtaactcctagtgtgtagctagcctctgatgagatggtaaactcaggaggctggcaccacggctgtgctactcacggtcatgctggagggatgcagaaactaaatgaatccacagctacttactcatcttgcctctggcaggttcaccttaaaattgttgctaccaagcttcctgtggtcaaagagcccttgaggaagcaagctccacggccaccatagataacccattcctgaaagtttttcataaacccccacttgttgcttttaaaattttataagcagcttacacatgtagaaaatgatcctccagcccaccaccacatagtaatcactgacactgtgaggtgtctcagctggggttctgctgtgtgtgtgtgtattttacaaaatatgtatggtttctgttcagctcttttcagttaacagatgaacttttgtatcattaaatatttttgaaaacatg

SEQ ID NO: 365826 - DNA, 2669 bp, Homo sapiens
tgaatgtctgtccaccagacccccagaggaagattagtcataattcgagtccaaggaagacggctaattctagcgatcaatgtttgtttcccattcagaagaagtagatggctgccctgtcattctagtttgtggatcccaggatgttggaaagtcaacatttaatagatacctgattaaccatttgttaaatagtcttccctgcgttgactatttggaatgtgatctgggacagacagaatttacccctcctggttgcatttctttgcttaatattacagaaccagttctgggaccacctttcactcacctgaggactccacagaagatggtatattatgggaaaccttcttgtaaaaacaactatgagaattatattgacatagtgaaatatgtgttcagcgcttacaagagagagtcccctctcatcgtcaacactatgggatgggtttcagaccaggggctcctgcttctcattgatctgatccgattgctgtctcccagccacgtggttcagttccgctctgaccacagtaaatatatgccagaccttaccccgcagtatgtagatgacatggatggcttgtacacaaaaagcaagaccaagatgagaaatcgacgtttcagactcgcagcatttgcagatgctttggaatttgctgatgaagaaaaagagagtccagttgagttcactggacataaactgataggtgtttatacagactttgcattcagaataactccaagaaatagagagtcacataacaaaattcttcgagatctgtccatcttgagttaccttagccagctgcagcccccgatgcccaaaccactttctcctttacatagcctgacaccctatcaggtccctttcaatgcagtcgcactccggattacccactctgatgtcgcccctacccatatactatatgctgtaaacgccagctgggttggtctttgcaagatccaggatgacgtcagaggatacacgaatgggcccatcctgcttgcccagactccaatctgtgactgcttgggctttggcatctgtagaggcattgacatggagaagcggctgtaccacatcctcacccctgtgcccccggaagagctaaggaccgtgaattgtctgctcgttggagctattgccattccacattgtgtccttaagtgccagcgtgggatcgaagggacagtaccttatgtcacaacggattacaattttaaacttcctggagcatcagagaaaattggagcaagagaacctgaggaggcacataaagagaaaccataccgaagacctaagttctgtcgaaaaatgaagtgatgctcgcgtttttaataagggaagaaactttcctaccagaaagctttgtctcaagcctgaccacaagagacatgatggagtttcatggccatgaatggtgcccttattaacaacagtgttttttgtgtaattcgtgaatgtcatatagtagtcttaagtttctcttttaaagctgcatgagctagaatttgttctagtcttctgtgtgatactcatacttgctgtccagagggagtaaaacagcagagaacagtttgtgtgccattaaaacagagattcctcagaaagttcttcagggacctggttattagaatcaggataaaaataaggaaactggggccattacaatgtaccgagaaggaaggaagaaggccaacctgcaggatctcaagcataatggatacaagggctcgccacgggccttgcctgagccatgtgcagagctggggtccagcggtctgcttccttggagccagtgtggatggttacagcccatccatttggtgcagttgtacttggtctgttatattcaatcaaggtttaatagatagggctgggcatggtggctcatgcacacctgtaatcccaaagtgctgggattacaggcgtgagccaccgcgcccggcctaggtcatttgtttttgggtttggatggcaagatcatggataagacagcaggctttgattatagagctctgagttcaaatcctggctctaccacttgtcagtggtgtaacttggaggaagatgcttagcctgagcctgttttatgttttgaagattgggtaattgtccttccttcagtgttcctgggtgaggagtaagtgaagtcatgtctataagagatgtagcacagtctccggcatgtagaaatggtcagtaactcctagtgtgtagctagcctctgatgagatggtaaactcaggaggctggcaccacggctgtgctactcacggtcatgctggagggatgcagaaactaaatgaatccacagctacttactcatcttgcctctggcaggttcaccttaaaattgttgctaccaagcttcctgtggtcaaagagcccttgaggaagcaagctccacggccaccatagataacccattcctgaaagtttttcataaacccccacttgttgcttttaaaattttataagcagcttacacatgtagaaaatgatcctccagcccaccaccacatagtaatcactgacactgtgaggtgtctcagctggggttctgctgtgtgtgtgtgtattttacaaaatatgtatggtttctgttcagctcttttcagttaacagatgaacttttgtatcattaaatatttttgaaaacatg

SEQ ID NO: 365827 - DNA, 1678 bp, Homo sapiens
gtaggccctgaggacccagcataggcggactcgggactgctgctaaagtggggttcctgccgttccacttggctgcgggtccgcaaggcccggccccagctcatcctcagccgccggccccgccgccggctcgggagcctgcgctggtgcggtcggcggcgcctacggcggcggttactgcaagcccaggcggccggcgtggactggagggagggagcccgccaggtgtcgcgcgcggcggcggcccggagacccaacaccgcgacccccagcccgatccctagcccgaccccggcctccgaacccgagtccgaacccgaactcgaatccgcctcgagttgccaccggcctctcctcatcccaccggtgcggcccgtgggccccggccgcgcgttgctgctgctgccggtcgagcagggttttacttttagtgggatctgtcgtgtgacttgcctctatggccaggtgcaggtatttggttttaccatcagccaaggccagcctgcccaagacatcttctctgtgtatacccactcttgcttgagtatccatgcacttcactactcacagcctgagaaaagcaagaaggaactgaaaagggaagcccggaatttgctcaaatctcatcttaaccttgatgacaggcgttggtcgatgcagaatttttctcctcagtgttccattgtgttgctagaacatctgaaaactgccactgtaaacttcataaccagctatccgggttcatcctacatttttgtgcaagagagtccaactccccagattaaacctgaatatttagccttgaggtctgttggcatcagaagagagaaaaaaaggaaaggccttcagttaactgagagtaccctttcagccctggaagagttagtcaatgtttcctgtgaagaagtagatggctgccctgtcattctagtttgtggatcccaggatgttggaaagtcaacatttaatagatacctgattaaccatttgttaaatagtcttccctgcgttgactatttggaatgtgatctgggacagacagaatttacccctcctggttgcatttctttgcttaatattacagaaccagttctgggaccacctttcactcacctgaggactccacagaagatggtatattatgggaaaccttcttgtaaaaacaactatgagaattatattgacatagtgaaatatgtgttcagcgcttacaagagagagtcccctctcatcgtcaacactatgggatgggtttcagaccaggggctcctgcttctcattgatctgatccgattgctgtctcccagccacgtggttcagttccgctctgaccacagtaaatatatgccagaccttaccccgcagtatgtagatgacatggatggcttgtacacaaaaagcaagaccaagatgagaaatcgacgtttcagactcgcagcatttgcagatgctttggaatttgctgatgaagaaaaagagagtccagttgagttcactggacataaactgataggtgtttatacagactttgcattcagaataactccaagaaataggtaactaaccctcatttggctgaagaattatttttccttccgtcgaaaaagacctgccattctcaattcctctaaaggcctgagtcctctaagatcttcaggtcctgtcacagctgtgcatg

SEQ ID NO: 365828 - DNA, 3740 bp, Homo sapiens
ttccgcttcgggctcgctgacttccggcttagggccgagggtggggaactgccgggcgcggaagcgatgggcatatctgtggcttattttcagcactgtcgcgcagacagtggcgcgatctcagctcactgcagcccccgcctgccgggctcccaaggtgctgggattacagcagcaccgcggatgtgacgtttggtgttcctgtgaacgtggggcggggcgggtcgtttgcttgctcagtgcctagacgatggtggtggaaagacgcttctgtgggttaggtcctaacggttaggaaggattcacaggcgggtcatgaggaaggagcagacccctcgggcagaagcccgcgaggagcactgggtgtggtgggggcaggggtgcctcctctgtcaagtggagatcggcgcctcgctcgtgcctgcgagtgcgcgccgcgtcgaatacagccgtacagaacgcactacaggaaagtgaagccgggagagagactgggaggcggcgcggggactgggggccgtagacgcctttgctcccgggcacttgttagaagagcgagtggatcgcgcttcctgtgcgtcactgaatcctcatgacggccactgaaacggacacgcaggatctttgcttttcaagagggaactgagtccaggccagactgggttgctcccctttctctcggcccctccacctttgcaagtgctgctccttctgcctggagtggctcctccagtcttttcccggctcacttcccaccgtccggtgtcagcaaaaacagcacttcctcacagcccgttgcagcccagcagtcgccttttgcttcttttgaagcacagccctgtgaccgcctcgtgtccttttgtttttccttgtcccccttcccctctggaacataagctccacaaaggcagggacctgggaatcccgttcgcctgcattccccagcaaacgcctaacgaacccaatggcccaggactgaaaattcctttccacttcggctttcccctctacatcccatcggttctgtggagctcgaggggcgtcactgtgtgtgtggcagggcacggtgggggctgagatcgtttcctgttggaacttctggcccaagaagcgcgggtcacaaggagaggggtcagttcggttcagagcgactcagcccctcgactcgggtcttaaaacctccgagccgccagttctgcctcaggccgcgcccccttaaagcgccaccagacgctgcgccccgttaaagcgccaccagacgccgcgccccgtcccggcctcccccgcgcgctggcgcggggctttctgggccagggcggggccggcgaactgcggcccggaacggctgaggaagggcccgtcccgccttccccggcgcgccatggagccccgggcggttgcagaagccgtggagacgggtgaggaggatgtgattatggaagctctgcggtcatacaaccaggagcactcccagagcttcacgtttgatgatgcccaacaggaggaccggaagagactggcggagctgctggtctccgtcctggaacagggcttgccaccctcccaccgtgtcatctggctgcagagtgtccgaatcctgtcccgggaccgcaactgcctggacccgttcaccagccgccagagcctgcaggcactagcctgctatgctgacatctctgtctctgaggggtccgtcccagagtccgcagacatggatgttgtactggagtccctcaagtgcctgtgcaacctcgtgctcagcagccctgtggcacagatgctggcagcagaggcccgcctagtggtgaagctcacagagcgtgtggggctgtaccgtgagaggagcttcccccacgatgtccagttctttgacttgcggctcctcttcctgctaacggcactccgcaccgatgtgcgccagcagctgtttcaggagctgaaaggagtgcgcctgctaactgacacactggagctgacgctgggggtgactcctgaagggaaccccccacccacgctccttccttcccaagagactgagcgggccatggagatcctcaaagtgctcttcaacatcaccctggactccatcaagggggaggtggacgaggaagacgctgccctttaccgacacctggggacccttctccggcactgtgtgatgatcgctactgctggagaccgcacagaggagttccacggccacgcagtgaacctcctggggaacttgcccctcaagtgtctggatgttctcctcaccctggagccacatggagactccacggagttcatgggagtgaatatggatgtgattcgtgccctcctcatcttcctagagaagcgtttgcacaagacacacaggctgaaggagagtgtagctcccgtgctgagcgtgctgactgaatgtgcccggatgcaccgcccagccaggaagttcctgaaggcccaggtgctgccccctctgcgggatgtgaggacacggcctgaggttggggagatgctgcggaacaagcttgtccgcctcatgacacacctggacacagatgtgaagagggtggctgccgagttcttgtttgtcctgtgctctgagagtgtgccccgattcatcaagtacacaggctatgggaatgctgctggccttctggctgccaggggcctcatggcaggaggccggcccgagggccagtactcagaggatgaggacacagacacagatgagtacaaggaagccaaagccagcataaaccctgtgaccgggagggtggaggagaagccgcctaaccctatggagggcatgacagaggagcagaaggagcacgaggccatgaagctggtgaccatgtttgacaagctctccaggaacagagtcatccagccaatggggatgagtccccggggtcatcttacgtccctgcaggatgccatgtgcgagactatggagcagcagctctcctcggaccctgactcggaccctgactgaggatggcagctcttctgctcccccatcaggactggtgctgcttccagagacttccttggggttgcaacctggggaagccacatcccactggatccacacccgcccccacttctccatcttagaaaccccttctcttgactcccgttctgttcatgatttgcctctggtccagtttctcatctctggactgcaacggtcttcttgtgctagaactcaggctcagcctcgaattccacagacgaagtactttcttttgtctgcgccaagaggaatgtgttcagaagctgctgcctgagggcagggcctacctgggcacacagaagagcatatgggagggcaggggtttgggtgtgggtgcacacaaagcaagcaccatctgggattggcacactggcagagccagtgtgttggggtatgtgctgcacttcccagggagaaaacctgtcagaactttccatacgagtatatcagaacacacccttccaaggtatgtatgctctgttgttcctgtcctgtcttcactgagcgcagggctggaggcctcttagacattctccttggtcctcgttcagctgcccactgtagtatccacagtgcccgagttctcgctggttttggcaattaaacctccttcctactggtttagactacacttacaacaaggaaaatgcccctcgtgtgaccatagattgagatttataccacataccacacatagccacagaaacatcatcttgaaataaagaagagttttggacaaaaa

SEQ ID NO: 365829 - DNA, 510 bp, Homo sapiens
gtgtcatcacggaggcggtatcacagtgatattggagtattggagtagagccacggcctcgccatgtggttaggggctggtctctaattccggacctcaagtgagtggcgtggcttcagcctcccaagagtgctgggattacaggcgtgagtcaccacacccggccggtactttccttttaaagagaaaatctcattaaaatattaagagcctcatcactttggagtaatttctggcatatacagatgcaaagcaaaaagaaaacaaaatcccagctacccaggagaatcgcttaaacccgggaggcggaagttgcagtgagctgagatcgtaacaccgcactccaccctgagtgacagggcaagactcaaaaaataaaaaaggaacattaactagggttagaaactaacttcattctttttagaattcaacagttttcctaggtcaccaattccaccttttgttcttattaaggcgcaaagtcacaggacccccttcctgggagtcact

SEQ ID NO: 365830 - DNA, 3836 bp, Homo sapiens
ttccgcttcgggctcgctgacttccggcttagggccgagggtggggaactgccgggcgcggaagcgatgggcatatctgtggcttattttcagcactgtcgcgcagacagtggcgcgatctcagctcactgcagcccccgcctgccgggctcccaaggtgctgggattacagcagcaccgcggatgtgacgtttggtgttcctgtgaacgtggggcggggcgggtcgtttgcttgctcagtgcctagacgatggtggtggaaagacgcttctgtgggttaggtcctaacggttaggaaggattcacaggcgggtcatgaggaaggagcagacccctcgggcagaagcccgcgaggagcactgggtgtggtgggggcaggggtgcctcctctgtcaagtggagatcggcgcctcgctcgtgcctgcgagtgcgcgccgcgtcgaatacagccgtacagaacgcactacaggaaagtgaagccgggagagagactgggaggcggcgcggggactgggggccgtagacgcctttgctcccgggcacttgttagaagagcgagtggatcgcgcttcctgtgcgtcactgaatcctcatgacggccactgaaacggacacgcaggatctttgcttttcaagagggaactgagtccaggccagactgggttgctcccctttctctcggcccctccacctttgcaagtgctgctccttctgcctggagtggctcctccagtcttttcccggctcacttcccaccgtccggtgtcagcaaaaacagcacttcctcacagcccgttgcagcccagcagtcgccttttgcttcttttgaagcacagccctgtgaccgcctcgtgtccttttgtttttccttgtcccccttcccctctggaacataagctccacaaaggcagggacctgggaatcccgttcgcctgcattccccagcaaacgcctaacgaacccaatggcccaggactgaaaattcctttccacttcggctttcccctctacatcccatcggttctgtggagctcgaggggcgtcactgtgtgtgtggcagggcacggtgggggctgagatcgtttcctgttggaacttctggcccaagaagcgcgggtcacaaggagaggggtcagttcggttcagagcgactcagcccctcgactcgggtcttaaaacctccgagccgccagttctgcctcaggccgcgcccccttaaagcgccaccagacgctgcgccccgttaaagcgccaccagacgccgcgccccgtcccggcctcccccgcgcgctggcgcggggctttctgggccagggcggggccggcgaactgcggcccggaacggctgaggaagggcccgtcccgccttccccggcgcgccatggagccccgggcggttgcagaagccgtggagacgggtgaggaggatgtgattatggaagctctgcggtcatacaaccaggagtggctgctgcctgagttagaggccaataggccgcccgcatcagcggacgcggatcctacccctctgtggatttgaattcactagttctctctgcagcactcccagagcttcacgtttgatgatgcccaacaggaggaccggaagagactggcggagctgctggtctccgtcctggaacagggcttgccaccctcccaccgtgtcatctggctgcagagtgtccgaatcctgtcccgggaccgcaactgcctggacccgttcaccagccgccagagcctgcaggcactagcctgctatgctgacatctctgtctctgaggggtccgtcccagagtccgcagacatggatgttgtactggagtccctcaagtgcctgtgcaacctcgtgctcagcagccctgtggcacagatgctggcagcagaggcccgcctagtggtgaagctcacagagcgtgtggggctgtaccgtgagaggagcttcccccacgatgtccagttctttgacttgcggctcctcttcctgctaacggcactccgcaccgatgtgcgccagcagctgtttcaggagctgaaaggagtgcgcctgctaactgacacactggagctgacgctgggggtgactcctgaagggaaccccccacccacgctccttccttcccaagagactgagcgggccatggagatcctcaaagtgctcttcaacatcaccctggactccatcaagggggaggtggacgaggaagacgctgccctttaccgacacctggggacccttctccggcactgtgtgatgatcgctactgctggagaccgcacagaggagttccacggccacgcagtgaacctcctggggaacttgcccctcaagtgtctggatgttctcctcaccctggagccacatggagactccacggagttcatgggagtgaatatggatgtgattcgtgccctcctcatcttcctagagaagcgtttgcacaagacacacaggctgaaggagagtgtagctcccgtgctgagcgtgctgactgaatgtgcccggatgcaccgcccagccaggaagttcctgaaggcccaggtgctgccccctctgcgggatgtgaggacacggcctgaggttggggagatgctgcggaacaagcttgtccgcctcatgacacacctggacacagatgtgaagagggtggctgccgagttcttgtttgtcctgtgctctgagagtgtgccccgattcatcaagtacacaggctatgggaatgctgctggccttctggctgccaggggcctcatggcaggaggccggcccgagggccagtactcagaggatgaggacacagacacagatgagtacaaggaagccaaagccagcataaaccctgtgaccgggagggtggaggagaagccgcctaaccctatggagggcatgacagaggagcagaaggagcacgaggccatgaagctggtgaccatgtttgacaagctctccaggaacagagtcatccagccaatggggatgagtccccggggtcatcttacgtccctgcaggatgccatgtgcgagactatggagcagcagctctcctcggaccctgactcggaccctgactgaggatggcagctcttctgctcccccatcaggactggtgctgcttccagagacttccttggggttgcaacctggggaagccacatcccactggatccacacccgcccccacttctccatcttagaaaccccttctcttgactcccgttctgttcatgatttgcctctggtccagtttctcatctctggactgcaacggtcttcttgtgctagaactcaggctcagcctcgaattccacagacgaagtactttcttttgtctgcgccaagaggaatgtgttcagaagctgctgcctgagggcagggcctacctgggcacacagaagagcatatgggagggcaggggtttgggtgtgggtgcacacaaagcaagcaccatctgggattggcacactggcagagccagtgtgttggggtatgtgctgcacttcccagggagaaaacctgtcagaactttccatacgagtatatcagaacacacccttccaaggtatgtatgctctgttgttcctgtcctgtcttcactgagcgcagggctggaggcctcttagacattctccttggtcctcgttcagctgcccactgtagtatccacagtgcccgagttctcgctggttttggcaattaaacctccttcctactggtttagactacacttacaacaaggaaaatgcccctcgtgtgaccatagattgagatttataccacataccacacatagccacagaaacatcatcttgaaataaagaagagttttggacaaaaa

SEQ ID NO: 365831 - DNA, 3758 bp, Homo sapiens
ttccgcttcgggctcgctgacttccggcttagggccgagggtggggaactgccgggcgcggaagcgatgggcatatctgtggcttattttcagcactgtcgcgcagacagtggcgcgatctcagctcactgcagcccccgcctgccgggctcccaaggtgctgggattacagcagcaccgcggatgtgacgtttggtgttcctgtgaacgtggggcggggcgggtcgtttgcttgctcagtgcctagacgatggtggtggaaagacgcttctgtgggttaggtcctaacggttaggaaggattcacaggcgggtcatgaggaaggagcagacccctcgggcagaagcccgcgaggagcactgggtgtggtgggggcaggggtgcctcctctgtcaagtggagatcggcgcctcgctcgtgcctgcgagtgcgcgccgcgtcgaatacagccgtacagaacgcactacaggaaagtgaagccgggagagagactgggaggcggcgcggggactgggggccgtagacgcctttgctcccgggcacttgttagaagagcgagtggatcgcgcttcctgtgcgtcactgaatcctcatgacggccactgaaacggacacgcaggatctttgcttttcaagagggaactgagtccaggccagactgggttgctcccctttctctcggcccctccacctttgcaagtgctgctccttctgcctggagtggctcctccagtcttttcccggctcacttcccaccgtccggtgtcagcaaaaacagcacttcctcacagcccgttgcagcccagcagtcgccttttgcttcttttgaagcacagccctgtgaccgcctcgtgtccttttgtttttccttgtcccccttcccctctggaacataagctccacaaaggcagggacctgggaatcccgttcgcctgcattccccagcaaacgcctaacgaacccaatggcccaggactgaaaattcctttccacttcggctttcccctctacatcccatcggttctgtggagctcgaggggcgtcactgtgtgtgtggcagggcacggtgggggctgagatcgtttcctgttggaacttctggcccaagaagcgcgggtcacaaggagaggggtcagttcggttcagagcgactcagcccctcgactcgggtcttaaaacctccgagccgccagttctgcctcaggccgcgcccccttaaagcgccaccagacgctgcgccccgttaaagcgccaccagacgccgcgccccgtcccggcctcccccgcgcgctggcgcggggctttctgggccagggcggggccggcgaactgcggcccggaacggctgaggaagggcccgtcccgccttccccggcgcgccatggagccccgggcggttgcagaagccgtggagacgggtgaggaggatgtgattatggaagctctgcggtcatacaaccaggagcactcccagagcttcacgtttgatgatgcccaacaggaggaccggaagagactggcggagctgctggtctccgtcctggaacagggcttgccaccctcccaccgtgtcatctggctgcagagtgtccgaatcctgtcccgggaccgcaactgcctggacccgttcaccagccgccagagcctgcaggcactagcctgctatgctgacatctctgtctctgaggggtccgtcccagagtccgcagacatggatgttgtactggagtccctcaagtgcctgtgcaacctcgtgctcagcagccctgtggcacagatgctggcagcagaggcccgcctagtggtgaagctcacagagcgtgtggggctgtaccgtgagaggagcttcccccacgatgtccagttctttgacttgcggctcctcttcctgctaacggcactccgcaccgatgtgcgccagcagctgtttcaggagctgaaaggagtgcgcctgctaactgacacactggagctgacgctgggggtgactcctgaagggaaccccccacccacgctccttccttcccaagagactgagcgggccatggagatcctcaaagtgctcttcaacatcaccctggactccatcaagggggaggtggacgaggaagacgctgccctttaccgacacctggggacccttctccggcactgtgtgatgatcgctactgctggagaccgcacagaggagttccacggccacgcagtgaacctcctggggaacttgcccctcaagtgtctggatgttctcctcaccctggagccacatggagactccacggagttcatgggagtgaatatggatgtgattcgtgccctcctcatcttcctagagaagcgtttgcacaagacacacaggctgaaggagagtgtagctcccgtgctgagcgtgctgactgaatgtgcccggatgcaccgcccagccaggaagttcctgaaggcccagggatggccacctccccaggtgctgccccctctgcgggatgtgaggacacggcctgaggttggggagatgctgcggaacaagcttgtccgcctcatgacacacctggacacagatgtgaagagggtggctgccgagttcttgtttgtcctgtgctctgagagtgtgccccgattcatcaagtacacaggctatgggaatgctgctggccttctggctgccaggggcctcatggcaggaggccggcccgagggccagtactcagaggatgaggacacagacacagatgagtacaaggaagccaaagccagcataaaccctgtgaccgggagggtggaggagaagccgcctaaccctatggagggcatgacagaggagcagaaggagcacgaggccatgaagctggtgaccatgtttgacaagctctccaggaacagagtcatccagccaatggggatgagtccccggggtcatcttacgtccctgcaggatgccatgtgcgagactatggagcagcagctctcctcggaccctgactcggaccctgactgaggatggcagctcttctgctcccccatcaggactggtgctgcttccagagacttccttggggttgcaacctggggaagccacatcccactggatccacacccgcccccacttctccatcttagaaaccccttctcttgactcccgttctgttcatgatttgcctctggtccagtttctcatctctggactgcaacggtcttcttgtgctagaactcaggctcagcctcgaattccacagacgaagtactttcttttgtctgcgccaagaggaatgtgttcagaagctgctgcctgagggcagggcctacctgggcacacagaagagcatatgggagggcaggggtttgggtgtgggtgcacacaaagcaagcaccatctgggattggcacactggcagagccagtgtgttggggtatgtgctgcacttcccagggagaaaacctgtcagaactttccatacgagtatatcagaacacacccttccaaggtatgtatgctctgttgttcctgtcctgtcttcactgagcgcagggctggaggcctcttagacattctccttggtcctcgttcagctgcccactgtagtatccacagtgcccgagttctcgctggttttggcaattaaacctccttcctactggtttagactacacttacaacaaggaaaatgcccctcgtgtgaccatagattgagatttataccacataccacacatagccacagaaacatcatcttgaaataaagaagagttttggacaaaaa

SEQ ID NO: 365832 - DNA, 2210 bp, Homo sapiens
  misc_feature (10)..(10): n is a, c, g, or t
cggaggaacnaccaaacttaggctaggtacgaggctgcgtgtcatctggctgcagagtgtccgaatcctgtcccgggaccgcaactgcctggacccgttcaccagccgccagagcctgcaggcactagcctgctatgctgacatctctgtctctgaggggtccgtcccagagtccgcagacatggatgttgtactggagtccctcaagtgcctgtgcaacctcgtgctcagcagccctgtggcacagatgctggcagcagaggcccgcctagtggtgaagctcacagagcgtgtggggctgtaccgtgagaggagcttcccccacgatgtccagttctttgacttgcggctcctcttcctgctaacggcactccgcaccgatgtgcgccagcagctgtttcaggagctgaaaggagtgcgcctgctaactgacacactggagctgacgctgggggtgactcctgaagggaaccccccacccacgctccttccttcccaagagactgagcgggccatggagatcctcaaagtgctcttcaacatcaccctggactccatcaagggggaggtggacgaggaagacgctgccctttaccgacacctggggacccttctccggcactgtgtgatgatcgctactgctggagaccgcacagaggagttccacggccacgcagtgaacctcctggggaacttgcccctcaagtgtctggatgttctcctcaccctggagccacatggagactccacggagttcatgggagtgaatatggatgtgattcgtgccctcctcatcttcctagagaagcgtttgcacaagacacacaggctgaaggagagtgtagctcccgtgctgagcgtgctgactgaatgtgcccggatgcaccgcccagccaggaagttcctgaaggcccaggtgctgccccctctgcgggatgtgaggacacggcctgaggttggggagatgctgcggaacaagcttgtccgcctcatgacacacctggacacagatgtgaagagggtggctgccgagttcttgtttgtcctgtgctctgagagtgtgccccgattcatcaagtacacaggctatgggaatgctgctggccttctggctgccaggggcctcatggcaggaggccggcccgagggccagtactcagaggatgaggacacagacacagatgagtacaaggaagccaaagccagcataaaccctgtgaccgggagggtggaggagaagccgcctaaccctatggagggcatgacagaggagcagaaggagcacgaggccatgaagctggtgaccatgtttgacaagctctccaggaacagagtcatccagccaatggggatgagtccccggggtcatcttacgtccctgcaggatgccatgtgcgagactatggagcagcagctctcctcggaccctgactcggaccctgactgaggatggcagctcttctgctcccccatcaggactggtgctgcttccagagacttccttggggttgcaacctggggaagccacatcccactggatccacacccgcccccacttctccatcttagaaaccccttctcttgactcccgttctgttcatgatttgcctctggtccagtttctcatctctggactgcaacggtcttcttgtgctagaactcaggctcagcctcgaattccacagacgaagtactttcttttgtctgcgccaagaggaatgtgttcagaagctgctgcctgagggcagggcctacctgggcacacagaagagcatatgggagggcaggggtttgggtgtgggtgcacacaaagcaagcaccatctgggattggcacactggcagagccagtgtgttggggtatgtgctgcacttcccagggagaaaacctgtcagaactttccatacgagtatatcagaacacacccttccaaggtatgtatgctctgttgttcctgtcctgtcttcactgagcgcagggctggaggcctcttagacattctccttggtcctcgttcagctgcccactgtagtatccacagtgcccgagttctcgctggttttggcaattaaacctccttcctactggtttagactacacttacaacaaggaaaatgcccctcgtgtgaccatagattgagatttataccacataccacacatagccacagaaacatcatcttgaaataaagaagagttttggacaaaaa

SEQ ID NO: 365833 - DNA, 3817 bp, Homo sapiens
ttccgcttcgggctcgctgacttccggcttagggccgagggtggggaactgccgggcgcggaagcgatgggcatatctgtggcttattttcagcactgtcgcgcagacagtggcgcgatctcagctcactgcagcccccgcctgccgggctcccaaggtgctgggattacagcagcaccgcggatgtgacgtttggtgttcctgtgaacgtggggcggggcgggtcgtttgcttgctcagtgcctagacgatggtggtggaaagacgcttctgtgggttaggtcctaacggttaggaaggattcacaggcgggtcatgaggaaggagcagacccctcgggcagaagcccgcgaggagcactgggtgtggtgggggcaggggtgcctcctctgtcaagtggagatcggcgcctcgctcgtgcctgcgagtgcgcgccgcgtcgaatacagccgtacagaacgcactacaggaaagtgaagccgggagagagactgggaggcggcgcggggactgggggccgtagacgcctttgctcccgggcacttgttagaagagcgagtggatcgcgcttcctgtgcgtcactgaatcctcatgacggccactgaaacggacacgcaggatctttgcttttcaagagggaactgagtccaggccagactgggttgctcccctttctctcggcccctccacctttgcaagtgctgctccttctgcctggagtggctcctccagtcttttcccggctcacttcccaccgtccggtgtcagcaaaaacagcacttcctcacagcccgttgcagcccagcagtcgccttttgcttcttttgaagcacagccctgtgaccgcctcgtgtccttttgtttttccttgtcccccttcccctctggaacataagctccacaaaggcagggacctgggaatcccgttcgcctgcattccccagcaaacgcctaacgaacccaatggcccaggactgaaaattcctttccacttcggctttcccctctacatcccatcggttctgtggagctcgaggggcgtcactgtgtgtgtggcagggcacggtgggggctgagatcgtttcctgttggaacttctggcccaagaagcgcgggtcacaaggagaggggtcagttcggttcagagcgactcagcccctcgactcgggtcttaaaacctccgagccgccagttctgcctcaggccgcgcccccttaaagcgccaccagacgctgcgccccgttaaagcgccaccagacgccgcgccccgtcccggcctcccccgcgcgctggcgcggggctttctgggccagggcggggccggcgaactgcggcccggaacggctgaggaagggcccgtcccgccttccccggcgcgccatggagccccgggcggttgcagaagccgtggagacgggtgaggaggatgtgattatggaagctctgcggtcatacaaccaggagcactcccagagcttcacgtttgatgatgcccaacaggaggaccggaagagactggcggagctgctggtctccgtcctggaacagggcttgccaccctcccaccgtgtcatctggctgcagagtgtccgaatcctgtcccgggaccgcaactgcctggacccgttcaccagccgccagagcctgcaggcactagcctgctatgctgacatctctgtctctgaggggtccgtcccagagtccgcagacatggatgttgtactggagtccctcaagtgcctgtgcaacctcgtgctcagcagccctgtggcacagatgctggcagcagaggcccgcctagtggtgaagctcacagagcgtgtggggctgtaccgtgagaggagcttcccccacgatgtccagttctttgacttgcggctcctcttcctgctaacggcactccgcaccgatgtgcgccagcagctgtttcaggagctgaaaggagtgcgcctgctaactgacacactggagctgacgctgggggtgactcctgaagggaaccccccacccacgctccttccttcccaagagactgagcgggccatggagatcctcaaagtgctcttcaacatcaccctggactccatcaagggggaggtggacgaggaagacgctgccctttaccgacacctggggacccttctccggcactgtgtgatgatcgctactgctggagaccgcacagaggagttccacggccacgcagtgaacctcctggggaacttgcccctcaagtgtctggatgttctcctcaccctggagccacatggagactccacggagttcatgggagtgaatatggatgtgattcgtgccctcctcatcttcctagagaagcgtttgcacaagacacacaggctgaaggagagtgtagctcccgtgctgagcgtgctgactgaatgtgcccggatgcaccgcccagccaggaagttcctgaaggcccaggtgctgccccctctgcgggatgtgaggacacggcctgaggttggggagatgctgcggaacaagcttgtccgcctcatgacacacctggacacagatgtgaagagggtggctgccgagttcttgtttgtcctgtgctctgagagtggtgagttatggagacccaggtcccagcccaccccacctcagccaggcttgcacactgacctctgccttgcccctcagtgccccgattcatcaagtacacaggctatgggaatgctgctggccttctggctgccaggggcctcatggcaggaggccggcccgagggccagtactcagaggatgaggacacagacacagatgagtacaaggaagccaaagccagcataaaccctgtgaccgggagggtggaggagaagccgcctaaccctatggagggcatgacagaggagcagaaggagcacgaggccatgaagctggtgaccatgtttgacaagctctccaggaacagagtcatccagccaatggggatgagtccccggggtcatcttacgtccctgcaggatgccatgtgcgagactatggagcagcagctctcctcggaccctgactcggaccctgactgaggatggcagctcttctgctcccccatcaggactggtgctgcttccagagacttccttggggttgcaacctggggaagccacatcccactggatccacacccgcccccacttctccatcttagaaaccccttctcttgactcccgttctgttcatgatttgcctctggtccagtttctcatctctggactgcaacggtcttcttgtgctagaactcaggctcagcctcgaattccacagacgaagtactttcttttgtctgcgccaagaggaatgtgttcagaagctgctgcctgagggcagggcctacctgggcacacagaagagcatatgggagggcaggggtttgggtgtgggtgcacacaaagcaagcaccatctgggattggcacactggcagagccagtgtgttggggtatgtgctgcacttcccagggagaaaacctgtcagaactttccatacgagtatatcagaacacacccttccaaggtatgtatgctctgttgttcctgtcctgtcttcactgagcgcagggctggaggcctcttagacattctccttggtcctcgttcagctgcccactgtagtatccacagtgcccgagttctcgctggttttggcaattaaacctccttcctactggtttagactacacttacaacaaggaaaatgcccctcgtgtgaccatagattgagatttataccacataccacacatagccacagaaacatcatcttgaaataaagaagagttttggacaaaaa

SEQ ID NO: 365834 - DNA, 4170 bp, Homo sapiens
ttccgcttcgggctcgctgacttccggcttagggccgagggtggggaactgccgggcgcggaagcgatgggcatatctgtggcttattttcagcactgtcgcgcagacagtggcgcgatctcagctcactgcagcccccgcctgccgggctcccaaggtgctgggattacagcagcaccgcggatgtgacgtttggtgttcctgtgaacgtggggcggggcgggtcgtttgcttgctcagtgcctagacgatggtggtggaaagacgcttctgtgggttaggtcctaacggttaggaaggattcacaggcgggtcatgaggaaggagcagacccctcgggcagaagcccgcgaggagcactgggtgtggtgggggcaggggtgcctcctctgtcaagtggagatcggcgcctcgctcgtgcctgcgagtgcgcgccgcgtcgaatacagccgtacagaacgcactacaggaaagtgaagccgggagagagactgggaggcggcgcggggactgggggccgtagacgcctttgctcccgggcacttgttagaagagcgagtggatcgcgcttcctgtgcgtcactgaatcctcatgacggccactgaaacggacacgcaggatctttgcttttcaagagggaactgagtccaggccagactgggttgctcccctttctctcggcccctccacctttgcaagtgctgctccttctgcctggagtggctcctccagtcttttcccggctcacttcccaccgtccggtgtcagcaaaaacagcacttcctcacagcccgttgcagcccagcagtcgccttttgcttcttttgaagcacagccctgtgaccgcctcgtgtccttttgtttttccttgtcccccttcccctctggaacataagctccacaaaggcagggacctgggaatcccgttcgcctgcattccccagcaaacgcctaacgaacccaatggcccaggactgaaaattcctttccacttcggctttcccctctacatcccatcggttctgtggagctcgaggggcgtcactgtgtgtgtggcagggcacggtgggggctgagatcgtttcctgttggaacttctggcccaagaagcgcgggtcacaaggagaggggtcagttcggttcagagcgactcagcccctcgactcgggtcttaaaacctccgagccgccagttctgcctcaggccgcgcccccttaaagcgccaccagacgctgcgccccgttaaagcgccaccagacgccgcgccccgtcccggcctcccccgcgcgctggcgcggggctttctgggccagggcggggccggcgaactgcggcccggaacggctgaggaagggcccgtcccgccttccccggcgcgccatggagccccgggcggttgcagaagccgtggagacgggtgaggaggatgtgattatggaagctctgcggtcatacaaccaggagcactcccagagcttcacgtttgatgatgcccaacaggaggaccggaagagactggcggagctgctggtctccgtcctggaacagggcttgccaccctcccaccgtgtcatctggctgcagagtgtccgaatcctgtcccgggaccgcaactgcctggacccgttcaccagccgccagagcctgcaggcactagcctgctatgctgacatctctgtctctgaggggtccgtcccagagtccgcagacatggatgttgtactggagtccctcaagtgcctgtgcaacctcgtgctcagcagccctgtggcacagatgctggcagcagaggcccgcctagtggtgaagctcacagagcgtgtggggctgtaccgtgagaggagcttcccccacgatgtccagttctttgacttgcggctcctcttcctgctaacggcactccgcaccgatgtgcgccagcagctgtttcaggagctgaaaggagtgcgcctgctaactgacacactggagctgacgctgggggtgactcctgaagggaaccccccacccacgctccttccttcccaagagactgagcgggccatggagatcctcaaagtgctcttcaacatcaccctggactccatcaagggggaggtggacgaggaagacgctgccctttaccgacacctggggacccttctccggcactgtgtgatgatcgctactgctggagaccgcacagaggagttccacggccacgcagtgaacctcctggggaacttgcccctcaagtgtctggatgttctcctcaccctggagccacatggagactccacggagttcatgggagtgaatatggatgtgattcgtgccctcctcatcttcctagagaagcgtttgcacaagacacacaggctgaaggagagtgtagctcccgtgctgagcgtgctgactgaatgtgcccggatgcaccgcccagccaggaagttcctgaaggcccaggtgctgccccctctgcgggatgtgaggacacggcctgaggttggggagatgctgcggaacaagcttgtccgcctcatgacacacctggacacagatgtgaagagggtggctgccgagttcttgtttgtcctgtgctctgagagtgtgccccgattcatcaagtacacaggctatgggaatgctgctggccttctggctgccaggggcctcatggcaggaggccggcccgagggccagtactcagaggatgaggacacagacacagatgagtacaaggaagccaaagccagcataaaccctgtgaccgggagggtggaggagaagccgcctaaccctatggagggcatgacagaggagcagaaggagcacgaggccatgaagctggtgaccatgtttgacaagctctccaggaacagagtcatccagccaatggggatgagtccccggggtcatcttacgtccctgcaggatgccatgtgcgagactatggagcagcagctctcctcggaccctgactcggaccctgactgaggatggcagctcttctgctcccccatcaggactggtgctgcttccagagacttccttggggttgcaacctggggaagccacatcccactggatccacacccgcccccacttctccatcttagaaaccccttctcttgactcccgttctgttcatgatttgcctctggtccagtttctcatctctggactgcaacggtcttcttgtgctagaactcaggctcagcctcgaattccacagacgaagtactttcttttgtctgcgccaagaggaatgtgttcagaagctgctgcctgagggcagggcctacctgggcacacagaagagcatatgggagggcaggggtttgggtgtgggtgcacacaaagcaagcaccatctgggattggcacactggcagagccagtgtgttggggtatgtgctgcacttcccagggagaaaacctgtcagaactttccatacgagtatatcagaacacacccttccaaggtatgtatgctctgttgttcctgtcctgtcttcactgagcgcagggctggaggcctcttagacattctccttggtcctcgttcagctgcccactgtagtatccacagtgcccgagttctcgctggttttggcaattaaacctccttcctactggtttagactacacttacaacaaggaaaatgcccctcgtgtgaccatagattgagatttataccacataccacacatagccacagaaacatcatcttgaaataaagaagagttttggacaaaaatgtatgtgtaaattatcaaataaaggggccaggcacagtggctcatgcctgtaatcccagcactttgggaggccgaggtgggtggatcacttgaagccaggagttcgagaccagcctggccaacatagcaaaaccttgtctctattacaaatatgcccatgtgctaggtgtggtgggacacacctgtaatcccagctacccaggagaatcgcttaaacccgggaggcggaagttgcagtgagctgagatcgtaacaccgcactccaccctgagtgacagggcaagactcaaaaaataaaaaaggaacattaactagggttagaaactaacttcattctttttagaattcaacagttttcctaggtcaccaattccaccttttgttcttattaaggcgcaaagtcacaggacccccttcctgggagtcact

SEQ ID NO: 365835 - DNA, 1513 bp, Homo sapiens
tattgctcaaggctgttctagaggatcccagtgtgagcctactttaactccacggagttcatgggagtgaatatggatgtgattcgtgccctcctcatcttcctagagaagcgtttgcacaagacacacaggctgaaggagagtgtagctcccgtgctgagcgtgctgactgaatgtgcccggatgcaccgcccagccaggaagttcctgaaggcccaggtgctgccccctctgcgggatgtgaggacacggcctgaggttggggagatgctgcggaacaagcttgtccgcctcatgacacacctggacacagatgtgaagagggtggctgccgagttcttgtttgtcctgtgctctgagagtgtgccccgattcatcaagtacacaggctatgggaatgctgctggccttctggctgccaggggcctcatggcaggaggccggcccgagggccagtactcagaggatgaggacacagacacagatgagtacaaggaagccaaagccagcataaaccctgtgaccgggagggtggaggagaagccgcctaaccctatggagggcatgacagaggagcagaaggagcacgaggccatgaagctggtgaccatgtttgacaagctctccaggaacagagtcatccagccaatggggatgagtccccggggtcatcttacgtccctgcaggatgccatgtgcgagactatggagcagcagctctcctcggaccctgactcggaccctgactgaggatggcagctcttctgctcccccatcaggactggtgctgcttccagagacttccttggggttgcaacctggggaagccacatcccactggatccacacccgcccccacttctccatcttagaaaccccttctcttgactcccgttctgttcatgatttgcctctggtccagtttctcatctctggactgcaacggtcttcttgtgctagaactcaggctcagcctcgaattccacagacgaagtactttcttttgtctgcgccaagaggaatgtgttcagaagctgctgcctgagggcagggcctacctgggcacacagaagagcatatgggagggcaggggtttgggtgtgggtgcacacaaagcaagcaccatctgggattggcacactggcagagccagtgtgttggggtatgtgctgcacttcccagggagaaaacctgtcagaactttccatacgagtatatcagaacacacccttccaaggtatgtatgctctgttgttcctgtcctgtcttcactgagcgcagggctggaggcctcttagacattctccttggtcctcgttcagctgcccactgtagtatccacagtgcccgagttctcgctggttttggcaattaaacctccttcctactggtttagactacacttacaacaaggaaaatgcccctcgtgtgaccatagattgagatttataccacataccacacatagccacagaaacatcatcttgaaataaagaagagttttggacaaaaa

SEQ ID NO: 365836 - DNA, 2543 bp, Homo sapiens
ttccgcttcgggctcgctgacttccggcttagggccgagggtggggaactgccgggcgcggaagcgatgggcatatctgtggcttattttcagcactgtcgcgcagacagtggcgcgatctcagctcactgcagcccccgcctgccgggctcccaaggtgctgggattacagcagcaccgcggatgtgacgtttggtgttcctgtgaacgtggggcggggcgggtcgtttgcttgctcagtgcctagacgatggtggtggaaagacgcttctgtgggttaggtcctaacggttaggaaggattcacaggcgggtcatgaggaaggagcagacccctcgggcagaagcccgcgaggagcactgggtgtggtgggggcaggggtgcctcctctgtcaagtggagatcggcgcctcgctcgtgcctgcgagtgcgcgccgcgtcgaatacagccgtacagaacgcactacaggaaagtgaagccgggagagagactgggaggcggcgcggggactgggggccgtagacgcctttgctcccgggcacttgttagaagagcgagtggatcgcgcttcctgtgcgtcactgaatcctcatgacggccactgaaacggacacgcaggatctttgcttttcaagagggaactgagtccaggccagactgggttgctcccctttctctcggcccctccacctttgcaagtgctgctccttctgcctggagtggctcctccagtcttttcccggctcacttcccaccgtccggtgtcagcaaaaacagcacttcctcacagcccgttgcagcccagcagtcgccttttgcttcttttgaagcacagccctgtgaccgcctcgtgtccttttgtttttccttgtcccccttcccctctggaacataagctccacaaaggcagggacctgggaatcccgttcgcctgcattccccagcaaacgcctaacgaacccaatggcccaggactgaaaattcctttccacttcggctttcccctctacatcccatcggttctgtggagctcgaggggcgtcactgtgtgtgtggcagggcacggtgggggctgagatcgtttcctgttggaacttctggcccaagaagcgcgggtcacaaggagaggggtcagttcggttcagagcgactcagcccctcgactcgggtcttaaaacctccgagccgccagttctgcctcaggccgcgcccccttaaagcgccaccagacgctgcgccccgttaaagcgccaccagacgccgcgccccgtcccggcctcccccgcgcgctggcgcggggctttctgggccagggcggggccggcgaactgcggcccggaacggctgaggaagggcccgtcccgccttccccggcgcgccatggagccccgggcggttgcagaagccgtggagacgggtgaggaggatgtgattatggaagctctgcggtcatacaaccaggagcactcccagagcttcacgtttgatgatgcccaacaggaggaccggaagagactggcggagctgctggtctccgtcctggaacagggcttgccaccctcccaccgtgtcatctggctgcagagtgtccgaatcctgtcccgggaccgcaactgcctggacccgttcaccagccgccagagcctgcaggcactagcgaacagagtcatccagccaatggggatgagtccccggggtcatcttacgtccctgcaggatgccatgtgcgagactatggagcagcagctctcctcggaccctgactcggaccctgactgaggatggcagctcttctgctcccccatcaggactggtgctgcttccagagacttccttggggttgcaacctggggaagccacatcccactggatccacacccgcccccacttctccatcttagaaaccccttctcttgactcccgttctgttcatgatttgcctctggtccagtttctcatctctggactgcaacggtcttcttgtgctagaactcaggctcagcctcgaattccacagacgaagtactttcttttgtctgcgccaagaggaatgtgttcagaagctgctgcctgagggcagggcctacctgggcacacagaagagcatatgggagggcaggggtttgggtgtgggtgcacacaaagcaagcaccatctgggattggcacactggcagagccagtgtgttggggtatgtgctgcacttcccagggagaaaacctgtcagaactttccatacgagtatatcagaacacacccttccaaggtatgtatgctctgttgttcctgtcctgtcttcactgagcgcagggctggaggcctcttagacattctccttggtcctcgttcagctgcccactgtagtatccacagtgcccgagttctcgctggttttggcaattaaacctccttcctactggtttagactacacttacaacaaggaaaatgcccctcgtgtgaccatagattgagatttataccacataccacacatagccacagaaacatcatcttgaaataaagaagagttttggacaaaaa

SEQ ID NO: 365837 - DNA, 916 bp, Homo sapiens
tgttcctggagagcttgtcaaacatggtcaccgaacagagtcatccagccaatggggatgagtccccggggtcatcttacgtccctgcaggatgccatgtgcgagactatggagcagcagctctcctcggaccctgactcggaccctgactgaggatggcagctcttctgctcccccatcaggactggtgctgcttccagagacttccttggggttgcaacctggggaagccacatcccactggatccacacccgcccccacttctccatcttagaaaccccttctcttgactcccgttctgttcatgatttgcctctggtccagtttctcatctctggactgcaacggtcttcttgtgctagaactcaggctcagcctcgaattccacagacgaagtactttcttttgtctgcgccaagaggaatgtgttcagaagctgctgcctgagggcagggcctacctgggcacacagaagagcatatgggagggcaggggtttgggtgtgggtgcacacaaagcaagcaccatctgggattggcacactggcagagccagtgtgttggggtatgtgctgcacttcccagggagaaaacctgtcagaactttccatacgagtatatcagaacacacccttccaaggtatgtatgctctgttgttcctgtcctgtcttcactgagcgcagggctggaggcctcttagacattctccttggtcctcgttcagctgcccactgtagtatccacagtgcccgagttctcgctggttttggcaattaaacctccttcctactggtttagactacacttacaacaaggaaaatgcccctcgtgtgaccatagattgagatttataccacataccacacatagccacagaaacatcatcttgaaataaagaagagttttggacaaaaa

SEQ ID NO: 365838 - DNA, 479 bp, Homo sapiens
catagtccctgcttccacacccatgtggacccctgtagggtgggacaggatgacaaatgggcaagagcttccagaatcaagcacctgttcctaagtgctatctgggataccagaaggtggcagatggcaggagctggttacctgtgccgcttctggagggaggcctcttcctgcagttgccttgcccacctcaccccactgggaaaataggtggcttgcctcctgtcctggagagtcactaatgcattccccacattccacccactgggaaacagcataaaccctgtgaccgggagggtggaggagaagccgcctaaccctatggagggcatgacagaggagcagaaggagcacgaggccatgaagctggtgaccatgtttgacaagctctccaggtgtgtggcatgaggaggaggggcctgcagctgggagaagggagagctgacccacatcctgtcttgtgagccccaggaggtagg

SEQ ID NO: 365839 - DNA, 634 bp, Homo sapiens
ctttaattgctttgtgttttcttcccagctctggtttatagttgaagtaattagacttaaagcagttatttctcccaagtcacaaagcttacgagtacctctgagttacgctctatccctgtccttttcaaaagtgacacagacacccaccacccactcttggccttctgctgactaactgcagaggggcctcttcccaaacctctgccgccaggaccagctgttgtgtatgttggtgggaaggggtggtggggaggtgtaactctgtgccagtcacaagttaggcaggggcatagccccagtgacagagaatcctctacagacacacaggctgaaggagagtgtagctcccgtgctgagcgtgctgactgaatgtgcccggatgcaccgcccagccaggaagttcctgaaggcccaggtataaggctgaggagctggtgctcctgggggatgtggtttcggccctgatcacagacccttggctgctctaagcccaagcttagggatggccacctccccaggtgctgccccctctgcgggatgtgaggacacggcctgaggttggggagatgctgcggaacaagcttgtccgcctcatgacacacctggacacagatgtgaagagggtggctgc

SEQ ID NO: 365840 - DNA, 2493 bp, Homo sapiens
gcggcggggtgcggggggcaggtctgggatgcagtgttgcggggagagtgggggtgcacccgttgggtggcaggcgtgtagggatgggggcgagtgccgaccctgccatccgttctgagcagtggctgctgcctgagttagaggccaataggccgcccgcatcagcggacgcggatcctacccctctgtggatttgaattcactagttctctctgcagcactcccagagcttcacgtttgatgatgcccaacaggaggaccggaagagactggcggagctgctggtctccgtcctggaacagggcttgccaccctcccaccgtgtcatctggctgcagagtgtccgaatcctgtcccgggaccgcaactgcctggacccgttcaccagccgccagagcctgcaggcactagcctgctatgctgacatctctgtctctgaggggtccgtcccagagtccgcagacatggatgttgtactggagtccctcaagtgcctgtgcaacctcgtgctcagcagccctgtggcacagatgctggcagcagaggcccgcctagtggtgaagctcacagagcgtgtggggctgtaccgtgagaggagcttcccccacgatgtccagttctttgacttgcggctcctcttcctgctaacggcactccgcaccgatgtgcgccagcagctgtttcaggagctgaaaggagtgcgcctgctaactgacacactggagctgacgctgggggtgactcctgaagggaaccccccacccacgctccttccttcccaagagactgagcgggccatggagatcctcaaagtgctcttcaacatcaccctggactccatcaagggggaggtggacgaggaagacgctgccctttaccgacacctggggacccttctccggcactgtgtgatgatcgctactgctggagaccgcacagaggagttccacggccacgcagtgaacctcctggggaacttgcccctcaagtgtctggatgttctcctcaccctggagccacatggagactccacggagttcatgggagtgaatatggatgtgattcgtgccctcctcatcttcctagagaagcgtttgcacaagacacacaggctgaaggagagtgtagctcccgtgctgagcgtgctgactgaatgtgcccggatgcaccgcccagccaggaagttcctgaaggcccaggtgctgccccctctgcgggatgtgaggacacggcctgaggttggggagatgctgcggaacaagcttgtccgcctcatgacacacctggacacagatgtgaagagggtggctgccgagttcttgtttgtcctgtgctctgagagtgtgccccgattcatcaagtacacaggctatgggaatgctgctggccttctggctgccaggggcctcatggcaggaggccggcccgagggccagtactcagaggatgaggacacagacacagatgagtacaaggaagccaaagccagcataaaccctgtgaccgggagggtggaggagaagccgcctaaccctatggagggcatgacagaggagcagaaggagcacgaggccatgaagctggtgaccatgtttgacaagctctccaggaacagagtcatccagccaatggggatgagtccccggggtcatcttacgtccctgcaggatgccatgtgcgagactatggagcagcagctctcctcggaccctgactcggaccctgactgaggatggcagctcttctgctcccccatcaggactggtgctgcttccagagacttccttggggttgcaacctggggaagccacatcccactggatccacacccgcccccacttctccatcttagaaaccccttctcttgactcccgttctgttcatgatttgcctctggtccagtttctcatctctggactgcaacggtcttcttgtgctagaactcaggctcagcctcgaattccacagacgaagtactttcttttgtctgcgccaagaggaatgtgttcagaagctgctgcctgagggcagggcctacctgggcacacagaagagcatatgggagggcaggggtttgggtgtgggtgcacacaaagcaagcaccatctgggattggcacactggcagagccagtgtgttggggtatgtgctgcacttcccagggagaaaacctgtcagaactttccatacgagtatatcagaacacacccttccaaggtatgtatgctctgttgttcctgtcctgtcttcactgagcgcagggctggaggcctcttagacattctccttggtcctcgttcagctgcccactgtagtatccacagtgcccgagttctcgctggttttggcaattaaacctccttcctactggtttagactacacttacaacaaggaaaatgcccctcgtgtgaccatagattgagatttataccacataccacacatagccacagaaacatcatcttgaaataaagaagagttttggacaaaaa

SEQ ID NO: 365841 - DNA, 3075 bp, Homo sapiens
ttccgcttcgggctcgctgacttccggcttagggccgagggtggggaactgccgggcgcggaagcgatgggcatatctgtggcttattttcagcactgtcgcgcagacagtggcgcgatctcagctcactgcagcccccgcctgccgggctcccaaggtgctgggattacagcagcaccgcggatgtgacgtttggtgttcctgtgaacgtggggcggggcgggtcgtttgcttgctcagtgcctagacgatggtggtggaaagacgcttctgtgggttaggtcctaacggttaggaaggattcacaggcgggtcatgaggaaggagcagacccctcgggcagaagcccgcgaggagcactgggtgtggtgggggcaggggtgcctcctctgtcaagtggagatcggcgcctcgctcgtgcctgcgagtgcgcgccgcgtcgaatacagccgtacagaacgcactacaggaaagtgaagccgggagagagactgggaggcggcgcggggactgggggccgtagacgcctttgctcccgggcacttgttagaagagcgagtggatcgcgcttcctgtgcgtcactgaatcctcatgacggccactgaaacggacacgcaggatctttgcttttcaagagggaactgagtccaggccagactgggttgctcccctttctctcggcccctccacctttgcaagtgctgctccttctgcctggagtggctcctccagtcttttcccggctcacttcccaccgtccggtgtcagcaaaaacagcacttcctcacagcccgttgcagcccagcagtcgccttttgcttcttttgaagcacagccctgtgaccgcagactggcggagctgctggtctccgtcctggaacagggcttgccaccctcccaccgtgtcatctggctgcagagtgtccgaatcctgtcccgggaccgcaactgcctggacccgttcaccagccgccagagcctgcaggcactagcctgctatgctgacatctctgtctctgaggggtccgtcccagagtccgcagacatggatgttgtactggagtccctcaagtgcctgtgcaacctcgtgctcagcagccctgtggcacagatgctggcagcagaggcccgcctagtggtgaagctcacagagcgtgtggggctgtaccgtgagaggagcttcccccacgatgtccagttctttgacttgcggctcctcttcctgctaacggcactccgcaccgatgtgcgccagcagctgtttcaggagctgaaaggagtgcgcctgctaactgacacactggagctgacgctgggggtgactcctgaagggaaccccccacccacgctccttccttcccaagagactgagcgggccatggagatcctcaaagtgctcttcaacatcaccctggactccatcaagggggaggtggacgaggaagacgctgccctttaccgacacctggggacccttctccggcactgtgtgatgatcgctactgctggagaccgcacagaggagttccacggccacgcagtgaacctcctggggaacttgcccctcaagtgtctggatgttctcctcaccctggagccacatggagactccacggagttcatgggagtgaatatggatgtgattcgtgccctcctcatcttcctagagaagcgtttgcacaagacacacaggctgaaggagagtgtagctcccgtgctgagcgtgctgactgaatgtgcccggatgcaccgcccagccaggaagttcctgaaggcccaggtgctgccccctctgcgggatgtgaggacacggcctgaggttggggagatgctgcggaacaagcttgtccgcctcatgacacacctggacacagatgtgaagagggtggctgccgagttcttgtttgtcctgtgctctgagagtgtgccccgattcatcaagtacacaggctatgggaatgctgctggccttctggctgccaggggcctcatggcaggaggccggcccgagggccagtactcagaggatgaggacacagacacagatgagtacaaggaagccaaagccagcataaaccctgtgaccgggagggtggaggagaagccgcctaaccctatggagggcatgacagaggagcagaaggagcacgaggccatgaagctggtgaccatgtttgacaagctctccaggaacagagtcatccagccaatggggatgagtccccggggtcatcttacgtccctgcaggatgccatgtgcgagactatggagcagcagctctcctcggaccctgactcggaccctgactgaggatggcagctcttctgctcccccatcaggactggtgctgcttccagagacttccttggggttgcaacctggggaagccacatcccactggatccacacccgcccccacttctccatcttagaaaccccttctcttgactcccgttctgttcatgatttgcctctggtccagtttctcatctctggactgcaacggtcttcttgtgctagaactcaggctcagcctcgaattccacagacgaagtactttcttttgtctgcgccaagaggaatgtgttcagaagctgctgcctgagggcagggcctacctgggcacacagaagagcatatgggagggcaggggtttgggtgtgggtgcacacaaagcaagcaccatctgggattggcacactggcagagccagtgtgttggggtatgtgctgcacttcccagggagaaaacctgtcagaactttccatacgagtatatcagaacacacccttccaaggtatgtatgctctgttgttcctgtcctgtcttcactgagcgcagggctggaggcctcttagacattctccttggtcctcgttcagctgcccactgtagtatccacagtgcccgagttctcgctggttttggcaattaaacctccttcctactggtttagactacacttacaacaaggaaaatgcccctcgtgtgaccatagattgagatttataccacataccacacatagccacagaaacatcatcttgaaataaagaagagttttggacaaaaa

SEQ ID NO: 365842 - DNA, 2217 bp, Homo sapiens
tccgccccgccctccccccgccaacagtatgtatagtacgatcccgtgtcatctggctgcagagtgtccgaatcctgtcccgggaccgcaactgcctggacccgttcaccagccgccagagcctgcaggcactagcctgctatgctgacatctctgtctctgaggggtccgtcccagagtccgcagacatggatgttgtactggagtccctcaagtgcctgtgcaacctcgtgctcagcagccctgtggcacagatgctggcagcagaggcccgcctagtggtgaagctcacagagcgtgtggggctgtaccgtgagaggagcttcccccacgatgtccagttctttgacttgcggctcctcttcctgctaacggcactccgcaccgatgtgcgccagcagctgtttcaggagctgaaaggagtgcgcctgctaactgacacactggagctgacgctgggggtgactcctgaagggaaccccccacccacgctccttccttcccaagagactgagcgggccatggagatcctcaaagtgctcttcaacatcaccctggactccatcaagggggaggtggacgaggaagacgctgccctttaccgacacctggggacccttctccggcactgtgtgatgatcgctactgctggagaccgcacagaggagttccacggccacgcagtgaacctcctggggaacttgcccctcaagtgtctggatgttctcctcaccctggagccacatggagactccacggagttcatgggagtgaatatggatgtgattcgtgccctcctcatcttcctagagaagcgtttgcacaagacacacaggctgaaggagagtgtagctcccgtgctgagcgtgctgactgaatgtgcccggatgcaccgcccagccaggaagttcctgaaggcccaggtgctgccccctctgcgggatgtgaggacacggcctgaggttggggagatgctgcggaacaagcttgtccgcctcatgacacacctggacacagatgtgaagagggtggctgccgagttcttgtttgtcctgtgctctgagagtgtgccccgattcatcaagtacacaggctatgggaatgctgctggccttctggctgccaggggcctcatggcaggaggccggcccgagggccagtactcagaggatgaggacacagacacagatgagtacaaggaagccaaagccagcataaaccctgtgaccgggagggtggaggagaagccgcctaaccctatggagggcatgacagaggagcagaaggagcacgaggccatgaagctggtgaccatgtttgacaagctctccaggaacagagtcatccagccaatggggatgagtccccggggtcatcttacgtccctgcaggatgccatgtgcgagactatggagcagcagctctcctcggaccctgactcggaccctgactgaggatggcagctcttctgctcccccatcaggactggtgctgcttccagagacttccttggggttgcaacctggggaagccacatcccactggatccacacccgcccccacttctccatcttagaaaccccttctcttgactcccgttctgttcatgatttgcctctggtccagtttctcatctctggactgcaacggtcttcttgtgctagaactcaggctcagcctcgaattccacagacgaagtactttcttttgtctgcgccaagaggaatgtgttcagaagctgctgcctgagggcagggcctacctgggcacacagaagagcatatgggagggcaggggtttgggtgtgggtgcacacaaagcaagcaccatctgggattggcacactggcagagccagtgtgttggggtatgtgctgcacttcccagggagaaaacctgtcagaactttccatacgagtatatcagaacacacccttccaaggtatgtatgctctgttgttcctgtcctgtcttcactgagcgcagggctggaggcctcttagacattctccttggtcctcgttcagctgcccactgtagtatccacagtgcccgagttctcgctggttttggcaattaaacctccttcctactggtttagactacacttacaacaaggaaaatgcccctcgtgtgaccatagattgagatttataccacataccacacatagccacagaaacatcatcttgaaataaagaagagttttggacaaaaa

SEQ ID NO: 365843 - DNA, 3682 bp, Homo sapiens
ttccgcttcgggctcgctgacttccggcttagggccgagggtggggaactgccgggcgcggaagcgatgggcatatctgtggcttattttcagcactgtcgcgcagacagtggcgcgatctcagctcactgcagcccccgcctgccgggctcccaaggtgctgggattacagcagcaccgcggatgtgacgtttggtgttcctgtgaacgtggggcggggcgggtcgtttgcttgctcagtgcctagacgatggtggtggaaagacgcttctgtgggttaggtcctaacggttaggaaggattcacaggcgggtcatgaggaaggagcagacccctcgggcagaagcccgcgaggagcactgggtgtggtgggggcaggggtgcctcctctgtcaagtggagatcggcgcctcgctcgtgcctgcgagtgcgcgccgcgtcgaatacagccgtacagaacgcactacaggaaagtgaagccgggagagagactgggaggcggcgcggggactgggggccgtagacgcctttgctcccgggcacttgttagaagagcgagtggatcgcgcttcctgtgcgtcactgaatcctcatgacggccactgaaacggacacgcaggatctttgcttttcaagagggaactgagtccaggccagactgggttgctcccctttctctcggcccctccacctttgcaagtgctgctccttctgcctggagtggctcctccagtcttttcccggctcacttcccaccgtccggtgtcagcaaaaacagcacttcctcacagcccgttgcagcccagcagtcgccttttgcttcttttgaagcacagccctgtgaccgcctcgtgtccttttgtttttccttgtcccccttcccctctggaacataagctccacaaaggcagggacctgggaatcccgttcgcctgcattccccagcaaacgcctaacgaacccaatggcccaggactgaaaattcctttccacttcggctttcccctctacatcccatcggttctgtggagctcgaggggcgtcactgtgtgtgtggcagggcacggtgggggctgagatcgtttcctgttggaacttctggcccaagaagcgcgggtcacaaggagaggggtcagttcggttcagagcgactcagcccctcgactcgggtcttaaaacctccgagccgccagttctgcctcaggccgcgcccccttaaagcgccaccagacgctgcgccccgttaaagcgccaccagacgccgcgccccgtcccggcctcccccgcgcgctggcgcggggctttctgggccagggcggggccggcgaactgcggcccggaacggctgaggaagggcccgtcccgccttccccggcgcgccatggagccccgggcggttgcagaagccgtggagacgggtgaggaggatgtgattatggaagctctgcggtcatacaaccaggagcactcccagagcttcacgtttgatgatgcccaacaggaggaccggaagagactggcggagctgctggtctccgtcctggaacagggcttgccaccctcccaccgtgtcatctggctgcagagtgtccgaatcctgtcccgggaccgcaactgcctggacccgttcaccagccgccagagcctgcaggcactagcctgctatgctgacatctctgtctctgaggggtccgtcccagagtccgcagacatggatgttgtactggagtccctcaagtgcctgtgcaacctcgtgctcagcagccctgtggcacagatgctggcagcagaggcccgcctagtggtgaagctcacagagcgtgtggggctgtaccgtgagaggagcttcccccacgatgtccagttctttgacttgcggctcctcttcctgctaacggcactccgcaccgatgtgcgccagcagctgtttcaggagctgaaaggagtgcgcctgctaactgacacactggagctgacgctgggggtgactcctgaagggaaccccccacccacgctccttccttcccaagagactgagcgggccatggagatcctcaaagtgctcttcaacatcaccctggactccatcaagggggaggtggacgaggaagacgctgccctttaccgacacctggggacccttctccggcactgtgtgatgatcgctactgctggagaccgcacagaggagttccacggccacgcagtgaacctcctggggaacttgcccctcaagtgtctggatgttctcctcaccctggagccacatggagactccacggagttcatgggagtgaatatggatgtgattcgtgccctcctcatcttcctagagaagcgtttgcacaagacacacaggctgaaggagagtgtagctcccgtgctgagcgtgctgactgaatgtgcccggatgcaccgcccagccaggaagttcctgaaggcccaggtgctgccccctctgcgggatgtgaggacacggcctgaggttggggagatgctgcggaacaagcttgtccgcctcatgacacacctggacacagatgtgaagagggtggctgccgagttcttgtttgtcctgtgctctgagagtgtgccccgattcatcaagtacacaggctatgggaatgctgctggccttctggctgccaggggcctcatggcaggaggccggcccgagggccagtactcagaggatgaggacacagacacagatgagtacaaggaagccaaagccagcataaaccctgtgaccgggagggtggaggagaagccgcctaaccctatggagggcatgacagaggagcagaaggagcacgaggccatgaagctggtgaccatgtttgacaagctctccaggatgccatgtgcgagactatggagcagcagctctcctcggaccctgactcggaccctgactgaggatggcagctcttctgctcccccatcaggactggtgctgcttccagagacttccttggggttgcaacctggggaagccacatcccactggatccacacccgcccccacttctccatcttagaaaccccttctcttgactcccgttctgttcatgatttgcctctggtccagtttctcatctctggactgcaacggtcttcttgtgctagaactcaggctcagcctcgaattccacagacgaagtactttcttttgtctgcgccaagaggaatgtgttcagaagctgctgcctgagggcagggcctacctgggcacacagaagagcatatgggagggcaggggtttgggtgtgggtgcacacaaagcaagcaccatctgggattggcacactggcagagccagtgtgttggggtatgtgctgcacttcccagggagaaaacctgtcagaactttccatacgagtatatcagaacacacccttccaaggtatgtatgctctgttgttcctgtcctgtcttcactgagcgcagggctggaggcctcttagacattctccttggtcctcgttcagctgcccactgtagtatccacagtgcccgagttctcgctggttttggcaattaaacctccttcctactggtttagactacacttacaacaaggaaaatgcccctcgtgtgaccatagattgagatttataccacataccacacatagccacagaaacatcatcttgaaataaagaagagttttggacaaaaa

SEQ ID NO: 365844 - DNA, 4206 bp, Homo sapiens
  misc_feature (3744)..(3744): n is a, c, g, or t
  misc_feature (4206)..(4206): n is a, c, g, or t
ttccgcttcgggctcgctgacttccggcttagggccgagggtggggaactgccgggcgcggaagcgatgggcatatctgtggcttattttcagcactgtcgcgcagacagtggcgcgatctcagctcactgcagcccccgcctgccgggctcccaaggtgctgggattacagcagcaccgcggatgtgacgtttggtgttcctgtgaacgtggggcggggcgggtcgtttgcttgctcagtgcctagacgatggtggtggaaagacgcttctgtgggttaggtcctaacggttaggaaggattcacaggcgggtcatgaggaaggagcagacccctcgggcagaagcccgcgaggagcactgggtgtggtgggggcaggggtgcctcctctgtcaagtggagatcggcgcctcgctcgtgcctgcgagtgcgcgccgcgtcgaatacagccgtacagaacgcactacaggaaagtgaagccgggagagagactgggaggcggcgcggggactgggggccgtagacgcctttgctcccgggcacttgttagaagagcgagtggatcgcgcttcctgtgcgtcactgaatcctcatgacggccactgaaacggacacgcaggatctttgcttttcaagagggaactgagtccaggccagactgggttgctcccctttctctcggcccctccacctttgcaagtgctgctccttctgcctggagtggctcctccagtcttttcccggctcacttcccaccgtccggtgtcagcaaaaacagcacttcctcacagcccgttgcagcccagcagtcgccttttgcttcttttgaagcacagccctgtgaccgcctcgtgtccttttgtttttccttgtcccccttcccctctggaacataagctccacaaaggcagggacctgggaatcccgttcgcctgcattccccagcaaacgcctaacgaacccaatggcccaggactgaaaattcctttccacttcggctttcccctctacatcccatcggttctgtggagctcgaggggcgtcactgtgtgtgtggcagggcacggtgggggctgagatcgtttcctgttggaacttctggcccaagaagcgcgggtcacaaggagaggggtcagttcggttcagagcgactcagcccctcgactcgggtcttaaaacctccgagccgccagttctgcctcaggccgcgcccccttaaagcgccaccagacgctgcgccccgttaaagcgccaccagacgccgcgccccgtcccggcctcccccgcgcgctggcgcggggctttctgggccagggcggggccggcgaactgcggcccggaacggctgaggaagggcccgtcccgccttccccggcgcgccatggagccccgggcggttgcagaagccgtggagacgggtgaggaggatgtgattatggaagctctgcggtcatacaaccaggagcactcccagagcttcacgtttgatgatgcccaacaggaggaccggaagagactggcggagctgctggtctccgtcctggaacagggcttgccaccctcccaccgtgtcatctggctgcagagtgtccgaatcctgtcccgggaccgcaactgcctggacccgttcaccagccgccagagcctgcaggcactagcctgctatgctgacatctctgtctctgaggggtccgtcccagagtccgcagacatggatgttgtactggagtccctcaagtgcctgtgcaacctcgtgctcagcagccctgtggcacagatgctggcagcagaggcccgcctagtggtgaagctcacagagcgtgtggggctgtaccgtgagaggagcttcccccacgatgtccagttctttgacttgcggctcctcttcctgctaacggcactccgcaccgatgtgcgccagcagctgtttcaggagctgaaaggagtgcgcctgctaactgacacactggagctgacgctgggggtgactcctgaagggaaccccccacccacgctccttccttcccaagagactgagcgggccatggagatcctcaaagtgctcttcaacatcaccctggactccatcaagggggaggtggacgaggaagacgctgccctttaccgacacctggggacccttctccggcactgtgtgatgatcgctactgctggagaccgcacagaggagttccacggccacgcagtgaacctcctggggaacttgcccctcaagtgtctggatgttctcctcaccctggagccacatggagactccacggagttcatgggagtgaatatggatgtgattcgtgccctcctcatcttcctagagaagcgtttgcacaagacacacaggctgaaggagagtgtagctcccgtgctgagcgtgctgactgaatgtgcccggatgcaccgcccagccaggaagttcctgaaggcccaggtgctgccccctctgcgggatgtgaggacacggcctgaggttggggagatgctgcggaacaagcttgtccgcctcatgacacacctggacacagatgtgaagagggtggctgccgagttcttgtttgtcctgtgctctgagagtgtgccccgattcatcaagtacacaggctatgggaatgctgctggccttctggctgccaggggcctcatggcaggaggccggcccgagggccagtactcagaggatgaggacacagacacagatgagtacaaggaagccaaagccagcataaaccctgtgaccgggagggtggaggagaagccgcctaaccctatggagggcatgacagaggagcagaaggagcacgaggccatgaagctggtgaccatgtttgacaagctctccaggaacagagtcatccagccaatggggatgagtccccggggtcatcttacgtccctgcaggatgccatgtgcgagactatggagcagcagctctcctcggaccctgactcggaccctgactgaggatggcagctcttctgctcccccatcaggactggtgctgcttccagagacttccttggggttgcaacctggggaagccacatcccactggatccacacccgcccccacttctccatcttagaaaccccttctcttgactcccgttctgttcatgatttgcctctggtccagtttctcatctctggactgcaacggtcttcttgtgctagaactcaggctcagcctcgaattccacagacgaagtactttcttttgtctgcgccaagaggaatgtgttcagaagctgctgcctgagggcagggcctacctgggcacacagaagagcatatgggagggcaggggtttgggtgtgggtgcacacaaagcaagcaccatctgggattggcacactggcagagccagtgtgttggggtatgtgctgcacttcccagggagaaaacctgtcagaactttccatacgagtatatcagaacacacccttccaaggtatgtatgctctgttgttcctgtcctgtcttcactgagcgcagggctggaggcctcttagacattctccttggtcctcgttcagctgcccactgtagtatccacagtgcccgagttctcgctggttttggcaattaaacctccttcctactggtttagactacacttacaacaaggaaaatgcccctcgtgtgaccatagattgagatttataccacataccacacatagccacagaaacatcatcttgaaataaagaagagttttggacaaaaaaaanaaaaaaaaacactcgagactagttctctcggcaaaagccttggagtcctggtccttttctctcttccccgggacagcaatgaagctttcaaccaacttcggcttccaacctttcttccaccaaacttaccgggctccctggggctctggtccaaggccgcccagcttaggggcgcccgggccgggtccaagcaagcgcgggcaaggggtctatcgcaggggccgctgagggggctcctgggtacccgaggaatctccggaggatcccggcttccaccaggtttcgaggggggcggcagtggggcgtccggggggccgggccaccggggaatagccggggggtctctggaccagagaaatgggaggcactccagaaccgaaaaagggagaccattgcaaaaggccttgaaacaaccggcctgggacatttaaccgtggaccagatgtgaggaacccttggaan

SEQ ID NO: 365845 - DNA, 3754 bp, Homo sapiens
ttccgcttcgggctcgctgacttccggcttagggccgagggtggggaactgccgggcgcggaagcgatgggcatatctgtggcttattttcagcactgtcgcgcagacagtggcgcgatctcagctcactgcagcccccgcctgccgggctcccaaggtgctgggattacagcagcaccgcggatgtgacgtttggtgttcctgtgaacgtggggcggggcgggtcgtttgcttgctcagtgcctagacgatggtggtggaaagacgcttctgtgggttaggtcctaacggttaggaaggattcacaggcgggtcatgaggaaggagcagacccctcgggcagaagcccgcgaggagcactgggtgtggtgggggcaggggtgcctcctctgtcaagtggagatcggcgcctcgctcgtgcctgcgagtgcgcgccgcgtcgaatacagccgtacagaacgcactacaggaaagtgaagccgggagagagactgggaggcggcgcggggactgggggccgtagacgcctttgctcccgggcacttgttagaagagcgagtggatcgcgcttcctgtgcgtcactgaatcctcatgacggccactgaaacggacacgcaggatctttgcttttcaagagggaactgagtccaggccagactgggttgctcccctttctctcggcccctccacctttgcaagtgctgctccttctgcctggagtggctcctccagtcttttcccggctcacttcccaccgtccggtgtcagcaaaaacagcacttcctcacagcccgttgcagcccagcagtcgccttttgcttcttttgaagcacagccctgtgaccgcctcgtgtccttttgtttttccttgtcccccttcccctctggaacataagctccacaaaggcagggacctgggaatcccgttcgcctgcattccccagcaaacgcctaacgaacccaatggcccaggactgaaaattcctttccacttcggctttcccctctacatcccatcggttctgtggagctcgaggggcgtcactgtgtgtgtggcagggcacggtgggggctgagatcgtttcctgttggaacttctggcccaagaagcgcgggtcacaaggagaggggtcagttcggttcagagcgactcagcccctcgactcgggtcttaaaacctccgagccgccagttctgcctcaggccgcgcccccttaaagcgccaccagacgctgcgccccgttaaagcgccaccagacgccgcgccccgtcccggcctcccccgcgcgctggcgcggggctttctgggccagggcggggccggcgaactgcggcccggaacggctgaggaagggcccgtcccgccttccccggcgcgccatggagccccgggcggttgcagaagccgtggagacgggtgaggaggatgtgattatggaagctctgcggtcatacaaccaggagcactcccagagcttcacgtttgatgatgcccaacaggaggaccggaagagactggcggagctgctggtctccgtcctggaacagggcttgccaccctcccaccgtgtcatctggctgcagagtgtccgaatcctgtcccgggaccgcaactgcctggacccgttcaccagccgccagagcctgcaggcactagcctgctatgctgacatctctgtctctgaggggtccgtcccagagtccgcagacatggatgttgtactggagtccctcaagtgcctgtgcaacctcgtgctcagcagccctgtggcacagatgctggcagcagaggcccgcctagtggtgaagctcacagagcgtgtggggctgtaccgtgagaggagcttcccccacgatgtccagttctttgacttgcggctcctcttcctgctaacggcactccgcaccgatgtgcgccagcagctgtttcaggagctgaaaggagtgcgcctgctaactgacacactggagctgacgctgggggtgactcctgaagggaaccccccacccacgctccttccttcccaagagactgagcgggccatggagatcctcaaagtgctcttcaacatcaccctggactccatcaagggggaggtggacgaggaagacgctgccctttaccgacacctggggacccttctccggcactgtgtgatgatcgctactgctggagaccgcacagaggagttccacggccacgcagtgaacctcctggggaacttgcccctcaagtgtctggatgttctcctcaccctggagccacatggagactccacggagttcatgggagtgaatatggatgtgattcgtgccctcctcatcttcctagagaagcgtttgcacaagacacacaggctgaaggagagtgtagctcccgtgctgagcgtgctgactgaatgtgcccggatgcaccgcccagccaggaagttcctgaaggcccaggtgctgccccctctgcgggatgtgaggacacggcctgaggttggggagatgctgcggaacaagcttgtccgcctcatgacacacctggacacagatgtgaagagggtggctgccgagttcttgtttgtcctgtgctctgagagtgtgccccgattcatcaagtacacaggctatgggaatgctgctggccttctggctgccaggggcctcatggcaggaggccggcccgagggccagtactcagaggatgaggacacagacacagatgagtacaaggaagccaaagccagcataaaccctgtgaccgggagggtggaggagaagccgcctaaccctatggagggcatgacagaggagcagaaggagcacgaggccatgaagctggtgaccatgtttgacaagctctccaggaacagagtcatccagccaatggggatgagtccccggggtcatcttacgtccctgcaggatgccatgtgcgagactatggagcagcagctctcctcggaccctgactcggaccctgactgaggatggcagctcttctgctcccccatcaggactggtgctgcttccagagacttccttggggttgcaacctggggaagccacatcccactggatccacacccgcccccacttctccatcttagaaaccccttctcttgactcccgttctgttcatgatttgcctctggtccagtttctcatctctggactgcaacggtcttcttgtgctagaactcaggctcagcctcgaattccacagacgaagtactttcttttgtctgcgccaagaggaatgtgttcagaagctgctgcctgagggcagggcctacctgggcacacagaagagcatatgggagggcaggggtttgggtgtgggtgcacacaaagcaagcaccatctgggattggcacactggcagagccagtgtgttggggtatgtgctgcacttcccagggagaaaacctgtcagaactttccatacgagtatatcagaacacacccttccaaggtatgtatgctctgttgttcctgtcctgtcttcactgagcgcagggctggaggcctcttagacattctccttggtcctcgttcagctgcccactgtagtatccacagtgcccgagttctcgctggttttggcaattaaacctccttcctactggtttagactacacttacaacaaggaaaatgcccctcgtgtgaccatagattgagatttataccacataccacacatagtacccgacatatctgtataaggtttggggggggtggtgcggcgcgtaggtggtgtgtgg

SEQ ID NO: 365846 - DNA, 3239 bp, Homo sapiens
ttccgcttcgggctcgctgacttccggcttagggccgagggtggggaactgccgggcgcggaagcgatgggcatatctgtggcttattttcagcactgtcgcgcagacagtggcgcgatctcagctcactgcagcccccgcctgccgggctcccaaggtgctgggattacagcagcaccgcggatgtgacgtttggtgttcctgtgaacgtggggcggggcgggtcgtttgcttgctcagtgcctagacgatggtggtggaaagacgcttctgtgggttaggtcctaacggttaggaaggattcacaggcgggtcatgaggaaggagcagacccctcgggcagaagcccgcgaggagcactgggtgtggtgggggcaggggtgcctcctctgtcaagtggagatcggcgcctcgctcgtgcctgcgagtgcgcgccgcgtcgaatacagccgtacagaacgcactacaggaaagtgaagccgggagagagactgggaggcggcgcggggactgggggccgtagacgcctttgctcccgggcacttgttagaagagcgagtggatcgcgcttcctgtgcgtcactgaatcctcatgacggccactgaaacggacacgcaggatctttgcttttcaagagggaactgagtccaggccagactgggttgctcccctttctctcggcccctccacctttgcaagtgctgctccttctgcctggagtggctcctccagtcttttcccggctcacttcccaccgtccggtgtcagcaaaaacagcacttcctcacagcccgttgcagcccagcagtcgccttttgcttcttttgaagcacagccctgtgaccgcctcgtgtccttttgtttttccttgtcccccttcccctctggaacataagctccacaaaggcagggacctgggaatcccgttcgcctgcattccccagcaaacgcctaacgaacccaatggcccaggactgaaaattcctttccacttcggctttcccctctacatcccatcggttctgtggagctcgaggggcgtcactgtgtgtgtggcagggcacggtgggggctgagatcgtttcctgttggaacttctggcccaagaagcgcgggtcacaaggagaggggtcagttcggttcagagcgactcagcccctcgactcgggtcttaaaacctccgagccgccagttctgcctcaggccgcgcccccttaaagcgccaccagacgctgcgccccgttaaagcgccaccagacgccgcgccccgtcccggcctcccccgcgcgctggcgcggggctttctgggccagggcggggccggcgaactgcggcccggaacggctgaggaagggcccgtcccgccttccccggcgcgccatggagccccgggcggttgcagaagccgtggagacgggtgaggaggatgtgattatggaagctctgcggtcatacaaccaggagcactcccagagcttcacgtttgatgatgcccaacaggaggaccggaagagactggcggagctgctggtctccgtcctggaacagggcttgccaccctcccaccgtgtcatctggctgcagagtgtccgaatcctgtcccgggaccgcaactgcctggacccgttcaccagccgccagagcctgcaggcactagcctgctatgctgacatctctgtctctgaggggtccgtcccagagtccgcagacatggatgttgtactggagtccctcaagtgcctgtgcaacctcgtgctcagcagccctgtggcacagatgctggcagcagaggcccgcctagtggtgaagctcacagagcgtgtggggctgtaccgtgagaggagcttcccccacgatgtccagttctttgacttgcggctcctcttcctgctaacggcactccgcaccgatgtgcgccagcagctgtttcaggagctgaaaggagtgcgcctgctaactgacacactggagctgacgctgggggtgactcctgaagggaaccccccacccacgctccttccttcccaagagactgagcgggccatggagatcctcaaagtgctcttcaacatcaccctggactccatcaagggggaggtggacgaggaagacgctgccctttaccgacacctggggacccttctccggcactgtgtgatgatcgctactgctggagaccgcacagaggagttccacggccacgcagtgaacctcctggggaacttgcccctcaagtgtctggatgttctcctcaccctggagccacatggagactccacggagttcatgggagtgaatatggatgtgattcgtgccctcctcatcttcctagagaagcgtttgcacaagacacacaggctgaaggagagtgtagctcccgtgctgagcgtgctgactgaatgtgcccggatgcaccgcccagccaggaagttcctgaaggcccaggtgctgccccctctgcgggatgtgaggacacggcctgaggttggggagatgctgcggaacaagcttgtccgcctcatgacacacctggacacagatgtgaagagggtggctgccgagttcttgtttgtcctgtgctctgagagtgtgccccgattcatcaagtacacaggctatgggaatgctgctggccttctggctgccaggggcctcatggcaggaggccggcccgagggccagtactcagaggatgaggacacagacacagatgagtacaaggaagccaaagccagcataaaccctgtgaccgggagggtggaggagaagccgcctaaccctatggagggcatgacagaggagcagaaggagcacgaggccatgaagctggtgaccatgtttgacaagctctccaggaacagagtcatccagccaatggggatgagtccccggggtcatcttacgtccctgcaggatgccatgtgcgagactatggagcagcagctctcctcggaccctgactcggaccctgactgaggatggcagctcttctgctcccccatcaggactggtgctgcttccagagacttccttggggttgcaacctggggaagccacatcccactggatccacacccgcccccacttctccatcttagaaacctccttcctactggtttagactacacttacaacaaggaaaatgcccctcgtgtgaccatagattgagatttataccacataccacacatagccacagaaacatcatcttgaaataaagaagagttttggacaaaaa

SEQ ID NO: 365847 - DNA, 1236 bp, Homo sapiens
aaggcatagtacgagggctgcggttgaattcggccgatgtgaagagggtggctgccgagttcttgtttgtcctgtgctctgagagtgtgccccgattcatcaagtacacaggctatgggaatgctgctggccttctggctgccaggggcctcatggcaggaggccggcccgagggccagtactcagaggatgaggacacagacacagatgagtacaaggaagccaaagccagcataaaccctgtgaccgggagggtggaggagaagccgcctaaccctatggagggcatgacagaggagcagaaggagcacgaggccatgaagctggtgaccatgtttgacaagctctccaggaacagagtcatccagccaatggggatgagtccccggggtcatcttacgtccctgcaggatgccatgtgcgagactatggagcagcagctctcctcggaccctgactcggaccctgactgaggatggcagctcttctgctcccccatcaggactggtgctgcttccagagacttccttggggttgcaacctggggaagccacatcccactggatccacacccgcccccacttctccatcttagaaaccccttctcttgactcccgttctgttcatgatttgcctctggtccagtttctcatctctggactgcaacggtcttcttgtgctagaactcaggctcagcctcgaattccacagacgaagtactttcttttgtctgcgccaagaggaatgtgttcagaagctgctgcctgagggcagggcctacctgggcacacagaagagcatatgggagggcaggggtttgggtgtgggtgcacacaaagcaagcaccatctgggattggcacactggcagagccagtgtgttggggtatgtgctgcacttcccagggagaaaacctgtcagaactttccatacgagtatatcagaacacacccttccaaggtatgtatgctctgttgttcctgtcctgtcttcactgagcgcagggctggaggcctcttagacattctccttggtcctcgttcagctgcccactgtagtatccacagtgcccgagttctcgctggttttggcaattaaacctccttcctactggtttagactacacttacaacaaggaaaatgcccctcgtgtgaccatagattgagatttataccacataccacacatagccacagaaacatcatcttgaaataaagaagagttttggacaaaaa

SEQ ID NO: 365848 - DNA, 1048 bp, Homo sapiens
agagtcactaatgcattccccacattccacccactgggaaacagcataaaccctgtgaccgggagggtggaggagaagccgcctaaccctatggagggcatgacagaggagcagaaggagcacgaggccatgaagctggtgaccatgtttgacaagctctccaggaacagagtcatccagccaatggggatgagtccccggggtcatcttacgtccctgcaggatgccatgtgcgagactatggagcagcagctctcctcggaccctgactcggaccctgactgaggatggcagctcttctgctcccccatcaggactggtgctgcttccagagacttccttggggttgcaacctggggaagccacatcccactggatccacacccgcccccacttctccatcttagaaaccccttctcttgactcccgttctgttcatgatttgcctctggtccagtttctcatctctggactgcaacggtcttcttgtgctagaactcaggctcagcctcgaattccacagacgaagtactttcttttgtctgcgccaagaggaatgtgttcagaagctgctgcctgagggcagggcctacctgggcacacagaagagcatatgggagggcaggggtttgggtgtgggtgcacacaaagcaagcaccatctgggattggcacactggcagagccagtgtgttggggtatgtgctgcacttcccagggagaaaacctgtcagaactttccatacgagtatatcagaacacacccttccaaggtatgtatgctctgttgttcctgtcctgtcttcactgagcgcagggctggaggcctcttagacattctccttggtcctcgttcagctgcccactgtagtatccacagtgcccgagttctcgctggttttggcaattaaacctccttcctactggtttagactacacttacaacaaggaaaatgcccctcgtgtgaccatagattgagatttataccacataccacacatagccacagaaacatcatcttgaaataaagaagagttttggacaaaaa

SEQ ID NO: 365849 - DNA, 3166 bp, Homo sapiens
cgatgattggctggagtggcccgagtcgggaaaatggctgcgagtacctccatggtcccggtggctgtgacggcggcagtggcgcctgtcctgtccataaacagcgatttctcagatttgcgggaaattaaaaagcaactgctgcttattgcgggccttacccgggagcggggcctactacacagtagcaaatggtcggcggagttggctttctctctccctgcattgcctctggccgagctgcaaccgcctccgcctattacagaggaagatgcccaggatatggatgcctataccctggccaaggcctactttgacgttaaagagtatgatcgggcagcacatttcctgcatggctgcaatagcaagaaagcctattttctgtatatgtattccagatatctgtctggagaaaaaaagaaggacgatgaaacagttgatagcttaggccccctggaaaaaggacaagtgaaaaatgaggcgcttagagaattgagagtggagctcagcaaaaaacaccaagctcgagaacttgatggatttggactttatctgtatggtgtggtgcttcgaaaactggacttggttaaagaggccattgatgtgtttgtggaagctactcatgttttgcccttgcattggggagcctggttagaactctgtaacctgatcacagacaaagagatgctgaagttcctgtctttgccagacacctggatgaaagagttttttctggctcatatatacacagagttgcagttgatagaggaggccctgcaaaagtatcagaatctcattgatgtgggcttctctaagagctcgtatattgtttcccaaattgcagttgcctatcacaatatcagagatattgacaaagccctctccatttttaatgagctaaggaaacaagacccttacaggattgaaaatatggacacattctccaaccttctttatgtcaggagcatgaaatcggagttgagttatctggctcataacctctgtgagattgataaatatcgtgtagaaacgtgctgtgtaattggcaattattacagtttacgttctcagcatgagaaagcagccttatatttccagagagccctgaaattaaatcctcggtatcttggtgcctggacactaatgggacatgagtacatggagatgaagaacacgtctgctgctatccaggcttatagacatgccattgaggtcaacaaacgggactacagagcttggtatggcctcgggcagacctatgaaatccttaagatgccattttactgcctttattattatagacgggcccaccagcttcgacccaatgattctcgcatgctggttgctttaggagaatgttacgagaaactcaatcaactagtggaagccaaaaagtgttattggagagcttacgccgtgggagatgtggagaaaatggctctggtgaaactggcaaagcttcatgaacagttgactgagtcagaacaggctgcccagtgttacatcaaatatatccaagatatctattcctgtggggaaatagtagaacacttggaggaaagcactgcctttcgctatctggcccagtactattttaagtgcaaactgtgggatgaagcttcaacttgtgcacaaaagtgttgtgcatttaatgatacccgggaagaaggtaaggccttactccggcaaatcctacagcttcggaaccaaggcgagactcctaccaccgaggtgcctgctccctttttcctacctgcttcactctctgctaacaatacccccacacgcagagtttctccactcaacttgtcttctgtcacgccatagttggctactctcaagccagcacattgttagacccatcttaattaagccttacctccatgtaaagaacagcacgtctgttccaaggacctcagctcttcttgtttctacagatggcaacagctccatagggacagcttgtataattaccttcagaggccaactgacagaatcctggcaggaacagacattatcttgccagttagaagtacttctgtctcacttatgtccaaagagtggctatagatcttggccttcttccctgaatgctttttttttttgggcccccaagaaagtcccttttatagcactttagcacaggcaatgctacaggaacaaagtttcaatgctgctgagagtgaaagaaaggaggaaagtctgccactctaccctgagctggcagtagggcactgagtaccctaggaagaagtcagagcaatggatacaaatgaccttgctcttggatttgctgagcatgatccctattctgatgtcagagattaggtttaaatggaatagagctatccatttgttcttactctctagggagacaatcttccaaaacagttttgggggggtcttctaaagctttcaaattggaagtaactttattcaactagagttgaataaaagaagggcaaaaataatctcacagagcttggaactgctgatagcccttactgagggcaaaagatggctatattgttagctatactcctaccaaagcaagcaaggagataggattatagataatttcacggacatttggaaataacattggtgattatacagacaagaataaactcacttcaagctggtctgttttaataaattttcaacgtaattgtctatttttttccctcccatctgcaacagaatacatttttttcagcctttatctagatgaggtaaagggaatcattcttatggtgctcttggagagtttcaggcctgtgcatgtgtgtacagcaggaggtaatatgctataatgtctgctgtaatatatttgcacagtagatgctatggatcattctgagctcagggtccagactttattcttattcccagaattttgtgttacgtttttacctcctaacatatgacacttcatcttatattaaggaaggtttagaatatctaatacgacttgaattcatttgttactaagccttctcaggcaagctgtatactagttactggtctccactgccatgccttttcaaggttcccatggtccagaatgatgtttgattcttaatttttctgtcccttttataatttgttttaatgattttgctacatttggaattcaataaaaaatgtgaacaataaaaaaaaaaaa

SEQ ID NO: 365850 - DNA, 914 bp, Homo sapiens
  misc_feature (799)..(799): n is a, c, g, or t
cgatgattggctggagtggcccgagtcgggaaaatggctgcgagtacctccatggtcccggtggctgtgacggcggcagtggcgcctgtcctgtccataaacagcgatttctcagatttgcgggaaattaaaaagcaactgctgcttattgcgggccttacccgggagcggggcctactacacagtagcaaatggtcggcggagttggctttctctctccctgcattgcctctggccgagctgcaaccgcctccgcctattacagaggaagatgcccaggatatggatgcctataccctggccaaggcctactttgacgttaaagagtatgatcgggcagcacatttcctgcatggctgcaatagcaagaaagcctattttctgtatatgtattccagatatctggtgagggccattttaaaatgtcattctgcctttagtgaaacatccatatttagaaccaatggaaaagttaaatcttttaaatagcttagcagtgggccactgaatgaatgtactttatacatagcaataataaaaaaaagatatcataaataaagttaaaaaggatggtagagaagaaaatattcttaggaatgactaacaggataagtaacaacctgattatttatttactttaggttatataaggttcttcatgcctgtgaattatattattgtgtaagaattaagttaaaaagcctgggctgacttttaaatttataaattcatttatcatgtttatagtatattatggggcttctgggtttaaaagtgtggaggacaggggtaccctttntggtggataggcactttttttggaaattgagattcacactgggtctcttagggcacattggtcaggggctggggggcgggatgtgttgggggggaaaaaacccgggggcggcggg

SEQ ID NO: 365851 - DNA, 867 bp, Homo sapiens
cgatgattggctggagtggcccgagtcgggaaaatggctgcgagtacctccatggtcccggtggctgtgacggcggcagtggcgcctgtcctgtccataaacagcgatttctcagatttgcgggaaattaaaaagcaactgctgcttattgcgggccttacccgggagcggggcctactacacagtagcaaatggtcggcggagttggctttctctctccctgcattgcctctggccgagctgcaaccgcctccgcctattacagaggaagatgcccaggatatggatgcctataccctggccaaggcctactttgacgttaaagagtatgatcgggcagcacatttcctgcatggctgcaatagcaagaaagcctattttctgtatatgtattccagatatctgtctggagaaaaaaagaaggacgatgaaacagttgatagcttaggccccctggaaaaaggacaagtgaaaaatgaggcgcttagagaattgagagtggagctcagcaaaaaacaccaagctcgagaacttgatggatttggactttatctgtatggtgtggtgcttcgaaaactggacttggttaaagaggccattgatgtgtttgtggaagctactcatgttttgcccttgcattggggagcctggttagaactctgtaacctgatcacagacaaagagatggtaaattgtgatgagctatgtgaaaaaccctctgcttcaagccttttgtaattctgtagtaatataggggtggggaaagttttggcagggctttggttatagttctccctttgctgcgcctctggtgtcttttcgctgttttggaagtaagtctttgtttgaaagactgatgactagctc

SEQ ID NO: 365852 - DNA, 1072 bp, Homo sapiens
tatttcaacacttttttgtgaagtgttctcttcgctaactggtgtccgcggcaataaaatagttggggcatcgcttatttaggggttgaaggagaccctagccggtgcgcgagggccttctttcaaaaacgtttccattgcggaataaaagcacgctgctatgggcctaccgggagggggctaatacacatagcaatggtcgcggagttgcttctctctcggcatgctctgccgagctgcaactgcctccgctattacagaggaagatgcccaggatatggatgcctataccctggccaaggcctactttgacgttaaagagtatgatcgggcagcacatttcctgcatggctgcaatagcaagaaagcctattttctgtatatgtattccagatatctggtgagggccattttaaaatgtcattctgcctttagtgaaacatccatatttagaaccaatggaaaagttaaatcttttaaatagcttagcagtgggccactgaatgaatgtactttatacatagcaataataaaaaaaagatatcataaataaagttaaaaaggatggtagagaagaaaatattcttaggaatgactaacaggataagtaacaacctgattatttatttactttaggttatataaggttcttcatgcctgtgaattatattattgtgtaagaattaagttaaaaagcctgggctgacttttaaatttataaattcatttatcatgtttatagtatatttattgtttttctttcatggctattaaaaagtatgactgtaaaggacaatgcaagtaaaccaacttaatactgtattgaataataagtacaatttattattttactttgaaacattatgaatttactttcctactttttcttagttgttatctatataaattgattaaaaaaacattttatgtacttctcatttcctagtacaggttgagtatcccttatttgaagtgcttgggaccaaaagtgtttcagatttcagatttttttcagattttggtatatttgcattatacttactggttgaaataaaaaatgctgcagtgagtg

SEQ ID NO: 365853 - DNA, 2677 bp, Homo sapiens
cgatgattggctggagtggcccgagtcgggaaaatggctgcgagtacctccatggtcccggtggctgtgacggcggcagtggcgcctgtcctgtccataaacagcgatttctcagatttgcgggaaattaaaaagcaactgctgcttattgcgggccttacccgggagcggggcctactacacagtagcaaatggtcggcggagttggctttctctctccctgcattgcctctggccgagctgcaaccgcctccgcctattacagaggaagatgcccaggatatggatgcctataccctggccaaggcctactttgacgttaaagagtatgatcgggcagcacatttcctgcatggctgcaatagcaagaaagcctattttctgtatatgtattccagatatctgtctggagaaaaaaagaaggacgatgaaacagttgatagcttaggccccctggaaaaaggacaagtgaaaaatgaggcgcttagagaattgagagtggagctcagcaaaaaacaccaagctcgagaacttgatggatttggactttatctgtatggtgtggtgcttcgaaaactggacttggttaaagaggccattgatgtgtttgtggaagctactcatgttttgcccttgcattggggagcctggttagaactctgtaacctgatcacagacaaagagatgctgaagttcctgtctttgccagacacctggatgaaagagttttttctggctcatatatacacagagttgcagttgatagaggaggccctgcaaaagtatcagaatctcattgatgtgggcttctctaagagctcgtatattgtttcccaaattgcagttgcctatcacaatatcagagatattgacaaagccctctccatttttaatgagctaaggaaacaagacccttacaggattgaaaatatggacacattctccaaccttctttatgtcaggagcatgaaatcggagttgagttatctggctcataacctctgtgagattgataaatatcgtgtagaaacgtgctgtgtaattggcaattattacagtttacgttctcagcatgagaaagcagccttatatttccagagagccctgaaattaaatcctcggtatcttggtgcctggacactaatgggacatgagtacatggagatgaagaacacgtctgctgctatccaggcttatagacatgccattgaggtcaacaaacgggactacagagcttggtatggcctcgggcagacctatgaaatccttaagatgccattttactgcctttattattatagacgggcccaccagcttcgacccaatgattctcgcatgctggttgctttaggagaatgttacgagaaactcaatcaactagtggaagccaaaaagtgttattggagagcttacgccgtgggagatgtggagaaaatggctctggtgaaactggcaaagcttcatgaacagttgactgagtcagaacaggctgcccagtgttacatcaaatatatccaagatatctattcctgtggggaaatagtagaacacttggaggaaagcactgcctttcgctatctggcccagtactattttaagtgcaaactgtgggatgaagcttcaacttgtgcacaaaagtgttgtgcatttaatgatacccgggaagaaggtaaggccttactccggcaaatcctacagcttcggaaccaaggcgagactctctaccctgagctggcagtagggcactgagtaccctaggaagaagtcagagcaatggatacaaatgaccttgctcttggatttgctgagcatgatccctattctgatgtcagagattaggtttaaatggaatagagctatccatttgttcttactctctagggagacaatcttccaaaacagttttgggggggtcttctaaagctttcaaattggaagtaactttattcaactagagttgaataaaagaagggcaaaaataatctcacagagcttggaactgctgatagcccttactgagggcaaaagatggctatattgttagctatactcctaccaaagcaagcaaggagataggattatagataatttcacggacatttggaaataacattggtgattatacagacaagaataaactcacttcaagctggtctgttttaataaattttcaacgtaattgtctatttttttccctcccatctgcaacagaatacatttttttcagcctttatctagatgaggtaaagggaatcattcttatggtgctcttggagagtttcaggcctgtgcatgtgtgtacagcaggaggtaatatgctataatgtctgctgtaatatatttgcacagtagatgctatggatcattctgagctcagggtccagactttattcttattcccagaattttgtgttacgtttttacctcctaacatatgacacttcatcttatattaaggaaggtttagaatatctaatacgacttgaattcatttgttactaagccttctcaggcaagctgtatactagttactggtctccactgccatgccttttcaaggttcccatggtccagaatgatgtttgattcttaatttttctgtcccttttataatttgttttaatgattttgctacatttggaattcaataaaaaatgtgaacaataaaaaaaaaaaa

SEQ ID NO: 365854 - DNA, 1077 bp, Homo sapiens
cgatgattggctggagtggcccgagtcgggaaaatggctgcgagtacctccatggtcccggtggctgtgacggcggcagtggcgcctgtcctgtccataaacagcgatttctcagatttgcgggaaattaaaaagcaactgctgcttattgcgggccttacccgggagcggggcctactacacagtagcaaatggtcggcggagttggctttctctctccctgcattgcctctggccgagctgcaaccgcctccgcctattacagaggaagatgcccaggatatggatgcctataccctggccaaggcctactttgacgttaaagagtatgatcgggcagcacatttcctgcatggctgcaatagcaagaaagcctattttctgtatatgtattccagatatctggtgagggccattttaaaatgtcattctgcctttagtgaaacatccatatttagaaccaatggaaaagttaaatcttttaaatagcttagcagtgggccactgaatgaatgtactttatacatagcaataataaaaaaaagatatcataaataaagttaaaaaggatggtagagaagaaaatattcttaggaatgactaacaggataagtaacaacctgattatttatttactttaggttatataaggttcttcatgcctgtgaattatattattgtgtaagaattaagttaaaaagcctgggctgacttttaaatttataaattcatttatcatgtttatagtatatttattgtttttctttcatggctattaaaaagtatgactgtaaaggacaatgcaagtaaaccaacttaatactgtattgaataataagtacaatttattattttactttgaaacattatgaatttactttcctactttttcttagttgttatctatataaattgattaaaaaaacattttatgtacttctcatttcctagtacaggttgagtatcccttatttgaagtgcttgggaccaaaagtgtttcagatttcagatttttttcagattttggtatatttgcattatacttactggttgaaataaaaaatgctgcagtgagtg

SEQ ID NO: 365855 - DNA, 3061 bp, Homo sapiens
cgatgattggctggagtggcccgagtcgggaaaatggctgcgagtacctccatggtcccggtggctgtgacggcggcagtggcgcctgtcctgtccataaacagcgatttctcagatttgcgggaaattaaaaagcaactgctgcttattgcgggccttacccgggagcggggcctactacacagtagcaaatggtcggcggagttggctttctctctccctgcattgcctctggccgagctgcaaccgcctccgcctattacagaggaagatgcccaggatatggatgcctataccctggccaaggcctactttgacgttaaagagtatgatcgggcagcacatttcctgcatggctgcaatagcaagaaagcctattttctgtatatgtattccagatatctggccccctggaaaaaggacaagtgaaaaatgaggcgcttagagaattgagagtggagctcagcaaaaaacaccaagctcgagaacttgatggatttggactttatctctactcatgttttgcccttgcattggggagcctggttagaactctgtaacctgatcacagacaaagagatgctgaagttcctgtctttgccagacacctggatgaaagagttttttctggctcatatatacacagagttgcagttgatagaggaggccctgcaaaagtatcagaatctcattgatgtgggcttctctaagagctcgtatattgtttcccaaattgcagttgcctatcacaatatcagagatattgacaaagccctctccatttttaatgagctaaggaaacaagacccttacaggattgaaaatatggacacattctccaaccttctttatgtcaggagcatgaaatcggagttgagttatctggctcataacctctgtgagattgataaatatcgtgtagaaacgtgctgtgtaattggcaattattacagtttacgttctcagcatgagaaagcagccttatatttccagagagccctgaaattaaatcctcggtatcttggtgcctggacactaatgggacatgagtacatggagatgaagaacacgtctgctgctatccaggcttatagacatgccattgaggtcaacaaacgggactacagagcttggtatggcctcgggcagacctatgaaatccttaagatgccattttactgcctttattattatagacgggcccaccagcttcgacccaatgattctcgcatgctggttgctttaggagaatgttacgagaaactcaatcaactagtggaagccaaaaagtgttattggagagcttacgccgtgggagatgtggagaaaatggctctggtgaaactggcaaagcttcatgaacagttgactgagtcagaacaggctgcccagtgttacatcaaatatatccaagatatctattcctgtggggaaatagtagaacacttggaggaaagcactgcctttcgctatctggcccagtactattttaagtgcaaactgtgggatgaagcttcaacttgtgcacaaaagtgttgtgcatttaatgatacccgggaagaaggtaaggccttactccggcaaatcctacagcttcggaaccaaggcgagactcctaccaccgaggtgcctgctccctttttcctacctgcttcactctctgctaacaatacccccacacgcagagtttctccactcaacttgtcttctgtcacgccatagttggctactctcaagccagcacattgttagacccatcttaattaagccttacctccatgtaaagaacagcacgtctgttccaaggacctcagctcttcttgtttctacagatggcaacagctccatagggacagcttgtataattaccttcagaggccaactgacagaatcctggcaggaacagacattatcttgccagttagaagtacttctgtctcacttatgtccaaagagtggctatagatcttggccttcttccctgaatgctttttttttttgggcccccaagaaagtcccttttatagcactttagcacaggcaatgctacaggaacaaagtttcaatgctgctgagagtgaaagaaaggaggaaagtctgccactctaccctgagctggcagtagggcactgagtaccctaggaagaagtcagagcaatggatacaaatgaccttgctcttggatttgctgagcatgatccctattctgatgtcagagattaggtttaaatggaatagagctatccatttgttcttactctctagggagacaatcttccaaaacagttttgggggggtcttctaaagctttcaaattggaagtaactttattcaactagagttgaataaaagaagggcaaaaataatctcacagagcttggaactgctgatagcccttactgagggcaaaagatggctatattgttagctatactcctaccaaagcaagcaaggagataggattatagataatttcacggacatttggaaataacattggtgattatacagacaagaataaactcacttcaagctggtctgttttaataaattttcaacgtaattgtctatttttttccctcccatctgcaacagaatacatttttttcagcctttatctagatgaggtaaagggaatcattcttatggtgctcttggagagtttcaggcctgtgcatgtgtgtacagcaggaggtaatatgctataatgtctgctgtaatatatttgcacagtagatgctatggatcattctgagctcagggtccagactttattcttattcccagaattttgtgttacgtttttacctcctaacatatgacacttcatcttatattaaggaaggtttagaatatctaatacgacttgaattcatttgttactaagccttctcaggcaagctgtatactagttactggtctccactgccatgccttttcaaggttcccatggtccagaatgatgtttgattcttaatttttctgtcccttttataatttgttttaatgattttgctacatttggaattcaataaaaaatgtgaacaataaaaaaaaaaaa

SEQ ID NO: 365856 - DNA, 1289 bp, Homo sapiens
cgatgattggctggagtggcccgagtcgggaaaatggctgcgagtacctccatggtcccggtggctgtgacggcggcagtggcgcctgtcctgtccataaacagcgatttctcagatttgcgggaaattaaaaagcaactgctgcttattgcgggccttacccgggagcggggcctactacacagtagcaaatggtcggcggagttggctttctctctccctgcattgcctctggccgagctgcaaccgcctccgcctattacagaggaagatgcccaggatatggatgcctataccctggccaaggcctactttgacgttaaagagtatgatcgggcagcacatttcctgcatggctgcaatagcaagaaagcctattttctgtatatgtattccagatatctggtgagggccattttaaaatgtcattctgcctttagtgaaacatccatatttagaaccaatggaaaagttaaatcttttaaatagcttagcagtgggccactgaatgaatgtactttatacatagcaataataaaaaaaagatatcataaataaagttaaaaaggatggtagagaagaaaatattcttaggaatgactaacaggataagtaacaacctgattatttatttactttaggttatataaggttcttcatgcctgtgaattatattattgtgtaagaattaagttaaaaagcctgggctgacttttaaatttataaattcatttatcatgtttatagtatatttattgtttttctttcatggctattaaaaagtatgactgtaaaggacaatgcaagtaaaccaacttaatactgtattgaataataagtacaatttattattttactttgaaacattatgaatttactttcctactttttcttagttgttatctatataaattgattaaaaaaacattttatgtacttctcatttcctagtacaggttgagtatcccttatttgaagtgcttgggaccaaaagtgtttcagatttcagatttttttcagattttggtatatttgcattatacttactggttgaaataaaaaatgctgcagtgagtgtcattggtgctttgagtgtcattggtgctgaaaaagttttgggttttggagcaatgcagatttcagatcttatgatttaggttgatcaactattagcatagcttgtatttgtcaagcgtggtaaattcttgcagttatggactatgtttaagtcatctttgtttttttttttttttccaatttaccattttaacatttttaaagtgtacagt

SEQ ID NO: 365857 - DNA, 318 bp, Homo sapiens
cctgtgaagacgtgcctttcgtcaagattgtaagtttcctgaggccttcccacccatgcggaactgaaaaaatcttcctgtgacttcctacaacttttgggataaggaccaaagtatttcaaatgacctacaagatcctctatcatctggactatggacttacttgctcactccagctgtcctatgctttcttcagcgcctccagtgtagcctgctctctttcacctcagggctaacttctattttttctccaggtcgaatgatctaaatatcacttcctcagggtggaaggaaatcttctgggactagctagtcaag

SEQ ID NO: 365858 - DNA, 422 bp, Homo sapiens
gcgtcgacgatctgtgggatgttcatgaaatcagtcttttgtgacatgaattatgaatatttttctctttgactgctgtctcgtagagattgcaacctatttatgttcccacatctttaccaacagtaaagtcttttactttacaaaaacagtatgttggccagggaagatggctcatgcctgcaatcccagcactttgggatgctgaggtgggtggattgcatgagcctaggagttcgagaccagcctgggcagcgtggcgagacctcatctctacaaagaaacaaaaaaattagctgggcaaggtggtgcacgcctgtagtccagctactctgggggctgaggtgggaggatcacttgagcccggagatagggtctcactgtcatccaggtcgacgcggccgcaattttagtagtagtag

SEQ ID NO: 365859 - DNA, 3888 bp, Homo sapiens
gtcgacccacgcgtcccgtccccctgctggggacagcagcttgggtccagcagagagctggctgggggcttgacaggagtttatcctaactgatgctgggtgggcgcaggccctgagatgggcgtcagggagaggggacgccagacacacggcctgagcagggtgaggagcagctgccagccccggcaggcccaggccctgtctgggtgcacaggacagagacacagcaagatgcccagggagtgccgcttcctgggctagagacaagcaccagcctgcagtggagaacgcaggaccccgctgcccagaaggagcagccacggcctgcggaggactggcccagcaaggtcccaggtcttccctctcctcagcgcctaagagagaggcccagtgcgggtgaggagtcgcgaggaagaggcggaaggcgccggaaggcaccatgttccgcaagaaaaagaagaaacgccctgagatctcagcgccacagaacttccagcaccgtgtccacacctccttcgaccccaaagaaggcaagtttgtgggcctccccccacaatggcagaacatcctggacacactgcggcgccccaagcccgtggtggacccttcgcgaatcacacgggtgcagctccagcccatgaagacagtggtgcggggcagcgcgatgcctgtggatggctacatctcggggctgctcaacgacatccagaagttgtcagtcatcagctccaacaccctgcgtggccgcagccccaccagccggcggcgggcacagtccctggggctgctgggggatgagcactgggccaccgacccagacatgtacctccagagcccccagtctgagcgcactgacccccacggcctctacctcagctgcaacgggggcacaccagcaggccacaagcagatgccgtggcccgagccacagagcccacgggtcctgcccaatgggctggctgcaaaggcacagtccctgggccccgccgagtttcagggtgcctcgcagcgctgtctgcagctgggtgcctgcctgcagagctccccaccaggagcctcgccccccacgggcaccaataggcatggaatgaaggctgccaagcatggctctgaggaggcccggccacagtcctgcctggtgggctcagccacaggcaggccaggtggggaaggcagccctagccctaagacccgggagagcagcctgaagcgcaggctattccgaagcatgttcctgtccactgctgccacagcccctccaagcagcagcaagccaggccctccaccacagagcaagcccaactcctctttccgaccgccgcagaaagacaaccccccaagcctggtggccaaggcccagtccttgccctcggaccagccggtggggaccttcagccctctgaccacttcggataccagcagcccccagaagtccctccgcacagccccggccacaggccagcttccaggccggtcttccccagcgggatccccccgcacctggcacgcccagatcagcaccagcaacctgtacctgccccaggaccccacggttgccaagggtgccctggctggtgaggacacaggtgttgtgacacatgagcagttcaaggctgcgctcaggatggtggtggaccagggtgacccccggctgctgctggacagctacgtgaagattggcgagggctccaccggcatcgtctgcttggcccgggagaagcactcgggccgccaggtggccgtcaagatgatggacctcaggaagcagcagcgcagggagctgctcttcaacgaggtggtgatcatgcgggactaccagcacttcaacgtggtggagatgtacaagagctacctggtgggcgaggagctgtgggtgctcatggagttcctgcagggaggagccctcacagacatcgtctcccaagtcaggctgaatgaggagcagattgccactgtgtgtgaggctgtgctgcaggccctggcctacctgcatgctcagggtgtcatccaccgggacatcaagagtgactccatcctgctgaccctcgatggcagggtgaagctctcggacttcggattctgtgctcagatcagcaaagacgtccctaagaggaagtccctggtgggaaccccctactggatggctcctgaagtgatctccaggtctttgtatgccactgaggtggatatctggtctctgggcatcatggtgattgagatggtagatggggagccaccgtacttcagtgactccccagtgcaagccatgaagaggctccgggacagccccccacccaagctgaaaaactctcacaaggtctccccagtgctgcgagacttcctggagcggatgctggtgcgggacccccaagagagagccacagcccaggagctcctagaccaccccttcctgctgcagacagggctacctgagtgcctggtgcccctgatccagctctaccgaaagcagacctccacctgctgagcccaccccaagtatgcctgccacctacgcccacaggcagggcacactgggcagccagcctgccggcaggacttgcctgcctcctcctctcagtattctctccaaagattgaaatgtgaagccccagccccaccctctgcccttcagcctactgggccaggccggacctgccccctcagtgtctctccctcccgagtccccagatggagacccctttctacaggatgaccccttgatatttgcacagggatatttctaagaaacgcagaggccagcgttcctggcctctgcagccaacacagtagaaaaggctgctgtggttttttaaaggcagttgtccactagtgtcctaggccactgcagagggcagactgctggtctccacagatacctgctgttctcagctccagcttcaaacctcgagtctcgagagggccacggggtggtttttatgaccggaatcccgcttcctccctcacgtctgatgtcctgaaggtgcagtcccacctgtacagcccctccccgcccagaactgtgaatggcctgctccaggccatggctgggggcagggagtgaggggacaatttctgagtgaaagagaaagaatggggtcggtggtgaaggtgctctcactttacagaatggagagaacatcgtgtgtgtgtgtgtgtgtgtgtgtgtgtgtgtgtgtgtgtgtgtgtgtgtaaggggaggaaagccaccttgacagcccaggtccctccaggtcacccacagccagtttcaggaaggctgcccctctctcccactaagttctggcctgaagggacctgctttcttggcctggcttccacctctccactcctgtgtctacctggccagtggagtggtccatgctaagtctaacactcctgggagctcaggaggcttctgagcttctcctgtactgtgcatcgtgagggccagagacaggaatgtaaggattggcaactgtgttacctttcaagtttatctcaataaccaggtcatcagggacccattgttctcttcagaaccctatctgggagagaaggcgaaccacctccgggtttccatcatgtcaaggtcacaggcatccatgtgtgcaaaccatctgccccagctgcctccacagactgctgtctccttgtcctcctcggccctgccccacttcagggctgctgtgagatggaattccaggaaagaacttcaggtgtctggaccctttctatctagataatatttttagattcttctgctccctagtgacctacctgggggcaaagaaattgcaaggacttttttttaagggtcagagttttcaaaacaaaagcatcttccctagaaatttttgtgaattgtttgcacttgtgcctgttttaaattaaattgagtgttcaaagcca

SEQ ID NO: 365860 - DNA, 3692 bp, Homo sapiens
agccaggagttcagtcgggaggcgggcgcggagcggttcccagcgcctggacgtcagccagtcgcaacacccgcgggaacacttgctacatttgccataatgcatttctgatctgtttccgcgcaggcctgcggaggactggcccagcaaggtcccaggtcttccctctcctcagcgcctaagagagaggcccagtgcgggtgaggagtcgcgaggaagaggcggaaggcgccggaaggcaccatgttccgcaagaaaaagaagaaacgccctgagatctcagcgccacagaacttccagcaccgtgtccacacctccttcgaccccaaagaaggcaagtttgtgggcctccccccacaatggcagaacatcctggacacactgcggcgccccaagcccgtggtggacccttcgcgaatcacacgggtgcagctccagcccatgaagacagtggtgcggggcagcgcgatgcctgtggatggctacatctcggggctgctcaacgacatccagaagttgtcagtcatcagctccaacaccctgcgtggccgcagccccaccagccggcggcgggcacagtccctggggctgctgggggatgagcactgggccaccgacccagacatgtacctccagagcccccagtctgagcgcactgacccccacggcctctacctcagctgcaacgggggcacaccagcaggccacaagcagatgccgtggcccgagccacagagcccacgggtcctgcccaatgggctggctgcaaaggcacagtccctgggccccgccgagtttcagggtgcctcgcagcgctgtctgcagctgggtgcctgcctgcagagctccccaccaggagcctcgccccccacgggcaccaataggcatggaatgaaggctgccaagcatggctctgaggaggcccggccacagtcctgcctggtgggctcagccacaggcaggccaggtggggaaggcagccctagccctaagacccgggagagcagcctgaagcgcaggctattccgaagcatgttcctgtccactgctgccacagcccctccaagcagcagcaagccaggccctccaccacagagcaagcccaactcctctttccgaccgccgcagaaagacaaccccccaagcctggtggccaaggcccagtccttgccctcggaccagccggtggggaccttcagccctctgaccacttcggataccagcagcccccagaagtccctccgcacagccccggccacaggccagcttccaggccggtcttccccagcgggatccccccgcacctggcacgcccagatcagcaccagcaacctgtacctgccccaggaccccacggttgccaagggtgccctggctggtgaggacacaggtgttgtgacacatgagcagttcaaggctgcgctcaggatggtggtggaccagggtgacccccggctgctgctggacagctacgtgaagattggcgagggctccaccggcatcgtctgcttggcccgggagaagcactcgggccgccaggtggccgtcaagatgatggacctcaggaagcagcagcgcagggagctgctcttcaacgaggtggtgatcatgcgggactaccagcacttcaacgtggtggagatgtacaagagctacctggtgggcgaggagctgtgggtgctcatggagttcctgcagggaggagccctcacagacatcgtctcccaagtcaggctgaatgaggagcagattgccactgtgtgtgaggctgtgctgcaggccctggcctacctgcatgctcagggtgtcatccaccgggacatcaagagtgactccatcctgctgaccctcgatggcagggtgaagctctcggacttcggattctgtgctcagatcagcaaagacgtccctaagaggaagtccctggtgggaaccccctactggatggctcctgaagtgatctccaggtctttgtatgccactgaggtggatatctggtctctgggcatcatggtgattgagatggtagatggggagccaccgtacttcagtgactccccagtgcaagccatgaagaggctccgggacagccccccacccaagctgaaaaactctcacaaggtctccccagtgctgcgagacttcctggagcggatgctggtgcgggacccccaagagagagccacagcccaggagctcctagaccaccccttcctgctgcagacagggctacctgagtgcctggtgcccctgatccagctctaccgaaagcagacctccacctgctgagcccaccccaagtatgcctgccacctacgcccacaggcagggcacactgggcagccagcctgccggcaggacttgcctgcctcctcctctcagtattctctccaaagattgaaatgtgaagccccagccccaccctctgcccttcagcctactgggccaggccggacctgccccctcagtgtctctccctcccgagtccccagatggagacccctttctacaggatgaccccttgatatttgcacagggatatttctaagaaacgcagaggccagcgttcctggcctctgcagccaacacagtagaaaaggctgctgtggttttttaaaggcagttgtccactagtgtcctaggccactgcagagggcagactgctggtctccacagatacctgctgttctcagctccagcttcaaacctcgagtctcgagagggccacggggtggtttttatgaccggaatcccgcttcctccctcacgtctgatgtcctgaaggtgcagtcccacctgtacagcccctccccgcccagaactgtgaatggcctgctccaggccatggctgggggcagggagtgaggggacaatttctgagtgaaagagaaagaatggggtcggtggtgaaggtgctctcactttacagaatggagagaacatcgtgtgtgtgtgtgtgtgtgtgtgtgtgtgtgtgtgtgtgtgtgtgtgtgtaaggggaggaaagccaccttgacagcccaggtccctccaggtcacccacagccagtttcaggaaggctgcccctctctcccactaagttctggcctgaagggacctgctttcttggcctggcttccacctctccactcctgtgtctacctggccagtggagtggtccatgctaagtctaacactcctgggagctcaggaggcttctgagcttctcctgtactgtgcatcgtgagggccagagacaggaatgtaaggattggcaactgtgttacctttcaagtttatctcaataaccaggtcatcagggacccattgttctcttcagaaccctatctgggagagaaggcgaaccacctccgggtttccatcatgtcaaggtcacaggcatccatgtgtgcaaaccatctgccccagctgcctccacagactgctgtctccttgtcctcctcggccctgccccacttcagggctgctgtgagatggaattccaggaaagaacttcaggtgtctggaccctttctatctagataatatttttagattcttctgctccctagtgacctacctgggggcaaagaaattgcaaggacttttttttaagggtcagagttttcaaaacaaaagcatcttccctagaaatttttgtgaattgtttgcacttgtgcctgttttaaattaaattgagtgttcaaagcca

SEQ ID NO: 365861 - DNA, 3653 bp, Homo sapiens
ggcgttcccgcgccgaggtccctcccgcggagggcgggcccggctcccacgacctcttcgagcgttcctgggcttcccgctccgcaggcctgcggaggactggcccagcaaggtcccaggtcttccctctcctcagcgcctaagagagaggcccagtgcgggtgaggagtcgcgaggaagaggcggaaggcgccggaaggcaccatgttccgcaagaaaaagaagaaacgccctgagatctcagcgccacagaacttccagcaccgtgtccacacctccttcgaccccaaagaaggcaagtttgtgggcctccccccacaatggcagaacatcctggacacactgcggcgccccaagcccgtggtggacccttcgcgaatcacacgggtgcagctccagcccatgaagacagtggtgcggggcagcgcgatgcctgtggatggctacatctcggggctgctcaacgacatccagaagttgtcagtcatcagctccaacaccctgcgtggccgcagccccaccagccggcggcgggcacagtccctggggctgctgggggatgagcactgggccaccgacccagacatgtacctccagagcccccagtctgagcgcactgacccccacggcctctacctcagctgcaacgggggcacaccagcaggccacaagcagatgccgtggcccgagccacagagcccacgggtcctgcccaatgggctggctgcaaaggcacagtccctgggccccgccgagtttcagggtgcctcgcagcgctgtctgcagctgggtgcctgcctgcagagctccccaccaggagcctcgccccccacgggcaccaataggcatggaatgaaggctgccaagcatggctctgaggaggcccggccacagtcctgcctggtgggctcagccacaggcaggccaggtggggaaggcagccctagccctaagacccgggagagcagcctgaagcgcaggctattccgaagcatgttcctgtccactgctgccacagcccctccaagcagcagcaagccaggccctccaccacagagcaagcccaactcctctttccgaccgccgcagaaagacaaccccccaagcctggtggccaaggcccagtccttgccctcggaccagccggtggggaccttcagccctctgaccacttcggataccagcagcccccagaagtccctccgcacagccccggccacaggccagcttccaggccggtcttccccagcgggatccccccgcacctggcacgcccagatcagcaccagcaacctgtacctgccccaggaccccacggttgccaagggtgccctggctggtgaggacacaggtgttgtgacacatgagcagttcaaggctgcgctcaggatggtggtggaccagggtgacccccggctgctgctggacagctacgtgaagattggcgagggctccaccggcatcgtctgcttggcccgggagaagcactcgggccgccaggtggccgtcaagatgatggacctcaggaagcagcagcgcagggagctgctcttcaacgaggtggtgatcatgcgggactaccagcacttcaacgtggtggagatgtacaagagctacctggtgggcgaggagctgtgggtgctcatggagttcctgcagggaggagccctcacagacatcgtctcccaagtcaggctgaatgaggagcagattgccactgtgtgtgaggctgtgctgcaggccctggcctacctgcatgctcagggtgtcatccaccgggacatcaagagtgactccatcctgctgaccctcgatggcagggtgaagctctcggacttcggattctgtgctcagatcagcaaagacgtccctaagaggaagtccctggtgggaaccccctactggatggctcctgaagtgatctccaggtctttgtatgccactgaggtggatatctggtctctgggcatcatggtgattgagatggtagatggggagccaccgtacttcagtgactccccagtgcaagccatgaagaggctccgggacagccccccacccaagctgaaaaactctcacaaggtctccccagtgctgcgagacttcctggagcggatgctggtgcgggacccccaagagagagccacagcccaggagctcctagaccaccccttcctgctgcagacagggctacctgagtgcctggtgcccctgatccagctctaccgaaagcagacctccacctgctgagcccaccccaagtatgcctgccacctacgcccacaggcagggcacactgggcagccagcctgccggcaggacttgcctgcctcctcctctcagtattctctccaaagattgaaatgtgaagccccagccccaccctctgcccttcagcctactgggccaggccggacctgccccctcagtgtctctccctcccgagtccccagatggagacccctttctacaggatgaccccttgatatttgcacagggatatttctaagaaacgcagaggccagcgttcctggcctctgcagccaacacagtagaaaaggctgctgtggttttttaaaggcagttgtccactagtgtcctaggccactgcagagggcagactgctggtctccacagatacctgctgttctcagctccagcttcaaacctcgagtctcgagagggccacggggtggtttttatgaccggaatcccgcttcctccctcacgtctgatgtcctgaaggtgcagtcccacctgtacagcccctccccgcccagaactgtgaatggcctgctccaggccatggctgggggcagggagtgaggggacaatttctgagtgaaagagaaagaatggggtcggtggtgaaggtgctctcactttacagaatggagagaacatcgtgtgtgtgtgtgtgtgtgtgtgtgtgtgtgtgtgtgtgtgtgtgtgtgtaaggggaggaaagccaccttgacagcccaggtccctccaggtcacccacagccagtttcaggaaggctgcccctctctcccactaagttctggcctgaagggacctgctttcttggcctggcttccacctctccactcctgtgtctacctggccagtggagtggtccatgctaagtctaacactcctgggagctcaggaggcttctgagcttctcctgtactgtgcatcgtgagggccagagacaggaatgtaaggattggcaactgtgttacctttcaagtttatctcaataaccaggtcatcagggacccattgttctcttcagaaccctatctgggagagaaggcgaaccacctccgggtttccatcatgtcaaggtcacaggcatccatgtgtgcaaaccatctgccccagctgcctccacagactgctgtctccttgtcctcctcggccctgccccacttcagggctgctgtgagatggaattccaggaaagaacttcaggtgtctggaccctttctatctagataatatttttagattcttctgctccctagtgacctacctgggggcaaagaaattgcaaggacttttttttaagggtcagagttttcaaaacaaaagcatcttccctagaaatttttgtgaattgtttgcacttgtgcctgttttaaattaaattgagtgttcaaagcca

SEQ ID NO: 365862 - DNA, 1008 bp, Homo sapiens
tagcttcaccccgactacccggcgtgcgcgtcctcctgccggcctgcaggcccggggcctccgcctgcttccccacagctgctccttgcggccccgcttgcgttcacgctgtcgcccgggccggcgcggccgcgggcaaccgctccccctcccacacctaccccgccccctccccgccttttccgccctccggtccccctccctcggcccgctgctgctgctccagatgaggtgatggcaacggccaacttcggcaagatccagatcgggatttacgtggagatcaagcgcagcgatggccgaatacatcaagcaatggtaacatctttaaatgaagataatgaaagtgtaactgttgaatggatagaaaatggagatacaaaaggcaaagagattgacctggagagcatcttttcacttaaccctgaccttgttcctgatgaagaaattgaacccagtccagaaacacctccacctccagcatcctcagccaaagtaaacaaaattgtaaagaatcgacggactgtagcttctattaagaatgaccctccttcaagagataatagagtggttggttcagcacgtgcacggcccagtcaatttcctgaacagtcttcctctgcacaacagaatgcacgtagaaaatctaattgtgtgaaagaagtagaaaaactgcaagaaaaacgagagaaaaggagattgcaacagcaagaacttagagaaaaaagagcccagcaaaaaaaaaacttgtgtggggcggccttgcggacgccgagaaaaaggtttctcaagaacactcgcgtgggggcggcgggggcgccccataggtgaaggcgcacccgggccacagagctgccccgagggagaaaacccgggcaaggcatcagggcggggtttccccccataaaaaaaggcccgcgcggacccggagtgttctcgaacacaccaagggattccgaggcacacacggctctcacagcggggtccagcagggagacgataaatacg

SEQ ID NO: 365863 - DNA, 3969 bp, Homo sapiens
tagcttcaccccgactacccggcgtgcgcgtcctcctgccggcctgcaggcccggggcctccgcctgcttccccacagctgctccttgcggccccgcttgcgttcacgctgtcgcccgggccggcgcggccgcgggcaaccgctccccctcccacacctaccccgccccctccccgccttttccgccctccggtccccctccctcggcccgctgctgctgctccagatgaggtgatggcaacggccaacttcggcaagatccagatcgggatttacgtggagatcaagcgcagcgatggccgaatacatcaagcaatggtaacatctttaaatgaagataatgaaagtgtaactgttgaatggatagaaaatggagatacaaaaggcaaagagattgacctggagagcatcttttcacttaaccctgaccttgttcctgatgaagaaattgaacccagtccagaaacacctccacctccagcatcctcagccaaagtaaacaaaattgtaaagaatcgacggactgtagcttctattaagaatgaccctccttcaagagataatagagtggttggttcagcacgtgcacggcccagtcaatttcctgaacagtcttcctctgcacaacagaatggtagtgtttcagatatatctccagttcaagctgcaaaaaaggaatttggacccccttcacgtagaaaatctaattgtgtgaaagaagtagaaaaactgcaagaaaaacgagagaaaaggagattgcaacagcaagaacttagagaaaaaagagcccaggacgttgatgctacaaacccaaattatgaaattatgtgtatgatcagagactttagaggaagtttggattatagaccattaacaacagcagatcctattgatgaacataggatatgtgtgtgtgtaagaaaacgaccactcaataaaaaagaaactcaaatgaaagatcttgatgtaatcacaattcctagtaaagatgttgtgatggtacatgaaccaaaacaaaaagtagatttaacaaggtacctagaaaaccaaacatttcgttttgattatgcctttgatgactcagctcctaatgaaatggtttacaggtttactgctagaccactagtggaaactatatttgaaaggggaatggctacatgctttgcttatgggcagactggaagtggaaaaactcatactatgggtggtgacttttcaggaaagaaccaagattgttctaaaggaatttatgcattagcagctcgagatgtctttttaatgctaaagaagccaaactataagaagctagaacttcaagtatatgcaaccttctttgaaatttatagtggaaaggtgtttgacttgctaaacaggaaaacaaaattaagagttctagaagatggaaaacagcaggttcaagtggtgggattacaggaacgggaggtcaaatgtgttgaagatgtactgaaactcattgacataggcaacagttgcagaacatccggtcaaacatctgcaaatgcacattcatctcggagccatgcagtgtttcagattattcttagaaggaaaggaaaactacatggcaaattttctctcattgatttggctggaaatgaaagaggagctgatacttccagtgcggacaggcaaactaggcttgaaggtgctgaaattaataaaagccttttagcactcaaggagtgcatcagagccttaggtagaaataaacctcatactcctttccgtgcaagtaaactcactcaggtgttaagagattctttcataggtgaaaactctcgtacctgcatgattgccacaatctctccaggaatggcatcctgtgaaaatactcttaatacattaagatatgcaaatagggtcaaagaattgactgtagatccaactgctgctggtgatgttcgtccaataatgcaccatccaccaaaccagattgatgacttagagacacagtggggtgtggggagttcccctcagagagatgatctaaaacttctttgtgaacaaaatgaagaagaagtctctccacagttgtttactttccacgaagctgtttcacaaatggtagaaatggaagaacaagttgtagaagatcacagggcagtgttccaggaatctattcggtggttagaagatgaaaaggccctcttagagatgactgaagaagtagattatgatgtcgattcatatgctacacaacttgaagctattcttgagcaaaaaatagacattttaactgaactgcgggataaagtgaaatctttccgtgcagctctacaagaggaggaacaagccagcaagcaaatcaacccgaagagaccccgtgccctttaaaccggcatttgctgctaaaggatacccagaaccctcactactgtaacatacaacggttcagctgtaagggccatttgaaagtttggaattttaagtgtctgtggaaaatgttttgtccttcacctgaattacatttcaattttgtgaaacactcttttgtctacaaaatgcttctagtccaggaggcacaaccaagaactgggattaatgaagcattttgtttcatttacacaaatagtgatttacttttggagatccttgtcagttttattttctatttgatgaagtaagactgtggactcaatccagagccagatagtagggggaagccacagcatttccttttaactcagttcaatttttgtagtgagactgagcagttttaaatcctttgcgtgcatgcatacctcatcagtgattgtacataccttgcccactcctagagacagctgtgctcaccttttcctgctttgtgccttgattaaggctactgaccctaaatttctgaagcacagccaagaaaaattacattccttgtcattgtaaattacctttgtgtgtacatttttactgtatttgagacattttttgtgtgtgactagttaattttgcaggatgtgccatatcattgaacggaactaaagtctgtgacagtggatatagctgctggaccattccatcttatatgtaaagaaatctggaattattattttaaaaccatataacatgtgattataatttttcttagcattttctttgtaaagaactacaatataaactagttggtgtataataaaaagtaatgaaattctgagaagagttttatcttaggaaaatacatatatatgcagtgtgtgtgccagtgtggtattaacaagactaatagtgcagtttgatccttaccaatatcattacttaatttgaagtgttcattagcaccccaaaatataccttttctatgtactgttaaaagaaattggcttctgatgcatgaacatttacatgtacattgaaagtagtccataatagaagttagtttaagccaagtgtagacagtacattactcccttgaaaaagaattaagttgaaagagttgactttgccttaaaaggcagatctaacccaagctccatccagtaccaaatgtgaaacttcattgttgtttggtgagaatcgccaaattctcactaatacattggtatggtgtagggcatgctactttttaaacagcagcacttatttttacagattgctactccaaggaagaaaactggccacttttcatgtaaatattttgttcaaagatttgtatatctctctaggagttttccctcagttcccaggatggggtccaggagtagattaacagctaaaaatctcccaaggatatcttgttttgatttatttactccagggaactatcagctccttcacaggagccaaaggggagctatgaatagagggtcacatgagccagattctttactgttcataaaacccagagagtagttgtgaaagatcctaatacaattgtgaaaagctctgtaaacatgaaatctaaaacaaatgtagattttcacaatatgcttattaataaatgaagtctatggaata

SEQ ID NO: 365864 - DNA, 4571 bp, Homo sapiens
tagcttcaccccgactacccggcgtgcgcgtcctcctgccggcctgcaggcccggggcctccgcctgcttccccacagctgctccttgcggccccgcttgcgttcacgctgtcgcccgggccggcgcggccgcgggcaaccgctccccctcccacacctaccccgccccctccccgccttttccgccctccggtccccctccctcggcccgctgctgctgctccagatgaggtgatggcaacggccaacttcggcaagatccagatcgggatttacgtggagatcaagcgcagcgatggccgaatacatcaagcaatggtaacatctttaaatgaagataatgaaagtgtaactgttgaatggatagaaaatggagatacaaaaggcaaagagattgacctggagagcatcttttcacttaaccctgaccttgttcctgatgaagaaattgaacccagtccagaaacacctccacctccagcatcctcagccaaagtaaacaaaattgtaaagaatcgacggactgtagcttctattaagaatgaccctccttcaagagataatagagtggttggttcagcacgtgcacggcccagtcaatttcctgaacagtcttcctctgcacaacagaatggtagtgtttcagatatatctccagttcaagctgcaaaaaaggaatttggacccccttcacgtagaaaatctaattgtgtgaaagaagtagaaaaactgcaagaaaaacgagagaaaaggagattgcaacagcaagaacttagagaaaaaagagcccaggacgttgatgctacaaacccaaattatgaaattatgtgtatgatcagagactttagaggaagtttggattatagaccattaacaacagcagatcctattgatgaacataggatatgtgtgtgtgtaagaaaacgaccactcaataaaaaagaaactcaaatgaaagatcttgatgtaatcacaattcctagtaaagatgttgtgatggtacatgaaccaaaacaaaaagtagatttaacaaggtacctagaaaaccaaacatttcgttttgattatgcctttgatgactcagctcctaatgaaatggtttacaggtttactgctagaccactagtggaaactatatttgaaaggggaatggctacatgctttgcttatgggcagactggaagtggaaaaactcatactatgggtggtgacttttcaggaaagaaccaagattgttctaaaggaatttatgcattagcagctcgagatgtctttttaatgctaaagaagccaaactataagaagctagaacttcaagtatatgcaaccttctttgaaatttatagtggaaaggtgtttgacttgctaaacaggaaaacaaaattaagagttctagaagatggaaaacagcaggttcaagtggtgggattacaggaacgggaggtcaaatgtgttgaagatgtactgaaactcattgacataggcaacagttgcagaacatccggtcaaacatctgcaaatgcacattcatctcggagccatgcagtgtttcagattattcttagaaggaaaggaaaactacatggcaaattttctctcattgatttggctggaaatgaaagaggagctgatacttccagtgcggacaggcaaactaggcttgaaggtgctgaaattaataaaagccttttagcactcaaggagtgcatcagagccttaggtagaaataaacctcatactcctttccgtgcaagtaaactcactcaggtgttaagagattctttcataggtgaaaactctcgtacctgcatgattgccacaatctctccaggaatggcatcctgtgaaaatactcttaatacattaagatatgcaaatagggtcaaagaattgactgtagatccaactgctgctggtgatgttcgtccaataatgcaccatccaccaaaccagattgatgacttagagacacagtggggtgtggggagttcccctcagagagatgatctaaaacttctttgtgaacaaaatgaagaagaagtctctccacagttgtttactttccacgaagctgtttcacaaatggtagaaatggaagaacaagttgtagaagatcacagggcagtgttccaggaatctattcggtggttagaagatgaaaaggccctcttagagatgactgaagaagtagattatgatgtcgattcatatgctacacaacttgaagctattcttgagcaaaaaatagacattttaactgaactgcgggataaagtgaaatctttccgtgcagctctacaagaggaggaacaagccagcaagcaaatcaacccgaagagaccccgtgccctttaaaccggcatttgctgctaaaggatacccagaaccctcactactgtaacatacaacggttcagctgtaagggccatttgaaagtttggaattttaagtgtctgtggaaaatgttttgtccttcacctgaattacatttcaattttgtgaaacactcttttgtctacaaaatgcttctagtccaggaggcacaaccaagaactgggattaatgaagcattttgtttcatttacacaaatagtgatttacttttggagatccttgtcagttttattttctatttgatgaagtaagactgtggactcaatccagagccagatagtagggggaagccacagcatttccttttaactcagttcaatttttgtagtgagactgagcagttttaaatcctttgcgtgcatgcatacctcatcagtgattgtacataccttgcccactcctagagacagctgtgctcaccttttcctgctttgtgccttgattaaggctactgaccctaaatttctgaagcacagccaagaaaaattacattccttgtcattgtaaattacctttgtgtgtacatttttactgtatttgagacattttttgtgtgtgactagttaattttgcaggatgtgccatatcattgaacggaactaaagtctgtgacagtggatatagctgctggaccattccatcttatatgtaaagaaatctggaattattattttaaaaccatataacatgtgattataatttttcttagcattttctttgtaaagaactacaatataaactagttggtgtataataaaaagtaatgaaattctgagaagagttttatcttaggaaaatacatatatatgcagtgtgtgtgccagtgtggtattaacaagactaatagtgcagtttgatccttaccaatatcattacttaatttgaagtgttcattagcaccccaaaatataccttttctatgtactgttaaaagaaattggcttctgatgcatgaacatttacatgtacattgaaagtagtccataatagaagttagtttaagccaagtgtagacagtacattactcccttgaaaaagaattaagttgaaagagttgactttgccttaaaaggcagatctaacccaagctccatccagtaccaaatgtgaaacttcattgttgtttggtgagaatcgccaaattctcactaatacattggtatggtgtagggcatgctactttttaaacagcagcacttatttttacagattgctactccaaggaagaaaactggccacttttcatgtaaatattttgttcaaagatttgtatatctctctaggagttttccctcagttcccaggatggggtccaggagtagattaacagctaaaaatctcccaaggatatcttgttttgatttatttactccagggaactatcagctccttcacaggagccaaaggggagctatgaatagagggtcacatgagccagattctttactgttcataaaacccagagagtagttgtgaaagatcctaatacaattgtgaaaagctctgtaaacatgaaatctaaaacaaatgtagattttcacaatatgcttattaataaatgaagtctatggaataagttttagagataatttacttcagtcacctttgttttggaaaggactcaggttttcttgcagctgtaagatatattctatttgtgtttatttcaaagggaagaggaaggatggagaactgttacaattgaccttgcaaaggatatttaaaaaaaaggtagtttttgagattaaccaactttcaaagggcaataaagacatgtgaatttgctcattttaaagcacaacagatgattagcttcaaatttattatttgcattggatgggtactgtctttggaaagtctccttatagacaaatatgctgccttacactatgatggcttcattctgatcaggtattttaaaaattagtaccagaaaagatactggaggtaatataatacagtccttcagctttacagatagtgaaaactgaaggccagaaaaggaactaaaactcagcagttcataggggtagagggaaataacctgagaaagccgagttaaatcttaaaatttttactataaggatagagatgatacaagtgaactctgcaaaatagttttgtgaaattaaacaaaaaaatctactcttaatgtatattatttcatatttgtttaa

SEQ ID NO: 365865 - DNA, 3112 bp, Homo sapiens
tagcttcaccccgactacccggcgtgcgcgtcctcctgccggcctgcaggcccggggcctccgcctgcttccccacagctgctccttgcggccccgcttgcgttcacgctgtcgcccgggccggcgcggccgcgggcaaccgctccccctcccacacctaccccgccccctccccgccttttccgccctccggtccccctccctcggcccgctgctgctgctccagatgaggtgatggcaacggccaacttcggcaagatccagatcgggatttacgtggagatcaagcgcagcgatggccgaatacatcaagcaatggtaacatctttaaatgaagataatgaaagtgtaactgttgaatggatagaaaatggagatacaaaaggcaaagagattgacctggagagcatcttttcacttaaccctgaccttgttcctgatgaagaaattgaacccagtccagaaacacctccacctccagcatcctcagccaaagtaaacaaaattgtaaagaatcgacggactgtagcttctattaagaatgaccctccttcaagagataatagagtggttggttcagcacgtgcacggcccagtcaatttcctgaacagtcttcctctgcacaacagaatgcacgtagaaaatctaattgtgtgaaagaagtagaaaaactgcaagaaaaacgagagaaaaggagattgcaacagcaagaacttagagaaaaaagagcccaggacgttgatgctacaaacccaaattatgaaattatgtgtatgatcagagactttagaggaagtttggattatagaccattaacaacagcagatcctattgatgaacataggatatgtgtgtgtgtaagaaaacgaccactcaataaaaaagaaactcaaatgaaagatcttgatgtaatcacaattcctagtaaagatgttgtgatggtacatgaaccaaaacaaaaagtagatttaacaaggtacctagaaaaccaaacatttcgttttgattatgcctttgatgactcagctcctaatgaaatggtttacaggtttactgctagaccactagtggaaactatatttgaaaggggaatggctacatgctttgcttatgggcagactggaagtggaaaaactcatactatgggtggtgacttttcaggaaagaaccaagattgttctaaaggaatttatgcattagcagctcgagatgtctttttaatgctaaagaagccaaactataagaagctagaacttcaagtatatgcaaccttctttgaaatttatagtggaaaggtgtttgacttgctaaacaggaaaacaaaattaagagttctagaagatggaaaacagcaggttcaagtggtgggattacaggaacgggaggtcaaatgtgttgaagatgtactgaaactcattgacataggcaacagttgcagaacatccggtcaaacatctgcaaatgcacattcatctcggagccatgcagtgtttcagattattcttagaaggaaaggaaaactacatggcaaattttctctcattgatttggctggaaatgaaagaggagctgatacttccagtgcggacaggcaaactaggcttgaaggtgctgaaattaataaaagccttttagcactcaaggagtgcatcagagccttaggtagaaataaacctcatactcctttccgtgcaagtaaactcactcaggtgttaagagattctttcataggtgaaaactctcgtacctgcatgattgccacaatctctccaggaatggcatcctgtgaaaatactcttaatacattaagatatgcaaatagggtcaaagaattgactgtagatccaactgctgctggtgatgttcgtccaataatgcaccatccaccaaaccagattgatgacttagagacacagtggggtgtggggagttcccctcagagagatgatctaaaacttctttgtgaacaaaatgaagaagaagtctctccacagttgtttactttccacgaagctgtttcacaaatggtagaaatggaagaacaagttgtagaagatcacagggcagtgttccaggaatctattcggtggttagaagatgaaaaggccctcttagagatgactgaagaagtagattatgatgtcgattcatatgctacacaacttgaagctattcttgagcaaaaaatagacattttaactgaactgcgggataaagtgaaatctttccgtgcagctctacaagaggaggaacaagccagcaagcaaatcaacccgaagagaccccgtgccctttaaaccggcatttgctgctaaaggatacccagaaccctcactactgtaacatacaacggttcagctgtaagggccatttgaaagtttggaattttaagtgtctgtggaaaatgttttgtccttcacctgaattacatttcaattttgtgaaacactcttttgtctacaaaatgcttctagtccaggaggcacaaccaagaactgggattaatgaagcattttgtttcatttacacaaatagtgatttacttttggagatccttgtcagttttattttctatttgatgaagtaagactgtggactcaatccagagccagatagtagggggaagccacagcatttccttttaactcagttcaatttttgtagtgagactgagcagttttaaatcctttgcgtgcatgcatacctcatcagtgattgtacataccttgcccactcctagagacagctgtgctcaccttttcctgctttgtgccttgattaaggctactgaccctaaatttctgaagcacagccaagaaaaattacattccttgtcattgtaaattacctttgtgtgtacatttttactgtatttgagacattttttgtgtgtgactagttaattttgcaggatgtgccatatcattgaacggaactaaagtctgtgacagtggatatagctgctggaccattccatcttatatgtaaagaaatctggaattattattttaaaaccatataacatgtgattataatttttcttagcattttctttgtaaagaactacaatataaactagttggtgtataataaaaagtaatgaaattctga

SEQ ID NO: 365866 - DNA, 2871 bp, Homo sapiens
ggacgcgtgggtcgacccacgcgatccggatttacgtggagatcaagcgcagcgatggccgaatacatcaagcaatggtaacatctttaaatgaagataatgaaagtgtaactgttgaatggatagaaaatggagatacaaaaggcaaagagattgacctggagagcatcttttcacttaaccctgaccttgttcctgatgaagaaattgaacccagtccagaaacacctccacctccagcatcctcagccaaagtaaacaaaattgtaaagaatcgacggactgtagcttctattaagaatgaccctccttcaagagataatagagtggttggttcagcacgtgcacggcccagtcaatttcctgaacagtcttcctctgcacaacagaatgcacgtagaaaatctaattgtgtgaaagaagtagaaaaactgcaagaaaaacgagagaaaaggagattgcaacagcaagaacttagagaaaaaagagcccaggacgttgatgctacaaacccaaattatgaaattatgtgtatgatcagagactttagaggaagtttggattatagaccattaacaacagcagatcctattgatgaacataggatatgtgtgtgtgtaagaaaacgaccactcaataaaaaagaaactcaaatgaaagatcttgatgtaatcacaattcctagtaaagatgttgtgatggtacatgaaccaaaacaaaaagtagatttaacaaggtacctagaaaaccaaacatttcgttttgattatgcctttgatgactcagctcctaatgaaatggtttacaggtttactgctagaccactagtggaaactatatttgaaaggggaatggctacatgctttgcttatgggcagactggaagtggaaaaactcatactatgggtggtgacttttcaggaaagaaccaagattgttctaaaggaatttatgcattagcagctcgagatgtctttttaatgctaaagaagccaaactataagaagctagaacttcaagtatatgcaaccttctttgaaatttatagtggaaaggtgtttgacttgctaaacaggaaaacaaaattaagagttctagaagatggaaaacagcaggttcaagtggtgggattacaggaacgggaggtcaaatgtgttgaagatgtactgaaactcattgacataggcaacagttgcagaacatccggtcaaacatctgcaaatgcacattcatctcggagccatgcagtgtttcagattattcttagaaggaaaggaaaactacatggcaaattttctctcattgatttggctggaaatgaaagaggagctgatacttccagtgcggacaggcaaactaggcttgaaggtgctgaaattaataaaagccttttagcactcaaggagtgcatcagagccttaggtagaaataaacctcatactcctttccgtgcaagtaaactcactcaggtgttaagagattctttcataggtgaaaactctcgtacctgcatgattgccacaatctctccaggaatggcatcctgtgaaaatactcttaatacattaagatatgcaaatagggtcaaagaattgactgtagatccaactgctgctggtgatgttcgtccaataatgcaccatccaccaaaccagattgatgacttagagacacagtggggtgtggggagttcccctcagagagatgatctaaaacttctttgtgaacaaaatgaagaagaagtctctccacagttgtttactttccacgaagctgtttcacaaatggtagaaatggaagaacaagttgtagaagatcacagggcagtgttccaggaatctattcggtggttagaagatgaaaaggccctcttagagatgactgaagaagtagattatgatgtcgattcatatgctacacaacttgaagctattcttgagcaaaaaatagacattttaactgaactgcgggataaagtgaaatctttccgtgcagctctacaagaggaggaacaagccagcaagcaaatcaacccgaagagaccccgtgccctttaaaccggcatttgctgctaaaggatacccagaaccctcactactgtaacatacaacggttcagctgtaagggccatttgaaagtttggaattttaagtgtctgtggaaaatgttttgtccttcacctgaattacatttcaattttgtgaaacactcttttgtctacaaaatgcttctagtccaggaggcacaaccaagaactgggattaatgaagcattttgtttcatttacacaaatagtgatttacttttggagatccttgtcagttttattttctatttgatgaagtaagactgtggactcaatccagagccagatagtagggggaagccacagcatttccttttaactcagttcaatttttgtagtgagactgagcagttttaaatcctttgcgtgcatgcatacctcatcagtgattgtacataccttgcccactcctagagacagctgtgctcaccttttcctgctttgtgccttgattaaggctactgaccctaaatttctgaagcacagccaagaaaaattacattccttgtcattgtaaattacctttgtgtgtacatttttactgtatttgagacattttttgtgtgtgactagttaattttgcaggatgtgccatatcattgaacggaactaaagtctgtgacagtggatatagctgctggaccattccatcttatatgtaaagaaatctggaattattattttaaaaccatataacatgtgattataatttttcttagcattttctttgtaaagaactacaatataaactagttggtgtataataaaaagtaatgaaattctga

SEQ ID NO: 365867 - DNA, 2026 bp, Homo sapiens
attctccctactgtatcctaggtaaagagtaactgattcctctagaaatagaaaatttgagttgctttttaaaaatatttgttggatctcaattttctgtatatgaaatttttgacagctcgagatgtctttttaatgctaaagaagccaaactataagaagctagaacttcaagtatatgcaaccttctttgaaatttatagtggaaaggtgtttgacttgctaaacaggaaaacaaaattaagagttctagaagatggaaaacagcaggttcaagtggtgggattacaggaacgggaggtcaaatgtgttgaagatgtactgaaactcattgacataggcaacagttgcagaacatccggtcaaacatctgcaaatgcacattcatctcggagccatgcagtgtttcagattattcttagaaggaaaggaaaactacatggcaaattttctctcattgatttggctggaaatgaaagaggagctgatacttccagtgcggacaggcaaactaggcttgaaggtgctgaaattaataaaagccttttagcactcaaggagtgcatcagagccttaggtagaaataaacctcatactcctttccgtgcaagtaaactcactcaggtgttaagagattctttcataggtgaaaactctcgtacctgcatgattgccacaatctctccaggaatggcatcctgtgaaaatactcttaatacattaagatatgcaaatagggtcaaagaattgactgtagatccaactgctgctggtgatgttcgtccaataatgcaccatccaccaaaccagattgatgacttagagacacagtggggtgtggggagttcccctcagagagatgatctaaaacttctttgtgaacaaaatgaagaagaagtctctccacagttgtttactttccacgaagctgtttcacaaatggtagaaatggaagaacaagttgtagaagatcacagggcagtgttccaggaatctattcggtggttagaagatgaaaaggccctcttagagatgactgaagaagtagattatgatgtcgattcatatgctacacaacttgaagctattcttgagcaaaaaatagacattttaactgaactgcgggataaagtgaaatctttccgtgcagctctacaagaggaggaacaagccagcaagcaaatcaacccgaagagaccccgtgccctttaaaccggcatttgctgctaaaggatacccagaaccctcactactgtaacatacaacggttcagctgtaagggccatttgaaagtttggaattttaagtgtctgtggaaaatgttttgtccttcacctgaattacatttcaattttgtgaaacactcttttgtctacaaaatgcttctagtccaggaggcacaaccaagaactgggattaatgaagcattttgtttcatttacacaaatagtgatttacttttggagatccttgtcagttttattttctatttgatgaagtaagactgtggactcaatccagagccagatagtagggggaagccacagcatttccttttaactcagttcaatttttgtagtgagactgagcagttttaaatcctttgcgtgcatgcatacctcatcagtgattgtacataccttgcccactcctagagacagctgtgctcaccttttcctgctttgtgccttgattaaggctactgaccctaaatttctgaagcacagccaagaaaaattacattccttgtcattgtaaattacctttgtgtgtacatttttactgtatttgagacattttttgtgtgtgactagttaattttgcaggatgtgccatatcattgaacggaactaaagtctgtgacagtggatatagctgctggaccattccatcttatatgtaaagaaatctggaattattattttaaaaccatataacatgtgattataatttttcttagcattttctttgtaaagaactacaatataaactagttggtgtataataaaaagtaatgaaattctga

SEQ ID NO: 365868 - DNA, 1353 bp, Homo sapiens
actcgggaagctgaggtgggagaattgcttgaacccatgaggtggaggttgcagtgagcctagatcgcaccattgcactcaagcttgggtgacagagtgaggactccatctcaaaaaaaaaaaggtagactatgtattttacaatgtgaaacctgcctatactctaggaggaattccaataaattaaaacagagaactgtaaatgtgccaaacagaacagaaagctattgaaagatacagaaaaacaggtatttctggaaatctgtaacaaaaaactttcgcaatagttgagcattctatttagttccgagtttctagacaacaaagaacaaaaggaaaaatactgagttactgttaggaaataacacagctgacttgattgaacccataaagttgtaaactcttactgcgtgtaatacaatacttattccctctttcttttctttttccaagataaagtgaaatctttccgtgcagctctacaagaggaggaacaagccagcaagcaaatcaacccgaagagaccccgtgccctttaaaccggcatttgctgctaaaggatacccagaaccctcactactgtaacatacaacggttcagctgtaagggccatttgaaagtttggaattttaagtgtctgtggaaaatgttttgtccttcacctgaattacatttcaattttgtgaaacactcttttgtctacaaaatgcttctagtccaggaggcacaaccaagaactgggattaatgaagcattttgtttcatttacacaaatagtgatttacttttggagatccttgtcagttttattttctatttgatgaagtaagactgtggactcaatccagagccagatagtagggggaagccacagcatttccttttaactcagttcaatttttgtagtgagactgagcagttttaaatcctttgcgtgcatgcatacctcatcagtgattgtacataccttgcccactcctagagacagctgtgctcaccttttcctgctttgtgccttgattaaggctactgaccctaaatttctgaagcacagccaagaaaaattacattccttgtcattgtaaattacctttgtgtgtacatttttactgtatttgagacattttttgtgtgtgactagttaattttgcaggatgtgccatatcattgaacggaactaaagtctgtgacagtggatatagctgctggaccattccatcttatatgtaaagaaatctggaattattattttaaaaccatataacatgtgattataatttttcttagcattttctttgtaaagaactacaatataaactagttggtgtataataaaaagtaatgaaattctga

SEQ ID NO: 365869 - DNA, 625 bp, Homo sapiens
ataatttcttaactatttttattttaaggaagaagaagtctctccacagttgtttactttccacgaagctgtttcacaaatggtagaaatggaagaacaagttgtagaagatcacagggcagtgttccaggtaaagtaagacaggactttccttcaaaatatttcttgagataaattaagaatttgtcataattccttaaatatcacactattccttaaaaaatacttgtttgtatatatgtatatgtgtatttgtagggcatgtgacatggcaaatttttaatacaatgaacgatggctacaaataacatttctttgcaccatggtgaaacgttctactttatttacctcccgtcccccttattggtttttgtcatttgtccatttttagggaagagtgtcacttctgcccaccagtacttccttctaaatgttaggccaatgtatttgatagcagttaagaaaaactcttttaaagggttttggagcagttgaggaagtatcagttgttgcagaaaagagagactacttacttcaggagatggagagttactgctctgagctgtcagtggcaagttaagggaagggtgttatatcaccacctgtagcagtaactccttaggca

SEQ ID NO: 365870 - DNA, 3169 bp, Homo sapiens
tagcttcaccccgactacccggcgtgcgcgtcctcctgccggcctgcaggcccggggcctccgcctgcttccccacagctgctccttgcggccccgcttgcgttcacgctgtcgcccgggccggcgcggccgcgggcaaccgctccccctcccacacctaccccgccccctccccgccttttccgccctccggtccccctccctcggcccgctgctgctgctccagatgaggtgatggcaacggccaacttcggcaagatccagatcgggatttacgtggagatcaagcgcagcgatggccgaatacatcaagcaatggtaacatctttaaatgaagataatgaaagtgtaactgttgaatggatagaaaatggagatacaaaaggcaaagagattgacctggagagcatcttttcacttaaccctgaccttgttcctgatgaagaaattgaacccagtccagaaacacctccacctccagcatcctcagccaaagtaaacaaaattgtaaagaatcgacggactgtagcttctattaagaatgaccctccttcaagagataatagagtggttggttcagcacgtgcacggcccagtcaatttcctgaacagtcttcctctgcacaacagaatggtagtgtttcagatatatctccagttcaagctgcaaaaaaggaatttggacccccttcacgtagaaaatctaattgtgtgaaagaagtagaaaaactgcaagaaaaacgagagaaaaggagattgcaacagcaagaacttagagaaaaaagagcccaggacgttgatgctacaaacccaaattatgaaattatgtgtatgatcagagactttagaggaagtttggattatagaccattaacaacagcagatcctattgatgaacataggatatgtgtgtgtgtaagaaaacgaccactcaataaaaaagaaactcaaatgaaagatcttgatgtaatcacaattcctagtaaagatgttgtgatggtacatgaaccaaaacaaaaagtagatttaacaaggtacctagaaaaccaaacatttcgttttgattatgcctttgatgactcagctcctaatgaaatggtttacaggtttactgctagaccactagtggaaactatatttgaaaggggaatggctacatgctttgcttatgggcagactggaagtggaaaaactcatactatgggtggtgacttttcaggaaagaaccaagattgttctaaaggaatttatgcattagcagctcgagatgtctttttaatgctaaagaagccaaactataagaagctagaacttcaagtatatgcaaccttctttgaaatttatagtggaaaggtgtttgacttgctaaacaggaaaacaaaattaagagttctagaagatggaaaacagcaggttcaagtggtgggattacaggaacgggaggtcaaatgtgttgaagatgtactgaaactcattgacataggcaacagttgcagaacatccggtcaaacatctgcaaatgcacattcatctcggagccatgcagtgtttcagattattcttagaaggaaaggaaaactacatggcaaattttctctcattgatttggctggaaatgaaagaggagctgatacttccagtgcggacaggcaaactaggcttgaaggtgctgaaattaataaaagccttttagcactcaaggagtgcatcagagccttaggtagaaataaacctcatactcctttccgtgcaagtaaactcactcaggtgttaagagattctttcataggtgaaaactctcgtacctgcatgattgccacaatctctccaggaatggcatcctgtgaaaatactcttaatacattaagatatgcaaatagggtcaaagaattgactgtagatccaactgctgctggtgatgttcgtccaataatgcaccatccaccaaaccagattgatgacttagagacacagtggggtgtggggagttcccctcagagagatgatctaaaacttctttgtgaacaaaatgaagaagaagtctctccacagttgtttactttccacgaagctgtttcacaaatggtagaaatggaagaacaagttgtagaagatcacagggcagtgttccaggaatctattcggtggttagaagatgaaaaggccctcttagagatgactgaagaagtagattatgatgtcgattcatatgctacacaacttgaagctattcttgagcaaaaaatagacattttaactgaactgcgggataaagtgaaatctttccgtgcagctctacaagaggaggaacaagccagcaagcaaatcaacccgaagagaccccgtgccctttaaaccggcatttgctgctaaaggatacccagaaccctcactactgtaacatacaacggttcagctgtaagggccatttgaaagtttggaattttaagtgtctgtggaaaatgttttgtccttcacctgaattacatttcaattttgtgaaacactcttttgtctacaaaatgcttctagtccaggaggcacaaccaagaactgggattaatgaagcattttgtttcatttacacaaatagtgatttacttttggagatccttgtcagttttattttctatttgatgaagtaagactgtggactcaatccagagccagatagtagggggaagccacagcatttccttttaactcagttcaatttttgtagtgagactgagcagttttaaatcctttgcgtgcatgcatacctcatcagtgattgtacataccttgcccactcctagagacagctgtgctcaccttttcctgctttgtgccttgattaaggctactgaccctaaatttctgaagcacagccaagaaaaattacattccttgtcattgtaaattacctttgtgtgtacatttttactgtatttgagacattttttgtgtgtgactagttaattttgcaggatgtgccatatcattgaacggaactaaagtctgtgacagtggatatagctgctggaccattccatcttatatgtaaagaaatctggaattattattttaaaaccatataacatgtgattataatttttcttagcattttctttgtaaagaactacaatataaactagttggtgtataataaaaagtaatgaaattctga

SEQ ID NO: 365871 - DNA, 1004 bp, Homo sapiens
tagcttcaccccgactacccggcgtgcgcgtcctcctgccggcctgcaggcccggggcctccgcctgcttccccacagctgctccttgcggccccgcttgcgttcacgctgtcgcccgggccggcgcggccgcgggcaaccgctccccctcccacacctaccccgccccctccccgccttttccgccctccggtccccctccctcggcccgctgctgctgctccagatgaggtgatggcaacggccaacttcggcaagatccagatcgggatttacgtggagatcaagcgcagcgatggccgaatacatcaagcaatggtaacatctttaaatgaagataatgaaagtgtaactgttgaatggatagaaaatggagatacaaaaggcaaagagattgacctggagagcatcttttcacttaaccctgaccttgttcctgatgaagaaattgaacccagtccagaaacacctccacctccagcatcctcagccaaagtaaacaaaattgtaaagaatcgacggactgtagcttctattaagaatgaccctccttcaagagataatagagtggttggttcagcacgtgcacggcccagtcaatttcctgaacagtcttcctctgcacaacagaatggtagtgtttcagatatatctccagttcaagctgcaaaaaaggaatttggacccccttgtatgtaaattatgtatcaaggatttagtcattttaggcatacatgtattctctcttggtcatccttttaagtcctcaaagagtaaacactctaaatacaagcttgattgcagatttcattttaccactgtggaaaatttaacttcttcttattagtctgttaattgggttttttaaagtatattttggagcaaaaatttttttgtgaaattatagcaatgtttcagtttgagtttaaaattctgggcagatgataatttgtcagatgttacagaagaatgtgttgggctccttgattctttgaattaaaaag

SEQ ID NO: 365872 - DNA, 3285 bp, Homo sapiens
tagcttcaccccgactacccggcgtgcgcgtcctcctgccggcctgcaggcccggggcctccgcctgcttccccacagctgctccttgcggccccgcttgcgttcacgctgtcgcccgggccggcgcggccgcgggcaaccgctccccctcccacacctaccccgccccctccccgccttttccgccctccggtccccctccctcggcccgctgctgctgctccagatgaggtgatggcaacggccaacttcggcaagatccagatcgggatttacgtggagatcaagcgcagcgatggccgaatacatcaagcaatggtaacatctttaaatgaagataatgaaagtgtaactgttgaatggatagaaaatggagatacaaaaggcaaagagattgacctggagagcatcttttcacttaaccctgaccttgttcctgatgaagaaattgaacccagtccagaaacacctccacctccagcatcctcagccaaagtaaacaaaattgtaaagaatcgacggactgtagcttctattaagaatgaccctccttcaagagataatagagtggttggttcagcacgtgcacggcccagtcaatttcctgaacagtcttcctctgcacaacagaatggtagtgtttcagatatatctccagttcaagctgcaaaaaaggaatttggacccccttcacgtagaaaatctaattgtgtgaaagaagtagaaaaactgcaagaaaaacgagagaaaaggagattgcaacagcaagaacttagagaaaaaagagcccaggacgttgatgctacaaacccaaattatgaaattatgtgtatgatcagagactttagaggaagtttggattatagaccattaacaacagcagatcctattgatgaacataggatatgtgtgtgtgtaagaaaacgaccactcaataaaaaagaaactcaaatgaaagatcttgatgtaatcacaattcctagtaaagatgttgtgatggtacatgaaccaaaacaaaaagtagatttaacaaggtacctagaaaaccaaacatttcgttttgattatgcctttgatgactcagctcctaatgaaatggtttacaggtttactgctagaccactagtggaaactatatttgaaaggggaatggctacatgctttgcttatgggcagactggaagtggaaaaactcatactatgggtggtgacttttcaggaaagaaccaagattgttctaaaggaatttatgcattagcagctcgagatgtctttttaatgctaaagaagccaaactataagaagctagaacttcaagtatatgcaaccttctttgaaatttatagtggaaaggtgtttgacttgctaaacaggaaaacaaaattaagagttctagaagatggaaaacagcaggttcaagtggtgggattacaggaacgggaggtcaaatgtgttgaagatgtactgaaactcattgacataggcaacagttgcagaacatccggtcaaacatctgcaaatgcacattcatctcggagccatgcagtgtttcagattattcttagaaggaaaggaaaactacatggcaaattttctctcattgatttggctggaaatgaaagaggagctgatacttccagtgcggacaggcaaactaggcttgaaggtgctgaaattaataaaagccttttagcactcaaggagtgcatcagagccttaggtagaaataaacctcatactcctttccgtgcaagtaaactcactcaggtgttaagagattctttcataggtgaaaactctcgtacctgcatgattgccacaatctctccaggaatggcatcctgtgaaaatactcttaatacattaagatatgcaaatagagtaaaggagtttggaattagtccatcagacattcccttctcacagggtagtggcagtcgccctgatctctctccttcttatgaatatgacgacttttctccttcagttaccaggtggtcaaagaattgactgtagatccaactgctgctggtgatgttcgtccaataatgcaccatccaccaaaccagattgatgacttagagacacagtggggtgtggggagttcccctcagagagatgatctaaaacttctttgtgaacaaaatgaagaagaagtctctccacagttgtttactttccacgaagctgtttcacaaatggtagaaatggaagaacaagttgtagaagatcacagggcagtgttccaggaatctattcggtggttagaagatgaaaaggccctcttagagatgactgaagaagtagattatgatgtcgattcatatgctacacaacttgaagctattcttgagcaaaaaatagacattttaactgaactgcgggataaagtgaaatctttccgtgcagctctacaagaggaggaacaagccagcaagcaaatcaacccgaagagaccccgtgccctttaaaccggcatttgctgctaaaggatacccagaaccctcactactgtaacatacaacggttcagctgtaagggccatttgaaagtttggaattttaagtgtctgtggaaaatgttttgtccttcacctgaattacatttcaattttgtgaaacactcttttgtctacaaaatgcttctagtccaggaggcacaaccaagaactgggattaatgaagcattttgtttcatttacacaaatagtgatttacttttggagatccttgtcagttttattttctatttgatgaagtaagactgtggactcaatccagagccagatagtagggggaagccacagcatttccttttaactcagttcaatttttgtagtgagactgagcagttttaaatcctttgcgtgcatgcatacctcatcagtgattgtacataccttgcccactcctagagacagctgtgctcaccttttcctgctttgtgccttgattaaggctactgaccctaaatttctgaagcacagccaagaaaaattacattccttgtcattgtaaattacctttgtgtgtacatttttactgtatttgagacattttttgtgtgtgactagttaattttgcaggatgtgccatatcattgaacggaactaaagtctgtgacagtggatatagctgctggaccattccatcttatatgtaaagaaatctggaattattattttaaaaccatataacatgtgattataatttttcttagcattttctttgtaaagaactacaatataaactagttggtgtataataaaaagtaatgaaattctga

SEQ ID NO: 365873 - DNA, 3308 bp, Homo sapiens
tagcttcaccccgactacccggcgtgcgcgtcctcctgccggcctgcaggcccggggcctccgcctgcttccccacagctgctccttgcggccccgcttgcgttcacgctgtcgcccgggccggcgcggccgcgggcaaccgctccccctcccacacctaccccgccccctccccgccttttccgccctccggtccccctccctcggcccgctgctgctgctccagatgaggtgatggcaacggccaacttcggcaagatccagatcgggatttacgtggagatcaagcgcagcgatggatagagtcttattctgtctcccagactggagtgcaatggtgtgatgtcagttcactgcaacctctgcctcctgggctcaactgatcctccccgctcagcctcccaagtagctgggactacagatgcacaccacatccggccgaatacatcaagcaatggtaacatctttaaatgaagataatgaaagtgtaactgttgaatggatagaaaatggagatacaaaaggcaaagagattgacctggagagcatcttttcacttaaccctgaccttgttcctgatgaagaaattgaacccagtccagaaacacctccacctccagcatcctcagccaaagtaaacaaaattgtaaagaatcgacggactgtagcttctattaagaatgaccctccttcaagagataatagagtggttggttcagcacgtgcacggcccagtcaatttcctgaacagtcttcctctgcacaacagaatggtagtgtttcagatatatctccagttcaagctgcaaaaaaggaatttggacccccttcacgtagaaaatctaattgtgtgaaagaagtagaaaaactgcaagaaaaacgagagaaaaggagattgcaacagcaagaacttagagaaaaaagagcccaggacgttgatgctacaaacccaaattatgaaattatgtgtatgatcagagactttagaggaagtttggattatagaccattaacaacagcagatcctattgatgaacataggatatgtgtgtgtgtaagaaaacgaccactcaataaaaaagaaactcaaatgaaagatcttgatgtaatcacaattcctagtaaagatgttgtgatggtacatgaaccaaaacaaaaagtagatttaacaaggtacctagaaaaccaaacatttcgttttgattatgcctttgatgactcagctcctaatgaaatggtttacaggtttactgctagaccactagtggaaactatatttgaaaggggaatggctacatgctttgcttatgggcagactggaagtggaaaaactcatactatgggtggtgacttttcaggaaagaaccaagattgttctaaaggaatttatgcattagcagctcgagatgtctttttaatgctaaagaagccaaactataagaagctagaacttcaagtatatgcaaccttctttgaaatttatagtggaaaggtgtttgacttgctaaacaggaaaacaaaattaagagttctagaagatggaaaacagcaggttcaagtggtgggattacaggaacgggaggtcaaatgtgttgaagatgtactgaaactcattgacataggcaacagttgcagaacatccggtcaaacatctgcaaatgcacattcatctcggagccatgcagtgtttcagattattcttagaaggaaaggaaaactacatggcaaattttctctcattgatttggctggaaatgaaagaggagctgatacttccagtgcggacaggcaaactaggcttgaaggtgctgaaattaataaaagccttttagcactcaaggagtgcatcagagccttaggtagaaataaacctcatactcctttccgtgcaagtaaactcactcaggtgttaagagattctttcataggtgaaaactctcgtacctgcatgattgccacaatctctccaggaatggcatcctgtgaaaatactcttaatacattaagatatgcaaatagggtcaaagaattgactgtagatccaactgctgctggtgatgttcgtccaataatgcaccatccaccaaaccagattgatgacttagagacacagtggggtgtggggagttcccctcagagagatgatctaaaacttctttgtgaacaaaatgaagaagaagtctctccacagttgtttactttccacgaagctgtttcacaaatggtagaaatggaagaacaagttgtagaagatcacagggcagtgttccaggaatctattcggtggttagaagatgaaaaggccctcttagagatgactgaagaagtagattatgatgtcgattcatatgctacacaacttgaagctattcttgagcaaaaaatagacattttaactgaactgcgggataaagtgaaatctttccgtgcagctctacaagaggaggaacaagccagcaagcaaatcaacccgaagagaccccgtgccctttaaaccggcatttgctgctaaaggatacccagaaccctcactactgtaacatacaacggttcagctgtaagggccatttgaaagtttggaattttaagtgtctgtggaaaatgttttgtccttcacctgaattacatttcaattttgtgaaacactcttttgtctacaaaatgcttctagtccaggaggcacaaccaagaactgggattaatgaagcattttgtttcatttacacaaatagtgatttacttttggagatccttgtcagttttattttctatttgatgaagtaagactgtggactcaatccagagccagatagtagggggaagccacagcatttccttttaactcagttcaatttttgtagtgagactgagcagttttaaatcctttgcgtgcatgcatacctcatcagtgattgtacataccttgcccactcctagagacagctgtgctcaccttttcctgctttgtgccttgattaaggctactgaccctaaatttctgaagcacagccaagaaaaattacattccttgtcattgtaaattacctttgtgtgtacatttttactgtatttgagacattttttgtgtgtgactagttaattttgcaggatgtgccatatcattgaacggaactaaagtctgtgacagtggatatagctgctggaccattccatcttatatgtaaagaaatctggaattattattttaaaaccatataacatgtgattataatttttcttagcattttctttgtaaagaactacaatataaactagttggtgtataataaaaagtaatgaaattctga

SEQ ID NO: 365874 - DNA, 3893 bp, Homo sapiens
tagcttcaccccgactacccggcgtgcgcgtcctcctgccggcctgcaggcccggggcctccgcctgcttccccacagctgctccttgcggccccgcttgcgttcacgctgtcgcccgggccggcgcggccgcgggcaaccgctccccctcccacacctaccccgccccctccccgccttttccgccctccggtccccctccctcggcccgctgctgctgctccagatgaggtgatggcaacggccaacttcggcaagatccagatcgggatttacgtggagatcaagcgcagcgatggccgaatacatcaagcaatggtaacatctttaaatgaagataatgaaagtgtaactgttgaatggatagaaaatggagatacaaaaggcaaagagattgacctggagagcatcttttcacttaaccctgaccttgttcctgatgaagaaattgaacccagtccagaaacacctccacctccagcatcctcagccaaagtaaacaaaattgtaaagaatcgacggactgtagcttctattaagaatgaccctccttcaagagataatagagtggttggttcagcacgtgcacggcccagtcaatttcctgaacagtcttcctctgcacaacagaatggtagtgtttcagatatatctccagttcaagctgcaaaaaaggaatttggacccccttcacgtagaaaatctaattgtgtgaaagaagtagaaaaactgcaagaaaaacgagagaaaaggagattgcaacagcaagaacttagagaaaaaagagcccaggacgttgatgctacaaacccaaattatgaaattatgtgtatgatcagagactttagaggaagtttggattatagaccattaacaacagcagatcctattgatgaacataggatatgtgtgtgtgtaagaaaacgaccactcaataaaaaagaaactcaaatgaaagatcttgatgtaatcacaattcctagtaaagatgttgtgatggtacatgaaccaaaacaaaaagtagatttaacaaggtacctagaaaaccaaacatttcgttttgattatgcctttgatgactcagctcctaatgaaatggtttacaggtttactgctagaccactagtggaaactatatttgaaaggggaatggctacatgctttgcttatgggcagactggaagtggaaaaactcatactatgggtggtgacttttcaggaaagaaccaagattgttctaaaggaatttatgcattagcagctcgagatgtctttttaatgctaaagaagccaaactataagaagctagaacttcaagtatatgcaaccttctttgaaatttatagtggaaaggtgtttgacttgctaaacaggaaaacaaaattaagagttctagaagatggaaaacagcaggttcaagtggtgggattacaggaacgggaggtcaaatgtgttgaagatgtactgaaactcattgacataggcaacagttgcagaacatccggtcaaacatctgcaaatgcacattcatctcggagccatgcagtgtttcagattattcttagaaggaaaggaaaactacatggcaaattttctctcattgatttggctggaaatgaaagaggagctgatacttccagtgcggacaggcaaactaggcttgaaggtgctgaaattaataaaagccttttagcactcaaggagtgcatcagagccttaggtagaaataaacctcatactcctttccgtgcaagtaaactcactcaggtgttaagagattctttcataggtgaaaactctcgtacctgcatgattgccacaatctctccaggaatggcatcctgtgaaaatactcttaatacattaagatatgcaaatagggtcaaagaattgactgtagatccaactgctgctggtgatgttcgtccaataatgcaccatccaccaaaccagattgatgacttagagacacagtggggtgtggggagttcccctcagagagatgatctaaaacttctttgtgaacaaaatgaagaagaagtctctccacagttgtttactttccacgaagctgtttcacaaatggtagaaatggaagaacaagttgtagaagatcacagggcagtgttccaggaatctattcggtggttagaagatgaaaaggccctcttagagatgactgaagaagtagattatgatgtcgattcatatgctacacaacttgaagctattcttgagcaaaaaatagacattttaactgaactgcgggataaagtgaaatctttccgtgcagctctacaagaggaggaacaagccagcaagcaaatcaacccgaagagaccccgtgccctttaaaccggcatttgctgctaaaggatacccagaaccctcactactgtaacatacaacggttcagctgtaagggccatttgaaagtttggaattttaagtgtctgtggaaaatgttttgtccttcacctgaattacatttcaattttgtttcatttacacaaatagtgatttacttttggagatccttgtcagttttattttctatttgatgaagtaagactgtggactcaatccagagccagatagtagggggaagccacagcatttccttttaactcagttcaatttttgtagtgagactgagcagttttaaatcctttgcgtgcatgcatacctcatcagtgattgtacataccttgcccactcctagagacagctgtgctcaccttttcctgctttgtgccttgattaaggctactgaccctaaatttctgaagcacagccaagaaaaattacattccttgtcattgtaaattacctttgtgtgtacatttttactgtatttgagacattttttgtgtgtgactagttaattttgcaggatgtgccatatcattgaacggaactaaagtctgtgacagtggatatagctgctggaccattccatcttatatgtaaagaaatctggaattattattttaaaaccatataacatgtgattataatttttcttagcattttctttgtaaagaactacaatataaactagttggtgtataataaaaagtaatgaaattctgagaagagttttatcttaggaaaatacatatatatgcagtgtgtgtgccagtgtggtattaacaagactaatagtgcagtttgatccttaccaatatcattacttaatttgaagtgttcattagcaccccaaaatataccttttctatgtactgttaaaagaaattggcttctgatgcatgaacatttacatgtacattgaaagtagtccataatagaagttagtttaagccaagtgtagacagtacattactcccttgaaaaagaattaagttgaaagagttgactttgccttaaaaggcagatctaacccaagctccatccagtaccaaatgtgaaacttcattgttgtttggtgagaatcgccaaattctcactaatacattggtatggtgtagggcatgctactttttaaacagcagcacttatttttacagattgctactccaaggaagaaaactggccacttttcatgtaaatattttgttcaaagatttgtatatctctctaggagttttccctcagttcccaggatggggtccaggagtagattaacagctaaaaatctcccaaggatatcttgttttgatttatttactccagggaactatcagctccttcacaggagccaaaggggagctatgaatagagggtcacatgagccagattctttactgttcataaaacccagagagtagttgtgaaagatcctaatacaattgtgaaaagctctgtaaacatgaaatctaaaacaaatgtagattttcacaatatgcttattaataaatgaagtctatggaata

SEQ ID NO: 365875 - DNA, 3294 bp, Homo sapiens
tagcttcaccccgactacccggcgtgcgcgtcctcctgccggcctgcaggcccggggcctccgcctgcttccccacagctgctccttgcggccccgcttgcgttcacgctgtcgcccgggccggcgcggccgcgggcaaccgctccccctcccacacctaccccgccccctccccgccttttccgccctccggtccccctccctcggcccgctgctgctgctccagatgaggtgatggcaacggccaacttcggcaagatccagatcgggatttacgtggagatcaagcgcagcgatggccgaatacatcaagcaatggtaacatctttaaatgaagataatgaaagtgtaactgttgaatggatagaaaatggagatacaaaaggcaaagagattgacctggagagcatcttttcacttaaccctgaccttgttcctgatgaagaaattgaacccagtccagaaacacctccacctccagcatcctcagccaaagtaaacaaaattgtaaagaatcgacggactgtagcttctattaagaatgaccctccttcaagagataatagagtggttggttcagcacgtgcacggcccagtcaatttcctgaacagtcttcctctgcacaacagaatggtagtgtttcagatatatctccagttcaagctgcaaaaaaggaatttggacccccttcacgtagaaaatctaattgtgtgaaagaagtagaaaaactgcaagaaaaacgagagaaaaggagattgcaacagcaagaacttagagaaaaaagagcccaggacgttgatgctacaaacccaaattatgaaattatgtgtatgatcagagactttagaggaagtttggattatagaccattaacaacagcagatcctattgatgaacataggatatgtgtgtgtgtaagaaaacgaccactcaataaaaaagaaactcaaatgaaagatcttgatgtaatcacaattcctagtaaagatgttgtgatggtacatgaaccaaaacaaaaagtagatttaacaaggtacctagaaaaccaaacatttcgttttgattatgcctttgatgactcagctcctaatgaaatggtttacaggtttactgctagaccactagtggaaactatatttgaaaggggaatggctacatgctttgcttatgggcagactggaagtggaaaaactcatactatgggtggtgacttttcaggaaagaaccaagattgttctaaaggaatttatgcattagcagctcgagatgtctttttaatgctaaagaagccaaactataagaagctagaacttcaagtatatgcaaccttctttgaaatttatagtggaaaggtgtttgacttgctaaacaggaaaacaaaattaagagttctagaagatggaaaacagcaggttcaagtggtgggattacaggaacgggaggtcaaatgtgttgaagatgtactgaaactcattgacataggcaacagttgcagaacatccggtcaaacatctgcaaatgcacattcatctcggagccatgcagtgtttcagattattcttagaaggaaaggaaaactacatggcaaattttctctcattgatttggctggaaatgaaagaggagctgatacttccagtgcggacaggcaaactaggcttgaaggtgctgaaattaataaaagccttttagcactcaaggagtgcatcagagccttaggtagaaataaacctcatactcctttccgtgcaagtaaactcactcaggtgttaagagattctttcataggtgaaaactctcgtacctgcatgattgccacaatctctccaggaatggcatcctgtgaaaatactcttaatacattaagatatgcaaatagggtcaaagaattgactgtagatccaactgctgctggtgatgttcgtccaataatgcaccatccaccaaaccagattgatgacttagagacacagtggggtgtggggagttcccctcagagagatgatctaaaacttctttgtgaacaaaatgaagaagaagtctctccacagttgtttactttccacgaagctgtttcacaaatggtagaaatggaagaacaagttgtagaagatcacagggcagtgttccaggaatctattcggtggttagaagatgaaaaggccctcttagagatgactgaagaagtagattatgatgtcgattcatatgctacacaacttgaagctattcttgagcaaaaaatagacattttaactgaactgcgggataaagtgaaatctttccgtgcagctctacaagaggaggaacaagccagcaagcaaatcaacccgaagagaccccgtgccctttaaaccggcatttgctgctaaaggatacccagaaccctcactactgtaacatacaacggttcagctgtaagggccatttgaaagtttggaattttaagtgtctgtggaaaatgttttgtccttcacctgaattacatttcaattttgtgaaacactcttttgtctacaaaatgcttctagtccaggaggcacaaccaagaactgggattaatgaagcattttgtttcatttacacaaatagtgatttacttttggagatccttgtcagttttattttctatttgatgaagtaagactgtggactcaatccagagccagatagtagggggaagccacagcatttccttttaactcagttcaatttttgtagtgagactgagcagttttaaatcctttgcgtgcatgcatacctcatcagtgattgtacataccttgcccactcctagagacagctgtgctcaccttttcctgcttatctcctaggagataagcaggatgctgattttcctacccgtggcccaggtctgtgccttccccatgccaaggactctaggtcaaatgtcaataaatatgaacctcgagaaagttctgaaggccatgacacctgccttgcctccctcttccattctcttaggcacagtaatagcttatttgccctataagaaccttcccagagcagcagaggcccttctactccctcttgactgtctcagcctctgggattgcagcctttgtagtgtgcttccttgcttaaatcagaggtgctgatccagaggctcagtaaccccatcaacttggtggctctggtgtctcacacttgtatccttctgccctcgagacctggcacagcagtatcccttgaagaaatcctgaggctttgtagagtgctcctgaccatgtttaataattcttccctctcctgcttatctagggatcctctag

SEQ ID NO: 365876 - DNA, 505 bp, Homo sapiens
gtgtctgtgttcgttctctcttcctttgacttcaacaagcaaaacctgcctctcccaagggctgttaagaggaaattataagataaaatcctcaatttcaaatcaatctaaaatcttgtgaaaaaggtacacatttctcacttagaaaagggtattaataactgtaattaaaaattaagtttgaagaactaaaagttgcaaaagataccactaaagggatgcatgcagtggctcacacctgaaatcccagcactccgggaggctgaggtaggaggatcacctgagctcaggaatttaagaccagcctgggcaacatagggagacttcatctcaacaaaaaattttaaaaaaaattagctgggcatggtggcacatgcttgtgtttggtcccaactactcgaaaagctgaagtgggaagatcgcttgagcccaggagttcgagcgtatggtgagctatgatcctgctcctgcactccagcctgggtgagacagtaggaacctgtct

SEQ ID NO: 365877 - DNA, 641 bp, Homo sapiens
ggtgggcatctataataagcgactgagctacatagcttttaagcttccttagagctacattaaaattttaatttactttatccttattttaatcaagacagtggttttcaaacactgaattcctacaaatccttcatgctagatagtattataattactaatttacttctgcctatccccagcctgtcactctctatccgaagctcgctgatagatacggactgtctttttttttctgttcgagacagggtctcactcgagttgcccagactgaagtgcagtggcatgatcttggctcaccacagcctcaacctcccaggctcaggtaattttcccacatcagcctccagagtagctgggactacaagtgcacaccaccacacctagctagtttattttatttgtatttttagtagagacagggttttgccatgttgcccaggctggtctcgaactcctggactcaagcgatctgcctgcctcgacctcccaaggtgctggggttacatgcatgagccaccgcgcctggccaggactgtctttcataattatgaatacttagatgccaggaaattttagctttcctttacatagtatgttgtttacaaggaatctgtttttgaaccttactggttctcttt

SEQ ID NO: 365878 - DNA, 654 bp, Homo sapiens
cgtggagtgttgtggcgtgatctcggctctctgcaacctccgtctcctgggttcaagcgattctcctgcctcagctactttggagactgaggtgggagtaccccttgagcctgggaggcgcaggttgcagtgaaccaagatcacatcactgcacttcaacctgggtgacagagcaagaccctgtctcaaaaacaaaaaacaagcaaaaaaaacctagaggcaatatttttttttaaagtttgtcttttcttttctacccaaattactaatctatgccattaaggaaaggaataagaacctccatatgtattattatctccacagtcctgcagaagtacaatctgatctttaactttcatgctacaaataataatttgagtagattaatttgaattttatcaacaaaattattgccatatgatgtatcatttctgtgtttgaacaaagcatcgtaatgcaggataacttctactttattccctgtagttaaaaaaaaaaaaactatatagttcaagccaatatttaaaaattctaaacctaggctgggcatggtgactcatacctgtaatcccagcactttgggaggccgaggcaggtgaattgcttcagcccaggagttcgagaccagcctggccaatgtggtgaaaccccatc

SEQ ID NO: 365879 - DNA, 1279 bp, Homo sapiens
tataacctatgcacattctcccatatagtttaatcatctttagatacttataatgcctaatacaatgtaaatgctatgtaaatagttgttgttatactgtattgtttagggaataacaataagaaaaacagtctgtacatgttcactacagatgcaaccattgttaagcctgactacatctttttatctgcagttgattgaatctatggatgtggaacctgtgcatatggagggtcaactgtactataaataatacgaatatgccaacattatataatcattgctttctgcaactgtttactataatttcaaaattaatatcctattaactgttcctataaattatcaaatttggcaagtgtattactagcaggagatggaccttaaattatgacaactttatattttttgatagcatctcttgaaaaagaattttaatgattctaataagaggttctttttcttttttccatttccttgacaaatagtactcatttaaaaactagagggctaggcttagtggctcacgcctgtaatctcagcactttgggaggctgaggcgggcagatcgcttgaggtcaggagttcaagaccagcccgggcaacgtggtgaaacccggtctgtactaaaaaaaaaaaaaagaaaaagaaaaagaaaaaagaatacccaggtgtggtagtgcatgcctgtagtcccagctactttggagactgaggtgggagtaccccttgagcctgggaggcgcaggttgcagtgaaccaagatcacatcactgcacttcaacctgggtgacagagcaagaccctgtctcaaaaacaaaaaacaagcaaaaaaaacctagaggcaatatttttttttaaagtttgtcttttcttttctacccaaattactaatctatgccattaaggaaaggaataagaacctccatatgtattattatctccacagtcctgcagaagtacaatctgatctttaactttcatgctacaaataataatttgagtagattaatttgaattttatcaacaaaattattgccatatgatgtatcatttctgtgtttgaacaaagcatcgtaatgcaggataacttctactttattccctgtagttaaaaaaaaaaaaactatatagttcaagccaatatttaaaaattctaaacctaggctgggcatggtgactcatacctgtaatcccagcactttgggaggccgaggcaggtgaattgcttcagcccaggagttcgagaccagcctggccaatgtggtgaaaccccatc

SEQ ID NO: 365880 - DNA, 1225 bp, Homo sapiens
tataacctatgcacattctcccatatagtttaatcatctttagatacttataatgcctaatacaatgtaaatgctatgtaaatagttgttgttatactgtattgtttagggaataacaataagaaaaacagtctgtacatgttcactacagatgcaaccattgttaagcctgactacatctttttatctgcagttgattgaatctatggatgtggaacctgtgcatatggagggtcaactgtactataaataatacgaatatgccaacattatataatcattgctttctgcaactgtttactataatttcaaaattaatatcctattaactgttcctataaattatcaaatttggcaagtgtattactagcaggagatggaccttaaattatgacaactttatattttttgatagcatctcttgaaaaagaattttaatgattctaataagaggttctttttcttttttccatttccttgacaaatagtactcatttaagctgaggcgggcagatcgcttgaggtcaggagttcaagaccagcccgggcaacgtggtgaaacccggtctgtactaaaaaaaaaaaaaagaaaaagaaaaagaaaaaagaatacccaggtgtggtagtgcatgcctgtagtcccagctactttggagactgaggtgggagtaccccttgagcctgggaggcgcaggttgcagtgaaccaagatcacatcactgcacttcaacctgggtgacagagcaagaccctgtctcaaaaacaaaaaacaagcaaaaaaaacctagaggcaatatttttttttaaagtttgtcttttcttttctacccaaattactaatctatgccattaaggaaaggaataagaacctccatatgtattattatctccacagtcctgcagaagtacaatctgatctttaactttcatgctacaaataataatttgagtagattaatttgaattttatcaacaaaattattgccatatgatgtatcatttctgtgtttgaacaaagcatcgtaatgcaggataacttctactttattccctgtagttaaaaaaaaaaaaactatatagttcaagccaatatttaaaaattctaaacctaggctgggcatggtgactcatacctgtaatcccagcactttgggaggccgaggcaggtgaattgcttcagcccaggagttcgagaccagcctggccaatgtggtgaaaccccatc

SEQ ID NO: 365881 - DNA, 635 bp, Homo sapiens
tgtttttttagtgtccaacaggtatttttaacttctgggggcttccttttactgtttctaaatagcaacatttcatcaattgcagtatcactgacatacaaccatgttttgttatgccccctcaaggccagtcgccaatgactacagtatgtatttctggatattaaaaatagtcttgcttttttttttctaagatggattagctaaatcctgcataaaagaaacagtatgaactatgatttctaaaagtcttctttggcctaggattttaggattccgtgctacaatctcatgtgtctacttccaaagtccaaagtatgcttgaaatctacacattttgagtgactacctagtatttaccacaggctcatgagcttaagaacgtctacttttacaacttgttcagtggtaaaataagcactctttaatatatgctgatcctctcttttgctatgaaagaatgtattatttattttctttggatatatagccaatctttttgtgaagaacctccagctgggtagggtggctcatgcttataaagcccagtgctttgggaggccaatggaggaggattgcttgaggccagaagttcaagaccagcttgtgaaacatagcaagacactgtctctaca

SEQ ID NO: 365882 - DNA, 412 bp, Homo sapiens
ccttctgctgaatctataatagatcttctagttttcccttataaatattcaagtttattctccctagccaaagcacaaaactaaatccattctcttcagcgaactacgtcagacacataatgatctgcatgaagttttataacaatgtctttctatatttattagaaatatattcccccccataagaagcatgaattctagatgctgtgtgtccagtaggttgtccaggtatcagcacatcagcctttaggatgatgggaagatggagtacctacatcctcctttctcttgctgatgccagcttcgtgagttttccctttccccactaaggcttatttctaacccatgccaagtagcatttggaattcatcctaaccctggtgcatgacagatggtaatgcaggagtggctc

SEQ ID NO: 365883 - DNA, 3247 bp, Homo sapiens
tcctggcgagaagcgagccggcggcctgaggaggcgactgactgagcagcgcacccggggagcaaggaggcgcggtgaactgagcggcccctgagctgacagatacactgcgcagctggaacggcgagcgagccgacgggcgagtgaggggcgcagccatgatcacctcggccgctggaattatttctcttctggatgaagatgaaccacagcttaaggaatttgcactacacaaattgaatgcagttgttaatgacttctgggcagaaatttccgagtccgtagacaaaatagaggttttatacgaagatgaaggtttccggagtcggcagtttgcagccttagtggcatctaaagtattttatcacctgggggcttttgaggagtctctgaattatgctcttggagcaggggacctcttcaatgtcaatgataactctgaatatgtggaaactattatagcaaaatgcattgatcactacaccaaacaatgtgtggaaaatgcagatttgcctgaaggagaaaaaaaaccaattgaccagagattggaaggcatcgtaaataaaatgttccagcgatgtctagatgatcacaagtataaacaggctattggcattgctctggagacacgaagactggacgtctttgaaaagaccatactggagtcgaatgatgtcccaggaatgttagcttatagccttaagctctgcatgtctttaatgcagaataaacagtttcggaataaagtactaagagttctagttaaaatctacatgaacttggagaaacctgatttcatcaatgtttgtcagtgcttaattttcttagatgatcctcaggctgtgagtgatatcttagagaaactggtaaaggaagacaacctcctgatggcatatcagatttgttttgatttgtatgaaagtgctagccagcagtttttgtcatctgtaatccagaatcttcgaactgttggcacccctattgcttctgtgcctggatccactaatacgggtactgttccgggatcagagaaagacagtgactcgatggaaacagaagaaaagacaagcagtgcatttgtaggaaagacaccagaagccagtccagagcctaaggaccagactttgaaaatgattaaaattttaagtggtgaaatggctattgagttacatctgcagttcttaatacgaaacaataatacagacctcatgattctaaaaaacacaaaggatgcagtacggaattctgtatgtcatactgcaaccgttatagcaaactcttttatgcactgtgggacaaccagtgaccagtttcttagagataatttggaatggttagccagagccactaactgggcaaaatttactgctacagccagtttgggtgtaattcataagggtcatgaaaaagaagcattacagttaatggcaacataccttcccaaggatacttctccaggatcagcctatcaggaaggtggaggtctctatgcactaggtcttattcatgccaatcatggtggtgatataattgactatctgcttaatcagcttaagaacgccagcaatgatatcgttagacacggtggcagtctgggccttggtttggcagccatgggaactgcacgtcaagatgtttatgatttgctaaaaacaaacctttatcaggatgatgcagtaacaggggaagcagctggcctggccctaggtttggttatgttgggctctaaaaatgctcaggctattgaggacatggttggttatgcacaagaaactcaacatgagaagattctgcgtggtcttgcagttggcatagctttagtaatgtatgggaggatggaagaggctgatgctctcattgaatctctctgtcgtgacaaggacccaattcttcgaaggtctggaatgtatactgtagccatggcttattgtggctctggtaacaacaaagcaattcgacgcctgctacatgttgctgtaagtgatgttaatgatgatgtcaggagggcagcagtagaatcacttgggttcattctattcagaacccctgaacagtgcccaagtgttgtctctttgttgtcagagagttacaaccctcatgtgcgctacggagctgcaatggccttggggatatgctgtgctggtacaggaaacaaggaagccattaatttgctagaaccaatgacaaacgaccccgtgaactacgtgaggcaaggggcactcatagcttcagctctcatcatgatccagcagactgaaatcacttgtccaaaggtgaatcagttcagacagctgtattccaaagtcatcaatgataagcatgatgatgtcatggccaagtttggcgctattctggcccagggcatactggatgcaggtggtcataatgtcacaatctccttgcagtccaggactgggcatactcatatgccttctgtggttggcgtccttgtatttacccagttttggttctggtttcctctttcacacttcctgtcattggcttatacccctacctgtgtcattggccttaacaaggacttaaagatgccgaaagttcagtataaatcgaactgtaaaccatccacatttgcatatcctgcccctctggaagtaccaaaagaaaaagaaaaggaaaaggtttctactgctgtattatctataactgccaaggctaaaaagaaggaaaaagaaaaggaaaaaaaggaggaggagaaaatggaagtggatgaggcagagaaaaaggaggaaaaagagaagaaaaaagaacctgagccaaacttccagttattggataacccagcccgagttatgcctgcccagcttaaggtcctaaccatgccggagacctgtagataccagcctttcaaaccactctctattggaggcatcatcattctgaaggataccagtgaagacattgaggagctggtggaacctgtggcagcacatggcccaaaaatcgaggaggaggaacaagagccagaacccccagaaccatttgagtatattgatgattaagggccagaggatctcacttgcttatctgaagaagattgtccaggctcatattgggaatgcttatgaggaaattcatgccgagacctgctattcaatgcatgtatcgttgcctctgcactgacctgaagaaccctgtctccaagtctttggttgaagagaagatatatgactgttgagtgtgctctttcacagaacttggttttcaaataaatataagatctccagat

SEQ ID NO: 365884 - DNA, 1064 bp, Homo sapiens
tcctggcgagaagcgagccggcggcctgaggaggcgactgactgagcagcgcacccggggagcaaggaggcgcggtgaactgagcggcccctgagctgacagatacactgcgcagctggaacggcgagcgagccgacgggcgagtgaggggcgcagccatgatcacctcggccgctggaattatttctcttctggatgaagatgaaccacagcttaaggaatttgcactacacaaattgaatgcagttgttaatgacttctgggcagaaatttccgagtccgtagacaaaatagaggttttatacgaagatgaaggtttccggagtcggcagtttgcagccttagtggcatctaaagtattttatcacctgggggcttttgaggagtctctgaattatgctcttggagcaggggacctcttcaatgtcaatgataactctgaatatgtggaaactattatagcaaaatgcattgatcactacaccaaacaatgtgtggaaaatgcagatttgcctgaaggagaaaaaaaaccaaaagttccaaggccctgcttttgtttcttaaaagtactttaaaaaggaaattggtcgtatttgttatttacattttatattgcgtacatatagtgagggtcagccatttttaatgatcgtcggatgaccaaagcgagccttcggagagttctctgtactacttctgactttacatggggtgtgaccatgttcattataatcttaaggagaaaaaactggtaaaaagcaaatgacagggaaaacagccttatccgaagcctccaggacactaaagaagcaggacaagcggcacaacagaggcgggcaggactacacgggtaaacagcgcgagataacggccgatataagaacaccaaataggcaacaagcagccacaattaaggcacgatgagactctggaacaaagccgccagaaaggcaacaggcgaggtgaacaacaacaacacacgagcacgaagcgacacagacccacacagccaaataagcgagcgcgcagagtcaagatacgacagcagggatgtaactcggacg

SEQ ID NO: 365885 - DNA, 844 bp, Homo sapiens
aggtctggttgcaaatctagcatgctgtgtgttagatactgactagcaatttaggaaagatttgcagaaatctcagataaatattaaggtagaaacctgccattagtaggaaaatatatttatacctcaggaagactattagtttgggccttagagaaaggcagatttatactaaccttcctattttctaaacttacttttgaaaattatctttcagccttgatagtttcctaagctttacccaacttgcacagtacagcgtaggctatcatgatcactcagtctgtctgagaattgaggtgactcacgttagctcccatcaagcctttggcaatacctcatggaaaacccttgattacagctttcaaggcagttaattacaaaatgacttagaggtttatagctggaaactggaatcttgttagttttcaaaggggtaaaatattcagtccattaggagtttggaaactataatctgtcgtggcacaaactggtatattaggactgcagaggcagggttggggcctagttttagatttcaacagttaatagtaaagaggaaaaaaaagaatgtcttgaaattaagaatgaccctagctactactgttctttcttccctttcccaggatctcacttgcttatctgaagaagattgtccaggctcatattgggaatgcttatgaggaaattcatgccgagacctgctattcaatgcatgtatcgttgcctctgcactgacctgaagaaccctgtctccaagtctttggttgaagagaagatatatgactgttgagtgtgctctttcacagaacttggttttcaaataaatataagatctccagat

SEQ ID NO: 365886 - DNA, 3300 bp, Homo sapiens
  misc_feature (3249)..(3249): n is a, c, g, or t
  misc_feature (3264)..(3264): n is a, c, g, or t
  misc_feature (3266)..(3266): n is a, c, g, or t
  misc_feature (3269)..(3270): n is a, c, g, or t
tcctggcgagaagcgagccggcggcctgaggaggcgactgactgagcagcgcacccggggagcaaggaggcgcggtgaactgagcggcccctgagctgacagatacactgcgcagctggaacggcgagcgagccgacgggcgagtgaggggcgcagccatgatcacctcggccgctggaattatttctcttctggatgaagatgaaccacagcttaaggaatttgcactacacaaattgaatgcagttgttaatgacttctgggcagaaatttccgagtccgtagacaaaatagaggttttatacgaagatgaaggtttccggagtcggcagtttgcagccttagtggcatctaaagtattttatcacctgggggcttttgaggagtctctgaattatgctcttggagcaggggacctcttcaatgtcaatgataactctgaatatgtggaaactattatagcaaaatgcattgatcactacaccaaacaatgtgtggaaaatgcagatttgcctgaaggagaaaaaaaaccaattgaccagagattggaaggcatcgtaaataaaatgttccagcgatgtctagatgatcacaagtataaacaggctattggcattgctctggagacacgaagactggacgtctttgaaaagaccatactggagtcgaatgatgtcccaggaatgttagcttatagccttaagctctgcatgtctttaatgcagaataaacagtttcggaataaagtactaagagttctagttaaaatctacatgaacttggagaaacctgatttcatcaatgtttgtcagtgcttaattttcttagatgatcctcaggctgtgagtgatatcttagagaaactggtaaaggaagacaacctcctgatggcatatcagatttgttttgatttgtatgaaagtgctagccagcagtttttgtcatctgtaatccagaatcttcgaactgttggcacccctattgcttctgtgcctggatccactaatacgggtactgttccgggatcagagaaagacagtgactcgatggaaacagaagaaaagacaagcagtgcatttgtaggaaagacaccagaagccagtccagagcctaaggaccagactttgaaaatgattaaaattttaagtggtgaaatggctattgagttacatctgcagttcttaatacgaaacaataatacagacctcatgattctaaaaaacacaaaggatgcagtacggaattctgtatgtcatactgcaaccgttatagcaaactcttttatgcactgtgggacaaccagtgaccagtttcttagagataatttggaatggttagccagagccactaactgggcaaaatttactgctacagccagtttgggtgtaattcataagggtcatgaaaaagaagcattacagttaatggcaacataccttcccaaggatacttctccaggatcagcctatcaggaaggtggaggtctctatgcactaggtcttattcatgccaatcatggtggtgatataattgactatctgcttaatcagcttaagaacgccagcaatgatatcgttagacacggtggcagtctgggccttggtttggcagccatgggaactgcacgtcaagatgtttatgatttgctaaaaacaaacctttatcaggatgatgcagtaacaggggaagcagctggcctggccctaggtttggttatgttgggctctaaaaatgctcaggctattgaggacatggttggttatgcacaagaaactcaacatgagaagattctgcgtggtcttgcagttggcatagctttagtaatgtatgggaggatggaagaggctgatgctctcattgaatctctctgtcgtgacaaggacccaattcttcgaaggtctggaatgtatactgtagccatggcttattgtggctctggtaacaacaaagcaattcgacgcctgctacatgttgctgtaagtgatgttaatgatgatgtcaggagggcagcagtagaatcacttgggttcattctattcagaacccctgaacagtgcccaagtgttgtctctttgttgtcagagagttacaaccctcatgtgcgctacggagctgcaatggccttggggatatgctgtgctggtacaggaaacaaggaagccattaatttgctagaaccaatgacaaacgaccccgtgaactacgtgaggcaaggggcactcatagcttcagctctcatcatgatccagcagactgaaatcacttgtccaaaggtgaatcagttcagacagctgtattccaaagtcatcaatgataagcatgatgatgtcatggccaagtttggcgctattctggcccagggcatactggatgcaggtggtcataatgtcacaatctccttgcagtccaggactgggcatactcatatgccttctgtggttggcgtccttgtatttacccagttttggttctggtttcctctttcacacttcctgtcattggcttatacccctacctgtgtcattggccttaacaaggacttaaagatgccgaaagttcagtataaatcgaactgtaaaccatccacatttgcatatcctgcccctctggaagtaccaaaagaaaaagaaaaggaaaaggtttctactgctgtattatctataactgccaaggctaaaaagaaggaaaaagaaaaggaaaaaaaggaggaggagaaaatggaagtggatgaggcagagaaaaaggaggaaaaagagaagaaaaaagaacctgagccaaacttccagttattggataacccagcccgagttatgcctgcccagcttaaggtcctaaccatgccggagacctgtagataccagcctttcaaaccactctctattggaggcatcatcattctgaaggataccagtgaagacattgaggagctggtggaacctgtggcagcacatggcccaaaaatcgaggaggaggaacaagagccagaacccccagaaccatttgagtatattgatgattaagggccagaggatctcacttgcttatctgaagaagattgtccaggctcatattgggaatgcttatgaggaaattcatgccgagacctgctattcaatgcatgtatcgttgcctctgcactgacctgaagaaccctgtctccaagtctttggttgaagagaagatatatgactgttgagtgtgctctttcacagaacttggttttcaaataaatataagatctccagatcnagatgcggccgggcntntcnnttccctcccaccactctccaccttctatat

SEQ ID NO: 365887 - DNA, 3588 bp, Homo sapiens
tcctggcgagaagcgagccggcggcctgaggaggcgactgactgagcagcgcacccggggagcaaggaggcgcggtgaactgagcggcccctgagctgacagatacactgcgcagctggaacggcgagcgagccgacgggcgagtgaggggcgcagccatgatcacctcggccgctggaattatttctcttctggatgaagatgaaccacagcttaaggaatttgcactacacaaattgaatgcagttgttaatgacttctgggcagaaatttccgagtccgtagacaaaatagaggttttatacgaagatgaaggtttccggagtcggcagtttgcagccttagtggcatctaaagtattttatcacctgggggcttttgaggagtctctgaattatgctcttggagcaggggacctcttcaatgtcaatgataactctgaatatgtggaaactattatagcaaaatgcattgatcactacaccaaacaatgtgtggaaaatgcagatttgcctgaaggagaaaaaaaaccaattgaccagagattggaaggcatcgtaaataaaatgttccagcgatgtctagatgatcacaagtataaacaggctattggcattgctctggagacacgaagactggacgtctttgaaaagaccatactggagtcgaatgatgtcccaggaatgttagcttatagccttaagctctgcatgtctttaatgcagaataaacagtttcggaataaagtactaagagttctagttaaaatctacatgaacttggagaaacctgatttcatcaatgtttgtcagtgcttaattttcttagatgatcctcaggctgtgagtgatatcttagagaaactggtaaaggaagacaacctcctgatggcatatcagatttgttttgatttgtatgaaagtgctagccagcagtttttgtcatctgtaatccagaatcttcgaactgttggcacccctattgcttctgtgcctggatccactaatacgggtactgttccgggatcagagaaagacagtgactcgatggaaacagaagaaaagacaagcagtgcatttgtaggaaagacaccagaagccagtccagagcctaaggaccagactttgaaaatgattaaaattttaagtggtgaaatggctattgagttacatctgcagttcttaatacgaaacaataatacagacctcatgattctaaaaaacacaaaggatgcagtacggaattctgtatgtcatactgcaaccgttatagcaaactcttttatgcactgtgggacaaccagtgaccagtttcttagagataatttggaatggttagccagagccactaactgggcaaaatttactgctacagccagtttgggtgtaattcataagggtcatgaaaaagaagcattacagttaatggcaacataccttcccaaggatacttctccaggatcagcctatcaggaaggtggaggtctctatgcactaggtcttattcatgccaatcatggtggtgatataattgactatctgcttaatcagcttaagaacgccagcaatgatatcgttagacacggtggcagtctgggccttggtttggcagccatgggaactgcacgtcaagatgtttatgatttgctaaaaacaaacctttatcaggatgatgcagtaacaggggaagcagctggcctggccctaggtttggttatgttgggctctaaaaatgctcaggctattgaggacatggttggttatgcacaagaaactcaacatgagaagattctgcgtggtcttgcagttggcatagctttagtaatgtatgggaggatggaagaggctgatgctctcattgaatctctctgtcgtgacaaggacccaattcttcgaaggtctggaatgtatactgtagccatggcttattgtggctctggtaacaacaaagcaattcgacgcctgctacatgttgctgtaagtgatgttaatgatgatgtcaggagggcagcagtagaatcacttgggttcattctattcagaacccctgaacagtgcccaagtgttgtctctttgttgtcagagagttacaaccctcatgtgcgctacggagctgcaatggccttggggatatgctgtgctggtacaggaaacaaggaagccattaatttgctagaaccaatgacaaacgaccccgtgaactacgtgaggcaaggggcactcatagcttcagctctcatcatgatccagcagactgaaatcacttgtccaaaggtgaatcagttcagacagctgtattccaaagtcatcaatgataagcatgatgatgtcatggccaagtttggcgctattctggcccagggcatactggatgcaggtggtcataatgtcacaatctccttgcagtccaggactgggcatactcatatgccttctgtggttggcgtccttgtatttacccagttttggttctggtttcctctttcacacttcctgtcattggcttatacccctacctgtgtcattggccttaacaaggacttaaagatgccgaaagttcagtataaatcgaactgtaaaccatccacatttgcatatcctgcccctctggaagtaccaaaagaaaaagaaaaggaaaaggtttctactgctgtattatctataactgccaaggctaaaaagaaggaaaaagaaaaggaaaaaaaggaggaggagaaaatggaagtggatgaggcagagaaaaaggaggaaaaagagaagaaaaaagaacctgagccaaacttccagttattggataacccagcccgagttatgcctgcccagcttaaggtcctaaccatgccggagacctgtagataccagcctttcaaaccactctctattggaggcatcatcattctgaaggataccagtgaagacattgaggagctggtggaacctgtggcagcacatggcccaaaaatcgaggaggaggaacaagagccagaacccccagaaccatttgagtatattgatgattaagggccagaggatctcacttgcttatctgaagaagattgtccaggctcatattgggaatgcttatgaggaaattcatgccgagacctgctattcaatgcatgtatcgttgcctctgcactgacctgaagaaccctgtctccaagtctttggttgaagagaagatatatgactgttgagtgtgctctttcacagaacttggttttcaaataaatataagatctccagataaaaaaaaaaaaaaaacaagaaaaaaaaaaagaacaaaaacgaaacaataccaacacaacaaaaataaccaagaaagggggcggcctccggaaaagaactaacctgaggagggcgggacccccatgtacgaccctgccccgcgctttgtctagtgaccgcagagggcgcgcccacagggcgcaaagggcgcataatcaaggaggcacacggggcgcgctgatatacaaaccggccgcccatgggaagacaccgtgcctgcgctggggcattctgtgagagagccgcacctgcttggggggggggtcccgacaaactctagggggcgacccccacactcagg

SEQ ID NO: 365888 - DNA, 3298 bp, Homo sapiens
tcctggcgagaagcgagccggcggcctgaggaggcgactgactgagcagcgcacccggggagcaaggaggcgcggtgaactgagcggcccctgagctgacagatacactgcgcagctggaacggcgagcgagccgacgggcgagtgaggggcgcagccatgatcacctcggccgctggaattatttctcttctggatgaagatgaaccacagcttaaggaatttgcactacacaaattgaatgcagttgttaatgacttctgggcagaaatttccgagtccgtagacaaaatagaggttttatacgaagatgaaggtttccggagtcggcagtttgcagccttagtggcatctaaagtattttatcacctgggggcttttgaggagtctctgaattatgctcttggagcaggggacctcttcaatgtcaatgataactctgaatatgtggaaactattatagcaaaatgcattgatcactacaccaaacaatgtgtggaaaatgcagatttgcctgaaggagaaaaaaaaccaattgaccagagattggaaggcatcgtaaataaaatgttccagcgatgtctagatgatcacaagtataaacaggctattggcattgctctggagacacgaagactggacgtctttgaaaagaccatactggagtcgaatgatgtcccaggaatgttagcttatagccttaagctctgcatgtctttaatgcagaataaacagtttcggaataaagtactaagagttctagttaaaatctacatgaacttggagaaacctgatttcatcaatgtttgtcagtgcttaattttcttagatgatcctcaggctgtgagtgatatcttagagaaactggtaaaggaagacaacctcctgatggcatatcagatttgttttgatttgtatgaaagtgctagccagcagtttttgtcatctgtaatccagaatcttcgaactgttggcacccctattgcttctgtgcctggatccactaatacgggtactgttccgggatcagagaaagacagtgactcgatggaaacagaagaaaagacaagcagtgcatttgtaggaaagacaccagaagccagtccagagcctaaggaccagactttgaaaatgattaaaattttaagtggtgaaatggctattgagttacatctgcagttcttaatacgaaacaataatacagacctcatgattctaaaaaacacaaaggatgcagtacggaattctgtatgtcatactgcaaccgttatagcaaactcttttatgcactgtgggacaaccagtgaccagtttcttagagataatttggaatggttagccagagccactaactgggcaaaatttactgctacagccagtttgggtgtaattcataagggtcatgaaaaagaagcattacagttaatggcaacataccttcccaaggatacttctccaggatcagcctatcaggaaggtggaggtctctatgcactaggtcttattcatgccaatcatggtggtgatataattgactatctgcttaatcagcttaagaacgccagcaatgatatcgttagacacggtggcagtctgggccttggtttggcagccatgggaactgcacgtcaagatgtttatgatttgctaaaaacaaacctttatcaggatgatgcagtaacaggggaagcagctggcctggccctaggtttggttatgttgggctctaaaaatgctcaggctattgaggacatggttggttatgcacaagaaactcaacatgagaagattctgcgtggtcttgcagttggcatagctttagtaatgtatgggaggatggaagaggctgatgctctcattgaatctctctgtcgtgacaaggacccaattcttcgaaggtctggaatgtatactgtagccatggcttattgtggctctggtaacaacaaagcaattcgacgcctgctacatgttgctgtaagtgatgttaatgatgatgtcaggagggcagcagtagaatcacttgggttcattctattcagaacccctgaacagtgcccaagtgttgtctctttgttgtcagagagttacaaccctcatgtgcgctacggagctgcaatggccttggggatatgctgtgctggtacaggaaacaaggaagccattaatttgctagaaccaatgacaaacgaccccgtgaactacgtgaggcaaggggcactcatagcttcagctctcatcatgatccagcagactgaaatcacttgtccaaaggtgaatcagttcagacagctgtattccaaagtcatcaatgataagcatgatgatgtcatggccaagtttggcgctattctggcccagggcatactggatgcaggtggtcataatgtcacaatctccttgcagtccaggactgggcatactcatatgccttctgtggttggcgtccttgtatttacccagttttggttctggtttcctctttcacacttcctgtcattggcttatacccctacctgtgtcattggccttaacaaggacttaaagatgccgaaagttcagtataaatcgaactgtaaaccatccacatttgcatatcctgcccctctggaagtaccaaaagaaaaagaaaaggaaaaggtttctactgctgtattatctataactgccaaggctaaaaagaaggaaaaagaaaaggaaaaaaaggaggaggagaaaatggaagtggatgaggcagagaaaaaggaggaaaaagagaagaaaaaagaacctgagccaaacttccagttattggataacccagcccgagttatgcctgcccagcttaaggtcctaaccatgccggagacctgtagataccagcctttcaaaccactctctattggaggcatcatcattctgaaggataccagtgaagacattgaggagctggtggaacctgtggcagcacatggcccaaaaatcgaggaggaggaacaagagccagaacccccagaaccatttgagtatattgatgattaagggccagaggatctcacttgcttatctgaagaagattgtccaggctcatattgggaatgcttatgaggaaattcatgccgagacctgctattcaatgcatgtatcgttgcctctgcactgacctgaagaaccctgtctccaagtctttggttgaagagaagatatatgactgttgagtgtgctctttcacagaacttggttttcaaataaatataagatctccagatgcggcaagttctcctttttttcttcttttcccccccccgcactcccacccg

SEQ ID NO: 365889 - DNA, 2952 bp, Homo sapiens
tcctggcgagaagcgagccggcggcctgaggaggcgactgactgagcagcgcacccggggagcaaggaggcgcggtgaactgagcggcccctgagctgacagatacactgcgcagctggaacggcgagcgagccgacgggcgagtgaggggcgcagccatgatcacctcggccgctggaattatttctcttctggatgaagatgaaccacagcttaaggaatttgcactacacaaattgaatgcagttgttaatgacttctgggcagaaatttccgagtccgtagacaaaatagaggttttatacgaagatgaaggtttccggagtcggcagtttgcagccttagtggcatctaaagtattttatcacctgggggcttttgaggagtctctgaattatgctcttggagcaggggacctcttcaatgtcaatgataactctgaatatgtggaaactattatagcaaaatgcattgatcactacaccaaacaatgtgtggaaaatgcagatttgcctgaaggagaaaaaaaaccaattgaccagagattggaaggcatcgtaaataaaatgttccagcgatgtctagatgatcacaagtataaacaggctattggcattgctctggagacacgaagactggacgtctttgaaaagaccatactggagtcgaatgatgtcccaggaatgttagcttatagccttaagctctgcatgtctttaatgcagaataaacagtttcggaataaagtactaagagttctagttaaaatctacatgaacttggagaaacctgatttcatcaatgtttgtcagtgcttaattttcttagatgatcctcaggctgtgagtgatatcttagagaaactggtaaaggaagacaacctcctgatggcatatcagatttgttttgatttgtatgaaagtgctagccagcagtttttgtcatctgtaatccagaatcttcgaactgttggcacccctattgcttctgtgcctggatccactaatacgggtactgttccgggatcagagaaagacagtgactcgatggaaacagaagaaaagacaagcagtgcatttgtaggaaagacaccagaagccagtccagagcctaaggaccagactttgaaaatgattaaaattttaagtggtgaaatggctattgagttacatctgcagttcttaatacgaaacaataatacagacctcatgattctaaaaaacacaaaggatgcagtacggaattctgtatgtcatactgcaaccgttatagcaaactcttttatgcactgtgggacaaccagtgaccagtttcttagagataatttggaatggttagccagagccactaactgggcaaaatttactgctacagccagtttgggtgtaattcataagggtcatgaaaaagaagcattacagttaatggcaacataccttcccaaggatacttctccaggatcagcctatcaggaaggtggaggtctctatgcactaggtcttattcatgccaatcatggtggtgatataattgactatctgcttaatcagcttaagaacgccagcaatgatatcgttagacacggtggcagtctgggccttggtttggcagccatgggaactgcacgtcaagatgtttatgatttgctaaaaacaaacctttatcaggatgatgcagtaacaggggaagcagctggcctggccctaggtttggttatgttgggctctaaaaatgctcaggctattgaggacatggttggttatgcacaagaaactcaacatgagaagattctgcgtggtcttgcagttggcatagctttagtaatgtatgggaggatggaagaggctgatgctctcattgaatctctctgtcgtgacaaggacccaattcttcgaaggtctggaatgtatactgtagccatggcttattgtggctctggtaacaacaaagcaattcgacgcctgctacatgttgctgtaagtgatgttaatgatgatgtcaggagggcagcagtagaatcacttgggttcattctattcagaacccctgaacagtgcccaagtgttgtctctttgttgtcagagagttacaaccctcatgtgcgctacggagctgcaatggccttggggatatgctgtgctggtacaggaaacaaggaagccattaatttgctagaaccaatgacaaacgaccccgtgaactacgtgaggcaaggggcactcatagcttcagctctcatcatgatccagcagactgaaatcacttgtccaaaggtgaatcagttcagacagctgtattccaaagtcatcaatgataagcatgatgatgtcatggccaagtttggcgctattctggcccagggcatactggatgcaggtggtcataatgtcacaatctccttgcagtccaggactgggcatactcatatgccttctgtggttggcgtccttgtatttacccagttttggttctggtttcctctttcacacttcctgtcattggcttatacccctacctgtgtcattggccttaacaaggacttaaagatgccgaaagttcagtataaatcgaactgtaaaccatccacatttgcatatcctgcccctctggaagtaccaaaagaaaaagaaaaggaaaaggtttctactgctgtattatctataactgccaaggctaaaaagaaggaaaaagaaaaggaaaaaagataagatgagtaggagggcaggtccaaaagaagtgattcagcaaaatgaaaggggtcctcagggattaaaggggatgaatttacctgtcatccctaagaatctacaaaggagatgctcaggacagaaactgtatcaacacaactagtagcaagaagttactcggatgatatcagatgtttatttgggaaacttgctagtagagaaagctacatataatattagatgcaaagggacacagaagtccagt

SEQ ID NO: 365890 - DNA, 3716 bp, Homo sapiens
tcctggcgagaagcgagccggcggcctgaggaggcgactgactgagcagcgcacccggggagcaaggaggcgcggtgaactgagcggcccctgagctgacagatacactgcgcagctggaacggcgagcgagccgacgggcgagtgaggggcgcagccatgatcacctcggccgctggaattatttctcttctggatgaagatgaaccacagcttaaggaatttgcactacacaaattgaatgcagttgttaatgacttctgggcagaaatttccgagtccgtagacaaaatagaggttttatacgaagatgaaggtttccggagtcggcagtttgcagccttagtggcatctaaagtattttatcacctgggggcttttgaggagtctctgaattatgctcttggagcaggggacctcttcaatgtcaatgataactctgaatatgtggaaactattataggtaattatcgtctatctgcaaaatgcattgatcactacaccaaacaatgtgtggaaaatgcagatttgcctgaaggagaaaaaaaaccaattgaccagagattggaaggcatcgtaaataaaatgttccagcgatgtctagatgatcacaagtataaacaggctattggcattgctctggagacacgaagactggacgtctttgaaaagaccatactggagtcgaatgatgtcccaggaatgttagcttatagccttaagctctgcatgtctttaatgcagaataaacagtttcggaataaagtactaagagttctagttaaaatctacatgaacttggagaaacctgatttcatcaatgtttgtcagtgcttaattttcttagatgatcctcaggctgtgagtgatatcttagagaaactggtaaaggaagacaacctcctgatggcatatcagatttgttttgatttgtatgaaagtgctagccagcagtttttgtcatctgtaatccagaatcttcgaactgttggcacccctattgcttctgtgcctggatccactaatacgggtactgttccgggatcagagaaagacagtgactcgatggaaacagaagaaaagacaagcagtgcatttgtaggaaagacaccagaagccagtccagagcctaaggaccagactttgaaaatgattaaaattttaagtggtgaaatggctattgagttacatctgcagttcttaatacgaaacaataatacagacctcatgattctaaaaaacacaaaggatgcagtacggaattctgtatgtcatactgcaaccgttatagcaaactcttttatgcactgtgggacaaccagtgaccagtttcttagagataatttggaatggttagccagagccactaactgggcaaaatttactgctacagccagtttgggtgtaattcataagggtcatgaaaaagaagcattacagttaatggcaacataccttcccaaggatacttctccaggatcagcctatcaggaaggtggaggtctctatgcactaggtcttattcatgccaatcatggtggtgatataattgactatctgcttaatcagcttaagaacgccagcaatgatatcgttagacacggtggcagtctgggccttggtttggcagccatgggaactgcacgtcaagatgtttatgatttgctaaaaacaaacctttatcaggatgatgcagtaacaggggaagcagctggcctggccctaggtttggttatgttgggctctaaaaatgctcaggctattgaggacatggttggttatgcacaagaaactcaacatgagaagattctgcgtggtcttgcagttggcatagctttagtaatgtatgggaggatggaagaggctgatgctctcattgaatctctctgtcgtgacaaggacccaattcttcgaaggtctggaatgtatactgtagccatggcttattgtggctctggtaacaacaaagcaattcgacgcctgctacatgttgctgtaagtgatgttaatgatgatgtcaggagggcagcagtagaatcacttgggttcattctattcagaacccctgaacagtgcccaagtgttgtctctttgttgtcagagagttacaaccctcatgtgcgctacggagctgcaatggccttggggatatgctgtgctggtacaggaaacaaggaagccattaatttgctagaaccaatgacaaacgaccccgtgaactacgtgaggcaaggggcactcatagcttcagctctcatcatgatccagcagactgaaatcacttgtccaaaggtgaatcagttcagacagctgtattccaaagtcatcaatgataagcatgatgatgtcatggccaagtttggcgctattctggcccagggcatactggatgcaggtggtcataatgtcacaatctccttgcagtccaggactgggcatactcatatgccttctgtggttggcgtccttgtatttacccagttttggttctggtttcctctttcacacttcctgtcattggcttatacccctacctgtgtcattggccttaacaaggacttaaagatgccgaaagttcagtataaatcgaactgtaaaccatccacatttgcatatcctgcccctctggaagtaccaaaagaaaaagaaaaggaaaaggtttctactgctgtattatctataactgccaaggctaaaaagaaggaaaaagaaaaggaaaaaaaggaggaggagaaaatggaagtggatgaggcagagaaaaaggaggaaaaagagaagaaaaaagaacctgagccaaacttccagttattggataacccagcccgagttatgcctgcccagcttaaggtcctaaccatgccggagacctgtagataccagcctttcaaaccactctctattggaggcatcatcattctgaaggataccagtgaagacattgaggagctggtggaacctgtggcagcacatggcccaaaaatcgaggaggaggaacaagagccagaacccccagaaccatttgagtatattgatgattaagggccagaggatctcacttgcttatctgaagaagattgtccaggctcatattgggaatgcttatgaggaaattcatgccgagacctgctattcaatgcatgtatcgttgcctctgcactgacctgaagaaccctgtctccaagtctttggttgaagagaagatatatgactgttgagtgtgctctttcacagaacttggttttcaaataaatataagatctccagatggacaagacatttgtttttcagcctgggtttttaataaatgtatctaatcctccccacaccatgaaatgcctaaatcccaagagccagagtcttgatttgctaggatgagtatgcacgactttcatattgatgaaaaagtcaaactattcttaaattatagaccatgaaaataatggaagggaaaaaaatcaaaccttgctcatcacccccaagaattctctacagttttgttgtggttgtgggttgttgtttaatatggggtctaatcagccagggcaacatggtgagacccccatctctacaaaaaaattgaaaaattagctgggtaggccaggcagggtggctcacgcctataatcccagcactttggaaggccaaggtgggcagattgcttgagccaaggagtttgagaccagcctgggcaacatggcaaaaactcacctctacaaa

SEQ ID NO: 365891 - DNA, 3572 bp, Homo sapiens
tcctggcgagaagcgagccggcggcctgaggaggcgactgactgagcagcgcacccggggagcaaggaggcgcggtgaactgagcggcccctgagctgacagatacactgcgcagctggaacggcgagcgagccgacgggcgagtgaggggcgcagccatgatcacctcggccgctggaattatttctcttctggatgaagatgaaccacagcttaaggaatttgcactacacaaattgaatgcagttgttaatgacttctgggcagaaatttccgagtccgtagacaaaatagaggttttatacgaagatgaaggtttccggagtcggcagtttgcagccttagtggcatctaaagtattttatcacctgggggcttttgaggagtctctgaattatgctcttggagcaggggacctcttcaatgtcaatgataactctgaatatgtggaaactattataggtaattatcgtctatctgcaaaatgcattgatcactacaccaaacaatgtgtggaaaatgcagatttgcctgaaggagaaaaaaaaccaattgaccagagattggaaggcatcgtaaataaaatgttccagcgatgtctagatgatcacaagtataaacaggctattggcattgctctggagacacgaagactggacgtctttgaaaagaccatactggagtcgaatgatgtcccaggaatgttagcttatagccttaagctctgcatgtctttaatgcagaataaacagtttcggaataaagtactaagagttctagttaaaatctacatgaacttggagaaacctgatttcatcaatgtttgtcagaatcttcgaactgttggcacccctattgcttctgtgcctggatccactaatacgggtactgttccgggatcagagaaagacagtgactcgatggaaacagaagaaaagacaagcagtgcatttgtaggaaagacaccagaagccagtccagagcctaaggaccagactttgaaaatgattaaaattttaagtggtgaaatggctattgagttacatctgcagttcttaatacgaaacaataatacagacctcatgattctaaaaaacacaaaggatgcagtacggaattctgtatgtcatactgcaaccgttatagcaaactcttttatgcactgtgggacaaccagtgaccagtttcttagagataatttggaatggttagccagagccactaactgggcaaaatttactgctacagccagtttgggtgtaattcataagggtcatgaaaaagaagcattacagttaatggcaacataccttcccaaggatacttctccaggatcagcctatcaggaaggtggaggtctctatgcactaggtcttattcatgccaatcatggtggtgatataattgactatctgcttaatcagcttaagaacgccagcaatgatatcgttagacacggtggcagtctgggccttggtttggcagccatgggaactgcacgtcaagatgtttatgatttgctaaaaacaaacctttatcaggatgatgcagtaacaggggaagcagctggcctggccctaggtttggttatgttgggctctaaaaatgctcaggctattgaggacatggttggttatgcacaagaaactcaacatgagaagattctgcgtggtcttgcagttggcatagctttagtaatgtatgggaggatggaagaggctgatgctctcattgaatctctctgtcgtgacaaggacccaattcttcgaaggtctggaatgtatactgtagccatggcttattgtggctctggtaacaacaaagcaattcgacgcctgctacatgttgctgtaagtgatgttaatgatgatgtcaggagggcagcagtagaatcacttgggttcattctattcagaacccctgaacagtgcccaagtgttgtctctttgttgtcagagagttacaaccctcatgtgcgctacggagctgcaatggccttggggatatgctgtgctggtacaggaaacaaggaagccattaatttgctagaaccaatgacaaacgaccccgtgaactacgtgaggcaaggggcactcatagcttcagctctcatcatgatccagcagactgaaatcacttgtccaaaggtgaatcagttcagacagctgtattccaaagtcatcaatgataagcatgatgatgtcatggccaagtttggcgctattctggcccagggcatactggatgcaggtggtcataatgtcacaatctccttgcagtccaggactgggcatactcatatgccttctgtggttggcgtccttgtatttacccagttttggttctggtttcctctttcacacttcctgtcattggcttatacccctacctgtgtcattggccttaacaaggacttaaagatgccgaaagttcagtataaatcgaactgtaaaccatccacatttgcatatcctgcccctctggaagtaccaaaagaaaaagaaaaggaaaaggtttctactgctgtattatctataactgccaaggctaaaaagaaggaaaaagaaaaggaaaaaaaggaggaggagaaaatggaagtggatgaggcagagaaaaaggaggaaaaagagaagaaaaaagaacctgagccaaacttccagttattggataacccagcccgagttatgcctgcccagcttaaggtcctaaccatgccggagacctgtagataccagcctttcaaaccactctctattggaggcatcatcattctgaaggataccagtgaagacattgaggagctggtggaacctgtggcagcacatggcccaaaaatcgaggaggaggaacaagagccagaacccccagaaccatttgagtatattgatgattaagggccagaggatctcacttgcttatctgaagaagattgtccaggctcatattgggaatgcttatgaggaaattcatgccgagacctgctattcaatgcatgtatcgttgcctctgcactgacctgaagaaccctgtctccaagtctttggttgaagagaagatatatgactgttgagtgtgctctttcacagaacttggttttcaaataaatataagatctccagatggacaagacatttgtttttcagcctgggtttttaataaatgtatctaatcctccccacaccatgaaatgcctaaatcccaagagccagagtcttgatttgctaggatgagtatgcacgactttcatattgatgaaaaagtcaaactattcttaaattatagaccatgaaaataatggaagggaaaaaaatcaaaccttgctcatcacccccaagaattctctacagttttgttgtggttgtgggttgttgtttaatatggggtctaatcagccagggcaacatggtgagacccccatctctacaaaaaaattgaaaaattagctgggtaggccaggcagggtggctcacgcctataatcccagcactttggaaggccaaggtgggcagattgcttgagccaaggagtttgagaccagcctgggcaacatggcaaaaactcacctctacaaa

SEQ ID NO: 365892 - DNA, 3749 bp, Homo sapiens
tcctggcgagaagcgagccggcggcctgaggaggcgactgactgagcagcgcacccggggagcaaggaggcgcggtgaactgagcggcccctgagctgacagatacactgcgcagctggaacggcgagcgagccgacgggcgagtgaggggcgcagccatgatcacctcggccgctggaattatttctcttctggatgaagatgaaccacagcttaaggaatttgcactacacaaattgaatgcagttgttaatgacttctgggcagaaatttccgagtccgtagacaaaatagaggttttatacgaagatgaaggtttccggagtcggcagtttgcagccttagtggcatctaaagtattttatcacctgggggcttttgaggagtctctgaattatgctcttggagcaggggacctcttcaatgtcaatgataactctgaatatgtggaaactattatagcaaaatgcattgatcactacaccaaacaatgtgtggaaaatgcagatttgcctgaaggagaaaaaaaaccaattgaccagagattggaaggcatcgtaaataaaatgttccagcgatgtctagatgatcacaagtataaacaggctattggcattgctctggagacacgaagactggacgtctttgaaaagaccatactggagtcgaatgatgtcccaggaatgttagcttatagccttaagctctgcatgtctttaatgcagaataaacagtttcggaataaagtactaagagttctagttaaaatctacatgaacttggagaaacctgatttcatcaatgtttgtcagtgcttaattttcttagatgatcctcaggctgtgagtgatatcttagagaaactggtaaaggaagacaacctcctgatggcatatcagatttgttttgatttgtatgaaagtgctagccagcagtttttgtcatctgtaatccagaatcttcgaactgttggcacccctattgcttctgtgcctggatccactaatacgggtactgttccgggatcagagaaagacagtgactcgatggaaacagaagaaaagacaagcagtgcatttgtaggaaagacaccagaagccagtccagagcctaaggaccagactttgaaaatgattaaaattttaagtggtgaaatggctattgagttacatctgcagttcttaatacgaaacaataatacagacctcatgattctaaaaaacacaaaggatgcagtacggaattctgtatgtcatactgcaaccgttatagcaaactcttttatgcactgtgggacaaccagtgaccagtttcttagagataatttggaatggttagccagagccactaactgggcaaaatttactgctacagccagtttgggtgtaattcataagggtcatgaaaaagaagcattacagttaatggcaacataccttcccaaggatacttctccaggatcagcctatcaggaaggtggaggtctctatgcactaggtcttattcatgccaatcatggtggtgatataattgactatctgcttaatcagcttaagaacgccagcaatgatatcgttagacacggtggcagtctgggccttggtttggcagccatgggaactgcacgtcaagatgtttatgatttgctaaaaacaaacctttatcaggatgatgcagtaacaggggaagcagctggcctggccctaggtttggttatgttgggctctaaaaatgctcaggctattgaggacatggttggttatgcacaagaaactcaacatgagaagattctgcgtggtcttgcagttggcatagctttagtaatgtatgggaggatggaagaggctgatgctctcattgaatctctctgtcgtgacaaggacccaattcttcgaaggtctggaatgtatactgtagccatggcttattgtggctctggtaacaacaaagcaattcgacgcctgctacatgttgctgtaagtgatgttaatgatgatgtcaggagggcagcagtagaatcacttgggttcattctattcagaacccctgaacagtgcccaagtgttgtctctttgttgtcagagagttacaaccctcatgtgcgctacggagctgcaatggccttggggatatgctgtgctggtacaggaaacaaggaagccattaatttgctagaaccaatgacaaacgaccccgtgaactacgtgaggcaaggggcactcatagcttcagctctcatcatgatccagcagactgaaatcacttgtccaaaggtgaatcagttcagacagctgtattccaaagtcatcaatgataagcatgatgatgtcatggccaagtttggcgctattctggcccagggcatactggatgcagggtcataatgtcacaatctccttgcagtccaggactgggcatactggatgcgtggtcataatgtcacaatctccttgcagtccaggactgggcatactcatatgccttctgtggttggcgtccttgtatttacccagttttggttctggtttcctctttcacacttcctgtcattggcttatacccctacctgtgtcattggccttaacaaggacttaaagatgccgaaagttcagtataaatcgaactgtaaaccatccacatttgcatatcctgcccctctggaagtaccaaaagaaaaagaaaaggaaaaggtttctactgctgtattatctataactgccaaggctaaaaagaaggaaaaagaaaaggaaaaaaaggaggaggagaaaatggaagtggatgaggcagagaaaaaggaggaaaaagagaagaaaaaagaacctgagccaaacttccagttattggataacccagcccgagttatgcctgcccagcttaaggtcctaaccatgccggagacctgtagataccagcctttcaaaccactctctattggaggcatcatcattctgaaggataccagtgaagacattgaggagctggtggaacctgtggcagcacatggcccaaaaatcgaggaggaggaacaagagccagaacccccagaaccatttgagtatattgatgattaagggccagaggatctcacttgcttatctgaagaagattgtccaggctcatattgggaatgcttatgaggaaattcatgccgagacctgctattcaatgcatgtatcgttgcctctgcactgacctgaagaaccctgtctccaagtctttggttgaagagaagatatatgactgttgagtgtgctctttcacagaacttggttttcaaataaatataagatctccagatggacaagacatttgtttttcagcctgggtttttaataaatgtatctaatcctccccacaccatgaaatgcctaaatcccaagagccagagtcttgatttgctaggatgagtatgcacgactttcatattgatgaaaaagtcaaactattcttaaattatagaccatgaaaataatggaagggaaaaaaatcaaaccttgctcatcacccccaagaattctctacagttttgttgtggttgtgggttgttgtttaatatggggtctaatcagccagggcaacatggtgagacccccatctctacaaaaaaattgaaaaattagctgggtaggccaggcagggtggctcacgcctataatcccagcactttggaaggccaaggtgggcagattgcttgagccaaggagtttgagaccagcctgggcaacatggcaaaaactcacctctacaaa

SEQ ID NO: 365893 - DNA, 2731 bp, Homo sapiens
tcctggcgagaagcgagccggcggcctgaggaggcgactgactgagcagcgcacccggggagcaaggaggcgcggtgaactgagcggcccctgagctgacagatacactgcgcagctggaacggcgagcgagccgacgggcgagtgaggggcgcagccatgatcacctcggccgctggaattatttctcttctggatgaagatgaaccacagcttaaggaatttgcactacacaaattgaatgcagttgttaatgacttctgggcagaaatttccgagtccgtagacaaaatagaggttttatacgaagatgaaggtttccggagtcggcagtttgcagccttagtggcatctaaagtattttatcacctgggggcttttgaggagtctctgaattatgctcttggagcaggggacctcttcaatgtcaatgataactctgaatatgtggaaactattatagcaaaatgcattgatcactacaccaaacaatgtgtggaaaatgcagatttgcctgaaggagaaaaaaaaccaattgaccagagattggaaggcatcgtaaataaaatgttccagcgatgtctagatgatcacaagtataaacaggctattggcattgctctggagacacgaagactggacgtctttgaaaagaccatactggagtcgaatgatgtcccaggaatgttagcttatagccttaagctctgcatgtctttaatgcagaataaacagtttcggaataaagtactaagagttctagttaaaatctacatgaacttggagaaacctgatttcatcaatgtttgtcagtgcttaattttcttagatgatcctcaggctgtgagtgatatcttagagaaactggtaaaggaagacaacctcctgatggcatatcagatttgttttgatttgtatgaaagtgctagccagcagtttttgtcatctgtaatccagaatcttcgaactgttggcacccctattgcttctgtgcctggatccactaatacgggtactgttccgggatcagagaaagacagtgactcgatggaaacagaagaaaagacaagcagtgcatttgtaggaaagacaccagaagccagtccagagcctaaggaccagactttgaaaatgattaaaattttaagtggtgaaatggctattgagttacatctgcagttcttaatacgaaacaataatacagacctcatgattctaaaaaacacaaaggatgcagtacggaattctgtatgtcatactgcaaccgttatagcaaactcttttatgcactgtgggacaaccagtgaccagtttcttagagataatttggaatggttagccagagccactaactgggcaaaatttactgctacagccagtttgggtgtaattcataagggtcatgaaaaagaagcattacagttaatggcaacataccttcccaaggatacttctccaggatcagcctatcaggaaggtggaggtctctatgcactaggtcttattcatgccaatcatggtggtgatataattgactatctgcttaatcagcttaagaacgccagcaatgatatcgttagacacggtggcagtctgggccttggtttggcagccatgggaactgcacgtcaagatgtttatgatttgctaaaaacaaacctttatcaggatgatgcagtaacaggggaagcagctggcctggccctaggtttggttatgttgggctctaaaaatgctcaggctattgaggacatggttggttatgcacaagaaactcaacatgagaagattctgcgtggtcttgcagttggcatagctttagtaatgtatgggaggatggaagaggctgatgctctcattgaatctctctgtcgtgacaaggacccaattcttcgaaggtctggaatgtatactgtagccatggcttattgtggctctggtaacaacaaagcaattcgacgcctgctacatgttgctgtaagtgatgttaatgatgatgtcaggagggcagcagtagaatcacttgggttcattctattcagaacccctgaacagtgcccaagtgttgtctctttgttgtcagagagttacaaccctcatgtgcgctacggagctgcaatggccttggggatatgctgtgctggtacaggaaacaaggaagccattaatttgctagaaccaatgacaaacgaccccgtgaactacgtgaggcaaggggcactcatagcttcagctctcatcatgatccagcagactgaaatcacttgtccaaaggtgaatcagttcagacagctgtattccaaagtcatcaatgataagcatgatgatgtcatggccaagtttggcgctattctggcccagggcatactggatgcaggtggtcataatgtcacaatctccttgcagtccaggactgggcatactcatatgccttctgtggttggcgtccttgtatttacccagttttggttctggtttcctctttcacacttcctgtcattggcttatacccctacctgtgtcattggccttaacaaggacttaaagatgccgaaagttcagtataaatcgaactgtaaaccatccacatttgcatatcctgcccctctggaagtaccaaaagaaaaagaaaaggaaaagcgaataagaaggcctacataaaagacattgcacacaaggatgtggctgaaagacatgcagaggcactaggaaaagcggaacaactgaatcct

SEQ ID NO: 365894 - DNA, 2015 bp, Homo sapiens
gtgggctccatatatgctcatagccatagacgagtacatagatgcgcttatgcacccgaaactcaaggactgaagacgattcgtgcgctgctcttgcaatatggggattacccctagatatactgtctggaaggatgcaagcgggtgatggtctcgattgaatctcactttcgtgactgggacaccccttgcggaaggacccaattcttcgaaggtctggaatgtatactgtagccatggcttattgtggctctggtaacaacaaagcaattcgacgcctgctacatgttgctgtaagtgatgttaatgatgatgtcaggagggcagcagtagaatcacttgggttcattctattcagaacccctgaacagtgcccaagtgttgtctctttgttgtcagagagttacaaccctcatgtgcgctacggagctgcaatggccttggggatatgctgtgctggtacaggaaacaaggaagccattaatttgctagaaccaatgacaaacgaccccgtgaactacgtgaggcaaggggcactcatagcttcagctctcatcatgatccagcagactgaaatcacttgtccaaaggtgaatcagttcagacagctgtattccaaagtcatcaatgataagcatgatgatgtcatggccaagtttggcgctattctggcccagggcatactggatgcaggtggtcataatgtcacaatctccttgcagtccaggactgggcatactcatatgccttctgtggttggcgtccttgtatttacccagttttggttctggtttcctctttcacacttcctgtcattggcttatacccctacctgtgtcattggccttaacaaggacttaaagatgccgaaagttcagtataaatcgaactgtaaaccatccacatttgcatatcctgcccctctggaagtaccaaaagaaaaagaaaaggaaaaggtttctactgctgtattatctataactgccaaggctaaaaagaaggaaaaagaaaaggaaaaaaaggaggaggagaaaatggaagtggatgaggcagagaaaaaggaggaaaaagagaagaaaaaagaacctgagccaaacttccagttattggataacccagcccgagttatgcctgcccagcttaaggtcctaaccatgccggagacctgtagataccagcctttcaaaccactctctattggaggcatcatcattctgaaggataccagtgaagacattgaggagctggtggaacctgtggcagcacatggcccaaaaatcgaggaggaggaacaagagccagaacccccagaaccatttgagtatattgatgattaagggccagaggatctcacttgcttatctgaagaagattgtccaggctcatattgggaatgcttatgaggaaattcatgccgagacctgctattcaatgcatgtatcgttgcctctgcactgacctgaagaaccctgtctccaagtctttggttgaagagaagatatatgactgttgagtgtgctctttcacagaacttggttttcaaataaatataagatctccagatggacaagacatttgtttttcagcctgggtttttaataaatgtatctaatcctccccacaccatgaaatgcctaaatcccaagagccagagtcttgatttgctaggatgagtatgcacgactttcatattgatgaaaaagtcaaactattcttaaattatagaccatgaaaataatggaagggaaaaaaatcaaaccttgctcatcacccccaagaattctctacagttttgttgtggttgtgggttgttgtttaatatggggtctaatcagccagggcaacatggtgagacccccatctctacaaaaaaattgaaaaattagctgggtaggccaggcagggtggctcacgcctataatcccagcactttggaaggccaaggtgggcagattgcttgagccaaggagtttgagaccagcctgggcaacatggcaaaaactcacctctacaaa

SEQ ID NO: 365895 - DNA, 2650 bp, Homo sapiens
tcctggcgagaagcgagccggcggcctgaggaggcgactgactgagcagcgcacccggggagcaaggaggcgcggtgaactgagcggcccctgagctgacagatacactgcgcagctggaacggcgagcgagccgacgggcgagtgaggggcgcagccatgatcacctcggccgctggaattatttctcttctggatgaagatgaaccacagcttaaggaatttgcactacacaaattgaatgcagttgttaatgacttctgggcagaaatttccgagtccgtagacaaaatagaggttttatacgaagatgaaggtttccggagtcggcagtttgcagccttagtggcatctaaagtattttatcacctgggggcttttgaggagtctctgaattatgctcttggagcaggggacctcttcaatgtcaatgataactctgaatatgtggaaactattatagcaaaatgcattgatcactacaccaaacaatgtgtggaaaatgcagatttgcctgaaggagaaaaaaaaccaattgaccagagattggaaggcatcgtaaataaaatgttccagcgatgtctagatgatcacaagtataaacaggctattggcattgctctggagacacgaagactggacgtctttgaaaagaccatactggagtcgaatgatgtcccaggaatgttagcttatagccttaagctctgcatgtctttaatgcagaataaacagtttcggaataaagtactaagagttctagttaaaatctacatgaacttggagaaacctgatttcatcaatgtttgtcagtgcttaattttcttagatgatcctcaggctgtgagtgatatcttagagaaactggtaaaggaagacaacctcctgatggcatatcagatttgttttgatttgtatgaaagtgctagccagcagtttttgtcatctgtaatccagaatcttcgaactgttggcacccctattgcttctgtgcctggatccactaatacgggtactgttccgggatcagagaaagacagtgactcgatggaaacagaagaaaagacaagcagtgcatttgtaggaaagacaccagaagccagtccagagcctaaggaccagactttgaaaatgattaaaattttaagtggtgaaatggctattgagttacatctgcagttcttaatacgaaacaataatacagacctcatgattctaaaaaacacaaaggatgcagtacggaattctgtatgtcatactgcaaccgttatagcaaactcttttatgcactgtgggacaaccagtgaccagtttcttagagataatttggaatggttagccagagccactaactgggcaaaatttactgctacagccagtttgggtgtaattcataagggtcatgaaaaagaagcattacagttaatggcaacataccttcccaaggatacttctccaggatcagcctatcaggaaggtggaggtctctatgcactaggtcttattcatgccaatcatggtggtgatataattgactatctgcttaatcagcttaagaacgccagcaatgatatcgttagacacggtggcagtctgggccttggtttggcagccatgggaactgcacgtcaagatgtttatgatttgctaaaaacaaacctttatcaggatgatgcagtaacaggggaagcagctggcctggccctaggtttggttatgttgggctctaaaaatgctcaggctattgaggacatggttggttatgcacaagaaactcaacatgagaagattctgcgtggtcttgcagttggcatagctttagtaatgtatgggaggatggaagaggctgatgctctcattgaatctctctgtcgtgacaaggacccaattcttcgaaggtctggaatgtatactgtagccatggcttattgtggctctggtaacaacaaagcaattcgacgcctgctacatgttgctgtaagtgatgttaatgatgatgtcaggagggcagcagtagaatcacttgggttcattctattcagaacccctgaacagtgcccaagtgttgtctctttgttgtcagagagttacaaccctcatgtgcgctacggagctgcaatggccttggggatatgctgtgctggtacaggaaacaaggaagccattaatttgctagaaccaatgacaaacgaccccgtgaactacgtgaggcaaggggcactcatagcttcagctctcatcatgatccagcagactgaaatcacttgtccaaaggtgaatcagttcagacagctgtattccaaagtcatcaatgataagcatgatgatgtcatggccaagtttggcgctattctggcccagggcatactggatgcaggtggtcataatgtcacaatctccttgcagtccaggactgggcatactcatatgccttctgtggttggcgtccttgtatttacccagttttggttctggtttcctctttcacacttcctgtcattggcttatacccctacctgtgtcattggccttaacaaggacttaaaggtttctactgctgtattatctataactgccaaggctaaaaagaaggaaaaagaaaaggaaaaaaaggaggaggagaaaatggaagtggtaggtataaattggtg

SEQ ID NO: 365896 - DNA, 2554 bp, Homo sapiens
tcctggcgagaagcgagccggcggcctgaggaggcgactgactgagcagcgcacccggggagcaaggaggcgcggtgaactgagcggcccctgagctgacagatacactgcgcagctggaacggcgagcgagccgacgggcgagtgaggggcgcagccatgatcacctcggccgctggaattatttctcttctggatgaagatgaaccacagcttaaggaatttgcactacacaaattgaatgcagttgttaatgacttctgggcagaaatttccgagtccgtagacaaaatagaggttttatacgaagatgaaggtttccggagtcggcagtttgcagccttagtggcatctaaagtattttatcacctgggggcttttgaggagtctctgaattatgctcttggagcaggggacctcttcaatgtcaatgataactctgaatatgtggaaactattatagcaaaatgcattgatcactacaccaaacaatgtgtggaaaatgcagatttgcctgaaggagaaaaaaaaccaattgaccagagattggaaggcatcgtaaataaaatgttccagcgatgtctagatgatcacaagtataaacaggctattggcattgctctggagacacgaagactggacgtctttgaaaagaccatactggagtcgaatgatgtcccaggaatgttagcttatagccttaagctctgcatgtctttaatgcagaataaacagtttcggaataaagtactaagagttctagttaaaatctacatgaacttggagaaacctgatttcatcaatgtttgtcagtgcttaattttcttagatgatcctcaggctgtgagtgatatcttagagaaactggtaaaggaagacaacctcctgatggcatatcagatttgttttgatttgtatgaaagtgctagccagcagtttttgtcatctgtaatccagaatcttcgaactgttggcacccctattgcttctgtgcctggatccactaatacgggtactgttccgggatcagagaaagacagtgactcgatggaaacagaagaaaagacaagcagtgcatttgtaggaaagacaccagaagccagtccagagcctaaggaccagactttgaaaatgattaaaattttaagtggtgaaatggctattgagttacatctgcagttcttaatacgaaacaataatacagacctcatgattctaaaaaacacaaaggatgcagtacggaattctgtatgtcatactgcaaccgttatagcaaactcttttatgcactgtgggacaaccagtgaccagtttcttagttttggttctggtttcctctttcacacttcctgtcattggcttatacccctacctgtgtcattggccttaacaaggacttaaagatgccgaaagttcagtataaatcgaactgtaaaccatccacatttgcatatcctgcccctctggaagtaccaaaagaaaaagaaaaggaaaaggtttctactgctgtattatctataactgccaaggctaaaaagaaggaaaaagaaaaggaaaaaaaggaggaggagaaaatggaagtggatgaggcagagaaaaaggaggaaaaagagaagaaaaaagaacctgagccaaacttccagttattggataacccagcccgagttatgcctgcccagcttaaggtcctaaccatgccggagacctgtagataccagcctttcaaaccactctctattggaggcatcatcattctgaaggataccagtgaagacattgaggagctggtggaacctgtggcagcacatggcccaaaaatcgaggaggaggaacaagagccagaacccccagaaccatttgagtatattgatgattaagggccagaggatctcacttgcttatctgaagaagattgtccaggctcatattgggaatgcttatgaggaaattcatgccgagacctgctattcaatgcatgtatcgttgcctctgcactgacctgaagaaccctgtctccaagtctttggttgaagagaagatatatgactgttgagtgtgctctttcacagaacttggttttcaaataaatataagatctccagatggacaagacatttgtttttcagcctgggtttttaataaatgtatctaatcctccccacaccatgaaatgcctaaatcccaagagccagagtcttgatttgctaggatgagtatgcacgactttcatattgatgaaaaagtcaaactattcttaaattatagaccatgaaaataatggaagggaaaaaaatcaaaccttgctcatcacccccaagaattctctacagttttgttgtggttgtgggttgttgtttaatatggggtctaatcagccagggcaacatggtgagacccccatctctacaaaaaaattgaaaaattagctgggtaggccaggcagggtggctcacgcctataatcccagcactttggaaggccaaggtgggcagattgcttgagccaaggagtttgagaccagcctgggcaacatggcaaaaactcacctctacaaa

SEQ ID NO: 365897 - DNA, 2677 bp, Homo sapiens
tcctggcgagaagcgagccggcggcctgaggaggcgactgactgagcagcgcacccggggagcaaggaggcgcggtgaactgagcggcccctgagctgacagatacactgcgcagctggaacggcgagcgagccgacgggcgagtgaggggcgcagccatgatcacctcggccgctggaattatttctcttctggatgaagatgaaccacagcttaaggaatttgcactacacaaattgaatgcagttgttaatgacttctgggcagaaatttccgagtccgtagacaaaatagaggttttatacgaagatgaaggtttccggagtcggcagtttgcagccttagtggcatctaaagtattttatcacctgggggcttttgaggagtctctgaattatgctcttggagcaggggacctcttcaatgtcaatgataactctgaatatgtggaaactattatagcaaaatgcattgatcactacaccaaacaatgtgtggaaaatgcagatttgcctgaaggagaaaaaaaaccaattgaccagagattggaaggcatcgtaaataaaatgttccagcgatgtctagatgatcacaagtataaacaggctattggcattgctctggagacacgaagactggacgtctttgaaaagaccatactggagtcgaatgatgtcccaggaatgttagcttatagccttaagctctgcatgtctttaatgcagaataaacagtttcggaataaagtactaagagttctagttaaaatctacatgaacttggagaaacctgatttcatcaatgtttgtcagtgcttaattttcttagatgatcctcaggctgtgagtgatatcttagagaaactggtaaaggaagacaacctcctgatggcatatcagatttgttttgatttgtatgaaagtgctagccagcagtttttgtcatctgtaatccagaatcttcgaactgttggcacccctattgcttctgtgcctggatccactaatacgggtactgttccgggatcagagaaagacagtgactcgatggaaacagaagaaaagacaagcagtgcatttgtaggaaagacaccagaagccagtccagagcctaaggaccagactttgaaaatgattaaaattttaagtggtgaaatggctattgagttacatctgcagttcttaatacgaaacaataatacagacctcatgattctaaaaaacacaaaggatgcagtacggaattctgtatgtcatactgcaaccgttatagcaaactcttttatgcactgtgggacaaccagtgaccagtttcttagagataatttggaatggttagccagagccactaactgggcaaaatttactgctacagccagtttgggtgtaattcataagggtcatgaaaaagaagcattacagttaatggcaacataccttcccaaggatacttctccaggatcagcctatcaggaaggtggaggtctctatgcactaggtcttattcatgccaatcatggtggtgatataattgactatctgcttaatcagcttaagaacgccagcaatgatatcgttagacacggtggcagtctgggccttggtttggcagccatgggaactgcacgtcaagatgtttatgatttgctaaaaacaaacctttatcaggatgatgcagtaacaggggaagcagctggcctggccctaggtttggttatgttgggctctaaaaatgctcaggctattgaggacatggttggttatgcacaagaaactcaacatgagaagattctgcgtggtcttgcagttggcatagctttagtaatgtatgggaggatggaagaggctgatgctctcattgaatctctctgtcgtgacaaggacccaattcttcgaaggtctggaatgtatactgtagccatggcttattgtggctctggtaacaacaaagcaattcgacgcctgctacatgttgctgtaagtgatgttaatgatgatgtcaggagggcagcagtagaatcacttgggttcattctattcagaacccctgaacagtgcccaagtgttgtctctttgttgtcagagagttacaaccctcatgtgcgctacggagctgcaatggccttggggatatgctgtgctggtacaggaaacaaggaagccattaatttgctagaaccaatgacaaacgaccccgtgaactacgtgaggcaaggggcactcatagcttcagctctcatcatgatccagcagactgaaatcacttgtccaaaggtgaatcagttcagacagctgtattccaaactctctattggaggcatcatcattctgaaggataccagtgaagacattgaggagctggtggaacctgtggcagcacatggcccaaaaatcgaggaggaggaacaagagccagaacccccagaaccatttgagtatattgatgattaagggccagaggatctcacttgcttatctgaagaagattgtccaggctcatattgggaatgcttatgaggaaattcatgccgagacctgctattcaatgcatgtatcgttgcctctgcactgacctgaagaaccctgtctccaagtctttggttgaagagaagatatatgactgttgagtgtgctctttcacagaacttggttttcaaataaatataagatctccagat

SEQ ID NO: 365898 - DNA, 2448 bp, Homo sapiens
tcctggcgagaagcgagccggcggcctgaggaggcgactgactgagcagcgcacccggggagcaaggaggcgcggtgaactgagcggcccctgagctgacagatacactgcgcagctggaacggcgagcgagccgacgggcgagtgaggggcgcagccatgatcacctcggccgctggaattatttctcttctggatgaagatgaaccacagcttaaggaatttgcactacacaaattgaatgcagttgttaatgacttctgggcagaaatttccgagtccgtagacaaaatagaggttttatacgaagatgaaggtttccggagtcggcagtttgcagccttagtggcatctaaagtattttatcacctgggggcttttgaggagtctctgaattatgctcttggagcaggggacctcttcaatgtcaatgataactctgaatatgtggaaactattatagcaaaatgcattgatcactacaccaaacaatgtgtggaaaatgcagatttgcctgaaggagaaaaaaaaccaattgaccagagattggaaggcatcgtaaataaaatgttccagcgatgtctagatgatcacaagtataaacaggctattggcattgctctggagacacgaagactggacgtctttgaaaagaccatactggagtcgaatgatgtcccaggaatgttagcttatagccttaagctctgcatgtctttaatgcagaataaacagtttcggaataaagtactaagagttctagttaaaatctacatgaacttggagaaacctgatttcatcaatgtttgtcagtgcttaattttcttagatgatcctcaggctgtgagtgatatcttagagaaactggtaaaggaagacaacctcctgatggcatatcagatttgttttgatttgtatgaaagtgctagccagcagtttttgtcatctgtaatccagaatcttcgaactgttggcacccctattgcttctgtgcctggatccactaatacgggtactgttccgggatcagagaaagacagtgactcgatggaaacagaagaaaagacaagcagtgcatttgtaggaaagacaccagaagccagtccagagcctaaggaccagactttgaaaatgattaaaattttaagtggtgaaatggctattgagttacatctgcagttcttaatacgaaacaataatacagacctcatgattctaaaaaacacaaaggatgcagtacggaattctgtatgtcatactgcaaccgttatagcaaactcttttatgcactgtgggacaaccagtgaccagtttcttagagataatttggaatggttagccagagccactaactgggcaaaatttactgctacagccagtttgggtgtaattcataagggtcatgaaaaagaagcattacagttaatggcaacataccttcccaaggatacttctccaggatcagcctatcaggaaggtggaggtctctatgcactaggtcttattcatgccaatcatggtggtgatataattgactatctgcttaatcagcttaagaacgccagcaatgatatcgttagacacggtggcagtctgggccttggtttggcagccatgggaactgcacgtcaagatgtttatgatttgctaaaaacaaacctttatcaggatgatgcagtaacaggggaagcagctggcctggccctaggtttggttatgttgggctctaaaaatgctcaggctattgaggacatggttggttatgcacaagaaactcaacatgagaagattctgcgtggtcttgcagttggcatagctttagtaatgtatgggaggatggaagaggctgatgctctcattgaatctctctgtcgtgacaaggacccaattcttcgaaggtctggaatgtatactgtagccatggcttattgtggctctggtaacaacaaagcaattcgacgcctgctacatgttgctgtaagtgatgttaatgatgatgtcaggagggcagcagtagaatcacttgggttcattctattcagaacccctgaacagtgcccaagtgttgtctctttgttgtcagagagttacaaccctcatgtgcgctacggagctgcaatggccttggggatatgctgtgctggtacaggaaacaaggtaaagcccacagccaatggggtcagttctttcttggcgccagactgttttccctcgccgcagaatttatgtaacagctgtaaaaatacaagtgcaatgtgatctgtaagagtaaacttgccatacaaagcttcccagtactccctcattctgcgatgctggattgcccaaagctgcttaagaataaatcgtcacattacatggatagctgtaactgaaacagtgcttttgaatttctttttgaaatcactgatttctgggttttttgtttttgttttctttgtttgtttat

SEQ ID NO: 365899 - DNA, 1520 bp, Homo sapiens
taactcattatcattggagcaatattattccctgttctaaaatggtaccgcaaatgagtagacttagactataattctttctcttgctccttcaggtgaatcagttcagacagctgtattccaaagtcatcaatgataagcatgatgatgtcatggccaagtttggcgctattctggcccagggcatactggatgcaggtggtcataatgtcacaatctccttgcagtccaggactgggcatactcatatgccttctgtggttggcgtccttgtatttacccagttttggttctggtttcctctttcacacttcctgtcattggcttatacccctacctgtgtcattggccttaacaaggacttaaagatgccgaaagttcagtataaatcgaactgtaaaccatccacatttgcatatcctgcccctctggaagtaccaaaagaaaaagaaaaggaaaaggtttctactgctgtattatctataactgccaaggctaaaaagaaggaaaaagaaaaggaaaaaaaggaggaggagaaaatggaagtggatgaggcagagaaaaaggaggaaaaagagaagaaaaaagaacctgagccaaacttccagttattggataacccagcccgagttatgcctgcccagcttaaggtcctaaccatgccggagacctgtagataccagcctttcaaaccactctctattggaggcatcatcattctgaaggataccagtgaagacattgaggagctggtggaacctgtggcagcacatggcccaaaaatcgaggaggaggaacaagagccagaacccccagaaccatttgagtatattgatgattaagggccagaggatctcacttgcttatctgaagaagattgtccaggctcatattgggaatgcttatgaggaaattcatgccgagacctgctattcaatgcatgtatcgttgcctctgcactgacctgaagaaccctgtctccaagtctttggttgaagagaagatatatgactgttgagtgtgctctttcacagaacttggttttcaaataaatataagatctccagatggacaagacatttgtttttcagcctgggtttttaataaatgtatctaatcctccccacaccatgaaatgcctaaatcccaagagccagagtcttgatttgctaggatgagtatgcacgactttcatattgatgaaaaagtcaaactattcttaaattatagaccatgaaaataatggaagggaaaaaaatcaaaccttgctcatcacccccaagaattctctacagttttgttgtggttgtgggttgttgtttaatatggggtctaatcagccagggcaacatggtgagacccccatctctacaaaaaaattgaaaaattagctgggtaggccaggcagggtggctcacgcctataatcccagcactttggaaggccaaggtgggcagattgcttgagccaaggagtttgagaccagcctgggcaacatggcaaaaactcacctctacaaa

SEQ ID NO: 365900 - DNA, 1262 bp, Homo sapiens
tgatgacaagagtagtaaattatttcagtaaatgtcctgcttagttttcccatttattctttgatttatatatatatatatatatatatatatatgtaatacagctaggaaatagaatagtgttgtaggactgagttctctagggcttgcatgtttgtatgtcagtaagggattacaacagtttaccctgctcatttccccaggtttctactgctgtattatctataactgccaaggctaaaaagaaggaaaaagaaaaggaaaaaaaggaggaggagaaaatggaagtggatgaggcagagaaaaaggaggaaaaagagaagaaaaaagaacctgagccaaacttccagttattggataacccagcccgagttatgcctgcccagcttaaggtcctaaccatgccggagacctgtagataccagcctttcaaaccactctctattggaggcatcatcattctgaaggataccagtgaagacattgaggagctggtggaacctgtggcagcacatggcccaaaaatcgaggaggaggaacaagagccagaacccccagaaccatttgagtatattgatgattaagggccagaggatctcacttgcttatctgaagaagattgtccaggctcatattgggaatgcttatgaggaaattcatgccgagacctgctattcaatgcatgtatcgttgcctctgcactgacctgaagaaccctgtctccaagtctttggttgaagagaagatatatgactgttgagtgtgctctttcacagaacttggttttcaaataaatataagatctccagatggacaagacatttgtttttcagcctgggtttttaataaatgtatctaatcctccccacaccatgaaatgcctaaatcccaagagccagagtcttgatttgctaggatgagtatgcacgactttcatattgatgaaaaagtcaaactattcttaaattatagaccatgaaaataatggaagggaaaaaaatcaaaccttgctcatcacccccaagaattctctacagttttgttgtggttgtgggttgttgtttaatatggggtctaatcagccagggcaacatggtgagacccccatctctacaaaaaaattgaaaaattagctgggtaggccaggcagggtggctcacgcctataatcccagcactttggaaggccaaggtgggcagattgcttgagccaaggagtttgagaccagcctgggcaacatggcaaaaactcacctctacaaa

SEQ ID NO: 365901 - DNA, 1072 bp, Homo sapiens
tttagtgtttgaatttaccttctgtaatatgtttgggagagggcttaatagaattgctgctacagtctacttcccttttgtttcccatgtattttttcatcggcttgcatcacgtggatttatagattaaagtgaaaaacccgggatatctgtgttattctctccatcattctgaaattgctggagaaaaaattggcttttaatttatacactctcgtgttcttcagtgtgcatcagattgactgggatcttgttagaatgcagattctgcagatctagggtggggccagcttttctgcatttttaacaagctccagatgataatgatgcttctggcccaggaccatatcttgagtaggaaggaattaggatactatatttggacagtaaacattcttcctgcagtgagactgaggctggtagtcaaggccatggctgggaaataactattcttaaattgggatgcatcatccaagtagaacagcatcacatgttataccatctagagctactgggttaagtttgcaaatacttcgtatagatcacagttatctttatcccagtaaagttctactccagtttttcacttccaaatcatttaagtagttttaaagtaccatttaacaagtatttactctagattgtggagcacgcttgaaatatgagtgtacgcttctgcacgcccctgtgtttccagcctctctattggaggcatcatcattctgaaggataccagtgaagacattgaggagctggtggaacctgtggcagcacatggcccaaaaatcgaggaggaggaacaagagccagaacccccagaaccatttgagtatattgatgattaagggccagaggatctcacttgcttatctgaagaagattgtccaggctcatattgggaatgcttatgaggaaattcatgccgagacctgctattcaatgcatgtatcgttgcctctgcactgacctgaagaaccctgtctccaagtctttggttgaagagaagatatatgactgttgagtgtgctctttcacagaacttggttttcaaataaatataagatctccagat

SEQ ID NO: 365902 - DNA, 737 bp, Homo sapiens
  misc_feature (692)..(692): n is a, c, g, or t
  misc_feature (734)..(734): n is a, c, g, or t
  misc_feature (736)..(737): n is a, c, g, or t
tcctggcgagaagcgagccggcggcctgaggaggcgactgactgagcagcgcacccggggagcaaggaggcgcggtgaactgagcggcccctgagctgacagatacactgcgcagctggaacggcgagcgagccgacgggcgagtgaggggcgcagccatgatcacctcggccgctggaattatttctcttctggatgaagatgaaccacagcttaaggaatttgcactacacaaattgaatgcagttgttaatgacttctgggcagaaatttccgagtccgtagacaaaatagaggttttatacgaagatgaaggtttccggagtcggcagtttgcagccttagtggcatctaaagtattttatcacctgggggcttttgaggagtctctgaattatgctcttggagcaggggacctcttcaatgtcaatgataactctgaatatgtggaaactattatagcaaaatgcattgatcactacaccaaacaatgtgtggaaaatgcagatttgcctgaaggagaaaaaaaaccaattgaccagagattggaaggcatcgtaaataaaatgttccagcgatgtctagatgatcacaagtataaacaggctattggcattgctctggagacacgaagactggacgtctttgaaaagaccatactggagtcgaattcaaaatgaatgttcccccangaaaatgtttaagcctttaataacccccttaaaacctcctgncnn

SEQ ID NO: 365903 - DNA, 3698 bp, Homo sapiens
tcctggcgagaagcgagccggcggcctgaggaggcgactgactgagcagcgcacccggggagcaaggaggcgcggtgaactgagcggcccctgagctgacagatacactgcgcagctggaacggcgagcgagccgacgggcgagtgaggggcgcagccatgatcacctcggccgctggaattatttctcttctggatgaagatgaaccacagcttaaggaatttgcactacacaaattgaatgcagttgttaatgacttctgggcagaaatttccgagtccgtagacaaaatagaggttttatacgaagatgaaggtttccggagtcggcagtttgcagccttagtggcatctaaagtattttatcacctgggggcttttgaggagtctctgaattatgctcttggagcaggggacctcttcaatgtcaatgataactctgaatatgtggaaactattatagcaaaatgcattgatcactacaccaaacaatgtgtggaaaatgcagatttgcctgaaggagaaaaaaaaccaattgaccagagattggaaggcatcgtaaataaaatgttccagcgatgtctagatgatcacaagtataaacaggctattggcattgctctggagacacgaagactggacgtctttgaaaagaccatactggagtcgaatgatgtcccaggaatgttagcttatagccttaagctctgcatgtctttaatgcagaataaacagtttcggaataaagtactaagagttctagttaaaatctacatgaacttggagaaacctgatttcatcaatgtttgtcagtgcttaattttcttagatgatcctcaggctgtgagtgatatcttagagaaactggtaaaggaagacaacctcctgatggcatatcagatttgttttgatttgtatgaaagtgctagccagcagtttttgtcatctgtaatccagaatcttcgaactgttggcacccctattgcttctgtgcctggatccactaatacgggtactgttccgggatcagagaaagacagtgactcgatggaaacagaagaaaagacaagcagtgcatttgtaggaaagacaccagaagccagtccagagcctaaggaccagactttgaaaatgattaaaattttaagtggtgaaatggctattgagttacatctgcagttcttaatacgaaacaataatacagacctcatgattctaaaaaacacaaaggatgcagtacggaattctgtatgtcatactgcaaccgttatagcaaactcttttatgcactgtgggacaaccagtgaccagtttcttagagataatttggaatggttagccagagccactaactgggcaaaatttactgctacagccagtttgggtgtaattcataagggtcatgaaaaagaagcattacagttaatggcaacataccttcccaaggatacttctccaggatcagcctatcaggaaggtggaggtctctatgcactaggtcttattcatgccaatcatggtggtgatataattgactatctgcttaatcagcttaagaacgccagcaatgatatcgttagacacggtggcagtctgggccttggtttggcagccatgggaactgcacgtcaagatgtttatgatttgctaaaaacaaacctttatcaggatgatgcagtaacaggggaagcagctggcctggccctaggtttggttatgttgggctctaaaaatgctcaggctattgaggacatggttggttatgcacaagaaactcaacatgagaagattctgcgtggtcttgcagttggcatagctttagtaatgtatgggaggatggaagaggctgatgctctcattgaatctctctgtcgtgacaaggacccaattcttcgaaggtctggaatgtatactgtagccatggcttattgtggctctggtaacaacaaagcaattcgacgcctgctacatgttgctgtaagtgatgttaatgatgatgtcaggagggcagcagtagaatcacttgggttcattctattcagaacccctgaacagtgcccaagtgttgtctctttgttgtcagagagttacaaccctcatgtgcgctacggagctgcaatggccttggggatatgctgtgctggtacaggaaacaaggaagccattaatttgctagaaccaatgacaaacgaccccgtgaactacgtgaggcaaggggcactcatagcttcagctctcatcatgatccagcagactgaaatcacttgtccaaaggtgaatcagttcagacagctgtattccaaagtcatcaatgataagcatgatgatgtcatggccaagtttggcgctattctggcccagggcatactggatgcaggtggtcataatgtcacaatctccttgcagtccaggactgggcatactcatatgccttctgtggttggcgtccttgtatttacccagttttggttctggtttcctctttcacacttcctgtcattggcttatacccctacctgtgtcattggccttaacaaggacttaaagatgccgaaagttcagtataaatcgaactgtaaaccatccacatttgcatatcctgcccctctggaagtaccaaaagaaaaagaaaaggaaaaggtttctactgctgtattatctataactgccaaggctaaaaagaaggaaaaagaaaaggaaaaaaaggaggaggagaaaatggaagtggatgaggcagagaaaaaggaggaaaaagagaagaaaaaagaacctgagccaaacttccagttattggataacccagcccgagttatgcctgcccagcttaaggtcctaaccatgccggagacctgtagataccagcctttcaaaccactctctattggaggcatcatcattctgaaggataccagtgaagacattgaggagctggtggaacctgtggcagcacatggcccaaaaatcgaggaggaggaacaagagccagaacccccagaaccatttgagtatattgatgattaagggccagaggatctcacttgcttatctgaagaagattgtccaggctcatattgggaatgcttatgaggaaattcatgccgagacctgctattcaatgcatgtatcgttgcctctgcactgacctgaagaaccctgtctccaagtctttggttgaagagaagatatatgactgttgagtgtgctctttcacagaacttggttttcaaataaatataagatctccagatggacaagacatttgtttttcagcctgggtttttaataaatgtatctaatcctccccacaccatgaaatgcctaaatcccaagagccagagtcttgatttgctaggatgagtatgcacgactttcatattgatgaaaaagtcaaactattcttaaattatagaccatgaaaataatggaagggaaaaaaatcaaaccttgctcatcacccccaagaattctctacagttttgttgtggttgtgggttgttgtttaatatggggtctaatcagccagggcaacatggtgagacccccatctctacaaaaaaattgaaaaattagctgggtaggccaggcagggtggctcacgcctataatcccagcactttggaaggccaaggtgggcagattgcttgagccaaggagtttgagaccagcctgggcaacatggcaaaaactcacctctacaaa

SEQ ID NO: 365904 - DNA, 3320 bp, Homo sapiens
  misc_feature (3294)..(3294): n is a, c, g, or t
  misc_feature (3314)..(3314): n is a, c, g, or t
tcctggcgagaagcgagccggcggcctgaggaggcgactgactgagcagcgcacccggggagcaaggaggcgcggtgaactgagcggcccctgagctgacagatacactgcgcagctggaacggcgagcgagccgacgggcgagtgaggggcgcagccatgatcacctcggccgctggaattatttctcttctggatgaagatgaaccacagcttaaggaatttgcactacacaaattgaatgcagttgttaatgacttctgggcagaaatttccgagtccgtagacaaaatagaggttttatacgaagatgaaggtttccggagtcggcagtttgcagccttagtggcatctaaagtattttatcacctgggggcttttgaggagtctctgaattatgctcttggagcaggggacctcttcaatgtcaatgataactctgaatatgtggaaactattatagcaaaatgcattgatcactacaccaaacaatgtgtggaaaatgcagatttgcctgaaggagaaaaaaaaccaattgaccagagattggaaggcatcgtaaataaaatgttccagcgatgtctagatgatcacaagtataaacaggctattggcattgctctggagacacgaagactggacgtctttgaaaagaccatactggagtcgaatgatgtcccaggaatgttagcttatagccttaagctctgcatgtctttaatgcagaataaacagtttcggaataaagtactaagagttctagttaaaatctacatgaacttggagaaacctgatttcatcaatgtttgtcagtgcttaattttcttagatgatcctcaggctgtgagtgatatcttagagaaactggtaaaggaagacaacctcctgatggcatatcagatttgttttgatttgtatgaaagtgctagccagcagtttttgtcatctgtaatccagaatcttcgaactgttggcacccctattgcttctgtgcctggatccactaatacgggtactgttccgggatcagagaaagacagtgactcgatggaaacagaagaaaagacaagcagtgcatttgtaggaaagacaccagaagccagtccagagcctaaggaccagactttgaaaatgattaaaattttaagtggtgaaatggctattgagttacatctgcagttcttaatacgaaacaataatacagacctcatgattctaaaaaacacaaaggatgcagtacggaattctgtatgtcatactgcaaccgttatagcaaactcttttatgcactgtgggacaaccagtgaccagtttcttagagataatttggaatggttagccagagccactaactgggcaaaatttactgctacagccagtttgggtgtaattcataagggtcatgaaaaagaagcattacagttaatggcaacataccttcccaaggatacttctccaggatcagcctatcaggaaggtggaggtctctatgcactaggtcttattcatgccaatcatggtggtgatataattgactatctgcttaatcagcttaagaacgccagcaatgatatcgttagacacggtggcagtctgggccttggtttggcagccatgggaactgcacgtcaagatgtttatgatttgctaaaaacaaacctttatcaggatgatgcagtaacaggggaagcagctggcctggccctaggtttggttatgttgggctctaaaaatgctcaggctattgaggacatggttggttatgcacaagaaactcaacatgagaagattctgcgtggtcttgcagttggcatagctttagtaatgtatgggaggatggaagaggctgatgctctcattgaatctctctgtcgtgacaaggacccaattcttcgaaggtctggaatgtatactgtagccatggcttattgtggctctggtaacaacaaagcaattcgacgcctgctacatgttgctgtaagtgatgttaatgatgatgtcaggagggcagcagtagaatcacttgggttcattctattcagaacccctgaacagtgcccaagtgttgtctctttgttgtcagagagttacaaccctcatgtgcgctacggagctgcaatggccttggggatatgctgtgctggtacaggaaacaaggaagccattaatttgctagaaccaatgacaaacgaccccgtgaactacgtgaggcaaggggcactcatagcttcagctctcatcatgatccagcagactgaaatcacttgtccaaaggtgaatcagttcagacagctgtattccaaagtcatcaatgataagcatgatgatgtcatggccaagtttggcgctattctggcccagggcatactggatgcaggtggtcataatgtcacaatctccttgcagtccaggactgggcatactcatatgccttctgtggttggcgtccttgtatttacccagttttggttctggtttcctctttcacacttcctgtcattggcttatacccctacctgtgtcattggccttaacaaggacttaaagatgccgaaagttcagtataaatcgaactgtaaaccatccacatttgcatatcctgcccctctggaagtaccaaaagaaaaagaaaaggaaaaggtttctactgctgtattatctataactgccaaggctaaaaagaaggaaaaagaaaaggaaaaaaaggaggaggagaaaatggaagtggatgaggcagagaaaaaggaggaaaaagagaagaaaaaagaacctgagccaaacttccagttattggataacccagcccgagttatgcctgcccagcttaaggtcctaaccatgccggagacctgtagataccagcctttcaaaccactctctattggaggcatcatcattctgaaggataccagtgaagacattgaggagctggtggaacctgtggcagcacatggcccaaaaatcgaggaggaggaacaagagccagaacccccagaaccatttgagtatattgatgattaagggccagaggatctcacttgcttatctgaagaagattgtccaggctcatattgggaatgcttatgaggaaattcatgccgagacctgctattcaatgcatgtatcgttgcctctgcactgacctgaagaaccctgtctccaagtctttggttgaagagaagatatatgactgttgagtgtgctctttcacagaacttggttttcaaataaatataagatctccagataaaaaaaaaaaaaaaaaaaaaaaaaaaaaaaaaaaaaaaaaaaaaanaaaaaaaaagaggggggggngcaaaa

SEQ ID NO: 365905 - DNA, 3195 bp, Homo sapiens
  misc_feature (3182)..(3182): n is a, c, g, or t
tcctggcgagaagcgagccggcggcctgaggaggcgactgactgagcagcgcacccggggagcaaggaggcgcggtgaactgagcggcccctgagctgacagatacactgcgcagctggaacggcgagcgagccgacgggcgagtgaggggcgcagccatgatcacctcggccgctggaattatttctcttctggatgaagatgaaccacagcttaaggaatttgcactacacaaattgaatgcagttgttaatgacttctgggcagaaatttccgagtccgtagacaaaatagaggttttatacgaagatgaaggtttccggagtcggcagtttgcagccttagtggcatctaaagtattttatcacctgggggcttttgaggagtctctgaattatgctcttggagcaggggacctcttcaatgtcaatgataactctgaatatgtggaaactattatagcaaaatgcattgatcactacaccaaacaatgtgtggaaaatgcagatttgcctgaaggagaaaaaaaaccaattgaccagagattggaaggcatcgtaaataaaatgttccagcgatgtctagatgatcacaagtataaacaggctattggcattgctctggagacacgaagactggacgtctttgaaaagaccatactggagtcgaatgatgtcccaggaatgttagcttatagccttaagctctgcatgtctttaatgcagaataaacagtttcggaataaagtactaagagttctagttaaaatctacatgaacttggagaaacctgatttcatcaatgtttgtcagtgcttaattttcttagatgatcctcaggctgtgagtgatatcttagagaaactggtaaaggaagacaacctcctgatggcatatcagatttgttttgatttgtatgaaagtgctagccagcagtttttgtcatctgtaatccagaatcttcgaactgttggcacccctattgcttctgtgcctggatccactaatacgggtactgttccgggatcagagaaagacagtgactcgatggaaacagaagaaaagacaagcagtgcatttgtaggaaagacaccagaagccagtccagagcctaaggaccagactttgaaaatgattaaaattttaagtggtgaaatggctattgagttacatctgcagttcttaatacgaaacaataatacagacctcatgattctaaaaaacacaaaggatgcagtacggaattctgtatgtcatactgcaaccgttatagcaaactcttttatgcactgtgggacaaccagtgaccagtttcttagagataatttggaatggttagccagagccactaactgggcaaaatttactgctacagccagtttgggtgtaattcataagggtcatgaaaaagaagcattacagttaatggcaacataccttcccaaggatacttctccaggatcagcctatcaggaaggtggaggtctctatgcactaggtcttattcatgccaatcatggtggtgatataattgactatctgcttaatcagcttaagaacgccagcaatgatatcgttagacacggtggcagtctgggccttggtttggcagccatgggaactgcacgtcaagatgtttatgatttgctaaaaacaaacctttatcaggatgatgcagtaacaggggaagcagctggcctggccctaggtttggttatgttgggctctaaaaatgctcaggctattgaggacatggttggttatgcacaagaaactcaacatgagaagattctgcgtggtcttgcagttggcatagctttagtaatgtatgggaggatggaagaggctgatgctctcattgaatctctctgtcgtgacaaggacccaattcttcgaaggtctggaatgtatactgtagccatggcttattgtggctctggtaacaacaaagcaattcgacgcctgctacatgttgctgtaagtgatgttaatgatgatgtcaggagggcagcagtagaatcacttgggttcattctattcagaacccctgaacagtgcccaagtgttgtctctttgttgtcagagagttacaaccctcatgtgcgctacggagctgcaatggccttggggatatgctgtgctggtacaggaaacaaggaagccattaatttgctagaaccaatgacaaacgaccccgtgaactacgtgaggcaaggggcactcatagcttcagctctcatcatgatccagcagactgaaatcacttgtccaaaggtgaatcagttcagacagctgtattccaaagtcatcaatgataagcatgatgatgtcatggccaagtttggcgctattctggcccagggcatactggatgcaggtggtcataatgtcacaatctccttgcagtccaggactgggcatactcatatgccttctgtggttggcgtccttgtatttacccagttttggttctggtttcctctttcacacttcctgtcattggcttatacccctacctgtgtcattggccttaacaaggacttaaagatgccgaaagttcagtataaatcgaactgtaaaccatccacatttgcatatcctgcccctctggaagtaccaaaagaaaaagaaaaggaaaaggtttctactgctgtattatctataactgccaaggctaaaaagaaggaaaaagaaaaggaaaaaaaggaggaggagaaaatggaagtggatgaggcagagaaaaaggaggaaaaagagaagaaaaaagaacctgagccaaacttccagttattggataacccagcccgagttatgcctgcccagcttaaggtcctaaccatgccggagacctgtagataccagcctttcaaaccactctctattggaggcatcatcattctgaaggataccagtgaagacattgaggagctggtggaacctgtggcagcacatggcccaaaaatcgaggaggaggaacaagagccagaacccccagaaccatttgagtatattgatgattaagggccagaggatctcacttgcttatctgaagaagattgtccaggctcatattgggaatgcttatgaggaaattcatgccgagacctgctattcaatgcatgtatcgttgcctctgcactgacctgaagaaccctgtctccaagtctttgtatcagagatccncatggtccgagcc

SEQ ID NO: 365906 - DNA, 3651 bp, Homo sapiens
ggcgcggaggggcagcggagggggcgcgacccagaggggcagggcgcggcaggcagttgcaacatccgggagcgcagcggacagggcgagtgaggggcgcagccatgactcaccgtcggccgcgtggaacttatattcgtcttctggatgaacgatgaaccacagctcaaggaatttgcactacacaaattgaatgcagttgttaatgacttctgggcagaaatttccgagtccgtagacaaaatagaggttttatacgaagatgaaggtttccggagtcggcagtttgcagccttagtggcatctaaagtattttatcacctgggggcttttgaggagtctctgaattatgctcttggagcaggggacctcttcaatgtcaatgataactctgaatatgtggaaactattatagcaaaatgcattgatcactacaccaaacaatgtgtggaaaatgcagatttgcctgaaggagaaaaaaaaccaattgaccagagattggaaggcatcgtaaataaaatgttccagcgatgtctagatgatcacaagtataaacaggctattggcattgctctggagacacgaagactggacgtctttgaaaagaccatactggagtcgaatgatgtcccaggaatgttagcttatagccttaagctctgcatgtctttaatgcagaataaacagtttcggaataaagtactaagagttctagttaaaatctacatgaacttggagaaacctgatttcatcaatgtttgtcagtgcttaattttcttagatgatcctcaggctgtgagtgatatcttagagaaactggtaaaggaagacaacctcctgatggcatatcagatttgttttgatttgtatgaaagtgctagccagcagtttttgtcatctgtaatccagaatcttcgaactgttggcacccctattgcttctgtgcctggatccactaatacgggtactgttccgggatcagagaaagacagtgactcgatggaaacagaagaaaagacaagcagtgcatttgtaggaaagacaccagaagccagtccagagcctaaggaccagactttgaaaatgattaaaattttaagtggtgaaatggctattgagttacatctgcagttcttaatacgaaacaataatacagacctcatgattctaaaaaacacaaaggatgcagtacggaattctgtatgtcatactgcaaccgttatagcaaactcttttatgcactgtgggacaaccagtgaccagtttcttagagataatttggaatggttagccagagccactaactgggcaaaatttactgctacagccagtttgggtgtaattcataagggtcatgaaaaagaagcattacagttaatggcaacataccttcccaaggatacttctccaggatcagcctatcaggaaggtggaggtctctatgcactaggtcttattcatgccaatcatggtggtgatataattgactatctgcttaatcagcttaagaacgccagcaatgatatcgttagacacggtggcagtctgggccttggtttggcagccatgggaactgcacgtcaagatgtttatgatttgctaaaaacaaacctttatcaggatgatgcagtaacaggggaagcagctggcctggccctaggtttggttatgttgggctctaaaaatgctcaggctattgaggacatggttggttatgcacaagaaactcaacatgagaagattctgcgtggtcttgcagttggcatagctttagtaatgtatgggaggatggaagaggctgatgctctcattgaatctctctgtcgtgacaaggacccaattcttcgaaggtctggaatgtatactgtagccatggcttattgtggctctggtaacaacaaagcaattcgacgcctgctacatgttgctgtaagtgatgttaatgatgatgtcaggagggcagcagtagaatcacttgggttcattctattcagaacccctgaacagtgcccaagtgttgtctctttgttgtcagagagttacaaccctcatgtgcgctacggagctgcaatggccttggggatatgctgtgctggtacaggaaacaaggaagccattaatttgctagaaccaatgacaaacgaccccgtgaactacgtgaggcaaggggcactcatagcttcagctctcatcatgatccagcagactgaaatcacttgtccaaaggtgaatcagttcagacagctgtattccaaagtcatcaatgataagcatgatgatgtcatggccaagtttggcgctattctggcccagggcatactggatgcaggtggtcataatgtcacaatctccttgcagtccaggactgggcatactcatatgccttctgtggttggcgtccttgtatttacccagttttggttctggtttcctctttcacacttcctgtcattggcttatacccctacctgtgtcattggccttaacaaggacttaaagatgccgaaagttcagtataaatcgaactgtaaaccatccacatttgcatatcctgcccctctggaagtaccaaaagaaaaagaaaaggaaaaggtttctactgctgtattatctataactgccaaggctaaaaagaaggaaaaagaaaaggaaaaaaaggaggaggagaaaatggaagtggatgaggcagagaaaaaggaggaaaaagagaagaaaaaagaacctgagccaaacttccagttattggataacccagcccgagttatgcctgcccagcttaaggtcctaaccatgccggagacctgtagataccagcctttcaaaccactctctattggaggcatcatcattctgaaggataccagtgaagacattgaggagctggtggaacctgtggcagcacatggcccaaaaatcgaggaggaggaacaagagccagaacccccagaaccatttgagtatattgatgattaagggccagaggatctcacttgcttatctgaagaagattgtccaggctcatattgggaatgcttatgaggaaattcatgccgagacctgctattcaatgcatgtatcgttgcctctgcactgacctgaagaaccctgtctccaagtctttggttgaagagaagatatatgactgttgagtgtgctctttcacagaacttggttttcaaataaatataagatctccagatggacaagacatttgtttttcagcctgggtttttaataaatgtatctaatcctccccacaccatgaaatgcctaaatcccaagagccagagtcttgatttgctaggatgagtatgcacgactttcatattgatgaaaaagtcaaactattcttaaattatagaccatgaaaataatggaagggaaaaaaatcaaaccttgctcatcacccccaagaattctctacagttttgttgtggttgtgggttgttgtttaatatggggtctaatcagccagggcaacatggtgagacccccatctctacaaaaaaattgaaaaattagctgggtaggccaggcagggtggctcacgcctataatcccagcactttggaaggccaaggtgggcagattgcttgagccaaggagtttgagaccagcctgggcaacatggcaaaaactcacctctacaaa

SEQ ID NO: 365907 - DNA, 3583 bp, Homo sapiens
tcctggcgagaagcgagccggcggcctgaggaggcgactgactgagcagcgcacccggggagcaaggaggcgcggtgaactgagcggcccctgagctgacagatacactgcgcagctggaacggcgagcgagccgacgggcgagtgaggggcgcagccatgatcacctcggccgctggaattatttctcttctggatgaagatgaaccacagcttaaggaatttgcactacacaaattgaatgcagttgttaatgacttctgggcagaaatttccgagtccgtagacaaaatagaggttttatacgaagatgaaggtttccggagtcggcagtttgcagccttagtggcatctaaagtattttatcacctgggggcttttgaggagtctctgaattatgctcttggagcaggggacctcttcaatgtcaatgataactctgaatatgtggaaactattatagcaaaatgcattgatcactacaccaaacaatgtgtggaaaatgcagatttgcctgaaggagaaaaaaaaccaattgaccagagattggaaggcatcgtaaataaaatgttccagcgatgtctagatgatcacaagtataaacaggctattggcattgctctggagacacgaagactggacgtctttgaaaagaccatactggagtcgaatgatgtcccaggaatgttagcttatagccttaagctctgcatgtctttaatgcagaataaacagtttcggaataaagtactaagagttctagttaaaatctacatgaacttggagaaacctgatttcatcaatgtttgtcagtgcttaattttcttagatgatcctcaggctgtgagtgatatcttagagaaactggtaaaggaagacaacctcctgatggcatatcagatttgttttgatttgtatgaaagtgctagccagcagtttttgtcatctgtaatccagaatcttcgaactgttggcacccctattgcttctgtgcctggatccactaatacgggtactgttccgggatcagagaaagacagtgactcgatggaaacagaagaaaagacaagcagtgcatttgtaggaaagacaccagaagccagtccagagcctaaggaccagactttgaaaatgattaaaattttaagtggtgaaatggctattgagttacatctgcagttcttaatacgaaacaataatacagacctcatgattctaaaaaacacaaaggatgcagtacggaattctgtatgtcatactgcaaccgttatagcaaactcttttatgcactgtgggacaaccagtgaccagtttcttagagataatttggaatggttagccagagccactaactgggcaaaatttactgctacagccagtttgggtgtaattcataagggtcatgaaaaagaagcattacagttaatggcaacataccttcccaaggatacttctccaggatcagcctatcaggaaggtggaggtctctatgcactaggtcttattcatgccaatcatggtggtgatataattgactatctgcttaatcagcttaagaacgccagcaatgatatcgttagacacggtggcagtctgggccttggtttggcagccatgggaactgcacgtcaagatgtttatgatttgctaaaaacaaacctttatcaggatgatgcagtaacaggggaagcagctggcctggccctaggtttggttatgttgggctctaaaaatgctcaggctattgaggacatggttggttatgcacaagaaactcaacatgagaagattctgcgtggtcttgcagttggcatagctttagtaatgtatgggaggatggaagaggctgatgctctcattgaatctctctgtcgtgacaaggacccaattcttcgaaggtctggaatgtatactgtagccatggcttattgtggctctggtaacaacaaagcaattcgacgcctgctacatgttgctgtaagtgatgttaatgatgatgtcaggagggcagcagtagaatcacttgggttcattctattcaggaagccattaatttgctagaaccaatgacaaacgaccccgtgaactacgtgaggcaaggggcactcatagcttcagctctcatcatgatccagcagactgaaatcacttgtccaaaggtgaatcagttcagacagctgtattccaaagtcatcaatgataagcatgatgatgtcatggccaagtttggcgctattctggcccagggcatactggatgcaggtggtcataatgtcacaatctccttgcagtccaggactgggcatactcatatgccttctgtggttggcgtccttgtatttacccagttttggttctggtttcctctttcacacttcctgtcattggcttatacccctacctgtgtcattggccttaacaaggacttaaagatgccgaaagttcagtataaatcgaactgtaaaccatccacatttgcatatcctgcccctctggaagtaccaaaagaaaaagaaaaggaaaaggtttctactgctgtattatctataactgccaaggctaaaaagaaggaaaaagaaaaggaaaaaaaggaggaggagaaaatggaagtggatgaggcagagaaaaaggaggaaaaagagaagaaaaaagaacctgagccaaacttccagttattggataacccagcccgagttatgcctgcccagcttaaggtcctaaccatgccggagacctgtagataccagcctttcaaaccactctctattggaggcatcatcattctgaaggataccagtgaagacattgaggagctggtggaacctgtggcagcacatggcccaaaaatcgaggaggaggaacaagagccagaacccccagaaccatttgagtatattgatgattaagggccagaggatctcacttgcttatctgaagaagattgtccaggctcatattgggaatgcttatgaggaaattcatgccgagacctgctattcaatgcatgtatcgttgcctctgcactgacctgaagaaccctgtctccaagtctttggttgaagagaagatatatgactgttgagtgtgctctttcacagaacttggttttcaaataaatataagatctccagatggacaagacatttgtttttcagcctgggtttttaataaatgtatctaatcctccccacaccatgaaatgcctaaatcccaagagccagagtcttgatttgctaggatgagtatgcacgactttcatattgatgaaaaagtcaaactattcttaaattatagaccatgaaaataatggaagggaaaaaaatcaaaccttgctcatcacccccaagaattctctacagttttgttgtggttgtgggttgttgtttaatatggggtctaatcagccagggcaacatggtgagacccccatctctacaaaaaaattgaaaaattagctgggtaggccaggcagggtggctcacgcctataatcccagcactttggaaggccaaggtgggcagattgcttgagccaaggagtttgagaccagcctgggcaacatggcaaaaactcacctctacaaa

SEQ ID NO: 365908 - DNA, 2973 bp, Homo sapiens
tcctggcgagaagcgagccggcggcctgaggaggcgactgactgagcagcgcacccggggagcaaggaggcgcggtgaactgagcggcccctgagctgacagatacactgcgcagctggaacggcgagcgagccgacgggcgagtgaggggcgcagccatgatcacctcggccgctggaattatttctcttctggatgaagatgaaccacagcttaaggaatttgcactacacaaattgaatgcagttgttaatgacttctgggcagaaatttccgagtccgtagacaaaatagaggttttatacgaagatgaaggtttccggagtcggcagtttgcagccttagtggcatctaaagtattttatcacctgggggcttttgaggagtctctgaattatgctcttggagcaggggacctcttcaatgtcaatgataactctgaatatgtggaaactattatagcaaaatgcattgatcactacaccaaacaatgtgtggaaaatgcagatttgcctgaaggagaaaaaaaaccaattgaccagagattggaaggcatcgtaaataaaatgttccagcgatgtctagatgatcacaagtataaacaggctattggcattgctctggagacacgaagactggacgtctttgaaaagaccatactggagtcgaatgatgtcccaggaatgttagcttatagccttaagctctgcatgtctttaatgcagaataaacagtttcggaataaagtactaagagttctagttaaaatctacatgaacttggagaaacctgatttcatcaatgtttgtcagtgcttaattttcttagatgatcctcaggctgtgagtgatatcttagagaaactggtaaaggaagacaacctcctgatggcatatcagatttgttttgatttgtatgaaagtgctagccagcagtttttgtcatctgtaatccagaatcttcgaactgttggcacccctattgcttctgtgcctggatccactaatacgggtactgttccgggatcagagaaagacagtgactcgatggaaacagaagaaaagacaagcagtgcatttgtaggaaagacaccagaagccagtccagagcctaaggaccagactttgaaaatgattaaaattttaagtggtgaaatggctattgagttacatctgcagttcttaatacgaaacaataatacagacctcatgattctaaaaaacacaaaggatgcagtacggaattctgtatgtcatactgcaaccgttatagcaaactcttttatgcactgtgggacaaccagtgaccagtttcttagagataatttggaatggttagccagagccactaactgggcaaaatttactgctacagccagtttgggtgtaattcataagggtcatgaaaaagaagcattacagttaatggcaacataccttcccaaggatacttctccaggatcagcctatcaggaaggtggaggtctctatgcactaggtcttattcatgccaatcatggtggtgatataattgactatctgcttaatcagcttaagaacgccagcaatgatatcgttagacacggtggcagtctgggccttggtttggcagccatgggaactgcacgtcaagatgtttatgatttgctaaaaacaaacctttatcaggatgatgcagtaacaggggaagcagctggcctggccctaggtttggttatgttgggctctaaaaatgctcaggctattgaggacatggttggttatgcacaagaaactcaacatgagaagattctgcgtggtcttgcagttggcatagctttagtaatgtatgggaggatggaagaggctgatgctctcattgaatctctctgtcgtgacaaggacccaattcttcgaaggtctggaatgtatactgtagccatggcttattgtggctctggtaacaacaaagcaattcgacgcctgctacatgttgctgtaagtgatgttaatgatgatgtcaggagggcagcagtagaatcacttgggttcattctattcagaacccctgaacagtgcccaagtgttgtctctttgttgtcagagagttacaaccctcatgtgcgctacggagctgcaatggccttggggatatgctgtgctggtacaggaaacaaggaagccattaatttgctagaaccaatgacaaacgaccccgtgaactacgtgaggcaaggggcactcatagcttcagctctcatcatgatccagcagactgaaatcacttgtccaaaggtgaatcagttcagacagctgtattccaaagtcatcaatgataagcatgatgatgtcatggccaagtttggcgctattctggcccagggcatactggatgcaggtggtcataatgtcacaatctccttgcagtccaggactgggcatactcatatgccttctgtggttggcgtccttgtatttacccagttttggttctggtttcctctttcacacttcctgtcattggcttatacccctacctgtgtcattggccttaacaaggacttaaagatgccgaaagttcagtataaatcgaactgtaaaccatccacatttgcatatcctgcccctctggaagtaccaaaagaaaaagaaaaggaaaagaggtaggttctttgttccttttagcagcatttgtacttaaatataggagccactgagtattttactttttctttaactatcttttatgttttaaaagtaacacttcttatgctaacatttgacattacacaagaatatgaagtgaaagtcctttttgtctcttggtcatccaagtctcatgtcacaggagtcacaacttctgaatccctctgaaggttttctctgcacatgtcagtactttttataccacgaataaaattattctctacatacttttctgcatcttgttttcacattaactatatttttttttatttttaaaactttcaatgta

SEQ ID NO: 365909 - DNA, 2037 bp, Homo sapiens
cattttactcgttacttgccaggggaagcagctggcctggccctaggtttggttatgttgggctctaaaaatgctcaggctattgaggacatggttggttatgcacaagaaactcaacatgagaagattctgcgtggtcttgcagttggcatagctttagtaatgtatgggaggatggaagaggctgatgctctcattgaatctctctgtcgtgacaaggacccaattcttcgaaggtctggaatgtatactgtagccatggcttattgtggctctggtaacaacaaagcaattcgacgcctgctacatgttgctgtaagtgatgttaatgatgatgtcaggagggcagcagtagaatcacttgggttcattctattcagaacccctgaacagtgcccaagtgttgtctctttgttgtcagagagttacaaccctcatgtgcgctacggagctgcaatggccttggggatatgctgtgctggtacaggaaacaaggaagccattaatttgctagaaccaatgacaaacgaccccgtgaactacgtgaggcaaggggcactcatagcttcagctctcatcatgatccagcagactgaaatcacttgtccaaaggtgaatcagttcagacagctgtattccaaagtcatcaatgataagcatgatgatgtcatggccaagtttggcgctattctggcccagggcatactggatgcaggtggtcataatgtcacaatctccttgcagtccaggactgggcatactcatatgccttctgtggttggcgtccttgtatttacccagttttggttctggtttcctctttcacacttcctgtcattggcttatacccctacctgtgtcattggccttaacaaggacttaaagatgccgaaagttcagtataaatcgaactgtaaaccatccacatttgcatatcctgcccctctggaagtaccaaaagaaaaagaaaaggaaaaggtttctactgctgtattatctataactgccaaggctaaaaagaaggaaaaagaaaaggaaaaaaaggaggaggagaaaatggaagtggatgaggcagagaaaaaggaggaaaaagagaagaaaaaagaacctgagccaaacttccagttattggataacccagcccgagttatgcctgcccagcttaaggtcctaaccatgccggagacctgtagataccagcctttcaaaccactctctattggaggcatcatcattctgaaggataccagtgaagacattgaggagctggtggaacctgtggcagcacatggcccaaaaatcgaggaggaggaacaagagccagaacccccagaaccatttgagtatattgatgattaagggccagaggatctcacttgcttatctgaagaagattgtccaggctcatattgggaatgcttatgaggaaattcatgccgagacctgctattcaatgcatgtatcgttgcctctgcactgacctgaagaaccctgtctccaagtctttggttgaagagaagatatatgactgttgagtgtgctctttcacagaacttggttttcaaataaatataagatctccagatggacaagacatttgtttttcagcctgggtttttaataaatgtatctaatcctccccacaccatgaaatgcctaaatcccaagagccagagtcttgatttgctaggatgagtatgcacgactttcatattgatgaaaaagtcaaactattcttaaattatagaccatgaaaataatggaagggaaaaaaatcaaaccttgctcatcacccccaagaattctctacagttttgttgtggttgtgggttgttgtttaatatggggtctaatcagccagggcaacatggtgagacccccatctctacaaaaaaattgaaaaattagctgggtaggccaggcagggtggctcacgcctataatcccagcactttggaaggccaaggtgggcagattgcttgagccaaggagtttgagaccagcctgggcaacatggcaaaaactcacctctacaaa

SEQ ID NO: 365910 - DNA, 1982 bp, Homo sapiens
gtttgacatggcttggtattgcccaacatactccccatcaaacgattctcgcgtggttctatagcagtatggcatcctctagattctgtctggaagcatacaagctgctgattcgtctctttgttttatctctttcttgactgggaacccccctttgcgggaaggacccaattcttcgaaggtctggaatgtatactgtagccatggcttattgtggctctggtaacaacaaagcaattcgacgcctgctacatgttgctgtaagtgatgttaatgatgatgtcaggagggcagcagtagaatcacttgggttcattctattcagaacccctgaacagtgcccaagtgttgtctctttgttgtcagagagttacaaccctcatgtgcgctacggagctgcaatggccttggggatatgctgtgctggtacaggaaacaaggaagccattaatttgctagaaccaatgacaaacgaccccgtgaactacgtgaggcaaggggcactcatagcttcagctctcatcatgatccagcagactgaaatcacttgtccaaaggtgaatcagttcagacagctgtattccaaagtcatcaatgataagcatgatgatgtcatggccaagtttggcgctattctggcccagggcatactggatgcaggtggtcataatgtcacaatctccttgcagtccaggactgggcatactcatatgccttctgtggttggcgtccttgtatttacccagttttggttctggtttcctctttcacacttcctgtcattggcttatacccctacctgtgtcattggccttaacaaggacttaaagatgccgaaagttcagtataaatcgaactgtaaaccatccacatttgcatatcctgcccctctggaagtaccaaaagaaaaagaaaaggaaaaggtttctactgctgtattatctataactgccaaggctaaaaagaaggaaaaagaaaaggaaaaaaaggaggaggagaaaatggaagtggatgaggcagagaaaaaggaggaaaaagagaagaaaaaagaacctgagccaaacttccagttattggataacccagcccgagttatgcctgcccagcttaaggtcctaaccatgccggagacctgtagataccagcctttcaaaccactctctattggaggcatcatcattctgaaggataccagtgaagacattgaggagctggtggaacctgtggcagcacatggcccaaaaatcgaggaggaggaacaagagccagaacccccagaaccatttgagtatattgatgattaagggccagaggatctcacttgcttatctgaagaagattgtccaggctcatattgggaatgcttatgaggaaattcatgccgagacctgctattcaatgcatgtatcgttgcctctgcactgacctgaagaaccctgtctccaagtctttggttgaagagaagatatatgactgttgagtgtgctctttcacagaacttggttttcaaataaatataagatctccagatggacaagacatttgtttttcagcctgggtttttaataaatgtatctaatcctccccacaccatgaaatgcctaaatcccaagagccagagtcttgatttgctaggatgagtatgcacgactttcatattgatgaaaaagtcaaactattcttaaattatagaccatgaaaataatggaagggaaaaaaatcaaaccttgctcatcacccccaagaattctctacagttttgttgtggttgtgggttgttgtttaatatggggtctaatcagccagggcaacatggtgagacccccatctctacaaaaaaattgaaaaattagctgggtaggccaggcagggtggctcacgcctataatcccagcactttggaaggccaaggtgggcagattgcttgagccaaggagtttgagaccagcctgggcaacatggcaaaaactcacctctacaaa

SEQ ID NO: 365911 - DNA, 2417 bp, Homo sapiens
tcctggcgagaagcgagccggcggcctgaggaggcgactgactgagcagcgcacccggggagcaaggaggcgcggtgaactgagcggcccctgagctgacagatacactgcgcagctggaacggcgagcgagccgacgggcgagtgaggggcgcagccatgatcacctcggccgctggaattatttctcttctggatgaagatgaaccacagcttaaggaatttgcactacacaaattgaatgcagttgttaatgacttctgggcagaaatttccgagtccgtagacaaaatagaggttttatacgaagatgaaggtttccggagtcggcagtttgcagccttagtggcatctaaagtattttatcacctgggggcttttgaggagtctctgaattatgctcttggagcaggggacctcttcaatgtcaatgataactctgaatatgtggaaactattatagcaaaatgcattgatcactacaccaaacaatgtgtggaaaatgcagatttgcctgaaggagaaaaaaaaccaattgaccagagattggaaggcatcgtaaataaaatgttccagcgatgtctagatgatcacaagtataaacaggctattggcattgctctggagacacgaagactggacgtctttgaaaagaccatactggagtcgaatgatgtcccaggaatgttagcttatagccttaagctctgcatgtctttaatgcagaataaacagtttcggaataaagtactaagagttctagttaaaatctacatgaacttggagaaacctgatttcatcaatgtttgtcagtgcttaattttcttagatgatcctcaggctgtgagtgatatcttagagaaactggtaaaggaagacaacctcctgatggcatatcagatttgttttgatttgtatgaaagtgctagccagcagtttttgtcatctgtaatccagaatcttcgaactgttggcacccctattgcttctgtgcctggatccactaatacgggtactgttccgggatcagagaaagacagtgactcgatggaaacagaagaaaagacaagcagtgcatttgtaggaaagacaccagaagccagtccagagcctaaggaccagactttgaaaatgattaaaattttaagtggtgaaatggctattgagttacatctgcagttcttaatacgaaacaataatacagacctcatgattctaaaaaacacaaaggatgcagtacggaattctgtatgtcatactgcaaccgttatagcaaactcttttatgcactgtgggacaaccagtgaccagtttcttagagataatttggaatggttagccagagccactaactgggcaaaatttactgctacagccagtttgggtgtaattcataagggtcatgaaaaagaagcattacagttaatggcaacataccttcccaaggatacttctccaggatcagcctatcaggaaggtggaggtctctatgcactaggtcttattcatgccaatcatggtggtgatataattgactatctgcttaatcagcttaagaacgccagcaatgatatcgttagacacggtggcagtctgggccttggtttggcagccatgggaactgcacgtcaagatgtttatgatttgctaaaaacaaacctttatcaggatgatgcagtaacaggggaagcagctggcctggccctaggtttggttatgttgggctctaaaaatgctcaggctattgaggacatggttggttatgcacaagaaactcaacatgagaagattctgcgtggtcttgcagttggcatagctttagtaatgtatgggaggatggaagaggctgatgctctcattgaatctctctgtcgtgacaaggacccaattcttcgaaggtctggaatgtatactgtagccatggcttattgtggctctggtaacaacaaagcaattcgacgcctgctacatgttgctgtaagtgatgttaatgatgatgtcaggagggcagcagtagaatcacttgggttcattctattcagaacccctgaacagtgcccaagtgttgtctctttgttgtcagagagttacaaccctcatgtgcgctacggagctgcaatggccttggggatatgctgtgctggtacaggaaacaaggaagccattaatttgctagaaccaatgacaaacgaccccgtgaactacgtgaggcaaggggcactcatagcttcagctctcatcatgatccagcagactgaaatcacttgtccaaaggtgaatcagttcagacagctgtattccaaagtcatcaatgataagcatgatgatgtcatggccaagtttggcgctattctggcccagggcatactggatgcagtcctggactgcaaggagattgtgacattatgaccgtcgagc

SEQ ID NO: 365912 - DNA, 2551 bp, Homo sapiens
tcctggcgagaagcgagccggcggcctgaggaggcgactgactgagcagcgcacccggggagcaaggaggcgcggtgaactgagcggcccctgagctgacagatacactgcgcagctggaacggcgagcgagccgacgggcgagtgaggggcgcagccatgatcacctcggccgctggaattatttctcttctggatgaagatgaaccacagcttaaggaatttgcactacacaaattgaatgcagttgttaatgacttctgggcagaaatttccgagtccgtagacaaaatagaggttttatacgaagatgaaggtttccggagtcggcagtttgcagccttagtggcatctaaagtattttatcacctgggggcttttgaggagtctctgaattatgctcttggagcaggggacctcttcaatgtcaatgataactctgaatatgtggaaactattatagcaaaatgcattgatcactacaccaaacaatgtgtggaaaatgcagatttgcctgaaggagaaaaaaaaccaattgaccagagattggaaggcatcgtaaataaaatgttccagcgatgtctagatgatcacaagtataaacaggctattggcattgctctggagacacgaagactggacgtctttgaaaagaccatactggagtcgaatgatgtcccaggaatgttagcttatagccttaagctctgcatgtctttaatgcagaataaacagtttcggaataaagtactaagagttctagttaaaatctacatgaacttggagaaacctgatttcatcaatgtttgtcagtgcttaattttcttagatgatcctcaggctgtgagtgatatcttagagaaactggtaaaggaagacaacctcctgatggcatatcagatttgttttgatttgtatgaaagtgctagccagcagtttttgtcatctgtaatccagaatcttcgaactgttggcacccctattgcttctgtgcctggatccactaatacgggtactgttccgggatcagagaaagacagtgactcgatggaaacagaagaaaagacaagcagtgcatttgtaggaaagacaccagaagccagtccagagcctaaggaccagactttgaaaatgattaaaattttaagtggtgaaatggctattgagttacatctgcagttcttaatacgaaacaataatacagacctcatgattctaaaaaacacaaaggatgcagtacggaattctgtatgtcatactgcaaccgttatagcaaactcttttatgcactgtgggacaaccagtgaccagtttcttagagataatttggaatggttagccagagccactaactgggcaaaatttactgctacagccagtttgggtgtaattcataagggtcatgaaaaagaagcattacagttaatggcaacataccttcccaaggatacttctccaggatcagcctatcaggaaggtggaggtctctatgcactaggtcttattcatgccaatcatggtggtgatataattgactatctgcttaatcagcttaagaacgccagcaatgatatcgttagacacggtggcagtctgggccttggtttggcagccatgggaactgcacgtcaagatgtttatgatttgctaaaaacaaacctttatcaggatgatgcagtaacaggggaagcagctggcctggccctaggtttggttatgttgggctctaaaaatgctcaggctattgaggacatggttggttatgcacaagaaactcaacatgagaagattctgcgtggtcttgcagttggcatagctttagtaatgtatgggaggatggaagaggctgatgctctcattgaatctctctgtcgtgacaaggacccaattcttcgaaggtctggaatgtatactgtagccatggcttattgtggctctggtaacaacaaagcaattcgacgcctgctacatgttgctgtaagtgatgttaatgatgatgtcaggagggcagcagtagaatcacttgggttcattctattcagaacccctgaacagtgcccaagtgttgtctctttgttgtcagagagttacaaccctcatgtgcgctacggagctgcaatggccttggggatatgctgtgctggtacaggaaacaaggaagccattaatttgctagaaccaatgacaaacgaccccgtgaactacgtgaggcaaggggcactcatagcttcagctctcatcatgatccagcagactgaaatcacttgtccaaaggtgaatcagttcagacagctgtattccaaagtcatcaatgataagcatgatgatgtcatggccaagtttggcgctattctggcccagggcatactggatgcaggatgattatagctcgattttagagcattccaggactgggcatagtcataggcattcagtccggcgcatactgagacacaggagtgagagatcaaggttaagggagaactgtatctgatgatcgcacacacccggtctcatgtcgggtgacggggagatgcacatcagcgacaatc

SEQ ID NO: 365913 - DNA, 2603 bp, Homo sapiens
tcctggcgagaagcgagccggcggcctgaggaggcgactgactgagcagcgcacccggggagcaaggaggcgcggtgaactgagcggcccctgagctgacagatacactgcgcagctggaacggcgagcgagccgacgggcgagtgaggggcgcagccatgatcacctcggccgctggaattatttctcttctggatgaagatgaaccacagcttaaggaatttgcactacacaaattgaatgcagttgttaatgacttctgggcagaaatttccgagtccgtagacaaaatagaggttttatacgaagatgaaggtttccggagtcggcagtttgcagccttagtggcatctaaagtattttatcacctgggggcttttgaggagtctctgaattatgctcttggagcaggggacctcttcaatgtcaatgataactctgaatatgtggaaactattatagcaaaatgcattgatcactacaccaaacaatgtgtggaaaatgcagatttgcctgaaggagaaaaaaaaccaattgaccagagattggaaggcatcgtaaataaaatgttccagcgatgtctagatgatcacaagtataaacaggctattggcattgctctggagacacgaagactggacgtctttgaaaagaccatactggagtcgaatgatgtcccaggaatgttagcttatagccttaagctctgcatgtctttaatgcagaataaacagtttcggaataaagtactaagagttctagttaaaatctacatgaacttggagaaacctgatttcatcaatgtttgtcagtgcttaattttcttagatgatcctcaggctgtgagtgatatcttagagaaactggtaaaggaagacaacctcctgatggcatatcagatttgttttgatttgtatgaaagtgctagccagcagtttttgtcatctgtaatccagaatcttcgaactgttggcacccctattgcttctgtgcctggatccactaatacgggtactgttccgggatcagagaaagacagtgactcgatggaaacagaagaaaagacaagcagtgcatttgtaggaaagacaccagaagccagtccagagcctaaggaccagactttgaaaatgattaaaattttaagtggtgaaatggctattgagttacatctgcagttcttaatacgaaacaataatacagacctcatgattctaaaaaacacaaaggatgcagtacggaattctgtatgtcatactgcaaccgttatagcaaactcttttatgcactgtgggacaaccagtgaccagtttcttagagataatttggaatggttagccagagccactaactgggcaaaatttactgctacagccagtttgggtgtaattcataagggtcatgaaaaagaagcattacagttaatggcaacataccttcccaaggatacttctccaggatcagcctatcaggaaggtggaggtctctatgcactaggtcttattcatgccaatcatggtggtgatataattgactatctgcttaatcagcttaagaacgccagcaatgatatcgttagacacggtggcagtctgggccttggtttggcagccatgggaactgcacgtcaagatgtttatgatttgctaaaaacaaacctttatcaggatgatgcagtaacaggggaagcagctggcctggccctaggtttggttatgttgggctctaaaaatgctcaggctattgaggacatggttggttatgcacaagaaactcaacatgagaagattctgcgtggtcttgcagttggcatagctttagtaatgtatgggaggatggaagaggctgatgctctcattgaatctctctgtcgtgacaaggacccaattcttcgaaggtctggaatgtatactgtagccatggcttattgtggctctggtaacaacaaagcaattcgacgcctgctacatgttgctgtaagtgatgttaatgatgatgtcaggagggcagcagtagaatcacttgggttcattctattcagtgaggagaagcgtatctagtagaatgattgatgaagactgaatggttgaacttcggagcctcattggactctggtacatggcagggttaatcccatttcgaattccatgtttcttgaaaaacttagagttctctgccattggattccggaagtagatcttactggagcgttttctgagagtttttactgactttgtggcccggtaattgcaggtgatatatcggccaaatgcatcccgaaatgtcttattgaagagggtgtagaccaaaggattcactcctgaggaaacatagcctatccacacaaatatctccaggagcatttggagagtagtttggttacaggaatcacataaaactaaagttatatttgtaataaagaagggacaccacataagcaaaaagaggaaaaacacaatccctaggacctttgaggctctctgttcgttggaaatggtctgcactgactttttcccaattgtggatgttcttcgcataagtgtttcatcacctgagttgggcagagccttgtcctttcgagaaccatccagcattgccacctt

SEQ ID NO: 365914 - DNA, 1163 bp, Homo sapiens
actttaaatgatggtgtctaatatctcagttttcagaagtaatctagataaactgttaaaaatgaaagacttaagtacatgtaaatgggatgaatgattaggtaaattttgtgtaatttaaaatcttaaaagtatttttgatgcccattggatatctcagtcatttccaattaagaaagggttatgatagggaggaatatgtttccaaaaattgtggaattattctcatctataaaatgctaatatctgatagtttaggattttttgcttcctaaggtttcactaaaatttaaggttactaagatgatatggtttggctttgcatccccacccaaatctcttcttataactcccataattaccgtgtgttgtggggagggatccagtgggtgagagatgattgaattatgctgttctcatgatagcgaatgggtctcatgagatctgatggttttgaaaatgggagttgccctgcacaagctctccttttgcctgctgccatccgcataagatgtgatttgctcttccttgccttccaccatgattgtgaggccttcccagcatgtggaaatgtaagtccaataaacctctttcttttgtaaatgacccagtcttgggtatttctttatagcagtgtgaaaatggactaacacagatatttggcaggcatccagtagtcttcgataaacacaaccaccatctagtggccagaacagccttatcggaccccactgtctgcaatgaaaagctgttcctttcctcatcctttacagggccaagcacccagcatcctgggacagtggccccgtgtgcccagctttgaggatgagctcatgcctggttgctctgggtggagagagggaagagttgaatcaacatccatatgtataaatctccttttgtgcatttagaatcacgtccttagaataaattgcgatcagtggcattactgaagcaaattgtatcaaaaatgcaaaaaagacccatttttccaaattgttttctaacaaggaagtcatattgtttgctttttgatactgttctttagaaaacgatgcatgagagttttacatttcatatagtgtgttctatttattttatactttgcaatttctgtaatttttaagcactgttcttcccatactagaggctctgctctaact

SEQ ID NO: 365915 - DNA, 1395 bp, Homo sapiens
  misc_feature (9)..(9): n is a, c, g, or t
  misc_feature (1001)..(1001): n is a, c, g, or t
  misc_feature (1395)..(1395): n is a, c, g, or t
gagggcccntgccagaacctgaccatgctggcactctgattttggatttctagtctctagaactgtgaataagtacgtttctattgcgtaagccacccagtctatggtattttattatggcagcctgagctgactaatataggcttctagattggaaggggaaggaagtaaagagagagaattgatagggataaagaagaggcatgaagagacttggggtatctgctactgaagacatcagctctctatgacaaaacagcacagcatgtttggagtaagagaaagctgaagtctcaacaaacaaatagattcttaatgttctataccaccggacaaactgcagcccttttatacatatggagtactttctgggccagtcctgtggcccctttcaaatgtatggtgttgaaacgtagtaagtttatgtctttaaggtctgcccctcccttcttgcattatatcataaactcttctcttttttttttttttggagacggagtcccgctctgtcacgcaggctgccaggctggcgtacagtggcgcaatctcagctcgctgcaacctccacctcctgggttcaagcgattttcttgcctctgcctcctgagtagctgggattactggcacacaccaccatgcacagggagatatgagacatcaatcaatatatgtaagatgtacatcagtttcgtctggaaagatgggacaacatgaagcagggagggggctccctggtgacagttccttgttcaaaatgccaagaacctggatgactcatagtcaagaccctccaccagtaacatatattggcgagccagccaggagaccactacaggaaacactccatttattccacctgacttcccacttggctgcatcctcaaccattgaaatgaatttgaccctgataatctaaggaggaaacatttgatattcttttgcaataatacttggccccagtattgtttggaatctggagtttgctgttgaatgggaaagcnggatgacgttgcatgtatccaggctttggtgctgctgtcctaagaagggtcaggcctggtcagcatatggtgctctcctttggtgctatttggctccagtgtctttggagtctgaggaggtttggcctttaaaaatcaaactgccaccggaactgctttaaaaatgtttggttcacagccttcactggattacctattggagcaaacaaagtgtaaccatgtaaaacctgtgagcttgtattgatatctcatggctagagttccaaggtaaaagctattggatcttcgtttgtgtgtgtgtatacatgtctagatgtgtttatttgtatgtacacttattgttatatgttgtgtcaaccaaatcagcttataaataaaaaagcactcataaatn

SEQ ID NO: 365916 - DNA, 1053 bp, Homo sapiens
  misc_feature (9)..(9): n is a, c, g, or t
gagggcccntgccagaacctgaccatgctggcactctgattttggatttctagtctctagaactgtgaataagtacgtttctattgcgtaagccacccagtctatggtattttattatggcagcctgagctgactaatataggcttctagattggaaggggaaggaagtaaagagagagaattgatagggataaagaagaggcatgaagagacttggggtatctgctactgaagacatcagctctctatgacaaaacagcacagcatgtttggagtaagagaaagctgaagtctcaacaaacaaatagattcttaatgttctataccaccggacaaactgcagcccttttatacatatggagtactttctgggccagtcctgtggcccctttcaaatgtatggtgttgaaacgtagtaagtttatgtctttaaggtctgcccctcccttcttgcattatatcataaactcttctcttttttttttttttggagacggagtcccgctctgtcacgcaggctgccaggctggcgtacagtggcgcaatctcagctcgctgcaacctccacctcctgggttcaagcgattttcttgcctctgcctcctgagtagctgggattactggcacacaccaccatgcacaggtaatttttttatattttttaatagagacagggtgttggccaggctggtcttgaaatcctgacttcagtgatctgcccgtcttggcttcccgaagtgctgtgattacagccatgagccaccgtgcccggccaactcttctcagttctaagtgtcctaacacccttcatctcctgctgactgcaaggcagttctcagggaggagcctggattgtgtccatgtataaagaaagactctgctgctgatgtgcaaaggaatgtggatgtgatagtttccagcctgaaagtccccctcttttcatctccgcagtatagttcttagaaacaacaagccttgcttttacagtgagtccatatctaaaactttatctgaacccaaaatacctgagataggtctcagtcaatttagaga

SEQ ID NO: 365917 - DNA, 757 bp, Homo sapiens
aggggtttctcacgagatctgatggttttataaggggctctttcccctttgtgcaccctctctctttcctgcttccttgtgaagaaggtacttgcttctctttctcctgccaaagcatgaccttataattgtaagtttccggaggcctccccagccatgcggaactgtgagtcaatgaaacctctttcttttataaatgacccagtcttgggtatttctttatagcagtgtgaaaatggactaacacagatatttggcaggcatccagtagtcttcgataaacacaaccaccatctagtggccagaacagccttatcggaccccactgtctgcaatgaaaagctgttcctttcctcatcctttacagggccaagcacccagcatcctgggacagtggccccgtgtgcccagctttgaggatgagctcatgcctggttgctctgggtggagagagggaagagttgaatcaacatccatatgtataaatctccttttgtgcatttagaatcacgtccttagaataaattgcgatcagtggcattactgaagcaaattgtatcaaaaatgcaaaaaagacccatttttccaaattgttttctaacaaggaagtcatattgtttgctttttgatactgttctttagaaaacgatgcatgagagttttacatttcatatagtgtgttctatttattttatactttgcaatttctgtaatttttaagcactgttcttcccatactagaggctctgctctaact

SEQ ID NO: 365918 - DNA, 3686 bp, Homo sapiens
  misc_feature (9)..(9): n is a, c, g, or t
  misc_feature (1155)..(1155): n is a, c, g, or t
gagggcccntgccagaacctgaccatgctggcactctgattttggatttctagtctctagaactgtgaataagtacgtttctattgcgtaagccacccagtctatggtattttattatggcagcctgagctgactaatataggcttctagattggaaggggaaggaagtaaagagagagaattgatagggataaagaagaggcatgaagagacttggggtatctgctactgaagacatcagctctctatgacaaaacagcacagcatgtttggagtaagagaaagctgaagtctcaacaaacaaatagattcttaatgttctataccaccggacaaactgcagcccttttatacatatggagtactttctgggccagtcctgtggcccctttcaaatgtatggtgttgaaacgtagtaagtttatgtctttaaggtctgcccctcccttcttgcattatatcataaactcttctcttttttttttttttggagacggagtcccgctctgtcacgcaggctgccaggctggcgtacagtggcgcaatctcagctcgctgcaacctccacctcctgggttcaagcgattttcttgcctctgcctcctgagtagctgggattactggcacacaccaccatgcacagggagatatgagacatcaatcaatatatgtaagatgtacatcagtttcgtctggaaagatgggacaacatgaagcagggagggggctccctggtgacagggaattttcttgtgggcaaattgtgagggagttccttgttcaaaatgccaagaacctggatgactcatagtcaagaccctccaccagtaacatatattggcgagccagccaggagcttggaaccctcggtggacagtgcctaagcacagaggcaaccacaggtttctaacagggccactctctggtgaaactgaaaggtttctgtgtgaaagtgcctgaccaccactgcccagttcagaccactacaggaaacactccatttattccacctgacttcccacttggctgcatcctcaaccattgaaatgaatttgaccctgataatctaaggaggaaacatttgatattcttttgcaataatacttggccccagtattgtttggaatctggagtttgctgttgaatgggaaagcnggatgacgttgcatgtatccaggctttggtgctgctgtcctaagaagggtcaggcctggtcagcatatggtgctctcctttggtgctatttggctccagtgtctttggagtctgaggaggtttggcctttaaaaatcaaactgccaccggaactgctttaaaaatgtttggttcacagccttcactggattacctattggagcaaacaaagtgtaaccatgtaaaacctgtgagcttgtattgatatctcatggctagagttccaagcgaatgggtctcatgagatctgatggttttgaaaatgggagttgccctgcacaagctctccttttgcctgctgccatccgcataagatgtgatttgctcttccttgccttccaccatgattgtgaggccttcccagcatgtggaaatggtccagcctgcaataactgaagcccccagacctggaacctgaagatcccatcagccactaaacctgtgaacctgtagaagacctgaagtacctgtttaaaaggcagccaaaagataagtaaattcctatcaactttccttggtgtccttcttgtatatttactgtaagctggatataatagtagccatttttatatttttacaatttaattgctttcttccaaatggattgaatcacttcttttaaagtgttttaattaatttttatctatagaacaaaataacaaataagtattttttttttataccataatggtcacccacagcctgtgtatactaagaccatgcatactgataatcagctttattttacaaaagagtttcgctttacccctctggtaattaatggattctgggtatttattaaaaactttaacacaaagactgttaaataccaccagtccagctttggcaaggcactgttggctttgtttatctccatcatcatccaaacagactaccaatcctgatcccagcccaatcttgggcccttgaaaaaataacttaacatcctaactacaagggagaaactcctttcaaattaatgaacctggctgacttatatagccttaaaattatggaaatgacaagggttacaatgtcagaatgagcagtaaaccttccccagtcctatcagagcaaactttctggggttgcatcccctcagaaacccatttggggcccaatctcaatgcacatatcagtgcgcaaagcactaaaattccaggcaacactttgtattgagagaagccaaaattttggtcaggccctgggacatctaaagtcaccaatgtaactacaccatacagattaaaccctcacatgatcatgtaagctatgcagttacccaagctgcatcatttagaaaacctgtacagtttttatggaaaccatccctagtcaaggacactttaaatatatagtctaaataccgttaaggtaggcccactagctgtgttcacattttcccttggccaccttaccagggactttaataacttgggaaagtgaaaacaacaagctaacccacatgttcaccatagaaaacaattttgtcttgaaaaacaaggactctttttcccgtgtgggaccagttcctacttatgttttaccagccaattggactggaacctatacagttgtttatttagcccccgaaattaatatagctcccaacaaccaatccttcattatacttttaactgcaaccaccagacacaaatgagccatccaactgataccactttcggtagagctaggaataacagcaggagtaggaatgagagttagcagccttgcagtttccctatcctattaccaatgcttgtccaaggattttatggaaagcttaggtgacattgcccaaaagtatcatcaccttacaaaatcagatagagtctttggcagtggtggctttgtaaaatagaaggggactggatctcctaaatgctgaagaaggtggcttatgtctttttcctagaggaagaatgctgtttttatgtcaaccaaacaggattagtaagggatgccacccaaaaactagccgattggtaccataagatatgacaacagctgtctgagtcatggggcgcctagtcaaaatgctaatttggggctcacatctccttcctctggccagtccactattaattattatacttgccttggcttttggatcatgtttgttaaatcttttaaccagatttatttcttcttgcctagagaccattttgcaggaatttagccaattcagaggtcttgttctccataatttggaattttccttcggatttgatcaagttggatagagttggtcaaacccaatgggaaaaagatgaaaacaacaagaaacagaaacaaacagcaacaacaacaacaacaaaaacaaagcaggaaaaaactgaaactcatcttccctgctggaaacgagctcaaactccagaaaggagttacctgccttccatcatcatggacgcaggaaaatttgccttccttgttggaagcaagtaaaactccaaaaaaggagttgcacagcaaaataaacttcagatctcaac

SEQ ID NO: 365919 - DNA, 3434 bp, Homo sapiens
  misc_feature (9)..(9): n is a, c, g, or t
  misc_feature (903)..(903): n is a, c, g, or t
gagggcccntgccagaacctgaccatgctggcactctgattttggatttctagtctctagaactgtgaataagtacgtttctattgcgtaagccacccagtctatggtattttattatggcagcctgagctgactaatataggcttctagattggaaggggaaggaagtaaagagagagaattgatagggataaagaagaggcatgaagagacttggggtatctgctactgaagacatcagctctctatgacaaaacagcacagcatgtttggagtaagagaaagctgaagtctcaacaaacaaatagattcttaatgttctataccaccggacaaactgcagcccttttatacatatggagtactttctgggccagtcctgtggcccctttcaaatgtatggtgttgaaacgtagtaagtttatgtctttaaggtctgcccctcccttcttgcattatatcataaactcttctcttttttttttttttggagacggagtcccgctctgtcacgcaggctgccaggctggcgtacagtggcgcaatctcagctcgctgcaacctccacctcctgggttcaagcgattttcttgcctctgcctcctgagtagctgggattactggcacacaccaccatgcacagttccttgttcaaaatgccaagaacctggatgactcatagtcaagaccctccaccagtaacatatattggcgagccagccaggagaccactacaggaaacactccatttattccacctgacttcccacttggctgcatcctcaaccattgaaatgaatttgaccctgataatctaaggaggaaacatttgatattcttttgcaataatacttggccccagtattgtttggaatctggagtttgctgttgaatgggaaagcnggatgacgttgcatgtatccaggctttggtgctgctgtcctaagaagggtcaggcctggtcagcatatggtgctctcctttggtgctatttggctccagtgtctttggagtctgaggaggtttggcctttaaaaatcaaactgccaccggaactgctttaaaaatgtttggttcacagccttcactggattacctattggagcaaacaaagtgtaaccatgtaaaacctgtgagcttgtattgatatctcatggctagagttccaagcgaatgggtctcatgagatctgatggttttgaaaatgggagttgccctgcacaagctctccttttgcctgctgccatccgcataagatgtgatttgctcttccttgccttccaccatgattgtgaggccttcccagcatgtggaaatggtccagcctgcaataactgaagcccccagacctggaacctgaagatcccatcagccactaaacctgtgaacctgtagaagacctgaagtacctgtttaaaaggcagccaaaagataagtaaattcctatcaactttccttggtgtccttcttgtatatttactgtaagctggatataatagtagccatttttatatttttacaatttaattgctttcttccaaatggattgaatcacttcttttaaagtgttttaattaatttttatctatagaacaaaataacaaataagtattttttttttataccataatggtcacccacagcctgtgtatactaagaccatgcatactgataatcagctttattttacaaaagagtttcgctttacccctctggtaattaatggattctgggtatttattaaaaactttaacacaaagactgttaaataccaccagtccagctttggcaaggcactgttggctttgtttatctccatcatcatccaaacagactaccaatcctgatcccagcccaatcttgggcccttgaaaaaataacttaacatcctaactacaagggagaaactcctttcaaattaatgaacctggctgacttatatagccttaaaattatggaaatgacaagggttacaatgtcagaatgagcagtaaaccttccccagtcctatcagagcaaactttctggggttgcatcccctcagaaacccatttggggcccaatctcaatgcacatatcagtgcgcaaagcactaaaattccaggcaacactttgtattgagagaagccaaaattttggtcaggccctgggacatctaaagtcaccaatgtaactacaccatacagattaaaccctcacatgatcatgtaagctatgcagttacccaagctgcatcatttagaaaacctgtacagtttttatggaaaccatccctagtcaaggacactttaaatatatagtctaaataccgttaaggtaggcccactagctgtgttcacattttcccttggccaccttaccagggactttaataacttgggaaagtgaaaacaacaagctaacccacatgttcaccatagaaaacaattttgtcttgaaaaacaaggactctttttcccgtgtgggaccagttcctacttatgttttaccagccaattggactggaacctatacagttgtttatttagcccccgaaattaatatagctcccaacaaccaatccttcattatacttttaactgcaaccaccagacacaaatgagccatccaactgataccactttcggtagagctaggaataacagcaggagtaggaatgagagttagcagccttgcagtttccctatcctattaccaatgcttgtccaaggattttatggaaagcttaggtgacattgcccaaaagtatcatcaccttacaaaatcagatagagtctttggcagtggtggctttgtaaaatagaaggggactggatctcctaaatgctgaagaaggtggcttatgtctttttcctagaggaagaatgctgtttttatgtcaaccaaacaggattagtaagggatgccacccaaaaactagccgattggtaccataagatatgacaacagctgtctgagtcatggggcgcctagtcaaaatgctaatttggggctcacatctccttcctctggccagtccactattaattattatacttgccttggcttttggatcatgtttgttaaatcttttaaccagatttatttcttcttgcctagagaccattttgcaggaatttagccaattcagaggtcttgttctccataatttggaattttccttcggatttgatcaagttggatagagttggtcaaacccaatgggaaaaagatgaaaacaacaagaaacagaaacaaacagcaacaacaacaacaacaaaaacaaagcaggaaaaaactgaaactcatcttccctgctggaaacgagctcaaactccagaaaggagttacctgccttccatcatcatggacgcaggaaaatttgccttccttgttggaagcaagtaaaactccaaaaaaggagttgcacagcaaaataaacttcagatctcaac

SEQ ID NO: 365920 - DNA, 3557 bp, Homo sapiens
  misc_feature (9)..(9): n is a, c, g, or t
  misc_feature (1026)..(1026): n is a, c, g, or t
gagggcccntgccagaacctgaccatgctggcactctgattttggatttctagtctctagaactgtgaataagtacgtttctattgcgtaagccacccagtctatggtattttattatggcagcctgagctgactaatataggcttctagattggaaggggaaggaagtaaagagagagaattgatagggataaagaagaggcatgaagagacttggggtatctgctactgaagacatcagctctctatgacaaaacagcacagcatgtttggagtaagagaaagctgaagtctcaacaaacaaatagattcttaatgttctataccaccggacaaactgcagcccttttatacatatggagtactttctgggccagtcctgtggcccctttcaaatgtatggtgttgaaacgtagtaagtttatgtctttaaggtctgcccctcccttcttgcattatatcataaactcttctcttttttttttttttggagacggagtcccgctctgtcacgcaggctgccaggctggcgtacagtggcgcaatctcagctcgctgcaacctccacctcctgggttcaagcgattttcttgcctctgcctcctgagtagctgggattactggcacacaccaccatgcacagttccttgttcaaaatgccaagaacctggatgactcatagtcaagaccctccaccagtaacatatattggcgagccagccaggagcttggaaccctcggtggacagtgcctaagcacagaggcaaccacaggtttctaacagggccactctctggtgaaactgaaaggtttctgtgtgaaagtgcctgaccaccactgcccagttcagaccactacaggaaacactccatttattccacctgacttcccacttggctgcatcctcaaccattgaaatgaatttgaccctgataatctaaggaggaaacatttgatattcttttgcaataatacttggccccagtattgtttggaatctggagtttgctgttgaatgggaaagcnggatgacgttgcatgtatccaggctttggtgctgctgtcctaagaagggtcaggcctggtcagcatatggtgctctcctttggtgctatttggctccagtgtctttggagtctgaggaggtttggcctttaaaaatcaaactgccaccggaactgctttaaaaatgtttggttcacagccttcactggattacctattggagcaaacaaagtgtaaccatgtaaaacctgtgagcttgtattgatatctcatggctagagttccaagcgaatgggtctcatgagatctgatggttttgaaaatgggagttgccctgcacaagctctccttttgcctgctgccatccgcataagatgtgatttgctcttccttgccttccaccatgattgtgaggccttcccagcatgtggaaatggtccagcctgcaataactgaagcccccagacctggaacctgaagatcccatcagccactaaacctgtgaacctgtagaagacctgaagtacctgtttaaaaggcagccaaaagataagtaaattcctatcaactttccttggtgtccttcttgtatatttactgtaagctggatataatagtagccatttttatatttttacaatttaattgctttcttccaaatggattgaatcacttcttttaaagtgttttaattaatttttatctatagaacaaaataacaaataagtattttttttttataccataatggtcacccacagcctgtgtatactaagaccatgcatactgataatcagctttattttacaaaagagtttcgctttacccctctggtaattaatggattctgggtatttattaaaaactttaacacaaagactgttaaataccaccagtccagctttggcaaggcactgttggctttgtttatctccatcatcatccaaacagactaccaatcctgatcccagcccaatcttgggcccttgaaaaaataacttaacatcctaactacaagggagaaactcctttcaaattaatgaacctggctgacttatatagccttaaaattatggaaatgacaagggttacaatgtcagaatgagcagtaaaccttccccagtcctatcagagcaaactttctggggttgcatcccctcagaaacccatttggggcccaatctcaatgcacatatcagtgcgcaaagcactaaaattccaggcaacactttgtattgagagaagccaaaattttggtcaggccctgggacatctaaagtcaccaatgtaactacaccatacagattaaaccctcacatgatcatgtaagctatgcagttacccaagctgcatcatttagaaaacctgtacagtttttatggaaaccatccctagtcaaggacactttaaatatatagtctaaataccgttaaggtaggcccactagctgtgttcacattttcccttggccaccttaccagggactttaataacttgggaaagtgaaaacaacaagctaacccacatgttcaccatagaaaacaattttgtcttgaaaaacaaggactctttttcccgtgtgggaccagttcctacttatgttttaccagccaattggactggaacctatacagttgtttatttagcccccgaaattaatatagctcccaacaaccaatccttcattatacttttaactgcaaccaccagacacaaatgagccatccaactgataccactttcggtagagctaggaataacagcaggagtaggaatgagagttagcagccttgcagtttccctatcctattaccaatgcttgtccaaggattttatggaaagcttaggtgacattgcccaaaagtatcatcaccttacaaaatcagatagagtctttggcagtggtggctttgtaaaatagaaggggactggatctcctaaatgctgaagaaggtggcttatgtctttttcctagaggaagaatgctgtttttatgtcaaccaaacaggattagtaagggatgccacccaaaaactagccgattggtaccataagatatgacaacagctgtctgagtcatggggcgcctagtcaaaatgctaatttggggctcacatctccttcctctggccagtccactattaattattatacttgccttggcttttggatcatgtttgttaaatcttttaaccagatttatttcttcttgcctagagaccattttgcaggaatttagccaattcagaggtcttgttctccataatttggaattttccttcggatttgatcaagttggatagagttggtcaaacccaatgggaaaaagatgaaaacaacaagaaacagaaacaaacagcaacaacaacaacaacaaaaacaaagcaggaaaaaactgaaactcatcttccctgctggaaacgagctcaaactccagaaaggagttacctgccttccatcatcatggacgcaggaaaatttgccttccttgttggaagcaagtaaaactccaaaaaaggagttgcacagcaaaataaacttcagatctcaac

SEQ ID NO: 365921 - DNA, 3260 bp, Homo sapiens
  misc_feature (729)..(729): n is a, c, g, or t
cattcaccaccgcgtgacgcggcgccgggtcgccgccgcagattcgacacaaaacccggaaggaccccgccgaaggttttctccggttcgggagagagacggagtcccgctctgtcacgcaggctgccaggctggcgtacagtggcgcaatctcagctcgctgcaacctccacctcctgggttcaagcgattttcttgcctctgcctcctgagtagctgggattactggcacacaccaccatgcacagggagatatgagacatcaatcaatatatgtaagatgtacatcagtttcgtctggaaagatgggacaacatgaagcagggagggggctccctggtgacagttccttgttcaaaatgccaagaacctggatgactcatagtcaagaccctccaccagtaacatatattggcgagccagccaggagcttggaaccctcggtggacagtgcctaagcacagaggcaaccacaggtttctaacagggccactctctggtgaaactgaaaggtttctgtgtgaaagtgcctgaccaccactgcccagttcagaccactacaggaaacactccatttattccacctgacttcccacttggctgcatcctcaaccattgaaatgaatttgaccctgataatctaaggaggaaacatttgatattcttttgcaataatacttggccccagtattgtttggaatctggagtttgctgttgaatgggaaagcnggatgacgttgcatgtatccaggctttggtgctgctgtcctaagaagggtcaggcctggtcagcatatggtgctctcctttggtgctatttggctccagtgtctttggagtctgaggaggtttggcctttaaaaatcaaactgccaccggaactgctttaaaaatgtttggttcacagccttcactggattacctattggagcaaacaaagtgtaaccatgtaaaacctgtgagcttgtattgatatctcatggctagagttccaagcgaatgggtctcatgagatctgatggttttgaaaatgggagttgccctgcacaagctctccttttgcctgctgccatccgcataagatgtgatttgctcttccttgccttccaccatgattgtgaggccttcccagcatgtggaaatggtccagcctgcaataactgaagcccccagacctggaacctgaagatcccatcagccactaaacctgtgaacctgtagaagacctgaagtacctgtttaaaaggcagccaaaagataagtaaattcctatcaactttccttggtgtccttcttgtatatttactgtaagctggatataatagtagccatttttatatttttacaatttaattgctttcttccaaatggattgaatcacttcttttaaagtgttttaattaatttttatctatagaacaaaataacaaataagtattttttttttataccataatggtcacccacagcctgtgtatactaagaccatgcatactgataatcagctttattttacaaaagagtttcgctttacccctctggtaattaatggattctgggtatttattaaaaactttaacacaaagactgttaaataccaccagtccagctttggcaaggcactgttggctttgtttatctccatcatcatccaaacagactaccaatcctgatcccagcccaatcttgggcccttgaaaaaataacttaacatcctaactacaagggagaaactcctttcaaattaatgaacctggctgacttatatagccttaaaattatggaaatgacaagggttacaatgtcagaatgagcagtaaaccttccccagtcctatcagagcaaactttctggggttgcatcccctcagaaacccatttggggcccaatctcaatgcacatatcagtgcgcaaagcactaaaattccaggcaacactttgtattgagagaagccaaaattttggtcaggccctgggacatctaaagtcaccaatgtaactacaccatacagattaaaccctcacatgatcatgtaagctatgcagttacccaagctgcatcatttagaaaacctgtacagtttttatggaaaccatccctagtcaaggacactttaaatatatagtctaaataccgttaaggtaggcccactagctgtgttcacattttcccttggccaccttaccagggactttaataacttgggaaagtgaaaacaacaagctaacccacatgttcaccatagaaaacaattttgtcttgaaaaacaaggactctttttcccgtgtgggaccagttcctacttatgttttaccagccaattggactggaacctatacagttgtttatttagcccccgaaattaatatagctcccaacaaccaatccttcattatacttttaactgcaaccaccagacacaaatgagccatccaactgataccactttcggtagagctaggaataacagcaggagtaggaatgagagttagcagccttgcagtttccctatcctattaccaatgcttgtccaaggattttatggaaagcttaggtgacattgcccaaaagtatcatcaccttacaaaatcagatagagtctttggcagtggtggctttgtaaaatagaaggggactggatctcctaaatgctgaagaaggtggcttatgtctttttcctagaggaagaatgctgtttttatgtcaaccaaacaggattagtaagggatgccacccaaaaactagccgattggtaccataagatatgacaacagctgtctgagtcatggggcgcctagtcaaaatgctaatttggggctcacatctccttcctctggccagtccactattaattattatacttgccttggcttttggatcatgtttgttaaatcttttaaccagatttatttcttcttgcctagagaccattttgcaggaatttagccaattcagaggtcttgttctccataatttggaattttccttcggatttgatcaagttggatagagttggtcaaacccaatgggaaaaagatgaaaacaacaagaaacagaaacaaacagcaacaacaacaacaacaaaaacaaagcaggaaaaaactgaaactcatcttccctgctggaaacgagctcaaactccagaaaggagttacctgccttccatcatcatggacgcaggaaaatttgccttccttgttggaagcaagtaaaactccaaaaaaggagttgcacagcaaaataaacttcagatctcaac

SEQ ID NO: 365922 - DNA, 3212 bp, Homo sapiens
  misc_feature (9)..(9): n is a, c, g, or t
gagggcccntgccagaacctgaccatgctggcactctgattttggatttctagtctctagaactgtgaataagtacgtttctattgcgtaagccacccagtctatggtattttattatggcagcctgagctgactaatataggcttctagattggaaggggaaggaagtaaagagagagaattgatagggataaagaagaggcatgaagagacttggggtatctgctactgaagacatcagctctctatgacaaaacagcacagcatgtttggagtaagagaaagctgaagtctcaacaaacaaatagattcttaatgttctataccaccggacaaactgcagcccttttatacatatggagtactttctgggccagtcctgtggcccctttcaaatgtatggtgttgaaacgtagtaagtttatgtctttaaggtctgcccctcccttcttgcattatatcataaactcttctcttttttttttttttggagacggagtcccgctctgtcacgcaggctgccaggctggcgtacagtggcgcaatctcagctcgctgcaacctccacctcctgggttcaagcgattttcttgcctctgcctcctgagtagctgggattactggcacacaccaccatgcacagggagatatgagacatcaatcaatatatgtaagatgtacatcagtttcgtctggaaagatgggacaacatgaagcagggagggggctccctggtgacagttccttgttcaaaatgccaagaacctggatgactcatagtcaagaccctccaccagtaacatatattggcgagccagccaggagcttggaaccctcggtggacagtgcctaagcacagaggcaaccacaggtttctaacagggccactctctggtgaaactgaaaggtttctgtgtgaaagtgcctgaccaccactgcccagttcagcgaatgggtctcatgagatctgatggttttgaaaatgggagttgccctgcacaagctctccttttgcctgctgccatccgcataagatgtgatttgctcttccttgccttccaccatgattgtgaggccttcccagcatgtggaaatggtccagcctgcaataactgaagcccccagacctggaacctgaagatcccatcagccactaaacctgtgaacctgtagaagacctgaagtacctgtttaaaaggcagccaaaagataagtaaattcctatcaactttccttggtgtccttcttgtatatttactgtaagctggatataatagtagccatttttatatttttacaatttaattgctttcttccaaatggattgaatcacttcttttaaagtgttttaattaatttttatctatagaacaaaataacaaataagtattttttttttataccataatggtcacccacagcctgtgtatactaagaccatgcatactgataatcagctttattttacaaaagagtttcgctttacccctctggtaattaatggattctgggtatttattaaaaactttaacacaaagactgttaaataccaccagtccagctttggcaaggcactgttggctttgtttatctccatcatcatccaaacagactaccaatcctgatcccagcccaatcttgggcccttgaaaaaataacttaacatcctaactacaagggagaaactcctttcaaattaatgaacctggctgacttatatagccttaaaattatggaaatgacaagggttacaatgtcagaatgagcagtaaaccttccccagtcctatcagagcaaactttctggggttgcatcccctcagaaacccatttggggcccaatctcaatgcacatatcagtgcgcaaagcactaaaattccaggcaacactttgtattgagagaagccaaaattttggtcaggccctgggacatctaaagtcaccaatgtaactacaccatacagattaaaccctcacatgatcatgtaagctatgcagttacccaagctgcatcatttagaaaacctgtacagtttttatggaaaccatccctagtcaaggacactttaaatatatagtctaaataccgttaaggtaggcccactagctgtgttcacattttcccttggccaccttaccagggactttaataacttgggaaagtgaaaacaacaagctaacccacatgttcaccatagaaaacaattttgtcttgaaaaacaaggactctttttcccgtgtgggaccagttcctacttatgttttaccagccaattggactggaacctatacagttgtttatttagcccccgaaattaatatagctcccaacaaccaatccttcattatacttttaactgcaaccaccagacacaaatgagccatccaactgataccactttcggtagagctaggaataacagcaggagtaggaatgagagttagcagccttgcagtttccctatcctattaccaatgcttgtccaaggattttatggaaagcttaggtgacattgcccaaaagtatcatcaccttacaaaatcagatagagtctttggcagtggtggctttgtaaaatagaaggggactggatctcctaaatgctgaagaaggtggcttatgtctttttcctagaggaagaatgctgtttttatgtcaaccaaacaggattagtaagggatgccacccaaaaactagccgattggtaccataagatatgacaacagctgtctgagtcatggggcgcctagtcaaaatgctaatttggggctcacatctccttcctctggccagtccactattaattattatacttgccttggcttttggatcatgtttgttaaatcttttaaccagatttatttcttcttgcctagagaccattttgcaggaatttagccaattcagaggtcttgttctccataatttggaattttccttcggatttgatcaagttggatagagttggtcaaacccaatgggaaaaagatgaaaacaacaagaaacagaaacaaacagcaacaacaacaacaacaaaaacaaagcaggaaaaaactgaaactcatcttccctgctggaaacgagctcaaactccagaaaggagttacctgccttccatcatcatggacgcaggaaaatttgccttccttgttggaagcaagtaaaactccaaaaaaggagttgcacagcaaaataaacttcagatctcaac

SEQ ID NO: 365923 - DNA, 2449 bp, Homo sapiens
cattcaccaccgcgtgacgcggcgccgggtcgccgccgcagattcgacacaaaacccggaaggaccccgccgaaggttttctccggttcgggagagagacggagtcccgctctgtcacgcaggctgccaggctggcgtacagtggcgcaatctcagctcgctgcaacctccacctcctgggttcaagcgattttcttgcctctgcctcctgagtagctgggattactggcacacaccaccatgcacagttccttgttcaaaatgccaagaacctggatgactcatagtcaagaccctccaccagtaacatatattggcgagccagccaggagggtccagcctgcaataactgaagcccccagacctggaacctgaagatcccatcagccactaaacctgtgaacctgtagaagacctgaagtacctgtttaaaaggcagccaaaagataagtaaattcctatcaactttccttggtgtccttcttgtatatttactgtaagctggatataatagtagccatttttatatttttacaatttaattgctttcttccaaatggattgaatcacttcttttaaagtgttttaattaatttttatctatagaacaaaataacaaataagtattttttttttataccataatggtcacccacagcctgtgtatactaagaccatgcatactgataatcagctttattttacaaaagagtttcgctttacccctctggtaattaatggattctgggtatttattaaaaactttaacacaaagactgttaaataccaccagtccagctttggcaaggcactgttggctttgtttatctccatcatcatccaaacagactaccaatcctgatcccagcccaatcttgggcccttgaaaaaataacttaacatcctaactacaagggagaaactcctttcaaattaatgaacctggctgacttatatagccttaaaattatggaaatgacaagggttacaatgtcagaatgagcagtaaaccttccccagtcctatcagagcaaactttctggggttgcatcccctcagaaacccatttggggcccaatctcaatgcacatatcagtgcgcaaagcactaaaattccaggcaacactttgtattgagagaagccaaaattttggtcaggccctgggacatctaaagtcaccaatgtaactacaccatacagattaaaccctcacatgatcatgtaagctatgcagttacccaagctgcatcatttagaaaacctgtacagtttttatggaaaccatccctagtcaaggacactttaaatatatagtctaaataccgttaaggtaggcccactagctgtgttcacattttcccttggccaccttaccagggactttaataacttgggaaagtgaaaacaacaagctaacccacatgttcaccatagaaaacaattttgtcttgaaaaacaaggactctttttcccgtgtgggaccagttcctacttatgttttaccagccaattggactggaacctatacagttgtttatttagcccccgaaattaatatagctcccaacaaccaatccttcattatacttttaactgcaaccaccagacacaaatgagccatccaactgataccactttcggtagagctaggaataacagcaggagtaggaatgagagttagcagccttgcagtttccctatcctattaccaatgcttgtccaaggattttatggaaagcttaggtgacattgcccaaaagtatcatcaccttacaaaatcagatagagtctttggcagtggtggctttgtaaaatagaaggggactggatctcctaaatgctgaagaaggtggcttatgtctttttcctagaggaagaatgctgtttttatgtcaaccaaacaggattagtaagggatgccacccaaaaactagccgattggtaccataagatatgacaacagctgtctgagtcatggggcgcctagtcaaaatgctaatttggggctcacatctccttcctctggccagtccactattaattattatacttgccttggcttttggatcatgtttgttaaatcttttaaccagatttatttcttcttgcctagagaccattttgcaggaatttagccaattcagaggtcttgttctccataatttggaattttccttcggatttgatcaagttggatagagttggtcaaacccaatgggaaaaagatgaaaacaacaagaaacagaaacaaacagcaacaacaacaacaacaaaaacaaagcaggaaaaaactgaaactcatcttccctgctggaaacgagctcaaactccagaaaggagttacctgccttccatcatcatggacgcaggaaaatttgccttccttgttggaagcaagtaaaactccaaaaaaggagttgcacagcaaaataaacttcagatctcaac

SEQ ID NO: 365924 - DNA, 2689 bp, Homo sapiens
actttaaatgatggtgtctaatatctcagttttcagaagtaatctagataaactgttaaaaatgaaagacttaagtacatgtaaatgggatgaatgattaggtaaattttgtgtaatttaaaatcttaaaagtatttttgatgcccattggatatctcagtcatttccaattaagaaagggttatgatagggaggaatatgtttccaaaaattgtggaattattctcatctataaaatgctaatatctgatagtttaggattttttgcttcctaaggtttcactaaaatttaaggttactaagatgatatggtttggctttgcatccccacccaaatctcttcttataactcccataattaccgtgtgttgtggggagggatccagtgggtgagagatgattgaattatgctgttctcatgatagcgaatgggtctcatgagatctgatggttttgaaaatgggagttgccctgcacaagctctccttttgcctgctgccatccgcataagatgtgatttgctcttccttgccttccaccatgattgtgaggccttcccagcatgtggaaatggtccagcctgcaataactgaagcccccagacctggaacctgaagatcccatcagccactaaacctgtgaacctgtagaagacctgaagtacctgtttaaaaggcagccaaaagataagtaaattcctatcaactttccttggtgtccttcttgtatatttactgtaagctggatataatagtagccatttttatatttttacaatttaattgctttcttccaaatggattgaatcacttcttttaaagtgttttaattaatttttatctatagaacaaaataacaaataagtattttttttttataccataatggtcacccacagcctgtgtatactaagaccatgcatactgataatcagctttattttacaaaagagtttcgctttacccctctggtaattaatggattctgggtatttattaaaaactttaacacaaagactgttaaataccaccagtccagctttggcaaggcactgttggctttgtttatctccatcatcatccaaacagactaccaatcctgatcccagcccaatcttgggcccttgaaaaaataacttaacatcctaactacaagggagaaactcctttcaaattaatgaacctggctgacttatatagccttaaaattatggaaatgacaagggttacaatgtcagaatgagcagtaaaccttccccagtcctatcagagcaaactttctggggttgcatcccctcagaaacccatttggggcccaatctcaatgcacatatcagtgcgcaaagcactaaaattccaggcaacactttgtattgagagaagccaaaattttggtcaggccctgggacatctaaagtcaccaatgtaactacaccatacagattaaaccctcacatgatcatgtaagctatgcagttacccaagctgcatcatttagaaaacctgtacagtttttatggaaaccatccctagtcaaggacactttaaatatatagtctaaataccgttaaggtaggcccactagctgtgttcacattttcccttggccaccttaccagggactttaataacttgggaaagtgaaaacaacaagctaacccacatgttcaccatagaaaacaattttgtcttgaaaaacaaggactctttttcccgtgtgggaccagttcctacttatgttttaccagccaattggactggaacctatacagttgtttatttagcccccgaaattaatatagctcccaacaaccaatccttcattatacttttaactgcaaccaccagacacaaatgagccatccaactgataccactttcggtagagctaggaataacagcaggagtaggaatgagagttagcagccttgcagtttccctatcctattaccaatgcttgtccaaggattttatggaaagcttaggtgacattgcccaaaagtatcatcaccttacaaaatcagatagagtctttggcagtggtggctttgtaaaatagaaggggactggatctcctaaatgctgaagaaggtggcttatgtctttttcctagaggaagaatgctgtttttatgtcaaccaaacaggattagtaagggatgccacccaaaaactagccgattggtaccataagatatgacaacagctgtctgagtcatggggcgcctagtcaaaatgctaatttggggctcacatctccttcctctggccagtccactattaattattatacttgccttggcttttggatcatgtttgttaaatcttttaaccagatttatttcttcttgcctagagaccattttgcaggaatttagccaattcagaggtcttgttctccataatttggaattttccttcggatttgatcaagttggatagagttggtcaaacccaatgggaaaaagatgaaaacaacaagaaacagaaacaaacagcaacaacaacaacaacaaaaacaaagcaggaaaaaactgaaactcatcttccctgctggaaacgagctcaaactccagaaaggagttacctgccttccatcatcatggacgcaggaaaatttgccttccttgttggaagcaagtaaaactccaaaaaaggagttgcacagcaaaataaacttcagatctcaac

SEQ ID NO: 365925 - DNA, 5243 bp, Homo sapiens
  misc_feature (9)..(9): n is a, c, g, or t
  misc_feature (1155)..(1155): n is a, c, g, or t
gagggcccntgccagaacctgaccatgctggcactctgattttggatttctagtctctagaactgtgaataagtacgtttctattgcgtaagccacccagtctatggtattttattatggcagcctgagctgactaatataggcttctagattggaaggggaaggaagtaaagagagagaattgatagggataaagaagaggcatgaagagacttggggtatctgctactgaagacatcagctctctatgacaaaacagcacagcatgtttggagtaagagaaagctgaagtctcaacaaacaaatagattcttaatgttctataccaccggacaaactgcagcccttttatacatatggagtactttctgggccagtcctgtggcccctttcaaatgtatggtgttgaaacgtagtaagtttatgtctttaaggtctgcccctcccttcttgcattatatcataaactcttctcttttttttttttttggagacggagtcccgctctgtcacgcaggctgccaggctggcgtacagtggcgcaatctcagctcgctgcaacctccacctcctgggttcaagcgattttcttgcctctgcctcctgagtagctgggattactggcacacaccaccatgcacagggagatatgagacatcaatcaatatatgtaagatgtacatcagtttcgtctggaaagatgggacaacatgaagcagggagggggctccctggtgacagggaattttcttgtgggcaaattgtgagggagttccttgttcaaaatgccaagaacctggatgactcatagtcaagaccctccaccagtaacatatattggcgagccagccaggagcttggaaccctcggtggacagtgcctaagcacagaggcaaccacaggtttctaacagggccactctctggtgaaactgaaaggtttctgtgtgaaagtgcctgaccaccactgcccagttcagaccactacaggaaacactccatttattccacctgacttcccacttggctgcatcctcaaccattgaaatgaatttgaccctgataatctaaggaggaaacatttgatattcttttgcaataatacttggccccagtattgtttggaatctggagtttgctgttgaatgggaaagcnggatgacgttgcatgtatccaggctttggtgctgctgtcctaagaagggtcaggcctggtcagcatatggtgctctcctttggtgctatttggctccagtgtctttggagtctgaggaggtttggcctttaaaaatcaaactgccaccggaactgctttaaaaatgtttggttcacagccttcactggattacctattggagcaaacaaagtgtaaccatgtaaaacctgtgagcttgtattgatatctcatggctagagttccaagcgaatgggtctcatgagatctgatggttttgaaaatgggagttgccctgcacaagctctccttttgcctgctgccatccgcataagatgtgatttgctcttccttgccttccaccatgattgtgaggccttcccagcatgtggaaatggtccagcctgcaataactgaagcccccagacctggaacctgaagatcccatcagccactaaacctgtgaacctgtagaagacctgaagtacctgtttaaaaggcagccaaaagataagtaaattcctatcaactttccttggtgtccttcttgtatatttactgtaagctggatataatagtagccatttttatatttttacaatttaattgctttcttccaaatggattgaatcacttcttttaaagtgttttaattaatttttatctatagaacaaaataacaaataagtattttttttttataccataatggtcacccacagcctgtgtatactaagaccatgcatactgataatcagctttattttacaaaagagtttcgctttacccctctggtaattaatggattctgggtatttattaaaaactttaacacaaagactgttaaataccaccagtccagctttggcaaggcactgttggctttgtttatctccatcatcatccaaacagactaccaatcctgatcccagcccaatcttgggcccttgaaaaaataacttaacatcctaactacaagggagaaactcctttcaaattaatgaacctggctgacttatatagccttaaaattatggaaatgacaagggttacaatgtcagaatgagcagtaaaccttccccagtcctatcagagcaaactttctggggttgcatcccctcagaaacccatttggggcccaatctcaatgcacatatcagtgcgcaaagcactaaaattccaggcaacactttgtattgagagaagccaaaattttggtcaggccctgggacatctaaagtcaccaatgtaactacaccatacagattaaaccctcacatgatcatgtaagctatgcagttacccaagctgcatcatttagaaaacctgtacagtttttatggaaaccatccctagtcaaggacactttaaatatatagtctaaataccgttaaggtaggcccactagctgtgttcacattttcccttggccaccttaccagggactttaataacttgggaaagtgaaaacaacaagctaacccacatgttcaccatagaaaacaattttgtcttgaaaaacaaggactctttttcccgtgtgggaccagttcctacttatgttttaccagccaattggactggaacctatacagttgtttatttagcccccgaaattaatatagctcccaacaaccaatccttcattatacttttaactgcaaccaccagacacaaatgagccatccaactgataccactttcggtagagctaggaataacagcaggagtaggaatgagagttagcagccttgcagtttccctatcctattaccaatgcttgtccaaggattttatggaaagcttaggtgacattgcccaaaagtatcatcaccttacaaaatcagatagagtctttggcagtggtggctttgtaaaatagaaggggactggatctcctaaatgctgaagaaggtggcttatgtctttttcctagaggaagaatgctgtttttatgtcaaccaaacaggattagtaagggatgccacccaaaaactagccgattggtaccataagatatgacaacagctgtctgagtcatggggcgcctagtcaaaatgctaatttggggctcacatctccttcctctggccagtccactattaattattatacttgccttggcttttggatcatgtttgttaaatcttttaaccagatttatttcttcttgcctagagaccattatgataatgcagcagggccaccagtcagtttcagataatgatgtcaaccccggccaccaagaagtaaccttgtctccactagacagagcaggttgcaggaatttagccaattcagaggtcttgttctccataatttggaattttccttcggatttgatcaagttggatagagttggtcaaacccaatgggaaaaagatgaaaacaacaagaaacagaaacaaacagcaacaacaacaacaacaaaaacaatgcatttaattaaatgaagatgagctcatgctggagtagggtggactctgaacccagtgggacaagcgtccttattaagaagagggaaatctggacacacacagagcagagaccgccgtgtgaagatggaggcagagatcggagagatgctgccacacgccacaaatgcctggggctcccagaaactacacggagcctcccccagcggcttcagcaggagcatggctcggccaacactttgatcttggtcttccagcctccagaacgttttcctaaaattcccttttccactggtgtgtggtgcaagatgaggcacattttccatggatggtgaacagagggaggagccttttgatcacaaccaggtcaccccacttctaagccactgtgcctccagccccacaagactaaggagagagagcgcagcgtggtggagagtgagctgtgctgggaccattgtttccgtaacctcgttttctgtgtccagctgacacaccttcaaagtggcatcaggtcctaaactgtagcttgcaatgtgcctgtttccagaaaccaaggtgaaagtgcttttagacagtgttcccatgcaagagtcccttcccagcttttttctggaaatgcatgtttctctgaactctgagtcccaagaaaaatcacttgagacaccaagaaaatgggggaagtgctaaaattgtgtgggaattcaagcttaacaataaacatcaagacatttttgataaaaatgaatccactgacatcggggaggagcaagagaacagcacgctgacactgggtcagaggctaagaccgacatttctgggaaccactcccggaagggcacagaggagacgctttcagcctctcatcagccagcctggcctgtagctgctgcacgttatgagtgtgttcctggcatgactgcttctaacagcgaccatttcattaagtttttaagtgcctggtaattgcttggttatgaccggtgtctgctccatggcagcctcttcctgtttttgcccgaatgatgaaggaggaagtttacatcttgctccctggggacaggcagagacagtgtgtgcacttccatcctacagggaccagatctgaacagtctggagagaggagctgtggtggcagcagacagatctctgcttcaggggccaggtgtctagaagaaatgctgaggcagtgtcacgctggtgtctgtcctccttacagaatgcctgaacagttccattgactcaaagtgaagatcaaaagaaccaaatgacagcaatagccaagtgtaatcatcagtaaccctgtgttctatccacaggtaaaaaacaatcatcctcttcattatgggtttcaattttaaatgtaatacatttttagaaatgcctatttccttttataatctctttatataatctaggttattctggctcttaggtcttcatttagctactgaaaagatttgatctcaaatcaatgatctaaccacccatgaccatctcccacctctctccccgtacaccccccagcatgaattctgggaactcaggtaaaatgctttctggaaacctgcctgtattagtctgttgtcaagctgctaataaacacatacccgaaactgggtagtttataaagga

SEQ ID NO: 365926 - DNA, 5081 bp, Homo sapiens
  misc_feature (9)..(9): n is a, c, g, or t
  misc_feature (1155)..(1155): n is a, c, g, or t
gagggcccntgccagaacctgaccatgctggcactctgattttggatttctagtctctagaactgtgaataagtacgtttctattgcgtaagccacccagtctatggtattttattatggcagcctgagctgactaatataggcttctagattggaaggggaaggaagtaaagagagagaattgatagggataaagaagaggcatgaagagacttggggtatctgctactgaagacatcagctctctatgacaaaacagcacagcatgtttggagtaagagaaagctgaagtctcaacaaacaaatagattcttaatgttctataccaccggacaaactgcagcccttttatacatatggagtactttctgggccagtcctgtggcccctttcaaatgtatggtgttgaaacgtagtaagtttatgtctttaaggtctgcccctcccttcttgcattatatcataaactcttctcttttttttttttttggagacggagtcccgctctgtcacgcaggctgccaggctggcgtacagtggcgcaatctcagctcgctgcaacctccacctcctgggttcaagcgattttcttgcctctgcctcctgagtagctgggattactggcacacaccaccatgcacagggagatatgagacatcaatcaatatatgtaagatgtacatcagtttcgtctggaaagatgggacaacatgaagcagggagggggctccctggtgacagggaattttcttgtgggcaaattgtgagggagttccttgttcaaaatgccaagaacctggatgactcatagtcaagaccctccaccagtaacatatattggcgagccagccaggagcttggaaccctcggtggacagtgcctaagcacagaggcaaccacaggtttctaacagggccactctctggtgaaactgaaaggtttctgtgtgaaagtgcctgaccaccactgcccagttcagaccactacaggaaacactccatttattccacctgacttcccacttggctgcatcctcaaccattgaaatgaatttgaccctgataatctaaggaggaaacatttgatattcttttgcaataatacttggccccagtattgtttggaatctggagtttgctgttgaatgggaaagcnggatgacgttgcatgtatccaggctttggtgctgctgtcctaagaagggtcaggcctggtcagcatatggtgctctcctttggtgctatttggctccagtgtctttggagtctgaggaggtttggcctttaaaaatcaaactgccaccggaactgctttaaaaatgtttggttcacagccttcactggattacctattggagcaaacaaagtgtaaccatgtaaaacctgtgagcttgtattgatatctcatggctagagttccaagcgaatgggtctcatgagatctgatggttttgaaaatgggagttgccctgcacaagctctccttttgcctgctgccatccgcataagatgtgatttgctcttccttgccttccaccatgattgtgaggccttcccagcatgtggaaatggtccagcctgcaataactgaagcccccagacctggaacctgaagatcccatcagccactaaacctgtgaacctgtagaagacctgaagtacctgtttaaaaggcagccaaaagataagtaaattcctatcaactttccttggtgtccttcttgtatatttactgtaagctggatataatagtagccatttttatatttttacaatttaattgctttcttccaaatggattgaatcacttcttttaaagtgttttaattaatttttatctatagaacaaaataacaaataagtattttttttttataccataatggtcacccacagcctgtgtatactaagaccatgcatactgataatcagctttattttacaaaagagtttcgctttacccctctggtaattaatggattctgggtatttattaaaaactttaacacaaagactgttaaataccaccagtccagctttggcaaggcactgttggctttgtttatctccatcatcatccaaacagactaccaatcctgatcccagcccaatcttgggcccttgaaaaaataacttaacatcctaactacaagggagaaactcctttcaaattaatgaacctggctgacttatatagccttaaaattatggaaatgacaagggttacaatgtcagaatgagcagtaaaccttccccagtcctatcagagcaaactttctggggttgcatcccctcagaaacccatttggggcccaatctcaatgcacatatcagtgcgcaaagcactaaaattccaggcaacactttgtattgagagaagccaaaattttggtcaggccctgggacatctaaagtcaccaatgtaactacaccatacagattaaaccctcacatgatcatgtaagctatgcagttacccaagctgcatcatttagaaaacctgtacagtttttatggaaaccatccctagtcaaggacactttaaatatatagtctaaataccgttaaggtaggcccactagctgtgttcacattttcccttggccaccttaccagggactttaataacttgggaaagtgaaaacaacaagctaacccacatgttcaccatagaaaacaattttgtcttgaaaaacaaggactctttttcccgtgtgggaccagttcctacttatgttttaccagccaattggactggaacctatacagttgtttatttagcccccgaaattaatatagctcccaacaaccaatccttcattatacttttaactgcaaccaccagacacaaatgagccatccaactgataccactttcggtagagctaggaataacagcaggagtaggaatgagagttagcagccttgcagtttccctatcctattaccaatgcttgtccaaggattttatggaaagcttaggtgacattgcccaaaagtatcatcaccttacaaaatcagatagagtctttggcagtggtggctttgtaaaatagaaggggactggatctcctaaatgctgaagaaggtggcttatgtctttttcctagaggaagaatgctgtttttatgtcaaccaaacaggattagtaagggatgccacccaaaaactagccgattggtaccataagatatgacaacagctgtctgagtcatggggcgcctagtcaaaatgctaatttggggctcacatctccttcctctggccagtccactattaattattatacttgccttggcttttggatcatgtttgttaaatcttttaaccagatttatttcttcttgcctagagaccattatgataatgcagcagggccaccagtcagtttcagataatgatgtcaaccccggccaccaagaagtaaccttgtctccactagacagagcaggttgcaggaatttagccaattcagaggtcttgttctccataatttggaattttccttcggatttgatcaagttggatagagttggtcaaacccaatgggaaaaagatgaaaacaacaagaaacagaaacaaacagcaacaacaacaacaacaaaaacaatgcatttaattaaatgaagatgagctcatgctggagtagggtggactctgaacccagtgggacaagcgtccttattaagaagagggaaatctggacacacacagagcagagaccgccgtgtgaagatggaggcagagatcggagagatgctgccacacgccacaaatgcctggggctcccagaaactacacggagcctcccccagcggcttcagcaggagcatggctcggccaacactttgatcttggtcttccagcctccagaacgttttcctaaaattcccttttccactggtgtgtggtgcaagatgaggcacattttccatggatggtgaacagagggaggagccttttgatcacaaccaggtcaccccacttctaagccactgtgcctccagccccacaagactaaggagagagagcgcagcgtggtggagagtgagctgtgctgggaccattgtttccgtaacctcgttttctgtgtccagctgacacaccttcaaagtggcatcaggtcctaaactgtagcttgcaatgtgcctgtttccagaaaccaaggtgaaagtgcttttagacagtgttcccatgcaagagtcccttcccagcttttttctggaaatgcatgtttctctgaactctgagtcccaagaaaaatcacttgagacaccaagaaaatgggggaagtgctaaaattgtgtgggaattcaagcttaacaataaacatcaagacatttttgataaaaatgaatccactgacatcggggaggagcaagagaacagcacgctgacactgggtcagaggctaagaccgacatttctgggaaccactcccggaagggcacagaggagacgctttcagcctctcatcagccagcctggcctgtagctgctgcacgttatgagtgtgttcctggcatgactgcttctaacagcgaccatttcattaagtttttaagtgcctggtaattgcttggttatgaccggtgtctgctccatggcagcctcttcctgaagaaatgctgaggcagtgtcacgctggtgtctgtcctccttacagaatgcctgaacagttccattgactcaaagtgaagatcaaaagaaccaaatgacagcaatagccaagtgtaatcatcagtaaccctgtgttctatccacaggtaaaaaacaatcatcctcttcattatgggtttcaattttaaatgtaatacatttttagaaatgcctatttccttttataatctctttatataatctaggttattctggctcttaggtcttcatttagctactgaaaagatttgatctcaaatcaatgatctaaccacccatgaccatctcccacctctctccccgtacaccccccagcatgaattctgggaactcaggtaaaatgctttctggaaacctgcctgtattagtctgttgtcaagctgctaataaacacatacccgaaactgggtagtttataaagga

SEQ ID NO: 365927 - DNA, 5225 bp, Homo sapiens
  misc_feature (9)..(9): n is a, c, g, or t
  misc_feature (1155)..(1155): n is a, c, g, or t
gagggcccntgccagaacctgaccatgctggcactctgattttggatttctagtctctagaactgtgaataagtacgtttctattgcgtaagccacccagtctatggtattttattatggcagcctgagctgactaatataggcttctagattggaaggggaaggaagtaaagagagagaattgatagggataaagaagaggcatgaagagacttggggtatctgctactgaagacatcagctctctatgacaaaacagcacagcatgtttggagtaagagaaagctgaagtctcaacaaacaaatagattcttaatgttctataccaccggacaaactgcagcccttttatacatatggagtactttctgggccagtcctgtggcccctttcaaatgtatggtgttgaaacgtagtaagtttatgtctttaaggtctgcccctcccttcttgcattatatcataaactcttctcttttttttttttttggagacggagtcccgctctgtcacgcaggctgccaggctggcgtacagtggcgcaatctcagctcgctgcaacctccacctcctgggttcaagcgattttcttgcctctgcctcctgagtagctgggattactggcacacaccaccatgcacagggagatatgagacatcaatcaatatatgtaagatgtacatcagtttcgtctggaaagatgggacaacatgaagcagggagggggctccctggtgacagggaattttcttgtgggcaaattgtgagggagttccttgttcaaaatgccaagaacctggatgactcatagtcaagaccctccaccagtaacatatattggcgagccagccaggagcttggaaccctcggtggacagtgcctaagcacagaggcaaccacaggtttctaacagggccactctctggtgaaactgaaaggtttctgtgtgaaagtgcctgaccaccactgcccagttcagaccactacaggaaacactccatttattccacctgacttcccacttggctgcatcctcaaccattgaaatgaatttgaccctgataatctaaggaggaaacatttgatattcttttgcaataatacttggccccagtattgtttggaatctggagtttgctgttgaatgggaaagcnggatgacgttgcatgtatccaggctttggtgctgctgtcctaagaagggtcaggcctggtcagcatatggtgctctcctttggtgctatttggctccagtgtctttggagtctgaggaggtttggcctttaaaaatcaaactgccaccggaactgctttaaaaatgtttggttcacagccttcactggattacctattggagcaaacaaagtgtaaccatgtaaaacctgtgagcttgtattgatatctcatggctagagttccaagcgaatgggtctcatgagatctgatggttttgaaaatgggagttgccctgcacaagctctccttttgcctgctgccatccgcataagatgtgatttgctcttccttgccttccaccatgattgtgaggccttcccagcatgtggaaatggtccagcctgcaataactgaagcccccagacctggaacctgaagatcccatcagccactaaacctgtgaacctgtagaagacctgaagtacctgtttaaaaggcagccaaaagataagtaaattcctatcaactttccttggtgtccttcttgtatatttactgtaagctggatataatagtagccatttttatatttttacaatttaattgctttcttccaaatggattgaatcacttcttttaaagtgttttaattaatttttatctatagaacaaaataacaaataagtattttttttttataccataatggtcacccacagcctgtgtatactaagaccatgcatactgataatcagctttattttacaaaagagtttcgctttacccctctggtaattaatggattctgggtatttattaaaaactttaacacaaagactgttaaataccaccagtccagctttggcaaggcactgttggctttgtttatctccatcatcatccaaacagactaccaatcctgatcccagcccaatcttgggcccttgaaaaaataacttaacatcctaactacaagggagaaactcctttcaaattaatgaacctggctgacttatatagccttaaaattatggaaatgacaagggttacaatgtcagaatgagcagtaaaccttccccagtcctatcagagcaaactttctggggttgcatcccctcagaaacccatttggggcccaatctcaatgcacatatcagtgcgcaaagcactaaaattccaggcaacactttgtattgagagaagccaaaattttggtcaggccctgggacatctaaagtcaccaatgtaactacaccatacagattaaaccctcacatgatcatgtaagctatgcagttacccaagctgcatcatttagaaaacctgtacagtttttatggaaaccatccctagtcaaggacactttaaatatatagtctaaataccgttaaggtaggcccactagctgtgttcacattttcccttggccaccttaccagggactttaataacttgggaaagtgaaaacaacaagctaacccacatgttcaccatagaaaacaattttgtcttgaaaaacaaggactctttttcccgtgtgggaccagttcctacttatgttttaccagccaattggactggaacctatacagttgtttatttagcccccgaaattaatatagctcccaacaaccaatccttcattatacttttaactgcaaccaccagacacaaatgagccatccaactgataccactttcggtagagctaggaataacagcaggagtaggaatgagagttagcagccttgcagtttccctatcctattaccaatgcttgtccaaggattttatggaaagcttaggtgacattgcccaaaagtatcatcaccttacaaaatcagatagagtctttggcagtggtggctttgtaaaatagaaggggactggatctcctaaatgctgaagaaggtggcttatgtctttttcctagaggaagaatgctgtttttatgtcaaccaaacaggattagtaagggatgccacccaaaaactagccgattggtaccataagatatgacaacagctgtctgagtcatggggcgcctagtcaaaatgctaatttggggctcacatctccttcctctggccagtccactattaattattatacttgccttggcttttggatcatgtttgttaaatcttttaaccagatttatttcttcttgcctagagaccattatgataatgcagcagggccaccagtcagtttcagataatgatgtcaaccccggccaccaagaagtaaccttgtctccactagacagagcaggttgcaggaatttagccaattcagaggtcttgttctccataatttggaattttccttcggatttgatcaagttggatagagttggtcaaacccaatgggaaaaagatgaaaacaacaagaaacagaaacaaacagcaacaacaacaacaacaaaaacaatgcatttaattaaatgaagatgagctcatgctggagtagggtggactctgaacccagtgggacaagcgtccttattaagaagagggaaatctggacacacacagagcagagaccgccgtgtgaagatggaggcagagatcggagagatgctgccacacgccacaaatgcctggggctcccagaaactacacggagcctcccccagcggcttcagcaggagcatggctcggccaacactttgatcttggtcttccagcctccagaacgttttcctaaaattcccttttccactggtgtgtggtgcaagatgaggcacattttccatggatggtgaacagagggaggagccttttgatcacaaccaggtcaccccacttctaagccactgtgcctccagccccacaagactaaggagagagagcgcagcgtggtggagagtgagctgtgctgggaccattgtttccgtaacctcgttttctgtgtccagctgacacaccttcaaagtggcatcaggtcctaaactgtagcttgcaatgtgcctgtttccagaaaccaaggtgaaagtgcttttagagtcccttcccagcttttttctggaaatgcatgtttctctgaactctgagtcccaagaaaaatcacttgagacaccaagaaaatgggggaagtgctaaaattgtgtgggaattcaagcttaacaataaacatcaagacatttttgataaaaatgaatccactgacatcggggaggagcaagagaacagcacgctgacactgggtcagaggctaagaccgacatttctgggaaccactcccggaagggcacagaggagacgctttcagcctctcatcagccagcctggcctgtagctgctgcacgttatgagtgtgttcctggcatgactgcttctaacagcgaccatttcattaagtttttaagtgcctggtaattgcttggttatgaccggtgtctgctccatggcagcctcttcctgtttttgcccgaatgatgaaggaggaagtttacatcttgctccctggggacaggcagagacagtgtgtgcacttccatcctacagggaccagatctgaacagtctggagagaggagctgtggtggcagcagacagatctctgcttcaggggccaggtgtctagaagaaatgctgaggcagtgtcacgctggtgtctgtcctccttacagaatgcctgaacagttccattgactcaaagtgaagatcaaaagaaccaaatgacagcaatagccaagtgtaatcatcagtaaccctgtgttctatccacaggtaaaaaacaatcatcctcttcattatgggtttcaattttaaatgtaatacatttttagaaatgcctatttccttttataatctctttatataatctaggttattctggctcttaggtcttcatttagctactgaaaagatttgatctcaaatcaatgatctaaccacccatgaccatctcccacctctctccccgtacaccccccagcatgaattctgggaactcaggtaaaatgctttctggaaacctgcctgtattagtctgttgtcaagctgctaataaacacatacccgaaactgggtagtttataaagga

SEQ ID NO: 365928 - DNA, 4597 bp, Homo sapiens
  misc_feature (9)..(9): n is a, c, g, or t
  misc_feature (1155)..(1155): n is a, c, g, or t
gagggcccntgccagaacctgaccatgctggcactctgattttggatttctagtctctagaactgtgaataagtacgtttctattgcgtaagccacccagtctatggtattttattatggcagcctgagctgactaatataggcttctagattggaaggggaaggaagtaaagagagagaattgatagggataaagaagaggcatgaagagacttggggtatctgctactgaagacatcagctctctatgacaaaacagcacagcatgtttggagtaagagaaagctgaagtctcaacaaacaaatagattcttaatgttctataccaccggacaaactgcagcccttttatacatatggagtactttctgggccagtcctgtggcccctttcaaatgtatggtgttgaaacgtagtaagtttatgtctttaaggtctgcccctcccttcttgcattatatcataaactcttctcttttttttttttttggagacggagtcccgctctgtcacgcaggctgccaggctggcgtacagtggcgcaatctcagctcgctgcaacctccacctcctgggttcaagcgattttcttgcctctgcctcctgagtagctgggattactggcacacaccaccatgcacagggagatatgagacatcaatcaatatatgtaagatgtacatcagtttcgtctggaaagatgggacaacatgaagcagggagggggctccctggtgacagggaattttcttgtgggcaaattgtgagggagttccttgttcaaaatgccaagaacctggatgactcatagtcaagaccctccaccagtaacatatattggcgagccagccaggagcttggaaccctcggtggacagtgcctaagcacagaggcaaccacaggtttctaacagggccactctctggtgaaactgaaaggtttctgtgtgaaagtgcctgaccaccactgcccagttcagaccactacaggaaacactccatttattccacctgacttcccacttggctgcatcctcaaccattgaaatgaatttgaccctgataatctaaggaggaaacatttgatattcttttgcaataatacttggccccagtattgtttggaatctggagtttgctgttgaatgggaaagcnggatgacgttgcatgtatccaggctttggtgctgctgtcctaagaagggtcaggcctggtcagcatatggtgctctcctttggtgctatttggctccagtgtctttggagtctgaggaggtttggcctttaaaaatcaaactgccaccggaactgctttaaaaatgtttggttcacagccttcactggattacctattggagcaaacaaagtgtaaccatgtaaaacctgtgagcttgtattgatatctcatggctagagttccaagcgaatgggtctcatgagatctgatggttttgaaaatgggagttgccctgcacaagctctccttttgcctgctgccatccgcataagatgtgatttgctcttccttgccttccaccatgattgtgaggccttcccagcatgtggaaatggtccagcctgcaataactgaagcccccagacctggaacctgaagatcccatcagccactaaacctgtgaacctgtagaagacctgaagtacctgtttaaaaggcagccaaaagataagtaaattcctatcaactttccttggtgtccttcttgtatatttactgtaagctggatataatagtagccatttttatatttttacaatttaattgctttcttccaaatggattgaatcacttcttttaaagtgttttaattaatttttatctatagaacaaaataacaaataagtattttttttttataccataatggtcacccacagcctgtgtatactaagaccatgcatactgataatcagctttattttacaaaagagtttcgctttacccctctggtaattaatggattctgggtatttattaaaaactttaacacaaagactgttaaataccaccagtccagctttggcaaggcactgttggctttgtttatctccatcatcatccaaacagactaccaatcctgatcccagcccaatcttgggcccttgaaaaaataacttaacatcctaactacaagggagaaactcctttcaaattaatgaacctggctgacttatatagccttaaaattatggaaatgacaagggttacaatgtcagaatgagcagtaaaccttccccagtcctatcagagcaaactttctggggttgcatcccctcagaaacccatttggggcccaatctcaatgcacatatcagtgcgcaaagcactaaaattccaggcaacactttgtattgagagaagccaaaattttggtcaggccctgggacatctaaagtcaccaatgtaactacaccatacagattaaaccctcacatgatcatgtaagctatgcagttacccaagctgcatcatttagaaaacctgtacagtttttatggaaaccatccctagtcaaggacactttaaatatatagtctaaataccgttaaggtaggcccactagctgtgttcacattttcccttggccaccttaccagggactttaataacttgggaaagtgaaaacaacaagctaacccacatgttcaccatagaaaacaattttgtcttgaaaaacaaggactctttttcccgtgtgggaccagttcctacttatgttttaccagccaattggactggaacctatacagttgtttatttagcccccgaaattaatatagctcccaacaaccaatccttcattatacttttaactgcaaccaccagacacaaatgagccatccaactgataccactttcggtagagctaggaataacagcaggagtaggaatgagagttagcagccttgcagtttccctatcctattaccaatgcttgtccaaggattttatggaaagcttaggtgacattgcccaaaagtatcatcaccttacaaaatcagatagagtctttggcagtggtggctttgtaaaatagaaggggactggatctcctaaatgctgaagaaggtggcttatgtctttttcctagaggaagaatgctgtttttatgtcaaccaaacaggattagtaagggatgccacccaaaaactagccgattggtaccataagatatgacaacagctgtctgagtcatggggcgcctagtcaaaatgctaatttggggctcacatctccttcctctggccagtccactattaattattatacttgccttggcttttggatcatgtttgttaaatcttttaaccagatttatttcttcttgcctagagaccattatgataatgcagcagggccaccagtcagtttcagataatgatgtcaaccccggccaccaagaagtaaccttgtctccactagacagagcaggttgcaggaatttagccaattcagaggtcttgttctccataatttggaattttccttcggatttgatcaagttggatagagttggtcaaacccaatgggaaaaagatgaaaacaacaagaaacagaaacaaacagcaacaacaacaacaacaaaaacaatgcatttaattaaatgaagatgagctcatgctggagtagggtggactctgaacccagtgggacaagcgtccttattaagaagagggaaatctggacacacacagagcagagaccgccgtgtgaagatggaggcagagatcggagagatgctgccacacgccacaaatgcctggggctcccagaaactacacggagcctcccccagcggcttcagcaggagcatggctcggccaacactttgatcttggtcttccagcctccagaacgttttcctaaaattcccttttccactggtgtgtggtgcaagatgaggcacattttccatggatggtgaacagagggaggagccttttgatcacaaccaggtcaccccacttctaagccactgtgcctccagccccacaagactaaggagagagagcgcagcgtggtggagagtgagctgtgctgggaccattgtttccgtaacctcgttttctgtgtccagctgacacaccttcaaagtggcatcaggtcctaaactgtagcttgcaatgtgcctgtttccagaaaccaaggtgaaagtgcttttagacagtgttcccatgcaagagtcccttcccagcttttttctggaaatgcatgtttctctgaactctgagtcccaagaaaaatcacttgagacaccaagaaaatgggggaagtgctaaaattgtgtgggaattcaagcttaacaataaacatcaagacatttttgataaaaatgaatccactgacatcggggaggagcaagagaacagcacgctgacactgggtcagaggctaagaccgacatttctgggaaccactcccggaagggcacagaggagacgctttcagcctctcatcagccagcctggcctgtagctgctgcacgttatgagtgtgttcctggcatgactgcttctaacaacagtgagttttctggcaaatcaaataaatactaataagtctgtatgcacattatact

SEQ ID NO: 365929 - DNA, 4885 bp, Homo sapiens
  misc_feature (9)..(9): n is a, c, g, or t
  misc_feature (1155)..(1155): n is a, c, g, or t
gagggcccntgccagaacctgaccatgctggcactctgattttggatttctagtctctagaactgtgaataagtacgtttctattgcgtaagccacccagtctatggtattttattatggcagcctgagctgactaatataggcttctagattggaaggggaaggaagtaaagagagagaattgatagggataaagaagaggcatgaagagacttggggtatctgctactgaagacatcagctctctatgacaaaacagcacagcatgtttggagtaagagaaagctgaagtctcaacaaacaaatagattcttaatgttctataccaccggacaaactgcagcccttttatacatatggagtactttctgggccagtcctgtggcccctttcaaatgtatggtgttgaaacgtagtaagtttatgtctttaaggtctgcccctcccttcttgcattatatcataaactcttctcttttttttttttttggagacggagtcccgctctgtcacgcaggctgccaggctggcgtacagtggcgcaatctcagctcgctgcaacctccacctcctgggttcaagcgattttcttgcctctgcctcctgagtagctgggattactggcacacaccaccatgcacagggagatatgagacatcaatcaatatatgtaagatgtacatcagtttcgtctggaaagatgggacaacatgaagcagggagggggctccctggtgacagggaattttcttgtgggcaaattgtgagggagttccttgttcaaaatgccaagaacctggatgactcatagtcaagaccctccaccagtaacatatattggcgagccagccaggagcttggaaccctcggtggacagtgcctaagcacagaggcaaccacaggtttctaacagggccactctctggtgaaactgaaaggtttctgtgtgaaagtgcctgaccaccactgcccagttcagaccactacaggaaacactccatttattccacctgacttcccacttggctgcatcctcaaccattgaaatgaatttgaccctgataatctaaggaggaaacatttgatattcttttgcaataatacttggccccagtattgtttggaatctggagtttgctgttgaatgggaaagcnggatgacgttgcatgtatccaggctttggtgctgctgtcctaagaagggtcaggcctggtcagcatatggtgctctcctttggtgctatttggctccagtgtctttggagtctgaggaggtttggcctttaaaaatcaaactgccaccggaactgctttaaaaatgtttggttcacagccttcactggattacctattggagcaaacaaagtgtaaccatgtaaaacctgtgagcttgtattgatatctcatggctagagttccaagcgaatgggtctcatgagatctgatggttttgaaaatgggagttgccctgcacaagctctccttttgcctgctgccatccgcataagatgtgatttgctcttccttgccttccaccatgattgtgaggccttcccagcatgtggaaatggtccagcctgcaataactgaagcccccagacctggaacctgaagatcccatcagccactaaacctgtgaacctgtagaagacctgaagtacctgtttaaaaggcagccaaaagataagtaaattcctatcaactttccttggtgtccttcttgtatatttactgtaagctggatataatagtagccatttttatatttttacaatttaattgctttcttccaaatggattgaatcacttcttttaaagtgttttaattaatttttatctatagaacaaaataacaaataagtattttttttttataccataatggtcacccacagcctgtgtatactaagaccatgcatactgataatcagctttattttacaaaagagtttcgctttacccctctggtaattaatggattctgggtatttattaaaaactttaacacaaagactgttaaataccaccagtccagctttggcaaggcactgttggctttgtttatctccatcatcatccaaacagactaccaatcctgatcccagcccaatcttgggcccttgaaaaaataacttaacatcctaactacaagggagaaactcctttcaaattaatgaacctggctgacttatatagccttaaaattatggaaatgacaagggttacaatgtcagaatgagcagtaaaccttccccagtcctatcagagcaaactttctggggttgcatcccctcagaaacccatttggggcccaatctcaatgcacatatcagtgcgcaaagcactaaaattccaggcaacactttgtattgagagaagccaaaattttggtcaggccctgggacatctaaagtcaccaatgtaactacaccatacagattaaaccctcacatgatcatgtaagctatgcagttacccaagctgcatcatttagaaaacctgtacagtttttatggaaaccatccctagtcaaggacactttaaatatatagtctaaataccgttaaggtaggcccactagctgtgttcacattttcccttggccaccttaccagggactttaataacttgggaaagtgaaaacaacaagctaacccacatgttcaccatagaaaacaattttgtcttgaaaaacaaggactctttttcccgtgtgggaccagttcctacttatgttttaccagccaattggactggaacctatacagttgtttatttagcccccgaaattaatatagctcccaacaaccaatccttcattatacttttaactgcaaccaccagacacaaatgagccatccaactgataccactttcggtagagctaggaataacagcaggagtaggaatgagagttagcagccttgcagtttccctatcctattaccaatgcttgtccaaggattttatggaaagcttaggtgacattgcccaaaagtatcatcaccttacaaaatcagatagagtctttggcagtggtggctttgtaaaatagaaggggactggatctcctaaatgctgaagaaggtggcttatgtctttttcctagaggaagaatgctgtttttatgtcaaccaaacaggattagtaagggatgccacccaaaaactagccgattggtaccataagatatgacaacagctgtctgagtcatggggcgcctagtcaaaatgctaatttggggctcacatctccttcctctggccagtccactattaattattatacttgccttggcttttggatcatgtttgttaaatcttttaaccagatttatttcttcttgcctagagaccattatgataatgcagcagggccaccagtcagtttcagataatgatgtcaaccccggccaccaagaagtaaccttgtctccactagacagagcaggttgcaggaatttagccaattcagaggtcttgttctccataatttggaattttccttcggatttgatcaagttggatagagttggtcaaacccaatgggaaaaagatgaaaacaacaagaaacagaaacaaacagcaacaacaacaacaacaaaaacaatgcatttaattaaatgaagatgagctcatgctggagtagggtggactctgaacccagtgggacaagcgtccttattaagaagagggaaatctggacacacacagagcagagaccgccgtgtgaagatggaggcagagatcggagagatgctgccacacgccacaaatgcctggggctcccagaaactacacggagcctcccccagcggcttcagcaggagcatggctcggccaacactttgatcttggtcttccagcctccagaacgttttcctaaaattcccttttccactggtgtgtggtgcaagatgaggcacattttccatggatggtgaacagagggaggagccttttgatcacaaccaggtcaccccacttctaagccactgtgcctccagccccacaagactaaggagagagagcgcagcgtggtggagagtgagctgtgctgggaccattgtttccgtaacctcgttttctgtgtccagctgacacaccttcaaagtggcatcaggtcctaaactgtagcttgcaatgtgcctgtttccagaaaccaaggtgaaagtgcttttagacagtgttcccatgcaagagtcccttcccagcttttttctggaaatgcatgtttctctgaactctgagtcccaagaaaaatcacttgagacaccaagaaaatgggggaagtgctaaaattgtgtgggaattcaagcttaacaataaacatcaagacatttttgataaaaatgaatccactgacatcggggaggagcaagagaacagcacgctgacactgggtcagaggctaagaccgacatttctgggaaccactcccggaagggcacagaggagacgctttcagcctctcatcagccagcctggcctgtagctgctgcacgttatgagtgtgttcctggcatgactgcttctaacaaagaaatgctgaggcagtgtcacgctggtgtctgtcctccttacagaatgcctgaacagttccattgactcaaagtgaagatcaaaagaaccaaatgacagcaatagccaagtgtaatcatcagtaaccctgtgttctatccacaggtcttcatttagctactgaaaagatttgatctcaaatcaatgatctaaccacccatgaccatctcccacctctctccccgtacaccccccagcatgaattctgggaactcaggtaaaatgctttctggaaacctgcctgtattagtctgttgtcaagctgctaataaacacatacccgaaactgggtagtttataaagga

SEQ ID NO: 365930 - DNA, 5001 bp, Homo sapiens
  misc_feature (9)..(9): n is a, c, g, or t
  misc_feature (1155)..(1155): n is a, c, g, or t
gagggcccntgccagaacctgaccatgctggcactctgattttggatttctagtctctagaactgtgaataagtacgtttctattgcgtaagccacccagtctatggtattttattatggcagcctgagctgactaatataggcttctagattggaaggggaaggaagtaaagagagagaattgatagggataaagaagaggcatgaagagacttggggtatctgctactgaagacatcagctctctatgacaaaacagcacagcatgtttggagtaagagaaagctgaagtctcaacaaacaaatagattcttaatgttctataccaccggacaaactgcagcccttttatacatatggagtactttctgggccagtcctgtggcccctttcaaatgtatggtgttgaaacgtagtaagtttatgtctttaaggtctgcccctcccttcttgcattatatcataaactcttctcttttttttttttttggagacggagtcccgctctgtcacgcaggctgccaggctggcgtacagtggcgcaatctcagctcgctgcaacctccacctcctgggttcaagcgattttcttgcctctgcctcctgagtagctgggattactggcacacaccaccatgcacagggagatatgagacatcaatcaatatatgtaagatgtacatcagtttcgtctggaaagatgggacaacatgaagcagggagggggctccctggtgacagggaattttcttgtgggcaaattgtgagggagttccttgttcaaaatgccaagaacctggatgactcatagtcaagaccctccaccagtaacatatattggcgagccagccaggagcttggaaccctcggtggacagtgcctaagcacagaggcaaccacaggtttctaacagggccactctctggtgaaactgaaaggtttctgtgtgaaagtgcctgaccaccactgcccagttcagaccactacaggaaacactccatttattccacctgacttcccacttggctgcatcctcaaccattgaaatgaatttgaccctgataatctaaggaggaaacatttgatattcttttgcaataatacttggccccagtattgtttggaatctggagtttgctgttgaatgggaaagcnggatgacgttgcatgtatccaggctttggtgctgctgtcctaagaagggtcaggcctggtcagcatatggtgctctcctttggtgctatttggctccagtgtctttggagtctgaggaggtttggcctttaaaaatcaaactgccaccggaactgctttaaaaatgtttggttcacagccttcactggattacctattggagcaaacaaagtgtaaccatgtaaaacctgtgagcttgtattgatatctcatggctagagttccaagcgaatgggtctcatgagatctgatggttttgaaaatgggagttgccctgcacaagctctccttttgcctgctgccatccgcataagatgtgatttgctcttccttgccttccaccatgattgtgaggccttcccagcatgtggaaatggtccagcctgcaataactgaagcccccagacctggaacctgaagatcccatcagccactaaacctgtgaacctgtagaagacctgaagtacctgtttaaaaggcagccaaaagataagtaaattcctatcaactttccttggtgtccttcttgtatatttactgtaagctggatataatagtagccatttttatatttttacaatttaattgctttcttccaaatggattgaatcacttcttttaaagtgttttaattaatttttatctatagaacaaaataacaaataagtattttttttttataccataatggtcacccacagcctgtgtatactaagaccatgcatactgataatcagctttattttacaaaagagtttcgctttacccctctggtaattaatggattctgggtatttattaaaaactttaacacaaagactgttaaataccaccagtccagctttggcaaggcactgttggctttgtttatctccatcatcatccaaacagactaccaatcctgatcccagcccaatcttgggcccttgaaaaaataacttaacatcctaactacaagggagaaactcctttcaaattaatgaacctggctgacttatatagccttaaaattatggaaatgacaagggttacaatgtcagaatgagcagtaaaccttccccagtcctatcagagcaaactttctggggttgcatcccctcagaaacccatttggggcccaatctcaatgcacatatcagtgcgcaaagcactaaaattccaggcaacactttgtattgagagaagccaaaattttggtcaggccctgggacatctaaagtcaccaatgtaactacaccatacagattaaaccctcacatgatcatgtaagctatgcagttacccaagctgcatcatttagaaaacctgtacagtttttatggaaaccatccctagtcaaggacactttaaatatatagtctaaataccgttaaggtaggcccactagctgtgttcacattttcccttggccaccttaccagggactttaataacttgggaaagtgaaaacaacaagctaacccacatgttcaccatagaaaacaattttgtcttgaaaaacaaggactctttttcccgtgtgggaccagttcctacttatgttttaccagccaattggactggaacctatacagttgtttatttagcccccgaaattaatatagctcccaacaaccaatccttcattatacttttaactgcaaccaccagacacaaatgagccatccaactgataccactttcggtagagctaggaataacagcaggagtaggaatgagagttagcagccttgcagtttccctatcctattaccaatgcttgtccaaggattttatggaaagcttaggtgacattgcccaaaagtatcatcaccttacaaaatcagatagagtctttggcagtggtggctttgtaaaatagaaggggactggatctcctaaatgctgaagaaggtggcttatgtctttttcctagaggaagaatgctgtttttatgtcaaccaaacaggattagtaagggatgccacccaaaaactagccgattggtaccataagatatgacaacagctgtctgagtcatggggcgcctagtcaaaatgctaatttggggctcacatctccttcctctggccagtccactattaattattatacttgccttggcttttggatcatgtttgttaaatcttttaaccagatttatttcttcttgcctagagaccattatgataatgcagcagggccaccagtcagtttcagataatgatgtcaaccccggccaccaagaagtaaccttgtctccactagacagagcaggttgcaggaatttagccaattcagaggtcttgttctccataatttggaattttccttcggatttgatcaagttggatagagttggtcaaacccaatgggaaaaagatgaaaacaacaagaaacagaaacaaacagcaacaacaacaacaacaaaaacaatgcatttaattaaatgaagatgagctcatgctggagtagggtggactctgaacccagtgggacaagcgtccttattaagaagagggaaatctggacacacacagagcagagaccgccgtgtgaagatggaggcagagatcggagagatgctgccacacgccacaaatgcctggggctcccagaaactacacggagcctcccccagcggcttcagcaggagcatggctcggccaacactttgatcttggtcttccagcctccagaacgttttcctaaaattcccttttccactggtgtgtggtgcaagatgaggcacattttccatggatggtgaacagagggaggagccttttgatcacaaccaggtcaccccacttctaagccactgtgcctccagccccacaagactaaggagagagagcgcagcgtggtggagagtgagctgtgctgggaccattgtttccgtaacctcgttttctgtgtccagctgacacaccttcaaagtggcatcaggtcctaaactgtagcttgcaatgtgcctgtttccagaaaccaaggtgaaagtgcttttagacagtgttcccatgcaagagtcccttcccagcttttttctggaaatgcatgtttctctgaactctgagtcccaagaaaaatcacttgagacaccaagaaaatgggggaagtgctaaaattgtgtgggaattcaagcttaacaataaacatcaagacatttttgataaaaatgaatccactgacatcggggaggagcaagagaacagcacgctgacactgggtcagaggctaagaccgacatttctgggaaccactcccggaagggcacagaggagacgctttcagcctctcatcagccagcctggcctgtagctgctgcacgttatgagtgtgttcctggcatgactgcttctaacagcgaccatttcattaagtttttaagtgcctggtaattgcttggttatgaccggtgtctgctccatggcagcctcttcctgggaccagatctgaacagtctggagagaggagctgtggtggcagcagacagatctctgcttcaggggccaggtgtctagaagaaatgctgaggcagtgtcacgctggtgtctgtcctccttacagaatgcctgaacagttccattgactcaaagtgaagatcaaaagaaccaaatgacagcaatagccaagtgtaatcatcagtaaccctgtgttctatccacagttaaaagaatattggcagagaaacagccttggtgttccagcaggagtgaagaggaacaggaaaacgagtggcagtagccctgaaacagccacttctggtggttgccactcacctgaggatgtgagtctgggtgacaagagtgaaactccgtctcaaaa

SEQ ID NO: 365931 - DNA, 4579 bp, Homo sapiens
  misc_feature (9)..(9): n is a, c, g, or t
  misc_feature (1155)..(1155): n is a, c, g, or t
gagggcccntgccagaacctgaccatgctggcactctgattttggatttctagtctctagaactgtgaataagtacgtttctattgcgtaagccacccagtctatggtattttattatggcagcctgagctgactaatataggcttctagattggaaggggaaggaagtaaagagagagaattgatagggataaagaagaggcatgaagagacttggggtatctgctactgaagacatcagctctctatgacaaaacagcacagcatgtttggagtaagagaaagctgaagtctcaacaaacaaatagattcttaatgttctataccaccggacaaactgcagcccttttatacatatggagtactttctgggccagtcctgtggcccctttcaaatgtatggtgttgaaacgtagtaagtttatgtctttaaggtctgcccctcccttcttgcattatatcataaactcttctcttttttttttttttggagacggagtcccgctctgtcacgcaggctgccaggctggcgtacagtggcgcaatctcagctcgctgcaacctccacctcctgggttcaagcgattttcttgcctctgcctcctgagtagctgggattactggcacacaccaccatgcacagggagatatgagacatcaatcaatatatgtaagatgtacatcagtttcgtctggaaagatgggacaacatgaagcagggagggggctccctggtgacagggaattttcttgtgggcaaattgtgagggagttccttgttcaaaatgccaagaacctggatgactcatagtcaagaccctccaccagtaacatatattggcgagccagccaggagcttggaaccctcggtggacagtgcctaagcacagaggcaaccacaggtttctaacagggccactctctggtgaaactgaaaggtttctgtgtgaaagtgcctgaccaccactgcccagttcagaccactacaggaaacactccatttattccacctgacttcccacttggctgcatcctcaaccattgaaatgaatttgaccctgataatctaaggaggaaacatttgatattcttttgcaataatacttggccccagtattgtttggaatctggagtttgctgttgaatgggaaagcnggatgacgttgcatgtatccaggctttggtgctgctgtcctaagaagggtcaggcctggtcagcatatggtgctctcctttggtgctatttggctccagtgtctttggagtctgaggaggtttggcctttaaaaatcaaactgccaccggaactgctttaaaaatgtttggttcacagccttcactggattacctattggagcaaacaaagtgtaaccatgtaaaacctgtgagcttgtattgatatctcatggctagagttccaagcgaatgggtctcatgagatctgatggttttgaaaatgggagttgccctgcacaagctctccttttgcctgctgccatccgcataagatgtgatttgctcttccttgccttccaccatgattgtgaggccttcccagcatgtggaaatggtccagcctgcaataactgaagcccccagacctggaacctgaagatcccatcagccactaaacctgtgaacctgtagaagacctgaagtacctgtttaaaaggcagccaaaagataagtaaattcctatcaactttccttggtgtccttcttgtatatttactgtaagctggatataatagtagccatttttatatttttacaatttaattgctttcttccaaatggattgaatcacttcttttaaagtgttttaattaatttttatctatagaacaaaataacaaataagtattttttttttataccataatggtcacccacagcctgtgtatactaagaccatgcatactgataatcagctttattttacaaaagagtttcgctttacccctctggtaattaatggattctgggtatttattaaaaactttaacacaaagactgttaaataccaccagtccagctttggcaaggcactgttggctttgtttatctccatcatcatccaaacagactaccaatcctgatcccagcccaatcttgggcccttgaaaaaataacttaacatcctaactacaagggagaaactcctttcaaattaatgaacctggctgacttatatagccttaaaattatggaaatgacaagggttacaatgtcagaatgagcagtaaaccttccccagtcctatcagagcaaactttctggggttgcatcccctcagaaacccatttggggcccaatctcaatgcacatatcagtgcgcaaagcactaaaattccaggcaacactttgtattgagagaagccaaaattttggtcaggccctgggacatctaaagtcaccaatgtaactacaccatacagattaaaccctcacatgatcatgtaagctatgcagttacccaagctgcatcatttagaaaacctgtacagtttttatggaaaccatccctagtcaaggacactttaaatatatagtctaaataccgttaaggtaggcccactagctgtgttcacattttcccttggccaccttaccagggactttaataacttgggaaagtgaaaacaacaagctaacccacatgttcaccatagaaaacaattttgtcttgaaaaacaaggactctttttcccgtgtgggaccagttcctacttatgttttaccagccaattggactggaacctatacagttgtttatttagcccccgaaattaatatagctcccaacaaccaatccttcattatacttttaactgcaaccaccagacacaaatgagccatccaactgataccactttcggtagagctaggaataacagcaggagtaggaatgagagttagcagccttgcagtttccctatcctattaccaatgcttgtccaaggattttatggaaagcttaggtgacattgcccaaaagtatcatcaccttacaaaatcagatagagtctttggcagtggtggctttgtaaaatagaaggggactggatctcctaaatgctgaagaaggtggcttatgtctttttcctagaggaagaatgctgtttttatgtcaaccaaacaggattagtaagggatgccacccaaaaactagccgattggtaccataagatatgacaacagctgtctgagtcatggggcgcctagtcaaaatgctaatttggggctcacatctccttcctctggccagtccactattaattattatacttgccttggcttttggatcatgtttgttaaatcttttaaccagatttatttcttcttgcctagagaccattatgataatgcagcagggccaccagtcagtttcagataatgatgtcaaccccggccaccaagaagtaaccttgtctccactagacagagcaggttgcaggaatttagccaattcagaggtcttgttctccataatttggaattttccttcggatttgatcaagttggatagagttggtcaaacccaatgggaaaaagatgaaaacaacaagaaacagaaacaaacagcaacaacaacaacaacaaaaacaatgcatttaattaaatgaagatgagctcatgctggagtagggtggactctgaacccagtgggacaagcgtccttattaagaagagggaaatctggacacacacagagcagagaccgccgtgtgaagatggaggcagagatcggagagatgctgccacacgccacaaatgcctggggctcccagaaactacacggagcctcccccagcggcttcagcaggagcatggctcggccaacactttgatcttggtcttccagcctccagaacgttttcctaaaattcccttttccactggtgtgtggtgcaagatgaggcacattttccatggatggtgaacagagggaggagccttttgatcacaaccaggtcaccccacttctaagccactgtgcctccagccccacaagactaaggagagagagcgcagcgtggtggagagtgagctgtgctgggaccattgtttccgtaacctcgttttctgtgtccagctgacacaccttcaaagtggcatcaggtcctaaactgtagcttgcaatgtgcctgtttccagaaaccaaggtgaaagtgcttttagagtcccttcccagcttttttctggaaatgcatgtttctctgaactctgagtcccaagaaaaatcacttgagacaccaagaaaatgggggaagtgctaaaattgtgtgggaattcaagcttaacaataaacatcaagacatttttgataaaaatgaatccactgacatcggggaggagcaagagaacagcacgctgacactgggtcagaggctaagaccgacatttctgggaaccactcccggaagggcacagaggagacgctttcagcctctcatcagccagcctggcctgtagctgctgcacgttatgagtgtgttcctggcatgactgcttctaacaacagtgagttttctggcaaatcaaataaatactaataagtctgtatgcacattatact

SEQ ID NO: 365932 - DNA, 4895 bp, Homo sapiens
  misc_feature (9)..(9): n is a, c, g, or t
  misc_feature (1155)..(1155): n is a, c, g, or t
gagggcccntgccagaacctgaccatgctggcactctgattttggatttctagtctctagaactgtgaataagtacgtttctattgcgtaagccacccagtctatggtattttattatggcagcctgagctgactaatataggcttctagattggaaggggaaggaagtaaagagagagaattgatagggataaagaagaggcatgaagagacttggggtatctgctactgaagacatcagctctctatgacaaaacagcacagcatgtttggagtaagagaaagctgaagtctcaacaaacaaatagattcttaatgttctataccaccggacaaactgcagcccttttatacatatggagtactttctgggccagtcctgtggcccctttcaaatgtatggtgttgaaacgtagtaagtttatgtctttaaggtctgcccctcccttcttgcattatatcataaactcttctcttttttttttttttggagacggagtcccgctctgtcacgcaggctgccaggctggcgtacagtggcgcaatctcagctcgctgcaacctccacctcctgggttcaagcgattttcttgcctctgcctcctgagtagctgggattactggcacacaccaccatgcacagggagatatgagacatcaatcaatatatgtaagatgtacatcagtttcgtctggaaagatgggacaacatgaagcagggagggggctccctggtgacagggaattttcttgtgggcaaattgtgagggagttccttgttcaaaatgccaagaacctggatgactcatagtcaagaccctccaccagtaacatatattggcgagccagccaggagcttggaaccctcggtggacagtgcctaagcacagaggcaaccacaggtttctaacagggccactctctggtgaaactgaaaggtttctgtgtgaaagtgcctgaccaccactgcccagttcagaccactacaggaaacactccatttattccacctgacttcccacttggctgcatcctcaaccattgaaatgaatttgaccctgataatctaaggaggaaacatttgatattcttttgcaataatacttggccccagtattgtttggaatctggagtttgctgttgaatgggaaagcnggatgacgttgcatgtatccaggctttggtgctgctgtcctaagaagggtcaggcctggtcagcatatggtgctctcctttggtgctatttggctccagtgtctttggagtctgaggaggtttggcctttaaaaatcaaactgccaccggaactgctttaaaaatgtttggttcacagccttcactggattacctattggagcaaacaaagtgtaaccatgtaaaacctgtgagcttgtattgatatctcatggctagagttccaagcgaatgggtctcatgagatctgatggttttgaaaatgggagttgccctgcacaagctctccttttgcctgctgccatccgcataagatgtgatttgctcttccttgccttccaccatgattgtgaggccttcccagcatgtggaaatggtccagcctgcaataactgaagcccccagacctggaacctgaagatcccatcagccactaaacctgtgaacctgtagaagacctgaagtacctgtttaaaaggcagccaaaagataagtaaattcctatcaactttccttggtgtccttcttgtatatttactgtaagctggatataatagtagccatttttatatttttacaatttaattgctttcttccaaatggattgaatcacttcttttaaagtgttttaattaatttttatctatagaacaaaataacaaataagtattttttttttataccataatggtcacccacagcctgtgtatactaagaccatgcatactgataatcagctttattttacaaaagagtttcgctttacccctctggtaattaatggattctgggtatttattaaaaactttaacacaaagactgttaaataccaccagtccagctttggcaaggcactgttggctttgtttatctccatcatcatccaaacagactaccaatcctgatcccagcccaatcttgggcccttgaaaaaataacttaacatcctaactacaagggagaaactcctttcaaattaatgaacctggctgacttatatagccttaaaattatggaaatgacaagggttacaatgtcagaatgagcagtaaaccttccccagtcctatcagagcaaactttctggggttgcatcccctcagaaacccatttggggcccaatctcaatgcacatatcagtgcgcaaagcactaaaattccaggcaacactttgtattgagagaagccaaaattttggtcaggccctgggacatctaaagtcaccaatgtaactacaccatacagattaaaccctcacatgatcatgtaagctatgcagttacccaagctgcatcatttagaaaacctgtacagtttttatggaaaccatccctagtcaaggacactttaaatatatagtctaaataccgttaaggtaggcccactagctgtgttcacattttcccttggccaccttaccagggactttaataacttgggaaagtgaaaacaacaagctaacccacatgttcaccatagaaaacaattttgtcttgaaaaacaaggactctttttcccgtgtgggaccagttcctacttatgttttaccagccaattggactggaacctatacagttgtttatttagcccccgaaattaatatagctcccaacaaccaatccttcattatacttttaactgcaaccaccagacacaaatgagccatccaactgataccactttcggtagagctaggaataacagcaggagtaggaatgagagttagcagccttgcagtttccctatcctattaccaatgcttgtccaaggattttatggaaagcttaggtgacattgcccaaaagtatcatcaccttacaaaatcagatagagtctttggcagtggtggctttgtaaaatagaaggggactggatctcctaaatgctgaagaaggtggcttatgtctttttcctagaggaagaatgctgtttttatgtcaaccaaacaggattagtaagggatgccacccaaaaactagccgattggtaccataagatatgacaacagctgtctgagtcatggggcgcctagtcaaaatgctaatttggggctcacatctccttcctctggccagtccactattaattattatacttgccttggcttttggatcatgtttgttaaatcttttaaccagatttatttcttcttgcctagagaccattatgataatgcagcagggccaccagtcagtttcagataatgatgtcaaccccggccaccaagaagtaaccttgtctccactagacagagcaggttgcaggaatttagccaattcagaggtcttgttctccataatttggaattttccttcggatttgatcaagttggatagagttggtcaaacccaatgggaaaaagatgaaaacaacaagaaacagaaacaaacagcaacaacaacaacaacaaaaacaatgcatttaattaaatgaagatgagctcatgctggagtagggtggactctgaacccagtgggacaagcgtccttattaagaagagggaaatctggacacacacagagcagagaccgccgtgtgaagatggaggcagagatcggagagatgctgccacacgccacaaatgcctggggctcccagaaactacacggagcctcccccagcggcttcagcaggagcatggctcggccaacactttgatcttggtcttccagcctccagaacgttttcctaaaattcccttttccactggtgtgtggtgcaagatgaggcacattttccatggatggtgaacagagggaggagccttttgatcacaaccaggtcaccccacttctaagccactgtgcctccagccccacaagactaaggagagagagcgcagcgtggtggagagtgagctgtgctgggaccattgtttccgtaacctcgttttctgtgtccagctgacacaccttcaaagtggcatcaggtcctaaactgtagcttgcaatgtgcctgtttccagaaaccaaggtgaaagtgcttttagacagtgttcccatgcaagagtcccttcccagcttttttctggaaatgcatgtttctctgaactctgagtcccaagaaaaatcacttgagacaccaagaaaatgggggaagtgctaaaattgtgtgggaattcaagcttaacaataaacatcaagacatttttgataaaaatgaatccactgacatcggggaggagcaagagaacagcacgctgacactgggtcagaggctaagaccgacatttctgggaaccactcccggaagggcacagaggagacgctttcagcctctcatcagccagcctggcctgtagctgctgcacgttatgagtgtgttcctggcatgactgcttctaacaaagaaatgctgaggcagtgtcacgctggtgtctgtcctccttacagaatgcctgaacagttccattgactcaaagtgaagatcaaaagaaccaaatgacagcaatagccaagtgtaatcatcagtaaccctgtgttctatccacagctttaaactccctcctaagtttctgaagatcctcttgggccacttcatggatctgatttaaatctaaagtcctaggggtttcaaggagcacagtttggaatctaccatcccgggacattcattatattagtctgttttcatgctgctgataaagacatacccaagactgggcaatttacaaaagaaagagatttaattggacttacagtc

SEQ ID NO: 365933 - DNA, 4599 bp, Homo sapiens
  misc_feature (9)..(9): n is a, c, g, or t
  misc_feature (1155)..(1155): n is a, c, g, or t
gagggcccntgccagaacctgaccatgctggcactctgattttggatttctagtctctagaactgtgaataagtacgtttctattgcgtaagccacccagtctatggtattttattatggcagcctgagctgactaatataggcttctagattggaaggggaaggaagtaaagagagagaattgatagggataaagaagaggcatgaagagacttggggtatctgctactgaagacatcagctctctatgacaaaacagcacagcatgtttggagtaagagaaagctgaagtctcaacaaacaaatagattcttaatgttctataccaccggacaaactgcagcccttttatacatatggagtactttctgggccagtcctgtggcccctttcaaatgtatggtgttgaaacgtagtaagtttatgtctttaaggtctgcccctcccttcttgcattatatcataaactcttctcttttttttttttttggagacggagtcccgctctgtcacgcaggctgccaggctggcgtacagtggcgcaatctcagctcgctgcaacctccacctcctgggttcaagcgattttcttgcctctgcctcctgagtagctgggattactggcacacaccaccatgcacagggagatatgagacatcaatcaatatatgtaagatgtacatcagtttcgtctggaaagatgggacaacatgaagcagggagggggctccctggtgacagggaattttcttgtgggcaaattgtgagggagttccttgttcaaaatgccaagaacctggatgactcatagtcaagaccctccaccagtaacatatattggcgagccagccaggagcttggaaccctcggtggacagtgcctaagcacagaggcaaccacaggtttctaacagggccactctctggtgaaactgaaaggtttctgtgtgaaagtgcctgaccaccactgcccagttcagaccactacaggaaacactccatttattccacctgacttcccacttggctgcatcctcaaccattgaaatgaatttgaccctgataatctaaggaggaaacatttgatattcttttgcaataatacttggccccagtattgtttggaatctggagtttgctgttgaatgggaaagcnggatgacgttgcatgtatccaggctttggtgctgctgtcctaagaagggtcaggcctggtcagcatatggtgctctcctttggtgctatttggctccagtgtctttggagtctgaggaggtttggcctttaaaaatcaaactgccaccggaactgctttaaaaatgtttggttcacagccttcactggattacctattggagcaaacaaagtgtaaccatgtaaaacctgtgagcttgtattgatatctcatggctagagttccaagcgaatgggtctcatgagatctgatggttttgaaaatgggagttgccctgcacaagctctccttttgcctgctgccatccgcataagatgtgatttgctcttccttgccttccaccatgattgtgaggccttcccagcatgtggaaatggtccagcctgcaataactgaagcccccagacctggaacctgaagatcccatcagccactaaacctgtgaacctgtagaagacctgaagtacctgtttaaaaggcagccaaaagataagtaaattcctatcaactttccttggtgtccttcttgtatatttactgtaagctggatataatagtagccatttttatatttttacaatttaattgctttcttccaaatggattgaatcacttcttttaaagtgttttaattaatttttatctatagaacaaaataacaaataagtattttttttttataccataatggtcacccacagcctgtgtatactaagaccatgcatactgataatcagctttattttacaaaagagtttcgctttacccctctggtaattaatggattctgggtatttattaaaaactttaacacaaagactgttaaataccaccagtccagctttggcaaggcactgttggctttgtttatctccatcatcatccaaacagactaccaatcctgatcccagcccaatcttgggcccttgaaaaaataacttaacatcctaactacaagggagaaactcctttcaaattaatgaacctggctgacttatatagccttaaaattatggaaatgacaagggttacaatgtcagaatgagcagtaaaccttccccagtcctatcagagcaaactttctggggttgcatcccctcagaaacccatttggggcccaatctcaatgcacatatcagtgcgcaaagcactaaaattccaggcaacactttgtattgagagaagccaaaattttggtcaggccctgggacatctaaagtcaccaatgtaactacaccatacagattaaaccctcacatgatcatgtaagctatgcagttacccaagctgcatcatttagaaaacctgtacagtttttatggaaaccatccctagtcaaggacactttaaatatatagtctaaataccgttaaggtaggcccactagctgtgttcacattttcccttggccaccttaccagggactttaataacttgggaaagtgaaaacaacaagctaacccacatgttcaccatagaaaacaattttgtcttgaaaaacaaggactctttttcccgtgtgggaccagttcctacttatgttttaccagccaattggactggaacctatacagttgtttatttagcccccgaaattaatatagctcccaacaaccaatccttcattatacttttaactgcaaccaccagacacaaatgagccatccaactgataccactttcggtagagctaggaataacagcaggagtaggaatgagagttagcagccttgcagtttccctatcctattaccaatgcttgtccaaggattttatggaaagcttaggtgacattgcccaaaagtatcatcaccttacaaaatcagatagagtctttggcagtggtggctttgtaaaatagaaggggactggatctcctaaatgctgaagaaggtggcttatgtctttttcctagaggaagaatgctgtttttatgtcaaccaaacaggattagtaagggatgccacccaaaaactagccgattggtaccataagatatgacaacagctgtctgagtcatggggcgcctagtcaaaatgctaatttggggctcacatctccttcctctggccagtccactattaattattatacttgccttggcttttggatcatgtttgttaaatcttttaaccagatttatttcttcttgcctagagaccattatgataatgcagcagggccaccagtcagtttcagataatgatgtcaaccccggccaccaagaagtaaccttgtctccactagacagagcaggttgcaggaatttagccaattcagaggtcttgttctccataatttggaattttccttcggatttgatcaagttggatagagttggtcaaacccaatgggaaaaagatgaaaacaacaagaaacagaaacaaacagcaacaacaacaacaacaaaaacaatgcatttaattaaatgaagatgagctcatgctggagtagggtggactctgaacccagtgggacaagcgtccttattaagaagagggaaatctggacacacacagagcagagaccgccgtgtgaagatggaggcagagatcggagagatgctgccacacgccacaaatgcctggggctcccagaaactacacggagcctcccccagcggcttcagcaggagcatggctcggccaacactttgatcttggtcttccagcctccagaacgttttcctaaaattcccttttccactggtgtgtggtgcaagatgaggcacattttccatggatggtgaacagagggaggagccttttgatcacaaccaggtcaccccacttctaagccactgtgcctccagccccacaagactaaggagagagagcgcagcgtggtggagagtgagctgtgctgggaccattgtttccgtaacctcgttttctgtgtccagctgacacaccttcaaagtggcatcaggtcctaaactgtagcttgcaatgtgcctgtttccagaaaccaaggtgaaagtgcttttagagtcccttcccagcttttttctggaaatgcatgtttctctgaactctgagtcccaagaaaaatcacttgagacaccaagaaaatgggggaagtgctaaaattgtgtgggaattcaagcttaacaataaacatcaagacatttttgataaaaatgaatccactgacatcggggaggagcaagagaacagcacgctgacactgggtcagaggctaagaccgacatttctgggaaccactcccggaagggcacagaggagacgctttcagcctctcatcagccagcctggcctgtagctgctgcacgttatgagtgtgttcctggcatgactgcttctaacactctgaattttctctcttggtgttttgtttttgtttttgtttttttgacagagtgagattccatctcaaaaaaaaaaa

SEQ ID NO: 365934 - DNA, 2138 bp, Homo sapiens
cattcaccaccgcgtgacgcggcgccgggtcgccgccgcagattcgacacaaaacccggaaggaccccgccgaaggttttctccggttcgggagagagacggagtcccgctctgtcacgcaggctgccaggctggcgtacagtggcgcaatctcagctcgctgcaacctccacctcctgggttcaagcgattttcttgcctctgcctcctgagtagctgggattactggcacacaccaccatgcacagggagatatgagacatcaatcaatatatgtaagatgtacatcagtttcgtctggaaagatgggacaacatgaagcagggagggggctccctggtgacagttgcaggaatttagccaattcagaggtcttgttctccataatttggaattttccttcggatttgatcaagttggatagagttggtcaaacccaatgggaaaaagatgaaaacaacaagaaacagaaacaaacagcaacaacaacaacaacaaaaacaatgcatttaattaaatgaagatgagctcatgctggagtagggtggactctgaacccagtgggacaagcgtccttattaagaagagggaaatctggacacacacagagcagagaccgccgtgtgaagatggaggcagagatcggagagatgctgccacacgccacaaatgcctggggctcccagaaactacacggagcctcccccagcggcttcagcaggagcatggctcggccaacactttgatcttggtcttccagcctccagaacgttttcctaaaattcccttttccactggtgtgtggtgcaagatgaggcacattttccatggatggtgaacagagggaggagccttttgatcacaaccaggtcaccccacttctaagccactgtgcctccagccccacaagactaaggagagagagcgcagcgtggtggagagtgagctgtgctgggaccattgtttccgtaacctcgttttctgtgtccagctgacacaccttcaaagtggcatcaggtcctaaactgtagcttgcaatgtgcctgtttccagaaaccaaggtgaaagtgcttttagacagtgttcccatgcaagagtcccttcccagcttttttctggaaatgcatgtttctctgaactctgagtcccaagaaaaatcacttgagacaccaagaaaatgggggaagtgctaaaattgtgtgggaattcaagcttaacaataaacatcaagacatttttgataaaaatgaatccactgacatcggggaggagcaagagaacagcacgctgacactgggtcagaggctaagaccgacatttctgggaaccactcccggaagggcacagaggagacgctttcagcctctcatcagccagcctggcctgtagctgctgcacgttatgagtgtgttcctggcatgactgcttctaacagcgaccatttcattaagtttttaagtgcctggtaattgcttggttatgaccggtgtctgctccatggcagcctcttcctgtttttgcccgaatgatgaaggaggaagtttacatcttgctccctggggacaggcagagacagtgtgtgcacttccatcctacagggaccagatctgaacagtctggagagaggagctgtggtggcagcagacagatctctgcttcaggggccaggtgtctagaagaaatgctgaggcagtgtcacgctggtgtctgtcctccttacagaatgcctgaacagttccattgactcaaagtgaagatcaaaagaaccaaatgacagcaatagccaagtgtaatcatcagtaaccctgtgttctatccacaggtaaaaaacaatcatcctcttcattatgggtttcaattttaaatgtaatacatttttagaaatgcctatttccttttataatctctttatataatctaggttattctggctcttaggtcttcatttagctactgaaaagatttgatctcaaatcaatgatctaaccacccatgaccatctcccacctctctccccgtacaccccccagcatgaattctgggaactcaggtaaaatgctttctggaaacctgcctgtattagtctgttgtcaagctgctaataaacacatacccgaaactgggtagtttataaagga

SEQ ID NO: 365935 - DNA, 2008 bp, Homo sapiens
gcttgatttaggaaccaaacttaggcagtcatgatgaaaataaggacagaatcttagtttccaaactgcagtgctgggggacaaccattgctctttcagtttggcctggttagcaaaagatggccttgttatgtaaataaagcccctaaggtagtcaaagtcaaaaaaattttttttttccttttgctagctgtttttttcttttttctttttcagttgcaggaatttagccaattcagaggtcttgttctccataatttggaattttccttcggatttgatcaagttggatagagttggtcaaacccaatgggaaaaagatgaaaacaacaagaaacagaaacaaacagcaacaacaacaacaacaaaaacaatgcatttaattaaatgaagatgagctcatgctggagtagggtggactctgaacccagtgggacaagcgtccttattaagaagagggaaatctggacacacacagagcagagaccgccgtgtgaagatggaggcagagatcggagagatgctgccacacgccacaaatgcctggggctcccagaaactacacggagcctcccccagcggcttcagcaggagcatggctcggccaacactttgatcttggtcttccagcctccagaacgttttcctaaaattcccttttccactggtgtgtggtgcaagatgaggcacattttccatggatggtgaacagagggaggagccttttgatcacaaccaggtcaccccacttctaagccactgtgcctccagccccacaagactaaggagagagagcgcagcgtggtggagagtgagctgtgctgggaccattgtttccgtaacctcgttttctgtgtccagctgacacaccttcaaagtggcatcaggtcctaaactgtagcttgcaatgtgcctgtttccagaaaccaaggtgaaagtgcttttagacagtgttcccatgcaagagtcccttcccagcttttttctggaaatgcatgtttctctgaactctgagtcccaagaaaaatcacttgagacaccaagaaaatgggggaagtgctaaaattgtgtgggaattcaagcttaacaataaacatcaagacatttttgataaaaatgaatccactgacatcggggaggagcaagagaacagcacgctgacactgggtcagaggctaagaccgacatttctgggaaccactcccggaagggcacagaggagacgctttcagcctctcatcagccagcctggcctgtagctgctgcacgttatgagtgtgttcctggcatgactgcttctaacagcgaccatttcattaagtttttaagtgcctggtaattgcttggttatgaccggtgtctgctccatggcagcctcttcctgtttttgcccgaatgatgaaggaggaagtttacatcttgctccctggggacaggcagagacagtgtgtgcacttccatcctacagggaccagatctgaacagtctggagagaggagctgtggtggcagcagacagatctctgcttcaggggccaggtgtctagaagaaatgctgaggcagtgtcacgctggtgtctgtcctccttacagaatgcctgaacagttccattgactcaaagtgaagatcaaaagaaccaaatgacagcaatagccaagtgtaatcatcagtaaccctgtgttctatccacaggtaaaaaacaatcatcctcttcattatgggtttcaattttaaatgtaatacatttttagaaatgcctatttccttttataatctctttatataatctaggttattctggctcttaggtcttcatttagctactgaaaagatttgatctcaaatcaatgatctaaccacccatgaccatctcccacctctctccccgtacaccccccagcatgaattctgggaactcaggtaaaatgctttctggaaacctgcctgtattagtctgttgtcaagctgctaataaacacatacccgaaactgggtagtttataaagga

SEQ ID NO: 365936 - DNA, 3917 bp, Homo sapiens
  misc_feature (9)..(9): n is a, c, g, or t
  misc_feature (1155)..(1155): n is a, c, g, or t
gagggcccntgccagaacctgaccatgctggcactctgattttggatttctagtctctagaactgtgaataagtacgtttctattgcgtaagccacccagtctatggtattttattatggcagcctgagctgactaatataggcttctagattggaaggggaaggaagtaaagagagagaattgatagggataaagaagaggcatgaagagacttggggtatctgctactgaagacatcagctctctatgacaaaacagcacagcatgtttggagtaagagaaagctgaagtctcaacaaacaaatagattcttaatgttctataccaccggacaaactgcagcccttttatacatatggagtactttctgggccagtcctgtggcccctttcaaatgtatggtgttgaaacgtagtaagtttatgtctttaaggtctgcccctcccttcttgcattatatcataaactcttctcttttttttttttttggagacggagtcccgctctgtcacgcaggctgccaggctggcgtacagtggcgcaatctcagctcgctgcaacctccacctcctgggttcaagcgattttcttgcctctgcctcctgagtagctgggattactggcacacaccaccatgcacagggagatatgagacatcaatcaatatatgtaagatgtacatcagtttcgtctggaaagatgggacaacatgaagcagggagggggctccctggtgacagggaattttcttgtgggcaaattgtgagggagttccttgttcaaaatgccaagaacctggatgactcatagtcaagaccctccaccagtaacatatattggcgagccagccaggagcttggaaccctcggtggacagtgcctaagcacagaggcaaccacaggtttctaacagggccactctctggtgaaactgaaaggtttctgtgtgaaagtgcctgaccaccactgcccagttcagaccactacaggaaacactccatttattccacctgacttcccacttggctgcatcctcaaccattgaaatgaatttgaccctgataatctaaggaggaaacatttgatattcttttgcaataatacttggccccagtattgtttggaatctggagtttgctgttgaatgggaaagcnggatgacgttgcatgtatccaggctttggtgctgctgtcctaagaagggtcaggcctggtcagcatatggtgctctcctttggtgctatttggctccagtgtctttggagtctgaggaggtttggcctttaaaaatcaaactgccaccggaactgctttaaaaatgtttggttcacagccttcactggattacctattggagcaaacaaagtgtaaccatgtaaaacctgtgagcttgtattgatatctcatggctagagttccaagcgaatgggtctcatgagatctgatggttttgaaaatgggagttgccctgcacaagctctccttttgcctgctgccatccgcataagatgtgatttgctcttccttgccttccaccatgattgtgaggccttcccagcatgtggaaatggtccagcctgcaataactgaagcccccagacctggaacctgaagatcccatcagccactaaacctgtgaacctgtagaagacctgaagtacctgtttaaaaggcagccaaaagataagtaaattcctatcaactttccttggtgtccttcttgtatatttactgtaagctggatataatagtagccatttttatatttttacaatttaattgctttcttccaaatggattgaatcacttcttttaaagtgttttaattaatttttatctatagaacaaaataacaaataagtattttttttttataccataatggtcacccacagcctgtgtatactaagaccatgcatactgataatcagctttattttacaaaagagtttcgctttacccctctggtaattaatggattctgggtatttattaaaaactttaacacaaagactgttaaataccaccagtccagctttggcaaggcactgttggctttgtttatctccatcatcatccaaacagactaccaatcctgatcccagcccaatcttgggcccttgaaaaaataacttaacatcctaactacaagggagaaactcctttcaaattaatgaacctggctgacttatatagccttaaaattatggaaatgacaagggttacaatgtcagaatgagcagtaaaccttccccagtcctatcagagcaaactttctggggttgcatcccctcagaaacccatttggggcccaatctcaatgcacatatcagtgcgcaaagcactaaaattccaggcaacactttgtattgagagaagccaaaattttggtcaggccctgggacatctaaagtcaccaatgtaactacaccatacagattaaaccctcacatgatcatgtaagctatgcagttacccaagctgcatcatttagaaaacctgtacagtttttatggaaaccatccctagtcaaggacactttaaatatatagtctaaataccgttaaggtaggcccactagctgtgttcacattttcccttggccaccttaccagggactttaataacttgggaaagtgaaaacaacaagctaacccacatgttcaccatagaaaacaattttgtcttgaaaaacaaggactctttttcccgtgtgggaccagttcctacttatgttttaccagccaattggactggaacctatacagttgtttatttagcccccgaaattaatatagctcccaacaaccaatccttcattatacttttaactgcaaccaccagacacaaatgagccatccaactgataccactttcggtagagctaggaataacagcaggagtaggaatgagagttagcagccttgcagtttccctatcctattaccaatgcttgtccaaggattttatggaaagcttaggtgacattgcccaaaagtatcatcaccttacaaaatcagatagagtctttggcagtggtggctttgtaaaatagaaggggactggatctcctaaatgctgaagaaggtggcttatgtctttttcctagaggaagaatgctgtttttatgtcaaccaaacaggattagtaagggatgccacccaaaaactagccgattggtaccataagatatgacaacagctgtctgagtcatggggcgcctagtcaaaatgctaatttggggctcacatctccttcctctggccagtccactattaattattatacttgccttggcttttggatcatgtttgttaaatcttttaaccagatttatttcttcttgcctagagaccattatgataatgcagcagggccaccagtcagtttcagataatgatgtcaaccccggccaccaagaagtaaccttgtctccactagacagagcagggtgagagttctgtaatccccagtaggtagggactgtgccccaagtcagcatgaagtagttatggaagaaagaccatgggtccctctgcctcccagaaagatttatggggatcacatctctcaggggaaaatgaggcaggagaatagggtctggagacagggaacctaaagctgatttgtgctgagtttctaggattgaatgaaaaggaaaaccccacctctccacacccaagtaacaaaaggatcagaggctactccctttgcactgcattgcagataaaaaatggaaagtacctcagattggtcccctcccacaaccaatcagactggccatgggctactccttcgtttacatagggtgtaaccaagtaaccaatgggaaacctctagcgggtatgtaaaccccagaaaattctgtaaccagtgctcttgagctgcttgctggagcctactcccactttgtgaag

SEQ ID NO: 365937 - DNA, 1515 bp, Homo sapiens
aggggtttctcacgagatctgatggttttataaggggctctttcccctttgtgcaccctctctctttcctgcttccttgtgaagaaggtacttgcttctctttctcctgccaaagcatgaccttataattgtaagtttccggaggcctccccagccatgcggaactttttcctaaaattcccttttccactggtgtgtggtgcaagatgaggcacattttccatggatggtgaacagagggaggagccttttgatcacaaccaggtcaccccacttctaagccactgtgcctccagccccacaagactaaggagagagagcgcagcgtggtggagagtgagctgtgctgggaccattgtttccgtaacctcgttttctgtgtccagctgacacaccttcaaagtggcatcaggtcctaaactgtagcttgcaatgtgcctgtttccagaaaccaaggtgaaagtgcttttagagtcccttcccagcttttttctggaaatgcatgtttctctgaactctgagtcccaagaaaaatcacttgagacaccaagaaaatgggggaagtgctaaaattgtgtgggaattcaagcttaacaataaacatcaagacatttttgataaaaatgaatccactgacatcggggaggagcaagagaacagcacgctgacactgggtcagaggctaagaccgacatttctgggaaccactcccggaagggcacagaggagacgctttcagcctctcatcagccagcctggcctgtagctgctgcacgttatgagtgtgttcctggcatgactgcttctaacagcgaccatttcattaagtttttaagtgcctggtaattgcttggttatgaccggtgtctgctccatggcagcctcttcctgtttttgcccgaatgatgaaggaggaagtttacatcttgctccctggggacaggcagagacagtgtgtgcacttccatcctacagggaccagatctgaacagtctggagagaggagctgtggtggcagcagacagatctctgcttcaggggccaggtgtctagaagaaatgctgaggcagtgtcacgctggtgtctgtcctccttacagaatgcctgaacagttccattgactcaaagtgaagatcaaaagaaccaaatgacagcaatagccaagtgtaatcatcagtaaccctgtgttctatccacaggtaaaaaacaatcatcctcttcattatgggtttcaattttaaatgtaatacatttttagaaatgcctatttccttttataatctctttatataatctaggttattctggctcttaggtcttcatttagctactgaaaagatttgatctcaaatcaatgatctaaccacccatgaccatctcccacctctctccccgtacaccccccagcatgaattctgggaactcaggtaaaatgctttctggaaacctgcctgtattagtctgttgtcaagctgctaataaacacatacccgaaactgggtagtttataaagga

SEQ ID NO: 365938 - DNA, 1154 bp, Homo sapiens
  misc_feature (760)..(760): n is a, c, g, or t
  misc_feature (1154)..(1154): n is a, c, g, or t
cattcaccaccgcgtgacgcggcgccgggtcgccgccgcagattcgacacaaaacccggaaggaccccgccgaaggttttctccggttcgggagagagacggagtcccgctctgtcacgcaggctgccaggctggcgtacagtggcgcaatctcagctcgctgcaacctccacctcctgggttcaagcgattttcttgcctctgcctcctgagtagctgggattactggcacacaccaccatgcacagggagatatgagacatcaatcaatatatgtaagatgtacatcagtttcgtctggaaagatgggacaacatgaagcagggagggggctccctggtgacagggaattttcttgtgggcaaattgtgagggagttccttgttcaaaatgccaagaacctggatgactcatagtcaagaccctccaccagtaacatatattggcgagccagccaggagcttggaaccctcggtggacagtgcctaagcacagaggcaaccacaggtttctaacagggccactctctggtgaaactgaaaggtttctgtgtgaaagtgcctgaccaccactgcccagttcagaccactacaggaaacactccatttattccacctgacttcccacttggctgcatcctcaaccattgaaatgaatttgaccctgataatctaaggaggaaacatttgatattcttttgcaataatacttggccccagtattgtttggaatctggagtttgctgttgaatgggaaagcnggatgacgttgcatgtatccaggctttggtgctgctgtcctaagaagggtcaggcctggtcagcatatggtgctctcctttggtgctatttggctccagtgtctttggagtctgaggaggtttggcctttaaaaatcaaactgccaccggaactgctttaaaaatgtttggttcacagccttcactggattacctattggagcaaacaaagtgtaaccatgtaaaacctgtgagcttgtattgatatctcatggctagagttccaaggtaaaagctattggatcttcgtttgtgtgtgtgtatacatgtctagatgtgtttatttgtatgtacacttattgttatatgttgtgtcaaccaaatcagcttataaataaaaaagcactcataaatn

SEQ ID NO: 365939 - DNA, 902 bp, Homo sapiens
  misc_feature (508)..(508): n is a, c, g, or t
  misc_feature (902)..(902): n is a, c, g, or t
cattcaccaccgcgtgacgcggcgccgggtcgccgccgcagattcgacacaaaacccggaaggaccccgccgaaggttttctccggttcgggagagagacggagtcccgctctgtcacgcaggctgccaggctggcgtacagtggcgcaatctcagctcgctgcaacctccacctcctgggttcaagcgattttcttgcctctgcctcctgagtagctgggattactggcacacaccaccatgcacagttccttgttcaaaatgccaagaacctggatgactcatagtcaagaccctccaccagtaacatatattggcgagccagccaggagaccactacaggaaacactccatttattccacctgacttcccacttggctgcatcctcaaccattgaaatgaatttgaccctgataatctaaggaggaaacatttgatattcttttgcaataatacttggccccagtattgtttggaatctggagtttgctgttgaatgggaaagcnggatgacgttgcatgtatccaggctttggtgctgctgtcctaagaagggtcaggcctggtcagcatatggtgctctcctttggtgctatttggctccagtgtctttggagtctgaggaggtttggcctttaaaaatcaaactgccaccggaactgctttaaaaatgtttggttcacagccttcactggattacctattggagcaaacaaagtgtaaccatgtaaaacctgtgagcttgtattgatatctcatggctagagttccaaggtaaaagctattggatcttcgtttgtgtgtgtgtatacatgtctagatgtgtttatttgtatgtacacttattgttatatgttgtgtcaaccaaatcagcttataaataaaaaagcactcataaatn

SEQ ID NO: 365940 - DNA, 413 bp, Homo sapiens
tgctgggattacaggcgtgagccaccacacccggccaaacaagtggaatttttcctggaccagctctttgctggtcatgtgggaggagttggggctgtgttccaagtcagctggaatttttcttataacccaggattttacatgtgagcttgatcagcctttacttctcagcttaagcaggtctgggcatgtttggcaacctggcctgcataatgaagatttccataatttggtgttcatctatttattcagtttttgcccgaatgatgaaggaggaagtttacatcttgctccctggggacaggcagagacagtgtgtgcacttccatcctacagggaccagatctgaacagtctggagagaggagctgtggtggcagcagacagatctctgcttcaggggccaggtgtcta

SEQ ID NO: 365941 - DNA, 3291 bp, Homo sapiens
  misc_feature (760)..(760): n is a, c, g, or t
cattcaccaccgcgtgacgcggcgccgggtcgccgccgcagattcgacacaaaacccggaaggaccccgccgaaggttttctccggttcgggagagagacggagtcccgctctgtcacgcaggctgccaggctggcgtacagtggcgcaatctcagctcgctgcaacctccacctcctgggttcaagcgattttcttgcctctgcctcctgagtagctgggattactggcacacaccaccatgcacagggagatatgagacatcaatcaatatatgtaagatgtacatcagtttcgtctggaaagatgggacaacatgaagcagggagggggctccctggtgacagggaattttcttgtgggcaaattgtgagggagttccttgttcaaaatgccaagaacctggatgactcatagtcaagaccctccaccagtaacatatattggcgagccagccaggagcttggaaccctcggtggacagtgcctaagcacagaggcaaccacaggtttctaacagggccactctctggtgaaactgaaaggtttctgtgtgaaagtgcctgaccaccactgcccagttcagaccactacaggaaacactccatttattccacctgacttcccacttggctgcatcctcaaccattgaaatgaatttgaccctgataatctaaggaggaaacatttgatattcttttgcaataatacttggccccagtattgtttggaatctggagtttgctgttgaatgggaaagcnggatgacgttgcatgtatccaggctttggtgctgctgtcctaagaagggtcaggcctggtcagcatatggtgctctcctttggtgctatttggctccagtgtctttggagtctgaggaggtttggcctttaaaaatcaaactgccaccggaactgctttaaaaatgtttggttcacagccttcactggattacctattggagcaaacaaagtgtaaccatgtaaaacctgtgagcttgtattgatatctcatggctagagttccaagcgaatgggtctcatgagatctgatggttttgaaaatgggagttgccctgcacaagctctccttttgcctgctgccatccgcataagatgtgatttgctcttccttgccttccaccatgattgtgaggccttcccagcatgtggaaatggtccagcctgcaataactgaagcccccagacctggaacctgaagatcccatcagccactaaacctgtgaacctgtagaagacctgaagtacctgtttaaaaggcagccaaaagataagtaaattcctatcaactttccttggtgtccttcttgtatatttactgtaagctggatataatagtagccatttttatatttttacaatttaattgctttcttccaaatggattgaatcacttcttttaaagtgttttaattaatttttatctatagaacaaaataacaaataagtattttttttttataccataatggtcacccacagcctgtgtatactaagaccatgcatactgataatcagctttattttacaaaagagtttcgctttacccctctggtaattaatggattctgggtatttattaaaaactttaacacaaagactgttaaataccaccagtccagctttggcaaggcactgttggctttgtttatctccatcatcatccaaacagactaccaatcctgatcccagcccaatcttgggcccttgaaaaaataacttaacatcctaactacaagggagaaactcctttcaaattaatgaacctggctgacttatatagccttaaaattatggaaatgacaagggttacaatgtcagaatgagcagtaaaccttccccagtcctatcagagcaaactttctggggttgcatcccctcagaaacccatttggggcccaatctcaatgcacatatcagtgcgcaaagcactaaaattccaggcaacactttgtattgagagaagccaaaattttggtcaggccctgggacatctaaagtcaccaatgtaactacaccatacagattaaaccctcacatgatcatgtaagctatgcagttacccaagctgcatcatttagaaaacctgtacagtttttatggaaaccatccctagtcaaggacactttaaatatatagtctaaataccgttaaggtaggcccactagctgtgttcacattttcccttggccaccttaccagggactttaataacttgggaaagtgaaaacaacaagctaacccacatgttcaccatagaaaacaattttgtcttgaaaaacaaggactctttttcccgtgtgggaccagttcctacttatgttttaccagccaattggactggaacctatacagttgtttatttagcccccgaaattaatatagctcccaacaaccaatccttcattatacttttaactgcaaccaccagacacaaatgagccatccaactgataccactttcggtagagctaggaataacagcaggagtaggaatgagagttagcagccttgcagtttccctatcctattaccaatgcttgtccaaggattttatggaaagcttaggtgacattgcccaaaagtatcatcaccttacaaaatcagatagagtctttggcagtggtggctttgtaaaatagaaggggactggatctcctaaatgctgaagaaggtggcttatgtctttttcctagaggaagaatgctgtttttatgtcaaccaaacaggattagtaagggatgccacccaaaaactagccgattggtaccataagatatgacaacagctgtctgagtcatggggcgcctagtcaaaatgctaatttggggctcacatctccttcctctggccagtccactattaattattatacttgccttggcttttggatcatgtttgttaaatcttttaaccagatttatttcttcttgcctagagaccattttgcaggaatttagccaattcagaggtcttgttctccataatttggaattttccttcggatttgatcaagttggatagagttggtcaaacccaatgggaaaaagatgaaaacaacaagaaacagaaacaaacagcaacaacaacaacaacaaaaacaaagcaggaaaaaactgaaactcatcttccctgctggaaacgagctcaaactccagaaaggagttacctgccttccatcatcatggacgcaggaaaatttgccttccttgttggaagcaagtaaaactccaaaaaaggagttgcacagcaaaataaacttcagatctcaac

SEQ ID NO: 365942 - DNA, 2694 bp, Homo sapiens
cattcaccaccgcgtgacgcggcgccgggtcgccgccgcagattcgacacaaaacccggaaggaccccgccgaaggttttctccggttcgggagagagacggagtcccgctctgtcacgcaggctgccaggctggcgtacagtggcgcaatctcagctcgctgcaacctccacctcctgggttcaagcgattttcttgcctctgcctcctgagtagctgggattactggcacacaccaccatgcacagggagatatgagacatcaatcaatatatgtaagatgtacatcagtttcgtctggaaagatgggacaacatgaagcagggagggggctccctggtgacagttccttgttcaaaatgccaagaacctggatgactcatagtcaagaccctccaccagtaacatatattggcgagccagccaggagcgaatgggtctcatgagatctgatggttttgaaaatgggagttgccctgcacaagctctccttttgcctgctgccatccgcataagatgtgatttgctcttccttgccttccaccatgattgtgaggccttcccagcatgtggaaatggtccagcctgcaataactgaagcccccagacctggaacctgaagatcccatcagccactaaacctgtgaacctgtagaagacctgaagtacctgtttaaaaggcagccaaaagataagtaaattcctatcaactttccttggtgtccttcttgtatatttactgtaagctggatataatagtagccatttttatatttttacaatttaattgctttcttccaaatggattgaatcacttcttttaaagtgttttaattaatttttatctatagaacaaaataacaaataagtattttttttttataccataatggtcacccacagcctgtgtatactaagaccatgcatactgataatcagctttattttacaaaagagtttcgctttacccctctggtaattaatggattctgggtatttattaaaaactttaacacaaagactgttaaataccaccagtccagctttggcaaggcactgttggctttgtttatctccatcatcatccaaacagactaccaatcctgatcccagcccaatcttgggcccttgaaaaaataacttaacatcctaactacaagggagaaactcctttcaaattaatgaacctggctgacttatatagccttaaaattatggaaatgacaagggttacaatgtcagaatgagcagtaaaccttccccagtcctatcagagcaaactttctggggttgcatcccctcagaaacccatttggggcccaatctcaatgcacatatcagtgcgcaaagcactaaaattccaggcaacactttgtattgagagaagccaaaattttggtcaggccctgggacatctaaagtcaccaatgtaactacaccatacagattaaaccctcacatgatcatgtaagctatgcagttacccaagctgcatcatttagaaaacctgtacagtttttatggaaaccatccctagtcaaggacactttaaatatatagtctaaataccgttaaggtaggcccactagctgtgttcacattttcccttggccaccttaccagggactttaataacttgggaaagtgaaaacaacaagctaacccacatgttcaccatagaaaacaattttgtcttgaaaaacaaggactctttttcccgtgtgggaccagttcctacttatgttttaccagccaattggactggaacctatacagttgtttatttagcccccgaaattaatatagctcccaacaaccaatccttcattatacttttaactgcaaccaccagacacaaatgagccatccaactgataccactttcggtagagctaggaataacagcaggagtaggaatgagagttagcagccttgcagtttccctatcctattaccaatgcttgtccaaggattttatggaaagcttaggtgacattgcccaaaagtatcatcaccttacaaaatcagatagagtctttggcagtggtggctttgtaaaatagaaggggactggatctcctaaatgctgaagaaggtggcttatgtctttttcctagaggaagaatgctgtttttatgtcaaccaaacaggattagtaagggatgccacccaaaaactagccgattggtaccataagatatgacaacagctgtctgagtcatggggcgcctagtcaaaatgctaatttggggctcacatctccttcctctggccagtccactattaattattatacttgccttggcttttggatcatgtttgttaaatcttttaaccagatttatttcttcttgcctagagaccattttgcaggaatttagccaattcagaggtcttgttctccataatttggaattttccttcggatttgatcaagttggatagagttggtcaaacccaatgggaaaaagatgaaaacaacaagaaacagaaacaaacagcaacaacaacaacaacaaaaacaaagcaggaaaaaactgaaactcatcttccctgctggaaacgagctcaaactccagaaaggagttacctgccttccatcatcatggacgcaggaaaatttgccttccttgttggaagcaagtaaaactccaaaaaaggagttgcacagcaaaataaacttcagatctcaac

SEQ ID NO: 365943 - DNA, 5159 bp, Homo sapiens
  misc_feature (9)..(9): n is a, c, g, or t
  misc_feature (1155)..(1155): n is a, c, g, or t
gagggcccntgccagaacctgaccatgctggcactctgattttggatttctagtctctagaactgtgaataagtacgtttctattgcgtaagccacccagtctatggtattttattatggcagcctgagctgactaatataggcttctagattggaaggggaaggaagtaaagagagagaattgatagggataaagaagaggcatgaagagacttggggtatctgctactgaagacatcagctctctatgacaaaacagcacagcatgtttggagtaagagaaagctgaagtctcaacaaacaaatagattcttaatgttctataccaccggacaaactgcagcccttttatacatatggagtactttctgggccagtcctgtggcccctttcaaatgtatggtgttgaaacgtagtaagtttatgtctttaaggtctgcccctcccttcttgcattatatcataaactcttctcttttttttttttttggagacggagtcccgctctgtcacgcaggctgccaggctggcgtacagtggcgcaatctcagctcgctgcaacctccacctcctgggttcaagcgattttcttgcctctgcctcctgagtagctgggattactggcacacaccaccatgcacagggagatatgagacatcaatcaatatatgtaagatgtacatcagtttcgtctggaaagatgggacaacatgaagcagggagggggctccctggtgacagggaattttcttgtgggcaaattgtgagggagttccttgttcaaaatgccaagaacctggatgactcatagtcaagaccctccaccagtaacatatattggcgagccagccaggagcttggaaccctcggtggacagtgcctaagcacagaggcaaccacaggtttctaacagggccactctctggtgaaactgaaaggtttctgtgtgaaagtgcctgaccaccactgcccagttcagaccactacaggaaacactccatttattccacctgacttcccacttggctgcatcctcaaccattgaaatgaatttgaccctgataatctaaggaggaaacatttgatattcttttgcaataatacttggccccagtattgtttggaatctggagtttgctgttgaatgggaaagcnggatgacgttgcatgtatccaggctttggtgctgctgtcctaagaagggtcaggcctggtcagcatatggtgctctcctttggtgctatttggctccagtgtctttggagtctgaggaggtttggcctttaaaaatcaaactgccaccggaactgctttaaaaatgtttggttcacagccttcactggattacctattggagcaaacaaagtgtaaccatgtaaaacctgtgagcttgtattgatatctcatggctagagttccaagcgaatgggtctcatgagatctgatggttttgaaaatgggagttgccctgcacaagctctccttttgcctgctgccatccgcataagatgtgatttgctcttccttgccttccaccatgattgtgaggccttcccagcatgtggaaatggtccagcctgcaataactgaagcccccagacctggaacctgaagatcccatcagccactaaacctgtgaacctgtagaagacctgaagtacctgtttaaaaggcagccaaaagataagtaaattcctatcaactttccttggtgtccttcttgtatatttactgtaagctggatataatagtagccatttttatatttttacaatttaattgctttcttccaaatggattgaatcacttcttttaaagtgttttaattaatttttatctatagaacaaaataacaaataagtattttttttttataccataatggtcacccacagcctgtgtatactaagaccatgcatactgataatcagctttattttacaaaagagtttcgctttacccctctggtaattaatggattctgggtatttattaaaaactttaacacaaagactgttaaataccaccagtccagctttggcaaggcactgttggctttgtttatctccatcatcatccaaacagactaccaatcctgatcccagcccaatcttgggcccttgaaaaaataacttaacatcctaactacaagggagaaactcctttcaaattaatgaacctggctgacttatatagccttaaaattatggaaatgacaagggttacaatgtcagaatgagcagtaaaccttccccagtcctatcagagcaaactttctggggttgcatcccctcagaaacccatttggggcccaatctcaatgcacatatcagtgcgcaaagcactaaaattccaggcaacactttgtattgagagaagccaaaattttggtcaggccctgggacatctaaagtcaccaatgtaactacaccatacagattaaaccctcacatgatcatgtaagctatgcagttacccaagctgcatcatttagaaaacctgtacagtttttatggaaaccatccctagtcaaggacactttaaatatatagtctaaataccgttaaggtaggcccactagctgtgttcacattttcccttggccaccttaccagggactttaataacttgggaaagtgaaaacaacaagctaacccacatgttcaccatagaaaacaattttgtcttgaaaaacaaggactctttttcccgtgtgggaccagttcctacttatgttttaccagccaattggactggaacctatacagttgtttatttagcccccgaaattaatatagctcccaacaaccaatccttcattatacttttaactgcaaccaccagacacaaatgagccatccaactgataccactttcggtagagctaggaataacagcaggagtaggaatgagagttagcagccttgcagtttccctatcctattaccaatgcttgtccaaggattttatggaaagcttaggtgacattgcccaaaagtatcatcaccttacaaaatcagatagagtctttggcagtggtggctttgtaaaatagaaggggactggatctcctaaatgctgaagaaggtggcttatgtctttttcctagaggaagaatgctgtttttatgtcaaccaaacaggattagtaagggatgccacccaaaaactagccgattggtaccataagatatgacaacagctgtctgagtcatggggcgcctagtcaaaatgctaatttggggctcacatctccttcctctggccagtccactattaattattatacttgccttggcttttggatcatgtttgttaaatcttttaaccagatttatttcttcttgcctagagaccattatgataatgcagcagggccaccagtcagtttcagataatgatgtcaaccccggccaccaagaagtaaccttgtctccactagacagagcaggttgcaggaatttagccaattcagaggtcttgttctccataatttggaattttccttcggatttgatcaagttggatagagttggtcaaacccaatgggaaaaagatgaaaacaacaagaaacagaaacaaacagcaacaacaacaacaacaaaaacaatgcatttaattaaatgaagatgagctcatgctggagtagggtggactctgaacccagtgggacaagcgtccttattaagaagagggaaatctggacacacacagagcagagaccgccgtgtgaagatggaggcagagatcggagagatgctgccacacgccacaaatgcctggggctcccagaaactacacggagcctcccccagcggcttcagcaggagcatggctcggccaacactttgatcttggtcttccagcctccagaacgttttcctaaaattcccttttccactggtgtgtggtgcaagatgaggcacattttccatggatggtgaacagagggaggagccttttgatcacaaccaggtcaccccacttctaagccactgtgcctccagccccacaagactaaggagagagagcgcagcgtggtggagagtgagctgtgctgggaccattgtttccgtaacctcgttttctgtgtccagctgacacaccttcaaagtggcatcaggtcctaaactgtagcttgcaatgtgcctgtttccagaaaccaaggtgaaagtgcttttagacagtgttcccatgcaagagtcccttcccagcttttttctggaaatgcatgtttctctgaactctgagtcccaagaaaaatcacttgagacaccaagaaaatgggggaagtgctaaaattgtgtgggaattcaagcttaacaataaacatcaagacatttttgataaaaatgaatccactgacatcggggaggagcaagagaacagcacgctgacactgggtcagaggctaagaccgacatttctgggaaccactcccggaagggcacagaggagacgctttcagcctctcatcagccagcctggcctgtagctgctgcacgttatgagtgtgttcctggcatgactgcttctaacagcgaccatttcattaagtttttaagtgcctggtaattgcttggttatgaccggtgtctgctccatggcagcctcttcctgggaccagatctgaacagtctggagagaggagctgtggtggcagcagacagatctctgcttcaggggccaggtgtctagaagaaatgctgaggcagtgtcacgctggtgtctgtcctccttacagaatgcctgaacagttccattgactcaaagtgaagatcaaaagaaccaaatgacagcaatagccaagtgtaatcatcagtaaccctgtgttctatccacaggtaaaaaacaatcatcctcttcattatgggtttcaattttaaatgtaatacatttttagaaatgcctatttccttttataatctctttatataatctaggttattctggctcttaggtcttcatttagctactgaaaagatttgatctcaaatcaatgatctaaccacccatgaccatctcccacctctctccccgtacaccccccagcatgaattctgggaactcaggtaaaatgctttctggaaacctgcctgtattagtctgttgtcaagctgctaataaacacatacccgaaactgggtagtttataaagga

SEQ ID NO: 365944 - DNA, 5117 bp, Homo sapiens
  misc_feature (9)..(9): n is a, c, g, or t
  misc_feature (1155)..(1155): n is a, c, g, or t
gagggcccntgccagaacctgaccatgctggcactctgattttggatttctagtctctagaactgtgaataagtacgtttctattgcgtaagccacccagtctatggtattttattatggcagcctgagctgactaatataggcttctagattggaaggggaaggaagtaaagagagagaattgatagggataaagaagaggcatgaagagacttggggtatctgctactgaagacatcagctctctatgacaaaacagcacagcatgtttggagtaagagaaagctgaagtctcaacaaacaaatagattcttaatgttctataccaccggacaaactgcagcccttttatacatatggagtactttctgggccagtcctgtggcccctttcaaatgtatggtgttgaaacgtagtaagtttatgtctttaaggtctgcccctcccttcttgcattatatcataaactcttctcttttttttttttttggagacggagtcccgctctgtcacgcaggctgccaggctggcgtacagtggcgcaatctcagctcgctgcaacctccacctcctgggttcaagcgattttcttgcctctgcctcctgagtagctgggattactggcacacaccaccatgcacagggagatatgagacatcaatcaatatatgtaagatgtacatcagtttcgtctggaaagatgggacaacatgaagcagggagggggctccctggtgacagggaattttcttgtgggcaaattgtgagggagttccttgttcaaaatgccaagaacctggatgactcatagtcaagaccctccaccagtaacatatattggcgagccagccaggagcttggaaccctcggtggacagtgcctaagcacagaggcaaccacaggtttctaacagggccactctctggtgaaactgaaaggtttctgtgtgaaagtgcctgaccaccactgcccagttcagaccactacaggaaacactccatttattccacctgacttcccacttggctgcatcctcaaccattgaaatgaatttgaccctgataatctaaggaggaaacatttgatattcttttgcaataatacttggccccagtattgtttggaatctggagtttgctgttgaatgggaaagcnggatgacgttgcatgtatccaggctttggtgctgctgtcctaagaagggtcaggcctggtcagcatatggtgctctcctttggtgctatttggctccagtgtctttggagtctgaggaggtttggcctttaaaaatcaaactgccaccggaactgctttaaaaatgtttggttcacagccttcactggattacctattggagcaaacaaagtgtaaccatgtaaaacctgtgagcttgtattgatatctcatggctagagttccaagcgaatgggtctcatgagatctgatggttttgaaaatgggagttgccctgcacaagctctccttttgcctgctgccatccgcataagatgtgatttgctcttccttgccttccaccatgattgtgaggccttcccagcatgtggaaatggtccagcctgcaataactgaagcccccagacctggaacctgaagatcccatcagccactaaacctgtgaacctgtagaagacctgaagtacctgtttaaaaggcagccaaaagataagtaaattcctatcaactttccttggtgtccttcttgtatatttactgtaagctggatataatagtagccatttttatatttttacaatttaattgctttcttccaaatggattgaatcacttcttttaaagtgttttaattaatttttatctatagaacaaaataacaaataagtattttttttttataccataatggtcacccacagcctgtgtatactaagaccatgcatactgataatcagctttattttacaaaagagtttcgctttacccctctggtaattaatggattctgggtatttattaaaaactttaacacaaagactgttaaataccaccagtccagctttggcaaggcactgttggctttgtttatctccatcatcatccaaacagactaccaatcctgatcccagcccaatcttgggcccttgaaaaaataacttaacatcctaactacaagggagaaactcctttcaaattaatgaacctggctgacttatatagccttaaaattatggaaatgacaagggttacaatgtcagaatgagcagtaaaccttccccagtcctatcagagcaaactttctggggttgcatcccctcagaaacccatttggggcccaatctcaatgcacatatcagtgcgcaaagcactaaaattccaggcaacactttgtattgagagaagccaaaattttggtcaggccctgggacatctaaagtcaccaatgtaactacaccatacagattaaaccctcacatgatcatgtaagctatgcagttacccaagctgcatcatttagaaaacctgtacagtttttatggaaaccatccctagtcaaggacactttaaatatatagtctaaataccgttaaggtaggcccactagctgtgttcacattttcccttggccaccttaccagggactttaataacttgggaaagtgaaaacaacaagctaacccacatgttcaccatagaaaacaattttgtcttgaaaaacaaggactctttttcccgtgtgggaccagttcctacttatgttttaccagccaattggactggaacctatacagttgtttatttagcccccgaaattaatatagctcccaacaaccaatccttcattatacttttaactgcaaccaccagacacaaatgagccatccaactgataccactttcggtagagctaggaataacagcaggagtaggaatgagagttagcagccttgcagtttccctatcctattaccaatgcttgtccaaggattttatggaaagcttaggtgacattgcccaaaagtatcatcaccttacaaaatcagatagagtctttggcagtggtggctttgtaaaatagaaggggactggatctcctaaatgctgaagaaggtggcttatgtctttttcctagaggaagaatgctgtttttatgtcaaccaaacaggattagtaagggatgccacccaaaaactagccgattggtaccataagatatgacaacagctgtctgagtcatggggcgcctagtcaaaatgctaatttggggctcacatctccttcctctggccagtccactattaattattatacttgccttggcttttggatcatgtttgttaaatcttttaaccagatttatttcttcttgcctagagaccattatgataatgcagcagggccaccagtcagtttcagataatgatgtcaaccccggccaccaagaagtaaccttgtctccactagacagagcaggttgcaggaatttagccaattcagaggtcttgttctccataatttggaattttccttcggatttgatcaagttggatagagttggtcaaacccaatgggaaaaagatgaaaacaacaagaaacagaaacaaacagcaacaacaacaacaacaaaaacaatgcatttaattaaatgaagatgagctcatgctggagtagggtggactctgaacccagtgggacaagcgtccttattaagaagagggaaatctggacacacacagagcagagaccgccgtgtgaagatggaggcagagatcggagagatgctgccacacgccacaaatgcctggggctcccagaaactacacggagcctcccccagcggcttcagcaggagcatggctcggccaacactttgatcttggtcttccagcctccagaacgttttcctaaaattcccttttccactggtgtgtggtgcaagatgaggcacattttccatggatggtgaacagagggaggagccttttgatcacaaccaggtcaccccacttctaagccactgtgcctccagccccacaagactaaggagagagagcgcagcgtggtggagagtgagctgtgctgggaccattgtttccgtaacctcgttttctgtgtccagctgacacaccttcaaagtggcatcaggtcctaaactgtagcttgcaatgtgcctgtttccagaaaccaaggtgaaagtgcttttagacagtgttcccatgcaagagtcccttcccagcttttttctggaaatgcatgtttctctgaactctgagtcccaagaaaaatcacttgagacaccaagaaaatgggggaagtgctaaaattgtgtgggaattcaagcttaacaataaacatcaagacatttttgataaaaatgaatccactgacatcggggaggagcaagagaacagcacgctgacactgggtcagaggctaagaccgacatttctgggaaccactcccggaagggcacagaggagacgctttcagcctctcatcagccagcctggcctgtagctgctgcacgttatgagtgtgttcctggcatgactgcttctaacagcgaccatttcattaagtttttaagtgcctggtaattgcttggttatgaccggtgtctgctccatggcagcctcttcctgtttttgcccgaatgatgaaggaggaagtttacatcttgctccctggggacaggcagagacagtgtgtgcacttccatcctacagggaccagatctgaacagtctggagagaggagctgtggtggcagcagacagatctctgcttcaggggccaggtgtctaggtgagacgccacagcgcggcagagagaacagaggcttctctgcatgcctgccagggaattggcaccatgtcaacagaaatcttaggttacaggaacaggaaccagccctgactgacgtgtgcaagcccggagctttcctttctccttgcacttcccacatgttccccacataaccagcaaccacagagccaccccctgccacccaacaactccctcctgagctagaaacttgtaagactcagctaggagtctgaatggttggatatctaaagcaaagaataatctagtttgtaacatgggaccaaaggaagaactgaaatggcacaatctgtgtaa

SEQ ID NO: 365945 - DNA, 5194 bp, Homo sapiens
  misc_feature (9)..(9): n is a, c, g, or t
  misc_feature (1155)..(1155): n is a, c, g, or t
gagggcccntgccagaacctgaccatgctggcactctgattttggatttctagtctctagaactgtgaataagtacgtttctattgcgtaagccacccagtctatggtattttattatggcagcctgagctgactaatataggcttctagattggaaggggaaggaagtaaagagagagaattgatagggataaagaagaggcatgaagagacttggggtatctgctactgaagacatcagctctctatgacaaaacagcacagcatgtttggagtaagagaaagctgaagtctcaacaaacaaatagattcttaatgttctataccaccggacaaactgcagcccttttatacatatggagtactttctgggccagtcctgtggcccctttcaaatgtatggtgttgaaacgtagtaagtttatgtctttaaggtctgcccctcccttcttgcattatatcataaactcttctcttttttttttttttggagacggagtcccgctctgtcacgcaggctgccaggctggcgtacagtggcgcaatctcagctcgctgcaacctccacctcctgggttcaagcgattttcttgcctctgcctcctgagtagctgggattactggcacacaccaccatgcacagggagatatgagacatcaatcaatatatgtaagatgtacatcagtttcgtctggaaagatgggacaacatgaagcagggagggggctccctggtgacagggaattttcttgtgggcaaattgtgagggagttccttgttcaaaatgccaagaacctggatgactcatagtcaagaccctccaccagtaacatatattggcgagccagccaggagcttggaaccctcggtggacagtgcctaagcacagaggcaaccacaggtttctaacagggccactctctggtgaaactgaaaggtttctgtgtgaaagtgcctgaccaccactgcccagttcagaccactacaggaaacactccatttattccacctgacttcccacttggctgcatcctcaaccattgaaatgaatttgaccctgataatctaaggaggaaacatttgatattcttttgcaataatacttggccccagtattgtttggaatctggagtttgctgttgaatgggaaagcnggatgacgttgcatgtatccaggctttggtgctgctgtcctaagaagggtcaggcctggtcagcatatggtgctctcctttggtgctatttggctccagtgtctttggagtctgaggaggtttggcctttaaaaatcaaactgccaccggaactgctttaaaaatgtttggttcacagccttcactggattacctattggagcaaacaaagtgtaaccatgtaaaacctgtgagcttgtattgatatctcatggctagagttccaagcgaatgggtctcatgagatctgatggttttgaaaatgggagttgccctgcacaagctctccttttgcctgctgccatccgcataagatgtgatttgctcttccttgccttccaccatgattgtgaggccttcccagcatgtggaaatggtccagcctgcaataactgaagcccccagacctggaacctgaagatcccatcagccactaaacctgtgaacctgtagaagacctgaagtacctgtttaaaaggcagccaaaagataagtaaattcctatcaactttccttggtgtccttcttgtatatttactgtaagctggatataatagtagccatttttatatttttacaatttaattgctttcttccaaatggattgaatcacttcttttaaagtgttttaattaatttttatctatagaacaaaataacaaataagtattttttttttataccataatggtcacccacagcctgtgtatactaagaccatgcatactgataatcagctttattttacaaaagagtttcgctttacccctctggtaattaatggattctgggtatttattaaaaactttaacacaaagactgttaaataccaccagtccagctttggcaaggcactgttggctttgtttatctccatcatcatccaaacagactaccaatcctgatcccagcccaatcttgggcccttgaaaaaataacttaacatcctaactacaagggagaaactcctttcaaattaatgaacctggctgacttatatagccttaaaattatggaaatgacaagggttacaatgtcagaatgagcagtaaaccttccccagtcctatcagagcaaactttctggggttgcatcccctcagaaacccatttggggcccaatctcaatgcacatatcagtgcgcaaagcactaaaattccaggcaacactttgtattgagagaagccaaaattttggtcaggccctgggacatctaaagtcaccaatgtaactacaccatacagattaaaccctcacatgatcatgtaagctatgcagttacccaagctgcatcatttagaaaacctgtacagtttttatggaaaccatccctagtcaaggacactttaaatatatagtctaaataccgttaaggtaggcccactagctgtgttcacattttcccttggccaccttaccagggactttaataacttgggaaagtgaaaacaacaagctaacccacatgttcaccatagaaaacaattttgtcttgaaaaacaaggactctttttcccgtgtgggaccagttcctacttatgttttaccagccaattggactggaacctatacagttgtttatttagcccccgaaattaatatagctcccaacaaccaatccttcattatacttttaactgcaaccaccagacacaaatgagccatccaactgataccactttcggtagagctaggaataacagcaggagtaggaatgagagttagcagccttgcagtttccctatcctattaccaatgcttgtccaaggattttatggaaagcttaggtgacattgcccaaaagtatcatcaccttacaaaatcagatagagtctttggcagtggtggctttgtaaaatagaaggggactggatctcctaaatgctgaagaaggtggcttatgtctttttcctagaggaagaatgctgtttttatgtcaaccaaacaggattagtaagggatgccacccaaaaactagccgattggtaccataagatatgacaacagctgtctgagtcatggggcgcctagtcaaaatgctaatttggggctcacatctccttcctctggccagtccactattaattattatacttgccttggcttttggatcatgtttgttaaatcttttaaccagatttatttcttcttgcctagagaccattatgataatgcagcagggccaccagtcagtttcagataatgatgtcaaccccggccaccaagaagtaaccttgtctccactagacagagcaggttgcaggaatttagccaattcagaggtcttgttctccataatttggaattttccttcggatttgatcaagttggatagagttggtcaaacccaatgggaaaaagatgaaaacaacaagaaacagaaacaaacagcaacaacaacaacaacaaaaacaatgcatttaattaaatgaagatgagctcatgctggagtagggtggactctgaacccagtgggacaagcgtccttattaagaagagggaaatctggacacacacagagcagagaccgccgtgtgaagatggaggcagagatcggagagatgctgccacacgccacaaatgcctggggctcccagaaactacacggagcctcccccagcggcttcagcaggagcatggctcggccaacactttgatcttggtcttccagcctccagaacgattttccatggatggtgaacagagggaggagccttttgatcacaaccaggtcaccccacttctaagccactgtgcctccagccccacaagactaaggagagagagcgcagcgtggtggagagtgagctgtgctgggaccattgtttccgtaacctcgttttctgtgtccagctgacacaccttcaaagtggcatcaggtcctaaactgtagcttgcaatgtgcctgtttccagaaaccaaggtgaaagtgcttttagacagtgttcccatgcaagagtcccttcccagcttttttctggaaatgcatgtttctctgaactctgagtcccaagaaaaatcacttgagacaccaagaaaatgggggaagtgctaaaattgtgtgggaattcaagcttaacaataaacatcaagacatttttgataaaaatgaatccactgacatcggggaggagcaagagaacagcacgctgacactgggtcagaggctaagaccgacatttctgggaaccactcccggaagggcacagaggagacgctttcagcctctcatcagccagcctggcctgtagctgctgcacgttatgagtgtgttcctggcatgactgcttctaacagcgaccatttcattaagtttttaagtgcctggtaattgcttggttatgaccggtgtctgctccatggcagcctcttcctgtttttgcccgaatgatgaaggaggaagtttacatcttgctccctggggacaggcagagacagtgtgtgcacttccatcctacagggaccagatctgaacagtctggagagaggagctgtggtggcagcagacagatctctgcttcaggggccaggtgtctagaagaaatgctgaggcagtgtcacgctggtgtctgtcctccttacagaatgcctgaacagttccattgactcaaagtgaagatcaaaagaaccaaatgacagcaatagccaagtgtaatcatcagtaaccctgtgttctatccacaggtaaaaaacaatcatcctcttcattatgggtttcaattttaaatgtaatacatttttagaaatgcctatttccttttataatctctttatataatctaggttattctggctcttaggtcttcatttagctactgaaaagatttgatctcaaatcaatgatctaaccacccatgaccatctcccacctctctccccgtacaccccccagcatgaattctgggaactcaggtaaaatgctttctggaaacctgcctgtattagtctgttgtcaagctgctaataaacacatacccgaaactgggtagtttataaagga

SEQ ID NO: 365946 - DNA, 1749 bp, Homo sapiens
ctgacaagtgtccagcagggtggacttcagactccctgttaggaactgaattgtgtcccccaaaaagagaaagtcaccccagggtatgacctaattcaggaaaggtcattgcagatgcatttaattaaatgaagatgagctcatgctggagtagggtggactctgaacccagtgggacaagcgtccttattaagaagagggaaatctggacacacacagagcagagaccgccgtgtgaagatggaggcagagatcggagagatgctgccacacgccacaaatgcctggggctcccagaaactacacggagcctcccccagcggcttcagcaggagcatggctcggccaacactttgatcttggtcttccagcctccagaacgttttcctaaaattcccttttccactggtgtgtggtgcaagatgaggcacattttccatggatggtgaacagagggaggagccttttgatcacaaccaggtcaccccacttctaagccactgtgcctccagccccacaagactaaggagagagagcgcagcgtggtggagagtgagctgtgctgggaccattgtttccgtaacctcgttttctgtgtccagctgacacaccttcaaagtggcatcaggtcctaaactgtagcttgcaatgtgcctgtttccagaaaccaaggtgaaagtgcttttagacagtgttcccatgcaagagtcccttcccagcttttttctggaaatgcatgtttctctgaactctgagtcccaagaaaaatcacttgagacaccaagaaaatgggggaagtgctaaaattgtgtgggaattcaagcttaacaataaacatcaagacatttttgataaaaatgaatccactgacatcggggaggagcaagagaacagcacgctgacactgggtcagaggctaagaccgacatttctgggaaccactcccggaagggcacagaggagacgctttcagcctctcatcagccagcctggcctgtagctgctgcacgttatgagtgtgttcctggcatgactgcttctaacagcgaccatttcattaagtttttaagtgcctggtaattgcttggttatgaccggtgtctgctccatggcagcctcttcctgtttttgcccgaatgatgaaggaggaagtttacatcttgctccctggggacaggcagagacagtgtgtgcacttccatcctacagggaccagatctgaacagtctggagagaggagctgtggtggcagcagacagatctctgcttcaggggccaggtgtctagaagaaatgctgaggcagtgtcacgctggtgtctgtcctccttacagaatgcctgaacagttccattgactcaaagtgaagatcaaaagaaccaaatgacagcaatagccaagtgtaatcatcagtaaccctgtgttctatccacaggtaaaaaacaatcatcctcttcattatgggtttcaattttaaatgtaatacatttttagaaatgcctatttccttttataatctctttatataatctaggttattctggctcttaggtcttcatttagctactgaaaagatttgatctcaaatcaatgatctaaccacccatgaccatctcccacctctctccccgtacaccccccagcatgaattctgggaactcaggtaaaatgctttctggaaacctgcctgtattagtctgttgtcaagctgctaataaacacatacccgaaactgggtagtttataaagga

SEQ ID NO: 365947 - DNA, 2465 bp, Homo sapiens
aggcctgggccgggccgtgacggcggcgctaggacccggcgggccgcgggtgcggcgaggcctgggcggcctgaggagcgcggaccccggcgctcggctcccggcgccatgtgagggggctcgggggccgcggggggccgggcgctccccgccggagatgaggaaactgaggctcagagaggtcacatggcttgctcgaggccccccagccagtgtgaacccacatccctgcccccagggccacctgcaggacgccgacacctacccctcagcagacgccggagagaaatgagtagcaacaaagagcagcggtcagcagtgttcgtgatcctctttgccctcatcaccatcctcatcctctacagctccaacagtgccaatgaggtcttccattacggctccctgcggggccgtagccgccgacctgtcaacctcaagaagtggagcatcactgacggctatgtccccattctcggcaacaagacactgccctctcggtgccaccagtgtgtgattgtcagcagctccagccacctgctgggcaccaagctgggccctgagatcgagcgggctgagtgtacaatccgcatgaatgatgcacccaccactggctactcagctgatgtgggcaacaagaccacctaccgcgtcgtggcccattccagtgtgttccgcgtgctgaggaggccccaggagtttgtcaaccggacccctgaaaccgtgttcatcttctgggggcccccgagcaagatgcagaagccccagggcagcctcgtgcgtgtgatccagcgagcgggcctggtgttccccaacatggaagcatatgccgtctctcccggccgcatgcggcaatttgacgacctcttccggggtgagacgggcaaggacagggagaagtctcattcgtggttgagcacaggctggtttaccatggtgatcgcggtggagttgtgtgaccacgtgcatgtctatggcatggtcccccccaactactgcagccagcggccccgcctccagcgcatgccctaccactactacgagcccaaggggccggacgaatgtgtcacctacatccagaatgagcacagtcgcaagggcaaccaccaccgcttcatcaccgagaaaagggtcttctcatcgtgggcccagctgtatggcatcaccttctcccacccctcctggacctaggccacccagcctgtgggacctcaggagggtcagaggagaagcagcctccgcccagccgctaggccagggaccatcttctggccaatcaaggcttgctggagtgtctcccagccaatcagggccttgaggaggatgtatcctccagccaatcagggcctggggaatctgttggcgaatcagggatttgggagtctatgtggttaatcaggggtgtctttcttgtgcagtcagggtctgcgcacagtcaatcagggtagagggggtatttctgagtcaatctgaggctaaggacatgtcctttcccatgaggccttggttcagagccccaggaatggaccccccaatcactccccactctgctgggataatggggtcctgtcccaaggagctgggaacttggtgttgccccctcaatttccagcaccagaaagagagattgtgtgggggtagaagctgtctggaggcccggccagagaatttgtggggttgtggaggttgtgggggcggtggggaggtcccagaggtgggaggctggcatccaggtcttggctctgccctgagaccttggacaaacccttccccctctctgggcacccttctgcccacaccagtttccagtgcggagtctgagaccctttccacctcccctacaagtgccctcgggtctgtcctccccgtctggaccctcccagccactatcccttgctggaaggctcagctctttggggggtctggggtgacctccccacctcctggaaaactttagggtatttttgcgcaaactccttcagggttgggggactctgaaggaaacgggacaaaaccttaagctgttttcttagcccctcagccagctgccattagcttggctcttaaagggccaggcctccttttctgccctctagcagggaggttttccaactgttggaggcgcctttggggctgcccctttgtctggagtcactgggggcttccgagggtctccctcgaccctctgtcgtcctgggatggctgtcgggagctgtatcacctgggttctgtcccctggctctgtatcaggcactttattaaagctgggcctcagtggggtgtgtttgtctcctgctcttctggagcctggaaggaaagggcttcaggaggaggctgtgaggctggagggaccagatggaggaggccagcagctagccattgcacactggggtgatgggtgggggcggtgactgccccagacttggttttgtaatgatttgtacaggaataaacacacctacgctccg

SEQ ID NO: 365948 - DNA, 2509 bp, Homo sapiens
aggcctgggccgggccgtgacggcggcgctaggacccggcgggccgcgggtgcggcgaggcctgggcggcctgaggagcgcggaccccggcgctcggctcccggcgccatgtgagggggctcgggggccgcggggggccgggcgctccccgccggaggtgtgaacccacatccctgcccccagggccacctgcaggacgccgacacctacccctcagcagacgccggagagaaatgagtagcaacaaagagcagcggtcagcagtgttcgtgatcctctttgccctcatcaccatcctcatcctctacagctccaacagtgccaatgaggtcttccattacggctccctgcggggccgtagccgccgacctgtcaacctcaagaagtggagcatcactgacggctatgtccccattctcggcaacaagacactgccctctcggtgccaccagtgtgtgattgtcagcagctccagccacctgctgggcaccaagctgggccctgagatcgagcgggctgagtgtacaatccgcatgaatgatgcacccaccactggctactcagctgatgtgggcaacaagaccacctaccgcgtcgtggcccattccagtgtgttccgcgtgctgaggaggccccaggagtttgtcaaccggacccctgaaaccgtgttcatcttctgggggcccccgagcaagatgcagaagccccagggcagcctcgtgcgtgtgatccagcgagcgggcctggtgttccccaacatggaagcatatgccgtctctcccggccgcatgcggcaatttgacgacctcttccggggtgagacgggcaaggacagggagaagtctcattcgtggttgagcacaggctggtttaccatggtgatcgcggtggagttgtgtgaccacgtgcatgtctatggcatggtcccccccaactactgcagccagcggccccgcctccagcgcatgccctaccactactacgagcccaaggggccggacgaatgtgtcacctacatccagaatgagcacagtcgcaagggcaaccaccaccgcttcatcaccgagaaaagggtcttctcatcgtgggcccagctgtatggcatcaccttctcccacccctcctggacctaggccacccagcctgtgggacctcaggagggtcagaggagaagcagcctccgcccagccgctaggccagggaccatcttctggccaatcaaggcttgctggagtgtctcccagccaatcagggccttgaggaggatgtatcctccagccaatcagggcctggggaatctgttggcgaatcagggatttgggagtctatgtggttaatcaggggtgtctttcttgtgcagtcagggtctgcgcacagtcaatcagggtagagggggtatttctgagtcaatctgaggctaaggacatgtcctttcccatgaggccttggttcagagccccaggaatggaccccccaatcactccccactctgctgggataatggggtcctgtcccaaggagctgggaacttggtgttgccccctcaatttccagcaccagaaagagagattgtgtgggggtagaagctgtctggaggcccggccagagaatttgtggggttgtggaggttgtgggggcggtggggaggtcccagaggtgggaggctggcatccaggtcttggctctgccctgagaccttggacaaacccttccccctctctgggcacccttctgcccacaccagtttccagtgcggagtctgagaccctttccacctcccctacaagtgccctcgggtctgtcctccccgtctggaccctcccagccactatcccttgctggaaggctcagctctttggggggtctggggtgacctccccacctcctggaaaactttagggtatttttgcgcaaactccttcagggttgggggactctgaaggaaacgggacaaaaccttaagctgttttcttagcccctcagccagctgccattagcttggctcttaaagggccaggcctccttttctgccctctagcagggaggttttccaactgttggaggcgcctttggggctgcccctttgtctggagtcactgggggcttccgagggtctccctcgaccctctgtcgtcctgggatggctgtcgggagctgtatcacctgggttctgtcccctggctctgtatcaggcactttattaaagctgggcctcagtggggtgtgtttgtctcctgctcttctggagcctggaaggaaagggcttcaggaggaggctgtgaggctggagggaccagatggaggaggccagcagctagccattgcacactggggtgatgggtgggggcggtgactgccccagacttggttttgtaatgatttgtacaggaataaacacacctacgctccggcttcgtgtcctgtgtcacctgggtcgagcacagccttctggtccagcgctgcatgcggcctcaggaccacgtcttccggttgggggctcccagtaaag

SEQ ID NO: 365949 - DNA, 2476 bp, Homo sapiens
ccaggcagatggagatgatccttgacaggtctggtggctggttcggggtctactgaaggctgtcttgatcaggaaactgaagactctctgcttttgccacagcagttcctgcagcttccttgaggtgtgaacccacatccctgcccccagggccacctgcaggacgccgacacctacccctcagcagacgccggagagaaatgagtagcaacaaagagcagcggtcagcagtgttcgtgatcctctttgccctcatcaccatcctcatcctctacagctccaacagtgccaatgaggtcttccattacggctccctgcggggccgtagccgccgacctgtcaacctcaagaagtggagcatcactgacggctatgtccccattctcggcaacaagacactgccctctcggtgccaccagtgtgtgattgtcagcagctccagccacctgctgggcaccaagctgggccctgagatcgagcgggctgagtgtacaatccgcatgaatgatgcacccaccactggctactcagctgatgtgggcaacaagaccacctaccgcgtcgtggcccattccagtgtgttccgcgtgctgaggaggccccaggagtttgtcaaccggacccctgaaaccgtgttcatcttctgggggcccccgagcaagatgcagaagccccagggcagcctcgtgcgtgtgatccagcgagcgggcctggtgttccccaacatggaagcatatgccgtctctcccggccgcatgcggcaatttgacgacctcttccggggtgagacgggcaaggacagggagaagtctcattcgtggttgagcacaggctggtttaccatggtgatcgcggtggagttgtgtgaccacgtgcatgtctatggcatggtcccccccaactactgcagccagcggccccgcctccagcgcatgccctaccactactacgagcccaaggggccggacgaatgtgtcacctacatccagaatgagcacagtcgcaagggcaaccaccaccgcttcatcaccgagaaaagggtcttctcatcgtgggcccagctgtatggcatcaccttctcccacccctcctggacctaggccacccagcctgtgggacctcaggagggtcagaggagaagcagcctccgcccagccgctaggccagggaccatcttctggccaatcaaggcttgctggagtgtctcccagccaatcagggccttgaggaggatgtatcctccagccaatcagggcctggggaatctgttggcgaatcagggatttgggagtctatgtggttaatcaggggtgtctttcttgtgcagtcagggtctgcgcacagtcaatcagggtagagggggtatttctgagtcaatctgaggctaaggacatgtcctttcccatgaggccttggttcagagccccaggaatggaccccccaatcactccccactctgctgggataatggggtcctgtcccaaggagctgggaacttggtgttgccccctcaatttccagcaccagaaagagagattgtgtgggggtagaagctgtctggaggcccggccagagaatttgtggggttgtggaggttgtgggggcggtggggaggtcccagaggtgggaggctggcatccaggtcttggctctgccctgagaccttggacaaacccttccccctctctgggcacccttctgcccacaccagtttccagtgcggagtctgagaccctttccacctcccctacaagtgccctcgggtctgtcctccccgtctggaccctcccagccactatcccttgctggaaggctcagctctttggggggtctggggtgacctccccacctcctggaaaactttagggtatttttgcgcaaactccttcagggttgggggactctgaaggaaacgggacaaaaccttaagctgttttcttagcccctcagccagctgccattagcttggctcttaaagggccaggcctccttttctgccctctagcagggaggttttccaactgttggaggcgcctttggggctgcccctttgtctggagtcactgggggcttccgagggtctccctcgaccctctgtcgtcctgggatggctgtcgggagctgtatcacctgggttctgtcccctggctctgtatcaggcactttattaaagctgggcctcagtggggtgtgtttgtctcctgctcttctggagcctggaaggaaagggcttcaggaggaggctgtgaggctggagggaccagatggaggaggccagcagctagccattgcacactggggtgatgggtgggggcggtgactgccccagacttggttttgtaatgatttgtacaggaataaacacacctacgctccggcttcgtgtcctgtgtcacctgggtcgagcacagccttctggtccagcgctgcatgcggcctcaggaccacgtcttccggttgggggctcccagtaaag

SEQ ID NO: 365950 - DNA, 2486 bp, Homo sapiens
  misc_feature (2474)..(2474): n is a, c, g, or t
aggcctgggccgggccgtgacggcggcgctaggacccggcgggccgcgggtgcggcgaggcctgggcggcctgaggagcgcggaccccggcgctcggctcccggcgccatgtgagggggctcgggggccgcggggggccgggcgctccccgccggagatgaggaaactgaggctcagagaggtcacatggcttgctcgaggccccccagccagtgtgaacccacatccctgcccccagggccacctgcaggacgccgacacctacccctcagcagacgccggagagaaatgagtagcaacaaagagcagcggtcagcagtgttcgtgatcctctttgccctcatcaccatcctcatcctctacagctccaacagtgccaatgaggtcttccattacggctccctgcggggccgtagccgccgacctgtcaacctcaagaagtggagcatcactgacggctatgtccccattctcggcaacaagacactgccctctcggtgccaccagtgtgtgattgtcagcagctccagccacctgctgggcaccaagctgggccctgagatcgagcgggctgagtgtacaatccgcatgaatgatgcacccaccactggctactcagctgatgtgggcaacaagaccacctaccgcgtcgtggcccattccagtgtgttccgcgtgctgaggaggccccaggagtttgtcaaccggacccctgaaaccgtgttcatcttctgggggcccccgagcaagatgcagaagccccagggcagcctcgtgcgtgtgatccagcgagcgggcctggtgttccccaacatggaagcatatgccgtctctcccggccgcatgcggcaatttgacgacctcttccggggtgagacgggcaaggacagggagaagtctcattcgtggttgagcacaggctggtttaccatggtgatcgcggtggagttgtgtgaccacgtgcatgtctatggcatggtcccccccaactactgcagccagcggccccgcctccagcgcatgccctaccactactacgagcccaaggggccggacgaatgtgtcacctacatccagaatgagcacagtcgcaagggcaaccaccaccgcttcatcaccgagaaaagggtcttctcatcgtgggcccagctgtatggcatcaccttctcccacccctcctggacctaggccacccagcctgtgggacctcaggagggtcagaggagaagcagcctccgcccagccgctaggccagggaccatcttctggccaatcaaggcttgctggagtgtctcccagccaatcagggccttgaggaggatgtatcctccagccaatcagggcctggggaatctgttggcgaatcagggatttgggagtctatgtggttaatcaggggtgtctttcttgtgcagtcagggtctgcgcacagtcaatcagggtagagggggtatttctgagtcaatctgaggctaaggacatgtcctttcccatgaggccttggttcagagccccaggaatggaccccccaatcactccccactctgctgggataatggggtcctgtcccaaggagctgggaacttggtgttgccccctcaatttccagcaccagaaagagagattgtgtgggggtagaagctgtctggaggcccggccagagaatttgtggggttgtggaggttgtgggggcggtggggaggtcccagaggtgggaggctggcatccaggtcttggctctgccctgagaccttggacaaacccttccccctctctgggcacccttctgcccacaccagtttccagtgcggagtctgagaccctttccacctcccctacaagtgccctcgggtctgtcctccccgtctggaccctcccagccactatcccttgctggaaggctcagctctttggggggtctggggtgacctccccacctcctggaaaactttagggtatttttgcgcaaactccttcagggttgggggactctgaaggaaacgggacaaaaccttaagctgttttcttagcccctcagccagctgccattagcttggctcttaaagggccaggcctccttttctgccctctagcagggaggttttccaactgttggaggcgcctttggggctgcccctttgtctggagtcactgggggcttccgagggtctccctcgaccctctgtcgtcctgggatggctgtcgggagctgtatcacctgggttctgtcccctggctctgtatcaggcactttattaaagctgggcctcagtggggtgtgtttgtctcctgctcttctggagcctggaaggaaagggcttcaggaggaggctgtgaggctggagggaccagatggaggaggccagcagctagccattgcacactggggtgatgggtgggggcggtgactgccccagacttggttttgtaatgatttgtacaggaataaacacacctacgctccgaaaaacaanaaaaaaaacaac

SEQ ID NO: 365951 - DNA, 2502 bp, Homo sapiens
aggcctgggccgggccgtgacggcggcgctaggacccggcgggccgcgggtgcggcgaggcctgggcggcctgaggagcgcggaccccggcgctcggctcccggcgccatgtgagggggctcgggggccgcggggggccgggcgctccccgccggagatgaggaaactgaggctcagagaggtcacatggcttgctcgaggccccccagccagtgtgaacccacatccctgcccccagggccacctgcaggacgccgacacctacccctcagcagacgccggagagaaatgagtagcaacaaactccaacagtgccaatgaggtcttccattacggctccctgcggggccgtagccgccgacctgtcaacctcaagaagtggagcatcactgacggctatgtccccattctcggcaacaagacactgccctctcggtgccaccagtgtgtgattgtcagcagctccagccacctgctgggcaccaagctgggccctgagatcgagcgggctgagtgtacaatccgcatgaatgatgcacccaccactggctactcagctgatgtgggcaacaagaccacctaccgcgtcgtggcccattccagtgtgttccgcgtgctgaggaggccccaggagtttgtcaaccggacccctgaaaccgtgttcatcttctgggggcccccgagcaagatgcagaagccccagggcagcctcgtgcgtgtgatccagcgagcgggcctggtgttccccaacatggaagcatatgccgtctctcccggccgcatgcggcaatttgacgacctcttccggggtgagacgggcaaggacagggagaagtctcattcgtggttgagcacaggctggtttaccatggtgatcgcggtggagttgtgtgaccacgtgcatgtctatggcatggtcccccccaactactgcagccagcggccccgcctccagcgcatgccctaccactactacgagcccaaggggccggacgaatgtgtcacctacatccagaatgagcacagtcgcaagggcaaccaccaccgcttcatcaccgagaaaagggtcttctcatcgtgggcccagctgtatggcatcaccttctcccacccctcctggacctaggccacccagcctgtgggacctcaggagggtcagaggagaagcagcctccgcccagccgctaggccagggaccatcttctggccaatcaaggcttgctggagtgtctcccagccaatcagggccttgaggaggatgtatcctccagccaatcagggcctggggaatctgttggcgaatcagggatttgggagtctatgtggttaatcaggggtgtctttcttgtgcagtcagggtctgcgcacagtcaatcagggtagagggggtatttctgagtcaatctgaggctaaggacatgtcctttcccatgaggccttggttcagagccccaggaatggaccccccaatcactccccactctgctgggataatggggtcctgtcccaaggagctgggaacttggtgttgccccctcaatttccagcaccagaaagagagattgtgtgggggtagaagctgtctggaggcccggccagagaatttgtggggttgtggaggttgtgggggcggtggggaggtcccagaggtgggaggctggcatccaggtcttggctctgccctgagaccttggacaaacccttccccctctctgggcacccttctgcccacaccagtttccagtgcggagtctgagaccctttccacctcccctacaagtgccctcgggtctgtcctccccgtctggaccctcccagccactatcccttgctggaaggctcagctctttggggggtctggggtgacctccccacctcctggaaaactttagggtatttttgcgcaaactccttcagggttgggggactctgaaggaaacgggacaaaaccttaagctgttttcttagcccctcagccagctgccattagcttggctcttaaagggccaggcctccttttctgccctctagcagggaggttttccaactgttggaggcgcctttggggctgcccctttgtctggagtcactgggggcttccgagggtctccctcgaccctctgtcgtcctgggatggctgtcgggagctgtatcacctgggttctgtcccctggctctgtatcaggcactttattaaagctgggcctcagtggggtgtgtttgtctcctgctcttctggagcctggaaggaaagggcttcaggaggaggctgtgaggctggagggaccagatggaggaggccagcagctagccattgcacactggggtgatgggtgggggcggtgactgccccagacttggttttgtaatgatttgtacaggaataaacacacctacgctccggcttcgtgtcctgtgtcacctgggtcgagcacagccttctggtccagcgctgcatgcggcctcaggaccacgtcttccggttgggggctcccagtaaag

SEQ ID NO: 365952 - DNA, 2436 bp, Homo sapiens
aggcctgggccgggccgtgacggcggcgctaggacccggcgggccgcgggtgcggcgaggcctgggcggcctgaggagcgcggaccccggcgctcggctcccggcgccatgtgagggggctcgggggccgcggggggccgggcgctccccgccggagatgaggaaactgaggctcagagaggtcacatggcttgctcgaggccccccagccagtgtgaacccacatccctgcccccagggccacctgcaggacgccgacacctacccctcagcagacgccggagagaaatgagtagcaacaaagagcagcggtcagcagtgttcgtgatcctctttgccctcatcaccatcctcatcctctacagctccaacagtgccaatgaggtcttccattacggctccctgcggggccgtagccgccgacctgtcaacctcaagaagtggagcatcactgacggctatgtccccattctcggcaacaagacactgccctctcggtgccaccagtgtgtgattgtcagcagctccagccacctgctgggcaccaagctgggccctgagatcgagcgggctgagtgtacaatccgcatgaatgatgcacccaccactggctactcagctgatgtgggcaacaagaccacctaccgcgtcgtggcccattccagtgtgttccgcgtgctgaggaggccccaggagtttgtcaaccggacccctgaaaccgtgttcatcttctgggggcccccgagcaagatgcagaagccccagggcagcctcgtgcgtgtgatccagcgagcgggcctggtgttccccaacatggaagcatatgccgtctctcccggccgcatgcggcaatttgacgacctcttccggggtgagacgggcaaggacagggagaagtctcattcgtggttgagcacaggctggtttaccatggtgatcgcggtggagttgtgtgaccacgtgcatgtctatggcatggtcccccccaactactgcagccagcggccccgcctccagcgcatgccctaccactactacgagcccaaggggccggacgaatgtgtcacctacatccagaatgagcacagtcgcaagggcaaccaccaccgcttcatcaccgagaaaagggtcttctcatcgtgggcccagctgtatggcatcaccttctcccacccctcctggacctaggccacccagcctgtgggacctcaggagggtcagaggagaagcagcctccgcccagccgctaggccagggaccatcttctggccaatcaaggcttgctggagtgtctcccagccaatcagggccttgaggaggatgtatcctccagccaatcagggcctggggaatctgttggcgaatcagggatttgggagtctatgtggttaatcaggggtgtctttcttgtgcagtcagggtctgcgcacagtcaatcagggtagagggggtatttctgagtcaatctgaggctaaggacatgtcctttcccatgaggccttggttcagagccccaggaatggaccccccaatcactccccactctgctgggataatggggtcctgtcccaaggagctgggaacttggtgttgccccctcaatttccagcaccagaaagagagattgtgtgggggtagaagctgtctggaggcccggccagagaatttgtggggttgtggaggttgtgggggcggtggggaggtcccagaggtgggaggctggcatccaggtcttggctctgccctgagaccttggacaaacccttccccctctctgggcacccttctgcccacaccagtttccagtgcggagtctgagaccctttccacctcccctacaagtgccctcgggtctgtcctccccgtctggaccctcccagccactatcccttgctggaaggctcagctctttggggggtctggggtgacctccccacctcctggaaaactttagggtatttttgcgcaaactccttcagggttgggggactctgaaggaaacgggacaaaaccttaagctgttttcttagcccctcagccagctgccacttttctgccctctagcagggaggttttccaactgttggaggcgcctttggggctgcccctttgtctggagtcactgggggcttccgagggtctccctcgaccctctgtcgtcctgggatggctgtcgggagctgtatcacctgggttctgtcccctggctctgtatcaggcactttattaaagctgggcctcagtggggtgtgtttgtctcctgctcttctggagcctggaaggaaagggcttcaggaggaggctgtgaggctggagggaccagatggaggaggccagcagctagccattgcacactggggtgatgggtgggggcggtgactgccccagacttggttttgtaatgatttgtacaggaataaacacacctacgctccg

SEQ ID NO: 365953 - DNA, 1417 bp, Homo sapiens
aggcctgggccgggccgtgacggcggcgctaggacccggcgggccgcgggtgcggcgaggcctgggcggcctgaggagcgcggaccccggcgctcggctcccggcgccatgtgagggggctcgggggccgcggggggccgggcgctccccgccggagatgaggaaactgaggctcagagaggtcacatggcttgctcgaggccccccagccagtgtgaacccacatccctgcccccagggccacctgcaggacgccgacacctacccctcagcagacgccggagagaaatgagtagcaacaaagagcagcggtcagcagtgttcgtgatcctctttgccctcatcaccatcctcatcctctacagctccaacagtgccaatgaggtcttccattacggctccctgcggggccgtagccgccgacctgtcaacctcaagaagtggagcatcactgacggctatgtccccattctcggcaacaagacactgccctctcggtgccaccagtgtgtgattgtcagcagctccagccacctgctgggcaccaagctgggccctgagatcgagcgggctgagtgtacaatccgcatgaatgatgcacccaccactggctactcagctgatgtgggcaacaagaccacctaccgcgtcgtggcccattccagtgtgttccgcgtgctgaggaggccccaggagtttgtcaaccggacccctgaaaccgtgttcatcttctgggggcccccgagcaagatgcagaagccccagggcagcctcgtgcgtgtgatccagcgagcgggcctggtgttccccaacatggaagcatatgccgtctctcccggccgcatgcggcaatttgacgacctcttccggggtgagacgggcaaggacagggagaagtctcattcgtggttgagcacaggctggtttaccatggtgatcgcggtggagttgtgtgaccacgtgcatgtctatggcatggtcccccccaactactgcagccagcggccccgcctccagcgcatgccctaccactactacgagcccaaggggccggacgaatgtgtcacctacatccagaatgagcacagtcgcaagggcaaccaccaccgcttcatcaccgagaaaagggtcttctcatcgtgggcccagctgtatggcatcaccttctcccacccctcctggacctaggccacccagcctgtgggacctcaggagggtcagaggagaagcagcctcgccagcgtagcagacatttctggcatcagttgtggggttctccagcattggctgagagtgtgtctcagcatcaggctgggaactgtgggaccagtgggcacggggacacggggttgggggggggccgccccggagggttcggcaccggggagccgggggtaaccgagcctcccgggtagcc

SEQ ID NO: 365954 - DNA, 698 bp, Homo sapiens
aggcctgggccgggccgtgacggcggcgctaggacccggcgggccgcgggtgcggcgaggcctgggcggcctgaggagcgcggaccccggcgctcggctcccggcgccatgtgagggggctcgggggccgcggggggccgggcgctccccgccggaggtgtgaacccacatccctgcccccagggccacctgcaggacgccgacacctacccctcagcagacgccggagagaaatgagtagcaacaaagagcagcggtcagcagtgttcgtgatcctctttgccctcatcaccatcctcatcctctacagcttttctgccctctagcagggaggttttccaactgttggaggcgcctttggggctgcccctttgtctggagtcactgggggcttccgagggtctccctcgaccctctgtcgtcctgggatggctgtcgggagctgtatcacctgggttctgtcccctggctctgtatcaggcactttattaaagctgggcctcagtggggtgtgtttgtctcctgctcttctggagcctggaaggaaagggcttcaggaggaggctgtgaggctggagggaccagatggaggaggccagcagctagccattgcacactggggtgatgggtgggggcggtgactgccccagacttggttttgtaatgatttgtacaggaataaacacacctacgctccg

SEQ ID NO: 365955 - DNA, 575 bp, Homo sapiens
catattggccaggctggtctggatctcttcacctagtgatctgcccacctcggcctcccaaagggctgggattacagacgtgagccaccgcgcccggccaatgtgggagcactttcaagccccgcgtgtcccttgccacatctgcttgaatccttccaacaaccccttgagttaccgactcttattgttcccatttcacagatgaggaaactgaggctcagagaggtcacatggcttgctcgaggccccccagccagtaagtggtgaaaccgggattcgcactggcagctgacatgctgtactgaccatggccttctcagagcaggattgtgacggggcggaccagggggacggtggtcctggctgagggcacagctcgggcaaaggtgggaaagtgggcggcgggcagggggcatccgcaggaaagggtggccacgcgtagtaagatataggcggctggacccctgggcgccttgaatgccaaggtctcagggcagatggggccaccccaggattctggactcctgtcttttgctctaacggtctgtgagggcaagaacaagccgctccctgct

SEQ ID NO: 365956 - DNA, 2564 bp, Homo sapiens
aggcctgggccgggccgtgacggcggcgctaggacccggcgggccgcgggtgcggcgaggcctgggcggcctgaggagcgcggaccccggcgctcggctcccggcgccatgtgagggggctcgggggccgcggggggccgggcgctccccgccggagatgaggaaactgaggctcagagaggtcacatggcttgctcgaggccccccagccagtgtgaacccacatccctgcccccagggccacctgcaggacgccgacacctacccctcagcagacgccggagagaaatgagtagcaacaaagagcagcggtcagcagtgttcgtgatcctctttgccctcatcaccatcctcatcctctacagctccaacagtgccaatgaggtcttccattacggctccctgcggggccgtagccgccgacctgtcaacctcaagaagtggagcatcactgacggctatgtccccattctcggcaacaagacactgccctctcggtgccaccagtgtgtgattgtcagcagctccagccacctgctgggcaccaagctgggccctgagatcgagcgggctgagtgtacaatccgcatgaatgatgcacccaccactggctactcagctgatgtgggcaacaagaccacctaccgcgtcgtggcccattccagtgtgttccgcgtgctgaggaggccccaggagtttgtcaaccggacccctgaaaccgtgttcatcttctgggggcccccgagcaagatgcagaagccccagggcagcctcgtgcgtgtgatccagcgagcgggcctggtgttccccaacatggaagcatatgccgtctctcccggccgcatgcggcaatttgacgacctcttccggggtgagacgggcaaggacagggagaagtctcattcgtggttgagcacaggctggtttaccatggtgatcgcggtggagttgtgtgaccacgtgcatgtctatggcatggtcccccccaactactgcagccagcggccccgcctccagcgcatgccctaccactactacgagcccaaggggccggacgaatgtgtcacctacatccagaatgagcacagtcgcaagggcaaccaccaccgcttcatcaccgagaaaagggtcttctcatcgtgggcccagctgtatggcatcaccttctcccacccctcctggacctaggccacccagcctgtgggacctcaggagggtcagaggagaagcagcctccgcccagccgctaggccagggaccatcttctggccaatcaaggcttgctggagtgtctcccagccaatcagggccttgaggaggatgtatcctccagccaatcagggcctggggaatctgttggcgaatcagggatttgggagtctatgtggttaatcaggggtgtctttcttgtgcagtcagggtctgcgcacagtcaatcagggtagagggggtatttctgagtcaatctgaggctaaggacatgtcctttcccatgaggccttggttcagagccccaggaatggaccccccaatcactccccactctgctgggataatggggtcctgtcccaaggagctgggaacttggtgttgccccctcaatttccagcaccagaaagagagattgtgtgggggtagaagctgtctggaggcccggccagagaatttgtggggttgtggaggttgtgggggcggtggggaggtcccagaggtgggaggctggcatccaggtcttggctctgccctgagaccttggacaaacccttccccctctctgggcacccttctgcccacaccagtttccagtgcggagtctgagaccctttccacctcccctacaagtgccctcgggtctgtcctccccgtctggaccctcccagccactatcccttgctggaaggctcagctctttggggggtctggggtgacctccccacctcctggaaaactttagggtatttttgcgcaaactccttcagggttgggggactctgaaggaaacgggacaaaaccttaagctgttttcttagcccctcagccagctgccattagcttggctcttaaagggccaggcctccttttctgccctctagcagggaggttttccaactgttggaggcgcctttggggctgcccctttgtctggagtcactgggggcttccgagggtctccctcgaccctctgtcgtcctgggatggctgtcgggagctgtatcacctgggttctgtcccctggctctgtatcaggcactttattaaagctgggcctcagtggggtgtgtttgtctcctgctcttctggagcctggaaggaaagggcttcaggaggaggctgtgaggctggagggaccagatggaggaggccagcagctagccattgcacactggggtgatgggtgggggcggtgactgccccagacttggttttgtaatgatttgtacaggaataaacacacctacgctccggcttcgtgtcctgtgtcacctgggtcgagcacagccttctggtccagcgctgcatgcggcctcaggaccacgtcttccggttgggggctcccagtaaag

SEQ ID NO: 365957 - DNA, 2410 bp, Homo sapiens
aggcctgggccgggccgtgacggcggcgctaggacccggcgggccgcgggtgcggcgaggcctgggcggcctgaggagcgcggaccccggcgctcggctcccggcgccatgtgagggggctcgggggccgcggggggccgggcgctccccgccggaggtgtgaacccacatccctgcccccagggccacctgcaggacgccgacacctacccctcagcagacgccggagagaaatgagtagcaacaaagagcagcggtcagcagtgttcgtgatcctctttgccctcatcaccatcctcatcctctacagctccaacagtgccaatgaggtcttccattacggctccctgcggggccgtagccgccgacctgtcaacctcaagaagtggagcatcactgacggctatgtccccattctcggcaacaagacactgccctctcggtgccaccagtgtgtgattgtcagcagctccagccacctgctgggcaccaagctgggccctgagatcgagcgggctgagtgtacaatccgcatgaatgatgcacccaccactggctactcagctgatgtgggcaacaagaccacctaccgcgtcgtggcccattccagtgtgttccgcgtgctgaggaggccccaggagtttgtcaaccggacccctgaaaccgtgttcatcttctgggggcccccgagcaagatgcagaagccccagggcagcctcgtgcgtgtgatccagcgagcgggcctggtgttccccaacatggaagcatatgccgtctctcccggccgcatgcggcaatttgacgacctcttccggggtgagacgggcaaggacagggagaagtctcattcgtggttgagcacaggctggtttaccatggtgatcgcggtggagttgtgtgaccacgtgcatgtctatggcatggtcccccccaactactgcagccagcggccccgcctccagcgcatgccctaccactactacgagcccaaggggccggacgaatgtgtcacctacatccagaatgagcacagtcgcaagggcaaccaccaccgcttcatcaccgagaaaagggtcttctcatcgtgggcccagctgtatggcatcaccttctcccacccctcctggacctaggccacccagcctgtgggacctcaggagggtcagaggagaagcagcctccgcccagccgctaggccagggaccatcttctggccaatcaaggcttgctggagtgtctcccagccaatcagggccttgaggaggatgtatcctccagccaatcagggcctggggaatctgttggcgaatcagggatttgggagtctatgtggttaatcaggggtgtctttcttgtgcagtcagggtctgcgcacagtcaatcagggtagagggggtatttctgagtcaatctgaggctaaggacatgtcctttcccatgaggccttggttcagagccccaggaatggaccccccaatcactccccactctgctgggataatggggtcctgtcccaaggagctgggaacttggtgttgccccctcaatttccagcaccagaaagagagattgtgtgggggtagaagctgtctggaggcccggccagagaatttgtggggttgtggaggttgtgggggcggtggggaggtcccagaggtgggaggctggcatccaggtcttggctctgccctgagaccttggacaaacccttccccctctctgggcacccttctgcccacaccagtttccagtgcggagtctgagaccctttccacctcccctacaagtgccctcgggtctgtcctccccgtctggaccctcccagccactatcccttgctggaaggctcagctctttggggggtctggggtgacctccccacctcctggaaaactttagggtatttttgcgcaaactccttcagggttgggggactctgaaggaaacgggacaaaaccttaagctgttttcttagcccctcagccagctgccattagcttggctcttaaagggccaggcctccttttctgccctctagcagggaggttttccaactgttggaggcgcctttggggctgcccctttgtctggagtcactgggggcttccgagggtctccctcgaccctctgtcgtcctgggatggctgtcgggagctgtatcacctgggttctgtcccctggctctgtatcaggcactttattaaagctgggcctcagtggggtgtgtttgtctcctgctcttctggagcctggaaggaaagggcttcaggaggaggctgtgaggctggagggaccagatggaggaggccagcagctagccattgcacactggggtgatgggtgggggcggtgactgccccagacttggttttgtaatgatttgtacaggaataaacacacctacgctccg

SEQ ID NO: 365958 - DNA, 2528 bp, Homo sapiens
  misc_feature (2516)..(2516): n is a, c, g, or t
aggcctgggccgggccgtgacggcggcgctaggacccggcgggccgcgggtgcggcgaggcctgggcggcctgaggagcgcggaccccggcgctcggctcccggcgccatgtgagggggctcgggggccgcggggggccgggcgctccccgccggagatgaggaaactgaggctcagagaggtcacatggcttgctcgaggccccccagccagtgtgaacccacatccctgcccccagggccacctgcaggacgccgacacctacccctcagcagacgccggagagaaatgagtagcaacaaagagcagcggtcagcagtgttcgtgatcctctttgccctcatcaccatcctcatcctctacagctccaacagtgccaatgaggtcttccattacggctccctgcggggccgtagccgccgacctgtcaacctcaagaagtggagcatcactgacggctatgtccccattctcggcaacaagacactgccctctcggtgccaccagtgtgtgattgtcagcagctccagccacctgctgggcaccaagctgggccctgagatcgagcgggctgagtgtacaatccgcatgaatgatgcacccaccactggctactcagctgatgtgggcaacaagaccacctaccgcgtcgtggcccattccagtgtgttccgcgtgctgaggaggccccaggagtttgtcaaccggacccctgaaaccgtgttcatcttctgggggcccccgagcaagatgcagaagccccagggcagcctcgtgcgtgtgatccagcgagcgggcctggtgttccccaacatggaagcatatgccgtctctcccggccgcatgcggcaatttgacgacctcttccggggtgagacgggcaaggacagggagaagtctcattcgtggttgagcacaggctggtttaccatggtgatcgcggtggagttgtgtgaccacgtgcatgtctatggcatggtcccccccaactactgcagccagcggccccgcctccagcgcatgccctaccactactacgagcccaaggggccggacgaatgtgtcacctacatccagaatgagcacagtcgcaagggcaaccaccaccgcttcatcaccgagaaaagggtcttctcatcgtgggcccagctgtatggcatcaccttctcccacccctcctggacctaggccacccagcctgtgggacctcaggagggtcagaggagaagcagcctccgcccagccgctaggccagggaccatcttctggccaatcaaggcttgctggagtgtctcccagccaatcagggccttgaggaggatgtatcctccagccaatcagggcctggggaatctgttggcgaatcagggatttgggagtctatgtggttaatcaggggtgtctttcttgtgcagtcagggtctgcgcacagtcaatcagggtagagggggtatttctgagtcaatctgaggctaaggacatgtcctttcccatgaggccttggttcagagccccaggaatggaccccccaatcactccccactctgctgggataatggggtcctgtcccaaggagctgggaacttggtgttgccccctcaatttccagcaccagaaagagagattgtgtgggggtagaagctgtctggaggcccggccagagaatttgtggggttgtggaggttgtgggggcggtggggaggtcccagaggtgggaggctggcatccaggtcttggctctgccctgagaccttggacaaacccttccccctctctgggcacccttctgcccacaccagtttccagtgcggagtctgagaccctttccacctcccctacaagtgccctcgggtctgtcctccccgtctggaccctcccagccactatcccttgctggaaggctcagctctttggggggtctggggtgacctccccacctcctggaaaactttagggtatttttgcgcaaactccttcagggttgggggactctgaaggaaacgggacaaaaccttaagctgttttcttagcccctcagccagctgccattagcttggctcttaaagggccaggcctccttttctgccctctagcagggaggttttccaactgttggaggcgcctttggggctgcccctttgtctggagtcactgggggcttccgagggtctccctcgaccctctgtcgtcctgggatggctgtcgggagctgtatcacctgggttctgtcccctggctctgtatcaggcactttattaaagctgggcctcagtggggtgtgtttgtctcctgctcttctggagcctggaaggaaagggcttcaggaggaggctgtgaggctggagggaccagatggaggaggccagcagctagccattgcacactggggtgatgggtgggggcggtgactgccccagacttggttttgtaatgatttgtacaggaataaacacacctacgctccgaaaaaaaaaaaaaaaaaaaaaaaaaaaaaaaaaaaaaaaaaaaaaaacaanaaaaaaaacaac

SEQ ID NO: 365959 - DNA, 2447 bp, Homo sapiens
aggcctgggccgggccgtgacggcggcgctaggacccggcgggccgcgggtgcggcgaggcctgggcggcctgaggagcgcggaccccggcgctcggctcccggcgccatgtgagggggctcgggggccgcggggggccgggcgctccccgccggaggtgtgaacccacatccctgcccccagggccacctgcaggacgccgacacctacccctcagcagacgccggagagaaatgagtagcaacaaactccaacagtgccaatgaggtcttccattacggctccctgcggggccgtagccgccgacctgtcaacctcaagaagtggagcatcactgacggctatgtccccattctcggcaacaagacactgccctctcggtgccaccagtgtgtgattgtcagcagctccagccacctgctgggcaccaagctgggccctgagatcgagcgggctgagtgtacaatccgcatgaatgatgcacccaccactggctactcagctgatgtgggcaacaagaccacctaccgcgtcgtggcccattccagtgtgttccgcgtgctgaggaggccccaggagtttgtcaaccggacccctgaaaccgtgttcatcttctgggggcccccgagcaagatgcagaagccccagggcagcctcgtgcgtgtgatccagcgagcgggcctggtgttccccaacatggaagcatatgccgtctctcccggccgcatgcggcaatttgacgacctcttccggggtgagacgggcaaggacagggagaagtctcattcgtggttgagcacaggctggtttaccatggtgatcgcggtggagttgtgtgaccacgtgcatgtctatggcatggtcccccccaactactgcagccagcggccccgcctccagcgcatgccctaccactactacgagcccaaggggccggacgaatgtgtcacctacatccagaatgagcacagtcgcaagggcaaccaccaccgcttcatcaccgagaaaagggtcttctcatcgtgggcccagctgtatggcatcaccttctcccacccctcctggacctaggccacccagcctgtgggacctcaggagggtcagaggagaagcagcctccgcccagccgctaggccagggaccatcttctggccaatcaaggcttgctggagtgtctcccagccaatcagggccttgaggaggatgtatcctccagccaatcagggcctggggaatctgttggcgaatcagggatttgggagtctatgtggttaatcaggggtgtctttcttgtgcagtcagggtctgcgcacagtcaatcagggtagagggggtatttctgagtcaatctgaggctaaggacatgtcctttcccatgaggccttggttcagagccccaggaatggaccccccaatcactccccactctgctgggataatggggtcctgtcccaaggagctgggaacttggtgttgccccctcaatttccagcaccagaaagagagattgtgtgggggtagaagctgtctggaggcccggccagagaatttgtggggttgtggaggttgtgggggcggtggggaggtcccagaggtgggaggctggcatccaggtcttggctctgccctgagaccttggacaaacccttccccctctctgggcacccttctgcccacaccagtttccagtgcggagtctgagaccctttccacctcccctacaagtgccctcgggtctgtcctccccgtctggaccctcccagccactatcccttgctggaaggctcagctctttggggggtctggggtgacctccccacctcctggaaaactttagggtatttttgcgcaaactccttcagggttgggggactctgaaggaaacgggacaaaaccttaagctgttttcttagcccctcagccagctgccattagcttggctcttaaagggccaggcctccttttctgccctctagcagggaggttttccaactgttggaggcgcctttggggctgcccctttgtctggagtcactgggggcttccgagggtctccctcgaccctctgtcgtcctgggatggctgtcgggagctgtatcacctgggttctgtcccctggctctgtatcaggcactttattaaagctgggcctcagtggggtgtgtttgtctcctgctcttctggagcctggaaggaaagggcttcaggaggaggctgtgaggctggagggaccagatggaggaggccagcagctagccattgcacactggggtgatgggtgggggcggtgactgccccagacttggttttgtaatgatttgtacaggaataaacacacctacgctccggcttcgtgtcctgtgtcacctgggtcgagcacagccttctggtccagcgctgcatgcggcctcaggaccacgtcttccggttgggggctcccagtaaag

SEQ ID NO: 365960 - DNA, 2476 bp, Homo sapiens
aggcctgggccgggccgtgacggcggcgctaggacccggcgggccgcgggtgcggcgaggcctgggcggcctgaggagcgcggaccccggcgctcggctcccggcgccatgtgagggggctcgggggccgcggggggccgggcgctccccgccggagatgaggaaactgaggctcagagaggtcacatggcttgctcgaggccccccagccagtgtgaacccacatccctgcccccagggccacctgcaggacgccgacacctacccctcagcagacgccggagagaaatgagtagcaacaaagagcagcggtcagcagtgttcgtgatcctctttgccctcatcaccatcctcatcctctacagctccaacagtgccaatgaggtcttccattacggctccctgcggggccgtagccgccgacctgtcaacctcaagaagtggagcatcactgacggctatgtccccattctcggcaacaagacactgccctctcggtgccaccagtgtgtgattgtcagcagctccagccacctgctgggcaccaagctgggccctgagatcgagcgggctgagtgtacaatccgcatgaatgatgcacccaccactggctactcagctgatgtgggcaacaagaccacctaccgcgtcgtggcccattccagtgtgttccgcgtgctgaggaggccccaggagtttgtcaaccggacccctgaaaccgtgttcatcttctgggggcccccgagcaagatgcagaagccccagggcagcctcgtgcgtgtgatccagcgagcgggcctggtgttccccaacatggaagcatatgccgtctctcccggccgcatgcggcaatttgacgacctcttccggggtgagacgggcaaggacagggagaagtctcattcgtggttgagcacaggctggtttaccatggtgatcgcggtggagttgtgtgaccacgtgcatgtctatggcatggtcccccccaactactgcagccagcggccccgcctccagcgcatgccctaccactactacgagcccaaggggccggacgaatgtgtcacctacatccagaatgagcacagtcgcaagggcaaccaccaccgcttcatcaccgagaaaagggtcttctcatcgtgggcccagctgtatggcatcaccttctcccacccctcctggacctaggccacccagcctgtgggacctcaggagggtcagaggagaagcagcctccgcccagccgctaggccagggaccatcttctggccaatcaaggcttgctggagtgtctcccagccaatcagggccttgaggaggatgtatcctccagccaatcagggcctggggaatctgttggcgaatcagggatttgggagtctatgtggttaatcaggggtgtctttcttgtgcagtcagggtctgcgcacagtcaatcagggtagagggggtatttctgagtcaatctgaggctaaggacatgtcctttcccatgaggccttggttcagagccccaggaatggaccccccaatcactccccactctgctgggataatggggtcctgtcccaaggagctgggaacttggtgttgccccctcaatttccagcaccagaaagagagattgtgtgggggtagaagctgtctggaggcccggccagagaatttgtggggttgtggaggttgtgggggcggtggggaggtcccagaggtgggaggctggcatccaggtcttggctctgccctgagaccttggacaaacccttccccctctctgggcacccttctgcccacaccagtttccagtgcggagtctgagaccctttccacctcccctacaagtgccctcgggtctgtcctccccgtctggaccctcccagccactatcccttgctggaaggctcagctctttggggggtctggggtgacctccccacctcctggaaaactttagggtatttttgcgcaaactccttcagggttgggggactctgaaggaaacgggacaaaaccttaagctgttttcttagcccctcagccagctgccattagcttggctcttaaagggccaggcctccttttctgccctctagcagggaggttttccaactgttggaggcgcctttggggctgcccctttgtctggagtcactgggggcttccgagggtctccctcgaccctctgtcgtcctgggatggctgtcgggagctgtatcacctgggttctgtcccctggctctgtatcaggcactttattaaagctgggcctcagtggggtgtgtttgtctcctgctcttctggagcctggaaggaaagggcttcaggaggaggctgtgaggctggagggaccagatggaggaggccagcagctagcccctgagttagcagctcgcccctgagttaacagctcgcccctgagttagcagctcgcccctgagttagcagctcgcccctgagttagcagctcgcccctgag

SEQ ID NO: 365961 - DNA, 2545 bp, Homo sapiens
aggcctgggccgggccgtgacggcggcgctaggacccggcgggccgcgggtgcggcgaggcctgggcggcctgaggagcgcggaccccggcgctcggctcccggcgccatgtgagggggctcgggggccgcggggggccgggcgctccccgccggagatgaggaaactgaggctcagagaggtcacatggcttgctcgaggccccccagccagtgtgaacccacatccctgcccccagggccacctgcaggacgccgacacctacccctcagcagacgccggagagaaatgagtagcaacaaagagcagcggtcagcagtgttcgtgatcctctttgccctcatcaccatcctcatcctctacagctccaacagtgccaatgaggtcttccattacggctccctgcggggccgtagccgccgacctgtcaacctcaagaagtggagcatcactgacggctatgtccccattctcggcaacaagacactgccctctcggtgccaccagtgtgtgattgtcagcagctccagccacctgctgggcaccaagctgggccctgagatcgagcgggctgagtgtacaatccgcatgaatgatgcacccaccactggctactcagctgatgtgggcaacaagaccacctaccgcgtcgtggcccattccagtgtgttccgcgtgctgaggaggccccaggagtttgtcaaccggacccctgaaaccgtgttcatcttctgggggcccccgagcaagatgcagaagccccagggcagcctcgtgcgtgtgatccagcgagcgggcctggtgttccccaacatggaagcatatgccgtctctcccggccgcatgcggcaatttgacgacctcttccgggggagaagtctcattcgtggttgagcacaggctggtttaccatggtgatcgcggtggagttgtgtgaccacgtgcatgtctatggcatggtcccccccaactactgcagccagcggccccgcctccagcgcatgccctaccactactacgagcccaaggggccggacgaatgtgtcacctacatccagaatgagcacagtcgcaagggcaaccaccaccgcttcatcaccgagaaaagggtcttctcatcgtgggcccagctgtatggcatcaccttctcccacccctcctggacctaggccacccagcctgtgggacctcaggagggtcagaggagaagcagcctccgcccagccgctaggccagggaccatcttctggccaatcaaggcttgctggagtgtctcccagccaatcagggccttgaggaggatgtatcctccagccaatcagggcctggggaatctgttggcgaatcagggatttgggagtctatgtggttaatcaggggtgtctttcttgtgcagtcagggtctgcgcacagtcaatcagggtagagggggtatttctgagtcaatctgaggctaaggacatgtcctttcccatgaggccttggttcagagccccaggaatggaccccccaatcactccccactctgctgggataatggggtcctgtcccaaggagctgggaacttggtgttgccccctcaatttccagcaccagaaagagagattgtgtgggggtagaagctgtctggaggcccggccagagaatttgtggggttgtggaggttgtgggggcggtggggaggtcccagaggtgggaggctggcatccaggtcttggctctgccctgagaccttggacaaacccttccccctctctgggcacccttctgcccacaccagtttccagtgcggagtctgagaccctttccacctcccctacaagtgccctcgggtctgtcctccccgtctggaccctcccagccactatcccttgctggaaggctcagctctttggggggtctggggtgacctccccacctcctggaaaactttagggtatttttgcgcaaactccttcagggttgggggactctgaaggaaacgggacaaaaccttaagctgttttcttagcccctcagccagctgccattagcttggctcttaaagggccaggcctccttttctgccctctagcagggaggttttccaactgttggaggcgcctttggggctgcccctttgtctggagtcactgggggcttccgagggtctccctcgaccctctgtcgtcctgggatggctgtcgggagctgtatcacctgggttctgtcccctggctctgtatcaggcactttattaaagctgggcctcagtggggtgtgtttgtctcctgctcttctggagcctggaaggaaagggcttcaggaggaggctgtgaggctggagggaccagatggaggaggccagcagctagccattgcacactggggtgatgggtgggggcggtgactgccccagacttggttttgtaatgatttgtacaggaataaacacacctacgctccggcttcgtgtcctgtgtcacctgggtcgagcacagccttctggtccagcgctgcatgcggcctcaggaccacgtcttccggttgggggctcccagtaaag

SEQ ID NO: 365962 - DNA, 2490 bp, Homo sapiens
aggcctgggccgggccgtgacggcggcgctaggacccggcgggccgcgggtgcggcgaggcctgggcggcctgaggagcgcggaccccggcgctcggctcccggcgccatgtgagggggctcgggggccgcggggggccgggcgctccccgccggaggtgtgaacccacatccctgcccccagggccacctgcaggacgccgacacctacccctcagcagacgccggagagaaatgagtagcaacaaagagcagcggtcagcagtgttcgtgatcctctttgccctcatcaccatcctcatcctctacagctccaacagtgccaatgaggtcttccattacggctccctgcggggccgtagccgccgacctgtcaacctcaagaagtggagcatcactgacggctatgtccccattctcggcaacaagacactgccctctcggtgccaccagtgtgtgattgtcagcagctccagccacctgctgggcaccaagctgggccctgagatcgagcgggctgagtgtacaatccgcatgaatgatgcacccaccactggctactcagctgatgtgggcaacaagaccacctaccgcgtcgtggcccattccagtgtgttccgcgtgctgaggaggccccaggagtttgtcaaccggacccctgaaaccgtgttcatcttctgggggcccccgagcaagatgcagaagccccagggcagcctcgtgcgtgtgatccagcgagcgggcctggtgttccccaacatggaagcatatgccgtctctcccggccgcatgcggcaatttgacgacctcttccgggggagaagtctcattcgtggttgagcacaggctggtttaccatggtgatcgcggtggagttgtgtgaccacgtgcatgtctatggcatggtcccccccaactactgcagccagcggccccgcctccagcgcatgccctaccactactacgagcccaaggggccggacgaatgtgtcacctacatccagaatgagcacagtcgcaagggcaaccaccaccgcttcatcaccgagaaaagggtcttctcatcgtgggcccagctgtatggcatcaccttctcccacccctcctggacctaggccacccagcctgtgggacctcaggagggtcagaggagaagcagcctccgcccagccgctaggccagggaccatcttctggccaatcaaggcttgctggagtgtctcccagccaatcagggccttgaggaggatgtatcctccagccaatcagggcctggggaatctgttggcgaatcagggatttgggagtctatgtggttaatcaggggtgtctttcttgtgcagtcagggtctgcgcacagtcaatcagggtagagggggtatttctgagtcaatctgaggctaaggacatgtcctttcccatgaggccttggttcagagccccaggaatggaccccccaatcactccccactctgctgggataatggggtcctgtcccaaggagctgggaacttggtgttgccccctcaatttccagcaccagaaagagagattgtgtgggggtagaagctgtctggaggcccggccagagaatttgtggggttgtggaggttgtgggggcggtggggaggtcccagaggtgggaggctggcatccaggtcttggctctgccctgagaccttggacaaacccttccccctctctgggcacccttctgcccacaccagtttccagtgcggagtctgagaccctttccacctcccctacaagtgccctcgggtctgtcctccccgtctggaccctcccagccactatcccttgctggaaggctcagctctttggggggtctggggtgacctccccacctcctggaaaactttagggtatttttgcgcaaactccttcagggttgggggactctgaaggaaacgggacaaaaccttaagctgttttcttagcccctcagccagctgccattagcttggctcttaaagggccaggcctccttttctgccctctagcagggaggttttccaactgttggaggcgcctttggggctgcccctttgtctggagtcactgggggcttccgagggtctccctcgaccctctgtcgtcctgggatggctgtcgggagctgtatcacctgggttctgtcccctggctctgtatcaggcactttattaaagctgggcctcagtggggtgtgtttgtctcctgctcttctggagcctggaaggaaagggcttcaggaggaggctgtgaggctggagggaccagatggaggaggccagcagctagccattgcacactggggtgatgggtgggggcggtgactgccccagacttggttttgtaatgatttgtacaggaataaacacacctacgctccggcttcgtgtcctgtgtcacctgggtcgagcacagccttctggtccagcgctgcatgcggcctcaggaccacgtcttccggttgggggctcccagtaaag

SEQ ID NO: 365963 - DNA, 2157 bp, Homo sapiens
aggcctgggccgggccgtgacggcggcgctaggacccggcgggccgcgggtgcggcgaggcctgggcggcctgaggagcgcggaccccggcgctcggctcccggcgccatgtgagggggctcgggggccgcggggggccgggcgctccccgccggagatgaggaaactgaggctcagagaggtcacatggcttgctcgaggccccccagccagtgtgaacccacatccctgcccccagggccacctgcaggacgccgacacctacccctcagcagacgccggagagaaatgagtagcaacaaagagcagcggtcagcagtgttcgtgatcctctttgccctcatcaccatcctcatcctctacagctccaacagtgccaatgaggtcttccattacggctccctgcggggccgtagccgccgacctgtcaacctcaagaagtggagcatcactgacggctatgtccccattctcggcaacaagggagaagtctcattcgtggttgagcacaggctggtttaccatggtgatcgcggtggagttgtgtgaccacgtgcatgtctatggcatggtcccccccaactactgcagccagcggccccgcctccagcgcatgccctaccactactacgagcccaaggggccggacgaatgtgtcacctacatccagaatgagcacagtcgcaagggcaaccaccaccgcttcatcaccgagaaaagggtcttctcatcgtgggcccagctgtatggcatcaccttctcccacccctcctggacctaggccacccagcctgtgggacctcaggagggtcagaggagaagcagcctccgcccagccgctaggccagggaccatcttctggccaatcaaggcttgctggagtgtctcccagccaatcagggccttgaggaggatgtatcctccagccaatcagggcctggggaatctgttggcgaatcagggatttgggagtctatgtggttaatcaggggtgtctttcttgtgcagtcagggtctgcgcacagtcaatcagggtagagggggtatttctgagtcaatctgaggctaaggacatgtcctttcccatgaggccttggttcagagccccaggaatggaccccccaatcactccccactctgctgggataatggggtcctgtcccaaggagctgggaacttggtgttgccccctcaatttccagcaccagaaagagagattgtgtgggggtagaagctgtctggaggcccggccagagaatttgtggggttgtggaggttgtgggggcggtggggaggtcccagaggtgggaggctggcatccaggtcttggctctgccctgagaccttggacaaacccttccccctctctgggcacccttctgcccacaccagtttccagtgcggagtctgagaccctttccacctcccctacaagtgccctcgggtctgtcctccccgtctggaccctcccagccactatcccttgctggaaggctcagctctttggggggtctggggtgacctccccacctcctggaaaactttagggtatttttgcgcaaactccttcagggttgggggactctgaaggaaacgggacaaaaccttaagctgttttcttagcccctcagccagctgccattagcttggctcttaaagggccaggcctccttttctgccctctagcagggaggttttccaactgttggaggcgcctttggggctgcccctttgtctggagtcactgggggcttccgagggtctccctcgaccctctgtcgtcctgggatggctgtcgggagctgtatcacctgggttctgtcccctggctctgtatcaggcactttattaaagctgggcctcagtggggtgtgtttgtctcctgctcttctggagcctggaaggaaagggcttcaggaggaggctgtgaggctggagggaccagatggaggaggccagcagctagccattgcacactggggtgatgggtgggggcggtgactgccccagacttggttttgtaatgatttgtacaggaataaacacacctacgctccggcttcgtgtcctgtgtcacctgggtcgagcacagccttctggtccagcgctgcatgcggcctcaggaccacgtcttccggttgggggctcccagtaaag

SEQ ID NO: 365964 - DNA, 899 bp, Homo sapiens
atttccggctcctcccggaagtgccgaagctggctactaagggaacttgggaggatcccacctcagccttcgtgactagtgaggtgcgcaaacgcccgagttttccctggtgcgcgggttccgcctttgcagtgccctccacccttcctggtgtctgacccgcctccttcccaggccttttgttcctgtcccggaaagccggcgtcctgccgcgcgatgcccctgctcggacttcttcccaggagggcctgggcttcgctgctcagccagctcctgcgaccgccctgcgcttcgtgcaccggggcggtccgttgccaaagccaggttgcagaggcagtgttaacatcccaactgaaagcacatcaagagaaaccaaattttattatcaagaccccaaagggtaccagggatcttagtcctcagcatatggttgtgagggagaaaattcttgatttggttatcagctgctttaaacgtcatggagcaaaggggatggacaccccagcatttgagctgaaggaaaccctgactgagaagtatggagaggactctgggctcatgtatgatctgaaggatcaaggtggagagctgttgtccctccgctatgaccttactgttccctttgctcgttatctggccatgaataaggtgaagaagatgaaacgttatcatgttggaaaggtgtggcggcgagagagcccaaccatagtccaaggccgttatagggagttctgccagtgtgattttgacattgctggtcagtttgaccctatgatccccgatgcagagtgtttgaagatcatgtgtgaaatcctaagtggattgcagttgggagactttctcattaagaaatgaccggcggattgtggatgggatgataacgtttcatcttcttcacc

SEQ ID NO: 365965 - DNA, 568 bp, Homo sapiens
gagatagagagaattagtcttcagagtcggatgtcctgtcctgtgctgattgcccctgtctcttacttcttcccaatgatgtcctgttgtcttcttcttgctcagccaggtccgtgaagcgacacatgacaactatctttgtcaccggggcgggccgttgccaaagcgttgcagaggcagtgttaacatcccaactgaaagcacatcaagagaaaccaaattttattatcaagaccccaaagggtaccagggatcttagtcctcagcatatggttgtgagggagaaaattcttgatttggttatcagctgctttaaacgtcatggatgcacacacgcggcgcacttgtgacaaccccaggcatttagacgcttgaaagggaaaaccgcgtggatcttgcacgaaagtactcggacgaaggcacctcttggaggcgtcaattgtacttgatcgtcgagaggcgaatcacaggcttggaagcaagccttgtatagatacccctaccgacatatgacacgttaccttgtcaccacttttgcctccgttatcttgcgcatgaatcaaggtga

SEQ ID NO: 365966 - DNA, 2394 bp, Homo sapiens
atttccggctcctcccggaagtgccgaagctggctactaagggaacttgggaggatcccacctcagccttcgtgactagtgaggtgcgcaaacgcccgagttttccctggtgcgcgggttccgcctttgcagtgccctccacccttcctggtgtctgacccgcctccttcccaggccttttgttcctgtcccggaaagccggcgtcctgccgcgcgatgcccctgctcggacttcttcccaggagggcctgggcttcgctgctcagccagctcctgcgaccgccctgcgcttcgtgcaccggggcggtccgttgccaaagccaggttgcagaggcagtgttaacatcccaactgaaagcacatcaagagaaaccaaattttattatcaagaccccaaagggtaccagggatcttagtcctcagcatatggttgtgagggagaaaattcttgatttggttatcagctgctttaaacgtcatggagcaaaggggatggacaccccagcatttgagctgaaggaaaccctgactgagaagtatggagaggactctgggctcatgtatgatctgaaggatcaaggtggagagctgttgtccctccgctatgaccttactgttccctttgctcgttatctggccatgaataaggtgaagaagatgaaacgttatcatgttggaaaggtgtggcggcgagagagcccaaccatagtccaaggccgttatagggagttctgccagtgtgattttgacattgctggtcagtttgaccctatgatccccgatgcagagtgtttgaagatcatgtgtgaaatcctaagtggattgcagttgggagactttctcattaagatggcttggaaagatgtgagacatgagatggtggtgaagaaaggcctggctcctgaggtggctgatcgaattggggactatgtccagtgtcatggtggggtatccctagtagagcaaatgtttcaggatcccagactatcccagaacaagcaggccctggagggcctgggagacctaaagctgctatttgaatacctgactttatttggaattgctgataagatctcctttgacctcagcctggctcggggcctagactactatacaggagtgatctatgaagcagtgctgctgcagaccccaactcaggctggggaggagcccctgaatgtgggcagtgtggctgctggtgggcgctatgatgggctggtgggcatgtttgaccccaagggccacaaggtgccatgtgtgggactcagcattggggttgagcgaatcttctacattgtggagcagaggatgaagaccaaaggtgagaaggtgcggactacagagactcaagtgtttgtggccacaccacagaagaactttctccaagaacggttgaagcttattgcagagctttgggattctggaatcaaggcagagatgctatacaagaacaaccccaaactattaacccagctgcactattgtgagagcacaggcattccactggtggtcattattggtgagcaagaactgaaagaaggggtcatcaagatccgttcagtggccagcagagaggaggtggccattaaacgggaaaattttgtggctgaaattcagaagcgactgtctgagtcttgatccttgcctgattcccatctgctgctctttgtagaaaaggtttcctctagaactgaattcctctggaattgagtgatggacttcacaacaactagccaggaagggtgacaagtaccttctgcctcctccattcttcctgggtgcagaactgtagaagaccctgaggactcctgggctagtgtgagcagctattctgcatgggtgcagatggctggatgtgaaagagacatgctctagctgcagaggcaaatttgaagtgccacggaacgttgtcaagaggtagtgagattgttgctgtgagcaaggctctgggagagtcacctcaggctcaggattctgaaccattgagatcagaaaccagatacttagccttctactgtagctacggaaccagattctggtgaatttgtccacaatcagccattggcctgtctggggagtttttggaagacagcaaagaggggcaatggctgctttcagctttgaggacagatgctatcctaagggcatggcagtacccatgttgatttgacatctctctagcccatccattgcttacagtagaagagtggggctgtatgcttgataatcttgaacattgaacttaatagatgacttgacaaggtagagatctgatattttgagattttggagaccatttcctgtgccagaatcactgctctattccataccgtgccatggaggctgttttagaagtggttggataacatgttaaataaaatattaagtgtagta

SEQ ID NO: 365967 - DNA, 2597 bp, Homo sapiens
atttccggctcctcccggaagtgccgaagctggctactaagggaacttgggaggatcccacctcagccttcgtgactagtgaggtgcgcaaacgcccgagttttccctggtgcgcgggttccgcctttgcagtgccctccacccttcctggtgtctgacccgcctccttcccaggccttttgttcctgtcccggaaagccggcgtcctgccgcgcgatgcccctgctcggacttcttcccaggagggcctgggcttcgctgctcagccagctcctgcgaccgccctgcgcttcgtgcaccggggcggtccgttgccaaagccaggttgcagaggcagtgttaacatcccaactgaaagcacatcaagagaaaccaaattttattatcaagaccccaaagggtaccagggatcttagtcctcagcatatggttgtgagggagaaaattcttgatttggttatcagctgctttaaacgtcatggagcaaaggggatggacaccccagcatttgagctgaaggaaaccctgactgagaagtatggagaggactctgggctcatgtatgatctgaaggatcaaggtggagagctgttgtccctccgctatgaccttactgttccctttgctcgttatctggccatgaataaggtgaagaagatgaaacgttatcatgttggaaaggtgtggcggcgagagagcccaaccatagtccaaggccgttatagggagttctgccagtgtgtaagtgacctgatgggagcagcacagtttgatagttctaggggccacaaccttgaaactggctggataatggatgttttttcccatctttttctttgctgtaggattttgacattgctggtcagtttgaccctatgatccccgatgcagagtgtttgaagatcatgtgtgaaatcctaagtggattgcagttgggagactttctcattaaggtaaatgaccggcggattgtggatgggatgtttgctgtctgtggtgttcctgaaagcaagttccgtgccatctgctcctccatagataaactagacaagatggcttggaaagatgtgagacatgagatggtggtgaagaaaggcctggctcctgaggtggctgatcgaattggggactatgtccagtgtcatggtggggtatccctagtagagcaaatgtttcaggatcccagactatcccagaacaagcaggccctggagggcctgggagacctaaagctgctatttgaatacctgactttatttggaattgctgataagatctcctttgacctcagcctggctcggggcctagactactatacaggagtgatctatgaagcagtgctgctgcagaccccaactcaggctggggaggagcccctgaatgtgggcagtgtggctgctggtgggcgctatgatgggctggtgggcatgtttgaccccaagggccacaaggtgccatgtgtgggactcagcattggggttgagcgaatcttctacattgtggagcagaggatgaagaccaaaggtgagaaggtgcggactacagagactcaagtgtttgtggccacaccacagaagaactttctccaagaacggttgaagcttattgcagagctttgggattctggaatcaaggcagagatgctatacaagaacaaccccaaactattaacccagctgcactattgtgagagcacaggcattccactggtggtcattattggtgagcaagaactgaaagaaggggtcatcaagatccgttcagtggccagcagagaggaggtggccattaaacgggaaaattttgtggctgaaattcagaagcgactgtctgagtcttgatccttgcctgattcccatctgctgctctttgtagaaaaggtttcctctagaactgaattcctctggaattgagtgatggacttcacaacaactagccaggaagggtgacaagtaccttctgcctcctccattcttcctgggtgcagaactgtagaagaccctgaggactcctgggctagtgtgagcagctattctgcatgggtgcagatggctggatgtgaaagagacatgctctagctgcagaggcaaatttgaagtgccacggaacgttgtcaagaggtagtgagattgttgctgtgagcaaggctctgggagagtcacctcaggctcaggattctgaaccattgagatcagaaaccagatacttagccttctactgtagctacggaaccagattctggtgaatttgtccacaatcagccattggcctgtctggggagtttttggaagacagcaaagaggggcaatggctgctttcagctttgaggacagatgctatcctaagggcatggcagtacccatgttgatttgacatctctctagcccatccattgcttacagtagaagagtggggctgtatgcttgataatcttgaacattgaacttaatagatgacttgacaaggtagagatctgatattttgagattttggagaccatttcctgtgccagaatcactgctctattccataccgtgccatggaggctgttttagaagtggttggataacatgttaaataaaatattaagtgtagta

SEQ ID NO: 365968 - DNA, 1679 bp, Homo sapiens
ttgcaaggcttgggtcactgacattgagttctcaggtaaatgaccggcggattgtggatgggatgtttgctgtctgtggtgttcctgaaagcaagttccgtgccatctgctcctccatagataaactagacaagatggcttggaaagatgtgagacatgagatggtggtgaagaaaggcctggctcctgaggtggctgatcgaattggggactatgtccagtgtcatggtggggtatccctagtagagcaaatgtttcaggatcccagactatcccagaacaagcaggccctggagggcctgggagacctaaagctgctatttgaatacctgactttatttggaattgctgataagatctcctttgacctcagcctggctcggggcctagactactatacaggagtgatctatgaagcagtgctgctgcagaccccaactcaggctggggaggagcccctgaatgtgggcagtgtggctgctggtgggcgctatgatgggctggtgggcatgtttgaccccaagggccacaaggtgccatgtgtgggactcagcattggggttgagcgaatcttctacattgtggagcagaggatgaagaccaaaggtgagaaggtgcggactacagagactcaagtgtttgtggccacaccacagaagaactttctccaagaacggttgaagcttattgcagagctttgggattctggaatcaaggcagagatgctatacaagaacaaccccaaactattaacccagctgcactattgtgagagcacaggcattccactggtggtcattattggtgagcaagaactgaaagaaggggtcatcaagatccgttcagtggccagcagagaggaggtggccattaaacgggaaaattttgtggctgaaattcagaagcgactgtctgagtcttgatccttgcctgattcccatctgctgctctttgtagaaaaggtttcctctagaactgaattcctctggaattgagtgatggacttcacaacaactagccaggaagggtgacaagtaccttctgcctcctccattcttcctgggtgcagaactgtagaagaccctgaggactcctgggctagtgtgagcagctattctgcatgggtgcagatggctggatgtgaaagagacatgctctagctgcagaggcaaatttgaagtgccacggaacgttgtcaagaggtagtgagattgttgctgtgagcaaggctctgggagagtcacctcaggctcaggattctgaaccattgagatcagaaaccagatacttagccttctactgtagctacggaaccagattctggtgaatttgtccacaatcagccattggcctgtctggggagtttttggaagacagcaaagaggggcaatggctgctttcagctttgaggacagatgctatcctaagggcatggcagtacccatgttgatttgacatctctctagcccatccattgcttacagtagaagagtggggctgtatgcttgataatcttgaacattgaacttaatagatgacttgacaaggtagagatctgatattttgagattttggagaccatttcctgtgccagaatcactgctctattccataccgtgccatggaggctgttttagaagtggttggataacatgttaaataaaatattaagtgtagta

SEQ ID NO: 365969 - DNA, 1380 bp, Homo sapiens
atttccggctcctcccggaagtgccgaagctggctactaagggaacttgggaggatcccacctcagccttcgtgactagtgaggtgcgcaaacgcccgagttttccctggtgcgcgggttccgcctttgcagtgccctccacccttcctggtgtctgacccgcctccttcccaggccttttgttcctgtcccggaaagccggcgtcctgccgcgcgatgcccctgctcggacttcttcccaggagggcctgggcttcgctgctcagccagctcctgcgaccgccctgcgcttcgtgcaccggggcggtccgttgccaaagccaggttgcagaggcagtgttaacatcccaactgaaagcacatcaagagaaaccaaattttattatcaagaccccaaagggtaccagggatcttagtcctcagcatatggttgtgagggagaaaattcttgatttggttatcagctgctttaaacgtcatggagcaaaggggatggacaccccagcatttgagctgaaggaaaccctgactgagaagtatggagaggactctgggctcatgtatgatctgaaggatcaaggtggagagctgttgtccctccgctatgaccttactgttccctttgctcgttatctggccatgaataaggtgaagaagatgaaacgttatcatgttggaaaggtgtggcggcgagagagcccaaccatagtccaaggccgttatagggagttctgccagtgtgattttgacattgctggtcagtttgaccctatgatccccgatgcagagtgtttgaagatcatgtgtgaaatcctaagtggattgcagttgggagactttctcattaaggtaaatgaccggcggattgtggatgggatgtttgctgtctgtggtgttcctgaaagcaagttccgtgccatctgctcctccatagataaactagacaagaggctcaggattctgaaccattgagatcagaaaccagatacttagccttctactgtagctacggaaccagattctggtgaatttgtccacaatcagccattggcctgtctggggagtttttggaagacagcaaagaggggcaatggctgctttcagctttgaggacagatgctatcctaagggcatggcagtacccatgttgatttgacatctctctagcccatccattgcttacagtagaagagtggggctgtatgcttgataatcttgaacattgaacttaatagatgacttgacaaggtagagatctgatattttgagattttggagaccatttcctgtgccagaatcactgctctattccataccgtgccatggaggctgttttagaagtggttggataacatgttaaataaaatattaagtgtagta

SEQ ID NO: 365970 - DNA, 2493 bp, Homo sapiens
atttccggctcctcccggaagtgccgaagctggctactaagggaacttgggaggatcccacctcagccttcgtgactagtgaggtgcgcaaacgcccgagttttccctggtgcgcgggttccgcctttgcagtgccctccacccttcctggtgtctgacccgcctccttcccaggccttttgttcctgtcccggaaagccggcgtcctgccgcgcgatgcccctgctcggacttcttcccaggagggcctgggcttcgctgctcagccagctcctgcgaccgccctgcgcttcgtgcaccggggcggtccgttgccaaagccaggttgcagaggcagtgttaacatcccaactgaaagcacatcaagagaaaccaaattttattatcaagaccccaaagggtaccagggatcttagtcctcagcatatggttgtgagggagaaaattcttgatttggttatcagctgctttaaacgtcatggagcaaaggggatggacaccccagcatttgagctgaaggaaaccctgactgagaagtatggagaggactctgggctcatgtatgatctgaaggatcaaggtggagagctgttgtccctccgctatgaccttactgttccctttgctcgttatctggccatgaataaggtgaagaagatgaaacgttatcatgttggaaaggtgtggcggcgagagagcccaaccatagtccaaggccgttatagggagttctgccagtgtgattttgacattgctggtcagtttgaccctatgatccccgatgcagagtgtttgaagatcatgtgtgaaatcctaagtggattgcagttgggagactttctcattaaggtaaatgaccggcggattgtggatgggatgtttgctgtctgtggtgttcctgaaagcaagttccgtgccatctgctcctccatagataaactagacaagatggcttggaaagatgtgagacatgagatggtggtgaagaaaggcctggctcctgaggtggctgatcgaattggggactatgtccagtgtcatggtggggtatccctagtagagcaaatgtttcaggatcccagactatcccagaacaagcaggccctggagggcctgggagacctaaagctgctatttgaatacctgactttatttggaattgctgataagatctcctttgacctcagcctggctcggggcctagactactatacaggagtgatctatgaagcagtgctgctgcagaccccaactcaggctggggaggagcccctgaatgtgggcagtgtggctgctggtgggcgctatgatgggctggtgggcatgtttgaccccaagggccacaaggtgccatgtgtgggactcagcattggggttgagcgaatcttctacattgtggagcagaggatgaagaccaaaggtgagaaggtgcggactacagagactcaagtgtttgtggccacaccacagaagaactttctccaagaacggttgaagcttattgcagagctttgggattctggaatcaaggcagagatgctatacaagaacaaccccaaactattaacccagctgcactattgtgagagcacaggcattccactggtggtcattattggtgagcaagaactgaaagaaggggtcatcaagatccgttcagtggccagcagagaggaggtggccattaaacgggaaaattttgtggctgaaattcagaagcgactgtctgagtcttgatccttgcctgattcccatctgctgctctttgtagaaaaggtttcctctagaactgaattcctctggaattgagtgatggacttcacaacaactagccaggaagggtgacaagtaccttctgcctcctccattcttcctgggtgcagaactgtagaagaccctgaggactcctgggctagtgtgagcagctattctgcatgggtgcagatggctggatgtgaaagagacatgctctagctgcagaggcaaatttgaagtgccacggaacgttgtcaagaggtagtgagattgttgctgtgagcaaggctctgggagagtcacctcaggctcaggattctgaaccattgagatcagaaaccagatacttagccttctactgtagctacggaaccagattctggtgaatttgtccacaatcagccattggcctgtctggggagtttttggaagacagcaaagaggggcaatggctgctttcagctttgaggacagatgctatcctaagggcatggcagtacccatgttgatttgacatctctctagcccatccattgcttacagtagaagagtggggctgtatgcttgataatcttgaacattgaacttaatagatgacttgacaaggtagagatctgatattttgagattttggagaccatttcctgtgccagaatcactgctctattccataccgtgccatggaggctgttttagaagtggttggataacatgttaaataaaatattaagtgtagta

SEQ ID NO: 365971 - DNA, 2286 bp, Homo sapiens
ctttggcttcctgttgctcagggtgaagagtctttgcaggttggtggtcaacagggtcagagatgccacaggtctggccagtgtccagagaagccacatctcacattcattcttctggttgcagaggcagtgttaacatcccaactgaaagcacatcaagagaaaccaaattttattatcaagaccccaaagggtaccagggatcttagtcctcagcatatggttgtgagggagaaaattcttgatttggttatcagctgctttaaacgtcatggagcaaaggggatggacaccccagcatttgagctgaaggaaaccctgactgagaagtatggagaggactctgggctcatgtatgatctgaaggatcaaggtggagagctgttgtccctccgctatgaccttactgttccctttgctcgttatctggccatgaataaggtgaagaagatgaaacgttatcatgttggaaaggtgtggcggcgagagagcccaaccatagtccaaggccgttatagggagttctgccagtgtgattttgacattgctggtcagtttgaccctatgatccccgatgcagagtgtttgaagatcatgtgtgaaatcctaagtggattgcagttgggagactttctcattaaggtaaatgaccggcggattgtggatgggatgtttgctgtctgtggtgttcctgaaagcaagttccgtgccatctgctcctccatagataaactagacaagatggcttggaaagatgtgagacatgagatggtggtgaagaaaggcctggctcctgaggtggctgatcgaattggggactatgtccagtgtcatggtggggtatccctagtagagcaaatgtttcaggatcccagactatcccagaacaagcaggccctggagggcctgggagacctaaagctgctatttgaatacctgactttatttggaattgctgataagatctcctttgacctcagcctggctcggggcctagactactatacaggagtgatctatgaagcagtgctgctgcagaccccaactcaggctggggaggagcccctgaatgtgggcagtgtggctgctggtgggcgctatgatgggctggtgggcatgtttgaccccaagggccacaaggtgccatgtgtgggactcagcattggggttgagcgaatcttctacattgtggagcagaggatgaagaccaaaggtgagaaggtgcggactacagagactcaagtgtttgtggccacaccacagaagaactttctccaagaacggttgaagcttattgcagagctttgggattctggaatcaaggcagagatgctatacaagaacaaccccaaactattaacccagctgcactattgtgagagcacaggcattccactggtggtcattattggtgagcaagaactgaaagaaggggtcatcaagatccgttcagtggccagcagagaggaggtggccattaaacgggaaaattttgtggctgaaattcagaagcgactgtctgagtcttgatccttgcctgattcccatctgctgctctttgtagaaaaggtttcctctagaactgaattcctctggaattgagtgatggacttcacaacaactagccaggaagggtgacaagtaccttctgcctcctccattcttcctgggtgcagaactgtagaagaccctgaggactcctgggctagtgtgagcagctattctgcatgggtgcagatggctggatgtgaaagagacatgctctagctgcagaggcaaatttgaagtgccacggaacgttgtcaagaggtagtgagattgttgctgtgagcaaggctctgggagagtcacctcaggctcaggattctgaaccattgagatcagaaaccagatacttagccttctactgtagctacggaaccagattctggtgaatttgtccacaatcagccattggcctgtctggggagtttttggaagacagcaaagaggggcaatggctgctttcagctttgaggacagatgctatcctaagggcatggcagtacccatgttgatttgacatctctctagcccatccattgcttacagtagaagagtggggctgtatgcttgataatcttgaacattgaacttaatagatgacttgacaaggtagagatctgatattttgagattttggagaccatttcctgtgccagaatcactgctctattccataccgtgccatggaggctgttttagaagtggttggataacatgttaaataaaatattaagtgtagta

SEQ ID NO: 365972 - DNA, 2506 bp, Homo sapiens
atttccggctcctcccggaagtgccgaagctggctactaagggaacttgggaggatcccacctcagccttcgtgactagtgaggccttttgttcctgtcccggaaagccggcgtcctgccgcgcgatgcccctgctcggacttcttcccaggagggcctgggcttcgctgctcagccagctcctgcgaccgccctgcgcttcgtgcaccggggcggtccgttgccaaagccaggttgcagaggcagtgttaacatcccaactgaaagcacatcaagagaaaccaaattttattatcaagaccccaaagggtaccagggatcttagtcctcagcatatggttgtgagggagaaaattcttgatttggttatcagctgctttaaacgtcatggagcaaaggggatggacaccccagcatttgagctgaaggaaaccctgactgagaagtatggagaggactctgggctcatgtatgatctgaaggatcaaggtggagagctgttgtccctccgctatgaccttactgttccctttgctcgttatctggccatgaataaggtgaagaagatgaaacgttatcatgttggaaaggtgtggcggcgagagagcccaaccatagtccaaggccgttatagggagttctgccagtgtgtaagtgacctgatgggagcagcacagtttgatagttctaggggccacaaccttgaaactggctggataatggatgttttttcccatctttttctttgctgtaggattttgacattgctggtcagtttgaccctatgatccccgatgcagagtgtttgaagatcatgtgtgaaatcctaagtggattgcagttgggagactttctcattaaggtaaatgaccggcggattgtggatgggatgtttgctgtctgtggtgttcctgaaagcaagttccgtgccatctgctcctccatagataaactagacaagatggcttggaaagatgtgagacatgagatggtggtgaagaaaggcctggctcctgaggtggctgatcgaattggggactatgtccagtgtcatggtggggtatccctagtagagcaaatgtttcaggatcccagactatcccagaacaagcaggccctggagggcctgggagacctaaagctgctatttgaatacctgactttatttggaattgctgataagatctcctttgacctcagcctggctcggggcctagactactatacaggagtgatctatgaagcagtgctgctgcagaccccaactcaggctggggaggagcccctgaatgtgggcagtgtggctgctggtgggcgctatgatgggctggtgggcatgtttgaccccaagggccacaaggtgccatgtgtgggactcagcattggggttgagcgaatcttctacattgtggagcagaggatgaagaccaaaggtgagaaggtgcggactacagagactcaagtgtttgtggccacaccacagaagaactttctccaagaacggttgaagcttattgcagagctttgggattctggaatcaaggcagagatgctatacaagaacaaccccaaactattaacccagctgcactattgtgagagcacaggcattccactggtggtcattattggtgagcaagaactgaaagaaggggtcatcaagatccgttcagtggccagcagagaggaggtggccattaaacgggaaaattttgtggctgaaattcagaagcgactgtctgagtcttgatccttgcctgattcccatctgctgctctttgtagaaaaggtttcctctagaactgaattcctctggaattgagtgatggacttcacaacaactagccaggaagggtgacaagtaccttctgcctcctccattcttcctgggtgcagaactgtagaagaccctgaggactcctgggctagtgtgagcagctattctgcatgggtgcagatggctggatgtgaaagagacatgctctagctgcagaggcaaatttgaagtgccacggaacgttgtcaagaggtagtgagattgttgctgtgagcaaggctctgggagagtcacctcaggctcaggattctgaaccattgagatcagaaaccagatacttagccttctactgtagctacggaaccagattctggtgaatttgtccacaatcagccattggcctgtctggggagtttttggaagacagcaaagaggggcaatggctgctttcagctttgaggacagatgctatcctaagggcatggcagtacccatgttgatttgacatctctctagcccatccattgcttacagtagaagagtggggctgtatgcttgataatcttgaacattgaacttaatagatgacttgacaaggtagagatctgatattttgagattttggagaccatttcctgtgccagaatcactgctctattccataccgtgccatggaggctgttttagaagtggttggataacatgttaaataaaatattaagtgtagta

SEQ ID NO: 365973 - DNA, 2044 bp, Homo sapiens
atttccggctcctcccggaagtgccgaagctggctactaagggaacttgggaggatcccacctcagccttcgtgactagtgaggtgcgcaaacgcccgagttttccctggtgcgcgggttccgcctttgcagtgccctccacccttcctggtgtctgacccgcctccttcccaggccttttgttcctgtcccggaaagccggcgtcctgccgcgcgatgcccctgctcggacttcttcccaggagggcctgggcttcgctgctcagccagctcctgcgaccgccctgcgcttcgtgcaccggggcggtccgttgccaaagccaggttgcagaggcagtgttaacatcccaactgaaagcacatcaagagaaaccaaattttattatcaagaccccaaagggtaccagggatcttagtcctcagcatatggttgtgagggagaaaattcttgatttggttatcagctgctttaaacgtcatggagcaaaggggatggacaccccagcatttgagctgaaggaaaccctgactgagaagtatggagaggactctgggctcatgtatgatctgaaggatcaaggtggagagctgttgtccctccgctatgaccttactgttccctttgctcgttatctggccatgaataaggtgaagaagatgaaacgttatcatgttggaaaggtgtggcggcgagagagcccaaccatagtccaaggccgttatagggagttctgccagtgtgattttgacattgctggtcagtttgaccctatgatccccgatgcagagtgtttgaagatcatgtgtgaaatcctaagtggattgcagttgggagactttctcattaaggtaaatgaccggcggattgtggatgggatgtttgctgtctgtggtgttcctgaaagcaagttccgtgccatctgctcctccatagataaactagacaagatggcttggaaagatgtgagacatgagatggtggtgaagaaaggcctggctcctgaggtggctgatcgaattggggactatgtccagtgtcatggtggggtatccctagtagagcaaatgtttcaggatcccagactatcccagaacaagcaggccctggagggcctgggagacctaaagctgctatttgaatacctgactttatttggaattgctgataagatctcctttgacctcagcctggctcggggcctagactactatacaggagtgatctatgaagcagtgctgctgcagaccccaactcaggctggggaggagcccctgaatgtgggcagtgtggctgctggtgggcgctatgatgggctggtgggcatgtttgaccccaagggccacaaggtgccatgtgtgggactcagcattggggttgagcgaatcttctacattgtggagcagaggatgaagaccaaaggtgagaaggtgcggactacagagactcaagtgtttgtggccacaccacagaagaactttctccaagaacggttgaagcttattgcagagctttgggattctggaatcaaggcagagatgctatacaagaacaaccccaaactattaacccagctgcactattgtgagagcacaggcattccactggtggtcattattggtgagcaagaactgaaagaaggggtcatcaagatccgttcagtggccagcagagaggaggtggccattaaacgggaaaattttgtggctgaaattcagaagcgactgtctgagtcttgatccttgcctgattcccatctgctgctctttgtagaaaaggtttcctctagaactgaattcctctggaattgagtgatggacttcacaacaactagccaggaagggtgacaagtaccttctgcctcctccattcttcctgggtgcagaactgtagaagaccctgaggactcctgggctagtgtgagcagctattctgcatgggtgcagatggctggatgtgaaagagacatgctctagctgcagaggcaaatttgaagtgccacggaacgttgtcaagagacaaaaaacttggactttcgccgaaagt

SEQ ID NO: 365974 - DNA, 6101 bp, Homo sapiens
cgcagggaaaggcggacctcagtgtctgaaaagccagcttagagtgggagggcctgggagtagaaggtaaaaagggagtggtgagaatgaatgtgagaaggaagccaggacagcgcagtccccagtcccgaacggccagggagaggaggtggcctagcgctggcggggctcaccccaatccgtctgccttttgatgccgtactctgctggttgcgcagccacctcgggatactgcacacggagaggagggaaaataagcgaggcaccgccgcaccacgcgggagacctacggagacccacagcgcccgagccctggaagagcactactggatgtcagcggagaaatggctttgagctcagcctggcgctcggttctgcctctgtggctcctctggagcgctgcctgctcccgcgccgcgtccggggacgacaacgcttttccttttgacattgaagggagctcagcggttggcaggcaagacccgcctgagacgagcgaaccccgcgtggctctgggacgcctgccgcctgcggccgagaaatgcaatgctggattctttcacaccctgtcgggagaatgtgtgccctgcgactgtaatggcaattccaacgagtgtttggacggctcaggatactgtgtgcactgccagcggaacacaacaggagagcactgtgaaaagtgtctggatggttatatcggagattccatcaggggagcaccccaattctgccagccgtgcccctgtcccctgccccacttggccaattttgcagaatcctgctataggaaaaatggagctgttcggtgcatttgtaacgaaaattatgctggacctaactgtgaaagatgtgctcccggttactatggaaaccccttactcattggaagcacctgtaagaaatgtgactgcagtggaaattcagatcccaacctgatctttgaagattgtgatgaagtcactggccagtgtaggaattgcttacgcaacaccaccggattcaagtgtgaacgttgcgctcctggctactatggggacgccaggatagccaagaactgtgcagtgtgcaactgcgggggaggcccatgtgacagtgtaaccggagaatgcttggaagaaggttttgaaccccctacaggctgtgataagtgcgtctgggacctgactgatgacctgcggttagcagcgctctccatcgaggaaggcaaatccggggtgctgagcgtatcctctggggccgccgctcataggcacgtgaatgaaatcaacgccaccatctacctcctcaaaacaaaattgtcagaaagagaaaaccaatacgccctaagaaagatacaaatcaacaatgctgagaacacgatgaaaagccttctgtctgacgtagaggaattagttgaaaaggaaaatcaagcctccagaaaaggacaacttgttcagaaggaaagcatggacaccattaaccacgcaagtcagctggtagagcaagcccatgatatgagggataaaatccaagagatcaacaacaagatgctctattatggggaagagcatgaacttagccccaaggaaatctctgagaagctggtgttggcccagaagatgcttgaagagattagaagccgtcaaccatttttcacccaacgggagctcgtggatgaggaggcagatgaggcttacgaactactgagccaggctgagagctggcagcggctgcacaatgagacccgcactctgtttcctgtcgtcctggagcagctggatgactacaatgctaagttgtcagatctccaggaagcacttgaccaggcccttaaccatgtcagggatgccgaagacatgaacagggccacagcagccaggcagcgggaccatgagaaacaacaggaaagagtgagggaacaaatggaagtggtgaacatgtctctgagcacatctgcggactctctgacaacacctcgtctaactctttcagaacttgatgatataataaagaatgcgtcagggatttatgcagaaatagatggagccaaaagtgaactacaagtaaaactatctaacctaagtaacctcagccatgatttagtccaagaagctattgaccatgcacaggaccttcaacaagaagctaatgaattgagcaggaagttgcacagttcagatatgaacgggctggtacagaaggctttggatgcatcaaatgtctatgaaaatattgttaattatgttagtgaagccaatgaaacagcagaatttgctttgaacaccactgaccgaatttatgatgcggtgagtgggattgatactcaaatcatttaccataaagatgaaagtgagaacctcctcaatcaagccagagaactgcaagcaaaggcagagtctagcagtgatgaagcagtggctgacactagcaggcgtgtgggtggagccctagcaaggaaaagtgcccttaaaaccagactcagtgatgccgttaagcaactacaagcagcagagagaggggatgcccagcagcgcctggggcagtctagactgatcaccgaggaagccaacaggacgacgatggaggtgcagcaggccactgcccccatggccaacaatctaaccaactggtcacagaatcttcaacattttgactcttctgcttacaacactgcagtgaactctgctagggatgcagtaagaaatctgaccgaggttgtccctcagctcctggatcagcttcgtacggttgagcagaagcgacctgcaagcaacgtttctgccagcatccagaggatccgagagctcattgctcagaccagaagtgttgccagcaagatccaagtctccatgatgtttgatggccagtcagctgtggaagtgcactcgagaaccagtatggatgacttaaaggccttcacgtctctgagcctgtacatgaaaccccctgtgaagcggccggaactgaccgagactgcagatcagtttatcctgtacctcggaagcaaaaacgccaaaaaagagtatatgggtcttgcaatcaaaaatgataatctggtatacgtctataatttgggaactaaagatgtggagattcccctggactccaagcccgtcagttcctggcctgcttacttcagcattgtcaagattgaaagggtgggaaaacatggaaaggtgtttttaacagtcccgagtctaagtagcacagcagaggaaaagttcattaaaaagggggaattttcgggagatgactctctgctggacctggaccctgaggacacagtgttttatgttggtggagtgccttccaacttcaagctccctaccagcttaaacctgcctggctttgttggctgcctggaactggccactttgaataatgatgtgatcagcttgtacaactttaagcacatctataatatggacccctccacatcagtgccatgtgcccgagataagctggccttcactcagagtcgggctgccagttacttcttcgatggctccggttatgccgtggtgagagacatcacaaggagagggaaatttggtcaggtgactcgctttgacatagaagttcgaacaccagctgacaacggccttattctcctgatggtcaatggaagtatgtttttcagactggaaatgcgcaatggttacctacatgtgttctatgattttggattcagcagtggccgtgtgcatcttgaagatacgttaaagaaagctcaaattaatgatgcaaaataccatgagatctcaatcatttaccacaatgataagaaaatgatcttggtagttgacagaaggcatgtcaagagcatggataatgaaaagatgaaaataccttttacagatatatacattggaggagctcctccagaaatcttacaatccagggccctcagagcacaccttcccctagatatcaacttcagaggatgcatgaagggcttccagttccaaaagaaggacttcaatttactggagcagacagaaaccctgggagttggttatggatgcccagaagactcacttatatctcgcagagcatatttcaatggacagagcttcattgcttcaattcagaaaatatctttctttgatggctttgaaggaggttttaatttccgaacattacaaccaaatgggttactattctattatgcttcagggtcagacgtgttctccatctcactggataatggtactgtcatcatggatgtaaagggaatcaaagttcagtcagtagataagcagtacaatgatgggctgtcccacttcgtcattagctctgtctcacccacaagatatgaactgatagtagataaaagcagagttgggagtaagaatcctaccaaagggaaaatagaacagacacaagcaagtgaaaagaagttttacttcggtggctcaccaatcagtgctcagtatgctaatttcactggctgcataagtaatgcctactttaccagggtggatagagatgtggaggttgaagatttccaacggtatactgaaaaggtccacacttctctttatgagtgtcccattgagtcttcaccattgtttctcctccataaaaaaggaaaaaatttatccaagcctaaagcaagtcagaataaaaagggagggaaaagtaaagatgcaccttcatgggatcctgttgctctgaaactcccagagcggaatactccaagaaactctcattgccacctttccaacagccctagagcaatagagcacgcctatcaatatggaggaacagccaacagccgccaagagtttgaacacttaaaaggagattttggtgccaaatctcagttttccattcgtctgagaactcgttcctcccatggcatgatcttctatgtctcagatcaagaagagaatgacttcatgactctatttttggcccatggccgcttggtttacatgtttaatgttggtcacaaaaaactgaagattagaagccaggagaaatacaatgatggcctgtggcatgatgtgatatttattcgagaaaggagcagtggccgactggtaattgatggtctccgagtcctagaagaaagtcttcctcctactgaagctacctggaaaatcaagggtcccatttatttgggaggtgtggctcctggaaaggctgtgaaaaatgttcagattaactccatctacagttttagtggctgtctcagcaatctccagctcaatggggcctccatcacctctgcttctcagacattcagtgtgaccccttgctttgaaggccccatggaaacaggaacttacttttcaacagaaggaggatacgtggttctagatgaatctttcaatattggattgaagtttgaaattgcatttgaagtccgtcccagaagcagttccggaaccctggtccacggccacagtgtcaatggggagtacctaaatgttcacatgaaaaatggacaggtcatagtgaaagtcaataatggcatcagagatttttccacctcagttacacccaagcagagtctctgtgatggcagatggcacagaattacagttattagagattctaatgtggttcagttggatgtggactctgaagtgaaccatgtggttggacccctgaatccaaaaccaattgatcacagggagcctgtgtttgttggaggtgttccagaatctctactgacaccacgcttggcccccagcaaacccttcacaggctgcatacgccactttgtgattgatggacacccagtgagcttcagtaaagcagccctggtcagcggcgccgtaagcatcaactcctgtccagcagcctgacatgacagagcacagctgcccaaatacaaagttctttagagcactgaaagaaacacaaagccagccaggaggaacagtaactcttccttcgggtggaagctttcatcgagttgaacaggacttaaacgaatcatcagggaccggatatttcttatttctcatttggattcttaaccttgaatccaaagtgtctgcaatggacaacaattgaaggagtggcaaacttacttgtattgagagcacacgcaattcctactggtgaaattactgtttctgtttctaataaaatagaagggattccaaata

SEQ ID NO: 365975 - DNA, 884 bp, Homo sapiens
cgcagggaaaggcggacctcagtgtctgaaaagccagcttagagtgggagggcctgggagtagaaggtaaaaagggagtggtgagaatgaatgtgagaaggaagccaggacagcgcagtccccagtcccgaacggccagggagaggaggtggcctagcgctggcggggctcaccccaatccgtctgccttttgatgccgtactgtaagctccgtccatctgtaggttcttgagccagaacctctgcgggaaggagaaaaagtgaaagagggagagggagagggagagagagggggagaaggggagagagagagagggagagagaggctggaactctcccttactctcgcactttccctttatttcctaagctgctggttgcgcagccacctcgggatactgcacacggagaggagggaaaataagcgaggcaccgccgcaccacgcgggagacctacggagacccacagcgcccgagccctggaagagcactactggatgtcagcggagaaatggctttgagctcagcctggcgctcggttctgcctctgtggctcctctggagcgctgcctgctcccgcgccgcgtccggggacgacaacgcttttccttttgacattgaagggagctcagcggttggcaggcaagacccgcctgagacgagcgaaccccgcgtggctctgggacgcctgccgcctgcggccgaggtacagtgtccctgccattgccaccctgctggggcacctgcgcccccgcgggctgtgccacactcgtccttctctctctctccgcctctttcctctccccagtgccttgagagtttcacctgggctaggtcagttcggaaacttgaaataaagagttttcctttgtaaaatgaaaatg

SEQ ID NO: 365976 - DNA, 1190 bp, Homo sapiens
  misc_feature (691)..(691): n is a, c, g, or t
caaactgaatcctgctttaattcaagcttgtggagaacaaagtcctacagaaacattccacagaattttctggaaaagagggatcacaacaaccctgtaatgaatgtgagaaggaagccaggacagcgcagtccccagtcccgaacggccagggagaggaggtggcctagcgctggcggggctcaccccaatccgtctgccttttgatgccgtactctgctggttgcgcagccacctcgggatactgcacacggagaggagggaaaataagcgaggcaccgccgcaccacgcgggagacctacggagacccacagcgcccgagccctggaagagcactactggatgtcagcggagaaatggctttgagctcagcctggcgctcggttctgcctctgtggctcctctggagcgctgcctgctcccgcgccgcgtccggggacgacaacgcttttccttttgacattgaagggagctcagcggttggcaggcaagacccgcctgagacgagcgaaccccgcgtggctctgggacgcctgccgcctgcggccgagaaatgcaatgctggattctttcacaccctgtcgggagaatgtgtgccctgcgactgtaatggcaattccaacgagtgtttggacggctcaggatactgtgtgactactgacggagaagacccaggtttttcagcttctnccctatcgttcattctcagctctcagggagccagagaagccagggctccaacatgaacacttcttgtagctcactgtcatgaccagtgtttcagtcagttcttgcaggttgcctgacttacctcatttctctcatttcctgtaagcaaccaaaaataaaaggctttcttttatttcattttgtcttattttgcttttatcttgaaggcatataagacctctgtatctgccttgttcaccttcaactgcttctaattcttcctcaattccagtgtccaatgtcaatttgaaattaaaatttacagactgattttaactaagctgttggtaaagctgacctaagccattcagccacaaaatatagagtatacaaaactatgctaccattttacacatatcaagcaagcaaagagatttttttttactggtggaacactaatctttcaaatatagaatagtggctaaatgaaaataaaacagcttagaaatctaaaatgttt

SEQ ID NO: 365977 - DNA, 721 bp, Homo sapiens
tttatcctgggcctcatgaagagtttggcaactcgctgtcttttcattaaccacatgttccatttcaatttcatgagaaaacctgcttatccaacctagagtgggtcaaggtaaaatgctagctctgtggtatgtaaagaagcctttttcttttgcagatatgaactgatagtagataaaagcagagttgggagtaagaatcctaccaaagggaaaatagaacagacacaagcaagtgaaaagaagttttacttcggtggctcaccaatcagtgctcagtatgctaatttcactggctgcataagtaatgcctactttaccagggtggatagagatgtggaggttgaagatttccaacggtatactgaaaaggtccacacttctctttatgagtgtcccattgagtcttcaccattgtttctcctccataaaaaaggaaaaaatttatccaagcctaaagcaagtcagaataaaaagggagggaaaagtaaagatgcaccttcatgggatcctgttgctctgaaactcccagagcggaatactccaagaaactctcattgccacctttccaacagccctagagcaatagagcacgcctatcaatatggaggaacagccaacagccgccaagagtttgaacacttaaaaggagattttggtgccaaatctcagttttaacattcgtctgagaactcgacccagtgtgtagtcctgctagagt

SEQ ID NO: 365978 - DNA, 6636 bp, Homo sapiens
  misc_feature (6482)..(6482): n is a, c, g, or t
cgcagggaaaggcggacctcagtgtctgaaaagccagcttagagtgggagggcctgggagtagaaggtaaaaagggagtggtgagaatgaatgtgagaaggaagccaggacagcgcagtccccagtcccgaacggccagggagaggaggtggcctagcgctggcggggctcaccccaatccgtctgccttttgatgccgtactctgctggttgcgcagccacctcgggatactgcacacggagaggagggaaaataagcgaggcaccgccgcaccacgcgggagacctacggagacccacagcgcccgagccctggaagagcactactggatgtcagcggagaaatggctttgagctcagcctggcgctcggttctgcctctgtggctcctctggagcgctgcctgctcccgcgccgcgtccggggacgacaacgcttttccttttgacattgaagggagctcagcggttggcaggcaagacccgcctgagacgagcgaaccccgcgtggctctgggacgcctgccgcctgcggccgagaaatgcaatgctggattctttcacaccctgtcgggagaatgtgtgccctgcgactgtaatggcaattccaacgagtgtttggacggctcaggatactgtgtgcactgccagcggaacacaacaggagagcactgtgaaaagtgtctggatggttatatcggagattccatcaggggagcaccccaattctgccagccgtgcccctgtcccctgccccacttggccaattttgcagaatcctgctataggaaaaatggagctgttcggtgcatttgtaacgaaaattatgctggacctaactgtgaaagatgtgctcccggttactatggaaaccccttactcattggaagcacctgtaagaaatgtgactgcagtggaaattcagatcccaacctgatctttgaagattgtgatgaagtcactggccagtgtaggaattgcttacgcaacaccaccggattcaagtgtgaacgttgcgctcctggctactatggggacgccaggatagccaagaactgtgcagtgtgcaactgcgggggaggcccatgtgacagtgtaaccggagaatgcttggaagaaggttttgaaccccctacaggctgtgataagtgcgtctgggacctgactgatgacctgcggttagcagcgctctccatcgaggaaggcaaatccggggtgctgagcgtatcctctggggccgccgctcataggcacgtgaatgaaatcaacgccaccatctacctcctcaaaacaaaattgtcagaaagagaaaaccaatacgccctaagaaagatacaaatcaacaatgctgagaacacgatgaaaagccttctgtctgacgtagaggaattagttgaaaaggaaaatcaagcctccagaaaaggacaacttgttcagaaggaaagcatggacaccattaaccacgcaagtcagctggtagagcaagcccatgatatgagggataaaatccaagagatcaacaacaagatgctctattatggggaagagcatgaacttagccccaaggaaatctctgagaagctggtgttggcccagaagatgcttgaagagattagaagccgtcaaccatttttcacccaacgggagctcgtggatgaggaggcagatgaggcttacgaactactgagccaggctgagagctggcagcggctgcacaatgagacccgcactctgtttcctgtcgtcctggagcagctggatgactacaatgctaagttgtcagatctccaggaagcacttgaccaggcccttaaccatgtcagggatgccgaagacatgaacagggccacagcagccaggcagcgggaccatgagaaacaacaggaaagagtgagggaacaaatggaagtggtgaacatgtctctgagcacatctgcggactctctgacaacacctcgtctaactctttcagaacttgatgatataataaagaatgcgtcagggatttatgcagaaatagatggagccaaaagtgaactacaagtaaaactatctaacctaagtaacctcagccatgatttagtccaagaagctattgaccatgcacaggaccttcaacaagaagctaatgaattgagcaggaagttgcacagttcagatatgaacgggctggtacagaaggctttggatgcatcaaatgtctatgaaaatattgttaattatgttagtgaagccaatgaaacagcagaatttgctttgaacaccactgaccgaatttatgatgcggtgagtgggattgatactcaaatcatttaccataaagatgaaagtgagaacctcctcaatcaagccagagaactgcaagcaaaggcagagtctagcagtgatgaagcagtggctgacactagcaggcgtgtgggtggagccctagcaaggaaaagtgcccttaaaaccagactcagtgatgccgttaagcaactacaagcagcagagagaggggatgcccagcagcgcctggggcagtctagactgatcaccgaggaagccaacaggacgacgatggaggtgcagcaggccactgcccccatggccaacaatctaaccaactggtcacagaatcttcaacattttgactcttctgcttacaacactgcagtgaactctgctagggatgcagtaagaaatctgaccgaggttgtccctcagctcctggatcagcttcgtacggttgagcagaagcgacctgcaagcaacgtttctgccagcatccagaggatccgagagctcattgctcagaccagaagtgttgccagcaagatccaagtctccatgatgtttgatggccagtcagctgtggaagtgcactcgagaaccagtatggatgacttaaaggccttcacgtctctgagcctgtacatgaaaccccctgtgaagcggccggaactgaccgagactgcagatcagtttatcctgtacctcggaagcaaaaacgccaaaaaagagtatatgggtcttgcaatcaaaaatgataatctggtatacgtctataatttgggaactaaagatgtggagattcccctggactccaagcccgtcagttcctggcctgcttacttcagcattgtcaagattgaaagggtgggaaaacatggaaaggtgtttttaacagtcccgagtctaagtagcacagcagaggaaaagttcattaaaaagggggaattttcgggagatgactctctgctggacctggaccctgaggacacagtgttttatgttggtggagtgccttccaacttcaagctccctaccagcttaaacctgcctggctttgttggctgcctggaactggccactttgaataatgatgtgatcagcttgtacaactttaagcacatctataatatggacccctccacatcagtgccatgtgcccgagataagctggccttcactcagagtcgggctgccagttacttcttcgatggctccggttatgccgtggtgagagacatcacaaggagagggaaatttggtcaggtgactcgctttgacatagaagttcgaacaccagctgacaacggccttattctcctgatggtcaatggaagtatgtttttcagactggaaatgcgcaatggttacctacatgtgttctatgattttggattcagcagtggccgtgtgcatcttgaagatacgttaaagaaagctcaaattaatgatgcaaaataccatgagatctcaatcatttaccacaatgataagaaaatgatcttggtagttgacagaaggcatgtcaagagcatggataatgaaaagatgaaaataccttttacagatatatacattggaggagctcctccagaaatcttacaatccagggccctcagagcacaccttcccctagatatcaacttcagaggatgcatgaagggcttccagttccaaaagaaggacttcaatttactggagcagacagaaaccctgggagttggttatggatgcccagaagactcacttatatctcgcagagcatatttcaatggacagagcttcattgcttcaattcagaaaatatctttctttgatggctttgaaggaggttttaatttccgaacattacaaccaaatgggttactattctattatgcttcagggtcagacgtgttctccatctcactggataatggtactgtcatcatggatgtaaagggaatcaaagttcagtcagtagataagcagtacaatgatgggctgtcccacttcgtcattagctctgtctcacccacaagatatgaactgatagtagataaaagcagagttgggagtaagaatcctaccaaagggaaaatagaacagacacaagcaagtgaaaagaagttttacttcggtggctcaccaatcagtgctcagtatgctaatttcactggctgcataagtaatgcctactttaccagggtggatagagatgtggaggttgaagatttccaacggtatactgaaaaggtccacacttctctttatgagtgtcccattgagtcttcaccattgtttctcctccataaaaaaggaaaaaatttatccaagcctaaagcaagtcagaataaaaagggagggaaaagtaaagatgcaccttcatgggatcctgttgctctgaaactcccagagcggaatactccaagaaactctcattgccacctttccaacagccctagagcaatagagcacgcctatcaatatggaggaacagccaacagccgccaagagtttgaacacttaaaaggagattttggtgccaaatctcagttttccattcgtctgagaactcgttcctcccatggcatgatcttctatgtctcagatcaagaagagaatgacttcatgactctatttttggcccatggccgcttggtttacatgtttaatgttggtcacaaaaaactgaagattagaagccaggagaaatacaatgatggcctgtggcatgatgtgatatttattcgagaaaggagcagtggccgactggtaattgatggtctccgagtcctagaagaaagtcttcctcctactgaagctacctggaaaatcaagggtcccatttatttgggaggtgtggctcctggaaaggctgtgaaaaatgttcagattaactccatctacagttttagtggctgtctcagcaatctccagctcaatggggcctccatcacctctgcttctcagacattcagtgtgaccccttgctttgaaggccccatggaaacaggaacttacttttcaacagaaggaggatacgtggttctagatgaatctttcaatattggattgaagtttgaaattgcatttgaagtccgtcccagaagcagttccggaaccctggtccacggccacagtgtcaatggggagtacctaaatgttcacatgaaaaatggacaggtcatagtgaaagtcaataatggcatcagagatttttccacctcagttacacccaagcagagtctctgtgatggcagatggcacagaattacagttattagagattctaatgtggttcagttggatgtggactctgaagtgaaccatgtggttggacccctgaatccaaaaccaattgatcacagggagcctgtgtttgttggaggtgttccagaatctctactgacaccacgcttggcccccagcaaacccttcacaggctgcatacgccactttgtgattgatggacacccagtgagcttcagtaaagcagccctggtcagcggcgccgtaagcatcaactcctgtccagcagcctgacatgacagagcacagctgcccaaatacaaagttctttagagcactgaaagaaacacaaagccagccaggaggaacagtaactcttccttcgggtggaagctttcatcgagttgaacaggacttaaacgaatcatcagggaccggatatttcttatttctcatttggattcttaaccttgaatccaaagtgtctgcaatggacaacaattgaaggagtggcaaacttacttgtattgagagcacacgcaattcctactggtgaaattactgtttctgtttctaataaaatagaagggattccaaataaacacttgcacacatttttgaagtgcggctagattctcagattcacctttcttccagggaagataactttcaatctatataaaaatctctgtcctaaaactacctttctttattttgaagagacttactaacttacatataatctaaattagatgatagatttgtttttagcccttttgtttggtctatcagtataagaagaatattttaggtttatagctgaagttatcaaggtttaataaagtaaatttctaacagaatactagaaaaatgcagtataatttaattttttctaaataagaaacacaggaaatcaactactttttccccttccttatctccttaaaagaaaaataaaattgtacatgagaggaaaaaaangtttataacccccattgaggtgctcataggcactttagaaactaaaaaaccctttggggggggcccggcccccaatttgcccttatagagggggtttacacatcaatggccggcgttttacaactgctggactggaaaaaccctggcgttccca

SEQ ID NO: 365979 - DNA, 4307 bp, Homo sapiens
ataagcactaggtagtcatcataatggttcattcctctgcctgacttccatcacataaacaaactcctgcaagaagaagtgcagagggctgtttttaaatcgtcattcccttttcctgctgctactgccagacaggcagctgtcagagaaccaaaatgctgttcagcaaagacagaagaatgcagaggaggtgtgaccctcaagaaaaccttgccacactaggtgactttgaataacaggaaggaagcatctgtgatcctagaagtatttaaaaagcaagcattaaacatggccccattccccaagaaggtaagaaggagaaataacaatgtttgtttattaacaggaagttgcacagttcagatatgaacgggctggtacagaaggctttggatgcatcaaatgtctatgaaaatattgttaattatgttagtgaagccaatgaaacagcagaatttgctttgaacaccactgaccgaatttatgatgcggtgagtgggattgatactcaaatcatttaccataaagatgaaagtgagaacctcctcaatcaagccagagaactgcaagcaaaggcagagtctagcagtgatgaagcagtggctgacactagcaggcgtgtgggtggagccctagcaaggaaaagtgcccttaaaaccagactcagtgatgccgttaagcaactacaagcagcagagagaggggatgcccagcagcgcctggggcagtctagactgatcaccgaggaagccaacaggacgacgatggaggtgcagcaggccactgcccccatggccaacaatctaaccaactggtcacagaatcttcaacattttgactcttctgcttacaacactgcagtgaactctgctagggatgcagtaagaaatctgaccgaggttgtccctcagctcctggatcagcttcgtacggttgagcagaagcgacctgcaagcaacgtttctgccagcatccagaggatccgagagctcattgctcagaccagaagtgttgccagcaagatccaagtctccatgatgtttgatggccagtcagctgtggaagtgcactcgagaaccagtatggatgacttaaaggccttcacgtctctgagcctgtacatgaaaccccctgtgaagcggccggaactgaccgagactgcagatcagtttatcctgtacctcggaagcaaaaacgccaaaaaagagtatatgggtcttgcaatcaaaaatgataatctggtatacgtctataatttgggaactaaagatgtggagattcccctggactccaagcccgtcagttcctggcctgcttacttcagcattgtcaagattgaaagggtgggaaaacatggaaaggtgtttttaacagtcccgagtctaagtagcacagcagaggaaaagttcattaaaaagggggaattttcgggagatgactctctgctggacctggaccctgaggacacagtgttttatgttggtggagtgccttccaacttcaagctccctaccagcttaaacctgcctggctttgttggctgcctggaactggccactttgaataatgatgtgatcagcttgtacaactttaagcacatctataatatggacccctccacatcagtgccatgtgcccgagataagctggccttcactcagagtcgggctgccagttacttcttcgatggctccggttatgccgtggtgagagacatcacaaggagagggaaatttggtcaggtgactcgctttgacatagaagttcgaacaccagctgacaacggccttattctcctgatggtcaatggaagtatgtttttcagactggaaatgcgcaatggttacctacatgtgttctatgattttggattcagcagtggccgtgtgcatcttgaagatacgttaaagaaagctcaaattaatgatgcaaaataccatgagatctcaatcatttaccacaatgataagaaaatgatcttggtagttgacagaaggcatgtcaagagcatggataatgaaaagatgaaaataccttttacagatatatacattggaggagctcctccagaaatcttacaatccagggccctcagagcacaccttcccctagatatcaacttcagaggatgcatgaagggcttccagttccaaaagaaggacttcaatttactggagcagacagaaaccctgggagttggttatggatgcccagaagactcacttatatctcgcagagcatatttcaatggacagagcttcattgcttcaattcagaaaatatctttctttgatggctttgaaggaggttttaatttccgaacattacaaccaaatgggttactattctattatgcttcagggtcagacgtgttctccatctcactggataatggtactgtcatcatggatgtaaagggaatcaaagttcagtcagtagataagcagtacaatgatgggctgtcccacttcgtcattagctctgtctcacccacaagatatgaactgatagtagataaaagcagagttgggagtaagaatcctaccaaagggaaaatagaacagacacaagcaagtgaaaagaagttttacttcggtggctcaccaatcagtgctcagtatgctaatttcactggctgcataagtaatgcctactttaccagggtggatagagatgtggaggttgaagatttccaacggtatactgaaaaggtccacacttctctttatgagtgtcccattgagtcttcaccattgtttctcctccataaaaaaggaaaaaatttatccaagcctaaagcaagtcagaataaaaagggagggaaaagtaaagatgcaccttcatgggatcctgttgctctgaaactcccagagcggaatactccaagaaactctcattgccacctttccaacagccctagagcaatagagcacgcctatcaatatggaggaacagccaacagccgccaagagtttgaacacttaaaaggagattttggtgccaaatctcagttttccattcgtctgagaactcgttcctcccatggcatgatcttctatgtctcagatcaagaagagaatgacttcatgactctatttttggcccatggccgcttggtttacatgtttaatgttggtcacaaaaaactgaagattagaagccaggagaaatacaatgatggcctgtggcatgatgtgatatttattcgagaaaggagcagtggccgactggtaattgatggtctccgagtcctagaagaaagtcttcctcctactgaagctacctggaaaatcaagggtcccatttatttgggaggtgtggctcctggaaaggctgtgaaaaatgttcagattaactccatctacagttttagtggctgtctcagcaatctccagctcaatggggcctccatcacctctgcttctcagacattcagtgtgaccccttgctttgaaggccccatggaaacaggaacttacttttcaacagaaggaggatacgtggttctagatgaatctttcaatattggattgaagtttgaaattgcatttgaagtccgtcccagaagcagttccggaaccctggtccacggccacagtgtcaatggggagtacctaaatgttcacatgaaaaatggacaggtcatagtgaaagtcaataatggcatcagagatttttccacctcagttacacccaagcagagtctctgtgatggcagatggcacagaattacagttattagagattctaatgtggttcagttggatgtggactctgaagtgaaccatgtggttggacccctgaatccaaaaccaattgatcacagggagcctgtgtttgttggaggtgttccagaatctctactgacaccacgcttggcccccagcaaacccttcacaggctgcatacgccactttgtgattgatggacacccagtgagcttcagtaaagcagccctggtcagcggcgccgtaagcatcaactcctgtccagcagcctgacatgacagagcacagctgcccaaatacaaagttctttagagcactgaaagaaacacaaagccagccaggaggaacagtaactcttccttcgggtggaagctttcatcgagttgaacaggacttaaacgaatcatcagggaccggatatttcttatttctcatttggattcttaaccttgaatccaaagtgtctgcaatggacaacaattgaaggagtggcaaacttacttgtattgagagcacacgcaattcctactggtgaaattactgtttctgtttctaataaaatagaagggattccaaata

SEQ ID NO: 365980 - DNA, 3586 bp, Homo sapiens
gatacaggctagactgaccaccctgactggcaacgctattacctaagacattcagacggccactgcccccatggccaacaatctaaccaactggtcacagaatcttcaacattttgactcttctgcttacaacactgcagtgaactctgctagggatgcagtaagaaatctgaccgaggttgtccctcagctcctggatcagcttcgtacggttgagcagaagcgacctgcaagcaacgtttctgccagcatccagaggatccgagagctcattgctcagaccagaagtgttgccagcaagatccaagtctccatgatgtttgatggccagtcagctgtggaagtgcactcgagaaccagtatggatgacttaaaggccttcacgtctctgagcctgtacatgaaaccccctgtgaagcggccggaactgaccgagactgcagatcagtttatcctgtacctcggaagcaaaaacgccaaaaaagagtatatgggtcttgcaatcaaaaatgataatctggtatacgtctataatttgggaactaaagatgtggagattcccctggactccaagcccgtcagttcctggcctgcttacttcagcattgtcaagattgaaagggtgggaaaacatggaaaggtgtttttaacagtcccgagtctaagtagcacagcagaggaaaagttcattaaaaagggggaattttcgggagatgactctctgctggacctggaccctgaggacacagtgttttatgttggtggagtgccttccaacttcaagctccctaccagcttaaacctgcctggctttgttggctgcctggaactggccactttgaataatgatgtgatcagcttgtacaactttaagcacatctataatatggacccctccacatcagtgccatgtgcccgagataagctggccttcactcagagtcgggctgccagttacttcttcgatggctccggttatgccgtggtgagagacatcacaaggagagggaaatttggtcaggtgactcgctttgacatagaagttcgaacaccagctgacaacggccttattctcctgatggtcaatggaagtatgtttttcagactggaaatgcgcaatggttacctacatgtgttctatgattttggattcagcagtggccgtgtgcatcttgaagatacgttaaagaaagctcaaattaatgatgcaaaataccatgagatctcaatcatttaccacaatgataagaaaatgatcttggtagttgacagaaggcatgtcaagagcatggataatgaaaagatgaaaataccttttacagatatatacattggaggagctcctccagaaatcttacaatccagggccctcagagcacaccttcccctagatatcaacttcagaggatgcatgaagggcttccagttccaaaagaaggacttcaatttactggagcagacagaaaccctgggagttggttatggatgcccagaagactcacttatatctcgcagagcatatttcaatggacagagcttcattgcttcaattcagaaaatatctttctttgatggctttgaaggaggttttaatttccgaacattacaaccaaatgggttactattctattatgcttcagggtcagacgtgttctccatctcactggataatggtactgtcatcatggatgtaaagggaatcaaagttcagtcagtagataagcagtacaatgatgggctgtcccacttcgtcattagctctgtctcacccacaagatatgaactgatagtagataaaagcagagttgggagtaagaatcctaccaaagggaaaatagaacagacacaagcaagtgaaaagaagttttacttcggtggctcaccaatcagtgctcagtatgctaatttcactggctgcataagtaatgcctactttaccagggtggatagagatgtggaggttgaagatttccaacggtatactgaaaaggtccacacttctctttatgagtgtcccattgagtcttcaccattgtttctcctccataaaaaaggaaaaaatttatccaagcctaaagcaagtcagaataaaaagggagggaaaagtaaagatgcaccttcatgggatcctgttgctctgaaactcccagagcggaatactccaagaaactctcattgccacctttccaacagccctagagcaatagagcacgcctatcaatatggaggaacagccaacagccgccaagagtttgaacacttaaaaggagattttggtgccaaatctcagttttccattcgtctgagaactcgttcctcccatggcatgatcttctatgtctcagatcaagaagagaatgacttcatgactctatttttggcccatggccgcttggtttacatgtttaatgttggtcacaaaaaactgaagattagaagccaggagaaatacaatgatggcctgtggcatgatgtgatatttattcgagaaaggagcagtggccgactggtaattgatggtctccgagtcctagaagaaagtcttcctcctactgaagctacctggaaaatcaagggtcccatttatttgggaggtgtggctcctggaaaggctgtgaaaaatgttcagattaactccatctacagttttagtggctgtctcagcaatctccagctcaatggggcctccatcacctctgcttctcagacattcagtgtgaccccttgctttgaaggccccatggaaacaggaacttacttttcaacagaaggaggatacgtggttctagatgaatctttcaatattggattgaagtttgaaattgcatttgaagtccgtcccagaagcagttccggaaccctggtccacggccacagtgtcaatggggagtacctaaatgttcacatgaaaaatggacaggtcatagtgaaagtcaataatggcatcagagatttttccacctcagttacacccaagcagagtctctgtgatggcagatggcacagaattacagttattagagattctaatgtggttcagttggatgtggactctgaagtgaaccatgtggttggacccctgaatccaaaaccaattgatcacagggagcctgtgtttgttggaggtgttccagaatctctactgacaccacgcttggcccccagcaaacccttcacaggctgcatacgccactttgtgattgatggacacccagtgagcttcagtaaagcagccctggtcagcggcgccgtaagcatcaactcctgtccagcagcctgacatgacagagcacagctgcccaaatacaaagttctttagagcactgaaagaaacacaaagccagccaggaggaacagtaactcttccttcgggtggaagctttcatcgagttgaacaggacttaaacgaatcatcagggaccggatatttcttatttctcatttggattcttaaccttgaatccaaagtgtctgcaatggacaacaattgaaggagtggcaaacttacttgtattgagagcacacgcaattcctactggtgaaattactgtttctgtttctaataaaatagaagggattccaaata

SEQ ID NO: 365981 - DNA, 5968 bp, Homo sapiens
cgcagggaaaggcggacctcagtgtctgaaaagccagcttagagtgggagggcctgggagtagaaggtaaaaagggagtggtgagaatgaatgtgagaaggaagccaggacagcgcagtccccagtcccgaacggccagggagaggaggtggcctagcgctggcggggctcaccccaatccgtctgccttttgatgccgtactctgctggttgcgcagccacctcgggatactgcacacggagaggagggaaaataagcgaggcaccgccgcaccacgcgggagacctacggagacccacagcgcccgagccctggaagagcactactggatgtcagcggagaaatggctttgagctcagcctggcgctcggttctgcctctgtggctcctctggagcgctgcctgctcccgcgccgcgtccggggacgacaacgcttttccttttgacattgaagggagctcagcggttggcaggcaagacccgcctgagacgagcgaaccccgcgtggctctgggacgcctgccgcctgcggccgagaaatgcaatgctggattctttcacaccctgtcgggagaatgtgtgccctgcgactgtaatggcaattccaacgagtgtttggacggctcaggatactgtgtgcactgccagcggaacacaacaggagagcactgtgaaaagtgtctggatggttatatcggagattccatcaggggagcaccccaattctgccagccgtgcccctgtcccctgccccacttggccaattttgcagaatcctgctataggaaaaatggagctgttcggtgcatttgtaacgaaaattatgctggacctaactgtgaaagatgtgctcccggttactatggaaaccccttactcattggaagcacctgtaagaaatgtgactgcagtggaaattcagatcccaacctgatctttgaagattgtgatgaagtcactggccagtgtaggaattgcttacgcaacaccaccggattcaagtgtgaacgttgcgctcctggctactatggggacgccaggatagccaagaactgtgcagtgtgcaactgcgggggaggcccatgtgacagtgtaaccggagaatgcttggaagaaggttttgaaccccctacaggcatggactgcccaaccataagctgtgataagtgcgtctgggacctgactgatgacctgcggttagcagcgctctccatcgaggaaggcaaatccggggtgctgagcgtatcctctggggccgccgctcataggcacgtgaatgaaatcaacgccaccatctacctcctcaaaacaaaattgtcagaaagagaaaaccaatacgccctaagaaagatacaaatcaacaatgctgagaacacgatgaaaagccttctgtctgacgtagaggaattagttgaaaaggaaaatcaagcctccagaaaaggacaacttgttcagaaggaaagcatggacaccattaaccacgcaagtcagctggtagagcaagcccatgatatgagggataaaatccaagagatcaacaacaagatgctctattatggggaagagcatgaacttagccccaaggaaatctctgagaagctggtgttggcccagaagatgcttgaagagattagaagccgtcaaccatttttcacccaacgggagctcgtggatgaggaggcagatgaggcttacgaactactgagccaggctgagagctggcagcggctgcacaatgagacccgcactctgtttcctgtcgtcctggagcagctggatgactacaatgctaagttgtcagatctccaggaagcacttgaccaggcccttaaccatgtcagggatgccgaagacatgaacagggccacagcagccaggcagcgggaccatgagaaacaacaggaaagagtgagggaacaaatggaagtggtgaacatgtctctgagcacatctgcggactctctgacaacacctcgtctaactctttcagaacttgatgatataataaagaatgcgtcagggatttatgcagaaatagatggagccaaaagtgaactacaagtaaaactatctaacctaagtaacctcagccatgatttagtccaagaagctattgaccatgcacaggaccttcaacaagaagctaatgaattgagcaggaagttgcacagttcagatatgaacgggctggtacagaaggctttggatgcatcaaatgtctatgaaaatattgttaattatgttagtgaagccaatgaaacagcagaatttgctttgaacaccactgaccgaatttatgatgcggtgagtgggattgatactcaaatcatttaccataaagatgaaagtgagaacctcctcaatcaagccagagaactgcaagcaaaggcagagtctagcagtgatgaagcagtggctgacactagcaggcgtgtgggtggagccctagcaaggaaaagtgcccttaaaaccagactcagtgatgccgttaagcaactacaagcagcagagagaggggatgcccagcagcgcctggggcagtctagactgatcaccgaggaagccaacaggacgacgatggaggtgcagcaggccactgcccccatggccaacaatctaaccaactggtcacagaatcttcaacattttgactcttctgcttacaacactgcagtgaactctgctagggatgcagtaagaaatctgaccgaggttgtccctcagctcctggatcagcttcgtacggttgagcagaagcgacctgcaagcaacgtttctgccagcatccagaggatccgagagctcattgctcagaccagaagtgttgccagcaagatccaagtctccatgatgtttgatggccagtcagctgtggaagtgcactcgagaaccagtatggatgacttaaaggccttcacgtctctgagcctgtacatgaaaccccctgtgaagcggccggaactgaccgagactgcagatcagtttatcctgtacctcggaagcaaaaacgccaaaaaagagtatatgggtcttgcaatcaaaaatgataatctggtatacgtctataatttgggaactaaagatgtggagattcccctggactccaagcccgtcagttcctggcctgcttacttcagcattgtcaagattgaaagggtgggaaaacatggaaaggtgtttttaacagtcccgagtctaagtagcacagcagaggaaaagttcattaaaaagggggaattttcgggagatgactctctgctggacctggaccctgaggacacagtgttttatgttggtggagtgccttccaacttcaagctccctaccagcttaaacctgcctggctttgttggctgcctggaactggccactttgaataatgatgtgatcagcttgtacaactttaagcacatctataatatggacccctccacatcagtgccatgtgcccgagataagctggccttcactcagagtcgggctgccagttacttcttcgatggctccggttatgccgtggtgagagacatcacaaggagagggaaatttggtcaggtgactcgctttgacatagaagttcgaacaccagctgacaacggccttattctcctgatggtcaatggaagtatgtttttcagactggaaatgcgcaatggttacctacatgtgttctatgattttggattcagcagtggccgtgtgcatcttgaagatacgttaaagaaagctcaaattaatgatgcaaaataccatgagatctcaatcatttaccacaatgataagaaaatgatcttggtagttgacagaaggcatgtcaagagcatggataatgaaaagatgaaaataccttttacagatatatacattggaggagctcctccagaaatcttacaatccagggccctcagagcacaccttcccctagatatcaacttcagaggatgcatgaagggcttccagttccaaaagaaggacttcaatttactggagcagacagaaaccctgggagttggttatggatgcccagaagactcacttatatctcgcagagcatatttcaatggacagagcttcattgcttcaattcagaaaatatctttctttgatggctttgaaggaggttttaatttccgaacattacaaccaaatgggttactattctattatgcttcagggtcagacgtgttctccatctcactggataatggtactgtcatcatggatgtaaagggaatcaaagttcagtcagtagataagcagtacaatgatgggctgtcccacttcgtcattagctctgtctcacccacaagatatgaactgatagtagataaaagcagagttgggagtaagaatcctaccaaagggaaaatagaacagacacaagcaagtgaaaagaagttttacttcggtggctcaccaatcagtgctcagtatgctaatttcactggctgcataagtaatgcctactttaccagggagggaaaagtaaagatgcaccttcatgggatcctgttgctctgaaactcccagagcggaatactccaagaaactctcattgccacctttccaacagccctagagcaatagagcacgcctatcaatatggaggaacagccaacagccgccaagagtttgaacacttaaaaggagattttggtgccaaatctcagttttccattcgtctgagaactcgttcctcccatggcatgatcttctatgtctcagatcaagaagagaatgacttcatgactctatttttggcccatggccgcttggtttacatgtttaatgttggtcacaaaaaactgaagattagaagccaggagaaatacaatgatggcctgtggcatgatgtgatatttattcgagaaaggagcagtggccgactggtaattgatggtctccgagtcctagaagaaagtcttcctcctactgaagctacctggaaaatcaagggtcccatttatttgggaggtgtggctcctggaaaggctgtgaaaaatgttcagattaactccatctacagttttagtggctgtctcagcaatctccagctcaatggggcctccatcacctctgcttctcagacattcagtgtgaccccttgctttgaaggccccatggaaacaggaacttacttttcaacagaaggaggatacgtggttctagatgaatctttcaatattggattgaagtttgaaattgcatttgaagtccgtcccagaagcagttccggaaccctggtccacggccacagtgtcaatggggagtacctaaatgttcacatgaaaaatggacaggtcatagtgaaagtcaataatggcatcagagatttttccacctcagttacacccaagcagagtctctgtgatggcagatggcacagaattacagttattagagattctaatgtggttcagttggatgtggactctgaagtgaaccatgtggttggacccctgaatccaaaaccaattgatcacagggagcctgtgtttgttggaggtgttccagaatctctactgacaccacgcttggcccccagcaaacccttcacaggctgcatacgccactttgtgattgatggacacccagtgagcttcagtaaagcagccctggtcagcggcgccgtaagcatcaactcctgtccagcagcctgacatgacagagcacagctgcccaaatacaaagttctttagagcactgaaagaaacacaaagccagccaggaggaacagtaactcttccttcgggtggaagctttcatcgagttgaacaggacttaaacgaatcatcagggaccggatatttcttatttctcatttggattcttaaccttgaatccaaagtgtctgcaatggacaacaattgaaggagtggcaaacttacttgtattgagagcacacgcaattcctactggtgaaattactgtttctgtttctaataaaatagaagggattccaaata

SEQ ID NO: 365982 - DNA, 3694 bp, Homo sapiens
cgcagggaaaggcggacctcagtgtctgaaaagccagcttagagtgggagggcctgggagtagaaggtaaaaagggagtggtgagaatgaatgtgagaaggaagccaggacagcgcagtccccagtcccgaacggccagggagaggaggtggcctagcgctggcggggctcaccccaatccgtctgccttttgatgccgtactctgctggttgcgcagccacctcgggatactgcacacggagaggagggaaaataagcgaggcaccgccgcaccacgcgggagacctacggagacccacagcgcccgagccctggaagagcactactggatgtcagcggagaaatggctttgagctcagcctggcgctcggttctgcctctgtggctcctctggagcgctgcctgctcccgcgccgcgtccggggacgacaacgcttttccttttgacattgaagggagctcagcggttggcaggcaagacccgcctgagacgagcgaaccccgcgtggctctgggacgcctgccgcctgcggccgagaaatgcaatgctggattctttcacaccctgtcgggagaatgtgtgccctgcgactgtaatggcaattccaacgagtgtttggacggctcaggatactgtgtgcactgccagcggaacacaacaggagagcactgtgaaaagtgtctggatggttatatcggagattccatcaggggagcaccccaattctgccagccgtgcccctgtcccctgccccacttggccaattttgcagaatcctgctataggaaaaatggagctgttcggtgcatttgtaacgaaaattatgctggacctaactgtgaaagatgtgctcccggttactatggaaaccccttactcattggaagcacctgtaagaaatgtgactgcagtggaaattcagatcccaacctgatctttgaagattgtgatgaagtcactggccagtgtaggaattgcttacgcaacaccaccggattcaagtgtgaacgttgcgctcctggctactatggggacgccaggatagccaagaactgtgcagtgtgcaactgcgggggaggcccatgtgacagtgtaaccggagaatgcttggaagaaggttttgaaccccctacaggcatggactgcccaaccataagctgtgataagtgcgtctgggacctgactgatgacctgcggttagcagcgctctccatcgaggaaggcaaatccggggtgctgagcgtatcctctggggccgccgctcataggcacgtgaatgaaatcaacgccaccatctacctcctcaaaacaaaattgtcagaaagagaaaaccaatacgccctaagaaagatacaaatcaacaatgctgagaacacgatgaaaagccttctgtctgacgtagaggaattagttgaaaaggaaaatcaagcctccagaaaaggacaacttgttcagaaggaaagcatggacaccattaaccacgcaagtcagctggtagagcaagcccatgatatgagggataaaatccaagagatcaacaacaagatgctctattatggggaagagcatgaacttagccccaaggaaatctctgagaagctggtgttggcccagaagatgcttgaagagattagaagccgtcaaccatttttcacccaacgggagctcgtggatgaggaggcagatgaggcttacgaactactgagccaggctgagagctggcagcggctgcacaatgagacccgcactctgtttcctgtcgtcctggagcagctggatgactacaatgctaagttgtcagatctccaggaagcacttgaccaggcccttaaccatgtcagggatgccgaagacatgaacagggccacagcagccaggcagcgggaccatgagaaacaacaggaaagagtgagggaacaaatggaagtggtgaacatgtctctgagcacatctgcggactctctgacaacacctcgtctaactctttcagaacttgatgatataataaagaatgcgtcagggatttatgcagaaatagatggagccaaaagtgaactacaagtaaaactatctaacctaagtaacctcagccatgatttagtccaagaagctattgaccatgcacaggaccttcaacaagaagctaatgaattgagcaggaagttgcacagttcagatatgaacgggctggtacagaaggctttggatgcatcaaatgtctatgaaaatattgttaattatgttagtgaagccaatgaaacagcagaatttgctttgaacaccactgaccgaatttatgatgtgagtattccctgaaagttctttataccttgcctttcccactggcttttctgttttctgatgtcatctcttgaacttccagtgtgaaatccaaatggcagaaagagtggaaaaggcaggggaactaagggaagaccatttcatgaatgccttgaaggtttcagtctgcagattcttcgagatgtgctgtagtccagtcagcaaatgccagttcctttgacagtttatttttttagccaaagtccctgagatgtgctattgtccttctcttcatccaggtgatatttattcgagaaaggagcagtggccgactggtaattgatggtctccgagtcctagaagaaagtcttcctcctactgaagctacctggaaaatcaagggtcccatttatttgggaggtgtggctcctggaaaggctgtgaaaaatgttcagattaactccatctacagttttagtggctgtctcagcaatctccagctcaatggggcctccatcacctctgcttctcagacattcagtgtgaccccttgctttgaaggccccatggaaacaggaacttacttttcaacagaaggaggatacgtggttctagatgaatctttcaatattggattgaagtttgaaattgcatttgaagtccgtcccagaagcagttccggaaccctggtccacggccacagtgtcaatggggagtacctaaatgttcacatgaaaaatggacaggtcatagtgaaagtcaataatggcatcagagatttttccacctcagttacacccaagcagagtctctgtgatggcagatggcacagaattacagttattagagattctaatgtggttcagttggatgtggactctgaagtgaaccatgtggttggacccctgaatccaaaaccaattgatcacagggagcctgtgtttgttggaggtgttccagaatctctactgacaccacgcttggcccccagcaaacccttcacaggctgcatacgccactttgtgattgatggacacccagtgagcttcagtaaagcagccctggtcagcggcgccgtaagcatcaactcctgtccagcagcctgacatgacagagcacagctgcccaaatacaaagttctttagagcactgaaagaaacacaaagccagccaggaggaacagtaactcttccttcgggtggaagctttcatcgagttgaacaggacttaaacgaatcatcagggaccggatatttcttatttctcatttggattcttaaccttgaatccaaagtgtctgcaatggacaacaattgaaggagtggcaaacttacttgtattgagagcacacgcaattcctactggtgaaattactgtttctgtttctaataaaatagaagggattccaaata

SEQ ID NO: 365983 - DNA, 6150 bp, Homo sapiens
  misc_feature (5996)..(5996): n is a, c, g, or t
cgcagggaaaggcggacctcagtgtctgaaaagccagcttagagtgggagggcctgggagtagaaggtaaaaagggagtggtgagaatgaatgtgagaaggaagccaggacagcgcagtccccagtcccgaacggccagggagaggaggtggcctagcgctggcggggctcaccccaatccgtctgccttttgatgccgtactctgctggttgcgcagccacctcgggatactgcacacggagaggagggaaaataagcgaggcaccgccgcaccacgcgggagacctacggagacccacagcgcccgagccctggaagagcactactggatgtcagcggagaaatggctttgagctcagcctggcgctcggttctgcctctgtggctcctctggagcgctgcctgctcccgcgccgcgtccggggacgacaacgcttttccttttgacattgaagggagctcagcggttggcaggcaagacccgcctgagacgagcgaaccccgcgtggctctgggacgcctgccgcctgcggccgagaaatgcaatgctggattctttcacaccctgtcgggagaatgtgtgccctgcgactgtaatggcaattccaacgagtgtttggacggctcaggatactgtgtgcactgccagcggaacacaacaggagagcactgtgaaaagtgtctggatggttatatcggagattccatcaggggagcaccccaattctgccagccgtgcccctgtcccctgccccacttggccaattttgcagaatcctgctataggaaaaatggagctgttcggtgcatttgtaacgaaaattatgctggacctaactgtgaaagatgtgctcccggttactatggaaaccccttactcattggaagcacctgtaagaaatgtgactgcagtggaaattcagatcccaacctgatctttgaagattgtgatgaagtcactggccagtgtaggaattgcttacgcaacaccaccggattcaagtgtgaacgttgcgctcctggctactatggggacgccaggatagccaagaactgtgcagtgtgcaactgcgggggaggcccatgtgacagtgtaaccggagaatgcttggaagaaggttttgaaccccctacaggcatggactgcccaaccataagctgtgataagtgcgtctgggacctgactgatgacctgcggttagcagcgctctccatcgaggaaggcaaatccggggtgctgagcgtatcctctggggccgccgctcataggcacgtgaatgaaatcaacgccaccatctacctcctcaaaacaaaattgtcagaaagagaaaaccaatacgccctaagaaagatacaaatcaacaatgctgagaacacgatgaaaagccttctgtctgacgtagaggaattagttgaaaaggaaaatcaagcctccagaaaaggacaacttgttcagaaggaaagcatggacaccattaaccacgcaagtcagctggtagagcaagcccatgatatgagggataaaatccaagagatcaacaacaagatgctctattatggggaagagcatgaacttagccccaaggaaatctctgagaagctggtgttggcccagaagatgcttgaagagattagaagccgtcaaccatttttcacccaacgggagctcgtggatgaggaggcagatgaggcttacgaactactgagccaggctgagagctggcagcggctgcacaatgagacccgcactctgtttcctgtcgtcctggagcagctggatgactacaatgctaagttgtcagatctccaggaagcacttgaccaggcccttaaccatgtcagggatgccgaagacatgaacagggccacagcagccaggcagcgggaccatgagaaacaacaggaaagagtgagggaacaaatggaagtggtgaacatgtctctgagcacatctgcggactctctgacaacacctcgtctaactctttcagaacttgatgatataataaagaatgcgtcagggatttatgcagaaatagatggagccaaaagtgaactacaagtaaaactatctaacctaagtaacctcagccatgatttagtccaagaagctattgaccatgcacaggaccttcaacaagaagctaatgaattgagcaggaagttgcacagttcagatatgaacgggctggtacagaaggctttggatgcatcaaatgtctatgaaaatattgttaattatgttagtgaagccaatgaaacagcagaatttgctttgaacaccactgaccgaatttatgatgcggtgagtgggattgatactcaaatcatttaccataaagatgaaagtgagaacctcctcaatcaagccagagaactgcaagcaaaggcagagtctagcagtgatgaagcagtggctgacactagcaggcgtgtgggtggagccctagcaaggaaaagtgcccttaaaaccagactcagtgatgccgttaagcaactacaagcagcagagagaggggatgcccagcagcgcctggggcagtctagactgatcaccgaggaagccaacaggacgacgatggaggtgcagcaggccactgcccccatggccaacaatctaaccaactggtcacagaatcttcaacattttgactcttctgcttacaacactgcagtgaactctgctagggatgcagtaagaaatctgaccgaggttgtccctcagctcctggatcagcttcgtacggttgagcagaagcgacctgcaagcaacgtttctgccagcatccagaggatccgagagctcattgctcagaccagaagtgttgccagcaagatccaagtctccatgatgtttgatggccagtcagctgtggaagtgcactcgagaaccagtatggatgacttaaaggccttcacgtctctgagcctgtacatgaaaccccctgtgaagcggccggaactgaccgagactgcagatcagtttatcctgtacctcggaagcaaaaacgccaaaaaagagtatatgggtcttgcaatcaaaaatgataatctggtatacgtctataatttgggaactaaagatgtggagattcccctggactccaagcccgtcagttcctggcctgcttacttcagcattgtcaagattgaaagggtgggaaaacatggaaaggtgtttttaacagtcccgagtctaagtagcacagcagaggaaaagttcattaaaaagggggaattttcgggagatgactctctgctggacctggaccctgaggacacagtgttttatgttggtggagtgccttccaacttcaagctccctaccagcttaaacctgcctggctttgttggctgcctggaactggccactttgaataatgatgtgatcagcttgtacaactttaagcacatctataatatggacccctccacatcagtgccatgtgcccgagataagctggccttcactcagagtcgggctgccagttacttcttcgatggctccggttatgccgtggtgagagacatcacaaggagagggaaatttggtcaggtgactcgctttgacatagaagttcgaacaccagctgacaacggccttattctcctgatggtcaatggaagtatgtttttcagactggaaatgcgcaatggttacctacatgtgttctatgattttggattcagcagtggccgtgtgcatcttgaagatacgttaaagaaagctcaaattaatgatgcaaaataccatgagatctcaatcatttaccacaatgataagaaaatgatcttggtagttgacagaaggcatgtcaagagcatggataatgaaaagatgaaaataccttttacagatatatacattggaggagctcctccagaaatcttacaatccagggccctcagagcacaccttcccctagatatcaacttcagaggatgcatgaagggcttccagttccaaaagaaggacttcaatttactggagcagacagaaaccctgggagttggttatggatgcccagaagactcacttatatctcgcagagcatatttcaatggacagagcttcattgcttcaattcagaaaatatctttctttgatggctttgaaggaggttttaatttccgaacattacaaccaaatgggttactattctattatgcttcagggtcagacgtgttctccatctcactggataatggtactgtcatcatggatgtaaagggaatcaaagttcagtcagtagataagcagtacaatgatgggctgtcccacttcgtcattagctctgtctcacccacaagatatgaactgatagtagataaaagcagagttgggagtaagaatcctaccaaagggaaaatagaacagacacaagcaagtgaaaagaagttttacttcggtggctcaccaatcagtgctcagtatgctaatttcactggctgcataagtaatgcctactttaccagggtggatagagatgtggaggttgaagatttccaacggtatactgaaaaggtccacacttctctttatgagtgtcccattgagtcttcaccattgtttctcctccataaaaaaggaaaaaatttatccaagcctaaagcaagtcagaataaaaagggagggaaaagtaaagatgcaccttcatgggatcctgttgctctgaaactcccagagcggaatactccaagaaactctcattgccacctttccaacagccctagagcaatagagcacgcctatcaatatggaggaacagccaacagccgccaagagtttgaacacttaaaaggagattttggtgccaaatctcagttttccattcgtctgagaactcgttcctcccatggcatgatcttctatgtctcagatcaagaagagaatgacttcatgactctatttttggcccatggccgcttggtttacatgtttaatgttggtcacaaaaaactgaagattagaagccaggagaaatacaatgatggcctgtggcatgatgtgatatttattcgagaaaggagcagtggccgactggtaattgatggtctccgagtcctagaagaaagtcttcctcctactgaagctacctggaaaatcaagggtcccatttatttgggaggtgtggctcctggaaaggctgtgaaaaatgttcagattaactccatctacagttttagtggctgtctcagcaatctccagctcaatggggcctccatcacctctgcttctcagacattcagtgtgaccccttgctttgaaggccccatggaaacaggaacttacttttcaacagaaggaggatacgtggttctagatgaatctttcaatattggattgaagtttgaaagaaacacaaagccagccaggaggaacagtaactcttccttcgggtggaagctttcatcgagttgaacaggacttaaacgaatcatcagggaccggatatttcttatttctcatttggattcttaaccttgaatccaaagtgtctgcaatggacaacaattgaaggagtggcaaacttacttgtattgagagcacacgcaattcctactggtgaaattactgtttctgtttctaataaaatagaagggattccaaataaacacttgcacacatttttgaagtgcggctagattctcagattcacctttcttccagggaagataactttcaatctatataaaaatctctgtcctaaaactacctttctttattttgaagagacttactaacttacatataatctaaattagatgatagatttgtttttagcccttttgtttggtctatcagtataagaagaatattttaggtttatagctgaagttatcaaggtttaataaagtaaatttctaacagaatactagaaaaatgcagtataatttaattttttctaaataagaaacacaggaaatcaactactttttccccttccttatctccttaaaagaaaaataaaattgtacatgagaggaaaaaaangtttataacccccattgaggtgctcataggcactttagaaactaaaaaaccctttggggggggcccggcccccaatttgcccttatagagggggtttacacatcaatggccggcgttttacaactgctggactggaaaaaccctggcgttccca

SEQ ID NO: 365984 - DNA, 5061 bp, Homo sapiens
cgcagggaaaggcggacctcagtgtctgaaaagccagcttagagtgggagggcctgggagtagaaggtaaaaagggagtggtgagaatgaatgtgagaaggaagccaggacagcgcagtccccagtcccgaacggccagggagaggaggtggcctagcgctggcggggctcaccccaatccgtctgccttttgatgccgtactctgctggttgcgcagccacctcgggatactgcacacggagaggagggaaaataagcgaggcaccgccgcaccacgcgggagacctacggagacccacagcgcccgagccctggaagagcactactggatgtcagcggagaaatggctttgagctcagcctggcgctcggttctgcctctgtggctcctctggagcgctgcctgctcccgcgccgcgtccggggacgacaacgcttttccttttgacattgaagggagctcagcggttggcaggcaagacccgcctgagacgagcgaaccccgcgtggctctgggacgcctgccgcctgcggccgagaaatgcaatgctggattctttcacaccctgtcgggagaatgtgtgccctgcgactgtaatggcaattccaacgagtgtttggacggctcaggatactgtgtgcactgccagcggaacacaacaggagagcactgtgaaaagtgtctggatggttatatcggagattccatcaggggagcaccccaattctgccagccgtgcccctgtcccctgccccacttggccaattttgcagaatcctgctataggaaaaatggagctgttcggtgcatttgtaacgaaaattatgctggacctaactgtgaaagatgtgctcccggttactatggaaaccccttactcattggaagcacctgtaagaaatgtgactgcagtggaaattcagatcccaacctgatctttgaagattgtgatgaagtcactggccagtgtaggaattgcttacgcaacaccaccggattcaagtgtgaacgttgcgctcctggctactatggggacgccaggatagccaagaactgtgcagtgtgcaactgcgggggaggcccatgtgacagtgtaaccggagaatgcttggaagaaggttttgaaccccctacaggcatggactgcccaaccataagctgtgataagtgcgtctgggacctgactgatgacctgcggttagcagcgctctccatcgaggaaggcaaatccggggtgctgagcgtatcctctggggccgccgctcataggcacgtgaatgaaatcaacgccaccatctacctcctcaaaacaaaattgtcagaaagagaaaaccaatacgccctaagaaagatacaaatcaacaatgctgagaacacgatgaaaagccttctgtctgacgtagaggaattagttgaaaaggaaaatcaagcctccagaaaaggacaacttgttcagaaggaaagcatggacaccattaaccacgcaagtcagctggtagagcaagcccatgatatgagggataaaatccaagagatcaacaacaagatgctctattatggggaagagcatgaacttagccccaaggaaatctctgagaagctggtgttggcccagaagatgcttgaagagattagaagccgtcaaccatttttcacccaacgggagctcgtggatgaggaggcagatgaggcttacgaactactgagccaggctgagagctggcagcggctgcacaatgagacccgcactctgtttcctgtcgtcctggagcagctggatgactacaatgctaagttgtcagatctccaggaagcacttgaccaggcccttaaccatgtcagggatgccgaagacatgaacagggccacagcagccaggcagcgggaccatgagaaacaacaggaaagagtgagggaacaaatggaagtggtgaacatgtctctgagcacatctgcggactctctgacaacacctcgtctaactctttcagaacttgatgatataataaagaatgcgtcagggatttatgcagaaatagatggagccaaaagtgaactacaagtaaaactatctaacctaagtaacctcagccatgatttagtccaagaagctattgaccatgcacaggaccttcaacaagaagctaatgaattgagcaggaagttgcacagttcagatatgaacgggctggtacagaaggctttggatgcatcaaatgtctatgaaaatattgttaattatgttagtgaagccaatgaaacagcagaatttgctttgaacaccactgaccgaatttatgatgcggtgagtgggattgatactcaaatcatttaccataaagatgaaagtgagaacctcctcaatcaagccagagaactgcaagcaaaggcagagtctagcagtgatgaagcagtggctgacactagcaggcgtgtgggtggagccctagcaaggaaaagtgcccttaaaaccagactcagtgatgccgttaagcaactacaagcagcagagagaggggatgcccagcagcgcctggggcagtctagactgatcaccgaggaagccaacaggacgacgatggaggtgcagcaggccactgcccccatggccaacaatctaaccaactggtcacagaatcttcaacattttgactcttctgcttacaacactgcagtgaactctgctagggatgcagtaagaaatctgaccgaggttgtccctcagctcctggatcagcttcgtacggttgagcagaagcgacctgcaagcaacgtttctgccagcatccagaggatccgagagctcattgctcagaccagaagtgttgccagcaagatccaagtctccatgatgtttgatggccagtcagctgtggaagtgcactcgagaaccagtatggatgacttaaaggccttcacgtctctgagcctgtacatgaaaccccctgtgaagcggccggaactgaccgagactgcagatcagtttatcctgtacctcggaagcaaaaacgccaaaaaagagtatatgggtcttgcaatcaaaaatgataatctggtatacgtctataatttgggaactaaagatgtggagattcccctggactccaagcccgtcagttcctggcctgcttacttcagcattgtcaagattgaaagggtgggaaaacatggaaaggtgtttttaacagtcccgagtctaagtagcacagcagaggaaaagttcattaaaaagggggaattttcgggagatgactctctgctggacctggaccctgaggacacagtgttttatgttggtggagtgccttccaacttcaagctccctaccagcttaaacctgcctggctttgttggctgcctggaactggccactttgaataatgatgtgatcagcttgtacaactttaagcacatctataatatggacccctccacatcagtgccatgtgcccgagataagctggccttcactcagagtcgggctgccagttacttcttcgatggctccggttatgccgtggtgagagacatcacaaggagagggaaatttggtcaggtgactcgctttgacatagaagttcgaacaccagctgacaacggccttattctcctgatggtcaatggaagtatgtttttcagactggaaatgcgcaatggttacctacatgtgttctatgattttggattcagcagtggccgtgtgcatcttgaagatacgttaaagaaagctcaaattaatgatgcaaaataccatgagatctcaatcatttaccacaatgataagaaaatgatcttggtagttgacagaaggcatgtcaagagcatggataatgaaaagatgaaaataccttttacagatatatacattggaggagctcctccagaaatcttacaatccagggccctcagagcacaccttcccctagatatcaacttcagaggatgcatgaagggcttccagttccaaaagaaggacttcaatttactggagcagacagaaaccctgggagttggttatggatgcccagaagactcacttatatctcgcagagcatatttcaatggacagagcttcattgcttcaattcagaaaatatctttctttgatggctttgaaggaggttttaatttccgaacattacaaccaaatgggttactattctattatgcttcagggtcagacgtgttctccatctcactggataatggtactgtcatcatggatgtaaagggaatcaaagttcagtcagtagataagcagtacaatgatgggctgtcccacttcgtcattagctctgtctcacccacaagatatgaactgatagtagataaaagcagagttgggagtaagaatcctaccaaagggaaaatagaacagacacaagcaagtgaaaagaagttttacttcggtggctcaccaatcagtgctcagtatgctaatttcactggctgcataagtaatgcctactttaccagggtggatagagatgtggaggttgaagatttccaacggtatactgaaaaggtccacacttctctttatgagtgtcccattgagtcttcaccattgtttctcctccataaaaaaggaaaaaatttatccaagcctaaagcaagtcagaataaaaagggagggaaaagtaaagatgcaccttcatgggatcctgttgctctgaaactcccagagcggaatactccaagaaactctcattgccacctttccaacagccctagagcaatagagcacgcctatcaatatggaggaacagccaacagccgccaagagtttgaacacttaaaaggagattttggtgccaagtaaagtaacacactatactcctagactcctaatgacatggctgggctccatctttgtttgtcacatgtcatcgttttttcccatctttcctttctgtgccaccttaatcctattatgttatcaccaaaataaacactaaatagtacatgatttatgctatcaaaagaattatattctctgtgactttccaattgtaaggttcataaaacagtattcttccaggatactgtatttgatcaaa

SEQ ID NO: 365985 - DNA, 976 bp, Homo sapiens
cagaaaaattgaatcttagtttattcgaattcattactttctcattatattttatgaacaggcaaaaatgtagaggcttaagggtgaagggtaatgaattaaacagaaatattaaccaagtccaaaaatagtgtggaagctaaaatttctttcctccttcttagcaaagtacacattataagtgaggcccaggtgaaattaactttaaaaaacataggtagatcatgaaaattcactgctgaggctttacatgtaagtggtaaatttcagccttgaaagacagctacaatacacagaaatgtgatcatggaaaacatggcaaaacgttaaaattaccacatgtccataggacttcacaagcaaataatgttactgagaaatgagtcaattataactatgttctatttttgaaatgtaaatcatattgatgatatgagcaaatatgtatacttttaccaggaagtaatatttgggcttggaatacctcaattgcaatctttgtttttatttcttgctcttttcagaatctctactgacaccacgcttggcccccagcaaacccttcacaggctgcatacgccactttgtgattgatggacacccagtgagcttcagtaaagcagccctggtcagcggcgccgtaagcatcaactcctgtccagcagcctgacatgacagagcacagctgcccaaatacaaagttctttagagcactgaaagaaacacaaagccagccaggaggaacagtaactcttccttcgggtggaagctttcatcgagttgaacaggacttaaacgaatcatcagggaccggatatttcttatttctcatttggattcttaaccttgaatccaaagtgtctgcaatggacaacaattgaaggagtggcaaacttacttgtattgagagcacacgcaattcctactggtgaaattactgtttctgtttctaataaaatagaagggattccaaata

SEQ ID NO: 365986 - DNA, 4345 bp, Homo sapiens
cgcagggaaaggcggacctcagtgtctgaaaagccagcttagagtgggagggcctgggagtagaaggtaaaaagggagtggtgagaatgaatgtgagaaggaagccaggacagcgcagtccccagtcccgaacggccagggagaggaggtggcctagcgctggcggggctcaccccaatccgtctgccttttgatgccgtactctgctggttgcgcagccacctcgggatactgcacacggagaggagggaaaataagcgaggcaccgccgcaccacgcgggagacctacggagacccacagcgcccgagccctggaagagcactactggatgtcagcggagaaatggctttgagctcagcctggcgctcggttctgcctctgtggctcctctggagcgctgcctgctcccgcgccgcgtccggggacgacaacgcttttccttttgacattgaagggagctcagcggttggcaggcaagacccgcctgagacgagcgaaccccgcgtggctctgggacgcctgccgcctgcggccgagaaatgcaatgctggattctttcacaccctgtcgggagaatgtgtgccctgcgactgtaatggcaattccaacgagtgtttggacggctcaggatactgtgtgcactgccagcggaacacaacaggagagcactgtgaaaagtgtctggatggttatatcggagattccatcaggggagcaccccaattctgccagccgtgcccctgtcccctgccccacttggccaattttgcagaatcctgctataggaaaaatggagctgttcggtgcatttgtaacgaaaattatgctggacctaactgtgaaagatgtgctcccggttactatggaaaccccttactcattggaagcacctgtaagaaatgtgactgcagtggaaattcagatcccaacctgatctttgaagattgtgatgaagtcactggccagtgtaggaattgcttacgcaacaccaccggattcaagtgtgaacgttgcgctcctggctactatggggacgccaggatagccaagaactgtgcagtgtgcaactgcgggggaggcccatgtgacagtgtaaccggagaatgcttggaagaaggttttgaaccccctacaggcatggactgcccaaccataagctgtgataagtgcgtctgggacctgactgatgacctgcggttagcagcgctctccatcgaggaaggcaaatccggggtgctgagcgtatcctctggggccgccgctcataggcacgtgaatgaaatcaacgccaccatctacctcctcaaaacaaaattgtcagaaagagaaaaccaatacgccctaagaaagatacaaatcaacaatgctgagaacacgatgaaaagccttctgtctgacgtagaggaattagttgaaaaggaaaatcaagcctccagaaaaggacaacttgttcagaaggaaagcatggacaccattaaccacgcaagtcagctggtagagcaagcccatgatatgagggataaaatccaagagatcaacaacaagatgctctattatggggaagagcatgaacttagccccaaggaaatctctgagaagctggtgttggcccagaagatgcttgaagagattagaagccgtcaaccatttttcacccaacgggagctcgtggatgaggaggcagatgaggcttacgaactactgagccaggctgagagctggcagcggctgcacaatgagacccgcactctgtttcctgtcgtcctggagcagctggatgactacaatgctaagttgtcagatctccaggaagcacttgaccaggcccttaaccatgtcagggatgccgaagacatgaacagggccacagcagccaggcagcgggaccatgagaaacaacaggaaagagtgagggaacaaatggaagtggtgaacatgtctctgagcacatctgcggactctctgacaacacctcgtctaactctttcagaacttgatgatataataaagaatgcgtcagggatttatgcagaaatagatggagccaaaagtgaactacaagtaaaactatctaacctaagtaacctcagccatgatttagtccaagaagctattgaccatgcacaggaccttcaacaagaagctaatgaattgagcaggaagttgcacagttcagatatgaacgggctggtacagaaggctttggatgcatcaaatgtctatgaaaatattgttaattatgttagtgaagccaatgaaacagcagaatttgctttgaacaccactgaccgaatttatgatgcggtgagtgggattgatactcaaatcatttaccataaagatgaaagtgagaacctcctcaatcaagccagagaactgcaagcaaaggcagagtctagcagtgatgaagcagtggctgacactagcaggcgtgtgggtggagccctagcaaggaaaagtgcccttaaaaccagactcagtgatgccgttaagcaactacaagcagcagagagaggggatgcccagcagcgcctggggcagtctagactgatcaccgaggaagccaacaggacgacgatggaggtgcagcaggccactgcccccatggccaacaatctaaccaactggtcacagaatcttcaacattttgactcttctgcttacaacactgcagtgaactctgctagggatgcagtaagaaatctgaccgaggttgtccctcagctcctggatcagcttcgtacggttgagcagaagcgacctgcaagcaacgtttctgccagcatccagaggatccgagagctcattgctcagaccagaagtgttgccagcaagatccaagtctccatgatgtttgatggccagtcagctgtggaagtgcactcgagaaccagtatggatgacttaaaggccttcacgtctctgagcctgtacatgaaaccccctgtgaagcggccggaactgaccgagactgcagatcagtttatcctgtacctcggaagcaaaaacgccaaaaaagagtatatgggtcttgcaatcaaaaatgataatctggtatacgtctataatttgggaactaaagatgtggagattcccctggactccaagcccgtcagttcctggcctgcttacttcagcattgtcaagattgaaagggtgggaaaacatggaaaggtgtttttaacagtcccgagtctaagtagcacagcagaggaaaagttcattaaaaagggggaattttcgggagatgactctctgctggacctggaccctgaggacacagtgttttatgttggtggagtgccttccaacttcaagctccctaccagcttaaacctgcctggctttgttggctgcctggaactggccactttgaataatgatgtgatcagcttgtacaactttaagcacatctataatatggacccctccacatcagtgccatgtgcccgagataagctggccttcactcagagtcgggctgccagttacttcttcgatggctccggttatgccgtggtgagagacatcacaaggagagggaaatttggtcaggtgactcgctttgacatagaagttcgaacaccagctgacaacggccttattctcctgatggtcaatggaagtatgtttttcagactggaaatgcgcaatggttacctacatgtgttctatgattttggattcagcagtggccgtgtgcatcttgaagatacgttaaagaaagctcaaattaatgatgcaaaataccatgagatctcaatcatttaccacaatgataagaaaatgatcttggtagttgacagaaggcatgtcaagagcatggataatgaaaagatgaaaataccttttacagatatatacattggaggagctcctccagaaatcttacaatccagggccctcagagcacaccttcccctagatatcaacttcagaggatgcatgaagggcttccagttccaaaagaaggacttcaatttactggagcagacagaaaccctgggagttggttatggatgcccagaagactcacttatatctcgcagagcatatttcaatggacagagcttcattgcttcaattcagaaaatatctttctttgatggctttgaaggaggttttaatttccgaacattacaaccaaatgggttactattctattatgcttcagggtcagacgtgttctccatctcactggataatggtactgtcatcatggatgtaaagggaatcaaagttcagtcagtagataagcagtacaatgatgggctgtcccacttcgtcattagctctgtctcacccacaagattgaaccggatagcttgccggtatcctctatg

SEQ ID NO: 365987 - DNA, 2544 bp, Homo sapiens
  misc_feature (2475)..(2475): n is a, c, g, or t
  misc_feature (2491)..(2492): n is a, c, g, or t
  misc_feature (2507)..(2507): n is a, c, g, or t
cgcagggaaaggcggacctcagtgtctgaaaagccagcttagagtgggagggcctgggagtagaaggtaaaaagggagtggtgagaatgaatgtgagaaggaagccaggacagcgcagtccccagtcccgaacggccagggagaggaggtggcctagcgctggcggggctcaccccaatccgtctgccttttgatgccgtactctgctggttgcgcagccacctcgggatactgcacacggagaggagggaaaataagcgaggcaccgccgcaccacgcgggagacctacggagacccacagcgcccgagccctggaagagcactactggatgtcagcggagaaatggctttgagctcagcctggcgctcggttctgcctctgtggctcctctggagcgctgcctgctcccgcgccgcgtccggggacgacaacgcttttccttttgacattgaagggagctcagcggttggcaggcaagacccgcctgagacgagcgaaccccgcgtggctctgggacgcctgccgcctgcggccgagaaatgcaatgctggattctttcacaccctgtcgggagaatgtgtgccctgcgactgtaatggcaattccaacgagtgtttggacggctcaggatactgtgtgcactgccagcggaacacaacaggagagcactgtgaaaagtgtctggatggttatatcggagattccatcaggggagcaccccaattctgccagccgtgcccctgtcccctgccccacttggccaattttgcagaatcctgctataggaaaaatggagctgttcggtgcatttgtaacgaaaattatgctggacctaactgtgaaagatgtgctcccggttactatggaaaccccttactcattggaagcacctgtaagaaatgtgactgcagtggaaattcagatcccaacctgatctttgaagattgtgatgaagtcactggccagtgtaggaattgcttacgcaacaccaccggattcaagtgtgaacgttgcgctcctggctactatggggacgccaggatagccaagaactgtgcagtgtgcaactgcgggggaggcccatgtgacagtgtaaccggagaatgcttggaagaaggttttgaaccccctacaggcatggactgcccaaccataagctgtgataagtgcgtctgggacctgactgatgacctgcggttagcagcgctctccatcgaggaaggcaaatccggggtgctgagcgtatcctctggggccgccgctcataggcacgtgaatgaaatcaacgccaccatctacctcctcaaaacaaaattgtcagaaagagaaaaccaatacgccctaagaaagatacaaatcaacaatgctgagaacacgatgaaaagccttctgtctgacgtagaggaattagttgaaaaggaaaatcaagcctccagaaaaggacaacttgttcagaaggaaagcatggacaccattaaccacgcaagtcagctggtagagcaagcccatgatatgagggataaaatccaagagatcaacaacaagatgctctattatggggaagagcatgaacttagccccaaggaaatctctgagaagctggtgttggcccagaagatgcttgaagagattagaagccgtcaaccatttttcacccaacgggagctcgtggatgaggaggcagatgaggcttacgaactactgagccaggctgagagctggcagcggctgcacaatgagacccgcactctgtttcctgtcgtcctggagcagctggatgactacaatgctaagttgtcagatctccaggaagcacttgaccaggcccttaaccatgtcagggatgccgaagacatgaacagggccacagcagccaggcagcgggaccatgagaaacaacaggaaagagtgagggaacaaatggaagtggtgaacatgtctctgagcacatctgcggactctctgacaacacctcgtctaactctttcagaacttgatgatataataaagaatgcgtcagggatttatgcagaaatagatggagccaaaagtgaactacaagtaaaactatctaacctaagtaacctcagccatgatttagtccaagaagctattgaccatgcacaggaccttcaacaagaagctaatgaattgagcaggaagttgcacagttcagatatgaacgggctggtacagaaggctttggatgcatcaaatgtctatgaaaatattgttaattatgttagtgaagccaatgaaacagcagaatttgctttgaacaccactgaccgaatttatgatgcggtgagtgggattgatactcaaatcatttaccataaagatgaaagtgagaacctcctcaatcaagccagagaactgcaagcaaaggcagagtctagcagtgatgaagcagtggctgacactagcaggcgtgtgggtggagccctagcaaggaaaagtgcccttaaaaccnagctctctagtgatcnntataatcaagcttancgatacggtcgacctcgaggggggccattaccccatg

SEQ ID NO: 365988 - DNA, 1614 bp, Homo sapiens
cgcagggaaaggcggacctcagtgtctgaaaagccagcttagagtgggagggcctgggagtagaaggtaaaaagggagtggtgagaatgaatgtgagaaggaagccaggacagcgcagtccccagtcccgaacggccagggagaggaggtggcctagcgctggcggggctcaccccaatccgtctgccttttgatgccgtactctgctggttgcgcagccacctcgggatactgcacacggagaggagggaaaataagcgaggcaccgccgcaccacgcgggagacctacggagacccacagcgcccgagccctggaagagcactactggatgtcagcggagaaatggctttgagctcagcctggcgctcggttctgcctctgtggctcctctggagcgctgcctgctcccgcgccgcgtccggggacgacaacgcttttccttttgacattgaagggagctcagcggttggcaggcaagacccgcctgagacgagcgaaccccgcgtggctctgggacgcctgccgcctgcggccgagaaatgcaatgctggattctttcacaccctgtcgggagaatgtgtgccctgcgactgtaatggcaattccaacgagtgtttggacggctcaggatactgtgtgcactgccagcggaacacaacaggagagcactgtgaaaagtgtctggatggttatatcggagattccatcaggggagcaccccaattctgccagccgtgcccctgtcccctgccccacttggccaattttgcagaatcctgctataggaaaaatggagctgttcggtgcatttgtaacgaaaattatgctggacctaactgtgaaagatgtgctcccggttactatggaaaccccttactcattggaagcacctgtaagaaatgtgactgcagtggaaattcagatcccaacctgatctttgaagattgtgatgaagtcactggccagtgtaggaattgcttacgcaacaccaccggattcaagtgtgaacgttgcgctcctggctactatggggacgccaggatagccaagaactgtgcagtgtgcaactgcgggggaggcccatgtgacagtgtaaccggagaatgcttggaagaaggttttgaaccccctacaggcatggactgcccaaccataagtaaaaataacagtacatgattgactaaccccactttctctaatgtgctgcaggtgtgggattaagaaaagctatgcaatatcactctctagaaactctgagtcccacccctggacttaaccctttctgcacctcagcaaatggagcctgcaccaagtacttggtggtccacttgattccctagggcaaatgggtggtttacatttgcatagctctattttatccagtctttacattcagaatcttacctaatggctaaaggcaaagtcagaaacacaactcccagtgacagagctcttttcagctccttttcctatatcgtctcttcaggtccctgaaaatacgacgtacaaacaatttacaacacctggggaaactgagataccaagagatttaagtggcttctcccaagttacctcaaatctgaagtgggagcagaagtaaatattcaggctt

SEQ ID NO: 365989 - DNA, 1032 bp, Homo sapiens
  misc_feature (953)..(953): n is a, c, g, or t
  misc_feature (959)..(959): n is a, c, g, or t
  misc_feature (999)..(999): n is a, c, g, or t
  misc_feature (1002)..(1002): n is a, c, g, or t
  misc_feature (1004)..(1004): n is a, c, g, or t
  misc_feature (1009)..(1009): n is a, c, g, or t
  misc_feature (1012)..(1012): n is a, c, g, or t
  misc_feature (1018)..(1018): n is a, c, g, or t
cgcagggaaaggcggacctcagtgtctgaaaagccagcttagagtgggagggcctgggagtagaaggtaaaaagggagtggtgagaatgaatgtgagaaggaagccaggacagcgcagtccccagtcccgaacggccagggagaggaggtggcctagcgctggcggggctcaccccaatccgtctgccttttgatgccgtactctgctggttgcgcagccacctcgggatactgcacacggagaggagggaaaataagcgaggcaccgccgcaccacgcgggagacctacggagacccacagcgcccgagccctggaagagcactactggatgtcagcggagaaatggctttgagctcagcctggcgctcggttctgcctctgtggctcctctggagcgctgcctgctcccgcgccgcgtccggggacgacaacgcttttccttttgacattgaagggagctcagcggttggcaggcaagacccgcctgagacgagcgaaccccgcgtggctctgggacgcctgccgcctgcggccgagaaatgcaatgctggattctttcacaccctgtcgggagaatgtgtgccctgcgactgtaatggcaattccaacgagtgtttggacggctcaggatactgtgtgcactgccagcggaacacaacaggagagcactgtgaaaagtgtctggatggttatatcggagattccatcaggggagcaccccaattctgccagccgtgcccctgtcccctgccccacttggccaattttgcagaatcctgctataggaaaaatggagctgttcggtgcatttgtaacgaaaattatgctggacctaactgtgaaaggccttctccacagagcacgagaggctttccactgaatgactcgaaatgcaatgctggattctttcacacccgtcgggagaatgtgtgccctgcgactgtaatggcnattccnacgagtgtttggacggctcaggatactgtgtgcactgccngcngnacacnacnggagancactgtgaaaagtg

SEQ ID NO: 365990 - DNA, 473 bp, Homo sapiens
tgatatttattcgagaaaggagcagtggccgactggtaattgatggtctccgagtcctagaagaaagtcttcctcctactgaagctacctggaaaatcaagggtcccatttatttgggaggtgtggctcctggaaaggctgtgaaaaatgttcaggtaagccaggcatgaccaggtagagccattgaccattagagccagaagatcatctaattgaggccctcgtctcacagattaggaaactagaaactagcaccagtaaaactgtagttttctggaaatgggatatcaaagtaagtactgtcttatgggctgcctgtctgccctgtggcattacaaagtcagaagtaatctttcaattctaaggtagatgtcaaatgaaaaagtttcagaggcataaattatcatgaaaatttatgtctcaaggagatcttatttgttcaggaagtacccatacttttaatgtaaagacat

SEQ ID NO: 365991 - DNA, 851 bp, Homo sapiens
caaacaagagcccaagctacactcctgagtcaatccctttcagccaggagaatagcaggcactgaatggctcaagcttagttacttaaacaattcattgtgactagactgatcaatgtttctcaatagaggtgctattaacgttgtggctaggacatttcccagctgtacgctacaggtacatctcattgcagtacctttggcatatctggtcccacccatcatatatcatttgtgtacaccagttccctggctggatataccagttcaatcctatagctggaagcctggctgaactgaatggcctacagatgaagtgaaccaaatgatctataacataatggggaggggtagttccttaaaaacgaaatctggtcctatgaagaagatgagagagtgcaaatgaattctgggagggaaatcaataaatatccactacatctttcttctttgtaggaaagaagattaaaaggaagaaaaaccatgatgctaaatatttaaatgtgtgatattcctcttcagatgtgctcccggttactatggaaaccccttactcattggaagcacctgtaagaaatgtgactgcagtggaaattcagatcccaacctgatctttgaagattgtgatgaagtcactggccagtgtaggaattgcttacgcaacaccaccggattcaagtgtgaacgttgcgctcctggctactatggggacgccaggatagccaagaactgtgcaggtgcagtatcataaatactaagccagctgcctggccagcatgaccctctgccaatactgaatttagatgaagaatttctcttggggaagtattgtgagtgcccccttgtcacttt

SEQ ID NO: 365992 - DNA, 280 bp, Homo sapiens
cacaagcagtattacaagtgttctgcaattctgtacctcgaattttaaatgctactttccagaattgttgatctatgttcagagtattcagaatactgcaaatactgcagatgactgcatcgtacaaatgagaagtttccttgttgaaatggaatccttttcgaggcatcttggctccactagtacttctttctgctgctcttccacaggcagtgatgaagcagtggctgacactagcaggcgtgtgggtggagccctagcaaggaaaagtgcccttaaa

SEQ ID NO: 365993 - DNA, 758 bp, Homo sapiens
acttttcagcaattattattgagtgtcttttattggctaagctgtggaagatacaaagtgaagagtaaatcagtgaggaagataggataccacagtgggagcagataaatattgaaagaaattggtgggtatgtaatgtcaagagtaagcaatgtaacatgcattacaagtaatcacaagaagtttaactgggagagaacatatggcctgttctgtctatatgtggcctggttaactgggaaaagcttcatagagaacatggaaaaacataagctatattcagaaattaagctttaaatcattctatctagaggtcagaaaatacatagatcacttcctctaatacctgaagtggtaaatggaagatgatcatgaaaaaaatacacctatgcatataaagcaaaggggcctggagacagctcacaataaaggcatatgctgtataacaaaacagaatcaaatgagggataaagtttctgccattccaaaaactgcattgccagaagcctactaaacagaagagataaactcctgaccttcagagatggggccattttaaaaataaactttctgaagatttcccacagcattgcaatagcaaagttggaagaagaggaaacacagccttttctgcaatcttggaatgtacctgagatgtgctattgtccttctcttcatccaggtgatatttattcgagaaaggagcagtggccgactggtaattgatggtctccgagtcctagaagaaagtcttcctc

SEQ ID NO: 365994 - DNA, 2719 bp, Homo sapiens
  misc_feature (55)..(55): n is a, c, g, or t
  misc_feature (209)..(209): n is a, c, g, or t
  misc_feature (638)..(638): n is a, c, g, or t
  misc_feature (690)..(690): n is a, c, g, or t
  misc_feature (828)..(828): n is a, c, g, or t
  misc_feature (831)..(831): n is a, c, g, or t
  misc_feature (913)..(913): n is a, c, g, or t
  misc_feature (1049)..(1049): n is a, c, g, or t
  misc_feature (1137)..(1137): n is a, c, g, or t
ttttaaagagctgagccaaaaaagcaacagacaaggcaagtgggcattcgaccanatgccagactaaagaacttctcttcctcttaaatataacccatagatcagtccttcaaatcccaaaagtaagtacatgtcgcccatgctgtgcatacagggtggtgtcctagccttgaatcatttctgtgctcttagatcacattctgtccttnaccacgcacacaaaaacacacacatacacacagacgcccacacaaaccctttcttcagaggccacatttgagttgggcattatttttgacaaatactgtgtgagatctctgaaacagaatctcccaagttgagagaatggaatcagcttctcggagaagagctccattcacgctgagccaaatctgcttgagcagttatttgtacacaagtgccatcaatgttgatgggaatttggaatgaagcactgaaaacagcatgttaggccagtgagaataatccttgaaatctctgtggtaattcaatttcagcagtggttggaccacccaggagccactggaagcatggtgcatttcaaggtctgcctattttttcaacaattttctctttgaaactttaagctcttcagtcagcacaatgtcaaaatgatnagcagacatgggcaattttctagtccagcaacttgagatacagtaaaaattngaagaataaattacatatgaaaggcagttggttgggactgaactgtgactgatgatataggaatagcaccagattttatagcattctgtcattctaaaactggccatcaagtgaagtaacttaggaatggaaaaccanacnttgtatgtcctaactgatacgtgggagctaagctatgaggacgcagaggcataagaatgatacaatggactttggggacttncagggaagagtggagtggggagggataaaagactacaaatatggtgcagtgtatactgctcgggtgatgggtgcaccaaagtctaacaaatcaccactaaagaacttactcatgtaaccaaataccacctataccncaataacttacggaaaaattaaaaaattttttaaaagtaaaactggccatcacattacctttcatgcattatttttgggatgatttcntgtgttatagaactttcacatgccaggaagatttacgtttaggaaatacattatgcccacccacccctatctgtgcttatacaacattcttttctcatacatttaatctagcctttatacggattatttgtaggaaaatcaagcctccagaaaaggacaacttgttcagaaggaaagcatggacaccattaaccacgcaagtcagctggtagagcaagcccatgatatgagggataaaatccaagagatcaacaacaagatgctctattatggggaagagcatgaacttagccccaaggaaatctctgagaagctggtgttggcccagaagatgcttgaagagattagaagccgtcaaccatttttcacccaacgggagctcgtggatgaggaggcagatgaggcttacgaactactgagccaggctgagagctggcagcggctgcacaatgagacccgcactctgtttcctgtcgtcctggagcagctggatgactacaatgctaagttgtcagatctccaggaagcacttgaccaggcccttaaccatgtcagggatgccgaagacatgaacagggccacagcagccaggcagcgggaccatgaggtacagcggacactcaccatcaatgcatttcagcatcagcagtgtgatggtacaccaagaaggggctgttgatataaatttttttaaaatattggtatagttaaatacttatattttaaaatattggtgtgttttttggtgctataaattactaacttgtgtgttcctaaaatcaagttgaaactaggataattgtctagttcttgctttgataagaacgcagtagttctgatgcttgtgtccatgtgtatgggtctgttattcttgcaagtgggtaagcaatgcatagctttttttatactgagagcactagaaggccaaagcatctcaaaaccatgggttctgggtatgcataatttttggaaaggcacgataagcaaatctcacagtctggctggtcagcagctgcagggataaggagactaattgccaaggccatgcaaatgcaaagaggaaggtgaggaggattcccagatgtgatcatagcttgcaaagatggtcatctcatggggccagaattcgtgcatgcccacacctacaaagctgagaactggtagtggtcatgtgtccgcttcaagcaatgcatgtattcacagccgccagcatcaagaggggccatcttttgataggatgacacatgcatgttcaaacatattttaaaagattagggagaaaagaatactgtgaacaaatagaaaccaattatgagcaaattcacgaattcggttatgtactattgtggctggcaaaagccacttaaactaggctctctagcctgattttcagccatcattacccctcactaagaatccttgtaaaatttcttccgtaaaagttaattacactcatcaccactgtttgctaatgggagcaaacccctagccaatattttttagaataatatggttgggataactttttttttttttttgctaaatgaatgcatgattatcttatacaataaaagtataacac

SEQ ID NO: 365995 - DNA, 1968 bp, Homo sapiens
tttatcctgggcctcatgaagagtttggcaactcgctgtcttttcattaaccacatgttccatttcaatttcatgagaaaacctgcttatccaacctagagtgggtcaaggtaaaatgctagctctgtggtatgtaaagaagcctttttcttttgcagatatgaactgatagtagataaaagcagagttgggagtaagaatcctaccaaagggaaaatagaacagacacaagcaagtgaaaagaagttttacttcggtggctcaccaatcagtgctcagtatgctaatttcactggctgcataagtaatgcctactttaccagggtggatagagatgtggaggttgaagatttccaacggtatactgaaaaggtccacacttctctttatgagtgtcccattgagtcttcaccattgtttctcctccataaaaaaggaaaaaatttatccaagcctaaagcaagtcagaataaaaagggagggaaaagtaaagatgcaccttcatgggatcctgttgctctgaaactcccagagcggaatactccaagaaactctcattgccacctttccaacagccctagagcaatagagcacgcctatcaatatggaggaacagccaacagccgccaagagtttgaacacttaaaaggagattttggtgccaaatctcagttttccattcgtctgagaactcgttcctcccatggcatgatcttctatgtctcagatcaagaagagaatgacttcatgactctatttttggcccatggccgcttggtttacatgtttaatgttggtcacaaaaaactgaagattagaagccaggagaaatacaatgatggcctgtggcatgatgtgatatttattcgagaaaggagcagtggccgactggtaattgatggtctccgagtcctagaagaaagtcttcctcctactgaagctacctggaaaatcaagggtcccatttatttgggaggtgtggctcctggaaaggctgtgaaaaatgttcagattaactccatctacagttttagtggctgtctcagcaatctccagctcaatggggcctccatcacctctgcttctcagacattcagtgtgaccccttgctttgaaggccccatggaaacaggaacttacttttcaacagaaggaggatacgtggttctagatgaatctttcaatattggattgaagtttgaaattgcatttgaagtccgtcccagaagcagttccggaaccctggtccacggccacagtgtcaatggggagtacctaaatgttcacatgaaaaatggacaggtcatagtgaaagtcaataatggcatcagagatttttccacctcagttacacccaagcagagtctctgtgatggcagatggcacagaattacagttattagagattctaatgtggttcagttggatgtggactctgaagtgaaccatgtggttggacccctgaatccaaaaccaattgatcacagggagcctgtgtttgttggaggtgttccagaatctctactgacaccacgcttggcccccagcaaacccttcacaggctgcatacgccactttgtgattgatggacacccagtgagcttcagtaaagcagccctggtcagcggcgccgtaagcatcaactcctgtccagcagcctgacatgacagagcacagctgcccaaatacaaagttctttagagcactgaaagaaacacaaagccagccaggaggaacagtaactcttccttcgggtggaagctttcatcgagttgaacaggacttaaacgaatcatcagggaccggatatttcttatttctcatttggattcttaaccttgaatccaaagtgtctgcaatggacaacaattgaaggagtggcaaacttacttgtattgagagcacacgcaattcctactggtgaaattactgtttctgtttctaataaaatagaagggattccaaata

SEQ ID NO: 365996 - DNA, 1879 bp, Homo sapiens
ataagcactaggtagtcatcataatggttcattcctctgcctgacttccatcacataaacaaactcctgcaagaagaagtgcagagggctgtttttaaatcgtcattcccttttcctgctgctactgccagacaggcagctgtcagagaaccaaaatgctgttcagcaaagacagaagaatgcagaggaggtgtgaccctcaagaaaaccttgccacactaggtgactttgaataacaggaaggaagcatctgtgatcctagaagtatttaaaaagcaagcattaaacatggccccattccccaagaaggtaagaaggagaaataacaatgtttgtttattaacaggaagttgcacagttcagatatgaacgggctggtacagaaggctttggatgcatcaaatgtctatgaaaatattgttaattatgttagtgaagccaatgaaacagcagaatttgctttgaacaccactgaccgaatttatgatgtgagtattccctgaaagttctttataccttgcctttcccactggcttttctgttttctgatgtcatctcttgaacttccagtgtgaaatccaaatggcagaaagagtggaaaaggcaggggaactaagggaagaccatttcatgaatgccttgaaggtttcagtctgcagattcttcgagatgtgctgtagtccagtcagcaaatgccagttcctttgacagtttatttttttagccaaagtccctgagatgtgctattgtccttctcttcatccaggtgatatttattcgagaaaggagcagtggccgactggtaattgatggtctccgagtcctagaagaaagtcttcctcctactgaagctacctggaaaatcaagggtcccatttatttgggaggtgtggctcctggaaaggctgtgaaaaatgttcagattaactccatctacagttttagtggctgtctcagcaatctccagctcaatggggcctccatcacctctgcttctcagacattcagtgtgaccccttgctttgaaggccccatggaaacaggaacttacttttcaacagaaggaggatacgtggttctagatgaatctttcaatattggattgaagtttgaaattgcatttgaagtccgtcccagaagcagttccggaaccctggtccacggccacagtgtcaatggggagtacctaaatgttcacatgaaaaatggacaggtcatagtgaaagtcaataatggcatcagagatttttccacctcagttacacccaagcagagtctctgtgatggcagatggcacagaattacagttattagagattctaatgtggttcagttggatgtggactctgaagtgaaccatgtggttggacccctgaatccaaaaccaattgatcacagggagcctgtgtttgttggaggtgttccagaatctctactgacaccacgcttggcccccagcaaacccttcacaggctgcatacgccactttgtgattgatggacacccagtgagcttcagtaaagcagccctggtcagcggcgccgtaagcatcaactcctgtccagcagcctgacatgacagagcacagctgcccaaatacaaagttctttagagcactgaaagaaacacaaagccagccaggaggaacagtaactcttccttcgggtggaagctttcatcgagttgaacaggacttaaacgaatcatcagggaccggatatttcttatttctcatttggattcttaaccttgaatccaaagtgtctgcaatggacaacaattgaaggagtggcaaacttacttgtattgagagcacacgcaattcctactggtgaaattactgtttctgtttctaataaaatagaagggattccaaata

SEQ ID NO: 365997 - DNA, 6053 bp, Homo sapiens
  misc_feature (5899)..(5899): n is a, c, g, or t
cgcagggaaaggcggacctcagtgtctgaaaagccagcttagagtgggagggcctgggagtagaaggtaaaaagggagtggtgagaatgaatgtgagaaggaagccaggacagcgcagtccccagtcccgaacggccagggagaggaggtggcctagcgctggcggggctcaccccaatccgtctgccttttgatgccgtactctgctggttgcgcagccacctcgggatactgcacacggagaggagggaaaataagcgaggcaccgccgcaccacgcgggagacctacggagacccacagcgcccgagccctggaagagcactactggatgtcagcggagaaatggctttgagctcagcctggcgctcggttctgcctctgtggctcctctggagcgctgcctgctcccgcgccgcgtccggggacgacaacgcttttccttttgacattgaagggagctcagcggttggcaggcaagacccgcctgagacgagcgaaccccgcgtggctctgggacgcctgccgcctgcggccgagaaatgcaatgctggattctttcacaccctgtcgggagaatgtgtgccctgcgactgtaatggcaattccaacgagtgtttggacggctcaggatactgtgtgcactgccagcggaacacaacaggagagcactgtgaaaagtgtctggatggttatatcggagattccatcaggggagcaccccaattctgccagccgtgcccctgtcccctgccccacttggccaattttgcagaatcctgctataggaaaaatggagctgttcggtgcatttgtaacgaaaattatgctggacctaactgtgaaagatgtgctcccggttactatggaaaccccttactcattggaagcacctgtaagaaatgtgactgcagtggaaattcagatcccaacctgatctttgaagattgtgatgaagtcactggccagtgtaggaattgcttacgcaacaccaccggattcaagtgtgaacgttgcgctcctggctactatggggacgccaggatagccaagaactgtgcagtgtgcaactgcgggggaggcccatgtgacagtgtaaccggagaatgcttggaagaaggttttgaaccccctacaggcatggactgcccaaccataagctgtgataagtgcgtctgggacctgactgatgacctgcggttagcagcgctctccatcgaggaaggcaaatccggggtgctgagcgtatcctctggggccgccgctcataggcacgtgaatgaaatcaacgccaccatctacctcctcaaaacaaaattgtcagaaagagaaaaccaatacgccctaagaaagatacaaatcaacaatgctgagaacacgatgaaaagccttctgtctgacgtagaggaattagttgaaaaggaaaatcaagcctccagaaaaggacaacttgttcagaaggaaagcatggacaccattaaccacgcaagtcagctggtagagcaagcccatgatatgagggataaaatccaagagatcaacaacaagatgctctattatggggaagagcatgaacttagccccaaggaaatctctgagaagctggtgttggcccagaagatgcttgaagagattagaagccgtcaaccatttttcacccaacgggagctcgtggatgaggaggcagatgaggcttacgaactactgagccaggctgagagctggcagcggctgcacaatgagacccgcactctgtttcctgtcgtcctggagcagctggatgactacaatgctaagttgtcagatctccaggaagcacttgaccaggcccttaaccatgtcagggatgccgaagacatgaacagggccacagcagccaggcagcgggaccatgagaaacaacaggaaagagtgagggaacaaatggaagtggtgaacatgtctctgagcacatctgcggactctctgacaacacctcgtctaactctttcagaacttgatgatataataaagaatgcgtcagggatttatgcagaaatagatggagccaaaagtgaactacaagtaaaactatctaacctaagtaacctcagccatgatttagtccaagaagctattgaccatgcacaggaccttcaacaagaagctaatgaattgagcaggaagttgcacagttcagatatgaacgggctggtacagaaggctttggatgcatcaaatgtctatgaaaatattgttaattatgttagtgaagccaatgaaacagcagaatttgctttgaacaccactgaccgaatttatgatgcggtgagtgggattgatactcaaatcatttaccataaagatgaaagtgagaacctcctcaatcaagccagagaactgcaagcaaaggcagagtctagcagtgatgaagcagtggctgacactagcaggcgtgtgggtggagccctagcaaggaaaagtgcccttaaaaccagactcagtgatgccgttaagcaactacaagcagcagagagaggggatgcccagcagcgcctggggcagtctagactgatcaccgaggaagccaacaggacgacgatggaggtgcagcaggccactgcccccatggccaacaatctaaccaactggtcacagaatcttcaacattttgactcttctgcttacaacactgcagtgaactctgctagggatgcagtaagaaatctgaccgaggttgtccctcagctcctggatcagcttcgtacggttgagcagaagcgacctgcaagcaacgtttctgccagcatccagaggatccgagagctcattgctcagaccagaagtgttgccagcaagatccaagtctccatgatgtttgatggccagtcagctgtggaagtgcactcgagaaccagtatggatgacttaaaggccttcacgtctctgagcctgtacatgaaaccccctgtgaagcggccggaactgaccgagactgcagatcagtttatcctgtacctcggaagcaaaaacgccaaaaaagagtatatgggtcttgcaatcaaaaatgataatctggtatacgtctataatttgggaactaaagatgtggagattcccctggactccaagcccgtcagttcctggcctgcttacttcagcattgtcaagattgaaagggtgggaaaacatggaaaggtgtttttaacagtcccgagtctaagtagcacagcagaggaaaagttcattaaaaagggggaattttcgggagatgactctctgctggacctggaccctgaggacacagtgttttatgttggtggagtgccttccaacttcaagctccctaccagcttaaacctgcctggctttgttggctgcctggaactggccactttgaataatgatgtgatcagcttgtacaactttaagcacatctataatatggacccctccacatcagtgccatgtgcccgagataagctggccttcactcagagtcgggctgccagttacttcttcgatggctccggttatgccgtggtgagagacatcacaaggagagggaaatttggtcaggtgactcgctttgacatagaagttcgaacaccagctgacaacggccttattctcctgatggtcaatggaagtatgtttttcagactggaaatgcgcaatggttacctacatgtgttctatgattttggattcagcagtggccgtgtgcatcttgaagatacgttaaagaaagctcaaattaatgatgcaaaataccatgagatctcaatcatttaccacaatgataagaaaatgatcttggtagttgacagaaggcatgtcaagagcatggataatgaaaagatgaaaataccttttacagatatatacattggaggagctcctccagaaatcttacaatccagggccctcagagcacaccttcccctagatatcaacttcagaggatgcatgaagggcttccagttccaaaagaaggacttcaatttactggagcagacagaaaccctgggagttggttatggatgcccagaagactcacttatatctcgcagagcatatttcaatggacagagcttcattgcttcaattcagaaaatatctttctttgatggctttgaaggaggttttaatttccgaacattacaaccaaatgggttactattctattatgcttcagggtcagacgtgttctccatctcactggataatggtactgtcatcatggatgtaaagggaatcaaagttcagtcagtagataagcagtacaatgatgggctgtcccacttcgtcattagctctgtctcacccacaagatatgaactgatagtagataaaagcagagttgggagtaagaatcctaccaaagggaaaatagaacagacacaagcaagtgaaaagaagttttacttcggtggctcaccaatcagtgctcagtatgctaatttcactggctgcataagtaatgcctactttaccagggtggatagagatgtggaggttgaagatttccaacggtatactgaaaaggtccacacttctctttatgagtgtcccattgagtcttcaccattgtttctcctccataaaaaaggaaaaaatttatccaagcctaaagcaagtcagaataaaaagggagggaaaagtaaagatgcaccttcatgggatcctgttgctctgaaactcccagagcggaatactccaagaaactctcattgccacctttccaacagccctagagcaatagagcacgcctatcaatatggaggaacagccaacagccgccaagagtttgaacacttaaaaggagattttggtgccaaatctcagttttccattcgtctgagaactcgttcctcccatggcatgatcttctatgtctcagatcaagaagagaatgacttcatgactctatttttggcccatggccgcttggtttacatgtttaatgttggtcacaaaaaactgaagattagaagccaggagaaatacaatgatggcctgtggcatgatgtgatatttattcgagaaaggagcagtggccgactggtaattgatggtctccgagtcctagaagaaagtcttcctcctactgaagctacctggaaaatcaagggtcccatttatttgggaggtgtggctcctggaaaggctgtgaaaaatgttcagattaactccatctacagttttagtggctgtctcagcaatctccagctcaatggggcctccatcacctctgcttctcagacattcagtgtgaccccttgctttgaaggccccatggaaacaggaacttatcttccttcgggtggaagctttcatcgagttgaacaggacttaaacgaatcatcagggaccggatatttcttatttctcatttggattcttaaccttgaatccaaagtgtctgcaatggacaacaattgaaggagtggcaaacttacttgtattgagagcacacgcaattcctactggtgaaattactgtttctgtttctaataaaatagaagggattccaaataaacacttgcacacatttttgaagtgcggctagattctcagattcacctttcttccagggaagataactttcaatctatataaaaatctctgtcctaaaactacctttctttattttgaagagacttactaacttacatataatctaaattagatgatagatttgtttttagcccttttgtttggtctatcagtataagaagaatattttaggtttatagctgaagttatcaaggtttaataaagtaaatttctaacagaatactagaaaaatgcagtataatttaattttttctaaataagaaacacaggaaatcaactactttttccccttccttatctccttaaaagaaaaataaaattgtacatgagaggaaaaaaangtttataacccccattgaggtgctcataggcactttagaaactaaaaaaccctttggggggggcccggcccccaatttgcccttatagagggggtttacacatcaatggccggcgttttacaactgctggactggaaaaaccctggcgttccca

SEQ ID NO: 365998 - DNA, 3779 bp, Homo sapiens
  misc_feature (3701)..(3701): n is a, c, g, or t
cgcagggaaaggcggacctcagtgtctgaaaagccagcttagagtgggagggcctgggagtagaaggtaaaaagggagtggtgagaatgaatgtgagaaggaagccaggacagcgcagtccccagtcccgaacggccagggagaggaggtggcctagcgctggcggggctcaccccaatccgtctgccttttgatgccgtactctgctggttgcgcagccacctcgggatactgcacacggagaggagggaaaataagcgaggcaccgccgcaccacgcgggagacctacggagacccacagcgcccgagccctggaagagcactactggatgtcagcggagaaatggctttgagctcagcctggcgctcggttctgcctctgtggctcctctggagcgctgcctgctcccgcgccgcgtccggggacgacaacgcttttccttttgacattgaagggagctcagcggttggcaggcaagacccgcctgagacgagcgaaccccgcgtggctctgggacgcctgccgcctgcggccgagaaatgcaatgctggattctttcacaccctgtcgggagaatgtgtgccctgcgactgtaatggcaattccaacgagtgtttggacggctcaggatactgtgtgcactgccagcggaacacaacaggagagcactgtgaaaagtgtctggatggttatatcggagattccatcaggggagcaccccaattctgccagccgtgcccctgtcccctgccccacttggccaattttgcagaatcctgctataggaaaaatggagctgttcggtgcatttgtaacgaaaattatgctggacctaactgtgaaagatgtgctcccggttactatggaaaccccttactcattggaagcacctgtaagaaatgtgactgcagtggaaattcagatcccaacctgatctttgaagattgtgatgaagtcactggccagtgtaggaattgcttacgcaacaccaccggattcaagtgtgaacgttgcgctcctggctactatggggacgccaggatagccaagaactgtgcagtgtgcaactgcgggggaggcccatgtgacagtgtaaccggagaatgcttggaagaaggttttgaaccccctacaggcatggactgcccaaccataagctgtgataagtgcgtctgggacctgactgatgacctgcggttagcagcgctctccatcgaggaaggcaaatccggggtgctgagcgtatcctctggggccgccgctcataggcacgtgaatgaaatcaacgccaccatctacctcctcaaaacaaaattgtcagaaagagaaaaccaatacgccctaagaaagatacaaatcaacaatgctgagaacacgatgaaaagccttctgtctgacgtagaggaattagttgaaaaggaaaatcaagcctccagaaaaggacaacttgttcagaaggaaagcatggacaccattaaccacgcaagtcagctggtagagcaagcccatgatatgagggataaaatccaagagatcaacaacaagatgctctattatggggaagagcatgaacttagccccaaggaaatctctgagaagctggtgttggcccagaagatgcttgaagagattagaagccgtcaaccatttttcacccaacgggagctcgtggatgaggaggcagatgaggcttacgaactactgagccaggctgagagctggcagcggctgcacaatgagacccgcactctgtttcctgtcgtcctggagcagctggatgactacaatgctaagttgtcagatctccaggaagcacttgaccaggcccttaaccatgtcagggatgccgaagacatgaacagggccacagcagccaggcagcgggaccatgagaaacaacaggaaagagtgagggaacaaatggaagtggtgaacatgtctctgagcacatctgcggactctctgacaacacctcgtctaactctttcagaacttgatgatataataaagaatgcgtcagggatttatgcagaaatagatggagccaaaagtgaactacaagtaaaactatctaacctaagtaacctcagccatgatttagtccaagaagctattgaccatgcacaggaccttcaacaagaagctaatgaattgagcaggaagttgcacagttcagatatgaacgggctggtacagaaggctttggatgcatcaaatgtctatgaaaatattgttaattatgttagtgaagccaatgaaacagcagaatttgctttgaacaccactgaccgaatttatgatgcggtgagtgggattgatactcaaatcatttaccataaagatgaaagtgagaacctcctcaatcaagccagagaactgcaagcaaaggcagagtctagcagtgatgaagcagtggctgacactagcaggcgtgtgggtggagccctagcaaggaaaagtgcccttaaaaccagactcagtgatgccgttaagcaactacaagcagcagagagaggggatgcccagcagcgcctggggcagtctagactgatcaccgaggaagccaacaggacgacgatggaggtgcagcaggccactgcccccatggccaacaatctaaccaactggtcacagaatcttcaacattttgactcttctgcttacaacactgcagtgaactctgctagggatgcagtaagaaatctgaccgaggttgtccctcagctcctggatcagcttcgtacggttgagcagaagcgacctgcaagcaacgtttctgccagcatccagaggatccgagagctcattgctcagaccagaagtgttgccagcaagatccaagtctccatgatgtttgatggccagtcagctgtggaagtgcactcgagaaccagtatggatgacttaaaggccttcacgtctctgagcctgtacatgaaaccccctgtgaagcggccggaactgaccgagactgcagatcagtttatcctgtacctcggaagcaaaaacgccaaaaaagagtatatgggtcttgcaatcaaaaatgataatctggtatacgtctataatttgggaactaaagatgtggagattcccctggactccaagcccgtcagttcctggcctgcttacttcagcattgtcaagattgaaagggtgggaaaacatggaaaggtgtttttaacagtcccgagtctaagtagcacagcagaggaaaagttcattaaaaagggggaattttcgggagatgactctctgctggacctggaccctgaggacacagtgttttatgttggtggagtgccttccaacttcaagctccctaccagcttaaacctgcctggctttgttggctgcctggaactggccactttgaataatgatgtgatcagcttgtacaactttaagcacatctataatatggacccctccacatcagtgccatgtgcccgagataagctggccttcactcagagtcgggctgccagttacttcttcgatggctccggttatgccgtggtgagagacatcacaaggagagggaaatttggtcaggtgactcgctttgacatagaagttcgaacaccagctgacaacggccttattctcctgatggtcaatggaagtatgtttttcagactggaaatgcgcaatggttacctacatgtgttctatgattttggattcaggtggtgtgcncaccacctgagtccaaaggtggttccagaaaaagaagtaaaccgaatgcttacaccctcagagttcctgaaggaagtg

SEQ ID NO: 365999 - DNA, 1608 bp, Homo sapiens
cgcagggaaaggcggacctcagtgtctgaaaagccagcttagagtgggagggcctgggagtagaaggtaaaaagggagtggtgagaatgaatgtgagaaggaagccaggacagcgcagtccccagtcccgaacggccagggagaggaggtggcctagcgctggcggggctcaccccaatccgtctgccttttgatgccgtactctgctggttgcgcagccacctcgggatactgcacacggagaggagggaaaataagcgaggcaccgccgcaccacgcgggagacctacggagacccacagcgcccgagccctggaagagcactactggatgtcagcggagaaatggctttgagctcagcctggcgctcggttctgcctctgtggctcctctggagcgctgcctgctcccgcgccgcgtccggggacgacaacgcttttccttttgacattgaagggagctcagcggttggcaggcaagacccgcctgagacgagcgaaccccgcgtggctctgggacgcctgccgcctgcggccgagaaatgcaatgctggattctttcacaccctgtcgggagaatgtgtgccctgcgactgtaatggcaattccaacgagtgtttggacggctcaggatactgtgtgcactgccagcggaacacaacaggagagcactgtgaaaagtgtctggatggttatatcggagattccatcaggggagcaccccaattctgccagccgtgcccctgtcccctgccccacttggccaattttgcagaatcctgctataggaaaaatggagctgttcggtgcatttgtaacgaaaattatgctggacctaactgtgaaagatgtgctcccggttactatggaaaccccttactcattggaagcacctgtaagaaatgtgactgcagtggaaattcagatcccaacctgatctttgaagattgtgatgaagtcactggccagtgtaggaattgcttacgcaacaccaccggattcaagtgtgaacgttgcgctcctggctactatggggacgccaggatagccaagaactgtgcagtgtgcaactgcgggggaggcccatgtgacagtgtaaccggagaatgcttggaagaaggttttgaaccccctacaggctgtgataagtgcgtctgggacctgactgatgacctgcggttagcagcgctctccatcgaggaaggcaaatccggggtgctgagcgtatcctctggggccgccgctcataggcacgtgaatgaaatcaacgccaccatctacctcctcaaaacaaaattgtcagaaagagaaaaccaatacgccctaagaaagatacaaatcaacaatgctgagaacacgatgaaaagccttctgtctgacgtagaggaattagttgaaaagcactggaacaagccaagaagaagactggaattgcaggaaggagtataatgactcagaagacagtgtccattcagagagcccacagtttatgaagggactgatgaccacattgccgctgcacagtgggctctgtgactacaggagccttgctctgtagggaggggattacccttctccaataaaaagcctctgggcatgtgtttgttat

SEQ ID NO: 366000 - DNA, 1629 bp, Homo sapiens
cgcagggaaaggcggacctcagtgtctgaaaagccagcttagagtgggagggcctgggagtagaaggtaaaaagggagtggtgagaatgaatgtgagaaggaagccaggacagcgcagtccccagtcccgaacggccagggagaggaggtggcctagcgctggcggggctcaccccaatccgtctgccttttgatgccgtactctgctggttgcgcagccacctcgggatactgcacacggagaggagggaaaataagcgaggcaccgccgcaccacgcgggagacctacggagacccacagcgcccgagccctggaagagcactactggatgtcagcggagaaatggctttgagctcagcctggcgctcggttctgcctctgtggctcctctggagcgctgcctgctcccgcgccgcgtccggggacgacaacgcttttccttttgacattgaagggagctcagcggttggcaggcaagacccgcctgagacgagcgaaccccgcgtggctctgggacgcctgccgcctgcggccgagaaatgcaatgctggattctttcacaccctgtcgggagaatgtgtgccctgcgactgtaatggcaattccaacgagtgtttggacggctcaggatactgtgtgcactgccagcggaacacaacaggagagcactgtgaaaagtgtctggatggttatatcggagattccatcaggggagcaccccaattctgccagccgtgcccctgtcccctgccccacttggccaattttgcagaatcctgctataggaaaaatggagctgttcggtgcatttgtaacgaaaattatgctggacctaactgtgaaagatgtgctcccggttactatggaaaccccttactcattggaagcacctgtaagaaatgtgactgcagtggaaattcagatcccaacctgatctttgaagattgtgatgaagtcactggccagtgtaggaattgcttacgcaacaccaccggattcaagtgtgaacgttgcgctcctggctactatggggacgccaggatagccaagaactgtgcagtgtgcaactgcgggggaggcccatgtgacagtgtaaccggagaatgcttggaagaaggttttgaaccccctacaggcatggactgcccaaccataagctgtgataagtgcgtctgggacctgactgatgacctgcggttagcagcgctctccatcgaggaaggcaaatccggggtgctgagcgtatcctctggggccgccgctcataggcacgtgaatgaaatcaacgccaccatctacctcctcaaaacaaaattgtcagaaagagaaaaccaatacgccctaagaaagatacaaatcaacaatgctgagaacacgatgaaaagccttctgtctgacgtagaggaattagttgaaaagcactggaacaagccaagaagaagactggaattgcaggaaggagtataatgactcagaagacagtgtccattcagagagcccacagtttatgaagggactgatgaccacattgccgctgcacagtgggctctgtgactacaggagccttgctctgtagggaggggattacccttctccaataaaaagcctctgggcatgtgtttgttat

SEQ ID NO: 366001 - DNA, 717 bp, Homo sapiens
cgcagggaaaggcggacctcagtgtctgaaaagccagcttagagtgggagggcctgggagtagaaggtaaaaagggagtggtgagaatgaatgtgagaaggaagccaggacagcgcagtccccagtcccgaacggccagggagaggaggtggcctagcgctggcggggctcaccccaatccgtctgccttttgatgccgtactctgctggttgcgcagccacctcgggatactgcacacggagaggagggaaaataagcgaggcaccgccgcaccacgcgggagacctacggagacccacagcgcccgagccctggaagagcactactggatgtcagcggagaaatggctttgagctcagcctggcgctcggttctgcctctgtggctcctctggagcgctgcctgctcccgcgccgcgtccggggacgacaacgcttttccttttgacattgaagggagctcagcggttggcaggcaagacccgcctgagacgagcgaaccccgcgtggctctgggacgcctgccgcctgcggccgaggtacagtgtccctgccattgccaccctgctggggcacctgcgcccccgcgggctgtgccacactcgtccttctctctctctccgcctctttcctctccccagtgccttgagagtttcacctgggctaggtcagttcggaaacttgaaataaagagttttcctttgtaaaatgaaaatg

SEQ ID NO: 366002 - DNA, 569 bp, Homo sapiens
ccctccaagctaccctgtcattatgccaagttagaaaattaatttagtttgtataactatatgatgtatatttcacatgtgtgttcactctgctttaaaaatattaattaccttttgtgtgaagttcagagacctgtcttttcccatgtggcagttttatatgttttgtggtcacaaatgtcaggaatctcaatgtaattctggataaatttttctgctctatgatttgtaaagaaatgaaaatcttatattttttaattgaaaattagtagttttagaaaaaaacgcacttatttgattttagtaaacgttgggcattttgaaaagttattcagagaaatgttactggtaggcaggacttttgtatctgatggaggaaaccgatgtagggtttggataaaataagactagcaggctgggcacagtggctcactcctgtagtctcagcattttgggaggacaaggtgggaggatcacttgataccaagagttcaaggttacagtgggctgtagtcatgccactgtactccagtctgtgccacagaaccagaccctgtctcaaaaaaaaa

SEQ ID NO: 366003 - DNA, 2397 bp, Homo sapiens
gctgcagcggcagcagctgtcgcgccagtcgcaacagaagcaggtccgaggcacagcccgatcccgccatggagcagccgaggaaggcggtggtagtgacgggatttggcccttttggggaacacaccgtgaacgccagttggattgcagttcaggagctagaaaagctaggccttggcgacagcgtggacctgcatgtgtacgagattccggttgagtaccaaacagtccagagactcatccccgccctgtgggagaagcacagtccacagctggtggtgcatgtgggggtgtcaggcatggcgaccacagtcacactggagaaatgtggacacaacaagggctacaaggggctggacaactgccgcttttgccccggctcccagtgctgcgtggaggacgggcctgaaagcattgactccatcatcgacatggatgctgtgtgcaagcgagtcaccacgttgggcctggatgtgtcggtgaccatctcgcaggatgccggcagccttggaagtcagaagtccaaggtcaaggtggtagcaggactggttccttctggaggtgctgaggatatctctgcgactttacctactacacctctttgtaccagagtcacggtcgatcagccttcgtccacgtgcccccactggggaagccgtacaacgcggaccagctgggcagggcactgagagccatcattgaggagatgttggacctcctggagcagtcagagggcaaaatcaactattgccacaaacactgagggacgctcaggtctcctaagacctcatcctgctggggaccccacgaggggacatccaccctctggggtgtggccaggaaaagacaagctcttcagcttggggatccgatctggatgacctgagtgagctgccaccgctggaggacatgggacaacccccggcggaggaggctgagcagcctggggccctggcccgagagttccttgctgccatggagcccgagcccgccccagccccggccccagaagagtggctggacattctggggaacgggctgttgaggaagaagacgctggtcccagggccgccaggttcgagccgcccggtcaagggccaggtggtcaccgtacatctgcagacgtcgctggagaatggcacacgggtgcaggaggagccggagctggtgttcactctgggtgactgtgacgtcatccaggccctggatctcagtgtcccactcatggacgtgggggagacggccatggtcactgctgactccaagtactgctacggcccccaaggcagcaggagcccatacatccccccgcacgcggccctgtgcctggaggtgaccctgaagacggctgtggacgggcctgacctggagatgctcacggggcaggagcgcgtggccctggccaaccggaagcgggagtgcggcaacgcccactaccagcgggcggacttcgtcctggccgccaactcctacgacctcgccatcaaggctatcacctccagcgccaaagtggacatgacgttcgaggaggaggcacagctcctgcagttgaaggtgaagtgtctgaacaacctggcggcctcgcagctgaagctcgaccactaccgcgcagccctgcgctcctgcagccttgtgctggagcaccagccagacaacatcaaggctctcttccgcaagggcaaggtgctggcccagcagggggagtacagtgaggccatccccatcctgagggcagccctgaagctggaaccttccaacaagacgatccacgcagagctctcaaagctggtgaagaagcatgcggcgcagcggagcacggagaccgccttgtaccggaaaatgctgggcaaccccagccggctgcctgctaagtgccctggcaagggtgcctggtccatcccatggaagtggctgtttggggcgactgctgttgccttggggggtgtggcactctctgtggtcatcgctgccaggaactgaccacctaggtggctgccaccccctctgcacaccatggaccctgccctgcgctccccaactcccccaggctccctgtccactgccctccctggtctggccccctcctccgggttaggggagcaaggattgggggtcgtgcagcccagccagcaggagggactgaggccctctaggaggaaagcccagagggagggggccctcattccttcagacccagttttcccccaccctccttaccccgctgggctaggtctccgccagggctggcctcagtttctcctcaacaggcctgggggcagcccttcccctgcctagtccccgcctgagtgccagccccccaccccgcctgccgccccctgtccaggttccctccccgccacagtgaaataaagcatcccaccctgcagtttcaaaaaa

SEQ ID NO: 366004 - DNA, 1807 bp, Homo sapiens
  misc_feature (43)..(43): n is a, c, g, or t
aaagcgagaagcgcacttcggctaggtacgaggctgggtgttnctggttcccgaggcgcggcggccgcggctgggggcggggaggggggcgcaggaccccaagtgggggtcccggagccagagggccaattcctgtccccccagcagcatggcatcgtgtgctgaaccctctgagccctctgccccactgcccgccggggtcccaccgctcgaggacttcgaggtactggatggggttgaggatgcagagggtgaggaggaagaggaggaggaagaggaggaagaggatgacctgagtgagctgccaccgctggaggacatgggacaacccccggcggaggaggctgagcagcctggggccctggcccgagagttccttgctgccatggagcccgagcccgccccagccccggccccagaagagtggctggacattctggggaacgggctgttgaggaagaagacgctggtcccagggccgccaggttcgagccgcccggtcaagggccaggtggtcaccgtacatctgcagacgtcgctggagaatggcacacgggtgcaggaggagccggagctggtgttcactctgggtgactgtgacgtcatccaggccctggatctcagtgtcccactcatggacgtgggggagacggccatggtcactgctgactccaagtactgctacggcccccaaggcagcaggagcccatacatccccccgcacgcggccctgtgcctggaggtgaccctgaagacggctgtggacgggcctgacctggagatgctcacggggcaggagcgcgtggccctggccaaccggaagcgggagtgcggcaacgcccactaccagcgggcggacttcgtcctggccgccaactcctacgacctcgccatcaaggctatcacctccagcgccaaagtggacatgacgttcgaggaggaggcacagctcctgcagttgaaggtgaagtgtctgaacaacctggcggcctcgcagctgaagctcgaccactaccgcgcagccctgcgctcctgcagccttgtgctggagcaccagccagacaacatcaaggctctcttccgcaagggcaaggtgctggcccagcagggggagtacagtgaggccatccccatcctgagggcagccctgaagctggaaccttccaacaagacgatccacgcagagctctcaaagctggtgaagaagcatgcggcgcagcggagcacggagaccgccttgtaccggaaaatgctgggcaaccccagccggctgcctgctaagtgccctggcaagggtgcctggtccatcccatggaagtggctgtttggggcgactgctgttgccttggggggtgtggcactctctgtggtcatcgctgccaggaactgaccacctaggtggctgccaccccctctgcacaccatggaccctgccctgcgctccccaactcccccaggctccctgtccactgccctccctggtctggccccctcctccgggttaggggagcaaggattgggggtcgtgcagcccagccagcaggagggactgaggccctctaggaggaaagcccagagggagggggccctcattccttcagacccagttttcccccaccctccttaccccgctgggctaggtctccgccagggctggcctcagtttctcctcaacaggcctgggggcagcccttcccctgcctagtccccgcctgagtgccagccccccaccccgcctgccgccccctgtccaggttccctccccgccacagtgaaataaagcatcccaccctgcagtttcaaaaaa

SEQ ID NO: 366005 - DNA, 1745 bp, Homo sapiens
gctggtactggtcccaggtggtagatgcgcaggaccccaagtgggggtcccggagccagagggccaattcctgtccccccagcagcatggcatcgtgtgctgaaccctctgagccctctgccccactgcccgccggggtcccaccgctcgaggacttcgaggtactggatggggttgaggatgcagagggtgaggaggaagaggaggaggaagaggaggaagaggatgacctgagtgagctgccaccgctggaggacatgggacaacccccggcggaggaggctgagcagcctggggccctggcccgagagttccttgctgccatggagcccgagcccgccccagccccggccccagaagagtggctggacattctggggaacgggctgttgaggaagaagacgctggtcccagggccgccaggttcgagccgcccggtcaagggccaggtggtcaccgtacatctgcagacgtcgctggagaatggcacacgggtgcaggaggagccggagctggtgttcactctgggtgactgtgacgtcatccaggccctggatctcagtgtcccactcatggacgtgggggagacggccatggtcactgctgactccaagtactgctacggcccccaaggcagcaggagcccatacatccccccgcacgcggccctgtgcctggaggtgaccctgaagacggctgtggacgggcctgacctggagatgctcacggggcaggagcgcgtggccctggccaaccggaagcgggagtgcggcaacgcccactaccagcgggcggacttcgtcctggccgccaactcctacgacctcgccatcaaggctatcacctccagcgccaaagtggacatgacgttcgaggaggaggcacagctcctgcagttgaaggtgaagtgtctgaacaacctggcggcctcgcagctgaagctcgaccactaccgcgcagccctgcgctcctgcagccttgtgctggagcaccagccagacaacatcaaggctctcttccgcaagggcaaggtgctggcccagcagggggagtacagtgaggccatccccatcctgagggcagccctgaagctggaaccttccaacaagacgatccacgcagagctctcaaagctggtgaagaagcatgcggcgcagcggagcacggagaccgccttgtaccggaaaatgctgggcaaccccagccggctgcctgctaagtgccctggcaagggtgcctggtccatcccatggaagtggctgtttggggcgactgctgttgccttggggggtgtggcactctctgtggtcatcgctgccaggaactgaccacctaggtggctgccaccccctctgcacaccatggaccctgccctgcgctccccaactcccccaggctccctgtccactgccctccctggtctggccccctcctccgggttaggggagcaaggattgggggtcgtgcagcccagccagcaggagggactgaggccctctaggaggaaagcccagagggagggggccctcattccttcagacccagttttcccccaccctccttaccccgctgggctaggtctccgccagggctggcctcagtttctcctcaacaggcctgggggcagcccttcccctgcctagtccccgcctgagtgccagccccccaccccgcctgccgccccctgtccaggttccctccccgccacagtgaaataaagcatcccaccctgcagtttcaaaaaa

SEQ ID NO: 366006 - DNA, 1628 bp, Homo sapiens
gattcccctcaccctctgcatcctcaaccccatccagtacctcgaagtcctcgagcggtgggaccccggcgggtgaggaggaagaggaggaggaagaggaggaagaggatgacctgagtgagctgccaccgctggaggacatgggacaacccccggcggaggaggctgagcagcctggggccctggcccgagagttccttgctgccatggagcccgagcccgccccagccccggccccagaagagtggctggacattctggggaacgggctgttgaggaagaagacgctggtcccagggccgccaggttcgagccgcccggtcaagggccaggtggtcaccgtacatctgcagacgtcgctggagaatggcacacgggtgcaggaggagccggagctggtgttcactctgggtgactgtgacgtcatccaggccctggatctcagtgtcccactcatggacgtgggggagacggccatggtcactgctgactccaagtactgctacggcccccaaggcagcaggagcccatacatccccccgcacgcggccctgtgcctggaggtgaccctgaagacggctgtggacgggcctgacctggagatgctcacggggcaggagcgcgtggccctggccaaccggaagcgggagtgcggcaacgcccactaccagcgggcggacttcgtcctggccgccaactcctacgacctcgccatcaaggctatcacctccagcgccaaagtggacatgacgttcgaggaggaggcacagctcctgcagttgaaggtgaagtgtctgaacaacctggcggcctcgcagctgaagctcgaccactaccgcgcagccctgcgctcctgcagccttgtgctggagcaccagccagacaacatcaaggctctcttccgcaagggcaaggtgctggcccagcagggggagtacagtgaggccatccccatcctgagggcagccctgaagctggaaccttccaacaagacgatccacgcagagctctcaaagctggtgaagaagcatgcggcgcagcggagcacggagaccgccttgtaccggaaaatgctgggcaaccccagccggctgcctgctaagtgccctggcaagggtgcctggtccatcccatggaagtggctgtttggggcgactgctgttgccttggggggtgtggcactctctgtggtcatcgctgccaggaactgaccacctaggtggctgccaccccctctgcacaccatggaccctgccctgcgctccccaactcccccaggctccctgtccactgccctccctggtctggccccctcctccgggttaggggagcaaggattgggggtcgtgcagcccagccagcaggagggactgaggccctctaggaggaaagcccagagggagggggccctcattccttcagacccagttttcccccaccctccttaccccgctgggctaggtctccgccagggctggcctcagtttctcctcaacaggcctgggggcagcccttcccctgcctagtccccgcctgagtgccagccccccaccccgcctgccgccccctgtccaggttccctccccgccacagtgaaataaagcatcccaccctgcagtttcaaaaaa

SEQ ID NO: 366007 - DNA, 1836 bp, Homo sapiens
ggcgtcactcctcctcaggccctcaggttcacttctgtaactaaggcttcaggatgggtcattcagcaaccccagagctgccctgcccgtcaagcttgaactctttaaggaaataacatttagagtggactgtgcccccagcagcccccaagggccaattcctgtccccccagcagcatggcatcgtgtgctgaaccctctgagccctctgccccactgcccgccggggtcccaccgctcgaggacttcgaggtactggatggggttgaggatgcagagggtgaggaggaagaggaggaggaagaggaggaagaggatgacctgagtgagctgccaccgctggaggacatgggacaacccccggcggaggaggctgagcagcctggggccctggcccgagagttccttgctgccatggagcccgagcccgccccagccccggccccagaagagtggctggacattctggggaacgggctgttgaggaagaagacgctggtcccagggccgccaggttcgagccgcccggtcaagggccaggtggtcaccgtacatctgcagacgtcgctggagaatggcacacgggtgcaggaggagccggagctggtgttcactctgggtgactgtgacgtcatccaggccctggatctcagtgtcccactcatggacgtgggggagacggccatggtcactgctgactccaagtactgctacggcccccaaggcagcaggagcccatacatccccccgcacgcggccctgtgcctggaggtgaccctgaagacggctgtggacgggcctgacctggagatgctcacggggcaggagcgcgtggccctggccaaccggaagcgggagtgcggcaacgcccactaccagcgggcggacttcgtcctggccgccaactcctacgacctcgccatcaaggctatcacctccagcgccaaagtggacatgacgttcgaggaggaggcacagctcctgcagttgaaggtgaagtgtctgaacaacctggcggcctcgcagctgaagctcgaccactaccgcgcagccctgcgctcctgcagccttgtgctggagcaccagccagacaacatcaaggctctcttccgcaagggcaaggtgctggcccagcagggggagtacagtgaggccatccccatcctgagggcagccctgaagctggaaccttccaacaagacgatccacgcagagctctcaaagctggtgaagaagcatgcggcgcagcggagcacggagaccgccttgtaccggaaaatgctgggcaaccccagccggctgcctgctaagtgccctggcaagggtgcctggtccatcccatggaagtggctgtttggggcgactgctgttgccttggggggtgtggcactctctgtggtcatcgctgccaggaactgaccacctaggtggctgccaccccctctgcacaccatggaccctgccctgcgctccccaactcccccaggctccctgtccactgccctccctggtctggccccctcctccgggttaggggagcaaggattgggggtcgtgcagcccagccagcaggagggactgaggccctctaggaggaaagcccagagggagggggccctcattccttcagacccagttttcccccaccctccttaccccgctgggctaggtctccgccagggctggcctcagtttctcctcaacaggcctgggggcagcccttcccctgcctagtccccgcctgagtgccagccccccaccccgcctgccgccccctgtccaggttccctccccgccacagtgaaataaagcatcccaccctgcagtttcaaaaaa

SEQ ID NO: 366008 - DNA, 1564 bp, Homo sapiens
  misc_feature (43)..(43): n is a, c, g, or t
aaagcgagaagcgcacttcggctaggtacgaggctgggtgttngatgacctgagtgagctgccaccgctggaggacatgggacaacccccggcggaggaggctgagcagcctggggccctggcccgagagttccttgctgccatggagcccgagcccgccccagccccggccccagaagagtggctggacattctggggaacgggctgttgaggaagaagacgctggtcccagggccgccaggttcgagccgcccggtcaagggccaggtggtcaccgtacatctgcagacgtcgctggagaatggcacacgggtgcaggaggagccggagctggtgttcactctgggtgactgtgacgtcatccaggccctggatctcagtgtcccactcatggacgtgggggagacggccatggtcactgctgactccaagtactgctacggcccccaaggcagcaggagcccatacatccccccgcacgcggccctgtgcctggaggtgaccctgaagacggctgtggacgggcctgacctggagatgctcacggggcaggagcgcgtggccctggccaaccggaagcgggagtgcggcaacgcccactaccagcgggcggacttcgtcctggccgccaactcctacgacctcgccatcaaggctatcacctccagcgccaaagtggacatgacgttcgaggaggaggcacagctcctgcagttgaaggtgaagtgtctgaacaacctggcggcctcgcagctgaagctcgaccactaccgcgcagccctgcgctcctgcagccttgtgctggagcaccagccagacaacatcaaggctctcttccgcaagggcaaggtgctggcccagcagggggagtacagtgaggccatccccatcctgagggcagccctgaagctggaaccttccaacaagacgatccacgcagagctctcaaagctggtgaagaagcatgcggcgcagcggagcacggagaccgccttgtaccggaaaatgctgggcaaccccagccggctgcctgctaagtgccctggcaagggtgcctggtccatcccatggaagtggctgtttggggcgactgctgttgccttggggggtgtggcactctctgtggtcatcgctgccaggaactgaccacctaggtggctgccaccccctctgcacaccatggaccctgccctgcgctccccaactcccccaggctccctgtccactgccctccctggtctggccccctcctccgggttaggggagcaaggattgggggtcgtgcagcccagccagcaggagggactgaggccctctaggaggaaagcccagagggagggggccctcattccttcagacccagttttcccccaccctccttaccccgctgggctaggtctccgccagggctggcctcagtttctcctcaacaggcctgggggcagcccttcccctgcctagtccccgcctgagtgccagccccccaccccgcctgccgccccctgtccaggttccctccccgccacagtgaaataaagcatcccaccctgcagtttcaaaaaa

SEQ ID NO: 366009 - DNA, 2332 bp, Homo sapiens
gctgcagcggcagcagctgtcgcgccagtcgcaacagaagcaggtccgaggcacagcccgatcccgccatggagcagccgaggaaggcggtggtagtgacgggatttggcccttttggggaacacaccgtgaacgccagttggattgcagttcaggagctagaaaagctaggccttggcgacagcgtggacctgcatgtgtacgagattccggttgagtaccaaacagtccagagactcatccccgccctgtgggagaagcacagtccacagctggtggtgcatgtgggggtgtcaggcatggcgaccacagtcacactggagaaatgtggacacaacaagggctacaaggggctggacaactgccgcttttgccccggctcccagtgctgcgtggaggacgggcctgaaagcattgactccatcatcgacatggatgctgtgtgcaagcgagtcaccacgttgggcctggatgtgtcggtgaccatctcgcaggatgccggcagatatctctgcgactttacctactacacctctttgtaccagagtcacggtcgatcagccttcgtccacgtgcccccactggggaagccgtacaacgcggaccagctgggcagggcactgagagccatcattgaggagatgttggacctcctggagcagtcagagggcaaaatcaactattgccacaaacactgagggacgctcaggtctcctaagacctcatcctgctggggaccccacgaggggacatccaccctctggggtgtggccaggaaaagacaagctcttcagcttggggatccgatctggatgacctgagtgagctgccaccgctggaggacatgggacaacccccggcggaggaggctgagcagcctggggccctggcccgagagttccttgctgccatggagcccgagcccgccccagccccggccccagaagagtggctggacattctggggaacgggctgttgaggaagaagacgctggtcccagggccgccaggttcgagccgcccggtcaagggccaggtggtcaccgtacatctgcagacgtcgctggagaatggcacacgggtgcaggaggagccggagctggtgttcactctgggtgactgtgacgtcatccaggccctggatctcagtgtcccactcatggacgtgggggagacggccatggtcactgctgactccaagtactgctacggcccccaaggcagcaggagcccatacatccccccgcacgcggccctgtgcctggaggtgaccctgaagacggctgtggacgggcctgacctggagatgctcacggggcaggagcgcgtggccctggccaaccggaagcgggagtgcggcaacgcccactaccagcgggcggacttcgtcctggccgccaactcctacgacctcgccatcaaggctatcacctccagcgccaaagtggacatgacgttcgaggaggaggcacagctcctgcagttgaaggtgaagtgtctgaacaacctggcggcctcgcagctgaagctcgaccactaccgcgcagccctgcgctcctgcagccttgtgctggagcaccagccagacaacatcaaggctctcttccgcaagggcaaggtgctggcccagcagggggagtacagtgaggccatccccatcctgagggcagccctgaagctggaaccttccaacaagacgatccacgcagagctctcaaagctggtgaagaagcatgcggcgcagcggagcacggagaccgccttgtaccggaaaatgctgggcaaccccagccggctgcctgctaagtgccctggcaagggtgcctggtccatcccatggaagtggctgtttggggcgactgctgttgccttggggggtgtggcactctctgtggtcatcgctgccaggaactgaccacctaggtggctgccaccccctctgcacaccatggaccctgccctgcgctccccaactcccccaggctccctgtccactgccctccctggtctggccccctcctccgggttaggggagcaaggattgggggtcgtgcagcccagccagcaggagggactgaggccctctaggaggaaagcccagagggagggggccctcattccttcagacccagttttcccccaccctccttaccccgctgggctaggtctccgccagggctggcctcagtttctcctcaacaggcctgggggcagcccttcccctgcctagtccccgcctgagtgccagccccccaccccgcctgccgccccctgtccaggttccctccccgccacagtgaaataaagcatcccaccctgcagtttcaaaaaa

SEQ ID NO: 366010 - DNA, 1498 bp, Homo sapiens
  misc_feature (16)..(16): n is a, c, g, or t
  misc_feature (22)..(23): n is a, c, g, or t
agccggagctggtgtncctctnngtgactgtgacgtcatccaggccctggatctcagtgtcccactcatggacgtgggggagacggccatggtcactgctgactccaagtactgctacggcccccaaggcaggaacgggctgttgaggaagaagacgctggtcccagggccgccaggttcgagccgcccggtcaagggccaggtggtcaccgtacatctgcagacgtcgctggagaatggcacacgggtgcaggaggagccggagctggtgttcactctgggtgactgtgacgtcatccaggccctggatctcagtgtcccactcatggacgtgggggagacggccatggtcactgctgactccaagtactgctacggcccccaaggcagcaggagcccatacatccccccgcacgcggccctgtgcctggaggtgaccctgaagacggctgtggacgggcctgacctggagatgctcacggggcaggagcgcgtggccctggccaaccggaagcgggagtgcggcaacgcccactaccagcgggcggacttcgtcctggccgccaactcctacgacctcgccatcaaggctatcacctccagcgccaaagtggacatgacgttcgaggaggaggcacagctcctgcagttgaaggtgaagtgtctgaacaacctggcggcctcgcagctgaagctcgaccactaccgcgcagccctgcgctcctgcagccttgtgctggagcaccagccagacaacatcaaggctctcttccgcaagggcaaggtgctggcccagcagggggagtacagtgaggccatccccatcctgagggcagccctgaagctggaaccttccaacaagacgatccacgcagagctctcaaagctggtgaagaagcatgcggcgcagcggagcacggagaccgccttgtaccggaaaatgctgggcaaccccagccggctgcctgctaagtgccctggcaagggtgcctggtccatcccatggaagtggctgtttggggcgactgctgttgccttggggggtgtggcactctctgtggtcatcgctgccaggaactgaccacctaggtggctgccaccccctctgcacaccatggaccctgccctgcgctccccaactcccccaggctccctgtccactgccctccctggtctggccccctcctccgggttaggggagcaaggattgggggtcgtgcagcccagccagcaggagggactgaggccctctaggaggaaagcccagagggagggggccctcattccttcagacccagttttcccccaccctccttaccccgctgggctaggtctccgccagggctggcctcagtttctcctcaacaggcctgggggcagcccttcccctgcctagtccccgcctgagtgccagccccccaccccgcctgccgccccctgtccaggttccctccccgccacagtgaaataaagcatcccaccctgcagtttcaaaaaa

SEQ ID NO: 366011 - DNA, 1516 bp, Homo sapiens
ctcggctttgacagagtgcaagacgatgacttgcaaaatgtcgcagctggaacgcaacatagagaccatcatcaacaccttccaccaatactctgtgaagctggggcacccagacaccccggccccagaagagtggctggacattctggggaacgggctgttgaggaagaagacgctggtcccagggccgccaggttcgagccgcccggtcaagggccaggtggtcaccgtacatctgcagacgtcgctggagaatggcacacgggtgcaggaggagccggagctggtgttcactctgggtgactgtgacgtcatccaggccctggatctcagtgtcccactcatggacgtgggggagacggccatggtcactgctgactccaagtactgctacggcccccaaggcagcaggagcccatacatccccccgcacgcggccctgtgcctggaggtgaccctgaagacggctgtggacgggcctgacctggagatgctcacggggcaggagcgcgtggccctggccaaccggaagcgggagtgcggcaacgcccactaccagcgggcggacttcgtcctggccgccaactcctacgacctcgccatcaaggctatcacctccagcgccaaagtggacatgacgttcgaggaggaggcacagctcctgcagttgaaggtgaagtgtctgaacaacctggcggcctcgcagctgaagctcgaccactaccgcgcagccctgcgctcctgcagccttgtgctggagcaccagccagacaacatcaaggctctcttccgcaagggcaaggtgctggcccagcagggggagtacagtgaggccatccccatcctgagggcagccctgaagctggaaccttccaacaagacgatccacgcagagctctcaaagctggtgaagaagcatgcggcgcagcggagcacggagaccgccttgtaccggaaaatgctgggcaaccccagccggctgcctgctaagtgccctggcaagggtgcctggtccatcccatggaagtggctgtttggggcgactgctgttgccttggggggtgtggcactctctgtggtcatcgctgccaggaactgaccacctaggtggctgccaccccctctgcacaccatggaccctgccctgcgctccccaactcccccaggctccctgtccactgccctccctggtctggccccctcctccgggttaggggagcaaggattgggggtcgtgcagcccagccagcaggagggactgaggccctctaggaggaaagcccagagggagggggccctcattccttcagacccagttttcccccaccctccttaccccgctgggctaggtctccgccagggctggcctcagtttctcctcaacaggcctgggggcagcccttcccctgcctagtccccgcctgagtgccagccccccaccccgcctgccgccccctgtccaggttccctccccgccacagtgaaataaagcatcccaccctgcagtttcaaaaaa

SEQ ID NO: 366012 - DNA, 1818 bp, Homo sapiens
atgggcacggcaggcgcggggccaagcggccgaacctggttcccgaggcgcggcggccgcggctgggggcggggaggggggcgcaggaccccaagtgggggtcccggagccagagggccaattcctgtccccccagcagcatggcatcgtgtgctgaaccctctgagccctctgccccactgcccgccggggtcccaccgctcgaggacttcgaggtactggatggggttgaggatgcagagggtgaggaggaagaggaggaggaagaggaggaagaggatgacctgagtgagctgccaccgctggaggacatgggacaacccccggcggaggaggctgagcagcctggggccctggcccgagagttccttgctgccatggagcccgagcccgccccagccccggccccagaagagtggctggacattctggggaacgggctgttgaggaagaagacgctggtcccagggccgccaggttcgagccgcccggtcaagggccaggtggtcaccgtacatctgcagacgtcgctggagaatggcacacgggtgcaggaggagccggagctggtgttcactctgggtgactgtgacgtcatccaggccctggatctcagtgtcccactcatggacgtgggggagacggccatggtcactgctgactccaagtactgctacggcccccaaggcagcaggagcccatacatccccccgcacgcggccctgtgcctggaggtgaccctgaagacggctgtggacgggcctgacctggagatgctcacggggcaggagcgcgtggccctggccaaccggaagcgggagtgcggcaacgcccactaccagcgggcggacttcgtcctggccgccaactcctacgacctcgccatcaaggctatcacctccagcgccaaagtggacatgacgttcgaggaggaggcacagctcctgcagttgaaggtgaagtgtctgaacaacctggcggcctcgcagctgaagctcgaccactaccgcgcagccctgcgctcctgcagccttgtgctggagcaccagccagacaacatcaaggctctcttccgcaagggcaaggtgctggcccagcagggggagtacagtgaggccatccccatcctgagggcagccctgaagctggaaccttccaacaagcttcccctgccttctgcagacgatccacgcagagctctcaaagctggtgaagaagcatgcggcgcagcggagcacggagaccgccttgtaccggaaaatgctgggcaaccccagccggctgcctgctaagtgccctggcaagggtgcctggtccatcccatggaagtggctgtttggggcgactgctgttgccttggggggtgtggcactctctgtggtcatcgctgccaggaactgaccacctaggtggctgccaccccctctgcacaccatggaccctgccctgcgctccccaactcccccaggctccctgtccactgccctccctggtctggccccctcctccgggttaggggagcaaggattgggggtcgtgcagcccagccagcaggagggactgaggccctctaggaggaaagcccagagggagggggccctcattccttcagacccagttttcccccaccctccttaccccgctgggctaggtctccgccagggctggcctcagtttctcctcaacaggcctgggggcagcccttcccctgcctagtccccgcctgagtgccagccccccaccccgcctgccgccccctgtccaggttccctccccgccacagtgaaataaagcatcccaccctgcagtttcaaaaaa

SEQ ID NO: 366013 - DNA, 1700 bp, Homo sapiens
atgggcacggcaggcgcggggccaagcggccgaacctggttcccgaggcgcggcggccgcggctgggggcggggaggggggcgcaggaccccaagtgggggtcccggagccagagggccaattcctgtccccccagcagcatggcatcgtgtgctgaaccctctgagccctctgccccactgcccgccggggtcccaccgctcgaggacttcgaggtactggatggggttgaggatgcagagggtgaggaggaagaggaggaggaagaggaggaagaggatgacctgagtgagctgccaccgctggaggacatgggacaacccccggcggaggaggctgagcagcctggggccctggcccgagagttccttgctgccatggagcccgagcccgccccagccccggccccagaagagtggctggacattctggggaacgggctgttgaggaagaagacgctggtcccagggccgccaggttcgagccgcccggtcaagggccaggtggtcaccgtacatctgcagacgtcgctggagaatggcacacgggtgcaggaggagccggagctggtgttcactctgggtgactgtgacgtcatccaggccctggatctcagtgtcccactcatggacgtgggggagacggccatggtcactgctgactccaagtactgctacggcccccaaggcagcaggagcccatacatccccccgcacgcggccctgtgcctggaggtgaccctgaagacggctgtggacgggcctgacctggagatgctcacggggcaggagcgcgtggccctggccaaccggaagcgggagtgcggcaacgcccactaccagcgggcggacttcgtcctggccgccaactcctacgacctcgccatcaaggctatcacctccagcgccaaagtggacatgacgttcgaggaggaggcacagctcctgcagttgaaggtgaagtgtctgaacaacctggcggcctcgcagctgaagctcgaccactaccgcgcagccctgcgctcctgcagccttgtgctggagcaccagccagacaacatcaaggctctcttccgcaagggcaaggtgctggcccagcagggggagtacagtgaggccatccccatcctgagggcagccctgaagctggaaccttccaacaagacgatccacgcagagctctcaaagctggtgaagaagcatgcggcgcagcggagcacggagaccgccttgtaccggaaaatgctgggcaaccccagccggctgcctgctaagtgccctggcaagggtgcctggtccatcccatggaagtggctgtttggggcgactgctgttgccttggggggtgtggcactctctgtggtcatcgctgccaggaactgaccacctaggtggctgccaccccctctgcacaccatggaccctgccctgcgctccccaactcccccaggctccctgtccactgccctccctgagggggccctcattccttcagacccagttttcccccaccctccttaccccgctgggctaggtctccgccagggctggcctcagtttctcctcaacaggcctgggggcagcccttcccctgcctagtccccgcctgagtgccagccccccaccccgcctgccgccccctgtccaggttccctccccgccacagtgaaataaagcatcccaccctgcagtttcaaaaaa

SEQ ID NO: 366014 - DNA, 1239 bp, Homo sapiens
  misc_feature (16)..(16): n is a, c, g, or t
  misc_feature (22)..(23): n is a, c, g, or t
agccggagctggtgtncctctnngtgactgtgacgtcatccaggccctggatctcagtgtcccactcatggacgtgggggagacggccatggtcactgctgactccaagtactgctacggcccccaaggcacaggagcccatacatccccccgcacgcggccctgtgcctggaggtgaccctgaagacggctgtggacgggcctgacctggagatgctcacggggcaggagcgcgtggccctggccaaccggaagcgggagtgcggcaacgcccactaccagcgggcggacttcgtcctggccgccaactcctacgacctcgccatcaaggctatcacctccagcgccaaagtggacatgacgttcgaggaggaggcacagctcctgcagttgaaggtgaagtgtctgaacaacctggcggcctcgcagctgaagctcgaccactaccgcgcagccctgcgctcctgcagccttgtgctggagcaccagccagacaacatcaaggctctcttccgcaagggcaaggtgctggcccagcagggggagtacagtgaggccatccccatcctgagggcagccctgaagctggaaccttccaacaagacgatccacgcagagctctcaaagctggtgaagaagcatgcggcgcagcggagcacggagaccgccttgtaccggaaaatgctgggcaaccccagccggctgcctgctaagtgccctggcaagggtgcctggtccatcccatggaagtggctgtttggggcgactgctgttgccttggggggtgtggcactctctgtggtcatcgctgccaggaactgaccacctaggtggctgccaccccctctgcacaccatggaccctgccctgcgctccccaactcccccaggctccctgtccactgccctccctggtctggccccctcctccgggttaggggagcaaggattgggggtcgtgcagcccagccagcaggagggactgaggccctctaggaggaaagcccagagggagggggccctcattccttcagacccagttttcccccaccctccttaccccgctgggctaggtctccgccagggctggcctcagtttctcctcaacaggcctgggggcagcccttcccctgcctagtccccgcctgagtgccagccccccaccccgcctgccgccccctgtccaggttccctccccgccacagtgaaataaagcatcccaccctgcagtttcaaaaaa

SEQ ID NO: 366015 - DNA, 1195 bp, Homo sapiens
tacgggtgaggtacagctacgggtgaggtacagctacgggtgaggtacagctacgggtgaggtacagctcctgcagttgaaggtgaagtgtctgaacaacctggcggcctcgcagctgaagctcgaccactaccgcgcagccctgcgctcctgcagccttgtgctggagatgctcacggggcaggagcgcgtggccctggccaaccggaagcgggagtgcggcaacgcccactaccagcgggcggacttcgtcctggccgccaactcctacgacctcgccatcaaggctatcacctccagcgccaaagtggacatgacgttcgaggaggaggcacagctcctgcagttgaaggtgaagtgtctgaacaacctggcggcctcgcagctgaagctcgaccactaccgcgcagccctgcgctcctgcagccttgtgctggagcaccagccagacaacatcaaggctctcttccgcaagggcaaggtgctggcccagcagggggagtacagtgaggccatccccatcctgagggcagccctgaagctggaaccttccaacaagacgatccacgcagagctctcaaagctggtgaagaagcatgcggcgcagcggagcacggagaccgccttgtaccggaaaatgctgggcaaccccagccggctgcctgctaagtgccctggcaagggtgcctggtccatcccatggaagtggctgtttggggcgactgctgttgccttggggggtgtggcactctctgtggtcatcgctgccaggaactgaccacctaggtggctgccaccccctctgcacaccatggaccctgccctgcgctccccaactcccccaggctccctgtccactgccctccctggtctggccccctcctccgggttaggggagcaaggattgggggtcgtgcagcccagccagcaggagggactgaggccctctaggaggaaagcccagagggagggggccctcattccttcagacccagttttcccccaccctccttaccccgctgggctaggtctccgccagggctggcctcagtttctcctcaacaggcctgggggcagcccttcccctgcctagtccccgcctgagtgccagccccccaccccgcctgccgccccctgtccaggttccctccccgccacagtgaaataaagcatcccaccctgcagtttcaaaaaa

SEQ ID NO: 366016 - DNA, 2183 bp, Homo sapiens
atgggcacggcaggcgcggggccaagcggccgaacctggttcccgaggcgcggcggccgcggctgggggcggggaggggggcgcaggaccccaagtgggggtcccggagccagagggccaattcctgtccccccagcagcatggcatcgtgtgctgaaccctctgagccctctgccccactgcccgccggggtcccaccgctcgaggacttcgaggtactggatggggttgaggatgcagagggtgaggaggaagaggaggaggaagaggaggaagaggatgacctgagtgagctgccaccgctggaggacatgggacaacccccggcggaggaggctgagcagcctggggccctggcccgagagttccttgctgccatggagcccgagcccgccccagccccggccccagaagagtggctggacattctggggaacgggctgttgaggaagaagacgctggtcccagggccgccaggttcgagccgcccggtcaagggccaggtggtcaccgtacatctgcagacgtcgctggagaatggcacacgggtgcaggaggagccggagctggtgttcactctgggtgactgtgacgtcatccaggccctggatctcagtgtcccactcatggacgtgggggagacggccatggtcactgctgactccaagtactgctacggcccccaaggcagcaggagcccatacatccccccgcacgcggccctgtgcctggaggtgaccctgaagacggctgtggacgggcctgacctggagatgctcacggggcaggagcgcgtggccctggccaaccggaagcgggagtgcggcaacgcccactaccagcgggcggacttcgtcctggccgccaactcctacgacctcgccatcaaggctatcacctccagcgccaaagtggacatgacgttcgaggaggaggcacagctcctgcagttgaaggtgaagtgtctgaacaacctggcggcctcgcagctgaagctcgaccactaccgcgcagccctgcgctcctgcagccttgtgctggagcaccagccagacaacatcaaggctctcttccgcaagggcaaggtgctggcccagcagggggagtacagtgagagggggccctcattccttcagacccagttttcccccaccctccttaccccgctgggctaggtctccgccagggctggcctcagtttctcctcaacaggcctgggggcagcccttcccctgccgcctcgcgcgacaaacgccgtagccgagaaagcgtagtccaagggtacaccatcacacgcagacacgtagaaataacagcatcaccaacccatgacaagacaaacaacaaaaaatagaaaacgcaaataacaacacaagtaatacaaacaaacccaacacgaaaccatactatataaataacaagcacaacacaacaacacaccctcacacacataaagacacaccactacccacaagagagtgagggggagaaaagaggggaagcgagaagaggagagaagaaggagcgagcgagggctgagtatactgacgaggagggcagcgaggaaggtagagggggaggcaccgcagccgtggggaagaaggagaggcgtcgcagggaccgaggccgccccagtatcaactaaactcacactcaacaacaaaacaaaaacaactccaacactaaacacaaaaaacaacaccaaatcataccatcaacacacaccaaacaatatacaaacacagagcgagaatatcaacacatcacaaagacacgaaaaactaaccccaacaatccctagaatcaaatacacctaacaaacaaccaacacaaacaaaataccagaacgactgtgtacagcaaagaaacacaaaacactacacatcacttatagcgccgcaccaaagccatcaaggaaatatatcaagtaaaagaataaataacgcactactgaacaacttcaagtaagaattacatacataaaatattaaatactatcctagaagcaatgcaacacacaatcatagcatgctacaaatcaatcgaacatacgaactaagcagtatacacaccacctcgacttgctaattactttgcgcccgaacgcagaagatacagaccgactgcgggtgtcgcaggaagtgcgaggtgacggagcagcgtacgacgagactgacgcagag

SEQ ID NO: 366017 - DNA, 696 bp, Homo sapiens
ccacgcgtcgcccacgcgtcgcccacgcgtcgagccctgaagctggaaccttccaacaagacgatccacgcagagctctcaaagctggtgaagaagcatgcggcgcagcggagcacggagaccgccttgtaccggaaaatgctgggcaaccccagccggctgcctgctaagtgccctggcaagggtgcctggtccatcccatggaagtggctgtttggggcgactgctgttgccttggggggtgtggcactctctgtggtcatcgctgccaggaactgaccacctaggtggctgccaccccctctgcacaccatggaccctgccctgcgctccccaactcccccaggctccctgtccactgccctccctggtctggccccctcctccgggttaggggagcaaggattgggggtcgtgcagcccagccagcaggagggactgaggccctctaggaggaaagcccagagggagggggccctcattccttcagacccagttttcccccaccctccttaccccgctgggctaggtctccgccagggctggcctcagtttctcctcaacaggcctgggggcagcccttcccctgcctagtccccgcctgagtgccagccccccaccccgcctgccgccccctgtccaggttccctccccgccacagtgaaataaagcatcccaccctgcagtttcaaaaaa

SEQ ID NO: 366018 - DNA, 1101 bp, Homo sapiens
atgggcacggcaggcgcggggccaagcggccgaacctggttcccgaggcgcggcggccgcggctgggggcggggaggggggcgcaggaccccaagtgggggtcccggagccagagggccaattcctgtccccccagcagcatggcatcgtgtgctgaaccctctgagccctctgccccactgcccgccggggtcccaccgctcgaggacttcgaggtactggatggggttgaggatgcagagggtgaggaggaagaggaggaggaagaggaggaagaggatgacctgagtgagctgccaccgctggaggacatgggacaacccccggcggaggaggctgagcagcctggggccctggcccgagagttccttgctgccatggagcccgagcccgccccagccccggccccagaagagtggctggacattctggggaacgggctgttgaggaagaagacgctggtcccagggccgccaggttcgagccgcccggtcaagggccaggtggtcaccgtacatctgcagacgtcgctggagaatggcacacgggtgcaggaggagccggagctggtgttcactctgggtgactgtgacgtcatccaggccctggatctcagtgtcccactcatggacgtgggggagacggccatggtcactgctgactccaagtactgctacggcccccaaggcagcaggagcccatacatccccccgcacgcggccctgtgcctggaggtgaccctgaagacggctgtggacgggcctgacctggagatgctcacggggcaggagcgcgtggccctggccaaccggaagcgggagtgcggcaacgcccactaccagcgggcggacttcgtcctggccgccaactcctacgacctcgccatcaaggctatcacctccagcgccaaagcctccttaccccgctgggctaggtctccgccagggctggcctcagtttctcctcaacaggcctgggggcagcccttcccctgcctagtccccgcctgagtgccagccccccaccccgcctgccgccccctgtccaggttccctccccgccacagtgaaataaagcatcccaccctgcagtttcaaaaaa

SEQ ID NO: 366019 - DNA, 489 bp, Homo sapiens
  misc_feature (279)..(279): n is a, c, g, or t
atgggcacggcaggcgcggggccaagcggccgaacctggttcccgaggcgcggcggccgcggctgggggcggggaggggggcgcaggaccccaagtgggggtcccggagccagagggccaattcctgtccccccagcagcatggcatcgtgtgctgaaccctctgagccctctgccccactgcccgccggggtcccaccgctcgaggacttcgaggtactggatggggttgaggatgcagagggtgaggaggaagaggaggaggaagaggaggaagagncctgggcatggggggcggggctgtgctaaacttcattactactgcaaaaccaccgtgtgctggaaactaaaggtactcatgggactgccttctctgcgcccacctgtgacctccaaaaactcaaacaggtccaaacctcactggctggcgtgatctttttatttgcttgggggtttggcttttactctgcaggccaaaaagcctttgcac

SEQ ID NO: 366020 - DNA, 413 bp, Homo sapiens
tacgggtgaggtacagctacgggtgaggtacagctacgggtgaggtacagctacgggtgaggtacagctcctgcagttgaaggtgaagtgtctgaacaacctggcggcctcgcagctgaagctcgaccactaccgcgcagccctgcgctcctgcagccttgtgctggagatgctcacggggcaggagcgcgtggccctggccaaccggaagcgggagtgcggcaacgcccactaccagcgggcggacttcgtcctggccgccaactcctacgacctcgccatcaaggctatcacctccagcgccaaagtagtccccgcctgagtgccagccccccaccccgcctgccgccccctgtccaggttccctccccgccacagtgaaataaagcatcccaccctgcagtttcaaaaaa

SEQ ID NO: 366021 - DNA, 1799 bp, Homo sapiens
atgggcacggcaggcgcggggccaagcggccgaacctggttcccgaggcgcggcggccgcggctgggggcggggaggggggcgcaggaccccaagtgggggtcccggagccagagggccaattcctgtccccccagcagcatggcatcgtgtgctgaaccctctgagccctctgccccactgcccgccggggtcccaccgctcgaggacttcgaggtactggatggggttgaggatgcagagggtgaggaggaagaggaggaggaagaggaggaagaggatgacctgagtgagctgccaccgctggaggacatgggacaacccccggcggaggaggctgagcagcctggggccctggcccgagagttccttgctgccatggagcccgagcccgccccagccccggccccagaagagtggctggacattctggggaacgggctgttgaggaagaagacgctggtcccagggccgccaggttcgagccgcccggtcaagggccaggtggtcaccgtacatctgcagacgtcgctggagaatggcacacgggtgcaggaggagccggagctggtgttcactctgggtgactgtgacgtcatccaggccctggatctcagtgtcccactcatggacgtgggggagacggccatggtcactgctgactccaagtactgctacggcccccaaggcagcaggagcccatacatccccccgcacgcggccctgtgcctggaggtgaccctgaagacggctgtggacgggcctgacctggagatgctcacggggcaggagcgcgtggccctggccaaccggaagcgggagtgcggcaacgcccactaccagcgggcggacttcgtcctggccgccaactcctacgacctcgccatcaaggctatcacctccagcgccaaagtggacatgacgttcgaggaggaggcacagctcctgcagttgaaggtgaagtgtctgaacaacctggcggcctcgcagctgaagctcgaccactaccgcgcagccctgcgctcctgcagccttgtgctggagcaccagccagacaacatcaaggctctcttccgcaagggcaaggtgctggcccagcagggggagtacagtgaggccatccccatcctgagggcagccctgaagctggaaccttccaacaagacgatccacgcagagctctcaaagctggtgaagaagcatgcggcgcagcggagcacggagaccgccttgtaccggaaaatgctgggcaaccccagccggctgcctgctaagtgccctggcaagggtgcctggtccatcccatggaagtggctgtttggggcgactgctgttgccttggggggtgtggcactctctgtggtcatcgctgccaggaactgaccacctaggtggctgccaccccctctgcacaccatggaccctgccctgcgctccccaactcccccaggctccctgtccactgccctccctggtctggccccctcctccgggttaggggagcaaggattgggggtcgtgcagcccagccagcaggagggactgaggccctctaggaggaaagcccagagggagggggccctcattccttcagacccagttttcccccaccctccttaccccgctgggctaggtctccgccagggctggcctcagtttctcctcaacaggcctgggggcagcccttcccctgcctagtccccgcctgagtgccagccccccaccccgcctgccgccccctgtccaggttccctccccgccacagtgaaataaagcatcccaccctgcagtttcaaaaaa

SEQ ID NO: 366022 - DNA, 1722 bp, Homo sapiens
gctggtacgcgccggaattaggggtcccggagccagagggccaattcctgtccccccagcagcatggcatcgtgtgctgaaccctctgagccctctgccccactgcccgccggggtcccaccgctcgaggacttcgaggtactggatggggttgaggatgcagagggtgaggaggaagaggaggaggaagaggaggaagaggatgacctgagtgagctgccaccgctggaggacatgggacaacccccggcggaggaggctgagcagcctggggccctggcccgagagttccttgctgccatggagcccgagcccgccccagccccggccccagaagagtggctggacattctggggaacgggctgttgaggaagaagacgctggtcccagggccgccaggttcgagccgcccggtcaagggccaggtggtcaccgtacatctgcagacgtcgctggagaatggcacacgggtgcaggaggagccggagctggtgttcactctgggtgactgtgacgtcatccaggccctggatctcagtgtcccactcatggacgtgggggagacggccatggtcactgctgactccaagtactgctacggcccccaaggcagcaggagcccatacatccccccgcacgcggccctgtgcctggaggtgaccctgaagacggctgtggacgggcctgacctggagatgctcacggggcaggagcgcgtggccctggccaaccggaagcgggagtgcggcaacgcccactaccagcgggcggacttcgtcctggccgccaactcctacgacctcgccatcaaggctatcacctccagcgccaaagtggacatgacgttcgaggaggaggcacagctcctgcagttgaaggtgaagtgtctgaacaacctggcggcctcgcagctgaagctcgaccactaccgcgcagccctgcgctcctgcagccttgtgctggagcaccagccagacaacatcaaggctctcttccgcaagggcaaggtgctggcccagcagggggagtacagtgaggccatccccatcctgagggcagccctgaagctggaaccttccaacaagacgatccacgcagagctctcaaagctggtgaagaagcatgcggcgcagcggagcacggagaccgccttgtaccggaaaatgctgggcaaccccagccggctgcctgctaagtgccctggcaagggtgcctggtccatcccatggaagtggctgtttggggcgactgctgttgccttggggggtgtggcactctctgtggtcatcgctgccaggaactgaccacctaggtggctgccaccccctctgcacaccatggaccctgccctgcgctccccaactcccccaggctccctgtccactgccctccctggtctggccccctcctccgggttaggggagcaaggattgggggtcgtgcagcccagccagcaggagggactgaggccctctaggaggaaagcccagagggagggggccctcattccttcagacccagttttcccccaccctccttaccccgctgggctaggtctccgccagggctggcctcagtttctcctcaacaggcctgggggcagcccttcccctgcctagtccccgcctgagtgccagccccccaccccgcctgccgccccctgtccaggttccctccccgccacagtgaaataaagcatcccaccctgcagtttcaaaaaa

SEQ ID NO: 366023 - DNA, 1706 bp, Homo sapiens
cgagcccgggaggagcaggcagggccaattcctgtccccccagcagcatggcatcgtgtgctgaaccctctgagccctctgccccactgcccgccggggtcccaccgctcgaggacttcgaggtactggatggggttgaggatgcagagggtgaggaggaagaggaggaggaagaggaggaagaggatgacctgagtgagctgccaccgctggaggacatgggacaacccccggcggaggaggctgagcagcctggggccctggcccgagagttccttgctgccatggagcccgagcccgccccagccccggccccagaagagtggctggacattctggggaacgggctgttgaggaagaagacgctggtcccagggccgccaggttcgagccgcccggtcaagggccaggtggtcaccgtacatctgcagacgtcgctggagaatggcacacgggtgcaggaggagccggagctggtgttcactctgggtgactgtgacgtcatccaggccctggatctcagtgtcccactcatggacgtgggggagacggccatggtcactgctgactccaagtactgctacggcccccaaggcagcaggagcccatacatccccccgcacgcggccctgtgcctggaggtgaccctgaagacggctgtggacgggcctgacctggagatgctcacggggcaggagcgcgtggccctggccaaccggaagcgggagtgcggcaacgcccactaccagcgggcggacttcgtcctggccgccaactcctacgacctcgccatcaaggctatcacctccagcgccaaagtggacatgacgttcgaggaggaggcacagctcctgcagttgaaggtgaagtgtctgaacaacctggcggcctcgcagctgaagctcgaccactaccgcgcagccctgcgctcctgcagccttgtgctggagcaccagccagacaacatcaaggctctcttccgcaagggcaaggtgctggcccagcagggggagtacagtgaggccatccccatcctgagggcagccctgaagctggaaccttccaacaagacgatccacgcagagctctcaaagctggtgaagaagcatgcggcgcagcggagcacggagaccgccttgtaccggaaaatgctgggcaaccccagccggctgcctgctaagtgccctggcaagggtgcctggtccatcccatggaagtggctgtttggggcgactgctgttgccttggggggtgtggcactctctgtggtcatcgctgccaggaactgaccacctaggtggctgccaccccctctgcacaccatggaccctgccctgcgctccccaactcccccaggctccctgtccactgccctccctggtctggccccctcctccgggttaggggagcaaggattgggggtcgtgcagcccagccagcaggagggactgaggccctctaggaggaaagcccagagggagggggccctcattccttcagacccagttttcccccaccctccttaccccgctgggctaggtctccgccagggctggcctcagtttctcctcaacaggcctgggggcagcccttcccctgcctagtccccgcctgagtgccagccccccaccccgcctgccgccccctgtccaggttccctccccgccacagtgaaataaagcatcccaccctgcagtttcaaaaaa

SEQ ID NO: 366024 - DNA, 1812 bp, Homo sapiens
ggcgtcactcctcctcaggccctcaggttcacttctgtaactaaggcttcaggatgggtcattcagcaaccccagagctgccctgcccgtcaagcttgaactctttaaggaaataacatttagagtggactgtgcccccagcagcccccaagcatggcatcgtgtgctgaaccctctgagccctctgccccactgcccgccggggtcccaccgctcgaggacttcgaggtactggatggggttgaggatgcagagggtgaggaggaagaggaggaggaagaggaggaagaggatgacctgagtgagctgccaccgctggaggacatgggacaacccccggcggaggaggctgagcagcctggggccctggcccgagagttccttgctgccatggagcccgagcccgccccagccccggccccagaagagtggctggacattctggggaacgggctgttgaggaagaagacgctggtcccagggccgccaggttcgagccgcccggtcaagggccaggtggtcaccgtacatctgcagacgtcgctggagaatggcacacgggtgcaggaggagccggagctggtgttcactctgggtgactgtgacgtcatccaggccctggatctcagtgtcccactcatggacgtgggggagacggccatggtcactgctgactccaagtactgctacggcccccaaggcagcaggagcccatacatccccccgcacgcggccctgtgcctggaggtgaccctgaagacggctgtggacgggcctgacctggagatgctcacggggcaggagcgcgtggccctggccaaccggaagcgggagtgcggcaacgcccactaccagcgggcggacttcgtcctggccgccaactcctacgacctcgccatcaaggctatcacctccagcgccaaagtggacatgacgttcgaggaggaggcacagctcctgcagttgaaggtgaagtgtctgaacaacctggcggcctcgcagctgaagctcgaccactaccgcgcagccctgcgctcctgcagccttgtgctggagcaccagccagacaacatcaaggctctcttccgcaagggcaaggtgctggcccagcagggggagtacagtgaggccatccccatcctgagggcagccctgaagctggaaccttccaacaagacgatccacgcagagctctcaaagctggtgaagaagcatgcggcgcagcggagcacggagaccgccttgtaccggaaaatgctgggcaaccccagccggctgcctgctaagtgccctggcaagggtgcctggtccatcccatggaagtggctgtttggggcgactgctgttgccttggggggtgtggcactctctgtggtcatcgctgccaggaactgaccacctaggtggctgccaccccctctgcacaccatggaccctgccctgcgctccccaactcccccaggctccctgtccactgccctccctggtctggccccctcctccgggttaggggagcaaggattgggggtcgtgcagcccagccagcaggagggactgaggccctctaggaggaaagcccagagggagggggccctcattccttcagacccagttttcccccaccctccttaccccgctgggctaggtctccgccagggctggcctcagtttctcctcaacaggcctgggggcagcccttcccctgcctagtccccgcctgagtgccagccccccaccccgcctgccgccccctgtccaggttccctccccgccacagtgaaataaagcatcccaccctgcagtttcaaaaaa

SEQ ID NO: 366025 - DNA, 2413 bp, Homo sapiens
gctgcagcggcagcagctgtcgcgccagtcgcaacagaagcaggtccgaggcacagcccgatcccgccatggagcagccgaggaaggcggtggtagtgacgggatttggcccttttggggaacacaccgtgaacgccagttggattgcagttcagagatgggatctcactatattgccctggctggtcttgaacttccgggctcaaatgatccttccacctcggcctcccaaagaagctgggattataggtgtgagccaccgagccctgccatcaggagctagaaaagctaggccttggcgacagcgtggacctgcatgtgtacgagattccggttgagtaccaaacagtccagagactcatccccgccctgtgggagaagcacagtccacagctggtggtgcatgtgggggtgtcaggcatggcgaccacagtcacactggagaaatgtggacacaacaagggctacaaggggctggacaactgccgcttttgccccggctcccagtgctgcgtggaggacgggcctgaaagcattgactccatcatcgacatggatgctgtgtgcaagcgagtcaccacgttgggcctggatgtgtcggtgaccatctcgcaggatgccggcagagtcacggtcgatcagccttcgtccacgtgcccccactggggaagccgtacaacgcggaccagctgggcagggcactgagagccatcattgaggagatgttggacctcctggagcagtcagagggcaaaatcaactattgccacaaacactgagggacgctcaggtctcctaagacctcatcctgctggggaccccacgaggggacatccaccctctggggtgtggccaggaaaagacaagctcttcagcttggggatccgatctggatgacctgagtgagctgccaccgctggaggacatgggacaacccccggcggaggaggctgagcagcctggggccctggcccgagagttccttgctgccatggagcccgagcccgccccagccccggccccagaagagtggctggacattctggggaacgggctgttgaggaagaagacgctggtcccagggccgccaggttcgagccgcccggtcaagggccaggtggtcaccgtacatctgcagacgtcgctggagaatggcacacgggtgcaggaggagccggagctggtgttcactctgggtgactgtgacgtcatccaggccctggatctcagtgtcccactcatggacgtgggggagacggccatggtcactgctgactccaagtactgctacggcccccaaggcagcaggagcccatacatccccccgcacgcggccctgtgcctggaggtgaccctgaagacggctgtggacgggcctgacctggagatgctcacggggcaggagcgcgtggccctggccaaccggaagcgggagtgcggcaacgcccactaccagcgggcggacttcgtcctggccgccaactcctacgacctcgccatcaaggctatcacctccagcgccaaagtggacatgacgttcgaggaggaggcacagctcctgcagttgaaggtgaagtgtctgaacaacctggcggcctcgcagctgaagctcgaccactaccgcgcagccctgcgctcctgcagccttgtgctggagcaccagccagacaacatcaaggctctcttccgcaagggcaaggtgctggcccagcagggggagtacagtgaggccatccccatcctgagggcagccctgaagctggaaccttccaacaagacgatccacgcagagctctcaaagctggtgaagaagcatgcggcgcagcggagcacggagaccgccttgtaccggaaaatgctgggcaaccccagccggctgcctgctaagtgccctggcaagggtgcctggtccatcccatggaagtggctgtttggggcgactgctgttgccttggggggtgtggcactctctgtggtcatcgctgccaggaactgaccacctaggtggctgccaccccctctgcacaccatggaccctgccctgcgctccccaactcccccaggctccctgtccactgccctccctggtctggccccctcctccgggttaggggagcaaggattgggggtcgtgcagcccagccagcaggagggactgaggccctctaggaggaaagcccagagggagggggccctcattccttcagacccagttttcccccaccctccttaccccgctgggctaggtctccgccagggctggcctcagtttctcctcaacaggcctgggggcagcccttcccctgcctagtccccgcctgagtgccagccccccaccccgcctgccgccccctgtccaggttccctccccgccacagtgaaataaagcatcccaccctgcagtttcaaaaaa

SEQ ID NO: 366026 - DNA, 1866 bp, Homo sapiens
atgggcacggcaggcgcggggccaagcggccgaacctggttcccgaggcgcggcggccgcggctgggggcggggaggggggcgcaggaccccaagtgggggtcccggagccagagggccaattcctgtccccccagcagcatggcatcgtgtgctgaaccctctgagccctctgccccactgcccgccggggtcccaccgctcgaggacttcgaggtactggatggggttgaggatgcagagggtgaggaggaagaggaggaggaagaggaggaagaggatgacctgagtgagctgccaccgctggaggacatgggacaacccccggcggaggaggctgagcagcctggggccctggcccgagagttccttgctgccatggagcccgagcccgccccagccccggccccagaagagtggctggacattctggggaacgggctgttgaggaagaagacgctggtcccagggccgccaggttcgagccgcccggtcaagggccaggtggtcaccgtacatctgcagacgtcgctggagaatggcacacgggtgcaggaggagccggagctggtgttcactctgggtgactgtgacgtcatccaggccctggatctcagtgtcccactcatggacgtgggggagacggccatggtcactgctgactccaagtactgctacggcccccaaggcagcaggagcccatacatccccccgcacgcggccctgtgcctggaggtgaccctgaagacggctgtggacgggcctgacctggagatgctcacggggcaggagcgcgtggccctggccaaccggaagcgggagtgcggcaacgcccactaccagcgggcggacttcgtcctggccgccaactcctacgacctcgccatcaaggctatcacctccagcgccaaagtggacatgacgttcgaggaggaggcacagctcctgcagttgaaggtgaagtgtctgaacaacctggcggcctcgcagctgaagctcgaccactaccgcgcagccctgcgctcctgcagccttgtgctggagcaccagccagacaacatcaaggctctcttccgcaagggcaaggtgctggcccagcagggggagtacagtgaggccatccccatcctgagggcagccctgaagctggaaccttccaacaagacgatccacgcagagctctcaaagctggtgaagaagcatgcggcgcagcggagcacggagaccgccttgtaccggaaaatgctgggcaaccccagccggctgcctgctaagtgccctggcaagggtgcctggtccatcccatggaagtggctgtttggggcgactgctgttgccttggggggtgtggcactctctgtggtcatcgctgccaggaactgaccacctaggtggctgccaccccctctgcacaccatggaccctgccctgcgctccccaactcccccaggctccctgtccactgccctccctggtctggccccctcctccgggttaggggagcaaggattgggggtcgtgcagcccagccagcaggagggactgaggccctctaggaggaaagcccagagggagggggccctcattccttcagacccagttttcccccaccctccttaccccgctgggctaggtctccgccagggctggcctcagtttctcctcaacaggcctgggggcagcccttcccctgcctagtccccgcctgagtgccagccccccaccccgcctgccgccccctgtccaggttccctccccgccacagtgaaataaagtatacctccttgtgaaggaaatgctttttttacaaaatacttcggggggtgcccgattccccatacgccctataaagaagctttttacaaat

SEQ ID NO: 366027 - DNA, 1766 bp, Homo sapiens
  misc_feature (1703)..(1703): n is a, c, g, or t
atgggcacggcaggcgcggggccaagcggccgaacctggttcccgaggcgcggcggccgcggctgggggcggggaggggggcgcaggaccccaagtgggggtcccggagccagagggccaattcctgtccccccagcagcatggcatcgtgtgctgaaccctctgagccctctgccccactgcccgccggggtcccaccgctcgaggacttcgaggtactggatggggttgaggatgcagagggtgaggaggaagaggaggaggaagaggaggaagaggatgacctgagtgagctgccaccgctggaggacatgggacaacccccggcggaggaggctgagcagcctggggccctggcccgagagttccttgctgccatggagcccgagcccgccccagccccggccccagaagagtggctggacattctggggaacgggctgttgaggaagaagacgctggtcccagggccgccaggttcgagccgcccggtcaagggccaggtggtcaccgtacatctgcagacgtcgctggagaatggcacacgggtgcaggaggagccggagctggtgttcactctgggtgactgtgacgtcatccaggccctggatctcagtgtcccactcatggacgtgggggagacggccatggtcactgctgactccaagtactgctacggcccccaaggcagcaggagcccatacatccccccgcacgcggccctgtgcctggaggtgaccctgaagacggctgtggacgggcctgacctggagatgctcacggggcaggagcgcgtggccctggccaaccggaagcgggagtgcggcaacgcccactaccagcgggcggacttcgtcctggccgccaactcctacgacctcgccatcaaggctatcacctccagcgccaaagtggacatgacgttcgaggaggaggcacagctcctgcagttgaaggtgaagtgtctgaacaacctggcggcctcgcagctgaagctcgaccactaccgcgcagccctgcgctcctgcagccttgtgctggagcaccagccagacaacatcaaggctctcttccgcaagggcaaggtgctggcccagcagggggagtacagtgaggccatccccatcctgagggcagccctgaagctggaaccttccaacaagacgatccacgcagagctctcaaagctggtgaagaagcatgcggcgcagcggagcacggagaccgccttgtaccggaaaatgctgggcaaccccagccggctgcctgctaagtgccctggcaagggtgcctggtccatcccatggaagtggctgtttggggcgactgctgttgccttggggggtgtggcactctctgtggtcatcgctgccaggaactgaccacctaggtggctgccaccccctctgcacaccatggaccctgccctgcgctccccaactcccccaggctccctgtccactgccctccctggtctggccccctcctccgggttaggggagcaaggattgggggtcgtgcagcccagccagcaggagggactgaggccctctaggaggaaagcccagagggagggggccctcattccttcagacccagttttcccccaccctccttaccccgctgggctaggtctccgccagggctggcctcagtttctcctcaacaggcctgggggcagcccttcccctgccgctgatgcngccaaagtgcgatgttaggtctcggaggaatactcactgaaaaaaaggcggcagcgcacccgg

SEQ ID NO: 366028 - DNA, 1715 bp, Homo sapiens
atgggcacggcaggcgcggggccaagcggccgaacctggttcccgaggcgcggcggccgcggctgggggcggggaggggggcgcaggaccccaagtgggggtcccggagccagagggccaattcctgtccccccagcagcatggcatcgtgtgctgaaccctctgagccctctgccccactgcccgccggggtcccaccgctcgaggacttcgaggtactggatggggttgaggatgcagagggtgaggaggaagaggaggaggaagaggaggaagaggatgacctgagtgagctgccaccgctggaggacatgggacaacccccggcggaggaggctgagcagcctggggccctggcccgagagttccttgctgccatggagcccgagcccgccccagccccggccccagaagagtggctggacattctggggaacgggctgttgaggaagaagacgctggtcccagggccgccaggttcgagccgcccggtcaagggccaggtggtcaccgtacatctgcagacgtcgctggagaatggcacacgggtgcaggaggagccggagctggtgttcactctgggtgactgtgacgtcatccaggccctggatctcagtgtcccactcatggacgtgggggagacggccatggtcactgctgactccaagtactgctacggcccccaaggcagcaggagcccatacatccccccgcacgcggccctgtgcctggaggtgaccctgaagacggctgtggacgggcctgacctggagatgctcacggggcaggagcgcgtggccctggccaaccggaagcgggagtgcggcaacgcccactaccagcgggcggacttcgtcctggccgccaactcctacgacctcgccatcaaggctatcacctccagcgccaaagtggacatgacgttcgaggaggaggcacagctcctgcagttgaaggtgaagtgtctgaacaacctggcggcctcgcagctgaagctcgaccactaccgcgcagccctgcgctcctgcagccttgtgctggagcaccagccagacaacatcaaggctctcttccgcaagggcaaggtgctggcccagcagggggagtacagtgaggccatccccatcctgagggcagccctgaagctggaaccttccaacaagacgatccacgcagagctctcaaagctggtgaagaagcatgcggcgcagcggagcacggagaccgccttgtaccggaaaatgctgggcaaccccagccggctgcctgctaagtgccctggcaagggtgcctggtccatcccatggaagtggctgtttggggcgactgctgttgccttggggggtgtggcactctctgtggtcatcgctgccaggaactgaccacctaggtggctgccaccccctctgcacaccatggaccctgccctgcgctccccaactcccccaggctccctgtccactgccctccctggtctggccccctcctccgggttaggggagcaaggattgggggtcgtgcagcccagccagcaggagggactgaggccctctaggaggaaagcccagagggagggggccctcattccttcagacccagttttcccccactagtccccgcctgagtgccagccccccaccccgcctgccgccccctgtccaggttccctccccgccacagtgaaataaagcatcccaccctgcagtttcaaaaaa

SEQ ID NO: 366029 - DNA, 1628 bp, Homo sapiens
atgggcacggcaggcgcggggccaagcggccgaacctggttcccgaggcgcggcggccgcggctgggggcggggaggggggcgcaggaccccaagtgggggtcccggagccagagggccaattcctgtccccccagcagcatggcatcgtgtgctgaaccctctgagccctctgccccactgcccgccggggtcccaccgctcgaggacttcgaggtactggatggggttgaggatgcagagggtgaggaggaagaggaggaggaagaggaggaagaggatgacctgagtgagctgccaccgctggaggacatgggacaacccccggcggaggaggctgagcagcctggggccctggcccgagagttccttgctgccatggagcccgagcccgccccagccccggccccagaagagtggctggacattctggggaacgggctgttgaggaagaagacgctggtcccagggccgccaggttcgagccgcccggtcaagggccaggtggtcaccgtacatctgcagacgtcgctggagaatggcacacgggtgcaggaggagccggagctggtgttcactctgggtgactgtgacgtcatccaggccctggatctcagtgtcccactcatggacgtgggggagacggccatggtcactgctgactccaagtactgctacggcccccaaggcagcaggagcccatacatccccccgcacgcggccctgtgcctggaggtgaccctgaagacggctgtggacgggcctgacctggagatgctcacggggcaggagcgcgtggccctggccaaccggaagcgggagtgcggcaacgcccactaccagcgggcggacttcgtcctggccgccaactcctacgacctcgccatcaaggctatcacctccagcgccaaagtggacatgacgttcgaggaggaggcacagctcctgcagttgaaggtgaagtgtctgaacaacctggcggcctcgcagctgaagctcgaccactaccgcgcagccctgcgctcctgcagccttgtgctggagcaccagccagacaacatcaaggctctcttccgcaagggcaaggtgctggcccagcagggggagtacagtgaggccatccccatcctgagggcagccctgaagctggaaccttccaacaagacgatccacgcagagctctcaaagctggtgaagaagcatgcggcgcagcggagcacggagaccgccttgtaccggaaaatgctgggcaaccccagccggctgcctgctaagtgccctggcaagggtgcctggtccatcccatggaagtggctgtttggggcgactgctgttgccttggggggtgtggcactctctgtggtcatcgctgccaggaactgaccacctaggtggctgccaccccctctgcacaccatggaccctgccctgcgctccccaactcccccaggctccctgtccactgccctccctggtctggccccctcctccgggttaggggagcaaggattgggggtcgtgcagtagtccccgcctgagtgccagccccccaccccgcctgccgccccctgtccaggttccctccccgccacagtgaaataaagcatcccaccctgcagtttcaaaaaa

SEQ ID NO: 366030 - DNA, 1679 bp, Homo sapiens
atgggcacggcaggcgcggggccaagcggccgaacctggttcccgaggcgcggcggccgcggctgggggcggggaggggggcgcaggaccccaagtgggggtcccggagccagagggccaattcctgtccccccagcagcatggcatcgtgtgctgaaccctctgagccctctgccccactgcccgccggggtcccaccgctcgaggacttcgaggtactggatggggttgaggatgcagagggtgaggaggaagaggaggaggaagaggaggaagaggatgacctgagtgagctgccaccgctggaggacatgggacaacccccggcggaggaggctgagcagcctggggccctggcccgagagttccttgctgccatggagcccgagcccgccccagccccggccccagaagagtggctggacattctggggaacgggctgttgaggaagaagacgctggtcccagggccgccaggttcgagccgcccggtcaagggccaggtggtcaccgtacatctgcagacgtcgctggagaatggcacacgggtgcaggaggagccggagctggtgttcactctgggtgactgtgacgtcatccaggccctggatctcagtgtcccactcatggacgtgggggagacggccatggtcactgctgactccaagtactgctacggcccccaaggcagcaggagcccatacatccccccgcacgcggccctgtgcctggaggtgaccctgaagacggctgtggacgggcctgacctggagatgctcacggggcaggagcgcgtggccctggccaaccggaagcgggagtgcggcaacgcccactaccagcgggcggacttcgtcctggccgccaactcctacgacctcgccatcaaggctatcacctccagcgccaaagtggacatgacgttcgaggaggaggcacagctcctgcagttgaaggtgaagtgtctgaacaacctggcggcctcgcagctgaagctcgaccactaccgcgcagccctgcgctcctgcagccttgtgctggagcaccagccagacaacatcaaggctctcttccgcaagggcaaggtgctggcccagcagggggagtacagtgaggccatccccatcctgagggcagcccggctgcctgctaagtgccctggcaagggtgcctggtccatcccatggaagtggctgtttggggcgactgctgttgccttggggggtgtggcactctctgtggtcatcgctgccaggaactgaccacctaggtggctgccaccccctctgcacaccatggaccctgccctgcgctccccaactcccccaggctccctgtccactgccctccctggtctggccccctcctccgggttaggggagcaaggattgggggtcgtgcagcccagccagcaggagggactgaggccctctaggaggaaagcccagagggagggggccctcattccttcagacccagttttcccccaccctccttaccccgctgggctaggtctccgccagggctggcctcagtttctcctcaacaggcctgggggcagcccttcccctgcctagtccccgcctgagtgccagccccccaccccgcctgccgccccctgtccaggttccctccccgccacagtgaaataaagcatcccaccctgcagtttcaaaaaa

SEQ ID NO: 366031 - DNA, 1342 bp, Homo sapiens
atgggcacggcaggcgcggggccaagcggccgaacctggttcccgaggcgcggcggccgcggctgggggcggggaggggggcgcaggaccccaagtgggggtcccggagccagagggccaattcctgtccccccagcagcatggcatcgtgtgctgaaccctctgagccctctgccccactgcccgccggggtcccaccgctcgaggacttcgaggtactggatggggttgaggatgcagagggtgaggaggaagaggaggaggaagaggaggaagaggatgacctgagtgagctgccaccgctggaggacatgggacaacccccggcggaggaggctgagcagcctggggccctggcccgagagttccttgctgccatggagcccgagcccgccccagccccggccccagaagagtggctggacattctggggaacgggctgttgaggaagaagacgctggtcccagggccgccaggttcgagccgcccggtcaagggccaggtggtcaccgtacatctgcagacgtcgctggagaatggcacacgggtgcaggaggagccggagctggtgttcactctgggtgactgtgacgtcatccaggccctggatctcagtgtcccactcatggacgtgggggagacggccatggtcactgctgactccaagtactgctacggcccccaaggcagcaggagcccatacatccccccgcacgcggccctgtgcctggaggtgaccctgaagacggctgtggacgggcctgacctggagatgctcacggggcaggagcgcgtggccctggccaaccggaagcgggagtgcggcaacgcccactaccagcgggcggacttcgtcctggccgccaactcctacgacctcgccatcaaggctatcacctccagcgccaaagtggacatgacgttcgaggaggaggcacagctcctgcagttgaaggtgaagtgtctgaacaacctggcggcctcgcagctgaagctcgaccactaccgcgcagccctgcgctcctgcagccttgtgctggagcaccagccagacaacatcaaggctctcttccgcaagggcaaggtgctggcccagcagggggagtacagtgagagggggccctcattccttcagacccagttttcccccaccctccttaccccgctgggctaggtctccgccagggctggcctcagtttctcctcaacaggcctgggggcagcccttcccctgcctagtccccgcctgagtgccagccccccaccccgcctgccgccccctgtccaggttccctccccgccacagtgaaataaagcatcccaccctgcagtttcaaaaaa

SEQ ID NO: 366032 - DNA, 1197 bp, Homo sapiens
  misc_feature (1090)..(1090): n is a, c, g, or t
  misc_feature (1092)..(1092): n is a, c, g, or t
  misc_feature (1097)..(1097): n is a, c, g, or t
  misc_feature (1103)..(1103): n is a, c, g, or t
atgggcacggcaggcgcggggccaagcggccgaacctggttcccgaggcgcggcggccgcggctgggggcggggaggggggcgcaggaccccaagtgggggtcccggagccagagggccaattcctgtccccccagcagcatggcatcgtgtgctgaaccctctgagccctctgccccactgcccgccggggtcccaccgctcgaggacttcgaggtactggatggggttgaggatgcagagggtgaggaggaagaggaggaggaagaggaggaagaggatgacctgagtgagctgccaccgctggaggacatgggacaacccccggcggaggaggctgagcagcctggggccctggcccgagagttccttgctgccatggagcccgagcccgccccagccccggccccagaagagtggctggacattctggggaacgggctgttgaggaagaagacgctggtcccagggccgccaggttcgagccgcccggtcaagggccaggtggtcaccgtacatctgcagacgtcgctggagaatggcacacgggtgcaggaggagccggagctggtgttcactctgggtgactgtgacgtcatccaggccctggatctcagtgtcccactcatggacgtgggggagacggccatggtcactgctgactccaagtactgctacggcccccaaggcagcaggagcccatacatccccccgcacgcggccctgtgcctggaggtgaccctgaagacggctgtggacgggcctgacctggagatgctcacggggcaggagcgcgtggccctggccaaccggaagcgggagtgcggcaacgcccactaccagcgggcggacttcgtcctggccgccaactcctacgacctcgccatcaaggctatcacctccagcgccaaagtggacatgacgttcgaggaggaggcacagctcctgcagttgaaggtgaagtgtctgaacaacctggcggcctcgcagctgaagctcgaccactaccgcgcagccctgcgctcctgcagccttgtgctggagcaccagccagacaacatcaaggctctcttccgcaagggcaaggggantnggagncatccnatctggggagctgagttgacttaaaagaaacaccaagctcaagcgtagactgcagaaggactttcaattgacagggttcgaggcgtgcccagta

SEQ ID NO: 366033 - DNA, 693 bp, Homo sapiens
  misc_feature (23)..(23): n is a, c, g, or t
  misc_feature (36)..(36): n is a, c, g, or t
cgtaccccaaaggaggctattgnagggcagccctgnaagctggaaccttccaacaagacgatccacgcagagctctcaaagctggtgaagaagcatgcggcgcagcggagcacggagaccgccttgtaccggaaaatgctgggcaaccccagccggctgcctgctaagtgccctggcaagggtgcctggtccatcccatggaagtggctgtttggggcgactgctgttgccttggggggtgtggcactctctgtggtcatcgctgccaggaactgaccacctaggtggctgccaccccctctgcacaccatggaccctgccctgcgctccccaactcccccaggctccctgtccactgccctccctggtctggccccctcctccgggttaggggagcaaggattgggggtcgtgcagcccagccagcaggagggactgaggccctctaggaggaaagcccagagggagggggccctcattccttcagacccagttttcccccaccctccttaccccgctgggctaggtctccgccagggctggcctcagtttctcctcaacaggcctgggggcagcccttcccctgcctagtccccgcctgagtgccagccccccaccccgcctgccgccccctgtccaggttccctccccgccacagtgaaataaagcatcccaccctgcagtttcaaaaaa

SEQ ID NO: 366034 - DNA, 505 bp, Homo sapiens
atgggcacggcaggcgcggggccaagcggccgaacctggttcccgaggcgcggcggccgcggctgggggcggggaggggggcgcaggaccccaagtgggggtcccggagccagagggccaattcctgtccccccagcagcatggcatcgtgtgctgaaccctctgagccctctgccccactgcccgccggggtcccaccgctcgaggacttcgaggtactggatggggttgaggatgcagagggtgaggaggaagaggaggaggaagaggaggaagagagggggccctcattccttcagacccagttttcccccaccctccttaccccgctgggctaggtctccgccagggctggcctcagtttctcctcaacaggcctgggggcagcccttcccctgcctagtccccgcctgagtgccagccccccaccccgcctgccgccccctgtccaggttccctccccgccacagtgaaataaagcatcccaccctgcagtttcaaaaaa

SEQ ID NO: 366035 - DNA, 444 bp, Homo sapiens
cttagtctagctaaaagtttcttgaatatttttatcttttctaaaatcaactctattttattgatcttttctattgttttcttgtctctatttatttctgttctgatctttgttatatcttcccttctgctaactctggcttagtttgttctttttctagtttcacgaggtgtaacattaggctgtttatctagaacctaattttttttttaatgtaggcatttatcattataaacgtacctcttagaactgcttttgctgcatcctgtaagttctgtggtgttgtgtttccattttcgtttatctcatgtattagtccattttcacactgctgataaagacatacccgagactgggaagaaaaagaggtttaattggacttacagttctacgtgactggggaggcctcagaatcatggggagaggtaatagacacttcctaca

SEQ ID NO: 366036 - DNA, 392 bp, Homo sapiens
gattgcatgtttgtgtccccccctaaattcgcacattgaaatcctaacctccaatatcatggtattaggaggtggggcctttgggaggtaattagaccatgagggtggagtcctcttgaatgggattagcacctttgtaaaagagactccacagggctctctagccttctttctgccaggtgagaatacaatgagaagcctgcaacctggaagagggccctcaccagaacctgaccacactggcaccctgatctcaaactttggcctccagaacagagataaataaattcctatggtttataaaccacgcagtctatggctcttggttatagcagcctacactgactataacatataccaatcaaaactaattgtaggctgggtgtggtggc

SEQ ID NO: 366037 - DNA, 3325 bp, Homo sapiens
ccacagcgctgtagactgcgccgcattagaagcctggcctcctgatgctgtgctcttcatctagacccaagccccaggtcgtgggacgatttctcccgtttttgactccctggaactgtattgcctgctttacctgcgtacatgttgattctttctcatggcaaccccgcaggaaaccatcaagatctcattttacagctgggattctctggttcacagaggtaacggagcttgcccgaggccagttaaacgagaagattcatcaccgctttgatggctgcctcacaaacttcacaaactgttgcatctcacgttccttttgcagatttgtgttcaactttagaacgaatacagaaaagtaaaggacgtgcagaaaaaatcagacacttcagggaatttttagattcttggagaaaatttcatgatgctcttcataagaaccacaaagatgtcacagactctttttatccagcaatgagactaattcttcctcagctagaaagagagagaatggcctatggaattaaagaaactatgcttgctaagctttatattgagttgcttaatttacctagagatggaaaagatgccctcaaacttttaaactacagaacacccactggaactcatggagatgctggagactttgcaatgattgcatattttgtgttgaagccaagatgtttacagaaaggaagtttaaccatacagcaagtaaacgaccttttagactcaattgccagcaataattctgctaaaagaaaagacctaataaaaaagagccttcttcaacttataactcagagttcagcacttgagcaaaagtggcttatacggatgatcataaaggatttaaagcttggtgttagtcagcaaactatcttttctgtttttcataatgatgctgctgagttgcataatgtcactacagatctggaaaaagtctgtaggcaactgcatgatccttctgtaggactcagtgatatttctatcactttattttctgcatttaaaccaatgctagctgctattgcagatattgagcacattgagaaggatatgaaacatcagagtttctacatagaaaccaagctagatggtgaacgtatgcaaatgcacaaagatggagatgtatataaatacttctctcgaaatggatataactacactgatcagtttggtgcttctcctactgaaggttctcttaccccattcattcataatgcattcaaagcagatatacaaatctgtattcttgatggtgagatgatggcctataatcctaatacacaaactttcatgcaaaagggaactaagtttgatattaaaagaatggtagaggattctgatctgcaaacttgttattgtgtttttgatgtattgatggttaataataaaaagctagggcatgagactctgagaaagaggtatgagattcttagtagtatttttacaccaattccaggtagaatagaaatagtgcagaaaacacaagctcatactaagaatgaagtaattgatgcattgaatgaagcaatagataaaagagaagagggaattatggtaaaacaacctctatccatctacaagccagacaaaagaggtgaagggtggttaaaaattaaaccagagtatgtcagtggactaatggatgaattggacattttaattgttggaggatattggggtaaaggatcacggggtggaatgatgtctcattttctgtgtgcagtagcagagaagccccctcctggtgagaagccatctgtgtttcatactctctctcgtgttgggtctggctgcaccatgaaagaactgtatgatctgggtttgaaattggccaagtattggaagccttttcatagaaaagctccaccaagcagcattttatgtggaacagagaagccagaagtatacattgaaccttgtaattctgtcattgttcagattaaagcagcagagatcgtacccagtgatatgtataaaactggctgcaccttgcgttttccacgaattgaaaagataagagatgacaaggagtggcatgagtgcatgaccctggacgacctagaacaacttagggggaaggcatctggtaagctcgcatctaaacacctttatataggtggtgatgatgaaccacaagaaaaaaagcggaaagctgccccaaagatgaagaaagttattggaattattgagcacttaaaagcacctaaccttactaacgttaacaaaatttctaatatatttgaagatgtagagttttgtgttatgagtggaacagatagccagccaaagcctgacctggagaacagaattgcagaatttggtggttatatagtacaaaatccaggcccagacacgtactgtgtaattgcagggtctgagaacatcagagtgaaaaacataattttgtcaaataaacatgatgttgtcaagcctgcatggcttttagaatgttttaagaccaaaagctttgtaccatggcagcctcgctttatgattcatatgtgcccatcaaccaaagaacattttgcccgtgaatatgattgctatggtgatagttatttcattgatacagacttgaaccaactgaaggaagtattctcaggaattaaaaattctaacgagcagactcctgaagaaatggcttctctgattgctgatttagaatatcggtattcctgggattgctctcctctcagtatgtttcgacgccacaccgtttatttggactcgtatgctgttattaatgacctgagtaccaaaaatgaggggacaaggttagctattaaagccttggagcttcggtttcatggagcaaaagtagtttcttgtttagctgagggagtgtctcatgtaataattggggaagatcatagtcgtgttgcagattttaaagcttttagaagaacttttaagagaaagtttaaaatcctaaaagaaagttgggtaactgattcaatagacaagtgtgaattacaagaagaaaaccagtatttgatttaaagctaggtttcctagtgaggaaagcctctgatctggcagactcattgcagcaggtggtaatgataaaatactaaactacattttatttttgtatcttaaaaatctatgcctaaaaagtatcattacatataggaaaacaataattttaacttttaaggttgaaaagacaatagcccaaagccaagaaagaaaaattatcttgaatgtagtattcaatgattttttatgatcaaggtgaaataaacagtctaaagaagaggtgtttttataatatccatatagaaatctagaatttttacttagatactaataaaat

SEQ ID NO: 366038 - DNA, 3161 bp, Homo sapiens
tgcgcggcgagcagctggcggaaccggcatcttctggcgccagcttccggcttagcggctgagcttcaggcttgacgtcagttaaacgagaagattcatcaccgctttgatggctgcctcacaaacttcacaaactgttgcatctcacgttccttttgcagatttgtgttcaactttagaacgaatacagaaaagtaaaggacgtgcagaaaaaatcagacacttcagggaatttttagattcttggagaaaatttcatgatgctcttcataagaaccacaaagatgtcacagactctttttatccagcaatgagactaattcttcctcagctagaaagagagagaatggcctatggaattaaagaaactatgcttgctaagctttatattgagttgcttaatttacctagagatggaaaagatgccctcaaacttttaaactacagaacacccactggaactcatggagatgctggagactttgcaatgattgcatattttgtgttgaagccaagatgtttacagaaaggaagtttaaccatacagcaagtaaacgaccttttagactcaattgccagcaataattctgctaaaagaaaagacctaataaaaaagagccttcttcaacttataactcagagttcagcacttgagcaaaagtggcttatacggatgatcataaaggatttaaagcttggtgttagtcagcaaactatcttttctgtttttcataatgatgctgctgagttgcataatgtcactacagatctggaaaaagtctgtaggcaactgcatgatccttctgtaggactcagtgatatttctatcactttattttctgcatttaaaccaatgctagctgctattgcagatattgagcacattgagaaggatatgaaacatcagagtttctacatagaaaccaagctagatggtgaacgtatgcaaatgcacaaagatggagatgtatataaatacttctctcgaaatggatataactacactgatcagtttggtgcttctcctactgaaggttctcttaccccattcattcataatgcattcaaagcagatatacaaatctgtattcttgatggtgagatgatggcctataatcctaatacacaaactttcatgcaaaagggaactaagtttgatattaaaagaatggtagaggattctgatctgcaaacttgttattgtgtttttgatgtattgatggttaataataaaaagctagggcatgagactctgagaaagaggtatgagattcttagtagtatttttacaccaattccaggtagaatagaaatagtgcagaaaacacaagctcatactaagaatgaagtaattgatgcattgaatgaagcaatagataaaagagaagagggaattatggtaaaacaacctctatccatctacaagccagacaaaagaggtgaagggtggttaaaaattaaaccagagtatgtcagtggactaatggatgaattggacattttaattgttggaggatattggggtaaaggatcacggggtggaatgatgtctcattttctgtgtgcagtagcagagaagccccctcctggtgagaagccatctgtgtttcatactctctctcgtgttgggtctggctgcaccatgaaagaactgtatgatctgggtttgaaattggccaagtattggaagccttttcatagaaaagctccaccaagcagcattttatgtggaacagagaagccagaagtatacattgaaccttgtaattctgtcattgttcagattaaagcagcagagatcgtacccagtgatatgtataaaactggctgcaccttgcgttttccacgaattgaaaagataagagatgacaaggagtggcatgagtgcatgaccctggacgacctagaacaacttagggggaaggcatctggtaagctcgcatctaaacacctttatataggtggtgatgatgaaccacaagaaaaaaagcggaaagctgccccaaagatgaagaaagttattggaattattgagcacttaaaagcacctaaccttactaacgttaacaaaatttctaatatatttgaagatgtagagttttgtgttatgagtggaacagatagccagccaaagcctgacctggagaacagaattgcagaatttggtggttatatagtacaaaatccaggcccagacacgtactgtgtaattgcagggtctgagaacatcagagtgaaaaacataattttgtcaaataaacatgatgttgtcaagcctgcatggcttttagaatgttttaagaccaaaagctttgtaccatggcagcctcgctttatgattcatatgtgcccatcaaccaaagaacattttgcccgtgaatatgattgctatggtgatagttatttcattgatacagacttgaaccaactgaaggaagtattctcaggaattaaaaattctaacgagcagactcctgaagaaatggcttctctgattgctgatttagaatatcggtattcctgggattgctctcctctcagtatgtttcgacgccacaccgtttatttggactcgtatgctgttattaatgacctgagtaccaaaaatgaggggacaaggttagctattaaagccttggagcttcggtttcatggagcaaaagtagtttcttgtttagctgagggagtgtctcatgtaataattggggaagatcatagtcgtgttgcagattttaaagcttttagaagaacttttaagagaaagtttaaaatcctaaaagaaagttgggtaactgattcaatagacaagtgtgaattacaagaagaaaaccagtatttgatttaaagctaggtttcctagtgaggaaagcctctgatctggcagactcattgcagcaggtggtaatgataaaatactaaactacattttatttttgtatcttaaaaatctatgcctaaaaagtatcattacatataggaaaacaataattttaacttttaaggttgaaaagacaatagcccaaagccaagaaagaaaaattatcttgaatgtagtattcaatgattttttatgatcaaggtgaaataaacagtctaaagaagaggtgtttttataatatccatatagaaatctagaatttttacttagatactaataaaat

SEQ ID NO: 366039 - DNA, 3234 bp, Homo sapiens
tgcgcggcgagcagctggcggaaccggcatcttctggcgccagcttccggcttagcggctgagcttcaggcttgacgtcaggaaaccatcaagatctcattttacagctgggattctctggttcacagaggtaacggagcttgcccgaggccagttaaacgagaagattcatcaccgctttgatggctgcctcacaaacttcacaaactgttgcatctcacgttccttttgcagatttgtgttcaactttagaacgaatacagaaaagtaaaggacgtgcagaaaaaatcagacacttcagggaatttttagattcttggagaaaatttcatgatgctcttcataagaaccacaaagatgtcacagactctttttatccagcaatgagactaattcttcctcagctagaaagagagagaatggcctatggaattaaagaaactatgcttgctaagctttatattgagttgcttaatttacctagagatggaaaagatgccctcaaacttttaaactacagaacacccactggaactcatggagatgctggagactttgcaatgattgcatattttgtgttgaagccaagatgtttacagaaaggaagtttaaccatacagcaagtaaacgaccttttagactcaattgccagcaataattctgctaaaagaaaagacctaataaaaaagagccttcttcaacttataactcagagttcagcacttgagcaaaagtggcttatacggatgatcataaaggatttaaagcttggtgttagtcagcaaactatcttttctgtttttcataatgatgctgctgagttgcataatgtcactacagatctggaaaaagtctgtaggcaactgcatgatccttctgtaggactcagtgatatttctatcactttattttctgcatttaaaccaatgctagctgctattgcagatattgagcacattgagaaggatatgaaacatcagagtttctacatagaaaccaagctagatggtgaacgtatgcaaatgcacaaagatggagatgtatataaatacttctctcgaaatggatataactacactgatcagtttggtgcttctcctactgaaggttctcttaccccattcattcataatgcattcaaagcagatatacaaatctgtattcttgatggtgagatgatggcctataatcctaatacacaaactttcatgcaaaagggaactaagtttgatattaaaagaatggtagaggattctgatctgcaaacttgttattgtgtttttgatgtattgatggttaataataaaaagctagggcatgagactctgagaaagaggtatgagattcttagtagtatttttacaccaattccaggtagaatagaaatagtgcagaaaacacaagctcatactaagaatgaagtaattgatgcattgaatgaagcaatagataaaagagaagagggaattatggtaaaacaacctctatccatctacaagccagacaaaagaggtgaagggtggttaaaaattaaaccagagtatgtcagtggactaatggatgaattggacattttaattgttggaggatattggggtaaaggatcacggggtggaatgatgtctcattttctgtgtgcagtagcagagaagccccctcctggtgagaagccatctgtgtttcatactctctctcgtgttgggtctggctgcaccatgaaagaactgtatgatctgggtttgaaattggccaagtattggaagccttttcatagaaaagctccaccaagcagcattttatgtggaacagagaagccagaagtatacattgaaccttgtaattctgtcattgttcagattaaagcagcagagatcgtacccagtgatatgtataaaactggctgcaccttgcgttttccacgaattgaaaagataagagatgacaaggagtggcatgagtgcatgaccctggacgacctagaacaacttagggggaaggcatctggtaagctcgcatctaaacacctttatataggtggtgatgatgaaccacaagaaaaaaagcggaaagctgccccaaagatgaagaaagttattggaattattgagcacttaaaagcacctaaccttactaacgttaacaaaatttctaatatatttgaagatgtagagttttgtgttatgagtggaacagatagccagccaaagcctgacctggagaacagaattgcagaatttggtggttatatagtacaaaatccaggcccagacacgtactgtgtaattgcagggtctgagaacatcagagtgaaaaacataattttgtcaaataaacatgatgttgtcaagcctgcatggcttttagaatgttttaagaccaaaagctttgtaccatggcagcctcgctttatgattcatatgtgcccatcaaccaaagaacattttgcccgtgaatatgattgctatggtgatagttatttcattgatacagacttgaaccaactgaaggaagtattctcaggaattaaaaattctaacgagcagactcctgaagaaatggcttctctgattgctgatttagaatatcggtattcctgggattgctctcctctcagtatgtttcgacgccacaccgtttatttggactcgtatgctgttattaatgacctgagtaccaaaaatgaggggacaaggttagctattaaagccttggagcttcggtttcatggagcaaaagtagtttcttgtttagctgagggagtgtctcatgtaataattggggaagatcatagtcgtgttgcagattttaaagcttttagaagaacttttaagagaaagtttaaaatcctaaaagaaagttgggtaactgattcaatagacaagtgtgaattacaagaagaaaaccagtatttgatttaaagctaggtttcctagtgaggaaagcctctgatctggcagactcattgcagcaggtggtaatgataaaatactaaactacattttatttttgtatcttaaaaatctatgcctaaaaagtatcattacatataggaaaacaataattttaacttttaaggttgaaaagacaatagcccaaagccaagaaagaaaaattatcttgaatgtagtattcaatgattttttatgatcaaggtgaaataaacagtctaaagaagaggtgtttttataatatccatatagaaatctagaatttttacttagatactaataaaat

SEQ ID NO: 366040 - DNA, 3180 bp, Homo sapiens
tgcgcggcgagcagctggcggaaccggcatcttctggcgccagcttccggcttagcggctgagcttcaggcttgacgtcaggaaaccatcaagatctcattttacagctgggattctctggttcacagaggtaacggagcttgcccgaggccagttaaacgagaagattcatcaccgctttgatggctgcctcacaaacttcacaaactgttgcatctcacgttccttttgcagatttgtgttcaactttagaacgaatacagaaaagtaaaggacgtgcagaaaaaatcagacacttcagggaatttttagattcttggagaaaatttcatgatgctcttcataagaaccacaaagatgtcacagactctttttatccagcaatgagactaattcttcctcagctagaaagagagagaatggcctatggaattaaagaaactatgcttgctaagctttatattgagttgcttaatttacctagagatggaaaagatgccctcaaacttttaaactacagaacacccactggaactcatggagatgctggagactttgcaatgattgcatattttgtgttgaagccaagatgtttacagaaaggaagtttaaccatacagcaagtaaacgaccttttagactcaattgccagcaataattctgctaaaagaaaagacctaataaaaaagagccttcttcaacttataactcagagttcagcacttgagcaaaagtggcttatacggatgatcataaaggatttaaagcttggtgttagtcagcaaactatcttttctgtttttcataatgatgctgctgagttgcataatgtcactacagatctggacactttattttctgcatttaaaccaatgctagctgctattgcagatattgagcacattgagaaggatatgaaacatcagagtttctacatagaaaccaagctagatggtgaacgtatgcaaatgcacaaagatggagatgtatataaatacttctctcgaaatggatataactacactgatcagtttggtgcttctcctactgaaggttctcttaccccattcattcataatgcattcaaagcagatatacaaatctgtattcttgatggtgagatgatggcctataatcctaatacacaaactttcatgcaaaagggaactaagtttgatattaaaagaatggtagaggattctgatctgcaaacttgttattgtgtttttgatgtattgatggttaataataaaaagctagggcatgagactctgagaaagaggtatgagattcttagtagtatttttacaccaattccaggtagaatagaaatagtgcagaaaacacaagctcatactaagaatgaagtaattgatgcattgaatgaagcaatagataaaagagaagagggaattatggtaaaacaacctctatccatctacaagccagacaaaagaggtgaagggtggttaaaaattaaaccagagtatgtcagtggactaatggatgaattggacattttaattgttggaggatattggggtaaaggatcacggggtggaatgatgtctcattttctgtgtgcagtagcagagaagccccctcctggtgagaagccatctgtgtttcatactctctctcgtgttgggtctggctgcaccatgaaagaactgtatgatctgggtttgaaattggccaagtattggaagccttttcatagaaaagctccaccaagcagcattttatgtggaacagagaagccagaagtatacattgaaccttgtaattctgtcattgttcagattaaagcagcagagatcgtacccagtgatatgtataaaactggctgcaccttgcgttttccacgaattgaaaagataagagatgacaaggagtggcatgagtgcatgaccctggacgacctagaacaacttagggggaaggcatctggtaagctcgcatctaaacacctttatataggtggtgatgatgaaccacaagaaaaaaagcggaaagctgccccaaagatgaagaaagttattggaattattgagcacttaaaagcacctaaccttactaacgttaacaaaatttctaatatatttgaagatgtagagttttgtgttatgagtggaacagatagccagccaaagcctgacctggagaacagaattgcagaatttggtggttatatagtacaaaatccaggcccagacacgtactgtgtaattgcagggtctgagaacatcagagtgaaaaacataattttgtcaaataaacatgatgttgtcaagcctgcatggcttttagaatgttttaagaccaaaagctttgtaccatggcagcctcgctttatgattcatatgtgcccatcaaccaaagaacattttgcccgtgaatatgattgctatggtgatagttatttcattgatacagacttgaaccaactgaaggaagtattctcaggaattaaaaattctaacgagcagactcctgaagaaatggcttctctgattgctgatttagaatatcggtattcctgggattgctctcctctcagtatgtttcgacgccacaccgtttatttggactcgtatgctgttattaatgacctgagtaccaaaaatgaggggacaaggttagctattaaagccttggagcttcggtttcatggagcaaaagtagtttcttgtttagctgagggagtgtctcatgtaataattggggaagatcatagtcgtgttgcagattttaaagcttttagaagaacttttaagagaaagtttaaaatcctaaaagaaagttgggtaactgattcaatagacaagtgtgaattacaagaagaaaaccagtatttgatttaaagctaggtttcctagtgaggaaagcctctgatctggcagactcattgcagcaggtggtaatgataaaatactaaactacattttatttttgtatcttaaaaatctatgcctaaaaagtatcattacatataggaaaacaataattttaacttttaaggttgaaaagacaatagcccaaagccaagaaagaaaaattatcttgaatgtagtattcaatgattttttatgatcaaggtgaaataaacagtctaaagaagaggtgtttttataatatccatatagaaatctagaatttttacttagatactaataaaat

SEQ ID NO: 366041 - DNA, 367 bp, Homo sapiens
tttggcatttaatatcagtaaagaattctgacagtgttgttgcctttggctgtgaccatcatcaagggccattggattatataagactgcaactgcacataccaaattagcctgaaaactttaaagggatcttctcaagtagaagatgaatatatggctgtgtctgaaccatcctcagtgacaaaaaggcaaagctgagacttaatgtgattcaaaggtgttaatctagatgtcgcttacctgaactgatggggaatctgtaagaaaaaagatgctggccgggtgcaggggctcacacctgtaatcctagcactttgggaggccgaggcgggtgggtcacctgaggtcaggagcttaggaccagcct

SEQ ID NO: 366042 - DNA, 509 bp, Homo sapiens
aagtccagcataaagtgttgctatttccttctctgtcttgggttaggctgatcacttgctattagtttcaagcacaatattaatttccctttgctccttttaggaatgtagcagaaccgttccccacactattcttctgccttatgacagtcacaaccaccatttgagtaacatgcttctcagctgacctagcctgtgtccaggtccaggtccacaatggccacattcttaggaaatacgtggttcacatctcattcggaaaatacttccttcctaggagagatacgtggagaaggatctcctgaggcccatctcagcaggcaatgcagggctgagaggctggatggtgcaggagaaagggaacaggggttcaatgcaaacattcttgggctttaatccatgctttgcttgataaacagagacttcattttcttatgtgcaagtgagtataatactaccatcactgggctgggtgctgtggctaacgcctgtaatcccagcactttagg

SEQ ID NO: 366043 - DNA, 476 bp, Homo sapiens
atcactatcctccttggccccatgggacagggaaatctgcacatagaggtggtcaaaaatgccaaataccatggggcagatctacacatagaggtggtcaaaaatgccaaataccatggggcagatctacaatagcatgcaggagagcagcgaaaaaaaaggagccctgagccctgggggtgcttgtcagagccaacaggtatttgaaggaagaggcaacactgttctggggcaaggagtcaaagtgggattacttcctagtaacaactgtctcctgcaggctagcctcttccacctcctccttccaccacctctcacacttctgggctgtgggaaataacatcatttcttggctgtgatcttccaacatacctatcttaaactgcttggtttgggtgcccataggggagaaaaagtacctgaattcaactggtagggtctgttagcttacaagtaggataaaattcacagatgtg

SEQ ID NO: 366044 - DNA, 369 bp, Homo sapiens
ggcaatgactttgtattactttcacaaatttttaaaatttttcatcagctttctcaggtttaattagtatgattcagaacagtgttggccaggcacagtggctcaggcctgtaatcccagcactttgggaggctgaggcaagcggattacctgaggttaggagttcaagaccagcctggccaacatggtgaaaccacatctctactaaaaatacaaaacttagccaggagtggtggcaggtgcctgtaatccctgctacttgggaggctggggtaggagaatcacttgaacctgggaggcgaaggttgccatgagccgagatcacaccattgcactccagcctgggcaacaagagtaaaacttggtctc

SEQ ID NO: 366045 - DNA, 523 bp, Homo sapiens
ttcaccaccggaccgtggaacacaaagagcctggaagagtctatcactttcaactgaaaccgcaagaagaactaagtaggttaagccctaagaatgttcctaggtaacctacttgagttgaaatttgactaaaaatccttacaccctacctaagagaggtaacgcctattaggatcggaagtgattggaagctttgtttcagatctcgtcccaaaagggagaacggtcaatgacaaagctgctgtgaatagtattctgggggcgtggtggaaccccgattcactgctatctcccgaatcagcaacttgacagagccgcgcctcccgggccttggaagccttccattccgagctggctgggtgggactcaggttttacggtatgctggactttttccccgtgagttaaaacacatttatagtaactaagtggttaatgatgagaaaaaaccccaaactactgtactaataatcaacctctgctatttggtttgtaaaaaacaaaaatacatctataaaaaggga

SEQ ID NO: 366046 - DNA, 1354 bp, Homo sapiens
  misc_feature (107)..(107): n is a, c, g, or t
ccacgcgtcgcggacgcgtgggtcggacgcgtgggtggatgatttcctgggcgattgtggtcggataccgggtggctattgccgcgtgctctacgcgtcctcgattngtggtgcgtagagagacaaataccgatactttgcttgtttgatgagagcccggtttgaagaacataagaatgaaaaggatatggcgaaggccacccagctgctgaaggaggccgaggaagaattctggtaccgtcagcatccacagccatacatcttccctgactctcctgggggcacctcctatgagagatacgattgctacaaggtcccagaatggtgcttagatgactggcatccttctgagaaggcaatgtatcctgattactttgccaagagagaacagtggaagaaactgcggagggaaagctgggaacgagaggttaagcagctgcaggaggaaacgccacctggtggtcctttaactgaagctttgccccctgcccgaaaggaaggtgatttgcccccactgtggtggtatattgtgaccagaccccgggagcggcccatgtagaaagagagagacctcatctttcatgcttgcaagtgaaatatgttacagaacatgcacttgccctaataaaaaatcagtgaaatggtctctggtatgactgacgttcttctaagaattactgtgatgccaagtgactgtgccactgtcattgttttatcaatcgtgcatgtaaagaaaatgacaggacatgtagtcagtcagctgtgttctctgcaataaatcactgatagcatatgttaccagtaaggaaaaactgaggcagaaccagattgaggcgaacaaactctcaagtcaaaggcctaattagctgtggtaactagaaggaataaacaaagccaagaacagaaatactgaggatttaaaaataacctttttggttttctaaagatttcactaatggaacttagtttttattagaagaacaactctccctaagaagtacatagtcaacaaataagcatggaatttgtggagttctgtcaggggtggaggtttgatggttggggttaaatggtccaatctgggataaaactttgtggcgcttattttagaagcagttttccagctttgcttctgctaccgtagcttggattgtctgcggactcaaaggtaagggaataacagaactccttaaatgtttcagaagctttgtttttgttttttaaagataaagcagtttttaaaactttcaacccaaaacagctgcttttagttcttgatccctcattagctagaactgttttcaaatagtttcaggcaactaatgatcttatagccatcacaaaaatattttgt

SEQ ID NO: 366047 - DNA, 1435 bp, Homo sapiens
ccgccggcaactccgcccttccggctggccccgctcagtcacccgcagcaggcgtgcagtttcccggctctccgcgcggccggggaaggtcagcgccgtaatggcgttcttggcgtcgggaccctacctgacccatcagcaaaaggtgttgcggctttataagcgggcgctacgccacctcgagtcgtggtgcgtccagagagacaaataccgatactttgcttgtttgatgagagcccggtttgaagaacataagaatgaaaaggatatggcgaaggccacccagctgctgaaggaggccgaggaagaattctggtaccgtcagcatccacagccatacatcttccctgactctcctgggggcacctcctatgagagatacgattgctacaaggtcccagaatggtgcttagatgactggcatccttctgagaaggcaatgtatcctgattactttgccaagagagaacagtggaagaaactgcggagggaaagctgggaacgagaggttaagcagctgcaggaggaaacgccacctggtggtcctttaactgaagctttgccccctgcccgaaaggaaggtgatttgcccccactgtggtggtatattgtgaccagaccccgggagcggcccatgtagaaagagagagacctcatctttcatgcttgcaagtgaaatatgttacagaacatgcacttgccctaataaaaaatcagtgaaatggtctctggtatgactgacgttcttctaagaattactgtgatgccaagtgactgtgccactgtcattgttttatcaatcgtgcatgtaaagaaaatgacaggacatgtagtcagtcagctgtgttctctgcaataaatcactgatagcatatgttaccagtaaggaaaaactgaggcagaaccagattgaggcgaacaaactctcaagtcaaaggcctaattagctgtggtaactagaaggaataaacaaagccaagaacagaaatactgaggatttaaaaataacctttttggttttctaaagatttcactaatggaacttagtttttattagaagaacaactctccctaagaagtacatagtcaacaaataagcatggaatttgtggagttctgtcaggggtggaggtttgatggttggggttaaatggtccaatctgggataaaactttgtggcgcttattttagaagcagttttccagctttgcttctgctaccgtagcttggattgtctgcggactcaaaggtaagggaataacagaactccttaaatgtttcagaagctttgtttttgttttttaaagataaagcagtttttaaaactttcaacccaaaacagctgcttttagttcttgatccctcattagctagaactgttttcaaatagtttcaggcaactaatgatcttatagccatcacaaaaatattttgt

SEQ ID NO: 366048 - DNA, 803 bp, Homo sapiens
ccgccggcaactccgcccttccggctggccccgctcagtcacccgcagcaggcgtgcagtttcccggctctccgcgcggccggggaaggtcagcgccgtaatggcgttcttggcgtcgggaccctacctgacccatcagcaaaaggtgttgcggctttataagcgggcgctacgccacctcgagtcgtggtgcgtccagagagacaaataccgatactttgcttgtttgatgagagcccggtttgaagaacataagaatgaaaaggatatggcgaaggccacccagctgctgaaggaggccgaggaagaattctggtaccgtcagcatccacagccatacatcttccctgactctcctgggggcacctcctatgagagatacgattgctacaaggtcccagaatggtgcttagatgactggcatccttctgagaaggcaatgtatcctgattactttgccaagagagaacagtggaagaaactgcggagggaaagctgggaacgagaggttaagcagctgcaggaggaaacgccacctggtggtcctttaactgaagctttgccccctgcccgaaaggaaggtgatttgcccccactgtggtggtatattgtgaccagaccccgggagcggcccatgtagaaagagagagacctcatctttcatgcttgcaagtgaaatatgttacagaacatgcacttgccctaataaaaaatcagtgaaatggtaacaaaaaaaaaaaaaaaaaaaaaaacccggggcataaacggggcggaaaaggtaaaaagcatgtccaatgttcgcc

SEQ ID NO: 366049 - DNA, 881 bp, Homo sapiens
ccgccggcaactccgcccttccggctggccccgctcagtcacccgcagcaggcgtgcagtttcccggctctccgcgcggccggggaaggtcagcgccgtaatggcgttcttggcgtcgggaccctacctgacccatcagcaaaaggtgttgcggctttataagcgggcgctacgccacctcgagtcgtggtgcgtccagagagacaaataccgatactttgcttgtttgatgagagcccggtttgaagaacataagaatgaaaaggatatggcgaaggccacccagctgctgaaggaggccgaggaagaattctggtaccgtcagcatccacagccatacatcttccctgactctcctgggggcacctcctatgagagatacgattgctacaaggtcccagaatggtgcttagatgactggcatccttctgagaaggcaatgtatcctgattactttgccaagagagaacagtggaagaaactgcggagggaaagctgggaacgagaggttaagcagctgcaggaggaaacgccacctggtggtcctttaactgaagctttgccccctgcccgaaaggaaggtgatttgcccccactgtggtggtatattgtgaccagaccccgggagcggcccatgtagaaagagagagacctcatctttcatgcttgcaagtgaaatatgttacagaacatgcacttgccctaataaaaaatcagtgaaatggtcaaaaacaaaaaaggaaaaaaaaatggggggcgccggcccgaaatttctaaccatgtgggggggggccgaggtaggaatgcctaggggtcaggaacggctgacaggtggttcccaaaaaaccggggcgggttgaaacagggcggtcggctaaggc

SEQ ID NO: 366050 - DNA, 782 bp, Homo sapiens
ccgccggcaactccgcccttccggctggccccgctcagtcacccgcagcaggcgtgcagtttcccggctctccgcgcggccggggaaggtcagcgccgtaatggcgttcttggcgtcgggaccctacctgacccatcagcaaaaggtgttgcggctttataagcgggcgctacgccacctcgagtcgtggtgcgtccagagagacaaataccgatactttgcttgtttgatgagagcccggtttgaagaacataagaatgaaaaggatatggcgaaggccacccagctgctgaaggaggccgaggaagaattctggtaccgtcagcatccacagccatacatcttccctgactctcctgggggcacctcctatgagagatacgattgctacaaggtcccagaatggtgcttagatgactggcatccttctgagaaggcaatgtatcctgattactttgccaagagagaacagtggaagaaactgcggagggaaagctgggaacgagaggttaagcagctgcaggaggaaacgccacctggtggtcctttaactgaagctttgccccctgcccgaaaggaaggtgatttgcccccactgtggtggtatattgtgaccagaccccgggagcggcccatgtagaaagagagagacctcatctttcatgcttgcaagtgaaatatgttacagaacatgctggtgctgccgctggcgcatgtgggttgtatgccggtggccataagcccgagtgagaggagaagcagttgtcttcggttcacggtga

SEQ ID NO: 366051 - DNA, 680 bp, Homo sapiens
ccgccggcaactccgcccttccggctggccccgctcagtcacccgcagcaggcgtgcagtttcccggctctccgcgcggccggggaaggtcagcgccgtaatggcgttcttggcgtcgggaccctacctgacccatcagcaaaaggtgttgcggctttataagcgggcgctacgccacctcgagtcgtggtgcgtccagaggaacataagaatgaaaaggatatggcgaaggccacccagctgctgaaggaggccgaggaagaattctggtaccgtcagcatccacagccatacatcttccctgactctcctgggggcacctcctatgagagatacgattgctacaaggtcccagaatggtgcttagatgactggcatccttctgagaaggcaatgtatcctgattactttgccaagagagaacagtggaagaaactgcggagggaaagctgggaacgagaggttaagcagctgcaggaggaaacgccacctggtggtcctttaactgaagctttgccccctgcccgaaaggaaggtgatttgcccccactgtggtggtatattgtgaccagaccccgggagcggcccatgtagaaagagagagacctcatctttcatgcttgcaagtgaaatatgttacagaacatgcacttgccctaataaaaaatcagtgaaatggt

SEQ ID NO: 366052 - DNA, 664 bp, Homo sapiens
ccgccggcaactccgcccttccggctggccccgctcagtcacccgcagcaggcgtgcagtttcccggctctccgcgcggccggggaaggtcagcgccgtaatggcgttcttggcgtcgggaccctacctgacccatcagcaaaaggtgttgcggctttataagcgggcgctacgccacctcgagtcgtggtgcgtccagagagacaaataccgatactttgcttgtttgatgagagcccggtttgaaattctggtaccgtcagcatccacagccatacatcttccctgactctcctgggggcacctcctatgagagatacgattgctacaaggtcccagaatggtgcttagatgactggcatccttctgagaaggcaatgtatcctgattactttgccaagagagaacagtggaagaaactgcggagggaaagctgggaacgagaggttaagcagctgcaggaggaaacgccacctggtggtcctttaactgaagctttgccccctgcccgaaaggaaggtgatttgcccccactgtggtggtatattgtgaccagaccccgggagcggcccatgtagaaagagagagacctcatctttcatgcttgcaagtgaaatatgttacagaacatgcacttgccctaataaaaaatcagtgaaatggt

SEQ ID NO: 366053 - DNA, 699 bp, Homo sapiens
  misc_feature (527)..(527): n is a, c, g, or t
ccgccggcaactccgcccttccggctggccccgctcagtcacccgcagcaggcgtgcagtttcccggctctccgcgcggccggggaaggtcagcgccgtaatggcgttcttggcgtcgggaccctacctgacccatcagcaaaaggtgttgcggctttataagcgggcgctacgccacctcgagtcgtggtgcgtccagagagacaaataccgatactttgcttgtttgatgagagcccggtttgaagaacataagaatgaaaaggatatggcgaaggccacccagctgctgaaggaggccgaggaagaattctggtaccgtcagcatccacagccatacatcttccctgactctcctgggggcacctcctatgagagatacgattgctacaaggtcccagaatggtgcttagatgactggcatccttctgagaaggcaatgtatcctgattactttgccaagagagaacagtggaagaaactgcggagggaaagctgggaacgagagtaagcagccgcaggagganacgctgcatagtgatcccctatactcaagctttgacccctgcagcgtcgacctggtatattaatcgcccgatgaagatgccgttttcgaagcccccatcgctggcctttttggacaggtggtgtgtggtggccctggtatcgaaaacgcatcttcattcggggacgcccgag

SEQ ID NO: 366054 - DNA, 1321 bp, Homo sapiens
ccgccggcaactccgcccttccggctggccccgctcagtcacccgcagcaggcgtgcagtttcccggctctccgcgcggccggggaaggtcagcgccgtaatggcgttcttggcgtcgggaccctacctgacccatcagcaaaaggtgttgcggctttataagcgggcgctacgccacctcgagtcgtggtgcgtccagagagacaaataccgatactttgcttgtttgatgagagcccggtttgaagaacataagaatgaaaaggatatggcgaaggccacccagctgctgaaggaggccgaggaagaattctggtaccgtcagcatccacagccatacatcttccctgactctcctgggggcacctcctatgagagatacgattgctacaaggttaagcagctgcaggaggaaacgccacctggtggtcctttaactgaagctttgccccctgcccgaaaggaaggtgatttgcccccactgtggtggtatattgtgaccagaccccgggagcggcccatgtagaaagagagagacctcatctttcatgcttgcaagtgaaatatgttacagaacatgcacttgccctaataaaaaatcagtgaaatggtctctggtatgactgacgttcttctaagaattactgtgatgccaagtgactgtgccactgtcattgttttatcaatcgtgcatgtaaagaaaatgacaggacatgtagtcagtcagctgtgttctctgcaataaatcactgatagcatatgttaccagtaaggaaaaactgaggcagaaccagattgaggcgaacaaactctcaagtcaaaggcctaattagctgtggtaactagaaggaataaacaaagccaagaacagaaatactgaggatttaaaaataacctttttggttttctaaagatttcactaatggaacttagtttttattagaagaacaactctccctaagaagtacatagtcaacaaataagcatggaatttgtggagttctgtcaggggtggaggtttgatggttggggttaaatggtccaatctgggataaaactttgtggcgcttattttagaagcagttttccagctttgcttctgctaccgtagcttggattgtctgcggactcaaaggtaagggaataacagaactccttaaatgtttcagaagctttgtttttgttttttaaagataaagcagtttttaaaactttcaacccaaaacagctgcttttagttcttgatccctcattagctagaactgttttcaaatagtttcaggcaactaatgatcttatagccatcacaaaaatattttgt

SEQ ID NO: 366055 - DNA, 352 bp, Homo sapiens
ctgtcagacagcaacactgaccacgtgagtaggtaacatttctaatcttcaaaatcattttggtttaagagacaaataccgatactttgcttgtttgatgagagcccggtttgaagaacataagaatgaaaaggatatggcgaaggccacccagctgctgaaggaggccgaggaagaattctggtaccgtcagcatccacagccatacatcttccctgactctcctgggggcacctcctatgagagatacgattgctacaaggtaggtgagaattatgatgactgccttctgagaaatagactttgtttcttcagtcccacacctcagcctcagaaatcacttgcccttcaa

SEQ ID NO: 366056 - DNA, 726 bp, Homo sapiens
ccgccggcaactccgcccttccggctggccccgctcagtcacccgcagcaggcgtgcagtttcccggctctccgcgcggccggggaaggtcagcgccgtaatggcgttcttggcgtcgggaccctacctgacccatcagcaaaaggtgttgcggctttataagcgggcgctacgccacctcgagtcgtggtgcgtccagagagacaaataccgatactttgcttgtttgatgagagcccggtttgaagaacataagaatgaaaaggatatggcgaaggccacccagctgctgaaggaggccgaggaagaattctggtaccgtcagcatccacagccatacatcttccctgactctcctgggggcacctcctatgagagatacgattgctacaaggtcccagaatggtgcttagatgactggcatccttctgagaaggcaatgtatcctgattactttgccaagagagaacagtggaagaaactgcggagggaaagctgggaacgagaggttaagcagctgcaggaggaaacgccacctggtggtcctttaactgaagctttgccccctgcccgaaaggaaggtgatttgcccccactgtggtggtatattgtgaccagaccccgggagcggcccatgtagaaagagagagacctcatctttcatgcttgcaagtgaaatatgttacagaacatgcacttgccctaataaaaaatcagtgaaatggt

SEQ ID NO: 366057 - DNA, 645 bp, Homo sapiens
  misc_feature (107)..(107): n is a, c, g, or t
ccacgcgtcgcggacgcgtgggtcggacgcgtgggtggatgatttcctgggcgattgtggtcggataccgggtggctattgccgcgtgctctacgcgtcctcgattngtggtgcgtagagagacaaataccgatactttgcttgtttgatgagagcccggtttgaagaacataagaatgaaaaggatatggcgaaggccacccagctgctgaaggaggccgaggaagaattctggtaccgtcagcatccacagccatacatcttccctgactctcctgggggcacctcctatgagagatacgattgctacaaggtcccagaatggtgcttagatgactggcatccttctgagaaggcaatgtatcctgattactttgccaagagagaacagtggaagaaactgcggagggaaagctgggaacgagaggttaagcagctgcaggaggaaacgccacctggtggtcctttaactgaagctttgccccctgcccgaaaggaaggtgatttgcccccactgtggtggtatattgtgaccagaccccgggagcggcccatgtagaaagagagagacctcatctttcatgcttgcaagtgaaatatgttacagaacatgcacttgccctaataaaaaatcagtgaaatggt

SEQ ID NO: 366058 - DNA, 1040 bp, Homo sapiens
ccgccggcaactccgcccttccggctggccccgctcagtcacccgcagcaggcgtgcagtttcccggctctccgcgcggccggggaaggtcagcgccgtaatggcgttcttggcgtcgggaccctacctgacccatcagcaaaaggtgttgcggctttataagcgggcgctacgccacctcgagtcgtggtgcgtccagagagacaaataccgatactttgcttgtttgatgagagcccggtttgaagaacataagaatgaaaaggatatggcgaaggccacccagctgctgaaggaggccgaggaagaattctggtaccgtcagcatccacagccatacatcttccctgactctcctgggggcacctcctatgagagatacgattgctacaaggtcccagaatggtgcttagatgactggcatccttctgagaaggcaatgtatcctgattactttgccaagagagaacagtggaagaaactgcggagggaaagctgggaacgagaggttaagcagctgcaggaggaaacgccacctggtggtcctttaactgaagctttgccccctgcccgaaaggaaggtgatttgcccccactgtggtggtatattgtgaccagaccccgggagcggcccatgtagaaagagagagacctcatctttcatgcttgcaagtgaaatatgttacagaacatgcacttgccctaataaaaaatcagtgaaatggtaacaaaaaaaaaaaaaaaaaaaaaaaaaaaaaaaaaaaaaaaaaaaacgaagaaagaacacacaccgggggggggaacaagagggcgacaggagggcgcgcggcggcggcacggggctccagacacgcgcagcgcgcacaaccgtcagcgcgcagaacacaacgcgaggagaacaacaccgacgcggcaacactccccccggaaatgcccaccaccagtgataacacgcagccaaagaaaccgagccccatacaccaagacatcaccacaactgtccgcacaagccgcacaagagaacgaaccaccatcccccc

SEQ ID NO: 366059 - DNA, 673 bp, Homo sapiens
ccgccggcaactccgcccttccggctggccccgctcagtcacccgcagcaggcgtgcagtttcccggctctccgcgcggccggggaaggtcagcgccgtaatggcgttcttggcgtcgggaccctacctgacccatcagcaaaaggtgttgcggctttataagcgggcgctacgccacctcgagtcgtggtgcgtccagagagacaaataccgatactttgcttgtttgatgagagcccggtttgaagaacataagaatgaaaaggatatggcgaaggccacccagctgctgaaggaggccgaggaagaattctggtaccgtcagcatccacagccatacatcttccctgactctcctgggggcacctcctatgagagatacgattgctacaaggtcccagaatggtgcttagatgactggcatccttctgagaaggcaatgtatcctgattactttgccaagagagaacagtggaagaaactgcggagggaaagctgggaacgagaggttaagcagctgcaggaggaaacgccacctggtggtcctttaactgaagctttgccccctgcccgaaaggaaggtgatttgcccccactgtggtggtatattgtgaccagaccccgggagcggcccatgtactcaggtagcgaccacagggatactctagagcgc

SEQ ID NO: 366060 - DNA, 508 bp, Homo sapiens
tgtattggtggtgctctctcttggcaatgtatcctgattactttgccaagagagaacagtggaagaaactgctgaaggaggccgaggaagaattctggtaccgtcagcatccacagccatacatcttccctgactctcctgggggcacctcctatgagagatacgattgctacaaggtcccagaatggtgcttagatgactggcatccttctgagaaggcaatgtatcctgattactttgccaagagagaacagtggaagaaactgcggagggaaagctgggaacgagaggttaagcagctgcaggaggaaacgccacctggtggtcctttaactgaagctttgccccctgcccgaaaggaaggtgatttgcccccactgtggtggtatattgtgaccagaccccgggagcggcccatgtagaaagagagagacctcatctttcatgcttgcaagtgaaatatgttacagaacatgcacttgccctaataaaaaatcagtgaaatggt

SEQ ID NO: 366061 - DNA, 508 bp, Homo sapiens
caacacagtgaaatccagtctctactaaaaatacaaaaattagttgggcatggtggcaggtgcctgtaatcccagctcttgggatgctgagattctggtaccgtcagcatccacagccatacatcttccctgactctcctgggggcacctcctatgagagatacgattgctacaaggtcccagaatggtgcttagatgactggcatccttctgagaaggcaatgtatcctgattactttgccaagagagaacagtggaagaaactgcggagggaaagctgggaacgagaggttaagcagctgcaggaggaaacgccacctggtggtcctttaactgaagctttgccccctgcccgaaaggaaggtgatttgcccccactgtggtggtatattgtgaccagaccccgggagcggcccatgtagaaagagagagacctcatctttcatgcttgcaagtgaaatatgttacagaacatgcacttgccctaataaaaaatcagtgaaatggt

SEQ ID NO: 366062 - DNA, 495 bp, Homo sapiens
ccgccggcaactccgcccttccggctggccccgctcagtcacccgcagcaggcgtgcagtttcccggctctccgcgcggccggggaaggtcagcgccgtaatggcgttcttggcgtcgggaccctacctgacccatcagcaaaaggtgttgcggctttataagcgggcgctacgccacctcgagtcgtggtgcgtccagagagacaaataccgatactttgcttgtttgatgagagcccggtttgaaaaactgcggagggaaagctgggaacgagaggttaagcagctgcaggaggaaacgccacctggtggtcctttaactgaagctttgccccctgcccgaaaggaaggtgatttgcccccactgtggtggtatattgtgaccagaccccgggagcggcccatgtagaaagagagagacctcatctttcatgcttgcaagtgaaatatgttacagaacatgcacttgccctaataaaaaatcagtgaaatggt

SEQ ID NO: 366063 - DNA, 752 bp, Homo sapiens
ggacttcgggccctctgtgagcctctgtccgccaaggcgatggagctgtgtttggagtccctcgtctttggcagcggctggggccaaagcccgggcaagaccaacgccttcggcacccggactcaggctccgtcctctctgccagcgtgcggctacaatgactcgacatggcaggccactgccttcagagaaggtgacagagggccatgtctgaaacattctcccacaaccaggaaccctcagcagccgctgaagaggaaaggcagttaaatggaaagacttctgagcaagtggaggaaaagtcacgtgtgacctagggaggggctcccacaggaaggggcaatgcccttgccctgttcacctagcctccaggtggctccccacttgaaatttcagaggatggcagaaacctacttacaaggaaatgaaagagggcacagcaaccttaagaccagagcagcccacgatattttttaatgagggcaaaaatagaagacttgcaaaagacccctgaaaataatgcctggaagctgcgaaacatcagactgacaccgcacaaaagaggtccagctgagcaggagaaaagcttgagaagcatccagaacaatgtaggtggagaggctaagaagaaagaggagcccacatggaatgaataaccaaggtcgggacagaggaaggttcgccagaactgggagggctgaaattggacattgagataaattaaagagtgttctttaaaactgtcaaaactt

SEQ ID NO: 366064 - DNA, 823 bp, Homo sapiens
ggacttcgggccctctgtgagcctctgtccgccaaggcgatggagctgtgtttggagtccctcgtctttggcagcggctggggccaaagcccgggcaagaccaacgccttcggcacccggactcaggctccgtcctctctgccagcgtgcggctacaatgactcgacatggcaggtgggcaagcacagcacgccccaacagacatgctttatttaatatgtactaaaaatacagcaggcctgtgaaacccacaggtgcaattgcttaaaatgaggctaaggtagacgtgtgaatggttaataatgagttgattaaaatattcagaaatcatctactggagacgggcaaactgcaaaatggtagcatgggagcaactgatgttcgagaaagcccaggctccggcaagccgtgggtttgaatttacacatgcgcacataatgggtatgaataaacctttcttcaaaaaaaccagatcaagtcaaggcagttatttgctgtgggcaggtgccaaggctggctgcttcagtccccacgcgagtcgcccccgagcctgcttctgcagcccagcctggaaagtgcaaggcacttggaaaggagccacgcccaacgccctgtaccagcggcctcccggacaccaacagcgtcctctgcgcctgctgcagcttgtcccttagtcctccctggacagagggcgtgaagttggctgcgccaacaggacgcggcccgctcacttcggggctcattgtcctggacacacagtcagggctggacgcctccagcagccccacgcttcaccccaaggtccgcaaacctgacaacttcg

SEQ ID NO: 366065 - DNA, 460 bp, Homo sapiens
agtaggggtcccaagtttttattttcctttcacatttctattttgcttttctatgatctgctgctgtaagcttccctatagcacattcccagttgaaatttcagaggatggcagaaacctacttacaaggaaatgaaagagggcacagcaaccttaagaccagagcagcccacgatattttttaatgagggcaaaaatagaagacttgcaaaagacccctgaaaataatgcctggaagctgcgaaacatcagactgacaccgcacaaaagaggtccagctgagcaggagaaaagcttgagaagcatccagaacaatgtaggtggagaggctaagaagaaagaggagcccacatggaatgaataaccaaggtcgggacagaggaaggttcgccagaactgggagggctgaaattggacattgagataaattaaagagtgttctttaaaactgtcaaaactt

SEQ ID NO: 366066 - DNA, 1061 bp, Homo sapiens
ttcttctgcccctactcccggctgtccgcttcctccccagccccctcctgtgagctctgggagctacagaataaggacactccttggccccaagccagccccagcttgctcgggagcctgggtttccccctccgtccccatcaccgcgagggtctgtgcatgggaatctgctccagaggctccctcaggcgccgcgccgcggggatacgcctttcaccgccccagcaattggagcgctgagtcgaagtcctgattccacgataggcggatgaagccctaacgctgaaattctttcctctaggtctttggcagcggctggggccaaagcccgggcaagaccaacgccttcggcacccggactcaggctccgtcctctctgccagcgtgcggctacaatgactcgacatggcaggtgggcaagcacagcacgccccaacagacatgctttatttaatatgtactaaaaatacagcaggcctgtgaaacccacaggtgcaattgcttaaaatgaggctaaggtagacgtgtgaatggttaataatgagttgattaaaatattcagaaatcatctactggagacgggcaaactgcaaaatggtagcatgggagcaactgatgttcgagaaagcccaggctccggcaagccgtgggtttgaatttacacatgcgcacataatgggtatgaataaacctttcttcaaaaaaaccagatcaagtcaaggcagttatttgctgtgggcaggtgccaaggctggctgcttcagtccccacgcgagtcgcccccgagcctgcttctgcagcccagcctggaaagtgcaaggcacttggaaaggagccacgcccaacgccctgtaccagcggcctcccggacaccaacagcgtcctctgcgcctgctgcagcttgtcccttagtcctccctggacagagggcgtgaagttggctgcgccaacaggacgcggcccgctcacttcggggctcattgtcctggacacacagtcagggctggacgcctccagcagccccacgcttcaccccaaggtccgcaaacctgacaacttcg

SEQ ID NO: 366067 - DNA, 811 bp, Homo sapiens
gggagagggaatgagtgtgagctcgtgagtgggcgccgccgccaccgcccccgccgccgtcgtctcggtagcagccttcgccacgccggggtcttcagctccactggggccatgtcagagcgagaagagcggcggtttgtggagatccctcgggagtctgtccggctcatggcggagagcacgggcctggagctgagcgatgaggtggcggcgctgctcgcagaggacgtgtgctatcgtctgagagaggccacgcagaatagctctcagttcatgaagcacaccaaacgccggaagctgacggttgaggacttcaacagggccctcagatggagcagcgtggaggctgtgtgtggttacggatcacaggaggcactgcccatgcgccccgccagggagggtgaactctactttcctgaggatcgagaggtgaacctggtggagctggccctggctaccaacatccccaaaggctgtgctgagacagctgtcagagttcatgtctcctacctggatggcaaagggaacctggcacctcaaggatcgggtaaggggtgatgtaggaaacaggctctttggatgaattttctcccttaggttctgagggtggtgcctatgtgcccccgagtctgcgtctaacatgtgtttacccatgcctgccttgtgccatggtctgagtgggcgctgggctctgcatggagggctcagagttggagatgggggcccagacctgtaactagtcataatgcagcatgttggatgctaagacagaagtctgggcagcatgctggggcggtgtttcacccccagg

SEQ ID NO: 366068 - DNA, 249 bp, Homo sapiens
gtctttgagactgtttatttcctcgttactattgtggtggtaaaaaaaataaaatatgcttattaaacgtgtgttaaaacaatacacacctactcgcaaacgtagcaagagaggttgctttaagaagcgggaatcttcagcgtcacgtgaccgccggtctctacagtctgttcacactggccaatcaagagccaggaagcctcctggagggccggaaactttccaaggcgcccgccgactggctgtatt

SEQ ID NO: 366069 - DNA, 2513 bp, Homo sapiens
gggagagggaatgagtgtgagctcgtgagtgggcgccgccgccaccgcccccgccgccgtcgtctcggtagcagccttcgccacgccggggtcttcagctccactggggccatgtcagagcgagaagagcggcggtttgtggagatccctcgggagtctgtccggctcatggcggagagcacgggcctggagctgagcgatgaggtggcggcgctgctcgcagaggacgtgtgctatcgtctgagagaggccacgcagaatagctctcagttcatgaagcacaccaaacgccggaagctgacggttgaggacttcaacagggccctcagatggagcagcgtggaggctgtgtgtggttacggatcacaggaggcactgcccatgcgccccgccagggagggtgaactctactttcctgaggatcgagaggtgaacctggtggagctggccctggctaccaacatccccaaaggctgtgctgagacagctgtcagagttcatgtctcctacctggatggcaaagggaacctggcacctcaaggatcggtgcccagtgctgtgtcttcactgacagatgaccttctcaagtactatcaccaggtgactcgtgctgtgctaggggatgatccgcaactgatgaaggttgcactccaggacttgcagacgaactccaagattggggcactcctgccttactttgtttatgtggtcagtggggtgaaatctgtaagccatgacctggagcaactgcaccggctgctgcaggtggcacggagcctatttcgtaatccgcacctgtgcttggggccctatgtccgctgtctggtgggcagtgtcctctactgtgtcctggagccactggctgcctccatcaaccccctgaatgaccactggactctgcgggatggggctgccctcctgctcagccacatcttctggtagccactgggcctaaacctgcgggtgggattgctgcagagccaagtgggttggggtaaggaaatggggcgaagcctctggctttgagagtctatgagaagatggggaaccttttccctaggagcgtcctagctggtgtgctgtgacacactgggattctgaaaatggattacaaatacgccaaggtattggttcttcagccctcaggtcctaggccagtcacccctggcagccttcttcacttaaccccagcactcccgagtgtgctgtacagatgctattctctttgtgttgtcttgtgccctgttgggtggcaccatgcctcattcccctccctaactgaatggtgctcccacaggactcatggggaccttgtaagtggcctctatcagcatatcctgctatccctgcagaagatcctggcagatcctgtgcggccgctctgctgccactatggagccgtggtggggctgcatgctcttggctggaaggcagtagaacgagtcctgtacccacacctgtccacctactggacaaacttgcaggctgtgctggatgattattcagtatctaatgcccaggtcaaagcagatggacacaaagtctatggagccattctggtgagtaccgtccccttccagcctcccttccctgcatgagcttagcagccaagcaggcttactttggaatatttgatgggcccaggttcctcgaattttttgcctatcttagtccttggctcttacaggtggcggtagagcgactgctgaagatgaaggcccaggcagcagagcccaacaggggtggcccaggtggcagggggtgccggcgcctggacgacctgccatgggacagccttctctttcaagagtcgtcctccgggggcggtgcagaacccagctttgggtccggcctcccgctgccgccagggggcgcggggccggaggacccttctctttcggtgaccctggccgacatctaccgggagctctacgccttcttcggtgacagcttggccacacgctttggcaccggccagcctgcacccacggctccgcggccgcccggggacaagaaggagccggcggcagccccggactcggtgcggaagatgccgcagctgacggcaagcgccatagtcagcccgcacggcgacgagagcccccggggcagcggcggaggcggccccgcgtcggcctctgggcccgccgcctctgagagcaggcccttgccgcgcgtgcatcgggcgcgcggggcaccccggcagcagggccccgggaccggcacccgcgacgttttccagaagagccgtttcgccccgcgcggcgccccgcactttcgtttcatcatagccgggcggcaggctgggaggcgctgccgcgggcgccttttccagactgccttccccgcgccgtacgggcctagcccggcctcgcgctacgtgcagaaactgcccatgatcggccgtaccagccgccccgcccgccggtgggcgctctcggactactcgctgtacttgccgctctgagtcagtggccccttcgttccttgtaaataaatcccgcccccggaaa

SEQ ID NO: 366070 - DNA, 2073 bp, Homo sapiens
catcaatatggtgacctcccgggagcgggggaccaccaggttgcctaaggaggggtgaaccggcccaggtcggaaacggagcaggtcaaaactcccgtgctgatcagtgcccagtgctgtgtcttcactgacagatgaccttctcaagtactatcaccaggtgactcgtgctgtgctaggggatgatccgcaactgatgaaggttgcactccaggacttgcagacgaactccaagattggggcactcctgccttactttgtttatgtggtcagtggggtgaaatctgtaagccatgacctggagcaactgcaccggctgctgcaggtggcacggagcctatttcgtaatccgcacctgtgcttggggccctatgtccgctgtctggtgggcagtgtcctctactgtgtcctggagccactggctgcctccatcaaccccctgaatgaccactggactctgcgggatggggctgccctcctgctcagccacatcttctggtagccactgggcctaaacctgcgggtgggattgctgcagagccaagtgggttggggtaaggaaatggggcgaagcctctggctttgagagtctatgagaagatggggaaccttttccctaggagcgtcctagctggtgtgctgtgacacactgggattctgaaaatggattacaaatacgccaaggtattggttcttcagccctcaggtcctaggccagtcacccctggcagccttcttcacttaaccccagcactcccgagtgtgctgtacagatgctattctctttgtgttgtcttgtgccctgttgggtggcaccatgcctcattcccctccctaactgaatggtgctcccacaggactcatggggaccttgtaagtggcctctatcagcatatcctgctatccctgcagaagatcctggcagatcctgtgcggccgctctgctgccactatggagccgtggtggggctgcatgctcttggctggaaggcagtagaacgagtcctgtacccacacctgtccacctactggacaaacttgcaggctgtgctggatgattattcagtatctaatgcccaggtcaaagcagatggacacaaagtctatggagccattctggtgagtaccgtccccttccagcctcccttccctgcatgagcttagcagccaagcaggcttactttggaatatttgatgggcccaggttcctcgaattttttgcctatcttagtccttggctcttacaggtggcggtagagcgactgctgaagatgaaggcccaggcagcagagcccaacaggggtggcccaggtggcagggggtgccggcgcctggacgacctgccatgggacagccttctctttcaagagtcgtcctccgggggcggtgcagaacccagctttgggtccggcctcccgctgccgccagggggcgcggggccggaggacccttctctttcggtgaccctggccgacatctaccgggagctctacgccttcttcggtgacagcttggccacacgctttggcaccggccagcctgcacccacggctccgcggccgcccggggacaagaaggagccggcggcagccccggactcggtgcggaagatgccgcagctgacggcaagcgccatagtcagcccgcacggcgacgagagcccccggggcagcggcggaggcggccccgcgtcggcctctgggcccgccgcctctgagagcaggcccttgccgcgcgtgcatcgggcgcgcggggcaccccggcagcagggccccgggaccggcacccgcgacgttttccagaagagccgtttcgccccgcgcggcgccccgcactttcgtttcatcatagccgggcggcaggctgggaggcgctgccgcgggcgccttttccagactgccttccccgcgccgtacgggcctagcccggcctcgcgctacgtgcagaaactgcccatgatcggccgtaccagccgccccgcccgccggtgggcgctctcggactactcgctgtacttgccgctctgagtcagtggccccttcgttccttgtaaataaatcccgcccccggaaa

SEQ ID NO: 366071 - DNA, 2148 bp, Homo sapiens
tgtgcagagcctagatggtcagggctgagcaggctctaagagcagtctcttgccctggttgtcctgtcagaaaggcttcttgtggatgtgtgtggggatggtggttgagggggaggaggctggagaggccaggagagggccagctctccacctgtccctgcttcctgcctgtcctctggcagtgcccagtgctgtgtcttcactgacagatgaccttctcaagtactatcaccaggtgactcgtgctgtgctaggggatgatccgcaactgatgaaggttgcactccaggacttgcagacgaactccaagattggggcactcctgccttactttgtttatgtggtcagtggggtgaaatctgtaagccatgacctggagcaactgcaccggctgctgcaggtggcacggagcctatttcgtaatccgcacctgtgcttggggccctatgtccgctgtctggtgggcagtgtcctctactgtgtcctggagccactggctgcctccatcaaccccctgaatgaccactggactctgcgggatggggctgccctcctgctcagccacatcttctggtagccactgggcctaaacctgcgggtgggattgctgcagagccaagtgggttggggtaaggaaatggggcgaagcctctggctttgagagtctatgagaagatggggaaccttttccctaggagcgtcctagctggtgtgctgtgacacactgggattctgaaaatggattacaaatacgccaaggtattggttcttcagccctcaggtcctaggccagtcacccctggcagccttcttcacttaaccccagcactcccgagtgtgctgtacagatgctattctctttgtgttgtcttgtgccctgttgggtggcaccatgcctcattcccctccctaactgaatggtgctcccacaggactcatggggaccttgtaagtggcctctatcagcatatcctgctatccctgcagaagatcctggcagatcctgtgcggccgctctgctgccactatggagccgtggtggggctgcatgctcttggctggaaggcagtagaacgagtcctgtacccacacctgtccacctactggacaaacttgcaggctgtgctggatgattattcagtatctaatgcccaggtcaaagcagatggacacaaagtctatggagccattctggtgagtaccgtccccttccagcctcccttccctgcatgagcttagcagccaagcaggcttactttggaatatttgatgggcccaggttcctcgaattttttgcctatcttagtccttggctcttacaggtggcggtagagcgactgctgaagatgaaggcccaggcagcagagcccaacaggggtggcccaggtggcagggggtgccggcgcctggacgacctgccatgggacagccttctctttcaagagtcgtcctccgggggcggtgcagaacccagctttgggtccggcctcccgctgccgccagggggcgcggggccggaggacccttctctttcggtgaccctggccgacatctaccgggagctctacgccttcttcggtgacagcttggccacacgctttggcaccggccagcctgcacccacggctccgcggccgcccggggacaagaaggagccggcggcagccccggactcggtgcggaagatgccgcagctgacggcaagcgccatagtcagcccgcacggcgacgagagcccccggggcagcggcggaggcggccccgcgtcggcctctgggcccgccgcctctgagagcaggcccttgccgcgcgtgcatcgggcgcgcggggcaccccggcagcagggccccgggaccggcacccgcgacgttttccagaagagccgtttcgccccgcgcggcgccccgcactttcgtttcatcatagccgggcggcaggctgggaggcgctgccgcgggcgccttttccagactgccttccccgcgccgtacgggcctagcccggcctcgcgctacgtgcagaaactgcccatgatcggccgtaccagccgccccgcccgccggtgggcgctctcggactactcgctgtacttgccgctctgagtcagtggccccttcgttccttgtaaataaatcccgcccccggaaa

SEQ ID NO: 366072 - DNA, 2041 bp, Homo sapiens
aatgagtttctgtaggttacatttatagaaatagaattgctagatcaaagaatatgaacattaaaattgtaaaacatgaataaggtgatacactgtcttccagaagaataccgcattcatgttttacaattttctggtggatccaatgcagtctgggcccttccttttaggttgcactccaggacttgcagacgaactccaagattggggcactcctgccttactttgtttatgtggtcagtggggtgaaatctgtaagccatgacctggagcaactgcaccggctgctgcaggtggcacggagcctatttcgtaatccgcacctgtgcttggggccctatgtccgctgtctggtgggcagtgtcctctactgtgtcctggagccactggctgcctccatcaaccccctgaatgaccactggactctgcgggatggggctgccctcctgctcagccacatcttctggtagccactgggcctaaacctgcgggtgggattgctgcagagccaagtgggttggggtaaggaaatggggcgaagcctctggctttgagagtctatgagaagatggggaaccttttccctaggagcgtcctagctggtgtgctgtgacacactgggattctgaaaatggattacaaatacgccaaggtattggttcttcagccctcaggtcctaggccagtcacccctggcagccttcttcacttaaccccagcactcccgagtgtgctgtacagatgctattctctttgtgttgtcttgtgccctgttgggtggcaccatgcctcattcccctccctaactgaatggtgctcccacaggactcatggggaccttgtaagtggcctctatcagcatatcctgctatccctgcagaagatcctggcagatcctgtgcggccgctctgctgccactatggagccgtggtggggctgcatgctcttggctggaaggcagtagaacgagtcctgtacccacacctgtccacctactggacaaacttgcaggctgtgctggatgattattcagtatctaatgcccaggtcaaagcagatggacacaaagtctatggagccattctggtgagtaccgtccccttccagcctcccttccctgcatgagcttagcagccaagcaggcttactttggaatatttgatgggcccaggttcctcgaattttttgcctatcttagtccttggctcttacaggtggcggtagagcgactgctgaagatgaaggcccaggcagcagagcccaacaggggtggcccaggtggcagggggtgccggcgcctggacgacctgccatgggacagccttctctttcaagagtcgtcctccgggggcggtgcagaacccagctttgggtccggcctcccgctgccgccagggggcgcggggccggaggacccttctctttcggtgaccctggccgacatctaccgggagctctacgccttcttcggtgacagcttggccacacgctttggcaccggccagcctgcacccacggctccgcggccgcccggggacaagaaggagccggcggcagccccggactcggtgcggaagatgccgcagctgacggcaagcgccatagtcagcccgcacggcgacgagagcccccggggcagcggcggaggcggccccgcgtcggcctctgggcccgccgcctctgagagcaggcccttgccgcgcgtgcatcgggcgcgcggggcaccccggcagcagggccccgggaccggcacccgcgacgttttccagaagagccgtttcgccccgcgcggcgccccgcactttcgtttcatcatagccgggcggcaggctgggaggcgctgccgcgggcgccttttccagactgccttccccgcgccgtacgggcctagcccggcctcgcgctacgtgcagaaactgcccatgatcggccgtaccagccgccccgcccgccggtgggcgctctcggactactcgctgtacttgccgctctgagtcagtggccccttcgttccttgtaaataaatcccgcccccggaaa

SEQ ID NO: 366073 - DNA, 1789 bp, Homo sapiens
tgtgcagagcctagatggtcagggctgagcaggctctaagagcagtctcttgccctggttgtcctgtcagaaaggcttcttgtggatgtgtgtggggatggtggttgagggggaggaggctggagaggccaggagagggccagctctccacctgtccctgcttcctgcctgtcctctggcagtgcccagtgctgtgtcttcactgacagatgaccttctcaagtactatcaccaggtgactcgtgctgtgctaggggatgatccgcaactgatgaaggttgcactccaggacttgcagacgaactccaagattggggcactcctgccttactttgtttatgtggtcagtggggtgaaatctgtaagccatgacctggagcaactgcaccggctgctgcaggtggcacggagcctatttcgtaatccgcacctgtgcttggggccctatgtccgctgtctggtgggcagtgtcctctactgtgtcctggagccactggctgcctccatcaaccccctgaatgaccactggactctgcgggatggggctgccctcctgctcagccacatcttctggactcatggggaccttgtaagtggcctctatcagcatatcctgctatccctgcagaagatcctggcagatcctgtgcggccgctctgctgccactatggagccgtggtggggctgcatgctcttggctggaaggcagtagaacgagtcctgtacccacacctgtccacctactggacaaacttgcaggctgtgctggatgattattcagtatctaatgcccaggtcaaagcagatggacacaaagtctatggagccattctggtgagtaccgtccccttccagcctcccttccctgcatgagcttagcagccaagcaggcttactttggaatatttgatgggcccaggttcctcgaattttttgcctatcttagtccttggctcttacaggtggcggtagagcgactgctgaagatgaaggcccaggcagcagagcccaacaggggtggcccaggtggcagggggtgccggcgcctggacgacctgccatgggacagccttctctttcaagagtcgtcctccgggggcggtgcagaacccagctttgggtccggcctcccgctgccgccagggggcgcggggccggaggacccttctctttcggtgaccctggccgacatctaccgggagctctacgccttcttcggtgacagcttggccacacgctttggcaccggccagcctgcacccacggctccgcggccgcccggggacaagaaggagccggcggcagccccggactcggtgcggaagatgccgcagctgacggcaagcgccatagtcagcccgcacggcgacgagagcccccggggcagcggcggaggcggccccgcgtcggcctctgggcccgccgcctctgagagcaggcccttgccgcgcgtgcatcgggcgcgcggggcaccccggcagcagggccccgggaccggcacccgcgacgttttccagaagagccgtttcgccccgcgcggcgccccgcactttcgtttcatcatagccgggcggcaggctgggaggcgctgccgcgggcgccttttccagactgccttccccgcgccgtacgggcctagcccggcctcgcgctacgtgcagaaactgcccatgatcggccgtaccagccgccccgcccgccggtgggcgctctcggactactcgctgtacttgccgctctgagtcagtggccccttcgttccttgtaaataaatcccgcccccggaaa

SEQ ID NO: 366074 - DNA, 1917 bp, Homo sapiens
gatcccaatggcagccgtggtggggctgcatgctcttggctggaaggttgcactccaggacttgcagacgaactccaagattggggcactcctgccttactttgtttatgtggtcagtggggtgaaatctgtaagccatgacctggagcaactgcaccggctgctgcaggtggcacggagcctatttcgtaatccgcacctgtgcttggggccctatgtccgctgtctggtgggcagtgtcctctactgtgtcctggagccactggctgcctccatcaaccccctgaatgaccactggactctgcgggatggggctgccctcctgctcagccacatcttctggtagccactgggcctaaacctgcgggtgggattgctgcagagccaagtgggttggggtaaggaaatggggcgaagcctctggctttgagagtctatgagaagatggggaaccttttccctaggagcgtcctagctggtgtgctgtgacacactgggattctgaaaatggattacaaatacgccaaggtattggttcttcagccctcaggtcctaggccagtcacccctggcagccttcttcacttaaccccagcactcccgagtgtgctgtacagatgctattctctttgtgttgtcttgtgccctgttgggtggcaccatgcctcattcccctccctaactgaatggtgctcccacaggactcatggggaccttgtaagtggcctctatcagcatatcctgctatccctgcagaagatcctggcagatcctgtgcggccgctctgctgccactatggagccgtggtggggctgcatgctcttggctggaaggcagtagaacgagtcctgtacccacacctgtccacctactggacaaacttgcaggctgtgctggatgattattcagtatctaatgcccaggtcaaagcagatggacacaaagtctatggagccattctggtgagtaccgtccccttccagcctcccttccctgcatgagcttagcagccaagcaggcttactttggaatatttgatgggcccaggttcctcgaattttttgcctatcttagtccttggctcttacaggtggcggtagagcgactgctgaagatgaaggcccaggcagcagagcccaacaggggtggcccaggtggcagggggtgccggcgcctggacgacctgccatgggacagccttctctttcaagagtcgtcctccgggggcggtgcagaacccagctttgggtccggcctcccgctgccgccagggggcgcggggccggaggacccttctctttcggtgaccctggccgacatctaccgggagctctacgccttcttcggtgacagcttggccacacgctttggcaccggccagcctgcacccacggctccgcggccgcccggggacaagaaggagccggcggcagccccggactcggtgcggaagatgccgcagctgacggcaagcgccatagtcagcccgcacggcgacgagagcccccggggcagcggcggaggcggccccgcgtcggcctctgggcccgccgcctctgagagcaggcccttgccgcgcgtgcatcgggcgcgcggggcaccccggcagcagggccccgggaccggcacccgcgacgttttccagaagagccgtttcgccccgcgcggcgccccgcactttcgtttcatcatagccgggcggcaggctgggaggcgctgccgcgggcgccttttccagactgccttccccgcgccgtacgggcctagcccggcctcgcgctacgtgcagaaactgcccatgatcggccgtaccagccgccccgcccgccggtgggcgctctcggactactcgctgtacttgccgctctgagtcagtggccccttcgttccttgtaaataaatcccgcccccggaaa

SEQ ID NO: 366075 - DNA, 1029 bp, Homo sapiens
  misc_feature (336)..(336): n is a, c, g, or t
gggagagggaatgagtgtgagctcgtgagtgggcgccgccgccaccgcccccgccgccgtcgtctcggtagcagccttcgccacgccggggtcttcagctccactggggccatgtcagagcgagaagagcggcggtttgtggagatccctcgggagtctgtccggctcatggcggagagcacgggcctggagctgagcgatgaggtggcggcgctgctcgcagaggacgtgtgctatcgtctgagagaggccacgcagaatagctctcagttcatgaagcacaccaaacgccggaagctgacggttgagaaccatgtcagagcgagaagagcggcngtttgtggagatccctcgggagtctgtccggcctcccgctgccgccagggggcgcggggccggaggacccttctctttcggtgaccctggccgacatctaccgggagctctacgccttcttcggtgacagcttggccacacgctttggcaccggccagcctgcacccacggctccgcggccgcccggggacaagaaggagccggcggcagccccggactcggtgcggaagatgccgcagctgacggcaagcgccatagtcagcccgcacggcgacgagagcccccggggcagcggcggaggcggccccgcgtcggcctctgggcccgccgcctctgagagcaggcccttgccgcgcgtgcatcgggcgcgcggggcaccccggcagcagggccccgggaccggcacccgcgacgttttccagaagagccgtttcgccccgcgcggcgccccgcactttcgtttcatcatagccgggcggcaggctgggaggcgctgccgcgggcgccttttccagactgccttccccgcgccgtacgggcctagcccggcctcgcgctacgtgcagaaactgcccatgatcggccgtaccagccgccccgcccgccggtgggcgctctcggactactcgctgtacttgccgctctgagtcagtggccccttcgttccttgtaaataaatcccgcccccggaaa

SEQ ID NO: 366076 - DNA, 447 bp, Homo sapiens
cgctgtctttgagactgtttatttcctcgttactattgtggtggtaaaaaaaataaaatatgcttattaaacgtgtgttaaaacaatacacacctactcgcaaacgtagcaagagaggttgctttaagaagcgggaatcttcagcgtcacgtgaccgccggtctctacagtctgttcacactggccaatcaagagccaggaagcctcctggagggccggaaactttccaaggcgcccgccgactggctgtattggggagggcggggccggggccccgggagagggaatgagtgtgagctcgtgagtgggcgccgccgccaccgcccccgccgccgtcgtctcggtagcagccttcgccacgccggggtcttcaggtgagcaggccttgctctggtccaaggactccccattcccgacgccgactgcttactcaccagtcttggagcc

SEQ ID NO: 366077 - DNA, 2026 bp, Homo sapiens
gggagagggaatgagtgtgagctcgtgagtgggcgccgccgccaccgcccccgccgccgtcgtctcggtagcagccttcgccacgccggggtcttcagctccactggggccatgtcagagcgagaagagcggcggtttgtggagatccctcgggagtctgtccggctcatggcggagagcacgggcctggagctgagcgatgaggtggcggcgctgctcgcagaggacgtgtgctatcgtctgagagaggccacgcagaatagctctcagttcatgaagcacaccaaacgccggaagctgacggttgaggacttcaacagggccctcagatggagcagcgtggaggctgtgtgtggttacggatcacaggaggcactgcccatgcgccccgccagggagggtgaactctactttcctgaggatcgagaggtgaacctggtggagctggccctggctaccaacatccccaaaggctgtgctgagacagctgtcagagttcatgtctcctacctggatggcaaagggaacctggcacctcaaggatcggtgcccagtgctgtgtcttcactgacagatgaccttctcaagtactatcaccaggtgactcgtgctgtgctaggggatgatccgcaactgatgaaggttgcactccaggacttgcagacgaactccaagattggggcactcctgccttactttgtttatgtggtcagtggggtgaaatctgtaagccatgacctggagcaactgcaccggctgctgcaggtggcacggagcctatttcgtaatccgcacctgtgcttggggccctatgtccgctgtctggtgggcagtgtcctctactgtgtcctggagccactggctgcctccatcaaccccctgaatgaccactggactctgcgggatggggctgccctcctgctcagccacatcttctggactcatggggaccttgtaagtggcctctatcagcatatcctgctatccctgcagaagatcctggcagatcctgtgcggccgctctgctgccactatggagccgtggtggggctgcatgctcttggctggaaggcagtagaacgagtcctgtacccacacctgtccacctactggacaaacttgcaggctgtgctggatgattattcagtatctaatgcccaggtcaaagcagatggacacaaagtctatggagccattctggtggcggtagagcgactgctgaagatgaaggcccaggcagcagagcccaacaggggtggcccaggtggcagggggtgccggcgcctggacgacctgccatgggacagccttctctttcaagagtcgtcctccgggggcggtgcagaacccagctttgggtccggcctcccgctgccgccagggggcgcggggccggaggacccttctctttcggtgaccctggccgacatctaccgggagctctacgccttcttcggtgacagcttggccacacgctttggcaccggccagcctgcacccacggctccgcggccgcccggggacaagaaggagccggcggcagccccggactcggtgcggaagatgccgcagctgacggcaagcgccatagtcagcccgcacggcgacgagagcccccggggcagcggcggaggcggccccgcgtcggcctctgggcccgccgcctctgagagcaggcccttgccgcgcgtgcatcgggcgcgcggggcaccccggcagcagggccccgggaccggcacccgcgacgttttccagaagagccgtttcgccccgcgcggcgccccgcactttcgtttcatcatagccgggcggcaggctgggaggcgctgccgcgggcgccttttccagactgccttccccgcgccgtacgggcctagcccggcctcgcgctacgtgcagaaactgcccatgatcggccgtaccagccgccccgcccgccggtgggcgctctcggactactcgctgtacttgccgctctgagtcagtggccccttcgttccttgtaaataaatcccgcccccggaaa

SEQ ID NO: 366078 - DNA, 2154 bp, Homo sapiens
gggagagggaatgagtgtgagctcgtgagtgggcgccgccgccaccgcccccgccgccgtcgtctcggtagcagccttcgccacgccggggtcttcagctccactggggccatgtcagagcgagaagagcggcggtttgtggagatccctcgggagtctgtccggctcatggcggagagcacgggcctggagctgagcgatgaggtggcggcgctgctcgcagaggacgtgtgctatcgtctgagagaggccacgcagaatagctctcagttcatgaagcacaccaaacgccggaagctgacggttgaggacttcaacagggccctcagatggagcagcgtggaggctgtgtgtggttacggatcacaggaggcactgcccatgcgccccgccagggagggtgaactctactttcctgaggatcgagaggtgaacctggtggagctggccctggctaccaacatccccaaaggctgtgctgagacagctgtcagagttcatgtctcctacctggatggcaaagggaacctggcacctcaaggatcggtgcccagtgctgtgtcttcactgacagatgaccttctcaagtactatcaccaggtgactcgtgctgtgctaggggatgatccgcaactgatgaaggttgcactccaggacttgcagacgaactccaagattggggcactcctgccttactttgtttatgtggtcagtggggtgaaatctgtaagccatgacctggagcaactgcaccggctgctgcaggtggcacggagcctatttcgtaatccgcacctgtgcttggggccctatgtccgctgtctggtgggcagtgtcctctactgtgtcctggagccactggctgcctccatcaaccccctgaatgaccactggactctgcgggatggggctgccctcctgctcagccacatcttctggactcatggggaccttgtaagtggcctctatcagcatatcctgctatccctgcagaagatcctggcagatcctgtgcggccgctctgctgccactatggagccgtggtggggctgcatgctcttggctggaaggcagtagaacgagtcctgtacccacacctgtccacctactggacaaacttgcaggctgtgctggatgattattcagtatctaatgcccaggtcaaagcagatggacacaaagtctatggagccattctggtgagtaccgtccccttccagcctcccttccctgcatgagcttagcagccaagcaggcttactttggaatatttgatgggcccaggttcctcgaattttttgcctatcttagtccttggctcttacaggtggcggtagagcgactgctgaagatgaaggcccaggcagcagagcccaacaggggtggcccaggtggcagggggtgccggcgcctggacgacctgccatgggacagccttctctttcaagagtcgtcctccgggggcggtgcagaacccagctttgggtccggcctcccgctgccgccagggggcgcggggccggaggacccttctctttcggtgaccctggccgacatctaccgggagctctacgccttcttcggtgacagcttggccacacgctttggcaccggccagcctgcacccacggctccgcggccgcccggggacaagaaggagccggcggcagccccggactcggtgcggaagatgccgcagctgacggcaagcgccatagtcagcccgcacggcgacgagagcccccggggcagcggcggaggcggccccgcgtcggcctctgggcccgccgcctctgagagcaggcccttgccgcgcgtgcatcgggcgcgcggggcaccccggcagcagggccccgggaccggcacccgcgacgttttccagaagagccgtttcgccccgcgcggcgccccgcactttcgtttcatcatagccgggcggcaggctgggaggcgctgccgcgggcgccttttccagactgccttccccgcgccgtacgggcctagcccggcctcgcgctacgtgcagaaactgcccatgatcggccgtaccagccgccccgcccgccggtgggcgctctcggactactcgctgtacttgccgctctgagtcagtggccccttcgttccttgtaaataaatcccgcccccggaaa

SEQ ID NO: 366079 - DNA, 1682 bp, Homo sapiens
aatgagtttctgtaggttacatttatagaaatagaattgctagatcaaagaatatgaacattaaaattgtaaaacatgaataaggtgatacactgtcttccagaagaataccgcattcatgttttacaattttctggtggatccaatgcagtctgggcccttccttttaggttgcactccaggacttgcagacgaactccaagattggggcactcctgccttactttgtttatgtggtcagtggggtgaaatctgtaagccatgacctggagcaactgcaccggctgctgcaggtggcacggagcctatttcgtaatccgcacctgtgcttggggccctatgtccgctgtctggtgggcagtgtcctctactgtgtcctggagccactggctgcctccatcaaccccctgaatgaccactggactctgcgggatggggctgccctcctgctcagccacatcttctggactcatggggaccttgtaagtggcctctatcagcatatcctgctatccctgcagaagatcctggcagatcctgtgcggccgctctgctgccactatggagccgtggtggggctgcatgctcttggctggaaggcagtagaacgagtcctgtacccacacctgtccacctactggacaaacttgcaggctgtgctggatgattattcagtatctaatgcccaggtcaaagcagatggacacaaagtctatggagccattctggtgagtaccgtccccttccagcctcccttccctgcatgagcttagcagccaagcaggcttactttggaatatttgatgggcccaggttcctcgaattttttgcctatcttagtccttggctcttacaggtggcggtagagcgactgctgaagatgaaggcccaggcagcagagcccaacaggggtggcccaggtggcagggggtgccggcgcctggacgacctgccatgggacagccttctctttcaagagtcgtcctccgggggcggtgcagaacccagctttgggtccggcctcccgctgccgccagggggcgcggggccggaggacccttctctttcggtgaccctggccgacatctaccgggagctctacgccttcttcggtgacagcttggccacacgctttggcaccggccagcctgcacccacggctccgcggccgcccggggacaagaaggagccggcggcagccccggactcggtgcggaagatgccgcagctgacggcaagcgccatagtcagcccgcacggcgacgagagcccccggggcagcggcggaggcggccccgcgtcggcctctgggcccgccgcctctgagagcaggcccttgccgcgcgtgcatcgggcgcgcggggcaccccggcagcagggccccgggaccggcacccgcgacgttttccagaagagccgtttcgccccgcgcggcgccccgcactttcgtttcatcatagccgggcggcaggctgggaggcgctgccgcgggcgccttttccagactgccttccccgcgccgtacgggcctagcccggcctcgcgctacgtgcagaaactgcccatgatcggccgtaccagccgccccgcccgccggtgggcgctctcggactactcgctgtacttgccgctctgagtcagtggccccttcgttccttgtaaataaatcccgcccccggaaa

SEQ ID NO: 366080 - DNA, 5720 bp, Homo sapiens
acgtcagagtttcctgcccaccatctttgtccctggcaaagtgggttttgcgcagtggcttagacctagaaaagaatcgtgacgggcaggaaaccattacaccaccacctgggctgtgctctccggctcccgccgccacccccgccctcgccttcgcctccgcctccggtgcacattaaagatccaaagtcatgactgactccaagtatttcacaaccaataaaaaaggagaaatatttgaactaaaagctgaactcaacaatgaaaagaaagaaaagagaaaggaggctgtgaagaaagtgattgctgctatgaccgtggggaaggatgttagttctctctttccagacgtagtgaactgtatgcagactgacaatctggaactaaagaagcttgtgtatctctacttgatgaactacgccaagagtcagccagacatggccatcatggctgtaaacagctttgtgaaggactgtgaagatcctaatcctttgattcgagccttggcagtcagaaccatggggtgcatccgggtagacaaaattacagaatatctctgtgagccgctccgcaagtgcttgaaggatgaggatccctatgttcggaaaacagcagcagtctgcgtggcaaaactccatgatatcaatgcccaaatggtggaagatcagggatttctggattctctacgggatctcatagcagattcaaatccaatggtggtggctaatgccgtagcggcattatctgaaatcagtgagtctcacccaaacagcaacttacttgatctgaacccacagaacattaataagctgctgacagccctgaatgaatgcactgaatggggccagattttcatcctggactgcctgtctaattacaaccctaaagatgatcgggaggctcagagcatctgtgagcgggtaactccccggctatcccatgccaactcagcagtggtgctttcagcggtaaaagtcctaatgaagtttctagaattgttacctaaggattctgactactacaatatgctgctgaagaagttagcccctccacttgtcactttgctgtctggggagccagaagtgcagtatgtcgccctgaggaacatcaacttaattgtccagaaaaggcctgaaatcttgaagcaggaaatcaaagtcttctttgtgaagtacaatgatcccatctatgttaaactagagaagttggacatcatgattcgtttggcatctcaagccaacattgctcaggttctggcagaactgaaagaatatgctacagaggtggatgttgactttgttcgaaaagctgtgcgggccattggacggtgtgccatcaaggtggagcaatctgcagagcgctgtgtaagcacattgcttgatctaatccagaccaaagtgaattatgtggtccaagaagcaattgttgtcatcagggacatcttccgcaaataccccaacaagtatgaaagtatcatcgccactctgtgtgagaacttagactcgctggatgagccagatgctcgagcagctatgatttggattgtgggagaatatgctgaaagaattgacaatgcagatgagttactagaaagcttcctggagggttttcacgatgaaagcacccaggtgcagctcactctgcttactgccatagtgaagctgtttctcaagaaaccatcagaaacacaggagctagtccagcaggtcttgagtttggcaacacaggattctgataatcctgaccttcgagaccggggctatatttattggcgccttctctcaactgaccctgttacagctaaagaagtagtcttgtctgagaagccactgatctctgaggagacggaccttattgagccaactctgctggatgagctaatctgccacattggttctttggcctctgtgtatcataagcctcccaatgcttttgtggaaggaagtcatggaattcatcgtaaacacttgccaattcatcatgggagcactgatgcaggtgacagccctgttggcactaccactgcaacgaacctggaacagcctcaggttatcccctctcaaggtgatcttctaggggatcttttaaaccttgacctcggtcccccagtcaatgtgccacaggtgtcctccatgcagatgggagcagtggatctcctaggaggaggactagatagtctggtgggacaatccttcatcccatcatcggtgcctgcaacctttgctccttcacctacacctgctgtggtcagcagtggactgaatgacctgtttgaactctccacagggataggcatggcacctggtggatatgtggctcctaaggctgtctggctacctgcagtaaaggctaaaggcttggagatttccggaacatttactcaccgccaagggcacatctatatggaaatgaacttcaccaataaagctctgcagcacatgacagattttgcaatccagtttaacaaaaatagctttggtgtcatccccagcactcctctggccatccatacaccactgatgccaaaccagagcattgatgtctccctgcctctcaataccttgggcccagtcatgaagatggaacctctgaataacctccaggtggctgtgaaaaacaatatcgatgtcttctacttcagctgcctcatcccactcaatgtgctttttgtagaagatggcaaaatggagcgccaggtcttccttgcaacatggaaggatattcccaatgaaaatgaacttcagtttcagattaaggaatgtcatttaaatgctgacactgtttccagcaagttgcaaaacaacaatgtttatactattgccaagaggaatgtggaagggcaggacatgctgtaccaatccctgaagctcactaatggcatttggattttggccgaactacgtatccagccaggaaaccccaattacacgctgtcactgaagtgtagagctcctgaagtctctcaatacatctatcaggtctacgacagcattttgaaaaactaacaagactggtccagtacccttcaaccatgctgtgatcggtgcaagtcaagaactcttaactggaagaaattgtattgctgcgtagaatctgaacacactgaggccacctagcaaggtagtaactagtctaacctgtgctaacattagggcacaacctgttggatagttttagcttcctgtgaacatttgtaaccactgcttcagtcacctcccacctcttgccacctgctgctgctatctgtccttacttgtgggcttctccatgctgtgccaatggctggctttttctacaccctcttttgagtgtagtttggtattttgtaattgagagctcatttcaaaagcagaaaaagacaacaaatattaaagcaaggaaaagtgtaactgaaacactgcactttactgttttatacttttgtacatatgagaaatcaagggattagtgcaaccagtagaaagcattgaaatgactgtcattaaccacacagtcctggaggcagagatgcagttacctaccctagcttttgatgggttctcttacctgtagtagccttatccctggtcatttggattttcagtttgcttttttctttttttcccctccaaactccttttccttggccaagccttcatgcttccccctttccatattataatctcatttgattgctctgcagttgggaacggtgatcttcttgaatgatgtttcagtgtgcaaaaactatagagcctgtcagcaccaaagctgacagaagttataccttactcctttcctttcccctgaacaaacctgctaatcccactaattcaggaatttgagtagagatggggaacaagaacccagatgctgtcccctcaccccctctcctgtatttctcaggtccagttcaaatctaaaattctacttttagagttgaaacagagtaataacttatctaaccctcttttcctacaaaggagaaagataaaaggcacaaaggttaccgccaaggcccgtcagctgtgtagtggcaaagccgagaccgagtctcctaagtccccgtcagtgtggttttcaccacaggactgtctcttgtcgttttcccctaatgccttctcctgccttttctgtgcctagtttttggctcttcacatattccatattgattttgacgctctgtatattggcatcaggtggcagctgaatatcttttgaattactcgaaggtaaagccagatgccagaatgaaggtgtagccagtgtttcccatatgcccctggagccccacttattgaggccagcagaataggtgcagagatgaagtgagcttagagatgttgcaaatgctctttatcccttcagctctctgatctgctctttcttcatgatacttagtctgcagggcatattaagatcatcccagaggttcaggcagttcctgtcatctctgaaaagactgggggatatgaaatcttccccctaccccacttaatgcgttggatatgatttttcaaagaatgcttcatgcccaaaataccagcctgtttagcagtgttacactgtttgatctgcgggcacttgttgcattgcctggcacccaatattcagggtccatgactaagactggtcttctcagatgccctgcttaaatcaggggcacttcaggctccacaggcgtcatgttggactgagacctaactcactggactcagaggaggaatcgtggaaaacaagagcaaaactaccccacacccctatttcatgtctgaaataaccctgtttcataccagttgcaaagcttgtggggagcggtcccacaaagcactttcttaaaccttgagaatctccaagagaaaaatatttggggaaggagggaggaaatatgtcccttgcacaccacccctgaagcacatggcagtagggaaacagcataggattgtatgtgggaggtggataggtcggtgatgtgtggagcggaaaagcaggttggtaaagttcccttcttgggacttattcctggagtcagtggatacaagtagtgcagaaggttcacactgcaaatagtgttctcatctcaaagcaaactatcattccagaaggaaaagtgtgtcagggcaagcagacaacacaatttcctatcagaatatgtccctcaacccccgaaacaaggcttctctcagcctccccaccagtgatggataacagctcctattctcagctgacctgactgagccaacccatgaactcttcactccttggggaagccacctcccatcacacccctgagcagagttagggaggaattctacttcccataaaaggacctctcctgagaggcaaaacctgttgcctccaccacggcttccctcttggctcattccaagcttggccaaattggggaagtgggatggaggttgccctgcatcccccctcctctgcctgagtgtgtctttgtaatgtcagctggcatcatacaaagagcaggagaagcaaacacccagaactcttttgctggtcagagattccctgagtgtctgtcctcacccaagcctgctctgtgtctgtgttgtgaagcttgagactctggaaagaaatggggagggggggcaggggaaatgttgccctaagaatgcttctcattcctctgttcttattgggtcctgtttttcgggagggtgggggttgggggaagcttgaccttgtgtcttcgtcaataaactcacatttacacaaaa

SEQ ID NO: 366081 - DNA, 426 bp, Homo sapiens
ggcggttgcctttagggtgtgtccctaattgacggggtcggggacggagagaagggtaacaccaggctgggtcggagaccggcggaggcgaggaaatcctaagagcgtgaccgttgatgatgcagggaaccgtcgggtgtgaccattgagagggaaaaggtgcacattaaagatccaaagtcatgactgactccaagtatttcacaaccaataaaaaaggagaaatatttgaactaaaagctgaactcaacaatgaaaagaaagaaaagagaaaggaggctgtgaagaaagtgattgctgctatgaccgtggggaaggatgttaggtgctgctcttctgaggtgaatttttgttatttttcttttgtttgttagcacataaagcacatttggtttttaaattgctgtcctgtgaccatctatctaa

SEQ ID NO: 366082 - DNA, 5753 bp, Homo sapiens
ggcggttgcctttagggtgtgtccctaattgacggggtcggggacggagagaagggtaacaccaggctgggtcggagaccggcggaggcgaggaaatcctaagagcgtgaccgttgatgatgcagggaaccgtcgggtgtgaccattgagagggaaaaggtgcacattaaagatccaaagtcatgactgactccaagtatttcacaaccaataaaaaaggagaaatatttgaactaaaagctgaactcaacaatgaaaagaaagaaaagagaaaggaggctgtgaagaaagtgattgctgctatgaccgtggggaaggatgttagttctctctttccagacgtagtgaactgtatgcagactgacaatctggaactaaagaagcttgtgtatctctacttgatgaactacgccaagagtcagccagacatggccatcatggctgtaaacagctttgtgaaggactgtgaagatcctaatcctttgattcgagccttggcagtcagaaccatggggtgcatccgggtagacaaaattacagaatatctctgtgagccgctccgcaagtgcttgaaggatgaggatccctatgttcggaaaacagcagcagtctgcgtggcaaaactccatgatatcaatgcccaaatggtggaagatcagggatttctggattctctacgggatctcatagcagattcaaatccaatggtggtggctaatgccgtagcggcattatctgaaatcagtgagtctcacccaaacagcaacttacttgatctgaacccacagaacattaataagctgctgacagccctgaatgaatgcactgaatggggccagattttcatcctggactgcctgtctaattacaaccctaaagatgatcgggaggctcagagcatctgtgagcgggtaactccccggctatcccatgccaactcagcagtggtgctttcagcggtaaaagtcctaatgaagtttctagaattgttacctaaggattctgactactacaatatgctgctgaagaagttagcccctccacttgtcactttgctgtctggggagccagaagtgcagtatgtcgccctgaggaacatcaacttaattgtccagaaaaggcctgaaatcttgaagcaggaaatcaaagtcttctttgtgaagtacaatgatcccatctatgttaaactagagaagttggacatcatgattcgtttggcatctcaagccaacattgctcaggttctggcagaactgaaagaatatgctacagaggtggatgttgactttgttcgaaaagctgtgcgggccattggacggtgtgccatcaaggtggagcaatctgcagagcgctgtgtaagcacattgcttgatctaatccagaccaaagtgaattatgtggtccaagaagcaattgttgtcatcagggacatcttccgcaaataccccaacaagtatgaaagtatcatcgccactctgtgtgagaacttagactcgctggatgagccagatgctcgagcagctatgatttggattgtgggagaatatgctgaaagaattgacaatgcagatgagttactagaaagcttcctggagggttttcacgatgaaagcacccaggtgcagctcactctgcttactgccatagtgaagctgtttctcaagaaaccatcagaaacacaggagctagtccagcaggtcttgagtttggcaacacaggattctgataatcctgaccttcgagaccggggctatatttattggcgccttctctcaactgaccctgttacagctaaagaagtagtcttgtctgagaagccactgatctctgaggagacggaccttattgagccaactctgctggatgagctaatctgccacattggttctttggcctctgtgtatcataagcctcccaatgcttttgtggaaggaagtcatggaattcatcgtaaacacttgccaattcatcatgggagcactgatgcaggtgacagccctgttggcactaccactgcaacgaacctggaacagcctcaggttatcccctctcaaggtgatcttctaggggatcttttaaaccttgacctcggtcccccagtcaatgtgccacaggtgtcctccatgcagatgggagcagtggatctcctaggaggaggactagatagtctgcttggcagtgaccttggcgggggcattggaggaagtccggcagtgggacaatccttcatcccatcatcggtgcctgcaacctttgctccttcacctacacctgctgtggtcagcagtggactgaatgacctgtttgaactctccacagggataggcatggcacctggtggatatgtggctcctaaggctgtctggctacctgcagtaaaggctaaaggcttggagatttccggaacatttactcaccgccaagggcacatctatatggaaatgaacttcaccaataaagctctgcagcacatgacagattttgcaatccagtttaacaaaaatagctttggtgtcatccccagcactcctctggccatccatacaccactgatgccaaaccagagcattgatgtctccctgcctctcaataccttgggcccagtcatgaagatggaacctctgaataacctccaggtggctgtgaaaaacaatatcgatgtcttctacttcagctgcctcatcccactcaatgtgctttttgtagaagatggcaaaatggagcgccaggtcttccttgcaacatggaaggatattcccaatgaaaatgaacttcagtttcagattaaggaatgtcatttaaatgctgacactgtttccagcaagttgcaaaacaacaatgtttatactattgccaagaggaatgtggaagggcaggacatgctgtaccaatccctgaagctcactaatggcatttggattttggccgaactacgtatccagccaggaaaccccaattacacgctgtcactgaagtgtagagctcctgaagtctctcaatacatctatcaggtctacgacagcattttgaaaaactaacaagactggtccagtacccttcaaccatgctgtgatcggtgcaagtcaagaactcttaactggaagaaattgtattgctgcgtagaatctgaacacactgaggccacctagcaaggtagtaactagtctaacctgtgctaacattagggcacaacctgttggatagttttagcttcctgtgaacatttgtaaccactgcttcagtcacctcccacctcttgccacctgctgctgctatctgtccttacttgtgggcttctccatgctgtgccaatggctggctttttctacaccctcttttgagtgtagtttggtattttgtaattgagagctcatttcaaaagcagaaaaagacaacaaatattaaagcaaggaaaagtgtaactgaaacactgcactttactgttttatacttttgtacatatgagaaatcaagggattagtgcaaccagtagaaagcattgaaatgactgtcattaaccacacagtcctggaggcagagatgcagttacctaccctagcttttgatgggttctcttacctgtagtagccttatccctggtcatttggattttcagtttgcttttttctttttttcccctccaaactccttttccttggccaagccttcatgcttccccctttccatattataatctcatttgattgctctgcagttgggaacggtgatcttcttgaatgatgtttcagtgtgcaaaaactatagagcctgtcagcaccaaagctgacagaagttataccttactcctttcctttcccctgaacaaacctgctaatcccactaattcaggaatttgagtagagatggggaacaagaacccagatgctgtcccctcaccccctctcctgtatttctcaggtccagttcaaatctaaaattctacttttagagttgaaacagagtaataacttatctaaccctcttttcctacaaaggagaaagataaaaggcacaaaggttaccgccaaggcccgtcagctgtgtagtggcaaagccgagaccgagtctcctaagtccccgtcagtgtggttttcaccacaggactgtctcttgtcgttttcccctaatgccttctcctgccttttctgtgcctagtttttggctcttcacatattccatattgattttgacgctctgtatattggcatcaggtggcagctgaatatcttttgaattactcgaaggtaaagccagatgccagaatgaaggtgtagccagtgtttcccatatgcccctggagccccacttattgaggccagcagaataggtgcagagatgaagtgagcttagagatgttgcaaatgctctttatcccttcagctctctgatctgctctttcttcatgatacttagtctgcagggcatattaagatcatcccagaggttcaggcagttcctgtcatctctgaaaagactgggggatatgaaatcttccccctaccccacttaatgcgttggatatgatttttcaaagaatgcttcatgcccaaaataccagcctgtttagcagtgttacactgtttgatctgcgggcacttgttgcattgcctggcacccaatattcagggtccatgactaagactggtcttctcagatgccctgcttaaatcaggggcacttcaggctccacaggcgtcatgttggactgagacctaactcactggactcagaggaggaatcgtggaaaacaagagcaaaactaccccacacccctatttcatgtctgaaataaccctgtttcataccagttgcaaagcttgtggggagcggtcccacaaagcactttcttaaaccttgagaatctccaagagaaaaatatttggggaaggagggaggaaatatgtcccttgcacaccacccctgaagcacatggcagtagggaaacagcataggattgtatgtgggaggtggataggtcggtgatgtgtggagcggaaaagcaggttggtaaagttcccttcttgggacttattcctggagtcagtggatacaagtagtgcagaaggttcacactgcaaatagtgttctcatctcaaagcaaactatcattccagaaggaaaagtgtgtcagggcaagcagacaacacaatttcctatcagaatatgtccctcaacccccgaaacaaggcttctctcagcctccccaccagtgatggataacagctcctattctcagctgacctgactgagccaacccatgaactcttcactccttggggaagccacctcccatcacacccctgagcagagttagggaggaattctacttcccataaaaggacctctcctgagaggcaaaacctgttgcctccaccacggcttccctcttggctcattccaagcttggccaaattggggaagtgggatggaggttgccctgcatcccccctcctctgcctgagtgtgtctttgtaatgtcagctggcatcatacaaagagcaggagaagcaaacacccagaactcttttgctggtcagagattccctgagtgtctgtcctcacccaagcctgctctgtgtctgtgttgtgaagcttgagactctggaaagaaatggggagggggggcaggggaaatgttgccctaagaatgcttctcattcctctgttcttattgggtcctgtttttcgggagggtgggggttgggggaagcttgaccttgtgtcttcgtcaataaactcacatttacacaaaa

SEQ ID NO: 366083 - DNA, 5617 bp, Homo sapiens
ggaattcttttctcttgctataggtgcacattaaagatccaaagtcatgactgactccaagtatttcacaaccaataaaaaaggagaaatatttgaactaaaagctgaactcaacaatgaaaagaaagaaaagagaaaggaggctgtgaagaaagtgattgctgctatgaccgtggggaaggatgttagttctctctttccagacgtagtgaactgtatgcagactgacaatctggaactaaagaagcttgtgtatctctacttgatgaactacgccaagagtcagccagacatggccatcatggctgtaaacagctttgtgaaggactgtgaagatcctaatcctttgattcgagccttggcagtcagaaccatggggtgcatccgggtagacaaaattacagaatatctctgtgagccgctccgcaagtgcttgaaggatgaggatccctatgttcggaaaacagcagcagtctgcgtggcaaaactccatgatatcaatgcccaaatggtggaagatcagggatttctggattctctacgggatctcatagcagattcaaatccaatggtggtggctaatgccgtagcggcattatctgaaatcagtgagtctcacccaaacagcaacttacttgatctgaacccacagaacattaataagctgctgacagccctgaatgaatgcactgaatggggccagattttcatcctggactgcctgtctaattacaaccctaaagatgatcgggaggctcagagcatctgtgagcgggtaactccccggctatcccatgccaactcagcagtggtgctttcagcggtaaaagtcctaatgaagtttctagaattgttacctaaggattctgactactacaatatgctgctgaagaagttagcccctccacttgtcactttgctgtctggggagccagaagtgcagtatgtcgccctgaggaacatcaacttaattgtccagaaaaggcctgaaatcttgaagcaggaaatcaaagtcttctttgtgaagtacaatgatcccatctatgttaaactagagaagttggacatcatgattcgtttggcatctcaagccaacattgctcaggttctggcagaactgaaagaatatgctacagaggtggatgttgactttgttcgaaaagctgtgcgggccattggacggtgtgccatcaaggtggagcaatctgcagagcgctgtgtaagcacattgcttgatctaatccagaccaaagtgaattatgtggtccaagaagcaattgttgtcatcagggacatcttccgcaaataccccaacaagtatgaaagtatcatcgccactctgtgtgagaacttagactcgctggatgagccagatgctcgagcagctatgatttggattgtgggagaatatgctgaaagaattgacaatgcagatgagttactagaaagcttcctggagggttttcacgatgaaagcacccaggtgcagctcactctgcttactgccatagtgaagctgtttctcaagaaaccatcagaaacacaggagctagtccagcaggtcttgagtttggcaacacaggattctgataatcctgaccttcgagaccggggctatatttattggcgccttctctcaactgaccctgttacagctaaagaagtagtcttgtctgagaagccactgatctctgaggagacggaccttattgagccaactctgctggatgagctaatctgccacattggttctttggcctctgtgtatcataagcctcccaatgcttttgtggaaggaagtcatggaattcatcgtaaacacttgccaattcatcatgggagcactgatgcaggtgacagccctgttggcactaccactgcaacgaacctggaacagcctcaggttatcccctctcaaggtgatcttctaggggatcttttaaaccttgacctcggtcccccagtcaatgtgccacaggtgtcctccatgcagatgggagcagtggatctcctaggaggaggactagatagtctgcttggcagtgaccttggcgggggcattggaggaagtccggcagtgggacaatccttcatcccatcatcggtgcctgcaacctttgctccttcacctacacctgctgtggtcagcagtggactgaatgacctgtttgaactctccacagggataggcatggcacctggtggatatgtggctcctaaggctgtctggctacctgcagtaaaggctaaaggcttggagatttccggaacatttactcaccgccaagggcacatctatatggaaatgaacttcaccaataaagctctgcagcacatgacagattttgcaatccagtttaacaaaaatagctttggtgtcatccccagcactcctctggccatccatacaccactgatgccaaaccagagcattgatgtctccctgcctctcaataccttgggcccagtcatgaagatggaacctctgaataacctccaggtggctgtgaaaaacaatatcgatgtcttctacttcagctgcctcatcccactcaatgtgctttttgtagaagatggcaaaatggagcgccaggtcttccttgcaacatggaaggatattcccaatgaaaatgaacttcagtttcagattaaggaatgtcatttaaatgctgacactgtttccagcaagttgcaaaacaacaatgtttatactattgccaagaggaatgtggaagggcaggacatgctgtaccaatccctgaagctcactaatggcatttggattttggccgaactacgtatccagccaggaaaccccaattacacgctgtcactgaagtgtagagctcctgaagtctctcaatacatctatcaggtctacgacagcattttgaaaaactaacaagactggtccagtacccttcaaccatgctgtgatcggtgcaagtcaagaactcttaactggaagaaattgtattgctgcgtagaatctgaacacactgaggccacctagcaaggtagtaactagtctaacctgtgctaacattagggcacaacctgttggatagttttagcttcctgtgaacatttgtaaccactgcttcagtcacctcccacctcttgccacctgctgctgctatctgtccttacttgtgggcttctccatgctgtgccaatggctggctttttctacaccctcttttgagtgtagtttggtattttgtaattgagagctcatttcaaaagcagaaaaagacaacaaatattaaagcaaggaaaagtgtaactgaaacactgcactttactgttttatacttttgtacatatgagaaatcaagggattagtgcaaccagtagaaagcattgaaatgactgtcattaaccacacagtcctggaggcagagatgcagttacctaccctagcttttgatgggttctcttacctgtagtagccttatccctggtcatttggattttcagtttgcttttttctttttttcccctccaaactccttttccttggccaagccttcatgcttccccctttccatattataatctcatttgattgctctgcagttgggaacggtgatcttcttgaatgatgtttcagtgtgcaaaaactatagagcctgtcagcaccaaagctgacagaagttataccttactcctttcctttcccctgaacaaacctgctaatcccactaattcaggaatttgagtagagatggggaacaagaacccagatgctgtcccctcaccccctctcctgtatttctcaggtccagttcaaatctaaaattctacttttagagttgaaacagagtaataacttatctaaccctcttttcctacaaaggagaaagataaaaggcacaaaggttaccgccaaggcccgtcagctgtgtagtggcaaagccgagaccgagtctcctaagtccccgtcagtgtggttttcaccacaggactgtctcttgtcgttttcccctaatgccttctcctgccttttctgtgcctagtttttggctcttcacatattccatattgattttgacgctctgtatattggcatcaggtggcagctgaatatcttttgaattactcgaaggtaaagccagatgccagaatgaaggtgtagccagtgtttcccatatgcccctggagccccacttattgaggccagcagaataggtgcagagatgaagtgagcttagagatgttgcaaatgctctttatcccttcagctctctgatctgctctttcttcatgatacttagtctgcagggcatattaagatcatcccagaggttcaggcagttcctgtcatctctgaaaagactgggggatatgaaatcttccccctaccccacttaatgcgttggatatgatttttcaaagaatgcttcatgcccaaaataccagcctgtttagcagtgttacactgtttgatctgcgggcacttgttgcattgcctggcacccaatattcagggtccatgactaagactggtcttctcagatgccctgcttaaatcaggggcacttcaggctccacaggcgtcatgttggactgagacctaactcactggactcagaggaggaatcgtggaaaacaagagcaaaactaccccacacccctatttcatgtctgaaataaccctgtttcataccagttgcaaagcttgtggggagcggtcccacaaagcactttcttaaaccttgagaatctccaagagaaaaatatttggggaaggagggaggaaatatgtcccttgcacaccacccctgaagcacatggcagtagggaaacagcataggattgtatgtgggaggtggataggtcggtgatgtgtggagcggaaaagcaggttggtaaagttcccttcttgggacttattcctggagtcagtggatacaagtagtgcagaaggttcacactgcaaatagtgttctcatctcaaagcaaactatcattccagaaggaaaagtgtgtcagggcaagcagacaacacaatttcctatcagaatatgtccctcaacccccgaaacaaggcttctctcagcctccccaccagtgatggataacagctcctattctcagctgacctgactgagccaacccatgaactcttcactccttggggaagccacctcccatcacacccctgagcagagttagggaggaattctacttcccataaaaggacctctcctgagaggcaaaacctgttgcctccaccacggcttccctcttggctcattccaagcttggccaaattggggaagtgggatggaggttgccctgcatcccccctcctctgcctgagtgtgtctttgtaatgtcagctggcatcatacaaagagcaggagaagcaaacacccagaactcttttgctggtcagagattccctgagtgtctgtcctcacccaagcctgctctgtgtctgtgttgtgaagcttgagactctggaaagaaatggggagggggggcaggggaaatgttgccctaagaatgcttctcattcctctgttcttattgggtcctgtttttcgggagggtgggggttgggggaagcttgaccttgtgtcttcgtcaataaactcacatttacacaaaa

SEQ ID NO: 366084 - DNA, 6040 bp, Homo sapiens
cagggctgagaacctttgcattcaagagtcaggagacacagtgctaagcccaactttgtcactgactctgtgaactttgagcctcatttcttaatctgtaaagcggagcgtgggtaaatgaggtaatacgcgcctgctccctacctacgtttatgttctcctccagactttaacattctgatggaagatcatccttcatatactgttctctccccattgtagctagatataatgagatttggtttttcccactcttgtggttcttgaagatctggattgcaccttcctctctggccataatttaaaagatttttaaaacttactgatggcttccttgtcagtgagtcaggtaatattctagggctttgaattttatatattctataattttaaaatcttattttagttgctgccctgctatcctggtattggttattacatagtgtagtattctgctctaagtctgtggtactggaaccttaccagtttgctctcatctcttgcaggagaaatatttgaactaaaagctgaactcaacaatgaaaagaaagaaaagagaaaggaggctgtgaagaaagtgattgctgctatgaccgtggggaaggatgttagttctctctttccagacgtagtgaactgtatgcagactgacaatctggaactaaagaagcttgtgtatctctacttgatgaactacgccaagagtcagccagacatggccatcatggctgtaaacagctttgtgaaggactgtgaagatcctaatcctttgattcgagccttggcagtcagaaccatggggtgcatccgggtagacaaaattacagaatatctctgtgagccgctccgcaagtgcttgaaggatgaggatccctatgttcggaaaacagcagcagtctgcgtggcaaaactccatgatatcaatgcccaaatggtggaagatcagggatttctggattctctacgggatctcatagcagattcaaatccaatggtggtggctaatgccgtagcggcattatctgaaatcagtgagtctcacccaaacagcaacttacttgatctgaacccacagaacattaataagctgctgacagccctgaatgaatgcactgaatggggccagattttcatcctggactgcctgtctaattacaaccctaaagatgatcgggaggctcagagcatctgtgagcgggtaactccccggctatcccatgccaactcagcagtggtgctttcagcggtaaaagtcctaatgaagtttctagaattgttacctaaggattctgactactacaatatgctgctgaagaagttagcccctccacttgtcactttgctgtctggggagccagaagtgcagtatgtcgccctgaggaacatcaacttaattgtccagaaaaggcctgaaatcttgaagcaggaaatcaaagtcttctttgtgaagtacaatgatcccatctatgttaaactagagaagttggacatcatgattcgtttggcatctcaagccaacattgctcaggttctggcagaactgaaagaatatgctacagaggtggatgttgactttgttcgaaaagctgtgcgggccattggacggtgtgccatcaaggtggagcaatctgcagagcgctgtgtaagcacattgcttgatctaatccagaccaaagtgaattatgtggtccaagaagcaattgttgtcatcagggacatcttccgcaaataccccaacaagtatgaaagtatcatcgccactctgtgtgagaacttagactcgctggatgagccagatgctcgagcagctatgatttggattgtgggagaatatgctgaaagaattgacaatgcagatgagttactagaaagcttcctggagggttttcacgatgaaagcacccaggtgcagctcactctgcttactgccatagtgaagctgtttctcaagaaaccatcagaaacacaggagctagtccagcaggtcttgagtttggcaacacaggattctgataatcctgaccttcgagaccggggctatatttattggcgccttctctcaactgaccctgttacagctaaagaagtagtcttgtctgagaagccactgatctctgaggagacggaccttattgagccaactctgctggatgagctaatctgccacattggttctttggcctctgtgtatcataagcctcccaatgcttttgtggaaggaagtcatggaattcatcgtaaacacttgccaattcatcatgggagcactgatgcaggtgacagccctgttggcactaccactgcaacgaacctggaacagcctcaggttatcccctctcaaggtgatcttctaggggatcttttaaaccttgacctcggtcccccagtcaatgtgccacaggtgtcctccatgcagatgggagcagtggatctcctaggaggaggactagatagtctgcttggcagtgaccttggcgggggcattggaggaagtccggcagtgggacaatccttcatcccatcatcggtgcctgcaacctttgctccttcacctacacctgctgtggtcagcagtggactgaatgacctgtttgaactctccacagggataggcatggcacctggtggatatgtggctcctaaggctgtctggctacctgcagtaaaggctaaaggcttggagatttccggaacatttactcaccgccaagggcacatctatatggaaatgaacttcaccaataaagctctgcagcacatgacagattttgcaatccagtttaacaaaaatagctttggtgtcatccccagcactcctctggccatccatacaccactgatgccaaaccagagcattgatgtctccctgcctctcaataccttgggcccagtcatgaagatggaacctctgaataacctccaggtggctgtgaaaaacaatatcgatgtcttctacttcagctgcctcatcccactcaatgtgctttttgtagaagatggcaaaatggagcgccaggtcttccttgcaacatggaaggatattcccaatgaaaatgaacttcagtttcagattaaggaatgtcatttaaatgctgacactgtttccagcaagttgcaaaacaacaatgtttatactattgccaagaggaatgtggaagggcaggacatgctgtaccaatccctgaagctcactaatggcatttggattttggccgaactacgtatccagccaggaaaccccaattacacgctgtcactgaagtgtagagctcctgaagtctctcaatacatctatcaggtctacgacagcattttgaaaaactaacaagactggtccagtacccttcaaccatgctgtgatcggtgcaagtcaagaactcttaactggaagaaattgtattgctgcgtagaatctgaacacactgaggccacctagcaaggtagtaactagtctaacctgtgctaacattagggcacaacctgttggatagttttagcttcctgtgaacatttgtaaccactgcttcagtcacctcccacctcttgccacctgctgctgctatctgtccttacttgtgggcttctccatgctgtgccaatggctggctttttctacaccctcttttgagtgtagtttggtattttgtaattgagagctcatttcaaaagcagaaaaagacaacaaatattaaagcaaggaaaagtgtaactgaaacactgcactttactgttttatacttttgtacatatgagaaatcaagggattagtgcaaccagtagaaagcattgaaatgactgtcattaaccacacagtcctggaggcagagatgcagttacctaccctagcttttgatgggttctcttacctgtagtagccttatccctggtcatttggattttcagtttgcttttttctttttttcccctccaaactccttttccttggccaagccttcatgcttccccctttccatattataatctcatttgattgctctgcagttgggaacggtgatcttcttgaatgatgtttcagtgtgcaaaaactatagagcctgtcagcaccaaagctgacagaagttataccttactcctttcctttcccctgaacaaacctgctaatcccactaattcaggaatttgagtagagatggggaacaagaacccagatgctgtcccctcaccccctctcctgtatttctcaggtccagttcaaatctaaaattctacttttagagttgaaacagagtaataacttatctaaccctcttttcctacaaaggagaaagataaaaggcacaaaggttaccgccaaggcccgtcagctgtgtagtggcaaagccgagaccgagtctcctaagtccccgtcagtgtggttttcaccacaggactgtctcttgtcgttttcccctaatgccttctcctgccttttctgtgcctagtttttggctcttcacatattccatattgattttgacgctctgtatattggcatcaggtggcagctgaatatcttttgaattactcgaaggtaaagccagatgccagaatgaaggtgtagccagtgtttcccatatgcccctggagccccacttattgaggccagcagaataggtgcagagatgaagtgagcttagagatgttgcaaatgctctttatcccttcagctctctgatctgctctttcttcatgatacttagtctgcagggcatattaagatcatcccagaggttcaggcagttcctgtcatctctgaaaagactgggggatatgaaatcttccccctaccccacttaatgcgttggatatgatttttcaaagaatgcttcatgcccaaaataccagcctgtttagcagtgttacactgtttgatctgcgggcacttgttgcattgcctggcacccaatattcagggtccatgactaagactggtcttctcagatgccctgcttaaatcaggggcacttcaggctccacaggcgtcatgttggactgagacctaactcactggactcagaggaggaatcgtggaaaacaagagcaaaactaccccacacccctatttcatgtctgaaataaccctgtttcataccagttgcaaagcttgtggggagcggtcccacaaagcactttcttaaaccttgagaatctccaagagaaaaatatttggggaaggagggaggaaatatgtcccttgcacaccacccctgaagcacatggcagtagggaaacagcataggattgtatgtgggaggtggataggtcggtgatgtgtggagcggaaaagcaggttggtaaagttcccttcttgggacttattcctggagtcagtggatacaagtagtgcagaaggttcacactgcaaatagtgttctcatctcaaagcaaactatcattccagaaggaaaagtgtgtcagggcaagcagacaacacaatttcctatcagaatatgtccctcaacccccgaaacaaggcttctctcagcctccccaccagtgatggataacagctcctattctcagctgacctgactgagccaacccatgaactcttcactccttggggaagccacctcccatcacacccctgagcagagttagggaggaattctacttcccataaaaggacctctcctgagaggcaaaacctgttgcctccaccacggcttccctcttggctcattccaagcttggccaaattggggaagtgggatggaggttgccctgcatcccccctcctctgcctgagtgtgtctttgtaatgtcagctggcatcatacaaagagcaggagaagcaaacacccagaactcttttgctggtcagagattccctgagtgtctgtcctcacccaagcctgctctgtgtctgtgttgtgaagcttgagactctggaaagaaatggggagggggggcaggggaaatgttgccctaagaatgcttctcattcctctgttcttattgggtcctgtttttcgggagggtgggggttgggggaagcttgaccttgtgtcttcgtcaataaactcacatttacacaaaa

SEQ ID NO: 366085 - DNA, 5647 bp, Homo sapiens
acgtcagagtttcctgcccaccatctttgtccctggcaaagtgggttttgcgcagtggcttagacctagaaaagaatcgtgacgggcaggaaaccattacaccaccacctgggctgtgctctccggctcccgccgccacccccgccctcgccttcgcctccgcctccggtgcacattaaagatccaaagtcatgactgactccaagtatttcacaaccaataaaaaaggagaaatatttgaactaaaagctgaactcaacaatgaaaagaaagaaaagagaaaggaggctgtgaagaaagtgattgctgctatgaccgtggggaaggatgttagttctctctttccagacgtagtgaactgtatgcagactgacaatctggaactaaagaagcttgtgtatctctacttgatgaactacgccaagagtcagccagacatggccatcatggctgtaaacagctttgtgaaggactgtgaagatcctaatcctttgattcgagccttggcagtcagaaccatggggtgcatccgggtagacaaaattacagaatatctctgtgagccgctccgcaagtgcttgaaggatgaggatccctatgttcggaaaacagcagcagtctgcgtggcaaaactccatgatatcaatgcccaaatggtggaagatcagggatttctggattctctacgggatctcatagcagattcaaatccaatggtggtggctaatgccgtagcggcattatctgaaatcagtgagtctcacccaaacagcaacttacttgatctgaacccacagaacattaataagctgctgacagccctgaatgaatgcactgaatggggccagattttcatcctggactgcctgtctaattacaaccctaaagatgatcgggaggctcagagcatctgtgagcgggtaactccccggctatcccatgccaactcagcagtggtgctttcagcggtaaaagtcctaatgaagtttctagaattgttacctaaggattctgactactacaatatgctgctgaagaagttagcccctccacttgtcactttgctgtctggggagccagaagtgcagtatgtcgccctgaggaacatcaacttaattgtccagaaaaggcctgaaatcttgaagcaggaaatcaaagtcttctttgtgaagtacaatgatcccatctatgttaaactagagaagttggacatcatgattcgtttggcatctcaagccaacattgctcaggttctggcagaactgaaagaatatgctacagaggtggatgttgactttgttcgaaaagctgtgcgggccattggacggtgtgccatcaaggtggagcaatctgcagagcgctgtgtaagcacattgcttgatctaatccagaccaaagtgaattatgtggtccaagaagcaattgttgtcatcagggacatcttccgcaaataccccaacaagtatgaaagtatcatcgccactctgtgtgagaacttagactcgctggatgagccagatgctcgagcagctatgatttggattgtgggagaatatgctgaaagaattgacaatgcagatgagttactagaaagcttcctggagggttttcacgatgaaagcacccaggtgcagctcactctgcttactgccatagtgaagctgtttctcaagaaaccatcagaaacacaggagctagtccagcaggtcttgagtttggcaacacagctaaagaagtagtcttgtctgagaagccactgatctctgaggagacggaccttattgagccaactctgctggatgagctaatctgccacattggttctttggcctctgtgtatcataagcctcccaatgcttttgtggaaggaagtcatggaattcatcgtaaacacttgccaattcatcatgggagcactgatgcaggtgacagccctgttggcactaccactgcaacgaacctggaacagcctcaggttatcccctctcaaggtgatcttctaggggatcttttaaaccttgacctcggtcccccagtcaatgtgccacaggtgtcctccatgcagatgggagcagtggatctcctaggaggaggactagatagtctggtgggacaatccttcatcccatcatcggtgcctgcaacctttgctccttcacctacacctgctgtggtcagcagtggactgaatgacctgtttgaactctccacagggataggcatggcacctggtggatatgtggctcctaaggctgtctggctacctgcagtaaaggctaaaggcttggagatttccggaacatttactcaccgccaagggcacatctatatggaaatgaacttcaccaataaagctctgcagcacatgacagattttgcaatccagtttaacaaaaatagctttggtgtcatccccagcactcctctggccatccatacaccactgatgccaaaccagagcattgatgtctccctgcctctcaataccttgggcccagtcatgaagatggaacctctgaataacctccaggtggctgtgaaaaacaatatcgatgtcttctacttcagctgcctcatcccactcaatgtgctttttgtagaagatggcaaaatggagcgccaggtcttccttgcaacatggaaggatattcccaatgaaaatgaacttcagtttcagattaaggaatgtcatttaaatgctgacactgtttccagcaagttgcaaaacaacaatgtttatactattgccaagaggaatgtggaagggcaggacatgctgtaccaatccctgaagctcactaatggcatttggattttggccgaactacgtatccagccaggaaaccccaattacacgctgtcactgaagtgtagagctcctgaagtctctcaatacatctatcaggtctacgacagcattttgaaaaactaacaagactggtccagtacccttcaaccatgctgtgatcggtgcaagtcaagaactcttaactggaagaaattgtattgctgcgtagaatctgaacacactgaggccacctagcaaggtagtaactagtctaacctgtgctaacattagggcacaacctgttggatagttttagcttcctgtgaacatttgtaaccactgcttcagtcacctcccacctcttgccacctgctgctgctatctgtccttacttgtgggcttctccatgctgtgccaatggctggctttttctacaccctcttttgagtgtagtttggtattttgtaattgagagctcatttcaaaagcagaaaaagacaacaaatattaaagcaaggaaaagtgtaactgaaacactgcactttactgttttatacttttgtacatatgagaaatcaagggattagtgcaaccagtagaaagcattgaaatgactgtcattaaccacacagtcctggaggcagagatgcagttacctaccctagcttttgatgggttctcttacctgtagtagccttatccctggtcatttggattttcagtttgcttttttctttttttcccctccaaactccttttccttggccaagccttcatgcttccccctttccatattataatctcatttgattgctctgcagttgggaacggtgatcttcttgaatgatgtttcagtgtgcaaaaactatagagcctgtcagcaccaaagctgacagaagttataccttactcctttcctttcccctgaacaaacctgctaatcccactaattcaggaatttgagtagagatggggaacaagaacccagatgctgtcccctcaccccctctcctgtatttctcaggtccagttcaaatctaaaattctacttttagagttgaaacagagtaataacttatctaaccctcttttcctacaaaggagaaagataaaaggcacaaaggttaccgccaaggcccgtcagctgtgtagtggcaaagccgagaccgagtctcctaagtccccgtcagtgtggttttcaccacaggactgtctcttgtcgttttcccctaatgccttctcctgccttttctgtgcctagtttttggctcttcacatattccatattgattttgacgctctgtatattggcatcaggtggcagctgaatatcttttgaattactcgaaggtaaagccagatgccagaatgaaggtgtagccagtgtttcccatatgcccctggagccccacttattgaggccagcagaataggtgcagagatgaagtgagcttagagatgttgcaaatgctctttatcccttcagctctctgatctgctctttcttcatgatacttagtctgcagggcatattaagatcatcccagaggttcaggcagttcctgtcatctctgaaaagactgggggatatgaaatcttccccctaccccacttaatgcgttggatatgatttttcaaagaatgcttcatgcccaaaataccagcctgtttagcagtgttacactgtttgatctgcgggcacttgttgcattgcctggcacccaatattcagggtccatgactaagactggtcttctcagatgccctgcttaaatcaggggcacttcaggctccacaggcgtcatgttggactgagacctaactcactggactcagaggaggaatcgtggaaaacaagagcaaaactaccccacacccctatttcatgtctgaaataaccctgtttcataccagttgcaaagcttgtggggagcggtcccacaaagcactttcttaaaccttgagaatctccaagagaaaaatatttggggaaggagggaggaaatatgtcccttgcacaccacccctgaagcacatggcagtagggaaacagcataggattgtatgtgggaggtggataggtcggtgatgtgtggagcggaaaagcaggttggtaaagttcccttcttgggacttattcctggagtcagtggatacaagtagtgcagaaggttcacactgcaaatagtgttctcatctcaaagcaaactatcattccagaaggaaaagtgtgtcagggcaagcagacaacacaatttcctatcagaatatgtccctcaacccccgaaacaaggcttctctcagcctccccaccagtgatggataacagctcctattctcagctgacctgactgagccaacccatgaactcttcactccttggggaagccacctcccatcacacccctgagcagagttagggaggaattctacttcccataaaaggacctctcctgagaggcaaaacctgttgcctccaccacggcttccctcttggctcattccaagcttggccaaattggggaagtgggatggaggttgccctgcatcccccctcctctgcctgagtgtgtctttgtaatgtcagctggcatcatacaaagagcaggagaagcaaacacccagaactcttttgctggtcagagattccctgagtgtctgtcctcacccaagcctgctctgtgtctgtgttgtgaagcttgagactctggaaagaaatggggagggggggcaggggaaatgttgccctaagaatgcttctcattcctctgttcttattgggtcctgtttttcgggagggtgggggttgggggaagcttgaccttgtgtcttcgtcaataaactcacatttacacaaaa

SEQ ID NO: 366086 - DNA, 3601 bp, Homo sapiens
tctcctttctctctttcagcttggcagtgaccttggcgggggcattggaggaagtccggcagtgggacaatccttcatcccatcatcggtgcctgcaacctttgctccttcacctacacctgctgtggtcagcagtggactgaatgacctgtttgaactctccacagggataggcatggcacctggtggatatgtggctcctaaggctgtctggctacctgcagtaaaggctaaaggcttggagatttccggaacatttactcaccgccaagggcacatctatatggaaatgaacttcaccaataaagctctgcagcacatgacagattttgcaatccagtttaacaaaaatagctttggtgtcatccccagcactcctctggccatccatacaccactgatgccaaaccagagcattgatgtctccctgcctctcaataccttgggcccagtcatgaagatggaacctctgaataacctccaggtggctgtgaaaaacaatatcgatgtcttctacttcagctgcctcatcccactcaatgtgctttttgtagaagatggcaaaatggagcgccaggtcttccttgcaacatggaaggatattcccaatgaaaatgaacttcagtttcagattaaggaatgtcatttaaatgctgacactgtttccagcaagttgcaaaacaacaatgtttatactattgccaagaggaatgtggaagggcaggacatgctgtaccaatccctgaagctcactaatggcatttggattttggccgaactacgtatccagccaggaaaccccaattacacgctgtcactgaagtgtagagctcctgaagtctctcaatacatctatcaggtctacgacagcattttgaaaaactaacaagactggtccagtacccttcaaccatgctgtgatcggtgcaagtcaagaactcttaactggaagaaattgtattgctgcgtagaatctgaacacactgaggccacctagcaaggtagtaactagtctaacctgtgctaacattagggcacaacctgttggatagttttagcttcctgtgaacatttgtaaccactgcttcagtcacctcccacctcttgccacctgctgctgctatctgtccttacttgtgggcttctccatgctgtgccaatggctggctttttctacaccctcttttgagtgtagtttggtattttgtaattgagagctcatttcaaaagcagaaaaagacaacaaatattaaagcaaggaaaagtgtaactgaaacactgcactttactgttttatacttttgtacatatgagaaatcaagggattagtgcaaccagtagaaagcattgaaatgactgtcattaaccacacagtcctggaggcagagatgcagttacctaccctagcttttgatgggttctcttacctgtagtagccttatccctggtcatttggattttcagtttgcttttttctttttttcccctccaaactccttttccttggccaagccttcatgcttccccctttccatattataatctcatttgattgctctgcagttgggaacggtgatcttcttgaatgatgtttcagtgtgcaaaaactatagagcctgtcagcaccaaagctgacagaagttataccttactcctttcctttcccctgaacaaacctgctaatcccactaattcaggaatttgagtagagatggggaacaagaacccagatgctgtcccctcaccccctctcctgtatttctcaggtccagttcaaatctaaaattctacttttagagttgaaacagagtaataacttatctaaccctcttttcctacaaaggagaaagataaaaggcacaaaggttaccgccaaggcccgtcagctgtgtagtggcaaagccgagaccgagtctcctaagtccccgtcagtgtggttttcaccacaggactgtctcttgtcgttttcccctaatgccttctcctgccttttctgtgcctagtttttggctcttcacatattccatattgattttgacgctctgtatattggcatcaggtggcagctgaatatcttttgaattactcgaaggtaaagccagatgccagaatgaaggtgtagccagtgtttcccatatgcccctggagccccacttattgaggccagcagaataggtgcagagatgaagtgagcttagagatgttgcaaatgctctttatcccttcagctctctgatctgctctttcttcatgatacttagtctgcagggcatattaagatcatcccagaggttcaggcagttcctgtcatctctgaaaagactgggggatatgaaatcttccccctaccccacttaatgcgttggatatgatttttcaaagaatgcttcatgcccaaaataccagcctgtttagcagtgttacactgtttgatctgcgggcacttgttgcattgcctggcacccaatattcagggtccatgactaagactggtcttctcagatgccctgcttaaatcaggggcacttcaggctccacaggcgtcatgttggactgagacctaactcactggactcagaggaggaatcgtggaaaacaagagcaaaactaccccacacccctatttcatgtctgaaataaccctgtttcataccagttgcaaagcttgtggggagcggtcccacaaagcactttcttaaaccttgagaatctccaagagaaaaatatttggggaaggagggaggaaatatgtcccttgcacaccacccctgaagcacatggcagtagggaaacagcataggattgtatgtgggaggtggataggtcggtgatgtgtggagcggaaaagcaggttggtaaagttcccttcttgggacttattcctggagtcagtggatacaagtagtgcagaaggttcacactgcaaatagtgttctcatctcaaagcaaactatcattccagaaggaaaagtgtgtcagggcaagcagacaacacaatttcctatcagaatatgtccctcaacccccgaaacaaggcttctctcagcctccccaccagtgatggataacagctcctattctcagctgacctgactgagccaacccatgaactcttcactccttggggaagccacctcccatcacacccctgagcagagttagggaggaattctacttcccataaaaggacctctcctgagaggcaaaacctgttgcctccaccacggcttccctcttggctcattccaagcttggccaaattggggaagtgggatggaggttgccctgcatcccccctcctctgcctgagtgtgtctttgtaatgtcagctggcatcatacaaagagcaggagaagcaaacacccagaactcttttgctggtcagagattccctgagtgtctgtcctcacccaagcctgctctgtgtctgtgttgtgaagcttgagactctggaaagaaatggggagggggggcaggggaaatgttgccctaagaatgcttctcattcctctgttcttattgggtcctgtttttcgggagggtgggggttgggggaagcttgaccttgtgtcttcgtcaataaactcacatttacacaaaa

SEQ ID NO: 366087 - DNA, 5708 bp, Homo sapiens
acgtcagagtttcctgcccaccatctttgtccctggcaaagtgggttttgcgcagtggcttagacctagaaaagaatcgtgacgggcaggaaaccattacaccaccacctgggctgtgctctccggctcccgccgccacccccgccctcgccttcgcctccgcctccggtgcacattaaagatccaaagtcatgactgactccaagtatttcacaaccaataaaaaaggagaaatatttgaactaaaagctgaactcaacaatgaaaagaaagaaaagagaaaggaggctgtgaagaaagtgattgctgctatgaccgtggggaaggatgttagttctctctttccagacgtagtgaactgtatgcagactgacaatctggaactaaagaagcttgtgtatctctacttgatgaactacgccaagagtcagccagacatggccatcatggctgtaaacagctttgtgaaggactgtgaagatcctaatcctttgattcgagccttggcagtcagaaccatggggtgcatccgggtagacaaaattacagaatatctctgtgagccgctccgcaagtgcttgaaggatgaggatccctatgttcggaaaacagcagcagtctgcgtggcaaaactccatgatatcaatgcccaaatggtggaagatcagggatttctggattctctacgggatctcatagcagattcaaatccaatggtggtggctaatgccgtagcggcattatctgaaatcagtgagtctcacccaaacagcaacttacttgatctgaacccacagaacattaataagctgctgacagccctgaatgaatgcactgaatggggccagattttcatcctggactgcctgtctaattacaaccctaaagatgatcgggaggctcagagcatctgtgagcgggtaactccccggctatcccatgccaactcagcagtggtgctttcagcggtaaaagtcctaatgaagtttctagaattgttacctaaggattctgactactacaatatgctgctgaagaagttagcccctccacttgtcactttgctgtctggggagccagaagtgcagtatgtcgccctgaggaacatcaacttaattgtccagaaaaggcctgaaatcttgaagcaggaaatcaaagtcttctttgtgaagtacaatgatcccatctatgttaaactagagaagttggacatcatgattcgtttggcatctcaagccaacattgctcaggttctggcagaactgaaagaatatgctacagaggtggatgttgactttgttcgaaaagctgtgcgggccattggacggtgtgccatcaaggtggagcaatctgcagagcgctgtgtaagcacattgcttgatctaatccagaccaaagtgaattatgtggtccaagaagcaattgttgtcatcagggacatcttccgcaaataccccaacaagtatgaaagtatcatcgccactctgtgtgagaacttagactcgctggatgagccagatgctcgagcagctatgatttggattgtgggagaatatgctgaaagaattgacaatgcagatgagttactagaaagcttcctggagggttttcacgatgaaagcacccaggtgcagctcactctgcttactgccatagtgaagctgtttctcaagaaaccatcagaaacacaggagctagtccagcaggtcttgagtttggcaacacaggattctgataatcctgaccttcgagaccggggctatatttattggcgccttctctcaactgaccctgttacagctaaagaagtagtcttgtctgagaagccactgatctctgaggagacggaccttattgagccaactctgctggatgagctaatctgccacattggttctttggcctctgtgtatcataagcctcccaatgcttttgtggaaggaagtcatggaattcatcgtaaacacttgccaattcatcatgggagcactgatgcaggtgacagccctgttggcactaccactgcaacgaacctggaacagcctcaggttatcccctctcaaggtgatcttctaggggatcttttaaaccttgacctcggtcccccagtcaatgtgccacaggtgtcctccatgcagatgggagcagtggatctcctaggaggaggactagatagtctgcttggcagtgaccttggcgggggcattggaggaagtccggcagtgggacaatccttcatcccatcatcggtgcctgcaacctttgctccttcacctacacctgctgtggtcagcagtggactgaatgacctgtttgaactctccacagggataggcatggcacctggtggatatgtggctcctaaggctgtctggctacctgcagtaaaggctaaaggcttggagatttccggaacatttactcaccgccaagggcacatctatatggaaatgaacttcaccaataaagctctgcagcacatgacagattttgcaatccagtttaacaaaaatagctttggtgtcatccccagcactcctctggccatccatacaccactgatgccaaaccagagcattgatgtctccctgcctctcaataccttgggcccagtcatgaagatggaacctctgaataacctccaggtggctgtgaaaaacaatatcgatgtcttctacttcagctgcctcatcccactcaatgtgctttttgtagaagatggcaaaatggagcgccaggtcttccttgcaacatggaaggatattcccaatgaaaatgaacttcagtttcagattaaggaatgtcatttaaatgctgacactgtttccagcaagttgcaaaacaacaatgtttatactattgccaagaggaatgtggaagggcaggacatgctgtaccaatccctgaagctcactaatggcatttggattttggccgaactacgtatccagccaggaaaccccaattacacgctgtcactgaagtgtagagctcctgaagtctctcaatacatctatcaggtctacgacagcattttgaaaaactaacaagactggtccagtacccttcaaccatgctgtgatcggtgcaagtcaagaactcttaactggaagaaattgtattgctgcgtagaatctgaacacactgaggccacctagcaaggtagtaactagtctaacctgtgctaacattagggcacaacctgttggatagttttagcttcctgtgaacatttgtaaccactgcttcagtcacctcccacctcttgccacctgctgctgctatctgtccttacttgtgggcttctccatgctgtgccaatggctggctttttctacaccctcttttgagtgtagtttggtattttgtaattgagagctcatttcaaaagcagaaaaagacaacaaatattaaagcaaggaaaagtgtaactgaaacactgcactttactgttttatacttttgtacatatgagaaatcaagggattagtgcaaccagtagaaagcattgaaatgactgtcattaaccacacagtcctggaggcagagatgcagttacctaccctagcttttgatgggttctcttacctgtagtagccttatccctggtcatttggattttcagtttgcttttttctttttttcccctccaaactccttttccttggccaagccttcatgcttccccctttccatattataatctcatttgattgctctgcagttgggaacggtgatcttcttgaatgatgtttcagtgtgcaaaaactatagagcctgtcagcaccaaagctgacagaagttataccttactcctttcctttcccctgaacaaacctgctaatcccactaattcaggaatttgagtagagatggggaacaagaacccagatgctgtcccctcaccccctctcctgtatttctcaggtccagttcaaatctaaaattctacttttagagttgaaacagagtaataacttatctaaccctcttttcctacaaaggagaaagataaaaggcacaaaggttaccgccaaggcccgtcagctgtgtagtggcaaagccgagaccgagtctcctaagtccccgtcagtgtggttttcaccacaggactgtctcttgtcgttttcccctaatgccttctcctgccttttctgtgcctagtttttggctcttcacatattccatattgattttgacgctctgtatattggcatcaggtggcagctgaatatcttttgaattactcgaaggtaaagccagatgccagaatgaaggtgtagccagtgtttcccatatgcccctggagccccacttattgaggccagcagaataggtgcagagatgaagtgagcttagagatgttgcaaatgctctttatcccttcagctctctgatctgctctttcttcatgatacttagtctgcagggcatattaagatcatcccagaggttcaggcagttcctgtcatctctgaaaagactgggggatatgaaatcttccccctaccccacttaatgcgttggatatgatttttcaaagaatgcttcatgcccaaaataccagcctgtttagcagtgttacactgtttgatctgcgggcacttgttgcattgcctggcacccaatattcagggtccatgactaagactggtcttctcagatgccctgcttaaatcaggggcacttcaggctccacaggcgtcatgttggactgagacctaactcactggactcagaggaggaatcgtggaaaacaagagcaaaactaccccacacccctatttcatgtctgaaataaccctgtttcataccagttgcaaagcttgtggggagcggtcccacaaagcactttcttaaaccttgagaatctccaagagaaaaatatttggggaaggagggaggaaatatgtcccttgcacaccacccctgaagcacatggcagtagggaaacagcataggattgtatgtgggaggtggataggtcggtgatgtgtggagcggaaaagcaggttggtaaagttcccttcttgggacttattcctggagtcagtggatacaagtagtgcagaaggttcacactgcaaatagtgttctcatctcaaagcaaactatcattccagaaggaaaagtgtgtcagggcaagcagacaacacaatttcctatcagaatatgtccctcaacccccgaaacaaggcttctctcagcctccccaccagtgatggataacagctcctattctcagctgacctgactgagccaacccatgaactcttcactccttggggaagccacctcccatcacacccctgagcagagttagggaggaattctacttcccataaaaggacctctcctgagaggcaattggggaagtgggatggaggttgccctgcatcccccctcctctgcctgagtgtgtctttgtaatgtcagctggcatcatacaaagagcaggagaagcaaacacccagaactcttttgctggtcagagattccctgagtgtctgtcctcacccaagcctgctctgtgtctgtgttgtgaagcttgagactctggaaagaaatggggagggggggcaggggaaatgttgccctaagaatgcttctcattcctctgttcttattgggtcctgtttttcgggagggtgggggttgggggaagcttgaccttgtgtcttcgtcaataaactcacatttacacaaaa

SEQ ID NO: 366088 - DNA, 3630 bp, Homo sapiens
gagaaataaaaatcaaggtttagcgtcaagtttctgtttgaatcgtaattcttctgtgtactagctacatgactctggatgttacttagtctttctaaacctgagtttcattatctgcgaaatgagaggggaatgatatctactttgtttgagatcattatagtgtgagttagaaataatatcattaataggtaacttagtaagtggtagcagctactattaataatcatagagaaaaaaatcacagactagattattcctggtatacaagttgtgccttgaagacaggccttctggaaggaggtagagttgcaggttgtcacagttctatgacaatggagtaagtaagggtgtgctttgcagtatatgggccagtttgtttgatttggggagacctgcactgagagaaagaggaaggaaatagggaggcctatttctagacacagcgctgttcttttcctcctacctggctccctgcgatgtcctcatttgaccttgttgctttcctggcaggtggctgtgaaaaacaatatcgatgtcttctacttcagctgcctcatcccactcaatgtgctttttgtagaagatggcaaaatggagcgccaggtcttccttgcaacatggaaggatattcccaatgaaaatgaacttcagtttcagattaaggaatgtcatttaaatgctgacactgtttccagcaagttgcaaaacaacaatgtttatactattgccaagaggaatgtggaagggcaggacatgctgtaccaatccctgaagctcactaatggcatttggattttggccgaactacgtatccagccaggaaaccccaattacacgctgtcactgaagtgtagagctcctgaagtctctcaatacatctatcaggtctacgacagcattttgaaaaactaacaagactggtccagtacccttcaaccatgctgtgatcggtgcaagtcaagaactcttaactggaagaaattgtattgctgcgtagaatctgaacacactgaggccacctagcaaggtagtaactagtctaacctgtgctaacattagggcacaacctgttggatagttttagcttcctgtgaacatttgtaaccactgcttcagtcacctcccacctcttgccacctgctgctgctatctgtccttacttgtgggcttctccatgctgtgccaatggctggctttttctacaccctcttttgagtgtagtttggtattttgtaattgagagctcatttcaaaagcagaaaaagacaacaaatattaaagcaaggaaaagtgtaactgaaacactgcactttactgttttatacttttgtacatatgagaaatcaagggattagtgcaaccagtagaaagcattgaaatgactgtcattaaccacacagtcctggaggcagagatgcagttacctaccctagcttttgatgggttctcttacctgtagtagccttatccctggtcatttggattttcagtttgcttttttctttttttcccctccaaactccttttccttggccaagccttcatgcttccccctttccatattataatctcatttgattgctctgcagttgggaacggtgatcttcttgaatgatgtttcagtgtgcaaaaactatagagcctgtcagcaccaaagctgacagaagttataccttactcctttcctttcccctgaacaaacctgctaatcccactaattcaggaatttgagtagagatggggaacaagaacccagatgctgtcccctcaccccctctcctgtatttctcaggtccagttcaaatctaaaattctacttttagagttgaaacagagtaataacttatctaaccctcttttcctacaaaggagaaagataaaaggcacaaaggttaccgccaaggcccgtcagctgtgtagtggcaaagccgagaccgagtctcctaagtccccgtcagtgtggttttcaccacaggactgtctcttgtcgttttcccctaatgccttctcctgccttttctgtgcctagtttttggctcttcacatattccatattgattttgacgctctgtatattggcatcaggtggcagctgaatatcttttgaattactcgaaggtaaagccagatgccagaatgaaggtgtagccagtgtttcccatatgcccctggagccccacttattgaggccagcagaataggtgcagagatgaagtgagcttagagatgttgcaaatgctctttatcccttcagctctctgatctgctctttcttcatgatacttagtctgcagggcatattaagatcatcccagaggttcaggcagttcctgtcatctctgaaaagactgggggatatgaaatcttccccctaccccacttaatgcgttggatatgatttttcaaagaatgcttcatgcccaaaataccagcctgtttagcagtgttacactgtttgatctgcgggcacttgttgcattgcctggcacccaatattcagggtccatgactaagactggtcttctcagatgccctgcttaaatcaggggcacttcaggctccacaggcgtcatgttggactgagacctaactcactggactcagaggaggaatcgtggaaaacaagagcaaaactaccccacacccctatttcatgtctgaaataaccctgtttcataccagttgcaaagcttgtggggagcggtcccacaaagcactttcttaaaccttgagaatctccaagagaaaaatatttggggaaggagggaggaaatatgtcccttgcacaccacccctgaagcacatggcagtagggaaacagcataggattgtatgtgggaggtggataggtcggtgatgtgtggagcggaaaagcaggttggtaaagttcccttcttgggacttattcctggagtcagtggatacaagtagtgcagaaggttcacactgcaaatagtgttctcatctcaaagcaaactatcattccagaaggaaaagtgtgtcagggcaagcagacaacacaatttcctatcagaatatgtccctcaacccccgaaacaaggcttctctcagcctccccaccagtgatggataacagctcctattctcagctgacctgactgagccaacccatgaactcttcactccttggggaagccacctcccatcacacccctgagcagagttagggaggaattctacttcccataaaaggacctctcctgagaggcaaaacctgttgcctccaccacggcttccctcttggctcattccaagcttggccaaattggggaagtgggatggaggttgccctgcatcccccctcctctgcctgagtgtgtctttgtaatgtcagctggcatcatacaaagagcaggagaagcaaacacccagaactcttttgctggtcagagattccctgagtgtctgtcctcacccaagcctgctctgtgtctgtgttgtgaagcttgagactctggaaagaaatggggagggggggcaggggaaatgttgccctaagaatgcttctcattcctctgttcttattgggtcctgtttttcgggagggtgggggttgggggaagcttgaccttgtgtcttcgtcaataaactcacatttacacaaaa

SEQ ID NO: 366089 - DNA, 1341 bp, Homo sapiens
aaccggttcgccatgttcccactgcagtaggtgcttttgactattttctttatggtgtctttaaagcacaacagtttttagattttggtgaaatcccacttacctacattttctttttgctatgcacttcatgcccaaaataccagcctgtttagcagtgttacactgtttgatctgcgggcacttgttgcattgcctggcacccaatattcagggtccatgactaagactggtcttctcagatgccctgcttaaatcaggggcacttcaggctccacaggcgtcatgttggactgagacctaactcactggactcagaggaggaatcgtggaaaacaagagcaaaactaccccacacccctatttcatgtctgaaataaccctgtttcataccagttgcaaagcttgtggggagcggtcccacaaagcactttcttaaaccttgagaatctccaagagaaaaatatttggggaaggagggaggaaatatgtcccttgcacaccacccctgaagcacatggcagtagggaaacagcataggattgtatgtgggaggtggataggtcggtgatgtgtggagcggaaaagcaggttggtaaagttcccttcttgggacttattcctggagtcagtggatacaagtagtgcagaaggttcacactgcaaatagtgttctcatctcaaagcaaactatcattccagaaggaaaagtgtgtcagggcaagcagacaacacaatttcctatcagaatatgtccctcaacccccgaaacaaggcttctctcagcctccccaccagtgatggataacagctcctattctcagctgacctgactgagccaacccatgaactcttcactccttggggaagccacctcccatcacacccctgagcagagttagggaggaattctacttcccataaaaggacctctcctgagaggcaaaacctgttgcctccaccacggcttccctcttggctcattccaagcttggccaaattggggaagtgggatggaggttgccctgcatcccccctcctctgcctgagtgtgtctttgtaatgtcagctggcatcatacaaagagcaggagaagcaaacacccagaactcttttgctggtcagagattccctgagtgtctgtcctcacccaagcctgctctgtgtctgtgttgtgaagcttgagactctggaaagaaatggggagggggggcaggggaaatgttgccctaagaatgcttctcattcctctgttcttattgggtcctgtttttcgggagggtgggggttgggggaagcttgaccttgtgtcttcgtcaataaactcacatttacacaaaa

SEQ ID NO: 366090 - DNA, 1016 bp, Homo sapiens
tcttgtccttggtaataagagcagagacaggacccctatttcatgtctgaaataaccctgtttcataccagttgcaaagcttgtggggagcggtcccacaaagcactttcttaaaccttgagaatctccaagagaaaaatatttggggaaggagggaggaaatatgtcccttgcacaccacccctgaagcacatggcagtagggaaacagcataggattgtatgtgggaggtggataggtcggtgatgtgtggagcggaaaagcaggttggtaaagttcccttcttgggacttattcctggagtcagtggatacaagtagtgcagaaggttcacactgcaaatagtgttctcatctcaaagcaaactatcattccagaaggaaaagtgtgtcagggcaagcagacaacacaatttcctatcagaatatgtccctcaacccccgaaacaaggcttctctcagcctccccaccagtgatggataacagctcctattctcagctgacctgactgagccaacccatgaactcttcactccttggggaagccacctcccatcacacccctgagcagagttagggaggaattctacttcccataaaaggacctctcctgagaggcaaaacctgttgcctccaccacggcttccctcttggctcattccaagcttggccaaattggggaagtgggatggaggttgccctgcatcccccctcctctgcctgagtgtgtctttgtaatgtcagctggcatcatacaaagagcaggagaagcaaacacccagaactcttttgctggtcagagattccctgagtgtctgtcctcacccaagcctgctctgtgtctgtgttgtgaagcttgagactctggaaagaaatggggagggggggcaggggaaatgttgccctaagaatgcttctcattcctctgttcttattgggtcctgtttttcgggagggtgggggttgggggaagcttgaccttgtgtcttcgtcaataaactcacatttacacaaaa

SEQ ID NO: 366091 - DNA, 2544 bp, Homo sapiens
acgtcagagtttcctgcccaccatctttgtccctggcaaagtgggttttgcgcagtggcttagacctagaaaagaatcgtgacgggcaggaaaccattacaccaccacctgggctgtgctctccggctcccgccgccacccccgccctcgccttcgcctccgcctccggtgcacattaaagatccaaagtcatgactgactccaagtatttcacaaccaataaaaaaggagaaatatttgaactaaaagctgaactcaacaatgaaaagaaagaaaagagaaaggaggctgtgaagaaagtgattgctgctatgaccgtggggaaggatgttagttctctctttccagacgtagtgaactgtatgcagactgacaatctggaactaaagaagcttgtgtatctctacttgatgaactacgccaagagtcagccagacatggccatcatggctgtaaacagctttgtgaaggactgtgaagatcctaatcctttgattcgagccttggcagtcagaaccatggggtgcatccgggtagacaaaattacagaatatctctgtgagccgctccgcaagtgcttgaaggatgaggatccctatgttcggaaaacagcagcagtctgcgtggcaaaactccatgatatcaatgcccaaatggtggaagatcagggatttctggattctctacgggatctcatagcagattcaaatccaatggtggtggctaatgccgtagcggcattatctgaaatcagtgagtctcacccaaacagcaacttacttgatctgaacccacagaacattaataagctgctgacagccctgaatgaatgcactgaatggggccagattttcatcctggactgcctgtctaattacaaccctaaagatgatcgggaggctcagagcatctgtgagcgggtaactccccggctatcccatgccaactcagcagtggtgctttcagcggtaaaagtcctaatgaagtttctagaattgttacctaaggattctgactactacaatatgctgctgaagaagttagcccctccacttgtcactttgctgtctggggagccagaagtgcagtatgtcgccctgaggaacatcaacttaattgtccagaaaaggcctgaaatcttgaagcaggaaatcaaagtcttctttgtgaagtacaatgatcccatctatgttaaactagagaagttggacatcatgattcgtttggcatctcaagccaacattgctcaggttctggcagaactgaaagaatatgctacagaggtggatgttgactttgttcgaaaagctgtgcgggccattggacggtgtgccatcaaggtggagcaatctgcagagcgctgtgtaagcacattgcttgatctaatccagaccaaagtgaattatgtggtccaagaagcaattgttgtcatcagggacatcttccgcaaataccccaacaagtatgaaagtatcatcgccactctgtgtgagaacttagactcgctggatgagccagatgctcgagcagctatgatttggattgtgggagaatatgctgaaagaattgacaatgcagatgagttactagaaagcttcctggagggttttcacgatgaaagcacccaggtgcagctcactctgcttactgccatagtgaagctgtttctcaagaaaccatcagaaacacaggagctagtccagcaggtcttgagtttggcaacacaggattctgataatcctgaccttcgagaccggggctatatttattggcgccttctctcaactgaccctgttacagctaaagaagtagtcttgtctgagaagccactgatctctgaggagacggaccttattgagccaactctgctggatgagctaatctgccacattggttctttggcctctgtgtatcataagcctcccaatgcttttgtggaaggaagtcatggaattcatcgtaaacacttgccaattcatcatgggagcactgatgcaggtgacagccctgttggcactaccactgcaacgaacctggaacagcctcaggttatcccctctcaaggtgatcttctaggggatcttttaaaccttgacctcggtcccccagtcaatgtgccacaggtgtcctccatgcagatgggagcagtggatctcctaggaggaggactagatagtctgccccagaaattgtttacagtgcagttttcttcagcttattctgagattgaaagatatcccagaaatcaagatgagaagaaattaaagcccttatttttgctttggatccgtatgtggttaaatatatattcactcagagaatcaaggttcctttttcgagaacatcacaaggaagacctaaatttgcctgtgtggaagaagatgagtttctaaggcggcagtggacttttaaaatgcttttattgttcttatgcaaattacctaaagagaagattaatcctcaaagccattttttgaatgcatccttgccttacagagtgcttctcaaaataaattatataccttgaatctcctaaaaaaaaag

SEQ ID NO: 366092 - DNA, 500 bp, Homo sapiens
atggaatggaagaatccattcaactccttttcattccattccgttccatctgattccattccattctaatcaattccattccattccattccattccattccattccattccattcctttacattccattccattccatttcagtccattccactccagtccattccattggagtccattccattcctttccattccattacggatgattccattccattgcattccattccattccattcccctgtactcgggttgaacacccagaactcttttgctggtcagagattccctgagtgtctgtcctcacccaagcctgctctgtgtctgtgttgtgaagcttgagactctggaaagaaatggggagggggggcaggggaaatgttgccctaagaatgcttctcattcctctgttcttattgggtcctgtttttcgggagggtgggggttgggggaagcttgaccttgtgtcttcgtcaataaactcacatttacacaaaa

SEQ ID NO: 366093 - DNA, 219 bp, Homo sapiens
gaaaaacaatatcgatgtcttctacttcagctgcctcatcccactcaatgtgctttttgtagaagatggcaaaatgggtaagtaccttcctgcctgtcctgctgaatatacctttgcccttcctgtgcatgtcaggcagagcatagccccagaagttttgagttattttgaggttaaaaaaaaatgggttaaggatattctaaagctcttaataattgc

SEQ ID NO: 366094 - DNA, 3444 bp, Homo sapiens
acgtcagagtttcctgcccaccatctttgtccctggcaaagtgggttttgcgcagtggcttagacctagaaaagaatcgtgacgggcaggaaaccattacaccaccacctgggctgtgctctccggctcccgccgccacccccgccctcgccttcgcctccgcctccggtgcacattaaagatccaaagtcatgactgactccaagtatttcacaaccaataaaaaaggagaaatatttgaactaaaagctgaactcaacaatgaaaagaaagaaaagagaaaggaggctgtgaagaaagtgattgctgctatgaccgtggggaaggatgttagttctctctttccagacgtagtgaactgtatgcagactgacaatctggaactaaagaagcttgtgtatctctacttgatgaactacgccaagagtcagccagacatggccatcatggctgtaaacagctttgtgaaggactgtgaagatcctaatcctttgattcgagccttggcagtcagaaccatggggtgcatccgggtagacaaaattacagaatatctctgtgagccgctccgcaagtgcttgaaggatgaggatccctatgttcggaaaacagcagcagtctgcgtggcaaaactccatgatatcaatgcccaaatggtggaagatcagggatttctggattctctacgggatctcatagcagattcaaatccaatggtggtggctaatgccgtagcggcattatctgaaatcagtgagtctcacccaaacagcaacttacttgatctgaacccacagaacattaataagctgctgacagccctgaatgaatgcactgaatggggccagattttcatcctggactgcctgtctaattacaaccctaaagatgatcgggaggctcagagcatctgtgagcgggtaactccccggctatcccatgccaactcagcagtggtgctttcagcggtaaaagtcctaatgaagtttctagaattgttacctaaggattctgactactacaatatgctgctgaagaagttagcccctccacttgtcactttgctgtctggggagccagaagtgcagtatgtcgccctgaggaacatcaacttaattgtccagaaaaggcctgaaatcttgaagcaggaaatcaaagtcttctttgtgaagtacaatgatcccatctatgttaaactagagaagttggacatcatgattcgtttggcatctcaagccaacattgctcaggttctggcagaactgaaagaatatgctacagaggtggatgttgactttgttcgaaaagctgtgcgggccattggacggtgtgccatcaaggtggagcaatctgcagagcgctgtgtaagcacattgcttgatctaatccagaccaaagtgaattatgtggtccaagaagcaattgttgtcatcagggacatcttccgcaaataccccaacaagtatgaaagtatcatcgccactctgtgtgagaacttagactcgctggatgagccagatgctcgagcagctatgatttggattgtgggagaatatgctgaaagaattgacaatgcagatgagttactagaaagcttcctggagggttttcacgatgaaagcacccaggtgcagctcactctgcttactgccatagtgaagctgtttctcaagaaaccatcagaaacacaggagctagtccagcaggtcttgagtttggcaacacaggattctgataatcctgaccttcgagaccggggctatatttattggcgccttctctcaactgaccctgttacagctaaagaagtagtcttgtctgagaagccactgatctctgaggagacggaccttattgagccaactctgctggatgagctaatctgccacattggttctttggcctctgtgtatcataagcctcccaatgcttttgtggaaggaagtcatggaattcatcgtaaacacttgccaattcatcatgggagcactgatgcaggtgacagccctgttggcactaccactgcaacgaacctggaacagcctcaggttatcccctctcaaggtgatcttctaggggatcttttaaaccttgacctcggtcccccagtcaatgtgccacaggtgtcctccatgcagatgggagcagtggatctcctaggaggaggactagatagtctgcttggcagtgaccttggcgggggcattggaggaagtccggcagtgggacaatccttcatcccatcatcggtgcctgcaacctttgctccttcacctacacctgctgtggtcagcagtggactgaatgacctgtttgaactctccacagggataggcatggcacctggtggatatgtggctcctaaggctgtctggctacctgcagtaaaggctaaaggcttggagatttccggaacatttactcaccgccaagggcacatctatatggaaatgaacttcaccaataaagctctgcagcacatgacagattttgcaatccagtttaacaaaaatagctttggtgtcatccccagcactcctctggccatccatacaccactgatgccaaaccagagcattgatgtctccctgcctctcaataccttgggcccagtcatgaagatggaacctctgaataacctccaggtggctgtgaaaaacaatatcgatgtcttctacttcagctgcctcatcccactcaatgtgctttttgtagaagatggcaaaatggagcgccaggtcttccttgcaacatggaaggatattcccaatgaaaatgaacttcagtttcagattaaggaatgtcatttaaatgctgacactgtttccagcaagttgcaaaacaacaatgtttatactattgccaagaggaatgtggaagggcaggacatgctgtaccaatccctgaagctcactaatggcatttggattttggccgaactacgtatccagccaggaaaccccaattacacgctgtcactgaagtgtagagctcctgaagtctctcaatacatctatcaggtctacgacagcattttgaaaaactaacaagactggtccagtacccttcaaccatgctgtgatcggtgcaagtcaagaactcttaactggaagaaattgtattgctgcgtagaatctgaacacactgaggccacctagcaaggtagtaactagtctaacctgtgctaacattagggcacaacctgttggatagttttagcttcctgtgaacatttgtaaccactgcttcagtcacctcccacctcttgccacctgctgctgctatctgtccttacttgtgggcttctccatgctgtgccaatggctggctttttctacaccctcttttgagtgtagtttggtattttgtaattgagagctcatttcaaaagcagaaaaagacaacaaatattaaagcaaggaaaagtgtaactgaaacactgca

SEQ ID NO: 366095 - DNA, 5762 bp, Homo sapiens
acgtcagagtttcctgcccaccatctttgtccctggcaaagtgggttttgcgcagtggcttagacctagaaaagaatcgtgacgggcaggaaaccattacaccaccacctgggctgtgctctccggctcccgccgccacccccgccctcgccttcgcctccgcctccggtgcacattaaagatccaaagtcatgactgactccaagtatttcacaaccaataaaaaaggagaaatatttgaactaaaagctgaactcaacaatgaaaagaaagaaaagagaaaggaggctgtgaagaaagtgattgctgctatgaccgtggggaaggatgttagttctctctttccagacgtagtgaactgtatgcagactgacaatctggaactaaagaagcttgtgtatctctacttgatgaactacgccaagagtcagccagacatggccatcatggctgtaaacagctttgtgaaggactgtgaagatcctaatcctttgattcgagccttggcagtcagaaccatggggtgcatccgggtagacaaaattacagaatatctctgtgagccgctccgcaagtgcttgaaggatgaggatccctatgttcggaaaacagcagcagtctgcgtggcaaaactccatgatatcaatgcccaaatggtggaagatcagggatttctggattctctacgggatctcatagcagattcaaatccaatggtggtggctaatgccgtagcggcattatctgaaatcagtgagtctcacccaaacagcaacttacttgatctgaacccacagaacattaataagctgctgacagccctgaatgaatgcactgaatggggccagattttcatcctggactgcctgtctaattacaaccctaaagatgatcgggaggctcagagcatctgtgagcgggtaactccccggctatcccatgccaactcagcagtggtgctttcagcggtaaaagtcctaatgaagtttctagaattgttacctaaggattctgactactacaatatgctgctgaagaagttagcccctccacttgtcactttgctgtctggggagccagaagtgcagtatgtcgccctgaggaacatcaacttaattgtccagaaaaggcctgaaatcttgaagcaggaaatcaaagtcttctttgtgaagtacaatgatcccatctatgttaaactagagaagttggacatcatgattcgtttggcatctcaagccaacattgctcaggttctggcagaactgaaagaatatgctacagaggtggatgttgactttgttcgaaaagctgtgcgggccattggacggtgtgccatcaaggtggagcaatctgcagagcgctgtgtaagcacattgcttgatctaatccagaccaaagtgaattatgtggtccaagaagcaattgttgtcatcagggacatcttccgcaaataccccaacaagtatgaaagtatcatcgccactctgtgtgagaacttagactcgctggatgagccagatgctcgagcagctatgatttggattgtgggagaatatgctgaaagaattgacaatgcagatgagttactagaaagcttcctggagggttttcacgatgaaagcacccaggtgcagctcactctgcttactgccatagtgaagctgtttctcaagaaaccatcagaaacacaggagctagtccagcaggtcttgagtttggcaacacaggattctgataatcctgaccttcgagaccggggctatatttattggcgccttctctcaactgaccctgttacagctaaagaagtagtcttgtctgagaagccactgatctctgaggagacggaccttattgagccaactctgctggatgagctaatctgccacattggttctttggcctctgtgtatcataagcctcccaatgcttttgtggaaggaagtcatggaattcatcgtaaacacttgccaattcatcatgggagcactgatgcaggtgacagccctgttggcactaccactgcaacgaacctggaacagcctcaggttatcccctctcaaggtgatcttctaggggatcttttaaaccttgacctcggtcccccagtcaatgtgccacaggtgtcctccatgcagatgggagcagtggatctcctaggaggaggactagatagtctgcttggcagtgaccttggcgggggcattggaggaagtccggcagtgggacaatccttcatcccatcatcggtgcctgcaacctttgctccttcacctacacctgctgtggtcagcagtggactgaatgacctgtttgaactctccacagggataggcatggcacctggtggatatgtggctcctaaggctgtctggctacctgcagtaaaggctaaaggcttggagatttccggaacatttactcaccgccaagggcacatctatatggaaatgaacttcaccaataaagctctgcagcacatgacagattttgcaatccagtttaacaaaaatagctttggtgtcatccccagcactcctctggccatccatacaccactgatgccaaaccagagcattgatgtctccctgcctctcaataccttgggcccagtcatgaagatggaacctctgaataacctccaggtggctgtgaaaaacaatatcgatgtcttctacttcagctgcctcatcccactcaatgtgctttttgtagaagatggcaaaatggagcgccaggtcttccttgcaacatggaaggatattcccaatgaaaatgaacttcagtttcagattaaggaatgtcatttaaatgctgacactgtttccagcaagttgcaaaacaacaatgtttatactattgccaagaggaatgtggaagggcaggacatgctgtaccaatccctgaagctcactaatggcatttggattttggccgaactacgtatccagccaggaaaccccaattacacgctgtcactgaagtgtagagctcctgaagtctctcaatacatctatcaggtctacgacagcattttgaaaaactaacaagactggtccagtacccttcaaccatgctgtgatcggtgcaagtcaagaactcttaactggaagaaattgtattgctgcgtagaatctgaacacactgaggccacctagcaaggtagtaactagtctaacctgtgctaacattagggcacaacctgttggatagttttagcttcctgtgaacatttgtaaccactgcttcagtcacctcccacctcttgccacctgctgctgctatctgtccttacttgtgggcttctccatgctgtgccaatggctggctttttctacaccctcttttgagtgtagtttggtattttgtaattgagagctcatttcaaaagcagaaaaagacaacaaatattaaagcaaggaaaagtgtaactgaaacactgcactttactgttttatacttttgtacatatgagaaatcaagggattagtgcaaccagtagaaagcattgaaatgactgtcattaaccacacagtcctggaggcagagatgcagttacctaccctagcttttgatgggttctcttacctgtagtagccttatccctggtcatttggattttcagtttgcttttttctttttttcccctccaaactccttttccttggccaagccttcatgcttccccctttccatattataatctcatttgattgctctgcagttgggaacggtgatcttcttgaatgatgtttcagtgtgcaaaaactatagagcctgtcagcaccaaagctgacagaagttataccttactcctttcctttcccctgaacaaacctgctaatcccactaattcaggaatttgagtagagatggggaacaagaacccagatgctgtcccctcaccccctctcctgtatttctcaggtccagttcaaatctaaaattctacttttagagttgaaacagagtaataacttatctaaccctcttttcctacaaaggagaaagataaaaggcacaaaggttaccgccaaggcccgtcagctgtgtagtggcaaagccgagaccgagtctcctaagtccccgtcagtgtggttttcaccacaggactgtctcttgtcgttttcccctaatgccttctcctgccttttctgtgcctagtttttggctcttcacatattccatattgattttgacgctctgtatattggcatcaggtggcagctgaatatcttttgaattactcgaaggtaaagccagatgccagaatgaaggtgtagccagtgtttcccatatgcccctggagccccacttattgaggccagcagaataggtgcagagatgaagtgagcttagagatgttgcaaatgctctttatcccttcagctctctgatctgctctttcttcatgatacttagtctgcagggcatattaagatcatcccagaggttcaggcagttcctgtcatctctgaaaagactgggggatatgaaatcttccccctaccccacttaatgcgttggatatgatttttcaaagaatgcttcatgcccaaaataccagcctgtttagcagtgttacactgtttgatctgcgggcacttgttgcattgcctggcacccaatattcagggtccatgactaagactggtcttctcagatgccctgcttaaatcaggggcacttcaggctccacaggcgtcatgttggactgagacctaactcactggactcagaggaggaatcgtggaaaacaagagcaaaactaccccacacccctatttcatgtctgaaataaccctgtttcataccagttgcaaagcttgtggggagcggtcccacaaagcactttcttaaaccttgagaatctccaagagaaaaatatttggggaaggagggaggaaatatgtcccttgcacaccacccctgaagcacatggcagtagggaaacagcataggattgtatgtgggaggtggataggtcggtgatgtgtggagcggaaaagcaggttggtaaagttcccttcttgggacttattcctggagtcagtggatacaagtagtgcagaaggttcacactgcaaatagtgttctcatctcaaagcaaactatcattccagaaggaaaagtgtgtcagggcaagcagacaacacaatttcctatcagaatatgtccctcaacccccgaaacaaggcttctctcagcctccccaccagtgatggataacagctcctattctcagctgacctgactgagccaacccatgaactcttcactccttggggaagccacctcccatcacacccctgagcagagttagggaggaattctacttcccataaaaggacctctcctgagaggcaaaacctgttgcctccaccacggcttccctcttggctcattccaagcttggccaaattggggaagtgggatggaggttgccctgcatcccccctcctctgcctgagtgtgtctttgtaatgtcagctggcatcatacaaagagcaggagaagcaaacacccagaactcttttgctggtcagagattccctgagtgtctgtcctcacccaagcctgctctgtgtctgtgttgtgaagcttgagactctggaaagaaatggggagggggggcaggggaaatgttgccctaagaatgcttctcattcctctgttcttattgggtcctgtttttcgggagggtgggggttgggggaagcttgaccttgtgtcttcgtcaataaactcacatttacacaaaa

SEQ ID NO: 366096 - DNA, 5816 bp, Homo sapiens
acgtcagagtttcctgcccaccatctttgtccctggcaaagtgggttttgcgcagtggcttagacctagaaaagaatcgtgacgggcaggaaaccattacaccaccacctgggctgtgctctccggctcccgccgccacccccgccctcgccttcgcctccgcctccggtgcacattaaagatccaaagtcatgactgactccaagtatttcacaaccaataaaaaaggagaaatatttgaactaaaagctgaactcaacaatgaaaagaaagaaaagagaaaggaggctgtgaagaaagtgattgctgctatgaccgtggggaaggatgttagttctctctttccagacgtagtgaactgtatgcagactgacaatctggaactaaagaagcttgtgtatctctacttgatgaactacgccaagagtcagccagacatggccatcatggctgtaaacagctttgtgaaggactgtgaagatcctaatcctttgattcgagccttggcagtcagaaccatggggtgcatccgggtagacaaaattacagaatatctctgtgagccgctccgcaagtgcttgaaggatgaggatccctatgttcggaaaacagcagcagtctgcgtggcaaaactccatgatatcaatgcccaaatggtggaagatcagggatttctggattctctacgggatctcatagcagattcaaatccaatggtggtggctaatgccgtagcggcattatctgaaatcagtgagtctcacccaaacagcaacttacttgatctgaacccacagaacattaataagctgctgacagccctgaatgaatgcactgaatggggccagattttcatcctggactgcctgtctaattacaaccctaaagatgatcgggaggctcagagcatctgtgagcgggtaactccccggctatcccatgccaactcagcagtggtgctttcagcggtaaaagtcctaatgaagtttctagaattgttacctaaggattctgactactacaatatgctgctgaagaagttagcccctccacttgtcactttgctgtctggggagccagaagtgcagtatgtcgccctgaggaacatcaacttaattgtccagaaaaggcctgaaatcttgaagcaggaaatcaaagtcttctttgtgaagtacaatgatcccatctatgttaaactagagaagttggacatcatgattcgtttggcatctcaagccaacattgctcaggttctggcagaactgaaagaatatgctacagaggtggatgttgactttgttcgaaaagctgtgcgggccattggacggtgtgccatcaaggtggagcaatctgcagagcgctgtgtaagcacattgcttgatctaatccagaccaaagtgaattatgtggtccaagaagcaattgttgtcatcagggacatcttccgcaaataccccaacaagtatgaaagtatcatcgccactctgtgtgagaacttagactcgctggatgagccagatgctcgagcagctatgatttggattgtgggagaatatgctgaaagaattgacaatgcagatgagttactagaaagcttcctggagggttttcacgatgaaagcacccaggtgcagctcactctgcttactgccatagtgaagctgtttctcaagaaaccatcagaaacacaggagctagtccagcaggtcttgagtttggcaacacaggattctgataatcctgaccttcgagaccggggctatatttattggcgccttctctcaactgaccctgttacagctaaagaagtagtcttgtctgagaagccactgatctctgaggagacggaccttattgagccaactctgctggatgagctaatctgccacattggttctttggcctctgtgtatcataagcctcccaatgcttttgtggaaggaagtcatggaattcatcgtaaacacttgccaattcatcatgggagcactgatgcaggtgacagccctgttggcactaccactgcaacgaacctggaacagcctcaggttatcccctctcaaggtgatcttctaggggatcttttaaaccttgacctcggtcccccagtcaatgtgccacaggtgtcctccatgcagatgggagcagtggatctcctaggaggaggactagatagtctggtgggacaatccttcatcccatcatcggtgcctgcaacctttgctccttcacctacacctgctgtggtcagcagtggactgaatgacctgtttgaactctccacagggataggcatggcacctggtggatatgtggctcctaaggctgtctggctacctgcagtaaaggctaaaggcttggagatttccggaacatttactcaccgccaagggcacatctatatggaaatgaacttcaccaataaagctctgcagcacatgacagattttgcaatccagtttaacaaaaatagctttggtgtcatccccagcactcctctggccatccatacaccactgatgccaaaccagagcattgatgtctccctgcctctcaataccttgggcccagtcatgaagatggaacctctgaataacctccaggttaaaagcaaggagaataattggatggacacttctgggagagagaacgcaaatattatggagaagggaatacaggcaccatttaaagtaaggaaggtggctgtgaaaaacaatatcgatgtcttctacttcagctgcctcatcccactcaatgtgctttttgtagaagatggcaaaatggagcgccaggtcttccttgcaacatggaaggatattcccaatgaaaatgaacttcagtttcagattaaggaatgtcatttaaatgctgacactgtttccagcaagttgcaaaacaacaatgtttatactattgccaagaggaatgtggaagggcaggacatgctgtaccaatccctgaagctcactaatggcatttggattttggccgaactacgtatccagccaggaaaccccaattacacgctgtcactgaagtgtagagctcctgaagtctctcaatacatctatcaggtctacgacagcattttgaaaaactaacaagactggtccagtacccttcaaccatgctgtgatcggtgcaagtcaagaactcttaactggaagaaattgtattgctgcgtagaatctgaacacactgaggccacctagcaaggtagtaactagtctaacctgtgctaacattagggcacaacctgttggatagttttagcttcctgtgaacatttgtaaccactgcttcagtcacctcccacctcttgccacctgctgctgctatctgtccttacttgtgggcttctccatgctgtgccaatggctggctttttctacaccctcttttgagtgtagtttggtattttgtaattgagagctcatttcaaaagcagaaaaagacaacaaatattaaagcaaggaaaagtgtaactgaaacactgcactttactgttttatacttttgtacatatgagaaatcaagggattagtgcaaccagtagaaagcattgaaatgactgtcattaaccacacagtcctggaggcagagatgcagttacctaccctagcttttgatgggttctcttacctgtagtagccttatccctggtcatttggattttcagtttgcttttttctttttttcccctccaaactccttttccttggccaagccttcatgcttccccctttccatattataatctcatttgattgctctgcagttgggaacggtgatcttcttgaatgatgtttcagtgtgcaaaaactatagagcctgtcagcaccaaagctgacagaagttataccttactcctttcctttcccctgaacaaacctgctaatcccactaattcaggaatttgagtagagatggggaacaagaacccagatgctgtcccctcaccccctctcctgtatttctcaggtccagttcaaatctaaaattctacttttagagttgaaacagagtaataacttatctaaccctcttttcctacaaaggagaaagataaaaggcacaaaggttaccgccaaggcccgtcagctgtgtagtggcaaagccgagaccgagtctcctaagtccccgtcagtgtggttttcaccacaggactgtctcttgtcgttttcccctaatgccttctcctgccttttctgtgcctagtttttggctcttcacatattccatattgattttgacgctctgtatattggcatcaggtggcagctgaatatcttttgaattactcgaaggtaaagccagatgccagaatgaaggtgtagccagtgtttcccatatgcccctggagccccacttattgaggccagcagaataggtgcagagatgaagtgagcttagagatgttgcaaatgctctttatcccttcagctctctgatctgctctttcttcatgatacttagtctgcagggcatattaagatcatcccagaggttcaggcagttcctgtcatctctgaaaagactgggggatatgaaatcttccccctaccccacttaatgcgttggatatgatttttcaaagaatgcttcatgcccaaaataccagcctgtttagcagtgttacactgtttgatctgcgggcacttgttgcattgcctggcacccaatattcagggtccatgactaagactggtcttctcagatgccctgcttaaatcaggggcacttcaggctccacaggcgtcatgttggactgagacctaactcactggactcagaggaggaatcgtggaaaacaagagcaaaactaccccacacccctatttcatgtctgaaataaccctgtttcataccagttgcaaagcttgtggggagcggtcccacaaagcactttcttaaaccttgagaatctccaagagaaaaatatttggggaaggagggaggaaatatgtcccttgcacaccacccctgaagcacatggcagtagggaaacagcataggattgtatgtgggaggtggataggtcggtgatgtgtggagcggaaaagcaggttggtaaagttcccttcttgggacttattcctggagtcagtggatacaagtagtgcagaaggttcacactgcaaatagtgttctcatctcaaagcaaactatcattccagaaggaaaagtgtgtcagggcaagcagacaacacaatttcctatcagaatatgtccctcaacccccgaaacaaggcttctctcagcctccccaccagtgatggataacagctcctattctcagctgacctgactgagccaacccatgaactcttcactccttggggaagccacctcccatcacacccctgagcagagttagggaggaattctacttcccataaaaggacctctcctgagaggcaaaacctgttgcctccaccacggcttccctcttggctcattccaagcttggccaaattggggaagtgggatggaggttgccctgcatcccccctcctctgcctgagtgtgtctttgtaatgtcagctggcatcatacaaagagcaggagaagcaaacacccagaactcttttgctggtcagagattccctgagtgtctgtcctcacccaagcctgctctgtgtctgtgttgtgaagcttgagactctggaaagaaatggggagggggggcaggggaaatgttgccctaagaatgcttctcattcctctgttcttattgggtcctgtttttcgggagggtgggggttgggggaagcttgaccttgtgtcttcgtcaataaactcacatttacacaaaa

SEQ ID NO: 366097 - DNA, 5710 bp, Homo sapiens
acgtcagagtttcctgcccaccatctttgtccctggcaaagtgggttttgcgcagtggcttagacctagaaaagaatcgtgacgggcaggaaaccattacaccaccacctgggctgtgctctccggctcccgccgccacccccgccctcgccttcgcctccgcctccggtgcacattaaagatccaaagtcatgactgactccaagtatttcacaaccaataaaaaaggagaaatatttgaactaaaagctgaactcaacaatgaaaagaaagaaaagagaaaggaggctgtgaagaaagtgattgctgctatgaccgtggggaaggatgttagttctctctttccagacgtagtgaactgtatgcagactgacaatctggaactaaagaagcttgtgtatctctacttgatgaactacgccaagagtcagccagacatggccatcatggctgtaaacagctttgtgaaggactgtgaagatcctaatcctttgattcgagccttggcagtcagaaccatggggtgcatccgggtagacaaaattacagaatatctctgtgagccgctccgcaagtgcttgaaggatgaggatccctatgttcggaaaacagcagcagtctgcgtggcaaaactccatgatatcaatgcccaaatggtggaagatcagggatttctggattctctacgggatctcatagcagattcaaatccaatggtggtggctaatgccgtagcggcattatctgaaatcagtgagtctcacccaaacagcaacttacttgatctgaacccacagaacattaataagctgctgacagccctgaatgaatgcactgaatggggccagattttcatcctggactgcctgtctaattacaaccctaaagatgatcgggaggctcagagcatctgtgagcgggtaactccccggctatcccatgccaactcagcagtggtgctttcagcggtaaaagtcctaatgaagtttctagaattgttacctaaggattctgactactacaatatgctgctgaagaagttagcccctccacttgtcactttgctgtctggggagccagaagtgcagtatgtcgccctgaggaacatcaacttaattgtccagaaaaggcctgaaatcttgaagcaggaaatcaaagtcttctttgtgaagtacaatgatcccatctatgttaaactagagaagttggacatcatgattcgtttggcatctcaagccaacattgctcaggttctggcagaactgaaagaatatgctacagaggtggatgttgactttgttcgaaaagctgtgcgggccattggacggtgtgccatcaaggtggagcaatctgcagagcgctgtgtaagcacattgcttgatctaatccagaccaaagtgaattatgtggtccaagaagcaattgttgtcatcagggacatcttccgcaaataccccaacaagtatgaaagtatcatcgccactctgtgtgagaacttagactcgctggatgagccagatgctcgagcagctatgatttggattgtgggagaatatgctgaaagaattgacaatgcagatgagttactagaaagcttcctggagggttttcacgatgaaagcacccaggtgcagctcactctgcttactgccatagtgaagctgtttctcaagaaaccatcagaaacacaggagctagtccagcaggtcttgagtttggcaacacaggattctgataatcctgaccttcgagaccggggctatatttattggcgccttctctcaactgaccctgttacagctaaagaagtagtcttgtctgagaagccactgatctctgaggagacggaccttattgagccaactctgctggatgagctaatctgccacattggttctttggcctctgtgtatcataagcctcccaatgcttttgtggaaggaagtcatggaattcatcgtaaacacttgccaattcatcatgggagcactgatgcaggtgacagccctgttggcactaccactgcaacgaacctggaacagcctcaggttatcccctctcaaggtgatcttctaggggatcttttaaaccttgacctcggtcccccagtcaatgtgccacaggtgtcctccatgcagatgggagcagtggatctcctaggaggaggactagatagtctgcttggcagtgaccttggcgggggcattggaggaagtccggcagtgggacaatccttcatcccatcatcggtgcctgcaacctttgctccttcacctacacctgctgtggtcagcagtggactgaatgacctgtttgaactctccacagggataggcatggcacctggtggatatgtggctcctaaggctgtctggctacctgcagtaaaggctaaaggcttggagatttccggaacatttactcaccgccaagggcacatctatatggaaatgaacttcaccaataaagctctgcagcacatgacagattttgcaatccagtttaacaaaaatagctttggtgtcatccccagcactcctctggccatccatacaccactgatgccaaaccagagcattgatgtctccctgcctctcaataccttgggcccagtcatgaagatggaacctctgaataacctccaggtggctgtgaaaaacaatatcgatgtcttctacttcagctgcctcatcccactcaatgtgctttttgtagaagatggcaaaatggagcgccaggtcttccttgcaacatggaaggatattcccaatgaaaatgaacttcagtttcagattaaggaatgtcatttaaatgctgacactgtttccagcaagttgcaaaacaacaatgtttatactattgccaagaggaatgtggaagggcaggacatgctgtaccaatccctgaagctcactaatggcatttggattttggccgaactacgtatccagccaggaaaccccaattacacgctgtcactgaagtgtagagctcctgaagtctctcaatacatctatcaggtctacgacagcattttgaaaaactaacaagactggtccagtacccttcaaccatgctgtgatcggtgcaagtcaagaactcttaactggaagaaattgtattgctgcgtagaatctgaacacactgaggccacctagcaaggtagtaactagtctaacctgtgctaacattagggcacaacctgttggatagttttagcttcctgtgaacatttgtaaccactgcttcagtcacctcccacctcttgccacctgctgctgctatctgtccttacttgtgggcttctccatgctgtgccaatggctggctttttctacaccctcttttgagtgtagtttggtattttgtaattgagagctcatttcaaaagcagaaaaagacaacaaatattaaagcaaggaaaagtgtaactgaaacactgcactttactgttttatacttttgtacatatgagaaatcaagggattagtgcaaccagtagaaagcattgaaatgactgtcattaaccacacagtcctggaggcagagatgcagttacctaccctagcttttgatgggttctcttacctgtagtagccttatccctggtcatttggattttcagtttgcttttttctttttttcccctccaaactccttttccttggccaagccttcatgcttccccctttccatattataatctcatttgattgctctgcagttgggaacggtgatcttcttgaatgatgtttcagtgtgcaaaaactatagagcctgtcagcaccaaagctgacagaagttataccttactcctttcctttcccctgaacaaacctgctaatcccactaattcaggaatttgagtagagatggggaacaagaacccagatgctgtcccctcaccccctctcctgtatttctcaggtccagttcaaatctaaaattctacttttagagttgaaacagagtaataacttatctaaccctcttttcctacaaaggagaaagataaaaggcacaaaggttaccgccaaggcccgtcagctgtgtagtggcaaagccgagaccgagtctcctaagtccccgtcagtgtggttttcaccacaggactgtctcttgtcgttttcccctaatgccttctcctgccttttctgtgcctagtttttggctcttcacatattccatattgattttgacgctctgtatattggcatcaggtggcagctgaatatcttttgaattactcgaaggtaaagccagatgccagaatgaaggtgtagccagtgtttcccatatgcccctggagccccacttattgaggccagcagaataggtgcagagatgaagtgagcttagagatgttgcaaatgctctttatcccttcagctctctgatctgctctttcttcatgatacttagtctgcagggcatattaagatcatcccagaggttcaggcagttcctgtcatctctgaaaagactgggggatatgaaatcttccccctaccccacttaatgcgttggatatgatttttcaaagaatgcttcatgcccaaaataccagcctgtttagcagtgttacactgtttgatctgcgggcacttgttgcattgcctggcacccaatattcagggtccatgactaagactggtcttctcagatgccctgcttaaatcaggggcacttcaggctccacaggcgtcatgttggactgagacctaactcactggactcagaggaggaatcgtggaaaacaagagcaaaactaccccacacccctatttcatgtctgaaataaccctgtttcataccaaatctccaagagaaaaatatttggggaaggagggaggaaatatgtcccttgcacaccacccctgaagcacatggcagtagggaaacagcataggattgtatgtgggaggtggataggtcggtgatgtgtggagcggaaaagcaggttggtaaagttcccttcttgggacttattcctggagtcagtggatacaagtagtgcagaaggttcacactgcaaatagtgttctcatctcaaagcaaactatcattccagaaggaaaagtgtgtcagggcaagcagacaacacaatttcctatcagaatatgtccctcaacccccgaaacaaggcttctctcagcctccccaccagtgatggataacagctcctattctcagctgacctgactgagccaacccatgaactcttcactccttggggaagccacctcccatcacacccctgagcagagttagggaggaattctacttcccataaaaggacctctcctgagaggcaaaacctgttgcctccaccacggcttccctcttggctcattccaagcttggccaaattggggaagtgggatggaggttgccctgcatcccccctcctctgcctgagtgtgtctttgtaatgtcagctggcatcatacaaagagcaggagaagcaaacacccagaactcttttgctggtcagagattccctgagtgtctgtcctcacccaagcctgctctgtgtctgtgttgtgaagcttgagactctggaaagaaatggggagggggggcaggggaaatgttgccctaagaatgcttctcattcctctgttcttattgggtcctgtttttcgggagggtgggggttgggggaagcttgaccttgtgtcttcgtcaataaactcacatttacacaaaa

SEQ ID NO: 366098 - DNA, 5709 bp, Homo sapiens
acgtcagagtttcctgcccaccatctttgtccctggcaaagtgggttttgcgcagtggcttagacctagaaaagaatcgtgacgggcaggaaaccattacaccaccacctgggctgtgctctccggctcccgccgccacccccgccctcgccttcgcctccgcctccggtgcacattaaagatccaaagtcatgactgactccaagtatttcacaaccaataaaaaaggagaaatatttgaactaaaagctgaactcaacaatgaaaagaaagaaaagagaaaggaggctgtgaagaaagtgattgctgctatgaccgtggggaaggatgttagttctctctttccagacgtagtgaactgtatgcagactgacaatctggaactaaagaagcttgtgtatctctacttgatgaactacgccaagagtcagccagacatggccatcatggctgtaaacagctttgtgaaggactgtgaagatcctaatcctttgattcgagccttggcagtcagaaccatggggtgcatccgggtagacaaaattacagaatatctctgtgagccgctccgcaagtgcttgaaggatgaggatccctatgttcggaaaacagcagcagtctgcgtggcaaaactccatgatatcaatgcccaaatggtggaagatcagggatttctggattctctacgggatctcatagcagattcaaatccaatggtggtggctaatgccgtagcggcattatctgaaatcagtgagtctcacccaaacagcaacttacttgatctgaacccacagaacattaataagctgctgacagccctgaatgaatgcactgaatggggccagattttcatcctggactgcctgtctaattacaaccctaaagatgatcgggaggctcagagcatctgtgagcgggtaactccccggctatcccatgccaactcagcagtggtgctttcagcggtaaaagtcctaatgaagtttctagaattgttacctaaggattctgactactacaatatgctgctgaagaagttagcccctccacttgtcactttgctgtctggggagccagaagtgcagtatgtcgccctgaggaacatcaacttaattgtccagaaaaggcctgaaatcttgaagcaggaaatcaaagtcttctttgtgaagtacaatgatcccatctatgttaaactagagaagttggacatcatgattcgtttggcatctcaagccaacattgctcaggttctggcagaactgaaagaatatgctacagaggtggatgttgactttgttcgaaaagctgtgcgggccattggacggtgtgccatcaaggtggagcaatctgcagagcgctgtgtaagcacattgcttgatctaatccagaccaaagtgaattatgtggtccaagaagcaattgttgtcatcagggacatcttccgcaaataccccaacaagtatgaaagtatcatcgccactctgtgtgagaacttagactcgctggatgagccagatgctcgagcagctatgatttggattgtgggagaatatgctgaaagaattgacaatgcagatgagttactagaaagcttcctggagggttttcacgatgaaagcacccaggtgcagctcactctgcttactgccatagtgaagctgtttctcaagaaaccatcagaaacacaggagctagtccagcaggtcttgagtttggcaacacaggattctgataatcctgaccttcgagaccggggctatatttattggcgccttctctcaactgaccctgttacagctaaagaagtagtcttgtctgagaagccactgatctctgaggagacggaccttattgagccaactctgctggatgagctaatctgccacattggttctttggcctctgtgtatcataagcctcccaatgcttttgtggaaggaagtcatggaattcatcgtaaacacttgccaattcatcatgggagcactgatgcaggtgacagccctgttggcactaccactgcaacgaacctggaacagcctcaggttatcccctctcaaggtgatcttctaggggatcttttaaaccttgacctcggtcccccagtcaatgtgccacaggtgtcctccatgcagatgggagcagtggatctcctaggaggaggactagatagtctgcttggcagtgaccttggcgggggcattggaggaagtccggcagtgggacaatccttcatcccatcatcggtgcctgcaacctttgctccttcacctacacctgctgtggtcagcagtggactgaatgacctgtttgaactctccacagggataggcatggcacctggtggatatgtggctcctaaggctgtctggctacctgcagtaaaggctaaaggcttggagatttccggaacatttactcaccgccaagggcacatctatatggaaatgaacttcaccaataaagctctgcagcacatgacagattttgcaatccagtttaacaaaaatagctttggtgtcatccccagcactcctctggccatccatacaccactgatgccaaaccagagcattgatgtctccctgcctctcaataccttgggcccagtcatgaagatggaacctctgaataacctccaggtggctgtgaaaaacaatatcgatgtcttctacttcagctgcctcatcccactcaatgtgctttttgtagaagatggcaaaatggagcgccaggtcttccttgcaacatggaaggatattcccaatgaaaatgaacttcagtttcagattaaggaatgtcatttaaatgctgacactgtttccagcaagttgcaaaacaacaatgtttatactattgccaagaggaatgtggaagggcaggacatgctgtaccaatccctgaagctcactaatggcatttggattttggccgaactacgtatccagccaggaaaccccaattacacgctgtcactgaagtgtagagctcctgaagtctctcaatacatctatcaggtctacgacagcattttgaaaaactaacaagactggtccagtacccttcaaccatgctgtgatcggtgcaagtcaagaactcttaactggaagaaattgtattgctgcgtagaatctgaacacactgaggccacctagcaaggtagtaactagtctaacctgtgctaacattagggcacaacctgttggatagttttagcttcctgtgaacatttgtaaccactgcttcagtcacctcccacctcttgccacctgctgctgctatctgtccttacttgtgggcttctccatgctgtgccaatggctggctttttctacaccctcttttgagtgtagtttggtattttgtaattgagagctcatttcaaaagcagaaaaagacaacaaatattaaagcaaggaaaagtgtaactgaaacactgcactttactgttttatacttttgtacatatgagaaatcaagggattagtgcaaccagtagaaagcattgaaatgactgtcattaaccacacagtcctggaggcagagatgcagttacctaccctagcttttgatgggttctcttacctgtagtagccttatccctggtcatttggattttcagtttgcttttttctttttttcccctccaaactccttttccttggccaagccttcatgcttccccctttccatattataatctcatttgattgctctgcagttgggaacggtgatcttcttgaatgatgtttcagtgtgcaaaaactatagagcctgtcagcaccaaagctgacagaagttataccttactcctttcctttcccctgaacaaacctgctaatcccactaattcaggaatttgagtagagatggggaacaagaacccagatgctgtcccctcaccccctctcctgtatttctcaggtccagttcaaatctaaaattctacttttagagttgaaacagagtaataacttatctaaccctcttttcctacaaaggagaaagataaaaggcacaaaggttaccgccaaggcccgtcagctgtgtagtggcaaagccgagaccgagtctcctaagtccccgtcagtgtggttttcaccacaggactgtctcttgtcgttttcccctaatgccttctcctgccttttctgtgcctagtttttggctcttcacatattccatattgattttgacgctctgtatattggcatcaggtggcagctgaatatcttttgaattactcgaaggtaaagccagatgccagaatgaaggtgtagccagtgtttcccatatgcccctggagccccacttattgaggccagcagaataggtgcagagatgaagtgagcttagagatgttgcaaatgctctttatcccttcagctctctgatctgctctttcttcatgatacttagtctgcagggcatattaagatcatcccagaggttcaggcagttcctgtcatctctgaaaagactgggggatatgaaatcttccccctaccccacttaatgcgttggatatgatttttcaaagaatgcttcatgcccaaaataccagcctgtttagcagtgttacactgtttgatctgcgggcacttgttgcattgcctggcacccaatattcagggtccatgactaagactggtcttctcagatgccctgcttaaatcaggggcacttcaggctccacaggcgtcatgttggactgagacctaactcactggactcagaggaggaatcgtggaaaacaagagcaaaactaccccacacccctatttcatgtctgaaataaccctgtttcataccagttgcaaagcttgtggggagcggtcccacaaagcactttcttaaaccttgagaatctccaagagaaaaatatttggggaaggagggaggaaatatgtcccttgcacaccacccctgaagcacatggcagtagggaaacagcataggattgtatgtgggaggtggataggtcggtgatgtgtggagcggaaaagcaggttggtaaagttcccttcttgggacttattcctggagtcagtggatacaagtagtgcagaaggttcacactgcaaatagtgttctcatctcaaagcaaactatcattccagaaggaaaaccccgaaacaaggcttctctcagcctccccaccagtgatggataacagctcctattctcagctgacctgactgagccaacccatgaactcttcactccttggggaagccacctcccatcacacccctgagcagagttagggaggaattctacttcccataaaaggacctctcctgagaggcaaaacctgttgcctccaccacggcttccctcttggctcattccaagcttggccaaattggggaagtgggatggaggttgccctgcatcccccctcctctgcctgagtgtgtctttgtaatgtcagctggcatcatacaaagagcaggagaagcaaacacccagaactcttttgctggtcagagattccctgagtgtctgtcctcacccaagcctgctctgtgtctgtgttgtgaagcttgagactctggaaagaaatggggagggggggcaggggaaatgttgccctaagaatgcttctcattcctctgttcttattgggtcctgtttttcgggagggtgggggttgggggaagcttgaccttgtgtcttcgtcaataaactcacatttacacaaaa

SEQ ID NO: 366099 - DNA, 5312 bp, Homo sapiens
acgtcagagtttcctgcccaccatctttgtccctggcaaagtgggttttgcgcagtggcttagacctagaaaagaatcgtgacgggcaggaaaccattacaccaccacctgggctgtgctctccggctcccgccgccacccccgccctcgccttcgcctccgcctccggtgcacattaaagatccaaagtcatgactgactccaagtatttcacaaccaataaaaaaggagaaatatttgaactaaaagctgaactcaacaatgaaaagaaagaaaagagaaaggaggctgtgaagaaagtgattgctgctatgaccgtggggaaggatgttagttctctctttccagacgtagtgaactgtatgcagactgacaatctggaactaaagaagcttgtgtatctctacttgatgaactacgccaagagtcagccagacatggccatcatggctgtaaacagctttgtgaaggactgtgaagatcctaatcctttgattcgagccttggcagtcagaaccatggggtgcatccgggtagacaaaattacagaatatctctgtgagccgctccgcaagtgcttgaaggatgaggatccctatgttcggaaaacagcagcagtctgcgtggcaaaactccatgatatcaatgcccaaatggtggaagatcagggatttctggattctctacgggatctcatagcagattcaaatccaatggtggtggctaatgccgtagcggcattatctgaaatcagtgagtctcacccaaacagcaacttacttgatctgaacccacagaacattaataagctgctgacagccctgaatgaatgcactgaatggggccagattttcatcctggactgcctgtctaattacaaccctaaagatgatcgggaggctcagagcatctgtgagcgggtaactccccggctatcccatgccaactcagcagtggtgctttcagcggtaaaagtcctaatgaagtttctagaattgttacctaaggattctgactactacaatatgctgctgaagaagttagcccctccacttgtcactttgctgtctggggagccagaagtgcagtatgtcgccctgaggaacatcaacttaattgtccagaaaaggcctgaaatcttgaagcaggaaatcaaagtcttctttgtgaagtacaatgatcccatctatgttaaactagagaagttggacatcatgattcgtttggcatctcaagccaacattgctcaggttctggcagaactgaaagaatatgctacagaggtggatgttgactttgttcgaaaagctgtgcgggccattggacggtgtgccatcaaggtggagcaatctgcagagcgctgtgtaagcacattgcttgatctaatccagaccaaagtgaattatgtggtccaagaagcaattgttgtcatcagggacatcttccgcaaataccccaacaagtatgaaagtatcatcgccactctgtgtgagaacttagactcgctggatgagccagatgctcgagcagctatgatttggattgtgggagaatatgctgaaagaattgacaatgcagatgagttactagaaagcttcctggagggttttcacgatgaaagcacccaggtgcagctcactctgcttactgccatagtgaagctgtttctcaagaaaccatcagaaacacaggagctagtccagcaggtcttgagtttggcaacacaggattctgataatcctgaccttcgagaccggggctatatttattggcgccttctctcaactgaccctgttacagctaaagaagtagtcttgtctgagaagccactgatctctgaggagacggaccttattgagccaactctgctggatgagctaatctgccacattggttctttggcctctgtgtatcataagcctcccaatgcttttgtggaaggaagtcatggaattcatcgtaaacacttgccaattcatcatgggagcactgatgcaggtgacagccctgttggcactaccactgcaacgaacctggaacagcctcaggttatcccctctcaaggtgatcttctaggggatcttttaaaccttgacctcggtcccccagtcaatgtgccacaggtgtcctccatgcagatgggagcagtggatctcctaggaggaggactagatagtctgcttggcagtgaccttggcgggggcattggaggaagtccggcagtgggacaatccttcatcccatcatcggtgcctgcaacctttgctccttcacctacacctgctgtggtcagcagtggactgaatgacctgtttgaactctccacagggataggcatggcacctggtggatatgtggctcctaaggctgtctggctacctgcagtaaaggctaaaggcttggagatttccggaacatttactcaccgccaagggcacatctatatggaaatgaacttcaccaataaagctctgcagcacatgacagattttgcaatccagtttaacaaaaatagctttggtgtcatccccagcactcctctggccatccatacaccactgatgccaaaccagagcattgatgtctccctgcctctcaataccttgggcccagtcatgaagatggaacctctgaataacctccaggtggctgtgaaaaacaatatcgatgtcttctacttcagctgcctcatcccactcaatgtgctttttgtagaagatggcaaaatggagcgccaggtcttccttgcaacatggaaggatattcccaatgaaaatgaacttcagtttcagattaaggaatgtcatttaaatgctgacactgtttccagcaagttgcaaaacaacaatgtttatactattgccaagaggaatgtggaagggcaggacatgctgtaccaatccctgaagctcactaatggcatttggattttggccgaactacgtatccagccaggaaaccccaattacacgctgtcactgaagtgtagagctcctgaagtctctcaatacatctatcaggtctacgacagcattttgaaaaactaacaagactggtccagtacccttcaaccatgctgtgatcggtgcaagtcaagaactcttaactggaagaaattgtattgctgcgtagaatctgaacacactgaggccacctagcaaggtagtaactagtctaacctgtgctaacattagggcacaacctgttggatagttttagcttcctgtgaacatttgtaaccactgcttcagtcacctcccacctcttgccacctgctgctgctatctgtccttacttgtgggcttctccatgctgtgccaatggctggctttttctacaccctcttttgagtgtagtttggtattttgtaattgagagctcatttcaaaagcagaaaaagacaacaaatattaaagcaaggaaaagtgtaactgaaacactgcactttactgttttatacttttgtacatatgagaaatcaagggattagtgcaaccagtagaaagcattgaaatgactgtcattaaccacacagtcctggaggcagagatgcagttacctaccctagcttttgatgggttctcttacctgtagtagccttatccctggtcatttggattttcagtttgcttttttctttttttcccctccaaactccttttccttggccaagccttcatgcttccccctttccatattataatctcatttgattgctctgcagttgggaacggtgatcttcttgaatgatgtttcagtgtgcaaaaactatagagcctgtcagcaccaaagctgacagaagttataccttactcctttcctttcccctgaacaaacctgctaatcccactaattcaggaatttgagtagagatggggaacaagaacccagatgctgtcccctcaccccctctcctgtatttctcaggtccagttcaaatctaaaattctacttttagagttgaaacagagtaataacttatctaaccctcttttcctacaaaggagaaagataaaaggcacaaaggttaccgccaaggcccgtcagctgtgtagtggcaaagccgagaccgagtctcctaagtccccgtcagtgtggttttcaccacaggactgtctcttgtcgttttcccctaatgccttctcctgccttttctgtgcctagtttttggctcttcacatattccatattgattttgacgctctgtatattggcatcaggtggcagctgaatatcttttgaattactcgaaggtaaagccagatgccagaatgaaggtgtagccagtgtttcccatatgcccctggagccccacttattgaggccagcagaataggtgcagagatgaagtgagcttagagatgttgcaaatgctctttatcccttcagctctctgatctgctctttcttcatgatacttagtctgcagggcatattaagatcatcccagaggttcaggcagttcctgtcatctctgaaaagactgggggatatgaaatcttccccctaccccacttaatgcgttggatatgatttttcaaagaatgcttcatgcccaaaataccagcctgtttagcagtgttacactgtttgatctgcgggcacttgttgcattgcctggcacccaatattcagggtccatgactaagactggtcttctcagatgccctgcttaaatcaggggcacttcaggctccacaggcgtcatgttggactgagacctaactcactggactcagaggaggaatcgtggaaaacaagagcaaaactaccccacacccctatttcatgtctgaaataaccctgtttcataccagttgcaaagcttgtggggagcggtcccacaaagcactttcttaaaccttgagaatctccaagagaaaaatatttggggaaggagggaggaaatatgtcccttgcacaccacccctgaagcacatggcagtagggaaacagcataggattgtatgtgggaggtggataggtcggtgatgtgtggagcggaaaagcaggttggtaaagttcccttcttgggacttattcctggagtcagtggatacaagtagtgcagaaggttcacactgcaaatagtgttctcatctcaaagcaaactatcattccagaaggaaaagtgtgtcagggcaagcagacaacacaatttcctatcagaatatgtccctcaacccccgaaacaaggcttctctcagcctccccaccagtgatggataacagctcctattctcagctgacctgactgagccaacccatgaactcttgcttcatgttggttgggatcctctagatcaccgcca

SEQ ID NO: 366100 - DNA, 5173 bp, Homo sapiens
acgtcagagtttcctgcccaccatctttgtccctggcaaagtgggttttgcgcagtggcttagacctagaaaagaatcgtgacgggcaggaaaccattacaccaccacctgggctgtgctctccggctcccgccgccacccccgccctcgccttcgcctccgcctccggtgcacattaaagatccaaagtcatgactgactccaagtatttcacaaccaataaaaaaggagaaatatttgaactaaaagctgaactcaacaatgaaaagaaagaaaagagaaaggaggctgtgaagaaagtgattgctgctatgaccgtggggaaggatgttagttctctctttccagacgtagtgaactgtatgcagactgacaatctggaactaaagaagcttgtgtatctctacttgatgaactacgccaagagtcagccagacatggccatcatggctgtaaacagctttgtgaaggactgtgaagatcctaatcctttgattcgagccttggcagtcagaaccatggggtgcatccgggtagacaaaattacagaatatctctgtgagccgctccgcaagtgcttgaaggatgaggatccctatgttcggaaaacagcagcagtctgcgtggcaaaactccatgatatcaatgcccaaatggtggaagatcagggatttctggattctctacgggatctcatagcagattcaaatccaatggtggtggctaatgccgtagcggcattatctgaaatcagtgagtctcacccaaacagcaacttacttgatctgaacccacagaacattaataagctgctgacagccctgaatgaatgcactgaatggggccagattttcatcctggactgcctgtctaattacaaccctaaagatgatcgggaggctcagagcatctgtgagcgggtaactccccggctatcccatgccaactcagcagtggtgctttcagcggtaaaagtcctaatgaagtttctagaattgttacctaaggattctgactactacaatatgctgctgaagaagttagcccctccacttgtcactttgctgtctggggagccagaagtgcagtatgtcgccctgaggaacatcaacttaattgtccagaaaaggcctgaaatcttgaagcaggaaatcaaagtcttctttgtgaagtacaatgatcccatctatgttaaactagagaagttggacatcatgattcgtttggcatctcaagccaacattgctcaggttctggcagaactgaaagaatatgctacagaggtggatgttgactttgttcgaaaagctgtgcgggccattggacggtgtgccatcaaggtggagcaatctgcagagcgctgtgtaagcacattgcttgatctaatccagaccaaagtgaattatgtggtccaagaagcaattgttgtcatcagggacatcttccgcaaataccccaacaagtatgaaagtatcatcgccactctgtgtgagaacttagactcgctggatgagccagatgctcgagcagctatgatttggattgtgggagaatatgctgaaagaattgacaatgcagatgagttactagaaagcttcctggagggttttcacgatgaaagcacccaggtgcagctcactctgcttactgccatagtgaagctgtttctcaagaaaccatcagaaacacaggagctagtccagcaggtcttgagtttggcaacacaggattctgataatcctgaccttcgagaccggggctatatttattggcgccttctctcaactgaccctgttacagctaaagaagtagtcttgtctgagaagccactgatctctgaggagacggaccttattgagccaactctgctggatgagctaatctgccacattggttctttggcctctgtgtatcataagcctcccaatgcttttgtggaaggaagtcatggaattcatcgtaaacacttgccaattcatcatgggagcactgatgcaggtgacagccctgttggcactaccactgcaacgaacctggaacagcctcaggttatcccctctcaaggtgatcttctaggggatcttttaaaccttgacctcggtcccccagtcaatgtgccacaggtgtcctccatgcagatgggagcagtggatctcctaggaggaggactagatagtctgcttggcagtgaccttggcgggggcattggaggaagtccggcagtgggacaatccttcatcccatcatcggtgcctgcaacctttgctccttcacctacacctgctgtggtcagcagtggactgaatgacctgtttgaactctccacagggataggcatggcacctggtggatatgtggctcctaaggctgtctggctacctgcagtaaaggctaaaggcttggagatttccggaacatttactcaccgccaagggcacatctatatggaaatgaacttcaccaataaagctctgcagcacatgacagattttgcaatccagtttaacaaaaatagctttggtgtcatccccagcactcctctggccatccatacaccactgatgccaaaccagagcattgatgtctccctgcctctcaataccttgggcccagtcatgaagatggaacctctgaataacctccaggtggctgtgaaaaacaatatcgatgtcttctacttcagctgcctcatcccactcaatgtgctttttgtagaagatggcaaaatggagcgccaggtcttccttgcaacatggaaggatattcccaatgaaaatgaacttcagtttcagattaaggaatgtcatttaaatgctgacactgtttccagcaagttgcaaaacaacaatgtttatactattgccaagaggaatgtggaagggcaggacatgctgtaccaatccctgaagctcactaatggcatttggattttggccgaactacgtatccagccaggaaaccccaattacacgctgtcactgaagtgtagagctcctgaagtctctcaatacatctatcaggtctacgacagcattttgaaaaactaacaagactggtccagtacccttcaaccatgctgtgatcggtgcaagtcaagaactcttaactggaagaaattgtattgctgcgtagaatctgaacacactgaggccacctagcaaggtagtaactagtctaacctgtgctaacattagggcacaacctgttggatagttttagcttcctgtgaacatttgtaaccactgcttcagtcacctcccacctcttgccacctgctgctgctatctgtccttacttgtgggcttctccatgctgtgccaatggctggctttttctacaccctcttttgagtgtagtttggtattttgtaattgagagctcatttcaaaagcagaaaaagacaacaaatattaaagcaaggaaaagtgtaactgaaacactgcactttactgttttatacttttgtacatatgagaaatcaagggattagtgcaaccagtagaaagcattgaaatgactgtcattaaccacacagtcctggaggcagagatgcagttacctaccctagcttttgatgggttctcttacctgtagtagccttatccctggtcatttggattttcagtttgcttttttctttttttcccctccaaactccttttccttggccaagccttcatgcttccccctttccatattataatctcatttgattgctctgcagttgggaacggtgatcttcttgaatgatgtttcagtgtgcaaaaactatagagcctgtcagcaccaaagctgacagaagttataccttactcctttcctttcccctgaacaaacctgctaatcccactaattcaggaatttgagtagagatggggaacaagaacccagatgctgtcccctcaccccctctcctgtatttctcaggtccagttcaaatctaaaattctacttttagagttgaaacagagtaataacttatctaaccctcttttcctacaaaggagaaagataaaaggcacaaaggttaccgccaaggcccgtcagctgtgtagtggcaaagccgagaccgagtctcctaagtccccgtcagtgtggttttcaccacaggactgtctcttgtcgttttcccctaatgccttctcctgccttttctgtgcctagtttttggctcttcacatattccatattgattttgacgctctgtatattggcatcaggtggcagctgaatatcttttgaattactcgaaggtaaagccagatgccagaatgaaggtgtagccagtgtttcccatatgcccctggagccccacttattgaggccagcagaataggtgcagagatgaagtgagcttagagatgttgcaaatgctctttatcccttcagctctctgatctgctctttcttcatgatacttagtctgcagggcatattaagatcatcccagaggttcaggcagttcctgtcatctctgaaaagactgggggatatgaaatcttccccctaccccacttaatgcgttggatatgatttttcaaagaatgcttcatgcccaaaataccagcctgtttagcagtgttacactgtttgatctgcgggcacttgttgcattgcctggcacccaatattcagggtccatgactaagactggtcttctcagatgccctgcttaaatcaggggcacttcaggctccacaggcgtcatgttggactgagacctaactcactggactcagaggaggaatcgtggaaaacaagagcaaaactaccccacctttttgtacaaaacacaaggagaaacaaataaaaaagaagataaagatagataaatacagcagataaaattaagagggcacataacgattacattacgcacaatcggtaatacagctacataccaacaattactatggagaatgaccgcatacggttaatcaatacgtacgtgcactgcgggccgtacatcgcaagatgtcatctacagctcttgttcaccacggaaagtaatgtggatccccttgcttttacgttgggtccaaatgtcactcgcacttggtccagctcatgctattaaatcccaatttagcagtcacgcatactgttgtagcgagcatttcgggggacacacctgcccacagtggggcatacaaagccaagcgcaacctacaag

SEQ ID NO: 366101 - DNA, 2874 bp, Homo sapiens
acgtcagagtttcctgcccaccatctttgtccctggcaaagtgggttttgcgcagtggcttagacctagaaaagaatcgtgacgggcaggaaaccattacaccaccacctgggctgtgctctccggctcccgccgccacccccgccctcgccttcgcctccgcctccggtgcacattaaagatccaaagtcatgactgactccaagtatttcacaaccaataaaaaaggagaaatatttgaactaaaagctgaactcaacaatgaaaagaaagaaaagagaaaggaggctgtgaagaaagtgattgctgctatgaccgtggggaaggatgttagttctctctttccagacgtagtgaactgtatgcagactgacaatctggaactaaagaagcttgtgtatctctacttgatgaactacgccaagagtcagccagacatggccatcatggctgtaaacagctttgtgaaggactgtgaagatcctaatcctttgattcgagccttggcagtcagaaccatggggtgcatccgggtagacaaaattacagaatatctctgtgagccgctccgcaagtgcttgaaggatgaggatccctatgttcggaaaacagcagcagtctgcgtggcaaaactccatgatatcaatgcccaaatggtggaagatcagggatttctggattctctacgggatctcatagcagattcaaatccaatggtggtggctaatgccgtagcggcattatctgaaatcagtgagtctcacccaaacagcaacttacttgatctgaacccacagaacattaataagctgctgacagccctgaatgaatgcactgaatggggccagattttcatcctggactgcctgtctaattacaaccctaaagatgatcgggaggctcagagcatctgtgagcgggtaactccccggctatcccatgccaactcagcagtggtgctttcagcggtaaaagtcctaatgaagtttctagaattgttacctaaggattctgactactacaatatgctgctgaagaagttagcccctccacttgtcactttgctgtctggggagccagaagtgcagtatgtcgccctgaggaacatcaacttaattgtccagaaaaggcctgaaatcttgaagcaggaaatcaaagtcttctttgtgaagtacaatgatcccatctatgttaaactagagaagttggacatcatgattcgtttggcatctcaagccaacattgctcaggttctggcagaactgaaagaatatgctacagaggtggatgttgactttgttcgaaaagctgtgcgggccattggacggtgtgccatcaaggtggagcaatctgcagagcgctgtgtaagcacattgcttgatctaatccagaccaaagtgaattatgtggtccaagaagcaattgttgtcatcagggacatcttccgcaaataccccaacaagtatgaaagtatcatcgccactctgtgtgagaacttagactcgctggatgagccagatgctcgagcagctatgatttggattgtgggagaatatgctgaaagaattgacaatgcagatgagttactagaaagcttcctggagggttttcacgatgaaagcacccaggtgcagctcactctgcttactgccatagtgaagctgtttctcaagaaaccatcagaaacacaggagctagtccagcaggtcttgagtttggcaacacaggattctgataatcctgaccttcgagaccggggctatatttattggcgccttctctcaactgaccctgttacagctaaagaagtagtcttgtctgagaagccactgatctctgaggagacggaccttattgagccaactctgctggatgagctaatctgccacattggttctttggcctctgtgtatcataagcctcccaatgcttttgtggaaggaagtcatggaattcatcgtaaacacttgccaattcatcatgggagcactgatgcaggtgacagccctgttggcactaccactgcaacgaacctggaacagcctcaggttatcccctctcaaggtgatcttctaggggatcttttaaaccttgacctcggtcccccagtcaatgtgccacaggtgtcctccatgcagatgggagcagtggatctcctaggaggaggactagatagtctggtaagcatctttcttcccttgttcttttggttatttttagttcttgatatgctagagagttttaaattattcagctttttagaactagacctttccttgatgagcagtagtgtcctttgataaaggacaggattctttgtctttagtaagacaaaattataattaatactgttcatcatcggtaatggggtatgtctgcaagtgtatgggattatttcattgtcctgcctctaaatagaacttttgacatttaaccatcctattgttcagcaattttaatgtttagtatcttttccagagtttattattgttcctagctcttaactctggatagcccacataaattctccttttgacctgaacggcattaaagtgacctcacacaaatcatcctattttgaggctttcaaacctttgcctttttaatattttatttacttatgccctaattctgaaaggttttgaggcagcctttttttttcttcttcttctttttttttttttaagtaaaatgtacctttattacagttgggaagggctgcttgattggttctttttttcccttcttccccacctactccattctatcatacttccaatttaattagcttccaggattctaatactaaaaggctccaaagtccagaatacctgcgaacatttgccaccaatgggaaccaaaattattttttgt

SEQ ID NO: 366102 - DNA, 405 bp, Homo sapiens
cttggcagtgaccttggcgggggcattggaggaagtccggcagtaagtgccatctgtttttttcaccatgagaagcactgccccctgtttgatgcctttcctatgtacacattatcagaccagccactgctgctgtctagcactgcacaccaaaacctctataacagtatatgggtagtagaaagtagtatagggttacttggaattgttggggtcatgcaccacatggtgtagagacatctttaaggtttaatgttccagtgcctatagagatctttgtctttctgatattaaagagctaaaggaaatggacccttccatcttgactggagaatgcttattccctggtgtcacctagaaagaacttgagagggtcagctggactcagagtgagactctcctcgt

SEQ ID NO: 366103 - DNA, 1071 bp, Homo sapiens
caagggaggcaggcctagctgggacggagaaaaacactgttgggggagatgcagtgtaggctccatatgggaagtaacagggaactaccacaggttcttgagcaagggagtgacaagatagaatccgaaattttgtatctgactgagcctgtagaccaggatgtatggggttggggtgggggcggcactaggaaactacttcttccatctgctaccatttagcccacaaaccgtgagcaaagcctggggctggatgtggttgagccagcggaggcaggcccggggctgtcctggtggagaagggtgtgagggctgcaggtgtgcagcaatggagaggatagtgctggccctacttgctgggaggaagggacagtggtggctctaggctggggagctctgagggaggtgccctgctctgaggaggcacagctacacattgtggaggcctgatctgagacgggagacatggcaggaccctcaggttgagccccccaagccacaaacactgggggagcttttccagggcgagcagaggccagaactgaagcgggggccgcggctccatggccagccccctctgaggtgatcacacctgcagagacgaggaggagctgagacgctctctgtctgagttggccgaccccaaccccaaggtcatcaagcggatcagcgggggcagtggcagtggctccagccctttcctggacctgactcccgagcctggggctgccgtctacaagcacggggccctggtgcgaaaggtgcacgcagaccctgactgcaggaagacacctcggggcaagcggggctggaagagcttccacgggatcctcaagggcatgatcctctacctgcagaaggaggagtacaagcctgggaaggccctttcagagacggagctcaagaatgccatcagcatccaccatgccctggccactcgtgccagtgactacagcaagaggccccacgtcttctacctgcgcacagctgactggcgggtcttcctcttccaggccccgtgagtgccctcctcctgcccatcccggaccccttcccccacctcccatcctg

SEQ ID NO: 366104 - DNA, 551 bp, Homo sapiens
agtgcgacaaatctggcgctgtccccttcagcaccacgcggagtccgcgccgcccctccccgcggtgagccccgcgcgcccccgcctcgcacgtcctcgcgccccctgactgcccgaacagaccccttcttccttccgaggtcaccatctgcccgccctggccctcccaaagagagtagttgccatagtaactccagcggctctttcttaaaatagcagggcccccttctaccctggccaagggcacaagggttgccggtcccccacgtcttccggtccctagttcatcccgtctaacctcttacccctgggcaggcgtgacgacacctaactcaggcagcaaggaagttcttcctgaagtctgatttaacatccccctgctgcatcctgggagggtggtcagggttggatctcctgggtccgagactcaaaacccctggcgggttcaagacggtgttccctagatctcctttccatagttgatggtctcctggatttagggggcgggtccagtctacacccataccgtgtgcttggcgcggccgcgtgct

SEQ ID NO: 366105 - DNA, 4938 bp, Homo sapiens
ggcgtagggcttctctagcaaccctctttcttcagattttgcatgtctccaagaaaaaacaacttgaaatttcttgaacacacagtttacttgttcatatctttaactatgctgttctcttttatctacaatgccatctatctcttccactgaaaacttccatttattcctcaaaatcctgctcaggtgctagcatatctgtgaagcgttctctgacctgttcctgaagtcaaacattccctcctcggtaatatttccatactttaaacttactattattgatggactccaaaaaaattctctttattgttgtgtctagccctatgatcctgatttcaagatcctgaaagacaagtttctatcccttacaaataccacaggacctggcacatagaagacacatttattgactcagtgttttcttcatgtttacattcttcaagtacacagctgtctatgcagtgaaaaatgtgctctacaagtagaaaaagaaatatgtgaagtgcacaatagacaatcctcaattcccataatgcagatgtgcatgagcaattattagcagttcaaagttgtttcattacggtaagtactattctaacaaactaactgccccaaccaattttgtctaggaagcatatatggttttaaagtgttgatttacgccagctgggcatggtgcttacgcctgcaatcccagcactttgggaggccaggcgggcggatcacaaggtcaagagatcgagaccatcctggccaacgtagtgaaaccccatctctattaaaaatacaaaaactagctgcgagtggtggcgcacgcctgtagtcccagctactcgaggccgggaactgggacgtgtgacagcaccctgtacacctctgcgtggccccccctcaccccgtgttgctccctcaccctgggcaccctcttcacccactgggcagcccccacccggggcccagagctctgtggtcatcttccgctttgtggagaaggccagtgtgaggccactgaatgggctacctgctccagggggcttgagtcggagctgggatctgggtggggtttctcctcccaggcccaccccagcccttgggcctggctccaaccggaagttacggctggaagcatccacatcagacccactccccgccagaggaggctcggccctacctggcagccggaaccttgtacatgggccgccagccccaccccaggttggagcagatggcctttactcctctctccccaatgggctggggggcccccctgagcgcctggccacactcttcggaggacctgctgacactggattcctgaaccagggggatacctggtcctccccccgggaagtctcctctcatgcccagagaatcgctagagccaaatgggaattcttctatggctccttggacccccccagctcaggtgctaagcccccagagcaggcccccccatctccacctggggtgggctcaaggcagggctctggggtggctgtggggcgagcagccaagtactccgagacagacctggacacggtgcccctgaggtgctaccgcgagactgacatcgatgaggtgctggctgagcgggaggaggccgactcggccatcgaaagtcagcccagctctgagggcccaccaggcactgcctacccacctgccccacggcccggcccactccctggccctcatcccagcctcggcagtggcaatgaggatgaggacgacgatgaggcaggtggggaagaagatgtggacgacgaggtgtttgaggcctctgaaggggcccggccagggagccggatgcctctcaagtcacctgtgccctttctacctgggacgagcccctcggctgatgggcctgactctttcagttgtgtgttcgaagccatcctggagtcacaccgggccaaaggcacctcctataccagcctcgcctcgctggaggccttggcctcacctggcccaacccagagccccttcttcacctttgagctgcctccccaaccccctgcaccccggcccgacccaccagctcccgccccacttacccctcttgaaccggattctggtaccagctctgctgctgatggtccttggacacagagaggggaggaggaggaggcagaggccagagccaagctggccccagggagggagccccctagtccctgccactcagaggacagccttgggctgggggcagcaccccttggcagcgaaccacccctgagccagctggtgtccgactcagactcagagctggacagcacagaccggctggccctgggaagcacagacaccttgtccaatgggcagaaagcggacctggaggctgcgcagcgcctggccaagaggctgtaccgactagatggcttcaggaaggccgatgtggcccggcacctgggcaagaacaatgacttcagcaaactggtggctggggagtacctcaagttctttgtcttcacgggcatgactctggaccaagctctcagggtgtttctgaaggagctggccttaatgggtgagacccaggaacgagagcgcgtgctggcccacttctcccagcgatacttccagtgcaatcctgaagccctgtcctcagaggacggcgcccacacgctgacctgtgcgctcatgctgctcaacacggatctccacggcataacatcgggaagcgcatgacctgcggggacttcatcgggaacctggagggcctcaatgatggcggcgacttccctagggagctgctcaaggccttgtacagctccatcaagaatgagaagctgcagtgggccatagacgaggaggagctgagacgctctctgtctgagttggccgaccccaaccccaaggtcatcaagcggatcagcgggggcagtggcagtggctccagccctttcctggacctgactcccgagcctggggctgccgtctacaagcacggggccctggtgcgaaaggtgcacgcagaccctgactgcaggaagacacctcggggcaagcggggctggaagagcttccacgggatcctcaagggcatgatcctctacctgcagaaggaggagtacaagcctgggaaggccctttcagagacggagctcaagaatgccatcagcatccaccatgccctggccactcgtgccagtgactacagcaagaggccccacgtcttctacctgcgcacagctgactggcgggtcttcctcttccaggccccgagcctggagcagatgcagtcctggatcactcgcatcaatgtagtagccgctatgttctctgcgccccccttcccagctgctgttagctcccaaaagaagttcagccgccctctcctgcccagcgctgccacccgcctctcccaggaggagcaggtgcggacccacgaggccaagctgaaggccatggcaagtgagctgcgggagcaccgggccgcccagctgggcaagaagggccggggcaaggaggctgaagagcagcggcagaaggaggcctacctggagtttgagaaatcccgctacagcacctatgcagcgctgcttcgggtcaagctgaaggcaggcagtgaggagctggatgcagtggaggcagcactggcccaggccgggagcacagaggatggactccctccttctcactccagtccctccctgcagcccaaaccctccagccagccccgggctcagcgtcacagctcagagcctcggccaggggcaggcagtgggcggcggaagccctgagatgaggtttagggtggggagtgcctgctgggcacctgaaggatgacatggccctgcctgagcccgggccggcctcgggccacccacgagggcctcccggcctagggcccgaccgcgccggacgcggtgtccggggcagggcagggctggggcctgggcctcaggagcctaggctaggggcacctccgagagcccctttttgtgataatgttttgcactttttcgtacagggtgggcgggggcgggaggggctagcgcccctgaacttttgatgctttttttttgtgtgggagaggcctgatgccgtttctgctttctgctgagaccacccccaccctgacaccatcagtccccctctgtcctggggcctggcttggacagagaccaggatttggggctgagctggtttcccctccttcctccccaagggcttactctttctcttgctggaggtggaggaagggcgtccatgccaaggccccacggcctggctttcccccgcttcagtgggccttgccctttgtacagcctccacccccattaaaactgctctggacttgcaaaaaaaaacaaaaaaaaaaaaaaaaaaaaaaaaaaaaaaaaaaaaaagagagagggcgcgcgcgcgcgcccccataaatattatctccctccggaggggcgccccattttccgcgcgccgctccaccctgtttttgtgtcacaacgggggcgccccttataggggcgactcctcttatttaatacacccgaggcgccggcggcgccccgcgctgtttataccacaacggtcgctcggaccgcggggagaacaacgcgcgcgctacacctctgtggcgaatatctcttgtgtgatgaacggagaccccccttctctttctgcgggggagtggagacaacacactattgtgggcgccacaacactcactccctctcagccggaacttattttaacgcgccctccaggggtgacaacatcttatacacctcttttaacagagcgagtgtctattagcgcgtgtgtgtcatacacacacctacaggcgcgccgctatttatcgccgctgcgcgcgtgtgtgagatgcaaaatttttgttgagccttctcctgcggcgcctattgtgtgtctttctcggtgacacacatatttttttttactcccacacgcgcgccgcctcctaccgcctatagtaaa

SEQ ID NO: 366106 - DNA, 2599 bp, Homo sapiens
cgctctagccaagccgcagagcagacagcgccgccgccgccgccgcgcactccgtgcgtccgtgagagccgggccggctcgggccgggccgcgccgctcgcgctggctgtcgggggagcggtccgcgggccgtccgggcggcccgggggccgagggcggacgggggcatggccgggggccgcggcgcgccggccgggccagcatgatcggcgtcaacagcatccacagcagcgccgggcggctgcgctcgcgctcgctgtgctccgtgcgctacgggcgcacccaccgcggcgcggagaccctgtgctacggctggccgcagcgctcgcgcagcctcaagcccgtgctctacaccgacctggtggtcagccgcctgcagagccgcaagaagaaaaaggcggccttgtacagctccatcaagaatgagaagctgcagtgggccatagacgaggaggagctgagacgctctctgtctgagttggccgaccccaaccccaaggtcatcaagcggatcagcgggggcagtggcagtggctccagccctttcctggacctgactcccgagcctggggctgccgtctacaagcacggggccctggtgcgaaaggtgcacgcagaccctgactgcaggaagacacctcggggcaagcggggctggaagagcttccacgggatcctcaagggcatgatcctctacctgcagaaggaggagtacaagcctgggaaggccctttcagagacggagctcaagaatgccatcagcatccaccatgccctggccactcgtgccagtgactacagcaagaggccccacgtcttctacctgcgcacagctgactggcgggtcttcctcttccaggccccgagcctggagcagatgcagtcctggatcactcgcatcaatgtagtagccgctatgttctctgcgccccccttcccagctgctgttagctcccaaaagaagttcagccgccctctcctgcccagcgctgccacccgcctctcccaggaggagcaggtgcggacccacgaggccaagctgaaggccatggcaagtgagctgcgggagcaccgggccgcccagctgggcaagaagggccggggcaaggaggctgaagagcagcggcagaaggaggcctacctggagtttgagaaatcccgctacagcacctatgcagcgctgcttcgggtcaagctgaaggcaggcagtgaggagctggatgcagtggaggcagcactggcccaggccgggagcacagaggatggactccctccttctcactccagtccctccctgcagcccaaaccctccagccagccccgggctcagcgtcacagctcagagcctcggccaggggcaggcagtgggcggcggaagccctgagatgaggtttagggtggggagtgcctgctgggcacctgaaggatgacatggccctgcctgagcccgggccggcctcgggccacccacgagggcctcccggcctagggcccgaccgcgccggacgcggtgtccggggcagggcagggctggggcctgggcctcaggagcctaggctaggggcacctccgagagcccctttttgtgataatgttttgcactttttcgtacagggtgggcgggggcgggaggggctagcgcccctgaacttttgatgctttttttttgtgtgggagaggcctgatgccgtttctgctttctgctgagaccacccccaccctgacaccatcagtccccctctgtcctggggcctggcttggacagagaccaggatttggggctgagctggtttcccctccttcctccccaagggcttactctttctcttgctggaggtggaggaagggcgtccatgccaaggccccatacctgggccgggggcagcacggcctggctttcccccgcttcagtgggccttgccctttgtacagcctccacccccattaaaactgctctggacttgcaaaaaaaaacaaaaaaaaaaaaaaaaaaaaaaaaaaaaaaaaaaaaaagagagagggcgcgcgcgcgcgcccccataaatattatctccctccggaggggcgccccattttccgcgcgccgctccaccctgtttttgtgtcacaacgggggcgccccttataggggcgactcctcttatttaatacacccgaggcgccggcggcgccccgcgctgtttataccacaacggtcgctcggaccgcggggagaacaacgcgcgcgctacacctctgtggcgaatatctcttgtgtgatgaacggagaccccccttctctttctgcgggggagtggagacaacacactattgtgggcgccacaacactcactccctctcagccggaacttattttaacgcgccctccaggggtgacaacatcttatacacctcttttaacagagcgagtgtctattagcgcgtgtgtgtcatacacacacctacaggcgcgccgctatttatcgccgctgcgcgcgtgtgtgagatgcaaaatttttgttgagccttctcctgcggcgcctattgtgtgtctttctcggtgacacacatatttttttttactcccacacgcgcgccgcctcctaccgcctatagtaaa

SEQ ID NO: 366107 - DNA, 2432 bp, Homo sapiens
ggccagacatgcaggacctgggaggccaagggccctccaaactcacaggcctccgttcccttccttagaacatcgggaagcgcatgacctgcggggacttcatcgggaacctggagggcctcaatgatggcggcgacttccctagggagctgctcaaggccttgtacagctccatcaagaatgagaagctgcagtgggccatggcgagcagaggccagaactgaagcgggggccgcggctccatggccagccccctctgaggtgatcacacctgcagagacgaggaggagctgagacgctctctgtctgagttggccgaccccaaccccaaggtcatcaagcggatcagcgggggcagtggcagtggctccagccctttcctggacctgactcccgagcctggggctgccgtctacaagcacggggccctggtgcgaaaggtgcacgcagaccctgactgcaggaagacacctcggggcaagcggggctggaagagcttccacgggatcctcaagggcatgatcctctacctgcagaaggaggagtacaagcctgggaaggccctttcagagacggagctcaagaatgccatcagcatccaccatgccctggccactcgtgccagtgactacagcaagaggccccacgtcttctacctgcgcacagctgactggcgggtcttcctcttccaggccccgagcctggagcagatgcagtcctggatcactcgcatcaatgtagtagccgctatgttctctgcgccccccttcccagctgctgttagctcccaaaagaagttcagccgccctctcctgcccagcgctgccacccgcctctcccaggaggagcaggtgcggacccacgaggccaagctgaaggccatggcaagtgagctgcgggagcaccgggccgcccagctgggcaagaagggccggggcaaggaggctgaagagcagcggcagaaggaggcctacctggagtttgagaaatcccgctacagcacctatgcagcgctgcttcgggtcaagctgaaggcaggcagtgaggagctggatgcagtggaggcagcactggcccaggccgggagcacagaggatggactccctccttctcactccagtccctccctgcagcccaaaccctccagccagccccgggctcagcgtcacagctcagagcctcggccaggggcaggcagtgggcggcggaagccctgagatgaggtttagggtggggagtgcctgctgggcacctgaaggatgacatggccctgcctgagcccgggccggcctcgggccacccacgagggcctcccggcctagggcccgaccgcgccggacgcggtgtccggggcagggcagggctggggcctgggcctcaggagcctaggctaggggcacctccgagagcccctttttgtgataatgttttgcactttttcgtacagggtgggcgggggcgggaggggctagcgcccctgaacttttgatgctttttttttgtgtgggagaggcctgatgccgtttctgctttctgctgagaccacccccaccctgacaccatcagtccccctctgtcctggggcctggcttggacagagaccaggatttggggctgagctggtttcccctccttcctccccaagggcttactctttctcttgctggaggtggaggaagggcgtccatgccaaggccccatacctgggccgggggcagcacggcctggctttcccccgcttcagtgggccttgccctttgtacagcctccacccccattaaaactgctctggacttgcaaaaaaaaacaaaaaaaaaaaaaaaaaaaaaaaaaaaaaaaaaaaaaagagagagggcgcgcgcgcgcgcccccataaatattatctccctccggaggggcgccccattttccgcgcgccgctccaccctgtttttgtgtcacaacgggggcgccccttataggggcgactcctcttatttaatacacccgaggcgccggcggcgccccgcgctgtttataccacaacggtcgctcggaccgcggggagaacaacgcgcgcgctacacctctgtggcgaatatctcttgtgtgatgaacggagaccccccttctctttctgcgggggagtggagacaacacactattgtgggcgccacaacactcactccctctcagccggaacttattttaacgcgccctccaggggtgacaacatcttatacacctcttttaacagagcgagtgtctattagcgcgtgtgtgtcatacacacacctacaggcgcgccgctatttatcgccgctgcgcgcgtgtgtgagatgcaaaatttttgttgagccttctcctgcggcgcctattgtgtgtctttctcggtgacacacatatttttttttactcccacacgcgcgccgcctcctaccgcctatagtaaa

SEQ ID NO: 366108 - DNA, 4495 bp, Homo sapiens
agtgcgacaaatctggcgctgtccccttcagcaccacgcggagtccgcgccgcccctccccgcgctcagctgggcccagcctctcctctgtctctcctcggtctcagctctgggcgagcagcggcctgtctgaagagcatgcagcccccttactccccgcctggcctcgccatccctgcccccccagcctgacccccggccccagcatggcccagggtgccatgcgcttctgctcggaaggcgactgtgccatctccccaccacgatgcccacgccgctggctccccgaaggcccggtgccccagagccccccagccagcatgtatggcagcacaggctccttgctacggcgagtggcaggtccaggtcctcgaggccgggaactgggacgtgtgacagcaccctgtacacctctgcgtggccccccctcaccccgtgttgctccctcaccctgggcaccctcttcacccactgggcagcccccacccggggcccagagctctgtggtcatcttccgctttgtggagaaggccagtgtgaggccactgaatgggctacctgctccagggggcttgagtcggagctgggatctgggtggggtttctcctcccaggcccaccccagcccttgggcctggctccaaccggaagttacggctggaagcatccacatcagacccactccccgccagaggaggctcggccctacctggcagccggaaccttgtacatgggccgccagccccaccccaggttggagcagatggcctttactcctctctccccaatgggctggggggcccccctgagcgcctggccacactcttcggaggacctgctgacactggattcctgaaccagggggatacctggtcctccccccgggaagtctcctctcatgcccagagaatcgctagagccaaatgggaattcttctatggctccttggacccccccagctcaggtgctaagcccccagagcaggcccccccatctccacctggggtgggctcaaggcagggctctggggtggctgtggggcgagcagccaagtactccgagacagacctggacacggtgcccctgaggtgctaccgcgagactgacatcgatgaggtgctggctgagcgggaggaggccgactcggccatcgaaagtcagcccagctctgagggcccaccaggcactgcctacccacctgccccacggcccggcccactccctggccctcatcccagcctcggcagtggcaatgaggatgaggacgacgatgaggcaggtggggaagaagatgtggacgacgaggtgtttgaggcctctgaaggggcccggccagggagccggatgcctctcaagtcacctgtgccctttctacctgggacgagcccctcggctgatgggcctgactctttcagttgtgtgttcgaagccatcctggagtcacaccgggccaaaggcacctcctataccagcctcgcctcgctggaggccttggcctcacctggcccaacccagagccccttcttcacctttgagctgcctccccaaccccctgcaccccggcccgacccaccagctcccgccccacttacccctcttgaaccggattctggtaccagctctgctgctgatggtccttggacacagagaggggaggaggaggaggcagaggccagagccaagctggccccagggagggagccccctagtccctgccactcagaggacagccttgggctgggggcagcaccccttggcagcgaaccacccctgagccagctggtgtccgactcagactcagagctggacagcacagaccggctggccctgggaagcacagacaccttgtccaatgggcagaaagcggacctggaggctgcgcagcgcctggccaagaggctgtaccgactagatggcttcaggaaggccgatgtggcccggcacctgggcaagaacaatgacttcagcaaactggtggctggggagtacctcaagttctttgtcttcacgggcatgactctggaccaagctctcagggtgtttctgaaggagctggccttaatgggtgagacccaggaacgagagcgcgtgctggcccacttctcccagcgatacttccagtgcaatcctgaagccctgtcctcagaggacggcgcccacacgctgacctgtgcgctcatgctgctcaacacggatctccacggcataacatcgggaagcgcatgacctgcggggacttcatcgggaacctggagggcctcaatgatggcggcgacttccctagggagctgctcaaggccttgtacagctccatcaagaatgagaagctgcagtgggccatagacgaggaggagctgagacgctctctgtctgagttggccgaccccaaccccaaggtcatcaagcggatcagcgggggcagtggcagtggctccagccctttcctggacctgactcccgagcctggggctgccgtctacaagcacggggccctggtgcgaaaggtgcacgcagaccctgactgcaggaagacacctcggggcaagcggggctggaagagcttccacgggatcctcaagggcatgatcctctacctgcagaaggaggagtacaagcctgggaaggccctttcagagacggagctcaagaatgccatcagcatccaccatgccctggccactcgtgccagtgactacagcaagaggccccacgtcttctacctgcgcacagctgactggcgggtcttcctcttccaggccccgagcctggagcagatgcagtcctggatcactcgcatcaatgtagtagccgctatgttctctgcgccccccttcccagctgctgttagctcccaaaagaagttcagccgccctctcctgcccagcgctgccacccgcctctcccaggaggagcaggtgcggacccacgaggccaagctgaaggccatggcaagtgagctgcgggagcaccgggccgcccagctgggcaagaagggccggggcaaggaggctgaagagcagcggcagaaggaggcctacctggagtttgagaaatcccgctacagcacctatgcagcgctgcttcgggtcaagctgaaggcaggcagtgaggagctggatgcagtggaggcagcactggcccaggccgggagcacagaggatggactccctccttctcactccagtccctccctgcagcccaaaccctccagccagccccgggctcagcgtcacagctcagagcctcggccaggggcaggcagtgggcggcggaagccctgagatgaggtttagggtggggagtgcctgctgggcacctgaaggatgacatggccctgcctgagcccgggccggcctcgggccacccacgagggcctcccggcctagggcccgaccgcgccggacgcggtgtccggggcagggcagggctggggcctgggcctcaggagcctaggctaggggcacctccgagagcccctttttgtgataatgttttgcactttttcgtacagggtgggcgggggcgggaggggctagcgcccctgaacttttgatgctttttttttgtgtgggagaggcctgatgccgtttctgctttctgctgagaccacccccaccctgacaccatcagtccccctctgtcctggggcctggcttggacagagaccaggatttggggctgagctggtttcccctccttcctccccaagggcttactctttctcttgctggaggtggaggaagggcgtccatgccaaggccccatacctgggccgggggcagcacggcctggctttcccccgcttcagtgggccttgccctttgtacagcctccacccccattaaaactgctctggacttgcaaaaaaaaacaaaaaaaaaaaaaaaaaaaaaaaaaaaaaaaaaaaaaagagagagggcgcgcgcgcgcgcccccataaatattatctccctccggaggggcgccccattttccgcgcgccgctccaccctgtttttgtgtcacaacgggggcgccccttataggggcgactcctcttatttaatacacccgaggcgccggcggcgccccgcgctgtttataccacaacggtcgctcggaccgcggggagaacaacgcgcgcgctacacctctgtggcgaatatctcttgtgtgatgaacggagaccccccttctctttctgcgggggagtggagacaacacactattgtgggcgccacaacactcactccctctcagccggaacttattttaacgcgccctccaggggtgacaacatcttatacacctcttttaacagagcgagtgtctattagcgcgtgtgtgtcatacacacacctacaggcgcgccgctatttatcgccgctgcgcgcgtgtgtgagatgcaaaatttttgttgagccttctcctgcggcgcctattgtgtgtctttctcggtgacacacatatttttttttactcccacacgcgcgccgcctcctaccgcctatagtaaa

SEQ ID NO: 366109 - DNA, 4492 bp, Homo sapiens
agcgggagggactgagaggcgggcgggcctggagcaaacgggagccgcgctgccttcacagctcagctgggcccagcctctcctctgtctctcctcggtctcagctctgggcgagcagcggcctgtctgaagagcatgcagcccccttactccccgcctggcctcgccatccctgcccccccagcctgacccccggccccagcatggcccagggtgccatgcgcttctgctcggaaggcgactgtgccatctccccaccacgatgcccacgccgctggctccccgaaggcccggtgccccagagccccccagccagcatgtatggcagcacaggctccttgctacggcgagtggcaggtccaggtcctcgaggccgggaactgggacgtgtgacagcaccctgtacacctctgcgtggccccccctcaccccgtgttgctccctcaccctgggcaccctcttcacccactgggcagcccccacccggggcccagagctctgtggtcatcttccgctttgtggagaaggccagtgtgaggccactgaatgggctacctgctccagggggcttgagtcggagctgggatctgggtggggtttctcctcccaggcccaccccagcccttgggcctggctccaaccggaagttacggctggaagcatccacatcagacccactccccgccagaggaggctcggccctacctggcagccggaaccttgtacatgggccgccagccccaccccaggttggagcagatggcctttactcctctctccccaatgggctggggggcccccctgagcgcctggccacactcttcggaggacctgctgacactggattcctgaaccagggggatacctggtcctccccccgggaagtctcctctcatgcccagagaatcgctagagccaaatgggaattcttctatggctccttggacccccccagctcaggtgctaagcccccagagcaggcccccccatctccacctggggtgggctcaaggcagggctctggggtggctgtggggcgagcagccaagtactccgagacagacctggacacggtgcccctgaggtgctaccgcgagactgacatcgatgaggtgctggctgagcgggaggaggccgactcggccatcgaaagtcagcccagctctgagggcccaccaggcactgcctacccacctgccccacggcccggcccactccctggccctcatcccagcctcggcagtggcaatgaggatgaggacgacgatgaggcaggtggggaagaagatgtggacgacgaggtgtttgaggcctctgaaggggcccggccagggagccggatgcctctcaagtcacctgtgccctttctacctgggacgagcccctcggctgatgggcctgactctttcagttgtgtgttcgaagccatcctggagtcacaccgggccaaaggcacctcctataccagcctcgcctcgctggaggccttggcctcacctggcccaacccagagccccttcttcacctttgagctgcctccccaaccccctgcaccccggcccgacccaccagctcccgccccacttacccctcttgaaccggattctggtaccagctctgctgctgatggtccttggacacagagaggggaggaggaggaggcagaggccagagccaagctggccccagggagggagccccctagtccctgccactcagaggacagccttgggctgggggcagcaccccttggcagcgaaccacccctgagccagctggtgtccgactcagactcagagctggacagcacagaccggctggccctgggaagcacagacaccttgtccaatgggcagaaagcggacctggaggctgcgcagcgcctggccaagaggctgtaccgactagatggcttcaggaaggccgatgtggcccggcacctgggcaagaacaatgacttcagcaaactggtggctggggagtacctcaagttctttgtcttcacgggcatgactctggaccaagctctcagggtgtttctgaaggagctggccttaatgggtgagacccaggaacgagagcgcgtgctggcccacttctcccagcgatacttccagtgcaatcctgaagccctgtcctcagaggacggcgcccacacgctgacctgtgcgctcatgctgctcaacacggatctccacggcataacatcgggaagcgcatgacctgcggggacttcatcgggaacctggagggcctcaatgatggcggcgacttccctagggagctgctcaaggccttgtacagctccatcaagaatgagaagctgcagtgggccatagacgaggaggagctgagacgctctctgtctgagttggccgaccccaaccccaaggtcatcaagcggatcagcgggggcagtggcagtggctccagccctttcctggacctgactcccgagcctggggctgccgtctacaagcacggggccctggtgcgaaaggtgcacgcagaccctgactgcaggaagacacctcggggcaagcggggctggaagagcttccacgggatcctcaagggcatgatcctctacctgcagaaggaggagtacaagcctgggaaggccctttcagagacggagctcaagaatgccatcagcatccaccatgccctggccactcgtgccagtgactacagcaagaggccccacgtcttctacctgcgcacagctgactggcgggtcttcctcttccaggccccgagcctggagcagatgcagtcctggatcactcgcatcaatgtagtagccgctatgttctctgcgccccccttcccagctgctgttagctcccaaaagaagttcagccgccctctcctgcccagcgctgccacccgcctctcccaggaggagcaggtgcggacccacgaggccaagctgaaggccatggcaagtgagctgcgggagcaccgggccgcccagctgggcaagaagggccggggcaaggaggctgaagagcagcggcagaaggaggcctacctggagtttgagaaatcccgctacagcacctatgcagcgctgcttcgggtcaagctgaaggcaggcagtgaggagctggatgcagtggaggcagcactggcccaggccgggagcacagaggatggactccctccttctcactccagtccctccctgcagcccaaaccctccagccagccccgggctcagcgtcacagctcagagcctcggccaggggcaggcagtgggcggcggaagccctgagatgaggtttagggtggggagtgcctgctgggcacctgaaggatgacatggccctgcctgagcccgggccggcctcgggccacccacgagggcctcccggcctagggcccgaccgcgccggacgcggtgtccggggcagggcagggctggggcctgggcctcaggagcctaggctaggggcacctccgagagcccctttttgtgataatgttttgcactttttcgtacagggtgggcgggggcgggaggggctagcgcccctgaacttttgatgctttttttttgtgtgggagaggcctgatgccgtttctgctttctgctgagaccacccccaccctgacaccatcagtccccctctgtcctggggcctggcttggacagagaccaggatttggggctgagctggtttcccctccttcctccccaagggcttactctttctcttgctggaggtggaggaagggcgtccatgccaaggccccatacctgggccgggggcagcacggcctggctttcccccgcttcagtgggccttgccctttgtacagcctccacccccattaaaactgctctggacttgcaaaaaaaaacaaaaaaaaaaaaaaaaaaaaaaaaaaaaaaaaaaaaaagagagagggcgcgcgcgcgcgcccccataaatattatctccctccggaggggcgccccattttccgcgcgccgctccaccctgtttttgtgtcacaacgggggcgccccttataggggcgactcctcttatttaatacacccgaggcgccggcggcgccccgcgctgtttataccacaacggtcgctcggaccgcggggagaacaacgcgcgcgctacacctctgtggcgaatatctcttgtgtgatgaacggagaccccccttctctttctgcgggggagtggagacaacacactattgtgggcgccacaacactcactccctctcagccggaacttattttaacgcgccctccaggggtgacaacatcttatacacctcttttaacagagcgagtgtctattagcgcgtgtgtgtcatacacacacctacaggcgcgccgctatttatcgccgctgcgcgcgtgtgtgagatgcaaaatttttgttgagccttctcctgcggcgcctattgtgtgtctttctcggtgacacacatatttttttttactcccacacgcgcgccgcctcctaccgcctatagtaaa

SEQ ID NO: 366110 - DNA, 4005 bp, Homo sapiens
agtgcgacaaatctggcgctgtccccttcagcaccacgcggagtccgcgccgcccctccccgcgctcagctgggcccagcctctcctctgtctctcctcggtctcagctctgggcgagcagcggcccaccccagcccttgggcctggctccaaccggaagttacggctggaagcatccacatcagacccactccccgccagaggaggctcggccctacctggcagccggaaccttgtacatgggccgccagccccaccccaggttggagcagatggcctttactcctctctccccaatgggctggggggcccccctgagcgcctggccacactcttcggaggacctgctgacactggattcctgaaccagggggatacctggtcctccccccgggaagtctcctctcatgcccagagaatcgctagagccaaatgggaattcttctatggctccttggacccccccagctcaggtgctaagcccccagagcaggcccccccatctccacctggggtgggctcaaggcagggctctggggtggctgtggggcgagcagccaagtactccgagacagacctggacacggtgcccctgaggtgctaccgcgagactgacatcgatgaggtgctggctgagcgggaggaggccgactcggccatcgaaagtcagcccagctctgagggcccaccaggcactgcctacccacctgccccacggcccggcccactccctggccctcatcccagcctcggcagtggcaatgaggatgaggacgacgatgaggcaggtggggaagaagatgtggacgacgaggtgtttgaggcctctgaaggggcccggccagggagccggatgcctctcaagtcacctgtgccctttctacctgggacgagcccctcggctgatgggcctgactctttcagttgtgtgttcgaagccatcctggagtcacaccgggccaaaggcacctcctataccagcctcgcctcgctggaggccttggcctcacctggcccaacccagagccccttcttcacctttgagctgcctccccaaccccctgcaccccggcccgacccaccagctcccgccccacttacccctcttgaaccggattctggtaccagctctgctgctgatggtccttggacacagagaggggaggaggaggaggcagaggccagagccaagctggccccagggagggagccccctagtccctgccactcagaggacagccttgggctgggggcagcaccccttggcagcgaaccacccctgagccagctggtgtccgactcagactcagagctggacagcacagaccggctggccctgggaagcacagacaccttgtccaatgggcagaaagcggacctggaggctgcgcagcgcctggccaagaggctgtaccgactagatggcttcaggaaggccgatgtggcccggcacctgggcaagaacaatgacttcagcaaactggtggctggggagtacctcaagttctttgtcttcacgggcatgactctggaccaagctctcagggtgtttctgaaggagctggccttaatgggtgagacccaggaacgagagcgcgtgctggcccacttctcccagcgatacttccagtgcaatcctgaagccctgtcctcagaggacggcgcccacacgctgacctgtgcgctcatgctgctcaacacggatctccacggcataacatcgggaagcgcatgacctgcggggacttcatcgggaacctggagggcctcaatgatggcggcgacttccctagggagctgctcaaggccttgtacagctccatcaagaatgagaagctgcagtgggccatagacgaggaggagctgagacgctctctgtctgagttggccgaccccaaccccaaggtcatcaagcggatcagcgggggcagtggcagtggctccagccctttcctggacctgactcccgagcctggggctgccgtctacaagcacggggccctggtgcgaaaggtgcacgcagaccctgactgcaggaagacacctcggggcaagcggggctggaagagcttccacgggatcctcaagggcatgatcctctacctgcagaaggaggagtacaagcctgggaaggccctttcagagacggagctcaagaatgccatcagcatccaccatgccctggccactcgtgccagtgactacagcaagaggccccacgtcttctacctgcgcacagctgactggcgggtcttcctcttccaggccccgagcctggagcagatgcagtcctggatcactcgcatcaatgtagtagccgctatgttctctgcgccccccttcccagctgctgttagctcccaaaagaagttcagccgccctctcctgcccagcgctgccacccgcctctcccaggaggagcaggtgcggacccacgaggccaagctgaaggccatggcaagtgagctgcgggagcaccgggccgcccagctgggcaagaagggccggggcaaggaggctgaagagcagcggcagaaggaggcctacctggagtttgagaaatcccgctacagcacctatgcagcgctgcttcgggtcaagctgaaggcaggcagtgaggagctggatgcagtggaggcagcactggcccaggccgggagcacagaggatggactccctccttctcactccagtccctccctgcagcccaaaccctccagccagccccgggctcagcgtcacagctcagagcctcggccaggggcaggcagtgggcggcggaagccctgagatgaggtttagggtggggagtgcctgctgggcacctgaaggatgacatggccctgcctgagcccgggccggcctcgggccacccacgagggcctcccggcctagggcccgaccgcgccggacgcggtgtccggggcagggcagggctggggcctgggcctcaggagcctaggctaggggcacctccgagagcccctttttgtgataatgttttgcactttttcgtacagggtgggcgggggcgggaggggctagcgcccctgaacttttgatgctttttttttgtgtgggagaggcctgatgccgtttctgctttctgctgagaccacccccaccctgacaccatcagtccccctctgtcctggggcctggcttggacagagaccaggatttggggctgagctggtttcccctccttcctccccaagggcttactctttctcttgctggaggtggaggaagggcgtccatgccaaggccccatacctgggccgggggcagcacggcctggctttcccccgcttcagtgggccttgccctttgtacagcctccacccccattaaaactgctctggacttgcaaaaaaaaacaaaaaaaaaaaaaaaaaaaaaaaaaaaaaaaaaaaaaagagagagggcgcgcgcgcgcgcccccataaatattatctccctccggaggggcgccccattttccgcgcgccgctccaccctgtttttgtgtcacaacgggggcgccccttataggggcgactcctcttatttaatacacccgaggcgccggcggcgccccgcgctgtttataccacaacggtcgctcggaccgcggggagaacaacgcgcgcgctacacctctgtggcgaatatctcttgtgtgatgaacggagaccccccttctctttctgcgggggagtggagacaacacactattgtgggcgccacaacactcactccctctcagccggaacttattttaacgcgccctccaggggtgacaacatcttatacacctcttttaacagagcgagtgtctattagcgcgtgtgtgtcatacacacacctacaggcgcgccgctatttatcgccgctgcgcgcgtgtgtgagatgcaaaatttttgttgagccttctcctgcggcgcctattgtgtgtctttctcggtgacacacatatttttttttactcccacacgcgcgccgcctcctaccgcctatagtaaa

SEQ ID NO: 366111 - DNA, 4570 bp, Homo sapiens
agtgcgacaaatctggcgctgtccccttcagcaccacgcggagtccgcgccgcccctccccgcgctcagctgggcccagcctctcctctgtctctcctcggtctcagctctgggcgagcagcggcctgtctgaagagcatgcagcccccttactccccgcctggcctcgccatccctgcccccccagcctgacccccggccccagcatggcccagggtgccatgcgcttctgctcggaaggcgactgtgccatctccccaccacgatgcccacgccgctggctccccgaaggcccggtgccccagagccccccagccagcatgtatggcagcacaggctccttgctacggcgagtggcaggtccaggtcctcgaggccgggaactgggacgtgtgacagcaccctgtacacctctgcgtggccccccctcaccccgtgttgctccctcaccctgggcaccctcttcacccactgggcagcccccacccggggcccagagctctgtggtcatcttccgctttgtggagaaggccagtgtgaggccactgaatgggctacctgctccagggggcttgagtcggagctgggatctgggtggggtttctcctcccaggcccaccccagcccttgggcctggctccaaccggaagttacggctggaagcatccacatcagacccactccccgccagaggaggctcggccctacctggcagccggaaccttgtacatgggccgccagccccaccccaggttggagcagatggcctttactcctctctccccaatgggctggggggcccccctgagcgcctggccacactcttcggaggacctgctgacactggattcctgaaccagggggatacctggtcctccccccgggaagtctcctctcatgcccagagaatcgctagagccaaatgggaattcttctatggctccttggacccccccagctcaggtgctaagcccccagagcaggcccccccatctccacctggggtgggctcaaggcagggctctggggtggctgtggggcgagcagccaagtactccgagacagacctggacacggtgcccctgaggtgctaccgcgagactgacatcgatgaggtgctggctgagcgggaggaggccgactcggccatcgaaagtcagcccagctctgagggcccaccaggcactgcctacccacctgccccacggcccggcccactccctggccctcatcccagcctcggcagtggcaatgaggatgaggacgacgatgaggcaggtggggaagaagatgtggacgacgaggtgtttgaggcctctgaaggggcccggccagggagccggatgcctctcaagtcacctgtgccctttctacctgggacgagcccctcggctgatgggcctgactctttcagttgtgtgttcgaagccatcctggagtcacaccgggccaaaggcacctcctataccagcctcgcctcgctggaggccttggcctcacctggcccaacccagagccccttcttcacctttgagctgcctccccaaccccctgcaccccggcccgacccaccagctcccgccccacttacccctcttgaaccggattctggtaccagctctgctgctgatggtccttggacacagagaggggaggaggaggaggcagaggccagagccaagctggccccagggagggagccccctagtccctgccactcagaggacagccttgggctgggggcagcaccccttggcagcgaaccacccctgagccagctggtgtccgactcagactcagagctggacagcacagaccggctggccctgggaagcacagacaccttgtccaatgggcagaaagcggacctggaggctgcgcagcgcctggccaagaggctgtaccgactagatggcttcaggaaggccgatgtggcccggcacctgggcaagaacaatgacttcagcaaactggtggctggggagtacctcaagttctttgtcttcacgggcatgactctggaccaagctctcagggtgtttctgaaggagctggccttaatgggtgagacccaggaacgagagcgcgtgctggcccacttctcccagcgatacttccagtgcaatcctgaagccctgtcctcagaggacggcgcccacacgctgacctgtgcgctcatgctgctcaacacggatctccacggcataacatcgggaagcgcatgacctgcggggacttcatcgggaacctggagggcctcaatgatggcggcgacttccctagggagctgctcaaggccttgtacagctccatcaagaatgagaagctgcagtgggccatggcgagcagaggccagaactgaagcgggggccgcggctccatggccagccccctctgaggtgatcacacctgcagagacgaggaggagctgagacgctctctgtctgagttggccgaccccaaccccaaggtcatcaagcggatcagcgggggcagtggcagtggctccagccctttcctggacctgactcccgagcctggggctgccgtctacaagcacggggccctggtgcgaaaggtgcacgcagaccctgactgcaggaagacacctcggggcaagcggggctggaagagcttccacgggatcctcaagggcatgatcctctacctgcagaaggaggagtacaagcctgggaaggccctttcagagacggagctcaagaatgccatcagcatccaccatgccctggccactcgtgccagtgactacagcaagaggccccacgtcttctacctgcgcacagctgactggcgggtcttcctcttccaggccccgagcctggagcagatgcagtcctggatcactcgcatcaatgtagtagccgctatgttctctgcgccccccttcccagctgctgttagctcccaaaagaagttcagccgccctctcctgcccagcgctgccacccgcctctcccaggaggagcaggtgcggacccacgaggccaagctgaaggccatggcaagtgagctgcgggagcaccgggccgcccagctgggcaagaagggccggggcaaggaggctgaagagcagcggcagaaggaggcctacctggagtttgagaaatcccgctacagcacctatgcagcgctgcttcgggtcaagctgaaggcaggcagtgaggagctggatgcagtggaggcagcactggcccaggccgggagcacagaggatggactccctccttctcactccagtccctccctgcagcccaaaccctccagccagccccgggctcagcgtcacagctcagagcctcggccaggggcaggcagtgggcggcggaagccctgagatgaggtttagggtggggagtgcctgctgggcacctgaaggatgacatggccctgcctgagcccgggccggcctcgggccacccacgagggcctcccggcctagggcccgaccgcgccggacgcggtgtccggggcagggcagggctggggcctgggcctcaggagcctaggctaggggcacctccgagagcccctttttgtgataatgttttgcactttttcgtacagggtgggcgggggcgggaggggctagcgcccctgaacttttgatgctttttttttgtgtgggagaggcctgatgccgtttctgctttctgctgagaccacccccaccctgacaccatcagtccccctctgtcctggggcctggcttggacagagaccaggatttggggctgagctggtttcccctccttcctccccaagggcttactctttctcttgctggaggtggaggaagggcgtccatgccaaggccccatacctgggccgggggcagcacggcctggctttcccccgcttcagtgggccttgccctttgtacagcctccacccccattaaaactgctctggacttgcaaaaaaaaacaaaaaaaaaaaaaaaaaaaaaaaaaaaaaaaaaaaaaagagagagggcgcgcgcgcgcgcccccataaatattatctccctccggaggggcgccccattttccgcgcgccgctccaccctgtttttgtgtcacaacgggggcgccccttataggggcgactcctcttatttaatacacccgaggcgccggcggcgccccgcgctgtttataccacaacggtcgctcggaccgcggggagaacaacgcgcgcgctacacctctgtggcgaatatctcttgtgtgatgaacggagaccccccttctctttctgcgggggagtggagacaacacactattgtgggcgccacaacactcactccctctcagccggaacttattttaacgcgccctccaggggtgacaacatcttatacacctcttttaacagagcgagtgtctattagcgcgtgtgtgtcatacacacacctacaggcgcgccgctatttatcgccgctgcgcgcgtgtgtgagatgcaaaatttttgttgagccttctcctgcggcgcctattgtgtgtctttctcggtgacacacatatttttttttactcccacacgcgcgccgcctcctaccgcctatagtaaa

SEQ ID NO: 366112 - DNA, 2753 bp, Homo sapiens
caagggaggcaggcctagctgggacggagaaaaacactgttgggggagatgcagtgtaggctccatatgggaagtaacagggaactaccacaggttcttgagcaagggagtgacaagatagaatccgaaattttgtatctgactgagcctgtagaccaggatgtatggggttggggtgggggcggcactaggaaactacttcttccatctgctaccatttagcccacaaaccgtgagcaaagcctggggctggatgtggttgagccagcggaggcaggcccggggctgtcctggtggagaagggtgtgagggctgcaggtgtgcagcaatggagaggatagtgctggccctacttgctgggaggaagggacagtggtggctctaggctggggagctctgagggaggtgccctgctctgaggaggcacagctacacattgtggaggcctgatctgagacgggagacatggcaggaccctcaggttgagccccccaagccacaaacactgggggagcttttccagggcgagcagaggccagaactgaagcgggggccgcggctccatggccagccccctctgaggtgatcacacctgcagagacgaggaggagctgagacgctctctgtctgagttggccgaccccaaccccaaggtcatcaagcggatcagcgggggcagtggcagtggctccagccctttcctggacctgactcccgagcctggggctgccgtctacaagcacggggccctggtgcgaaaggtgcacgcagaccctgactgcaggaagacacctcggggcaagcggggctggaagagcttccacgggatcctcaagggcatgatcctctacctgcagaaggaggagtacaagcctgggaaggccctttcagagacggagctcaagaatgccatcagcatccaccatgccctggccactcgtgccagtgactacagcaagaggccccacgtcttctacctgcgcacagctgactggcgggtcttcctcttccaggccccgagcctggagcagatgcagtcctggatcactcgcatcaatgtagtagccgctatgttctctgcgccccccttcccagctgctgttagctcccaaaagaagttcagccgccctctcctgcccagcgctgccacccgcctctcccaggaggagcaggtgcggacccacgaggccaagctgaaggccatggcaagtgagctgcgggagcaccgggccgcccagctgggcaagaagggccggggcaaggaggctgaagagcagcggcagaaggaggcctacctggagtttgagaaatcccgctacagcacctatgcagcgctgcttcgggtcaagctgaaggcaggcagtgaggagctggatgcagtggaggcagcactggcccaggccgggagcacagaggatggactccctccttctcactccagtccctccctgcagcccaaaccctccagccagccccgggctcagcgtcacagctcagagcctcggccaggggcaggcagtgggcggcggaagccctgagatgaggtttagggtggggagtgcctgctgggcacctgaaggatgacatggccctgcctgagcccgggccggcctcgggccacccacgagggcctcccggcctagggcccgaccgcgccggacgcggtgtccggggcagggcagggctggggcctgggcctcaggagcctaggctaggggcacctccgagagcccctttttgtgataatgttttgcactttttcgtacagggtgggcgggggcgggaggggctagcgcccctgaacttttgatgctttttttttgtgtgggagaggcctgatgccgtttctgctttctgctgagaccacccccaccctgacaccatcagtccccctctgtcctggggcctggcttggacagagaccaggatttggggctgagctggtttcccctccttcctccccaagggcttactctttctcttgctggaggtggaggaagggcgtccatgccaaggccccatacctgggccgggggcagcacggcctggctttcccccgcttcagtgggccttgccctttgtacagcctccacccccattaaaactgctctggacttgcaaaaaaaaacaaaaaaaaaaaaaaaaaaaaaaaaaaaaaaaaaaaaaagagagagggcgcgcgcgcgcgcccccataaatattatctccctccggaggggcgccccattttccgcgcgccgctccaccctgtttttgtgtcacaacgggggcgccccttataggggcgactcctcttatttaatacacccgaggcgccggcggcgccccgcgctgtttataccacaacggtcgctcggaccgcggggagaacaacgcgcgcgctacacctctgtggcgaatatctcttgtgtgatgaacggagaccccccttctctttctgcgggggagtggagacaacacactattgtgggcgccacaacactcactccctctcagccggaacttattttaacgcgccctccaggggtgacaacatcttatacacctcttttaacagagcgagtgtctattagcgcgtgtgtgtcatacacacacctacaggcgcgccgctatttatcgccgctgcgcgcgtgtgtgagatgcaaaatttttgttgagccttctcctgcggcgcctattgtgtgtctttctcggtgacacacatatttttttttactcccacacgcgcgccgcctcctaccgcctatagtaaa

SEQ ID NO: 366113 - DNA, 2544 bp, Homo sapiens
cgctctagccaagccgcagagcagacagcgccgccgccgccgccgcgcactccgtgcgtccgtgagagccgggccggctcgggccgggccgcgccgctcgcgctggctgtcgggggagcggtccgcgggccgtccgggcggcccgggggccgagggcggacgggggcatggccgggggccgcggcgcgccggccgggccagcatgatcggcgtcaacagcatccacagcagcgccgggcggctgcgctcgcgctcgctgtgctccgtgcgctacgggcgcacccaccgcggcgcggagaccctgtgctacggctggccgcagcgctcgcgcagcctcaagcccgtgctctacaccgacctggtggtcagccgcctgcagagccgcaagaagaaaaaggcggccttgtacagctccatcaagaatgagaagctgcagtgggccatgtcatcaagcggatcagcgggggcagtggcagtggctccagccctttcctggacctgactcccgagcctggggctgccgtctacaagcacggggccctggtgcgaaaggtgcacgcagaccctgactgcaggaagacacctcggggcaagcggggctggaagagcttccacgggatcctcaagggcatgatcctctacctgcagaaggaggagtacaagcctgggaaggccctttcagagacggagctcaagaatgccatcagcatccaccatgccctggccactcgtgccagtgactacagcaagaggccccacgtcttctacctgcgcacagctgactggcgggtcttcctcttccaggccccgagcctggagcagatgcagtcctggatcactcgcatcaatgtagtagccgctatgttctctgcgccccccttcccagctgctgttagctcccaaaagaagttcagccgccctctcctgcccagcgctgccacccgcctctcccaggaggagcaggtgcggacccacgaggccaagctgaaggccatggcaagtgagctgcgggagcaccgggccgcccagctgggcaagaagggccggggcaaggaggctgaagagcagcggcagaaggaggcctacctggagtttgagaaatcccgctacagcacctatgcagcgctgcttcgggtcaagctgaaggcaggcagtgaggagctggatgcagtggaggcagcactggcccaggccgggagcacagaggatggactccctccttctcactccagtccctccctgcagcccaaaccctccagccagccccgggctcagcgtcacagctcagagcctcggccaggggcaggcagtgggcggcggaagccctgagatgaggtttagggtggggagtgcctgctgggcacctgaaggatgacatggccctgcctgagcccgggccggcctcgggccacccacgagggcctcccggcctagggcccgaccgcgccggacgcggtgtccggggcagggcagggctggggcctgggcctcaggagcctaggctaggggcacctccgagagcccctttttgtgataatgttttgcactttttcgtacagggtgggcgggggcgggaggggctagcgcccctgaacttttgatgctttttttttgtgtgggagaggcctgatgccgtttctgctttctgctgagaccacccccaccctgacaccatcagtccccctctgtcctggggcctggcttggacagagaccaggatttggggctgagctggtttcccctccttcctccccaagggcttactctttctcttgctggaggtggaggaagggcgtccatgccaaggccccatacctgggccgggggcagcacggcctggctttcccccgcttcagtgggccttgccctttgtacagcctccacccccattaaaactgctctggacttgcaaaaaaaaacaaaaaaaaaaaaaaaaaaaaaaaaaaaaaaaaaaaaaagagagagggcgcgcgcgcgcgcccccataaatattatctccctccggaggggcgccccattttccgcgcgccgctccaccctgtttttgtgtcacaacgggggcgccccttataggggcgactcctcttatttaatacacccgaggcgccggcggcgccccgcgctgtttataccacaacggtcgctcggaccgcggggagaacaacgcgcgcgctacacctctgtggcgaatatctcttgtgtgatgaacggagaccccccttctctttctgcgggggagtggagacaacacactattgtgggcgccacaacactcactccctctcagccggaacttattttaacgcgccctccaggggtgacaacatcttatacacctcttttaacagagcgagtgtctattagcgcgtgtgtgtcatacacacacctacaggcgcgccgctatttatcgccgctgcgcgcgtgtgtgagatgcaaaatttttgttgagccttctcctgcggcgcctattgtgtgtctttctcggtgacacacatatttttttttactcccacacgcgcgccgcctcctaccgcctatagtaaa

SEQ ID NO: 366114 - DNA, 325 bp, Homo sapiens
  misc_feature (293)..(293): n is a, c, g, or t
ggcagcatgtcacttgcagggagtgacttttctttatttgagtgtaagtgctgtgggtggaaggtcagctggggccagaaggggaaggggcccgaatgccttgcatgtttcatctcagctctgcggtgaggcccaaacctgaagtgggccttcatttaagtatttggggagattctgcctggcccaactcaggcggtgactgcagcaggagagagaggtgcagtcggaagaaaggtcttgctgagcaaacgggacccaaagagggatgtgcacagtacacggtcccttcactncacatgccccgcgaccttactcccttttatgg

SEQ ID NO: 366115 - DNA, 585 bp, Homo sapiens
ggcagcatgtcacttgcagggagtgacttttctttatttgagtgtaagtgctgtgggtggaaggtcagctggggccagaaggggaaggggcccgaatgccttgcatgtttcatctcagctctgcggtgaggcccaaacctgaagtgggccttcatttaagtatttggggagattctgcctggcccaactcaggcggtgactgcagcaggagagagaggtgcagtcggaagaaaggtcttgctgagcaaacgggacccaaagagggatgtgcaagatctggaaacaacaaatggttttcaaactcaatagtcccctccagcaatcagcaaacagcagggtggctgcagatcttccatccacccactaaggcagccagcaatccctgtctctgcagtggcggaggaaacctctgtcttttgcaatccctgtgattcggaagctttccacccctctggaccggcccctcttcccctcccgcccctccgctctgatccgtgtggtttgctaagggaggaaagccagagcaggaaacagataacttagggagtggctgttcatgtgattaaaatgtctttgctttccaaa

SEQ ID NO: 366116 - DNA, 551 bp, Homo sapiens
cacgcctttcctgctgctctggagagagggtgggcaccgggctggaggaaatgttgcaagcattctctacccagtctggcatgaacctcgagtggtcccagaagtgccttcaggacaacaactgggactacaccagatctgcccaggccttcactcatctcaaggccaagggcgagatcccagaagtggcattcatgaagtgatcgtagtcatgcctcagaagcagtcccccctgtaaatagtccttggatattaccgtctggttgtcgtctgtcatctcctcctgtctggcccgaggccgccccgtgactgtgaccgagggagggagggctgcctgatccctctcctcgcctgccttctggaagacttcagaagattgagcctcactggtgccaggaagccaaagcttactttgtagaactgacactaaactacccgaaggacttaggtgctttgtgtacttaaccccaggacctccttactttttaatataaagagtgatgttgtatttcgtgttctgcactttttaatataaagagtgatgttgtatt

SEQ ID NO: 366117 - DNA, 2329 bp, Homo sapiens
cggcaccgcccacagcctgggacgtcagcggcgcgcgacgtgctttgctgtataaatgcggtggcgcccggcgtagggacacttcggtcctgagcgcttgggagttaggttgtttgccggcgtagcggccagcgcctgagcccgcccttgatcttcgctgtggcatggcggacgaggggaagtcgtacagcgaacacgatgatgaacgcgttaatttccctcaaagaaagaagaaaggccggggtcccttccggtggaaatatggtgaaggaaaccgtaggtctggaagaggcggttctggtattcggtcttcccgccttgaggaagatgatggagatgtggcaatgagtgatgcccaggatggtccccgagtacgatacaacccctataccacccgacctaaccgtcggggtgatacttggcatgatcgagatcgcattcatgttactgtgcggagagacagagctcctccagagagaggaggggctggcaccagccaggatgggacctcaaagaactggttcaagattacaattccttatggcagaaagtatgacaaggcatggctcctgagcatgattcagagcaagtgcagtgtgcccttcacccctattgagtttcactatgagaatacacgggcccagttcttcgttgaagacgccagtactgcctctgcattgaaggctgtcaactataagattttggatcgggagaaccgaaggatatctatcatcatcaactcttctgctccaccccacactatactgaatgaactgaagccagaacaagtagaacagctaaagctgatcatgagcaaacgatacgatggctcccaacaagcccttgacctcaaaggcctccgttcagacccagatttggtggcccagaacattgacgttgtcctgaatcgcagaagctgtatggcagctaccctgaggatcattgaagagaacatccctgagctattgtccttgaacttgagcaacaacaggctgtacaggctggatgacatgtctagcattgttcagaaggcacccaacctgaagatcctaaacctttctggaaatgaattgaagtctgagcgggaattggacaagataaaggggctgaagctagaagagctctggctcgatggaaactccctgtgtgacaccttccgagaccagtccacctacatcagcgccattcgcgaacgatttcccaagttactacgcctggatggccatgagctacccccaccaattgcctttgatgttgaagcccccacgacgttaccgccctgcaagggaagctattttggaacagaaaacttgaagagtctggtcttgcacttcctgcaacagtactatgcaatttacgactctggagaccgacaagggctcctggatgcctaccatgatggggcctgctgttccctgagcattcctttcattcctcagaaccctgcccgaagcagcttagccgagtatttcaaggatagcagaaatgtgaagaagcttaaagaccctaccttgcggttccggctgctgaagcacacgcgtctcaacgttgttgccttcctcaatgagttgcccaaaacccagcacgacgtcaattccttcgtggtagacataagcgcccagacaagcacattgctgtgtttttctgtcaatggagtcttcaaggaagtggacggaaagtcccgggattctttgcgagccttcacccggacattcattgctgttcctgctagcaattcagggctatgtattgtaaatgatgagctatttgtgcggaatgccagttctgaagagatccaaagagccttcgctatgcctgcacccacgccttcctccagcccggtgcccaccctctctccagagcagcaggaaatgttgcaagcattctctacccagtctggcatgaacctcgagtggtcccagaagtgccttcaggacaacaactgggactacaccagatctgcccaggccttcactcatctcaaggccaagggcgagatcccagaagtggcattcatgaagtgatcgtagtcatgcctcagaagcagtcccccctgtaaatagtccttggatattaccgtctggttgtcgtctgtcatctcctcctgtctggcccgaggccgccccgtgactgtgaccgagggagggagggctgcctgatccctctcctcgcctgccttctggaagacttcagaagattgagcctcactggtgccaggaagccaaagcttactttgtagaactgacactaaactacccgaaggacttaggtgctttgtgtacttaaccccaggacctccttactttttaatataaagagtgatgttgta

SEQ ID NO: 366118 - DNA, 2372 bp, Homo sapiens
cggcaccgcccacagcctgggacgtcagcggcgcgcgacgtgctttgctgtataaatgcggtggcgcccggcgtagggacacttcggtcctgagcgcttgggagttaggttgtttgccggcgtagcggccagcgcctgagcccgcccttgatcttcgctgtggcatggcggacgaggggaagtcgtacagcgaacacgatgatgaacgcgttaatttccctcaaagaaagaagaaaggccggggtcccttccggtggaaatatggtgaaggaaaccgtaggtctggaagaggcggttctggtattcggtcttcccgccttgaggaagatgatggagatgtggcaatgagtgatgcccaggatggtccccgagtacgatacaacccctataccacccgacctaaccgtcggggtgatacttggcatgatcgagatcgcattcatgttactgtgcggagagacagagctcctccagagagaggaggggctggcaccagccaggatgggacctcaaagaactggttcaagattacaattccttatggcagaaagtatgacaaggcatggctcctgagcatgattcagagcaagtgcagtgtgcccttcacccctattgagtttcactatgagaatacacgggcccagttcttcgttgaagacgccagtactgcctctgcattgaaggctgtcaactataagattttggatcgggagaaccgaaggatatctatcatcatcaactcttctgctccaccccacactatactgaatgaactgaagccagaacaagtagaacagctaaagctgatcatgagcaaacgatacgatggctcccaacaagcccttgacctcaaaggcctccgttcagacccagatttggtggcccagaacattgacgttgtcctgaatcgcagaagctgtatggcagctaccctgaggatcattgaagagaacatccctgagctattgtccttgaacttgagcaacaacaggctgtacaggctggatgacatgtctagcattgttcagaaggcacccaacctgaagatcctaaacctttctggaaatgaattgaagtctgagcgggaattggacaagataaaggggctgaagctagaagagctctggctcgatggaaactccctgtgtgacaccttccgagaccagtccacctacatcagcgccattcgcgaacgatttcccaagttactacgcctggatggccatgagctacccccaccaattgcctttgatgttgaagcccccacgacgttaccgccctgcaagggaagctattttggaacagaaaacttgaagagtctggtcttgcacttcctgcaacagtactatgcaatttacgactctggagaccgacaagggctcctggatgcctaccatgatggggcctgctgttccctgagcattcctttcattcctcagaaccctgcccgaagcagcttagccgagtatttcaaggatagcagaaatgtgaagaagcttaaagaccctaccttgcggttccggctgctgaagcacacgcgtctcaacgttgttgccttcctcaatgagttgcccaaaacccagcacgacgtcaattccttcgtggtagacataagcgcccagacaagcacattgctgtgtttttctgtcaatggagtcttcaaggaagtggacggaaagtcccgggattctttgcgagccttcacccggacattcattgctgttcctgctagcaattcagggctatgtattgtaaatgatgagctatttgtgcggaatgccagttctgaagagatccaaagagccttcgctatgcctgcacccacgccttcctccagcccggtgcccaccctctctccagagcagcaggaaatgttgcaagcattctctacccagtctggcatgaacctcgagtggtcccagaagtgccttcaggacaacaactgggactacaccagatctgcccaggccttcactcatctcaaggccaagggcgagatcccagaagtggcattcatgaagtgatcgtagtcatgcctcagaagcagtcccccctgtaaatagtccttggatattaccgtctggttgtcgtctgtcatctcctcctgtctggcccgaggccgccccgtgactgtgaccgagggagggagggctgcctgatccctctcctcgcctgccttctggaagacttcagaagattgagcctcactggtgccaggaagccaaagcttactttgtagaactgacactaaactacccgaaggacttaggtgctttgtgtacttaaccccaggacctccttactttttaatataaagagtgatgttgtatttcgtgttctgcactttttaatataaagagtgatgttgtatt

SEQ ID NO: 366119 - DNA, 2312 bp, Homo sapiens
agcaggctggtcccggccggagttgtaggatgagcgcttgggagttaggttgtttgccggcgtagcggccagcgcctgagcccgcccttgatcttcgctgtggcatggcggacgaggggaagtcgtacagcgaacacgatgatgaacgcgttaatttccctcaaagaaagaagaaaggccggggtcccttccggtggaaatatggtgaaggaaaccgtaggtctggaagaggcggttctggtattcggtcttcccgccttgaggaagatgatggagatgtggcaatgagtgatgcccaggatggtccccgagtacgatacaacccctataccacccgacctaaccgtcggggtgatacttggcatgatcgagatcgcattcatgttactgtgcggagagacagagctcctccagagagaggaggggctggcaccagccaggatgggacctcaaagaactggttcaagattacaattccttatggcagaaagtatgacaaggcatggctcctgagcatgattcagagcaagtgcagtgtgcccttcacccctattgagtttcactatgagaatacacgggcccagttcttcgttgaagacgccagtactgcctctgcattgaaggctgtcaactataagattttggatcgggagaaccgaaggatatctatcatcatcaactcttctgctccaccccacactatactgaatgaactgaagccagaacaagtagaacagctaaagctgatcatgagcaaacgatacgatggctcccaacaagcccttgacctcaaaggcctccgttcagacccagatttggtggcccagaacattgacgttgtcctgaatcgcagaagctgtatggcagctaccctgaggatcattgaagagaacatccctgagctattgtccttgaacttgagcaacaacaggctgtacaggctggatgacatgtctagcattgttcagaaggcacccaacctgaagatcctaaacctttctggaaatgaattgaagtctgagcgggaattggacaagataaaggggctgaagctagaagagctctggctcgatggaaactccctgtgtgacaccttccgagaccagtccacctacatcagcgccattcgcgaacgatttcccaagttactacgcctggatggccatgagctacccccaccaattgcctttgatgttgaagcccccacgacgttaccgccctgcaagggaagctattttggaacagaaaacttgaagagtctggtcttgcacttcctgcaacagtactatgcaatttacgactctggagaccgacaagggctcctggatgcctaccatgatggggcctgctgttccctgagcattcctttcattcctcagaaccctgcccgaagcagcttagccgagtatttcaaggatagcagaaatgtgaagaagcttaaagaccctaccttgcggttccggctgctgaagcacacgcgtctcaacgttgttgccttcctcaatgagttgcccaaaacccagcacgacgtcaattccttcgtggtagacataagcgcccagacaagcacattgctgtgtttttctgtcaatggagtcttcaaggaagtggacggaaagtcccgggattctttgcgagccttcacccggacattcattgctgttcctgctagcaattcagggctatgtattgtaaatgatgagctatttgtgcggaatgccagttctgaagagatccaaagagccttcgctatgcctgcacccacgccttcctccagcccggtgcccaccctctctccagagcagcaggaaatgttgcaagcattctctacccagtctggcatgaacctcgagtggtcccagaagtgccttcaggacaacaactgggactacaccagatctgcccaggccttcactcatctcaaggccaagggcgagatcccagaagtggcattcatgaagtgatcgtagtcatgcctcagaagcagtcccccctgtaaatagtccttggatattaccgtctggttgtcgtctgtcatctcctcctgtctggcccgaggccgccccgtgactgtgaccgagggagggagggctgcctgatccctctcctcgcctgccttctggaagacttcagaagattgagcctcactggtgccaggaagccaaagcttactttgtagaactgacactaaactacccgaaggacttaggtgctttgtgtacttaaccccaggacctccttactttttaatataaagagtgatgttgtatttcgtgttctgcactttttaatataaagagtgatgttgtatt

SEQ ID NO: 366120 - DNA, 2580 bp, Homo sapiens
cggcaccgcccacagcctgggacgtcagcggcgcgcgacgtgctttgctgtataaatgcggtggcgcccggcgtagggacacttcggtcctgagcgcttgggagttaggttgtttgccggcgtagcggccagcgcctgagcccgcccttgatcttcgctgtggcatggcggacgaggggaagtcgtacagcgaacacgatgatgaacgcgttaatttccctcaaagaaagaagaaaggccggggtcccttccggtggaaatatggtgaaggaaaccgtaggtctggaagaggcggttctggtattcggtcttcccgccttgaggaagatgatggagatgtggcaatgagtgatgcccaggatggtccccgagtacgatacaacccctataccacccgacctaaccgtcggggtgatacttggcatgatcgagatcgcattcatgttactgtgcggagagacagagctcctccagagagaggaggggctggcaccagccaggatgggacctcaaagaactggttcaagattacaattccttatggcagaaagtatgacaaggcatggctcctgagcatgattcagagcaagtgcagtgtgcccttcacccctattgagtttcactatgagaatacacgggcccagttcttcgttgaagacgccagtactgcctctgcattgaaggctgtcaactataagattttggatcgggagaaccgaaggatatctatcatcatcaactcttctgctccaccccacactatactgaatgaactgaagccagaacaagtagaacagctaaagctgatcatgagcaaacgatacgatggctcccaacaagcccttgacctcaaaggcctccgttcagacccagatttggtggcccagaacattgacgttgtcctgaatcgcagaagctgtatggcagctaccctgaggatcattgaagagaacatccctgagctattgtccttgaacttgagcaacaacaggctgtacaggctggatgacatgtctagcattgttcagaaggcacccaacctgaagatcctaaacctttctggaaatgaattgaagtctgagcgggaattggacaagataaaggggctgaagctagaagagctctggctcgatggaaactccctgtgtgacaccttccgagaccagtccacctacatcagcgccattcgcgaacgatttcccaagttactacgcctggatggccatgagctacccccaccaattgcctttgatgttgaagcccccacgacgttaccgccctgcaagggaagctattttggaacagaaaacttgaagagtctggtcttgcacttcctgcaacagtactatgcaatttacgactctggagaccgacaagggctcctggatgcctaccatgatggggcctgctgttccctgagcattcctttcattcctcagaaccctgcccgaagcagcttagccgagtatttcaaggatagcagaaatgtgaagaagcttaaagaccctaccttgcggttccggctgctgaagcacacgcgtctcaacgttgttgccttcctcaatgagttgcccaaaacccagcacgacgtcaattccttcgtggtagacataagcgcccagacaagcacattgctgtgtttttctgtcaatggagtcttcaaggaagtggacggaaagtcccgggattctttgcgagccttcacccggacattcattgctgttcctgctagcaattcagggctatgtattgtaaatgatgagctatttgtgcggaatgccagttctgaagagatccaaagagccttcgctatgcctgcacccacgccttcctccagcccggtgcccaccctctctccagagcagcaggaaatgttgcaagcattctctacccagtctggcatgaacctcgagtggtcccagaagtgccttcaggacaacaactgggactacaccagatctgcccaggccttcactcatctcaaggccaagggcgagatcccagaagtggcattcatgaagtgatcgtagtcatgcctcagaagcagtcccccctgtaaatagtccttggatattaccgtctggttgtcgtctgtcatctcctcctgtctggcccgaggccgccccgtgactgtgaccgagggagggagggctgcctgatccctctcctcgcctgccttctggaagacttcagaagattgagcctcactggtgccaggaagccaaagcttactttgtagaactgacactaaactacccgaaggacttaggtgctttgtgtacttaaccccaggacctccttactttttaatataaagagtgatgttgtaaaaaaaaaaaaaaaaaaacatataataaataaatattataaaaacataataaacttaattacaatatatataaaaaaaaaaaaaaaactcgagggggggcccgtaccccaatcgccctatagggagccgattacaattactggcgtcgtttaacagcgttgggactgggggcgaataccaagaagcccgacccgacgcctttccaacagtggcaacctgaatggcattgcaaattgtagcgtaatttttta

SEQ ID NO: 366121 - DNA, 2866 bp, Homo sapiens
cggcaccgcccacagcctgggacgtcagcggcgcgcgacgtgctttgctgtataaatgcggtggcgcccggcgtagggacacttcggtcctgagcgcttgggagttaggttgtttgccggcgtagcggccagcgcctgagcccgcccttgatcttcgctgtggcatggcggacgaggggaagtcgtacagcgaacacgatgatgaacgcgttaatttccctcaaagaaagaagaaaggccggggtcccttccggtggaaatatggtgaaggaaaccgtaggtctggaagaggcggttctggtattcggtcttcccgccttgaggaagatgatggagatgtggcaatgagtgatgcccaggatggtccccgagtacgatacaacccctataccacccgacctaaccgtcggggtgatacttggcatgatcgagatcgcattcatgttactgtgcggagagacagagctcctccagagagaggaggggctggcaccagccaggatgggacctcaaagaactggttcaagattacaattccttatggcagaaagtatgacaaggcatggctcctgagcatgattcagagcaagtgcagtgtgcccttcacccctattgagtttcactatgagaatacacgggcccagttcttcgttgaagacgccagtactgcctctgcattgaaggctgtcaactataagattttggatcgggagaaccgaaggatatctatcatcatcaactcttctgctccaccccacactatactgaatgaactgaagccagaacaagtagaacagctaaagctgatcatgagcaaacgatacgatggctcccaacaagcccttgacctcaaaggcctccgttcagacccagatttggtggcccagaacattgacgttgtcctgaatcgcagaagctgtatggcagctaccctgaggatcattgaagagaacatccctgagctattgtccttgaacttgagcaacaacaggctgtacaggctggatgacatgtctagcattgttcagaaggcacccaacctgaagatcctaaacctttctggaaatgaattgaagtctgagcgggaattggacaagataaaggggctgaagctagaagagctctggctcgatggaaactccctgtgtgacaccttccgagaccagtccacctacatcagcgccattcgcgaacgatttcccaagttactacgcctggatggccatgagctacccccaccaattgcctttgatgttgaagcccccacgacgttaccgccctgcaagggaagctattttggaacagaaaacttgaagagtctggtcttgcacttcctgcaacagtactatgcaatttacgactctggagaccgacaagggctcctggatgcctaccatgatggggcctgctgttccctgagcattcctttcattcctcagaaccctgcccgaagcagcttagccgagtatttcaaggatagcagaaatgtgaagaagcttaaagaccctaccttgcggttccggctgctgaagcacacgcgtctcaacgttgttgccttcctcaatgagttgcccaaaacccagcacgacgtcaattccttcgtggtagacataagcgcccagacaagcacattgctgtgtttttctgtcaatggagtcttcaaggaagtggacggaaagtcccgggattctttgcgagccttcacccggacattcattgctgttcctgctagcaattcagggtaagtattctgcttttcgcattggataccagtcctaatccatggccaacagtgtggtaattggagggtagagtcagtctttggggtgatttcagaaaggcaacaggaaatcagagaaagctcacatagtagttaagagccagttaatagcttggctctggaattgtaccgtctgggttttcatcctggctccaccacttctagcaagtaggctgctgcctcatctgaaaattcatataacaatattcatttcctaagtttgttgtgaggatgaattaaaagagctaaagtccatgcgttgggagaaccctagtgtgtttagtagataatccttccaaacattgattccatgggaggggataaatgataaaaggtaacaatagctaagagtgggagggggaccttgtggatattgaaagaatcagagaataggaatgatgttgggaggatgatgttatctctgtctagctttttaagtgctctttgtcctcaaggctatgtattgtaaatgatgagctatttgtgcggaatgccagttctgaagagatccaaagagccttcgctatgcctgcacccacgccttcctccagcccggtgcccaccctctctccagagcagcaggaaatgttgcaagcattctctacccagtctggcatgaacctcgagtggtcccagaagtgccttcaggacaacaactgggactacaccagatctgcccaggccttcactcatctcaaggccaagggcgagatcccagaagtggcattcatgaagtgatcgtagtcatgcctcagaagcagtcccccctgtaaatagtccttggatattaccgtctggttgtcgtctgtcatctcctcctgtctggcccgaggccgccccgtgactgtgaccgagggagggagggctgcctgatccctctcctcgcctgccttctggaagacttcagaagattgagcctcactggtgccaggaagccaaagcttactttgtagaactgacactaaactacccgaaggacttaggtgctttgtgtacttaaccccaggacctccttactttttaatataaagagtgatgttgtatttcgtgttctgcactttttaatataaagagtgatgttgtatt

SEQ ID NO: 366122 - DNA, 2330 bp, Homo sapiens
cggcaccgcccacagcctgggacgtcagcggcgcgcgacgtgctttgctgtataaatgcggtggcgcccggcgtagggacacttcggtcctgagcgcttgggagttaggttgtttgccggcgtagcggccagcgcctgagcccgcccttgatcttcgctgtggcatggcggacgaggggaagtcgtacagcgaacacgatgatgaacgcgttaatttccctcaaagaaagaagaaaggccggggtcccttccggtggaaatatggtgaaggaaaccgtaggtctggaagaggcggttctggtattcggtcttcccgccttgaggaagatgatggagatgtggcaatgagtgatgcccaggatggtccccgagtacgatacaacccctataccacccgacctaaccgtcggggtgatacttggcatgatcgagatcgcattcatgttactgtgcggagagacagagctcctccagagagaggaggggctggcaccagccaggatgggacctcaaagaactggttcaagattacaattccttatggcagaaagtatgacaaggcatggctcctgagcatgattcagagcaagtgcagtgtgcccttcacccctattgagtttcactatgagaatacacgggcccagttcttcgttgaagacgccagtactgcctctgcattgaaggctgtcaactataagattttggatcgggagaaccgaaggatatctatcatcatcaactcttctgctccaccccacactatactgaatgaactgaagccagaacaagtagaacagctaaagctgatcatgagcaaacgatacgatggctcccaacaagcccttgacctcaaaggcctccgttcagacccagatttggtggcccagaacattgacgttgtcctgaatcgcagaagctgtatggcagctaccctgaggatcattgaagagaacatccctgagctattgtccttgaacttgagcaacaacaggctgtacaggctggatgacatgtctagcattgttcagaaggcacccaacctgaagatcctaaacctttctggaaatgaattgaagtctgagcgggaattggacaagataaaggggctgaagctagaagagctctggctcgatggaaactccctgtgtgacaccttccgagaccagtccacctacatcagcgccattcgcgaacgatttcccaagttactacgcctggatggccatgagctacccccaccaattgcctttgatgttgaagcccccacgacgttaccgccctgcaagggaagctattttggaacagaaaacttgaagagtctggtcttgcacttcctgcaacagtactatgcaatttacgactctggagaccgacaagggctcctggatgcctaccatgatggggcctgctgttccctgagcattcctttcattcctcagaaccctgcccgaagcagcttagccgagtatttcaaggatagcagaaatgtgaagaagcttaaagaccctaccttgcggttccggctgctgaagcacacgcgtctcaacgttgttgccttcctcaatgagttgcccaaaacccagcacgacgtcaattccttcgtggtagacataagcgcccagacaagcacattgctgtgtttttctgtcaatggagtcttcaaggaagtggacggaaagtcccgggattctttgcgagccttcacccggacattcattgctgttcctgctagcaattcaggttctgaagagatccaaagagccttcgctatgcctgcacccacgccttcctccagcccggtgcccaccctctctccagagcagcaggaaatgttgcaagcattctctacccagtctggcatgaacctcgagtggtcccagaagtgccttcaggacaacaactgggactacaccagatctgcccaggccttcactcatctcaaggccaagggcgagatcccagaagtggcattcatgaagtgatcgtagtcatgcctcagaagcagtcccccctgtaaatagtccttggatattaccgtctggttgtcgtctgtcatctcctcctgtctggcccgaggccgccccgtgactgtgaccgagggagggagggctgcctgatccctctcctcgcctgccttctggaagacttcagaagattgagcctcactggtgccaggaagccaaagcttactttgtagaactgacactaaactacccgaaggacttaggtgctttgtgtacttaaccccaggacctccttactttttaatataaagagtgatgttgtatttcgtgttctgcactttttaatataaagagtgatgttgtatt

SEQ ID NO: 366123 - DNA, 1580 bp, Homo sapiens
aactgatggatacctggtgaggcagcggagcccctgggctcccaccccattccctcctcccggggctgcacaggtgagtaggtggaaggtaaggggggcagggaggggaaagaggtcctgggcttaaagcctgggcttggagtactgctccttgacactcagggtcaggcagagagaaaagagacagccttcaaggcagtccatgtctgggtgccccgggtcaggtggggagtgggggccatttttccctgagcacaggctgggagggagtggagggatgagcaggatgggatgggctgtccctcgggtttggtatatttgctcctagagcagcccaggaggcacggtggctctgaagcatcactcacttctgtcccgttcttgacagcgccattcgcgaacgatttcccaagttactacgcctggatggccatgagctacccccaccaattgcctttgatgttgaagcccccacgacgttaccgccctgcaagggaagctattttggaacagaaaacttgaagagtctggtcttgcacttcctgcaacagtactatgcaatttacgactctggagaccgacaagggctcctggatgcctaccatgatggggcctgctgttccctgagcattcctttcattcctcagaaccctgcccgaagcagcttagccgagtatttcaaggatagcagaaatgtgaagaagcttaaagaccctaccttgcggttccggctgctgaagcacacgcgtctcaacgttgttgccttcctcaatgagttgcccaaaacccagcacgacgtcaattccttcgtggtagacataagcgcccagacaagcacattgctgtgtttttctgtcaatggagtcttcaaggaagtggacggaaagtcccgggattctttgcgagccttcacccggacattcattgctgttcctgctagcaattcagggctatgtattgtaaatgatgagctatttgtgcggaatgccagttctgaagagatccaaagagccttcgctatgcctgcacccacgccttcctccagcccggtgcccaccctctctccagagcagcaggaaatgttgcaagcattctctacccagtctggcatgaacctcgagtggtcccagaagtgccttcaggacaacaactgggactacaccagatctgcccaggccttcactcatctcaaggccaagggcgagatcccagaagtggcattcatgaagtgatcgtagtcatgcctcagaagcagtcccccctgtaaatagtccttggatattaccgtctggttgtcgtctgtcatctcctcctgtctggcccgaggccgccccgtgactgtgaccgagggagggagggctgcctgatccctctcctcgcctgccttctggaagacttcagaagattgagcctcactggtgccaggaagccaaagcttactttgtagaactgacactaaactacccgaaggacttaggtgctttgtgtacttaaccccaggacctccttactttttaatataaagagtgatgttgtatttcgtgttctgcactttttaatataaagagtgatgttgtatt

SEQ ID NO: 366124 - DNA, 1474 bp, Homo sapiens
ctgctctgaggccagatggagaatccactttgctggcacctgtgaataatgcattttctgatgatactctcagcatggatcagcgcctccttaaattaattctgcagaatcacatattgaaagtaaaagttggccttaatgagctttacaacgggcaaatactggaaatgaattgaagtctgagcgggaattggacaagataaaggggctgaagctagaagagctctggctcgatggaaactccctgtgtgacaccttccgagaccagtccacctacatcagcgccattcgcgaacgatttcccaagttactacgcctggatggccatgagctacccccaccaattgcctttgatgttgaagcccccacgacgttaccgccctgcaagggaagctattttggaacagaaaacttgaagagtctggtcttgcacttcctgcaacagtactatgcaatttacgactctggagaccgacaagggctcctggatgcctaccatgatggggcctgctgttccctgagcattcctttcattcctcagaaccctgcccgaagcagcttagccgagtatttcaaggatagcagaaatgtgaagaagcttaaagaccctaccttgcggttccggctgctgaagcacacgcgtctcaacgttgttgccttcctcaatgagttgcccaaaacccagcacgacgtcaattccttcgtggtagacataagcgcccagacaagcacattgctgtgtttttctgtcaatggagtcttcaaggaagtggacggaaagtcccgggattctttgcgagccttcacccggacattcattgctgttcctgctagcaattcagggctatgtattgtaaatgatgagctatttgtgcggaatgccagttctgaagagatccaaagagccttcgctatgcctgcacccacgccttcctccagcccggtgcccaccctctctccagagcagcaggaaatgttgcaagcattctctacccagtctggcatgaacctcgagtggtcccagaagtgccttcaggacaacaactgggactacaccagatctgcccaggccttcactcatctcaaggccaagggcgagatcccagaagtggcattcatgaagtgatcgtagtcatgcctcagaagcagtcccccctgtaaatagtccttggatattaccgtctggttgtcgtctgtcatctcctcctgtctggcccgaggccgccccgtgactgtgaccgagggagggagggctgcctgatccctctcctcgcctgccttctggaagacttcagaagattgagcctcactggtgccaggaagccaaagcttactttgtagaactgacactaaactacccgaaggacttaggtgctttgtgtacttaaccccaggacctccttactttttaatataaagagtgatgttgtatttcgtgttctgcactttttaatataaagagtgatgttgtatt

SEQ ID NO: 366125 - DNA, 1176 bp, Homo sapiens
gagctcggtaccccctaggtagatggccatgagctacccccaccaattgcctttgatgttgaagcccccacgacgttaccgccctgcaagggaagctattttggaacagaaaacttgaagagtctggtcttgcacttcctgcaacagtactatgcaatttacgactctggagaccgacaagggctcctggatgcctaccatgatggggcctgctgttccctgagcattcctttcattcctcagaaccctgcccgaagcagcttagccgagtatttcaaggatagcagaaatgtgaagaagcttaaagaccctaccttgcggttccggctgctgaagcacacgcgtctcaacgttgttgccttcctcaatgagttgcccaaaacccagcacgacgtcaattccttcgtggtagacataagcgcccagacaagcacattgctgtgtttttctgtcaatggagtcttcaaggaagtggacggaaagtcccgggattctttgcgagccttcacccggacattcattgctgttcctgctagcaattcagggctatgtattgtaaatgatgagctatttgtgcggaatgccagttctgaagagatccaaagagccttcgctatgcctgcacccacgccttcctccagcccggtgcccaccctctctccagagcagcaggaaatgttgcaagcattctctacccagtctggcatgaacctcgagtggtcccagaagtgccttcaggacaacaactgggactacaccagatctgcccaggccttcactcatctcaaggccaagggcgagatcccagaagtggcattcatgaagtgatcgtagtcatgcctcagaagcagtcccccctgtaaatagtccttggatattaccgtctggttgtcgtctgtcatctcctcctgtctggcccgaggccgccccgtgactgtgaccgagggagggagggctgcctgatccctctcctcgcctgccttctggaagacttcagaagattgagcctcactggtgccaggaagccaaagcttactttgtagaactgacactaaactacccgaaggacttaggtgctttgtgtacttaaccccaggacctccttactttttaatataaagagtgatgttgtatttcgtgttctgcactttttaatataaagagtgatgttgtatt

SEQ ID NO: 366126 - DNA, 2095 bp, Homo sapiens
cggcaccgcccacagcctgggacgtcagcggcgcgcgacgtgctttgctgtataaatgcggtggcgcccggcgtagggacacttcggtcctgagcgcttgggagttaggttgtttgccggcgtagcggccagcgcctgagcccgcccttgatcttcgctgtggcatggcggacgaggggaagtcgtacagcgaacacgatgatgaacgcgttaatttccctcaaagaaagaagaaaggccggggtcccttccggtggaaatatggtgaaggaaaccgtaggtctggaagaggcggttctggtattcggtcttcccgccttgaggaagatgatggagatgtggcaatgagtgatgcccaggatggtccccgagtacgatacaacccctataccacccgacctaaccgtcggggtgatacttggcatgatcgagatcgcattcatgttactgtgcggagagacagagctcctccagagagaggaggggctggcaccagccaggatgggacctcaaagaactggttcaagattacaattccttatggcagaaagtatgacaaggcatggctcctgagcatgattcagagcaagtgcagtgtgcccttcacccctattgagtttcactatgagaatacacgggcccagttcttcgttgaagacgccagtactgcctctgcattgaaggctgtcaactataagattttggatcgggagaaccgaaggatatctatcatcatcaactcttctgctccaccccacactatactgaatgaactgaagccagaacaagtagaacagctaaagctgatcatgagcaaacgatacgatggctcccaacaagcccttgacctcaaaggcctccgttcagacccagatttggtggcccagaacattgacgttgtcctgaatcgcagaagctgtatggcagctaccctgaggatcattgaagagaacatccctgagctattgtccttgaacttgagcaacaacaggctgtacaggctggatgacatgtctagcattgttcagaaggcacccaacctgaagatcctaaacctttctggaaatgaattgaagtctgagcgggaattggacaagataaaggggctgaagctagaagagctctggctcgatggaaactccctgtgtgacaccttccgagaccagtccacctacatcagcgccattcgcgaacgatttcccaagttactacgcctggatggccatgagctacccccaccaattgcctttgatgttgaagcccccacgacgttaccgccctgcaagggaagctattttggaacagaaaacttgaagagtctggtcttgcacttcctgcaacagtactatgcaatttacgactctggagaccgacaagggctcctggatgcctaccatgatggggcctgctgttccctgagcattcctttcattcctcagaaccctgcccgaagcagcttagccgagtatttcaaggatagcagaaatgtgaagaagcttaaagaccctaccttgcggttccggctgctgaagcacacgcgtctcaacgttgttgccttcctcaatgagttgcccaaaacccagcacgacgtcaattccttcgtggtagacataagcgcccagacaagcacattgctgtgtttttctgtcaatggagtcttcaaggaagtggacggaaagtcccgggattctttgcgagccttcacccggacattcattgctgttcctgctagcaattcagggctatgtattgtaaatgatgagctatttgtgcggaatgccagttctgaagagatccaaagagccttcgctatgcctgcacccacgccttcctccagcccggtgcccaccctctctccagagcagcaggaaatgttgcaagcattctctacccagtctggcatgaacctcgagtggtcccagaagtgagtgcggggcatgtgtaggatggggatgcactgaagtagggctagtagtaaataatgagggctcctgacagttttttttgtttttttttttggagacaagttcttgcgctgtcatccaggctggagtatagtggtgatcataactcactgtagcctctaattcctgtg

SEQ ID NO: 366127 - DNA, 1528 bp, Homo sapiens
aactgatggatacctggtgaggcagcggagcccctgggctcccaccccattccctcctcccggggctgcacaggtgagtaggtggaaggtaaggggggcagggaggggaaagaggtcctgggcttaaagcctgggcttggagtactgctccttgacactcagggtcaggcagagagaaaagagacagccttcaaggcagtccatgtctgggtgccccgggtcaggtggggagtgggggccatttttccctgagcacaggctgggagggagtggagggatgagcaggatgggatgggctgtccctcgggtttggtatatttgctcctagagcagcccaggaggcacggtggctctgaagcatcactcacttctgtcccgttcttgacagcgccattcgcgaacgatttcccaagttactacgcctggatggccatgagctacccccaccaattgcctttgatgttgaagcccccacgacgttaccgccctgcaagggaagctattttggaacagaaaacttgaagagtctggtcttgcacttcctgcaacagtactatgcaatttacgactctggagaccgacaagggctcctggatgcctaccatgatggggcctgctgttccctgagcattcctttcattcctcagaaccctgcccgaagcagcttagccgagtatttcaaggatagcagaaatgtgaagaagcttaaagaccctaccttgcggttccggctgctgaagcacacgcgtctcaacgttgttgccttcctcaatgagttgccagcacattgctgtgtttttctgtcaatggagtcttcaaggaagtggacggaaagtcccgggattctttgcgagccttcacccggacattcattgctgttcctgctagcaattcagggctatgtattgtaaatgatgagctatttgtgcggaatgccagttctgaagagatccaaagagccttcgctatgcctgcacccacgccttcctccagcccggtgcccaccctctctccagagcagcaggaaatgttgcaagcattctctacccagtctggcatgaacctcgagtggtcccagaagtgccttcaggacaacaactgggactacaccagatctgcccaggccttcactcatctcaaggccaagggcgagatcccagaagtggcattcatgaagtgatcgtagtcatgcctcagaagcagtcccccctgtaaatagtccttggatattaccgtctggttgtcgtctgtcatctcctcctgtctggcccgaggccgccccgtgactgtgaccgagggagggagggctgcctgatccctctcctcgcctgccttctggaagacttcagaagattgagcctcactggtgccaggaagccaaagcttactttgtagaactgacactaaactacccgaaggacttaggtgctttgtgtacttaaccccaggacctccttactttttaatataaagagtgatgttgtatttcgtgttctgcactttttaatataaagagtgatgttgtatt

SEQ ID NO: 366128 - DNA, 1094 bp, Homo sapiens
ttcaagtggttctcctgcttcagcctcccgagtagctgggactacaggtgcgcactaccacgcccagctaatttttgtatttttagtagagaaggggtttcgccatgttggacaggatggtctcgatctcttgacctcgtgatctgcccacctcagcctcccaaagtgctgggattatacgcatgagacactgtgcccggccgtagttattactattgtcctttctgacctgacccttcaccccacctgtgcttcccttatacccttatatacttaatcattcctctctgacttgctaggattctttatatcaaagaccatgattcaagaagctgtttgtaaacataaagcactagtgaccctaaggtgttgttgctgttcttattgcagtggacggaaagtcccgggattctttgcgagccttcacccggacattcattgctgttcctgctagcaattcagggctatgtattgtaaatgatgagctatttgtgcggaatgccagttctgaagagatccaaagagccttcgctatgcctgcacccacgccttcctccagcccggtgcccaccctctctccagagcagcaggaaatgttgcaagcattctctacccagtctggcatgaacctcgagtggtcccagaagtgccttcaggacaacaactgggactacaccagatctgcccaggccttcactcatctcaaggccaagggcgagatcccagaagtggcattcatgaagtgatcgtagtcatgcctcagaagcagtcccccctgtaaatagtccttggatattaccgtctggttgtcgtctgtcatctcctcctgtctggcccgaggccgccccgtgactgtgaccgagggagggagggctgcctgatccctctcctcgcctgccttctggaagacttcagaagattgagcctcactggtgccaggaagccaaagcttactttgtagaactgacactaaactacccgaaggacttaggtgctttgtgtacttaaccccaggacctccttactttttaatataaagagtgatgttgtatttcgtgttctgcactttttaatataaagagtgatgttgtatt

SEQ ID NO: 366129 - DNA, 1486 bp, Homo sapiens
agcaggctggtcccggccggagttgtaggatgagcgcttgggagttaggttgtttgccggcgtagcggccagcgcctgagcccgcccttgatcttcgctgtggcatggcggacgaggggaagtcgtacagcggtaagtgctggtcttcgggtcgggaactggctatctggggcgcgggtgggcggcgccggcctaggcctcagcccccggggcgtgaggccgctaggggcccggcgtccgcggggagcggcgcgcggggggccgggcactcgaggtggacacccgagttgttgactcctggattcctgctggcatcctggtgttgggggacctgcggctcggagcggatggctcgggggtagggtgacgggattcctttgaactttgtgggtggttgatgcctgtcagttaggtttggcggcctgactcttcctttaatgtgagtgagtgccctgctcgtgggctgccctgatgccctattttttactgcgtccagtcggtcttgaactctcgggcctgggctttggcttaatattcgagacttacacatcaactggatattctagtctgaacactacactgggtgttagttctttgtagtaagttaggagtgcgtggtggaggttgaaaccgtgaatttaaaactctcgttttccacccccttaatgtggaataacaacagcatttcttaagagtgtgtgtggggaggggaaatgagatcattcctatcaagtgcctgaagcatagtggccggcactggagaaagttctcagtgaatgttagctgcgccttctatgttcttttttcctagggtcatttgttgacattcattgctgttcctgctagcaattcagggctatgtattgtaaatgatgagctatttgtgcggaatgccagttctgaagagatccaaagagccttcgctatgcctgcacccacgccttcctccagcccggtgcccaccctctctccagagcagcaggaaatgttgcaagcattctctacccagtctggcatgaacctcgagtggtcccagaagtgccttcaggacaacaactgggactacaccagatctgcccaggccttcactcatctcaaggccaagggcgagatcccagaagtggcattcatgaagtgatcgtagtcatgcctcagaagcagtcccccctgtaaatagtccttggatattaccgtctggttgtcgtctgtcatctcctcctgtctggcccgaggccgccccgtgactgtgaccgagggagggagggctgcctgatccctctcctcgcctgccttctggaagacttcagaagattgagcctcactggtgccaggaagccaaagcttactttgtagaactgacactaaactacccgaaggacttaggtgctttgtgtacttaaccccaggacctccttactttttaatataaagagtgatgttgtatttcgtgttctgcactttttaatataaagagtgatgttgtatt

SEQ ID NO: 366130 - DNA, 1588 bp, Homo sapiens
ttcaagtggttctcctgcttcagcctcccgagtagctgggactacaggtgcgcactaccacgcccagctaatttttgtatttttagtagagaaggggtttcgccatgttggacaggatggtctcgatctcttgacctcgtgatctgcccacctcagcctcccaaagtgctgggattatacgcatgagacactgtgcccggccgtagttattactattgtcctttctgacctgacccttcaccccacctgtgcttcccttatacccttatatacttaatcattcctctctgacttgctaggattctttatatcaaagaccatgattcaagaagctgtttgtaaacataaagcactagtgaccctaaggtgttgttgctgttcttattgcagtggacggaaagtcccgggattctttgcgagccttcacccggacattcattgctgttcctgctagcaattcagggtaagtattctgcttttcgcattggataccagtcctaatccatggccaacagtgtggtaattggagggtagagtcagtctttggggtgatttcagaaaggcaacaggaaatcagagaaagctcacatagtagttaagagccagttaatagcttggctctggaattgtaccgtctgggttttcatcctggctccaccacttctagcaagtaggctgctgcctcatctgaaaattcatataacaatattcatttcctaagtttgttgtgaggatgaattaaaagagctaaagtccatgcgttgggagaaccctagtgtgtttagtagataatccttccaaacattgattccatgggaggggataaatgataaaaggtaacaatagctaagagtgggagggggaccttgtggatattgaaagaatcagagaataggaatgatgttgggaggatgatgttatctctgtctagctttttaagtgctctttgtcctcaaggctatgtattgtaaatgatgagctatttgtgcggaatgccagttctgaagagatccaaagagccttcgctatgcctgcacccacgccttcctccagcccggtgcccaccctctctccagagcagcaggaaatgttgcaagcattctctacccagtctggcatgaacctcgagtggtcccagaagtgccttcaggacaacaactgggactacaccagatctgcccaggccttcactcatctcaaggccaagggcgagatcccagaagtggcattcatgaagtgatcgtagtcatgcctcagaagcagtcccccctgtaaatagtccttggatattaccgtctggttgtcgtctgtcatctcctcctgtctggcccgaggccgccccgtgactgtgaccgagggagggagggctgcctgatccctctcctcgcctgccttctggaagacttcagaagattgagcctcactggtgccaggaagccaaagcttactttgtagaactgacactaaactacccgaaggacttaggtgctttgtgtacttaaccccaggacctccttactttttaatataaagagtgatgttgtatttcgtgttctgcactttttaatataaagagtgatgttgtatt

SEQ ID NO: 366131 - DNA, 588 bp, Homo sapiens
cctagacctagtctccttgccaagcttccttctgcacccacgccttcctccagcccggtgcccaccctctctccagagcagcaggaaatgttgcaagcattctctacccagtctggcatgaacctcgagtggtcccagaagtgccttcaggacaacaactgggactacaccagatctgcccaggccttcactcatctcaaggccaagggcgagatcccagaagtggcattcatgaagtgatcgtagtcatgcctcagaagcagtcccccctgtaaatagtccttggatattaccgtctggttgtcgtctgtcatctcctcctgtctggcccgaggccgccccgtgactgtgaccgagggagggagggctgcctgatccctctcctcgcctgccttctggaagacttcagaagattgagcctcactggtgccaggaagccaaagcttactttgtagaactgacactaaactacccgaaggacttaggtgctttgtgtacttaaccccaggacctccttactttttaatataaagagtgatgttgtatttcgtgttctgcactttttaatataaagagtgatgttgtatt

SEQ ID NO: 366132 - DNA, 692 bp, Homo sapiens
cggcaccgcccacagcctgggacgtcagcggcgcgcgacgtgctttgctgtataaatgcggtggcgcccggcgtagggacacttcggtcctgagcgcttgggagttaggttgtttgccggcgtagcggccagcgcctgagcccgcccttgatcttcgctgtggcatggcggacgaggggaagtcgtacagcgaacacgatgatgaacgcgttaatttccctcaaagaaagaagaaaggccggggtcccttccggtggaaatatggtgaaggaaaccgtaggtctggaagaggcggttctggtattcggtcttcccgccttgaggaagatgatggagatgtggcaatgagtgatgcccaggatggtccccgagtacgatacaacccctataccacccgacctaaccgtcggggtgatacttggcatgatcgagatcgcattcatgttactgtgcggagagacagagctcctccagagagaggaggggctggcaccagccaggatgggacctcaaagaactggttcaagattacaattccttatggcagaaagtatgacaaggcatggctcctgagcatgattcagagcaagtgcagtgtgcccttcacccctattgagtttcactatgagatcacgagctggctcaatcactagtgaattcgcgccgcctgcaggtcgacaatatggaagcat

SEQ ID NO: 366133 - DNA, 454 bp, Homo sapiens
agcaggctggtcccggccggagttgtaggatgagcgcttgggagttaggttgtttgccggcgtagcggccagcgcctgagcccgcccttgatcttcgctgtggcatggcggacgaggggaagtcgtacagcgaacacgatgatgaacgcgttaatttccctcaaagaaagaagaaaggccggggtcccttccggtggaaatatggtgaaggaaaccgtaggtctggaggagggctgcctgatccctctcctcgcctgccttctggaagacttcagaagattgagcctcactggtgccaggaagccaaagcttactttgtagaactgacactaaactacccgaaggacttaggtgctttgtgtacttaaccccaggacctccttactttttaatataaagagtgatgttgtatttcgtgttctgcactttttaatataaagagtgatgttgtatt

SEQ ID NO: 366134 - DNA, 349 bp, Homo sapiens
tctggtttgaatttagtggctcatgagattatatggcccttttactgtccatgtcatttcctttcccacctgttagagtgagaaatgccaggactagcttagtgattaaacagtcttagttgtagtcccactaacagtgcaggaaggcctttgagaagactttcctagcatttgtggtcattttattctctgcttacccacagcaacccctataccacccgacctaaccgtcggggtgatacttggcatgatcgagatcgcattcatgttactgtgcggagagacagagctcctccagagagaggaggggctggcaccagccaggatgggacctcaaagaactggttca

SEQ ID NO: 366135 - DNA, 2313 bp, Homo sapiens
gcggctggtacggtcccgaagtccgtttgattgagcgcttgggagttaggttgtttgccggcgtagcggccagcgcctgagcccgcccttgatcttcgctgtggcatggcggacgaggggaagtcgtacagcgaacacgatgatgaacgcgttaatttccctcaaagaaagaagaaaggccggggtcccttccggtggaaatatggtgaaggaaaccgtaggtctggaagaggcggttctggtattcggtcttcccgccttgaggaagatgatggagatgtggcaatgagtgatgcccaggatggtccccgagtacgatacaacccctataccacccgacctaaccgtcggggtgatacttggcatgatcgagatcgcattcatgttactgtgcggagagacagagctcctccagagagaggaggggctggcaccagccaggatgggacctcaaagaactggttcaagattacaattccttatggcagaaagtatgacaaggcatggctcctgagcatgattcagagcaagtgcagtgtgcccttcacccctattgagtttcactatgagaatacacgggcccagttcttcgttgaagacgccagtactgcctctgcattgaaggctgtcaactataagattttggatcgggagaaccgaaggatatctatcatcatcaactcttctgctccaccccacactatactgaatgaactgaagccagaacaagtagaacagctaaagctgatcatgagcaaacgatacgatggctcccaacaagcccttgacctcaaaggcctccgttcagacccagatttggtggcccagaacattgacgttgtcctgaatcgcagaagctgtatggcagctaccctgaggatcattgaagagaacatccctgagctattgtccttgaacttgagcaacaacaggctgtacaggctggatgacatgtctagcattgttcagaaggcacccaacctgaagatcctaaacctttctggaaatgaattgaagtctgagcgggaattggacaagataaaggggctgaagctagaagagctctggctcgatggaaactccctgtgtgacaccttccgagaccagtccacctacatcagcgccattcgcgaacgatttcccaagttactacgcctggatggccatgagctacccccaccaattgcctttgatgttgaagcccccacgacgttaccgccctgcaagggaagctattttggaacagaaaacttgaagagtctggtcttgcacttcctgcaacagtactatgcaatttacgactctggagaccgacaagggctcctggatgcctaccatgatggggcctgctgttccctgagcattcctttcattcctcagaaccctgcccgaagcagcttagccgagtatttcaaggatagcagaaatgtgaagaagcttaaagaccctaccttgcggttccggctgctgaagcacacgcgtctcaacgttgttgccttcctcaatgagttgcccaaaacccagcacgacgtcaattccttcgtggtagacataagcgcccagacaagcacattgctgtgtttttctgtcaatggagtcttcaaggaagtggacggaaagtcccgggattctttgcgagccttcacccggacattcattgctgttcctgctagcaattcagggctatgtattgtaaatgatgagctatttgtgcggaatgccagttctgaagagatccaaagagccttcgctatgcctgcacccacgccttcctccagcccggtgcccaccctctctccagagcagcaggaaatgttgcaagcattctctacccagtctggcatgaacctcgagtggtcccagaagtgccttcaggacaacaactgggactacaccagatctgcccaggccttcactcatctcaaggccaagggcgagatcccagaagtggcattcatgaagtgatcgtagtcatgcctcagaagcagtcccccctgtaaatagtccttggatattaccgtctggttgtcgtctgtcatctcctcctgtctggcccgaggccgccccgtgactgtgaccgagggagggagggctgcctgatccctctcctcgcctgccttctggaagacttcagaagattgagcctcactggtgccaggaagccaaagcttactttgtagaactgacactaaactacccgaaggacttaggtgctttgtgtacttaaccccaggacctccttactttttaatataaagagtgatgttgtatttcgtgttctgcactttttaatataaagagtgatgttgtatt

SEQ ID NO: 366136 - DNA, 2645 bp, Homo sapiens
cggcaccgcccacagcctgggacgtcagcggcgcgcgacgtgctttgctgtataaatgcggtggcgcccggcgtagggacacttcggtcctgagcgcttgggagttaggttgtttgccggcgtagcggccagcgcctgagcccgcccttgatcttcgctgtggcatggcggacgaggggaagtcgtacagcgaacacgatgatgaacgcgttaatttccctcaaagaaagaagaaaggccggggtcccttccggtggaaatatggtgaaggaaaccgtaggtctggaagaggcggttctggtattcggtcttcccgccttgaggaagatgatggagatgtggcaatgagtgatgcccaggatggtccccgagtacgatacaacccctataccacccgacctaaccgtcggggtgatacttggcatgatcgagatcgcattcatgttactgtgcggagagacagagctcctccagagagaggaggggctggcaccagccaggatgggacctcaaagaactggttcaagattacaattccttatggcagaaagtatgacaaggcatggctcctgagcatgattcagagcaagtgcagtgtgcccttcacccctattgagtttcactatgagaatacacgggcccagttcttcgttgaagacgccagtactgcctctgcattgaaggctgtcaactataagattttggatcgggagaaccgaaggatatctatcatcatcaactcttctgctccaccccacactatactgaatgaactgaagccagaacaagtagaacagctaaagctgatcatgagcaaacgatacgatggctcccaacaagcccttgacctcaaaggcctccgttcagacccagatttggtggcccagaacattgacgttgtcctgaatcgcagaagctgtatggcagctaccctgaggatcattgaagagaacatccctgagctattgtccttgaacttgagcaacaacaggctgtacaggctggatgacatgtctagcattgttcagaaggcacccaacctgaagatcctaaacctttctggaaatgaattgaagtctgagcgggaattggacaagataaaggggctgaagctagaagagctctggctcgatggaaactccctgtgtgacaccttccgagaccagtccacctacatcagcgccattcgcgaacgatttcccaagttactacgcctggatggccatgagctacccccaccaattgcctttgatgttgaagcccccacgacgttaccgccctgcaagggaagctattttggaacagaaaacttgaagagtctggtcttgcacttcctgcaacagtactatgcaatttacgactctggagaccgacaagggctcctggatgcctaccatgatggggcctgctgttccctgagcattcctttcattcctcagaaccctgcccgaagcagcttagccgagtatttcaaggatagcagaaatgtgaagaagcttaaagaccctaccttgcggttccggctgctgaagcacacgcgtctcaacgttgttgccttcctcaatgagttgcccaaaacccagcacgacgtcaattccttcgtggtagacataagcgcccagacaagcacattgctgtgtttttctgtcaatggagtcttcaaggaagtggacggaaagtcccgggattctttgcgagccttcacccggacattcattgctgttcctgctagcaattcagggctatgtattgtaaatgatgagctatttgtgcggaatgccagttctgaagagatccaaagagccttcgctatgcctgcacccacgccttcctccagcccggtgcccaccctctctccagagcagcaggaaatgttgcaagcattctctacccagtctggcatgaacctcgagtggtcccagaagtgccttcaggacaacaactgggactacaccagatctgcccaggccttcactcatctcaaggccaagggcgagatcccagaagtggcattcatgaagtgatcgtagtcatgcctcagaagcagtcccccctgtaaatagtccttggatattaccgtctggttgtcgtctgtcatctcctcctgtctggcccgaggccgccccgtgactgtgaccgagggagggagggctgcctgatccctctcctcgcctgccttctggaagacttcagaagattgagcctcactggtgccaggaagccaaagcttactttgtagaactgacactaaactacccgaaggacttaggtgctttgtgtacttaaccccaggacctccttactttttaatataaagagtgatgttgtatttcgtgttctgcactttttaatataaagagtgatgttgtattaaaaaaaaaaacaacaaaaaaaaaaaaaaaaaaaaaaaaacatataataaataaatattataaaaacataataaacttaattacaatatatataaaaaaaaaaaaaaaactcgagggggggcccgtaccccaatcgccctatagggagccgattacaattactggcgtcgtttaacagcgttgggactgggggcgaataccaagaagcccgacccgacgcctttccaacagtggcaacctgaatggcattgcaaattgtagcgtaatttttta

SEQ ID NO: 366137 - DNA, 2285 bp, Homo sapiens
ggcgctagtagagtgtcgtagtaatgccggattagcgaggtaagcctgcatcacaggtccttgatcttcgctgtggcatggcggacgaggggaagtcgtacagcgaacacgatgatgaacgcgttaatttccctcaaagaaagaagaaaggccggggtcccttccggtggaaatatggtgaaggaaaccgtaggtctggaagaggcggttctggtattcggtcttcccgccttgaggaagatgatggagatgtggcaatgagtgatgcccaggatggtccccgagtacgatacaacccctataccacccgacctaaccgtcggggtgatacttggcatgatcgagatcgcattcatgttactgtgcggagagacagagctcctccagagagaggaggggctggcaccagccaggatgggacctcaaagaactggttcaagattacaattccttatggcagaaagtatgacaaggcatggctcctgagcatgattcagagcaagtgcagtgtgcccttcacccctattgagtttcactatgagaatacacgggcccagttcttcgttgaagacgccagtactgcctctgcattgaaggctgtcaactataagattttggatcgggagaaccgaaggatatctatcatcatcaactcttctgctccaccccacactatactgaatgaactgaagccagaacaagtagaacagctaaagctgatcatgagcaaacgatacgatggctcccaacaagcccttgacctcaaaggcctccgttcagacccagatttggtggcccagaacattgacgttgtcctgaatcgcagaagctgtatggcagctaccctgaggatcattgaagagaacatccctgagctattgtccttgaacttgagcaacaacaggctgtacaggctggatgacatgtctagcattgttcagaaggcacccaacctgaagatcctaaacctttctggaaatgaattgaagtctgagcgggaattggacaagataaaggggctgaagctagaagagctctggctcgatggaaactccctgtgtgacaccttccgagaccagtccacctacatcagcgccattcgcgaacgatttcccaagttactacgcctggatggccatgagctacccccaccaattgcctttgatgttgaagcccccacgacgttaccgccctgcaagggaagctattttggaacagaaaacttgaagagtctggtcttgcacttcctgcaacagtactatgcaatttacgactctggagaccgacaagggctcctggatgcctaccatgatggggcctgctgttccctgagcattcctttcattcctcagaaccctgcccgaagcagcttagccgagtatttcaaggatagcagaaatgtgaagaagcttaaagaccctaccttgcggttccggctgctgaagcacacgcgtctcaacgttgttgccttcctcaatgagttgcccaaaacccagcacgacgtcaattccttcgtggtagacataagcgcccagacaagcacattgctgtgtttttctgtcaatggagtcttcaaggaagtggacggaaagtcccgggattctttgcgagccttcacccggacattcattgctgttcctgctagcaattcagggctatgtattgtaaatgatgagctatttgtgcggaatgccagttctgaagagatccaaagagccttcgctatgcctgcacccacgccttcctccagcccggtgcccaccctctctccagagcagcaggaaatgttgcaagcattctctacccagtctggcatgaacctcgagtggtcccagaagtgccttcaggacaacaactgggactacaccagatctgcccaggccttcactcatctcaaggccaagggcgagatcccagaagtggcattcatgaagtgatcgtagtcatgcctcagaagcagtcccccctgtaaatagtccttggatattaccgtctggttgtcgtctgtcatctcctcctgtctggcccgaggccgccccgtgactgtgaccgagggagggagggctgcctgatccctctcctcgcctgccttctggaagacttcagaagattgagcctcactggtgccaggaagccaaagcttactttgtagaactgacactaaactacccgaaggacttaggtgctttgtgtacttaaccccaggacctccttactttttaatataaagagtgatgttgtatttcgtgttctgcactttttaatataaagagtgatgttgtatt

SEQ ID NO: 366138 - DNA, 2320 bp, Homo sapiens
cggcaccgcccacagcctgggacgtcagcggcgcgcgacgtgctttgctgtataaatgcggtggcgcccggcgtagggacacttcggtcctgagcgcttgggagttaggttgtttgccggcgtagcggccagcgcctgagcccgcccttgatcttcgctgtggcatggcggacgaggggaagtcgtacagcgaacacgatgatgaacgcgttaatttccctcaaagaaagaagaaaggccggggtcccttccggtggaaatatggtgaaggaaaccgtaggtctggaagaggcggttctggtattcggtcttcccgccttgaggaagatgatggagatgtggcaatgagtgatgcccaggatggtccccgagtacgatacaacccctataccacccgacctaaccgtcggggtgatacttggcatgatcgagatcgcattcatgttactgtgcggagagacagagctcctccagagagaggaggggctggcaccagccaggatgggacctcaaagaactggttcaagattacaattccttatggcagaaagtatgacaaggcatggctcctgagcatgattcagagcaagtgcagtgtgcccttcacccctattgagtttcactatgagaatacacgggcccagttcttcgttgaagacgccagtactgcctctgcattgaaggctgtcaactataagattttggatcgggagaaccgaaggatatctatcatcatcaactcttctgctccaccccacactatactgaatgaactgaagccagaacaagtagaacagctaaagctgatcatgagcaaacgatacgatggctcccaacaagcccttgacctcaaaggcctccgttcagacccagatttggtggcccagaacattgacgttgtcctgaatcgcagaagctgtatggcagctaccctgaggatcattgaagagaacatccctgagctattgtccttgaacttgagcaacaacaggctgtacaggctggatgacatgtctagcattgttcagaaggcacccaacctgaagatcctaaacctttctggaaatgaattgaagtctgagcgggaattggacaagataaaggggctgaagctagaagagctctggctcgatggaaactccctgtgtgacaccttccgagaccagtccacctacatcagcgccattcgcgaacgatttcccaagttactacgcctggatggccatgagctacccccaccaattgcctttgatgttgaagcccccacgacgttaccgccctgcaagggaagctattttggaacagaaaacttgaagagtctggtcttgcacttcctgcaacagtactatgcaatttacgactctggagaccgacaagggctcctggatgcctaccatgatggggcctgctgttccctgagcattcctttcattcctcagaaccctgcccgaagcagcttagccgagtatttcaaggatagcagaaatgtgaagaagcttaaagaccctaccttgcggttccggctgctgaagcacacgcgtctcaacgttgttgccttcctcaatgagttgccagcacattgctgtgtttttctgtcaatggagtcttcaaggaagtggacggaaagtcccgggattctttgcgagccttcacccggacattcattgctgttcctgctagcaattcagggctatgtattgtaaatgatgagctatttgtgcggaatgccagttctgaagagatccaaagagccttcgctatgcctgcacccacgccttcctccagcccggtgcccaccctctctccagagcagcaggaaatgttgcaagcattctctacccagtctggcatgaacctcgagtggtcccagaagtgccttcaggacaacaactgggactacaccagatctgcccaggccttcactcatctcaaggccaagggcgagatcccagaagtggcattcatgaagtgatcgtagtcatgcctcagaagcagtcccccctgtaaatagtccttggatattaccgtctggttgtcgtctgtcatctcctcctgtctggcccgaggccgccccgtgactgtgaccgagggagggagggctgcctgatccctctcctcgcctgccttctggaagacttcagaagattgagcctcactggtgccaggaagccaaagcttactttgtagaactgacactaaactacccgaaggacttaggtgctttgtgtacttaaccccaggacctccttactttttaatataaagagtgatgttgtatttcgtgttctgcactttttaatataaagagtgatgttgtatt

SEQ ID NO: 366139 - DNA, 2287 bp, Homo sapiens
cggcaccgcccacagcctgggacgtcagcggcgcgcgacgtgctttgctgtataaatgcggtggcgcccggcgtagggacacttcggtcctgagcgcttgggagttaggttgtttgccggcgtagcggccagcgcctgagcccgcccttgatcttcgctgtggcatggcggacgaggggaagtcgtacagcgaacacgatgatgaacgcgttaatttccctcaaagaaagaagaaaggccggggtcccttccggtggaaatatggtgaaggaaaccgtaggtctggaagaggcggttctggtattcggtcttcccgccttgaggaagatgatggagatgtggcaatgagtgatgcccaggatggtccccgagtacgatacaacccctataccacccgacctaaccgtcggggtgatacttggcatgatcgagatcgcattcatgttactgtgcggagagacagagctcctccagagagaggaggggctggcaccagccaggatgggacctcaaagaactggttcaagattacaattccttatggcagaaagtatgacaaggcatggctcctgagcatgattcagagcaagtgcagtgtgcccttcacccctattgagtttcactatgagaatacacgggcccagttcttcgttgaagacgccagtactgcctctgcattgaaggctgtcaactataagattttggatcgggagaaccgaaggatatctatcatcatcaactcttctgctccaccccacactatactgaatgaactgaagccagaacaagtagaacagctaaagctgatcatgagcaaacgatacgatggctcccaacaagcccttgacctcaaaggcctccgttcagacccagatttggtggcccagaacattgacgttgtcctgaatcgcagaagctgtatggcagctaccctgaggatcattgaagagaacatccctgagctattgtccttgaacttgagcaacaacaggctgtacaggctggatgacatgtctagcattgttcagaaggcacccaacctgaagatcctaaacctttctggaaatgaattgaagtctgagcgggaattggacaagataaaggggctgaagctagaagagctctggctcgatggaaactccctgtgtgacaccttccgagaccagtccacctacatcagcgccattcgcgaacgatttcccaagttactacgcctggatggccatgagctacccccaccaattgcctttgatgttgaagcccccacgacgttaccgccctgcaagggaagctattttggaacagaaaacttgaagagtctggtcttgcacttcctgcaacagtactatgcaatttacgactctggagaccgacaagggctcctggatgcctaccatgatggggcctgctgttccctgagcattcctttcattcctcagaaccctgcccgaagcagcttagccgagtatttcaaggatagcagaaatgtgaagaagcttaaagaccctaccttgcggttccggctgctgaagcacacgcgtctcaacgttgttgccttcctcaatgagttgcccaaaacccagcacgacgtcaattccttcgtggtagacataagcgcccagacaagcacattgctgtgtttttctgtcaatggagtcttcaaggaagtggacggaaagtcccgggattctttgcgagccttcacccggacattcattgctgttcctgctagcaattcaggttctgaagagatccaaagagccttcgctatgcctgcacccacgccttcctccagcccggtgcccaccctctctccagagcagcaggaaatgttgcaagcattctctacccagtctggcatgaacctcgagtggtcccagaagtgccttcaggacaacaactgggactacaccagatctgcccaggccttcactcatctcaaggccaagggcgagatcccagaagtggcattcatgaagtgatcgtagtcatgcctcagaagcagtcccccctgtaaatagtccttggatattaccgtctggttgtcgtctgtcatctcctcctgtctggcccgaggccgccccgtgactgtgaccgagggagggagggctgcctgatccctctcctcgcctgccttctggaagacttcagaagattgagcctcactggtgccaggaagccaaagcttactttgtagaactgacactaaactacccgaaggacttaggtgctttgtgtacttaaccccaggacctccttactttttaatataaagagtgatgttgta

SEQ ID NO: 366140 - DNA, 1543 bp, Homo sapiens
aactgatggatacctggtgaggcagcggagcccctgggctcccaccccattccctcctcccggggctgcacaggtgagtaggtggaaggtaaggggggcagggaggggaaagaggtcctgggcttaaagcctgggcttggagtactgctccttgacactcagggtcaggcagagagaaaagagacagccttcaaggcagtccatgtctgggtgccccgggtcaggtggggagtgggggccatttttccctgagcacaggctgggagggagtggagggatgagcaggatgggatgggctgtccctcgggtttggtatatttgctcctagagcagcccaggaggcacggtggctctgaagcatcactcacttctgtcccgttcttgacagcgccattcgcgaacgatttcccaagttactacgcctggatggccatgagctacccccaccaattgcctttgatgttgaagcccccacgacgttaccgccctgcaaggggaagctattttggaacagtactatgcaatttacgactctggagaccgacaagggctcctggatgcctaccatgatggggcctgctgttccctgagcattcctttcattcctcagaaccctgcccgaagcagcttagccgagtatttcaaggatagcagaaatgtgaagaagcttaaagaccctaccttgcggttccggctgctgaagcacacgcgtctcaacgttgttgccttcctcaatgagttgcccaaaacccagcacgacgtcaattccttcgtggtagacataagcgcccagacaagcacattgctgtgtttttctgtcaatggagtcttcaaggaagtggacggaaagtcccgggattctttgcgagccttcacccggacattcattgctgttcctgctagcaattcagggctatgtattgtaaatgatgagctatttgtgcggaatgccagttctgaagagatccaaagagccttcgctatgcctgcacccacgccttcctccagcccggtgcccaccctctctccagagcagcaggaaatgttgcaagcattctctacccagtctggcatgaacctcgagtggtcccagaagtgccttcaggacaacaactgggactacaccagatctgcccaggccttcactcatctcaaggccaagggcgagatcccagaagtggcattcatgaagtgatcgtagtcatgcctcagaagcagtcccccctgtaaatagtccttggatattaccgtctggttgtcgtctgtcatctcctcctgtctggcccgaggccgccccgtgactgtgaccgagggagggagggctgcctgatccctctcctcgcctgccttctggaagacttcagaagattgagcctcactggtgccaggaagccaaagcttactttgtagaactgacactaaactacccgaaggacttaggtgctttgtgtacttaaccccaggacctccttactttttaatataaagagtgatgttgtatttcgtgttctgcactttttaatataaagagtgatgttgtatt

SEQ ID NO: 366141 - DNA, 1147 bp, Homo sapiens
tctcactgtgtcacccaggctggagtgcaatggtgtgatcttggctcactgcaacctctgcctcccagggttcaagtgattctcctgcctcagcctccccagtagctgggactacaggtactatgcaatttacgactctggagaccgacaagggctcctggatgcctaccatgatggggcctgctgttccctgagcattcctttcattcctcagaaccctgcccgaagcagcttagccgagtatttcaaggatagcagaaatgtgaagaagcttaaagaccctaccttgcggttccggctgctgaagcacacgcgtctcaacgttgttgccttcctcaatgagttgcccaaaacccagcacgacgtcaattccttcgtggtagacataagcgcccagacaagcacattgctgtgtttttctgtcaatggagtcttcaaggaagtggacggaaagtcccgggattctttgcgagccttcacccggacattcattgctgttcctgctagcaattcagggctatgtattgtaaatgatgagctatttgtgcggaatgccagttctgaagagatccaaagagccttcgctatgcctgcacccacgccttcctccagcccggtgcccaccctctctccagagcagcaggaaatgttgcaagcattctctacccagtctggcatgaacctcgagtggtcccagaagtgccttcaggacaacaactgggactacaccagatctgcccaggccttcactcatctcaaggccaagggcgagatcccagaagtggcattcatgaagtgatcgtagtcatgcctcagaagcagtcccccctgtaaatagtccttggatattaccgtctggttgtcgtctgtcatctcctcctgtctggcccgaggccgccccgtgactgtgaccgagggagggagggctgcctgatccctctcctcgcctgccttctggaagacttcagaagattgagcctcactggtgccaggaagccaaagcttactttgtagaactgacactaaactacccgaaggacttaggtgctttgtgtacttaaccccaggacctccttactttttaatataaagagtgatgttgtatttcgtgttctgcactttttaatataaagagtgatgttgtatt

SEQ ID NO: 366142 - DNA, 1583 bp, Homo sapiens
cggcaccgcccacagcctgggacgtcagcggcgcgcgacgtgctttgctgtataaatgcggtggcgcccggcgtagggacacttcggtcctgagcgcttgggagttaggttgtttgccggcgtagcggccagcgcctgagcccgcccttgatcttcgctgtggcatggcggacgaggggaagtcgtacagcgaacacgatgatgaacgcgttaatttccctcaaagaaagaagaaaggccggggtcccttccggtggaaatatggtgaaggaaaccgtaggtctggaagaggcggttctggtattcggtcttcccgccttgaggaagatgatggagatgtggcaatgagtgatgcccaggatggtccccgagtacgatacaacccctataccacccgacctaaccgtcggggtgatacttggcatgatcgagatcgcattcatgttactgtgcggagagacagagctcctccagagagaggaggggctggcaccagccaggatgggacctcaaagaactggttcaagattacaattccttatggcagaaagtatgacaaggcatggctcctgagcatgattcagagcaagtgcagtgtgcccttcacccctattgagtttcactatgagaatacacgggcccagttcttcgttgaagacgccagtactgcctctgcattgaaggctgtcaactataagattttggatcgggagaaccgaaggatatctatcatcatcaactcttctgctccaccccacactatactgaatgaactgaagccagaacaagtagaacagctaaagctgatcatgagcaaacgatacgatggctcccaacaagcccttgacctcaaaggcctccgttcagacccagatttggtggcccagaacattgacgttgtcctgaatcgcagaagctgtatggcagctaccctgaggatcattgaagagaacatccctgagctattgtccttgaacttgagcaacaacaggctgtacaggctggatgacatgtctagcattgttcagaaggcacccaacctgaagatcctaaacctttctggaaatgaattgaagtctgagcgggaattggacaagataaaggggctgaagctagaagagctctggctcgatggaaactccctgtgtgacaccttccgagaccagtccacctacatcaggtcagttgtagcctgtgtctcccctcctggggaccttcaccccctgggaggctgagctaatgcatcctgaccagggcccgtctgcggagatgtgcagccctgagctggaaccacctgtcctttgagaggatcgcgtgctccccactttggtctgtctgtgtcttccagctttgtcctgagatgttctctcttctcttctgacttgactatctgtttgctgggtctgtggcctttctctttcttcctgaacacaaccttttctagaatctccctaccctgttgttccaggaaaggcatctcccctttctactctaaccagagggtatcttgtacataccctatagatggggttgccttgtgccaagagcctggtgtccatgggttgaggaagccctccctacct

SEQ ID NO: 366143 - DNA, 1443 bp, Homo sapiens
agcaggctggtcccggccggagttgtaggatgagcgcttgggagttaggttgtttgccggcgtagcggccagcgcctgagcccgcccttgatcttcgctgtggcatggcggacgaggggaagtcgtacagcggtaagtgctggtcttcgggtcgggaactggctatctggggcgcgggtgggcggcgccggcctaggcctcagcccccggggcgtgaggccgctaggggcccggcgtccgcggggagcggcgcgcggggggccgggcactcgaggtggacacccgagttgttgactcctggattcctgctggcatcctggtgttgggggacctgcggctcggagcggatggctcgggggtagggtgacgggattcctttgaactttgtgggtggttgatgcctgtcagttaggtttggcggcctgactcttcctttaatgtgagtgagtgccctgctcgtgggctgccctgatgccctattttttactgcgtccagtcggtcttgaactctcgggcctgggctttggcttaatattcgagacttacacatcaactggatattctagtctgaacactacactgggtgttagttctttgtagtaagttaggagtgcgtggtggaggttgaaaccgtgaatttaaaactctcgttttccacccccttaatgtggaataacaacagcatttcttaagagtgtgtgtggggaggggaaatgagatcattcctatcaagtgcctgaagcatagtggccggcactggagaaagttctcagtgaatgttagctgcgccttctatgttcttttttcctagggtcatttgttgacattcattgctgttcctgctagcaattcagggctatgtattgtaaatgatgagctatttgtgcggaatgccagttctgaagagatccaaagagccttcgctatgcctgcacccacgccttcctccagcccggtgcccaccctctctccagagcagcaggaaatgttgcaagcattctctacccagtctggcatgaacctcgagtggtcccagaagtgccttcaggacaacaactgggactacaccagatctgcccaggccttcactcatctcaaggccaagggcgagatcccagaagtggcattcatgaagtgatcgtagtcatgcctcagaagcagtcccccctgtaaatagtccttggatattaccgtctggttgtcgtctgtcatctcctcctgtctggcccgaggccgccccgtgactgtgaccgagggagggagggctgcctgatccctctcctcgcctgccttctggaagacttcagaagattgagcctcactggtgccaggaagccaaagcttactttgtagaactgacactaaactacccgaaggacttaggtgctttgtgtacttaaccccaggacctccttactttttaatataaagagtgatgttgta

SEQ ID NO: 366144 - DNA, 381 bp, Homo sapiens
gaaacaaacttgctgacacattgaccttttaacatctgacctccagaatcattaagagtataaatttgttgttttaagattggccagccaaggctgctgtgaaattcagatctgtgtgtccaggaaacccaggaaaacaactggactcacttttgctccgtagggttcaggaggacggatttttgcactggatttatggccccatgggctcccctcccagctccgtacactagcaattcagacattggccaagttgcttgacctgcctgtgccccacttccctcctctgaacggcaggatggtaacactacgtggcagagttctggagaggactgggtgcgatgccgtgtgctgagtccctggctcgtgtcagccttggca

SEQ ID NO: 366145 - DNA, 328 bp, Homo sapiens
  misc_feature (305)..(305): n is a, c, g, or t
agctcggtacccactagtccacggttggctactagtccacggttggctactagtccacggttggctactagtccacggttgtcttccagaaaatatatgtcttccaactaagctacgtcttccaacaaatccatgtcttcctatatctccaggtcttccagcatctccagggcttccagcatctgctcgtcttccaacatctccacgtcttccagcatctctgtgtcttccagcatcttcatgtcttccaacaactacccagtcttccatcaactggctcaatatccattccagcgtactaccanacccttagccaaccgtgactagt

SEQ ID NO: 366146 - DNA, 2164 bp, Homo sapiens
  misc_feature (62)..(62): n is a, c, g, or t
  misc_feature (65)..(65): n is a, c, g, or t
  misc_feature (67)..(67): n is a, c, g, or t
  misc_feature (71)..(71): n is a, c, g, or t
  misc_feature (74)..(74): n is a, c, g, or t
  misc_feature (77)..(79): n is a, c, g, or t
  misc_feature (103)..(103): n is a, c, g, or t
  misc_feature (2144)..(2146): n is a, c, g, or t
  misc_feature (2149)..(2150): n is a, c, g, or t
tacttttccacaggtcacaggtcttccaacgaactccgggtcttccagcgacttcaagtctnccngnaagngcncgnnntccaacaaagcctatgtcttccangactatccatgtcttccagaaaatccttgtcttccctcaaatccatagcttccgaaaaatccaggtcttccaggaaatccgtgtcttccagcaaatccacgtcttccaacaaagccatgtcttccatcaaattaatgtcttccagcctacttgtgtcttccaacaaaggtacgtcttccaacaaaggtacgtcttccaacaaaggtatgtcttccaacaaaggtacgtcttccagaaaatccacgtcttccaaccaagccatgtcttccagaaaatccacgtcttccagaaaatatatgtcttccaactaagctacgtcttccaacaaatccatgtcttcctatatctccaggtcttccagcatctccagggcttccagcatctgctcgtcttccaacatctccacgtcttccagcatctctgtgtcttccagcatcttcatgtcttccaacaactacccagtcttccatcaactggctcaatatccatgtcttccaacgtctccagtgtgctgatcttctgacattcaggtcttccagtgtctgcaatatccagggtttccgatggcacctgtgtcaaggtcttccaacaactccgggtcttccagcgacttcaagtcttccaataatctcaaggtcttccagataatcctgagcttccagaaaatccacatcttccagacaatccatgtcttccggacaatccatgtcttccaagaagctccaagtcttccagtaaatcaagtcttccagcaaatccagtcttccagcaattactggtcttccaccaaatccagatcttccaggaaaatccacgtcttccaggaaatccatgtcttccaataatttcaaggtcttccatcaaatacagatcttccagctaatccatgtcttccagaaaaatctgtgtcttccaccaaatccaagtcttccagtaaatctagttcttccagaaaaatctagatcttccagtcaatcagtgtcttccagaaagaaatccaggtcttccagtcaatcagtgtcttccagaaagaaatccaggtcttccagtcagtcagtgtcttccagaaaaatctacgtcttccaccaaatccaggtcttccagtcaatccacatcttccggaaaaaatccaggtcttccagccaatatatgtcttcctgaagatccacgtcttccagaaaatccatgtcttccagaaaatccatgtcttccagtaacctcccagtcttccagaaaatccacgtcttcccaacaatccaagtcttccggataatttgggtcttcctgaaaatctacgtcttccaaaaaagccatgtcttccagaaacacattcttccaacaaagccatgtcttccagactatccatgtcttccagaaaatccttgtcttccctcaaatccatagcttccgaaaaatccaggtcttccaggaaatccgtgtcttccagcaaatccacgtcttccaacaaagccatgtcttccatcaaattaatgtcttccagcctacttgtgtcttccaacaaaggtacgtcttccaacaaaggtacgtcttccaacaaaggtatgtcttccaacaaaggtacgtcttccagaaaatccacgtcttccaaccaagccatgtcttccagaaaatccacgtcttccagaaaatatatgtcttccaactaagctacgtcttccaacaaatccatgtcttcctatatctccaggtcttccagcatctccagggcttccagcatctgctcgtcttccaacatctccacgtcttccagcatctctgtgtcttccagcatcttcatgtcttccaacaactacccagtcttccatcaactggctcaatatccatgtcttccaacgtctccagtgtgctgatcttctgacattcaggtcttccagtgtctgcaatatccagggtttccgatggcacctgtgtcaaggtcttccaacaactccgggtcttccagcgacttcaagtcttccaataatctcaaggtcttccagataatcctgagcttccagaaaatccacatcttccagacaannnagnnccggacaatccatg

SEQ ID NO: 366147 - DNA, 2117 bp, Homo sapiens
  misc_feature (62)..(62): n is a, c, g, or t
  misc_feature (65)..(65): n is a, c, g, or t
  misc_feature (67)..(67): n is a, c, g, or t
  misc_feature (71)..(71): n is a, c, g, or t
  misc_feature (74)..(74): n is a, c, g, or t
  misc_feature (77)..(79): n is a, c, g, or t
  misc_feature (103)..(103): n is a, c, g, or t
  misc_feature (2097)..(2099): n is a, c, g, or t
  misc_feature (2102)..(2103): n is a, c, g, or t
tacttttccacaggtcacaggtcttccaacgaactccgggtcttccagcgacttcaagtctnccngnaagngcncgnnntccaacaaagcctatgtcttccangactatccatgtcttccagaaaatccttgtcttccctcaaatccatagcttccgaaaaatccaggtcttccaggaaatccgtgtcttccagcaaatccacgtcttccaacaaagccatgtcttccatcaaattaatgtcttccagcctacttgtgtcttccaacaaaggtacgtcttccaacaaaggtacgtcttccaacaaaggtatgtcttccaacaaaggtacgtcttccagaaaatccacgtcttccaaccaagccatgtcttccagaaaatccacgtcttccagaaaatatatgtcttccaactaagctacgtcttccaacaaatccatgtcttcctatatctccaggtcttccagcatctccagggcttccagcatctgctcgtcttccaacatctccacgtcttccagcatctctgtgtcttccagcatcttcatgtcttccaacaactacccagtcttccatcaactggctcaatatccatgtcttccaacgtctccagtgtgctgatcttctgacattcaggtcttccagtgtctgcaatatccagggtttccgatggcacctgtgtcaaggtcttccaacaactccgggtcttccagcgacttcaagtcttccaataatctcaaggtcttccagataatcctgagcttccagaaaatccacatcttccagacaatccatgtcttccggacaatccatgtcttccaagaagctccaagtcttccagtaaatcaagtcttccagcaaatccagtcttccagcaattactggtcttccaccaaatccagatcttccaggaaaatccacgtcttccaggaaatccatgtcttccaataatttcaaggtcttccatcaaatacagatcttccagctaatccatgtcttccagaaaaatctgtgtcttccaccaaatccaagtcttccagtaaatctagttcttccagaaaaatctagatcttccagtcaatcagtgtcttccagaaagaaatccaggtcttccagtcaatcagtgtcttccagaaagaaatccaggtcttccagtcagtcagtgtcttccagaaaaatctacgtcttccaccaaatccaggtcttccagtcaatccacatcttccggaaaaaatccaggtcttccagccaatatatgtcttcctgaagatccacgtcttccagaaaatccatgtcttccagaaaatccatgtcttccagtaacctcccagtcttccagaaaatccacgtcttcccaacaatccaagtcttccggataatttgggtcttcctgaaaatctacgtcttccaaaaaagccatgtcttccagaaacacattccacatcttccaatggcctccaggtcttccagactatccatgtcttccagaaaatccttgtcttcccttaaatctatagcttccaaaaaatccgggtcttccaggaaatccgtgtcttccagcaagtccacgtcttccaacaaagccatgtcttccagactatccatgtcttccagaaaatccttgtcttccctcaaatccatagcttccgaaaaatccaggtcttccaggaaatccgtgtcttccagcaaatccacgtcttccaacaaagccatgtcttccatcaaattaatgtcttccagcctacttgtgtcttccaacaaagccaggtcttccagcatctccagggcttccagcatctgctcgtcttccaacatctccacgtcttccagcatctctgtgtcttccagcatcttcatgtcttccaacaactacccagtcttccatcaactggctcaatatccatgtcttccaacgtctccagtgtgctgatcttctgacattcaggtcttccagtgtctgcaatatccagggtttccgatggcacctgtgtcaaggtcttccaacaactccgggtcttccagcgacttcaagtcttccaataatctcaaggtcttccagataatcctgagcttccagaaaatccacatcttccagacaannnagnnccggacaatccatg

SEQ ID NO: 366148 - DNA, 2117 bp, Homo sapiens
  misc_feature (62)..(62): n is a, c, g, or t
  misc_feature (65)..(65): n is a, c, g, or t
  misc_feature (67)..(67): n is a, c, g, or t
  misc_feature (71)..(71): n is a, c, g, or t
  misc_feature (74)..(74): n is a, c, g, or t
  misc_feature (77)..(79): n is a, c, g, or t
  misc_feature (103)..(103): n is a, c, g, or t
  misc_feature (2097)..(2099): n is a, c, g, or t
  misc_feature (2102)..(2103): n is a, c, g, or t
tacttttccacaggtcacaggtcttccaacgaactccgggtcttccagcgacttcaagtctnccngnaagngcncgnnntccaacaaagcctatgtcttccangactatccatgtcttccagaaaatccttgtcttccctcaaatccatagcttccgaaaaatccaggtcttccaggaaatccgtgtcttccagcaaatccacgtcttccaacaaagccatgtcttccatcaaattaatgtcttccagcctacttgtgtcttccaacaaaggtaggtcttccagcatctccagggcttccagcatctgctcgtcttccaacatctccacgtcttccagcatctctgtgtcttccagcatcttcatgtcttccaacaactacccagtcttccatcaactggctcaatatccatgtcttccaacgtctccagtgtgctgatcttctgacattcaggtcttccagtgtctgcaatatccagggtttccgatggcacctgtgtcaaggtcttccaacaactccgggtcttccagcgacttcaagtcttccaataatctcaaggtcttccagataatcctgagcttccagaaaatccacatcttccagacaatccatgtcttccggacaatccatgtcttccaagaagctccaagtcttccagtaaatcaagtcttccagcaaatccagtcttccagcaattactggtcttccaccaaatccagatcttccaggaaaatccacgtcttccaggaaatccatgtcttccaataatttcaaggtcttccatcaaatacagatcttccagctaatccatgtcttccagaaaaatctgtgtcttccaccaaatccaagtcttccagtaaatctagttcttccagaaaaatctagatcttccagtcaatcagtgtcttccagaaagaaatccaggtcttccagtcaatcagtgtcttccagaaagaaatccaggtcttccagtcagtcagtgtcttccagaaaaatctacgtcttccaccaaatccaggtcttccagtcaatccacatcttccggaaaaaatccaggtcttccagccaatatatgtcttcctgaagatccacgtcttccagaaaatccatgtcttccagaaaatccatgtcttccagtaacctcccagtcttccagaaaatccacgtcttcccaacaatccaagtcttccggataatttgggtcttcctgaaaatctacgtcttccaaaaaagccatgtcttccagaaacacattccacatcttccaatggcctccaggtcttccagactatccatgtcttccagaaaatccttgtcttcccttaaatctatagcttccaaaaaatccgggtcttccaggaaatccgtgtcttccagcaagtccacgtcttccaacaaagccatgtcttccagactatccatgtcttccagaaaatccttgtcttccctcaaatccatagcttccgaaaaatccaggtcttccaggaaatccgtgtcttccagcaaatccacgtcttccaacaaagccatgtcttccatcaaattaatgtcttccagcctacttgtgtcttccaacaaaggtacgtcttccaacaaaggtacgtcttccaacaaaggtatgtcttccaacaaaggtacgtcttccagaaaatccacgtcttccaaccaagccatgtcttccagaaaatccacgtcttccagaaaatatatgtcttccaactaagctacgtcttccaacaaatccatgtcttcctatatctccaggtcttccagcatctccagggcttccagcatctgctcgtcttccaacatctccacgtcttccagcatctctgtgtcttccagcatcttcatgtcttccaacaactacccagtcttccatcaactggctcaatatccatgtcttccaacgtctccagtgtgctgatcttctgacattcaggtcttccagtgtctgcaatatccagggtttccgatggcacctgtgtcaaggtcttccaacaactccgggtcttccagcgacttcaagtcttccaataatctcaaggtcttccagataatcctgagcttccagaaaatccacatcttccagacaannnagnnccggacaatccatg

SEQ ID NO: 366149 - DNA, 2153 bp, Homo sapiens
  misc_feature (62)..(62): n is a, c, g, or t
  misc_feature (65)..(65): n is a, c, g, or t
  misc_feature (67)..(67): n is a, c, g, or t
  misc_feature (71)..(71): n is a, c, g, or t
  misc_feature (74)..(74): n is a, c, g, or t
  misc_feature (77)..(79): n is a, c, g, or t
  misc_feature (103)..(103): n is a, c, g, or t
  misc_feature (2133)..(2135): n is a, c, g, or t
  misc_feature (2138)..(2139): n is a, c, g, or t
tacttttccacaggtcacaggtcttccaacgaactccgggtcttccagcgacttcaagtctnccngnaagngcncgnnntccaacaaagcctatgtcttccangactatccatgtcttccagaaaatccttgtcttccctcaaatccatagcttccgaaaaatccaggtcttccaggaaatccgtgtcttccagcaaatccacgtcttccaacaaagccatgtcttccatcaaattaatgtcttccagcctacttgtgtcttccaacaaaggtacgtcttccaacaaaggtacgtcttccaacaaaggtatgtcttccaacaaaggtacgtcttccagaaaatccacgtcttccaaccaagccatgtcttccagaaaatccacgtcttccagaaaatatatgtcttccaactactacccagtcttccatcaactggctcaatatccatgtcttccaacgtctccagtgtgctgatcttctgacattcaggtcttccagtgtctgcaatatccagggtttccgatggcacctgtgtcaaggtcttccaacaactccgggtcttccagcgacttcaagtcttccaataatctcaaggtcttccagataatcctgagcttccagaaaatccacatcttccagacaatccatgtcttccggacaatccatgtcttccaagaagctccaagtcttccagtaaatcaagtcttccagcaaatccagtcttccagcaattactggtcttccaccaaatccagatcttccaggaaaatccacgtcttccaggaaatccatgtcttccaataatttcaaggtcttccatcaaatacagatcttccagctaatccatgtcttccagaaaaatctgtgtcttccaccaaatccaagtcttccagtaaatctagttcttccagaaaaatctagatcttccagtcaatcagtgtcttccagaaagaaatccaggtcttccagtcaatcagtgtcttccagaaagaaatccaggtcttccagtcagtcagtgtcttccagaaaaatctacgtcttccaccaaatccaggtcttccagtcaatccacatcttccggaaaaaatccaggtcttccagccaatatatgtcttcctgaagatccacgtcttccagaaaatccatgtcttccagaaaatccatgtcttccagtaacctcccagtcttccagaaaatccacgtcttcccaacaatccaagtcttccggataatttgggtcttcctgaaaatctacgtcttccaaaaaagccatgtcttccagaaacacattccacatcttccaatggcctccaggtcttccagactatccatgtcttccagaaaatccttgtcttcccttaaatctatagcttccaaaaaatccgggtcttccaggaaatccgtgtcttccagcaagtccacgtcttccaacaaagccatgtcttccagactatccatgtcttccagaaaatccttgtcttccctcaaatccatagcttccgaaaaatccaggtcttccaggaaatccgtgtcttccagcaaatccacgtcttccaacaaagccatgtcttccatcaaattaatgtcttccagcctacttgtgtcttccaacaaaggtacgtcttccaacaaaggtacgtcttccaacaaaggtatgtcttccaacaaaggtacgtcttccagaaaatccacgtcttccaaccaagccatgtcttccagaaaatccacgtcttccagaaaatatatgtcttccaactaagctacgtcttccaacaaatccatgtcttcctatatctccaggtcttccagcatctccagggcttccagcatctgctcgtcttccaacatctccacgtcttccagcatctctgtgtcttccagcatcttcatgtcttccaacaactacccagtcttccatcaactggctcaatatccatgtcttccaacgtctccagtgtgctgatcttctgacattcaggtcttccagtgtctgcaatatccagggtttccgatggcacctgtgtcaaggtcttccaacaactccgggtcttccagcgacttcaagtcttccaataatctcaaggtcttccagataatcctgagcttccagaaaatccacatcttccagacaannnagnnccggacaatccatg

SEQ ID NO: 366150 - DNA, 1695 bp, Homo sapiens
  misc_feature (62)..(62): n is a, c, g, or t
  misc_feature (65)..(65): n is a, c, g, or t
  misc_feature (67)..(67): n is a, c, g, or t
  misc_feature (71)..(71): n is a, c, g, or t
  misc_feature (74)..(74): n is a, c, g, or t
  misc_feature (77)..(79): n is a, c, g, or t
  misc_feature (103)..(103): n is a, c, g, or t
tacttttccacaggtcacaggtcttccaacgaactccgggtcttccagcgacttcaagtctnccngnaagngcncgnnntccaacaaagcctatgtcttccangactatccatgtcttccagaaaatccttgtcttccctcaaatccatagcttccgaaaaatccaggtcttccaggaaatccgtgtcttccagcaaatccacgtcttccaacaaagccatgtcttccatcaaattaatgtcttccagcctacttgtgtcttccaacaaaggtacgtcttccaacaaaggtacgtcttccaacaaaggtatgtcttccaacaaaggtacgtcttccagaaaatccacgtcttccaaccaagccatgtcttccagaaaatccacgtcttccagaaaatatatgtcttccaactaagctacgtcttccaacaaatccatgtcttcctatatctccaggtcttccagcatctccagggcttccagcatctgctcgtcttccaacatctccacgtcttccagcatctctgtgtcttccagcatcttcatgtcttccaacaactacccagtcttccatcaactggctcaatatccatgtcttccaacgtctccagtgtgctgatcttctgacattcaggtcttccagtgtctgcaatatccagggtttccgatggcacctgtgtcaaggtcttccaacaactccgggtcttccagcgacttcaagtcttccaataatctcaaggtcttccagataatcctgagcttccagaaaatccacatcttccagacaatccatgtcttccggacaatccatgtcttccaagaagctccaagtcttccagtaaatcaagtcttccagcaaatccagtcttccagcaattactggtcttccaccaaatccagatcttccaggaaaatccacgtcttccaggaaatccatgtcttccaataatttcaaggtcttccatcaaatacagatcttccagctaatccatgtcttccagaaaaatctgtgtcttccaccaaatccaagtcttccagtaaatctagttcttccagaaaaatctagatcttccagtcaatcagtgtcttccagaaagaaatccaggtcttccagtcaatcagtgtcttccagaaagaaatccaggtcttccagtcagtcagtgtcttccagaaaaatctacgtcttccaccaaatccaggtcttccagtcaatccacatcttccggaaaaaatccaggtcttccagccaatatatgtcttcctgaagatccacgtcttccagaaaatccatgtcttccagaaaatccatgtcttccagtaacctcccagtcttccagaaaatccacgtcttcccaacaatccaagtcttccggataatttgggtcttcctgaaaatctacgtcttccaaaaaagccatgtcttccagaaacacattccacatcttccaatggcctccaggtcttccagactatccatgtcttccagaaaatccttgtcttcccttaaatctatagcttccaaaaaatccgggtcttccaggaaatccgtgtcttccagcaagtccacgtcttccaacaaagccatgtcttccagactgctggaagctctgtattcgaggaagacatggctttgctggaagacgtggatttgctggaagacacggatttcctggaagacctggatttgacggaagct

SEQ ID NO: 366151 - DNA, 1786 bp, Homo sapiens
  misc_feature (1766)..(1768): n is a, c, g, or t
  misc_feature (1771)..(1772): n is a, c, g, or t
aataacacgacaaaatgaaagcagaacagctgtatggttacaatattcttattaacctctctgcagcattttacacttactagggaaccttatgattacaccgtaatagtggagaatatacttgagttcgtgtcctaatggtctctaattcacattggatcgtgggcaaatcacctcacctctctgagcctgttccctcctcttagaccatcttactgttaccggaagattatcaccggcagcatgtcttccagaaaatccacatcttccagacaatccatgtcttccggacaatccatgtcttccaagaagctccaagtcttccagtaaatcaagtcttccagcaaatccagtcttccagcaattactggtcttccaccaaatccagatcttccaggaaaatccacgtcttccaggaaatccatgtcttccaataatttcaaggtcttccatcaaatacagatcttccagctaatccatgtcttccagaaaaatctgtgtcttccaccaaatccaagtcttccagtaaatctagttcttccagaaaaatctagatcttccagtcaatcagtgtcttccagaaagaaatccaggtcttccagtcaatcagtgtcttccagaaagaaatccaggtcttccagtcagtcagtgtcttccagaaaaatctacgtcttccaccaaatccaggtcttccagtcaatccacatcttccggaaaaaatccaggtcttccagccaatatatgtcttcctgaagatccacgtcttccagaaaatccatgtcttccagaaaatccatgtcttccagtaacctcccagtcttccagaaaatccacgtcttcccaacaatccaagtcttccggataatttgggtcttcctgaaaatctacgtcttccaaaaaagccatgtcttccagaaacacattccacatcttccaatggcctccaggtcttccagactatccatgtcttccagaaaatccttgtcttcccttaaatctatagcttccaaaaaatccgggtcttccaggaaatccgtgtcttccagcaagtccacgtcttccaacaaagccatgtcttccagactatccatgtcttccagaaaatccttgtcttccctcaaatccatagcttccgaaaaatccaggtcttccaggaaatccgtgtcttccagcaaatccacgtcttccaacaaagccatgtcttccatcaaattaatgtcttccagcctacttgtgtcttccaacaaaggtacgtcttccaacaaaggtacgtcttccaacaaaggtatgtcttccaacaaaggtacgtcttccagaaaatccacgtcttccaaccaagccatgtcttccagaaaatccacgtcttccagaaaatatatgtcttccaactaagctacgtcttccaacaaatccatgtcttcctatatctccaggtcttccagcatctccagggcttccagcatctgctcgtcttccaacatctccacgtcttccagcatctctgtgtcttccagcatcttcatgtcttccaacaactacccagtcttccatcaactggctcaatatccatgtcttccaacgtctccagtgtgctgatcttctgacattcaggtcttccagtgtctgcaatatccagggtttccgatggcacctgtgtcaaggtcttccaacaactccgggtcttccagcgacttcaagtcttccaataatctcaaggtcttccagataatcctgagcttccagaaaatccacatcttccagacaannnagnnccggacaatccatg

SEQ ID NO: 366152 - DNA, 1368 bp, Homo sapiens
  misc_feature (1348)..(1350): n is a, c, g, or t
  misc_feature (1353)..(1354): n is a, c, g, or t
cgtgcgcggtcgctctagagatcccactagtccacggtgggctacagattcagctaatccatgtcttccagaaaaatctgtgtcttccaccaaatccaagtcttccagtaaatctagttcttccagaaaaatctagatcttccagtcaatcagtgtcttccagaaagaaatccaggtcttccagtcaatcagtgtcttccagaaagaaatccaggtcttccagtcagtcagtgtcttccagaaaaatctacgtcttccaccaaatccaggtcttccagtcaatccacatcttccggaaaaaatccaggtcttccagccaatatatgtcttcctgaagatccacgtcttccagaaaatccatgtcttccagaaaatccatgtcttccagtaacctcccagtcttccagaaaatccacgtcttcccaacaatccaagtcttccggataatttgggtcttcctgaaaatctacgtcttccaaaaaagccatgtcttccagaaacacattccacatcttccaatggcctccaggtcttccagactatccatgtcttccagaaaatccttgtcttcccttaaatctatagcttccaaaaaatccgggtcttccaggaaatccgtgtcttccagcaagtccacgtcttccaacaaagccatgtcttccagactatccatgtcttccagaaaatccttgtcttccctcaaatccatagcttccgaaaaatccaggtcttccaggaaatccgtgtcttccagcaaatccacgtcttccaacaaagccatgtcttccatcaaattaatgtcttccagcctacttgtgtcttccaacaaaggtacgtcttccaacaaaggtacgtcttccaacaaaggtatgtcttccaacaaaggtacgtcttccagaaaatccacgtcttccaaccaagccatgtcttccagaaaatccacgtcttccagaaaatatatgtcttccaactaagctacgtcttccaacaaatccatgtcttcctatatctccaggtcttccagcatctccagggcttccagcatctgctcgtcttccaacatctccacgtcttccagcatctctgtgtcttccagcatcttcatgtcttccaacaactacccagtcttccatcaactggctcaatatccatgtcttccaacgtctccagtgtgctgatcttctgacattcaggtcttccagtgtctgcaatatccagggtttccgatggcacctgtgtcaaggtcttccaacaactccgggtcttccagcgacttcaagtcttccaataatctcaaggtcttccagataatcctgagcttccagaaaatccacatcttccagacaannnagnnccggacaatccatg

SEQ ID NO: 366153 - DNA, 1980 bp, Homo sapiens
  misc_feature (62)..(62): n is a, c, g, or t
  misc_feature (65)..(65): n is a, c, g, or t
  misc_feature (67)..(67): n is a, c, g, or t
  misc_feature (71)..(71): n is a, c, g, or t
  misc_feature (74)..(74): n is a, c, g, or t
  misc_feature (77)..(79): n is a, c, g, or t
  misc_feature (103)..(103): n is a, c, g, or t
  misc_feature (1960)..(1962): n is a, c, g, or t
  misc_feature (1965)..(1966): n is a, c, g, or t
tacttttccacaggtcacaggtcttccaacgaactccgggtcttccagcgacttcaagtctnccngnaagngcncgnnntccaacaaagcctatgtcttccangactatccatgtcttccagaaaatccttgtcttccctcaaatccatagcttccgaaaaatccaggtcttccaggaaatccgtgtcttccagcaaatccacgtcttccaacaaagccatgtcttccatcaaattaatgtcttccagcctacttgtgtcttccaacaaaggtacgtcttccaacaaaggtacgtcttccaacaaaggtatgtcttccaacaaaggtacgtcttccagaaaatccacgtcttccaaccaagccatgtcttccagaaaatccacgtcttccagaaaatatatgtcttccaactaagctacgtcttccaacaaatccatgtcttcctatatctccaggtcttccagcatctccagggcttccagcatctgctcgtcttccaacatctccacgtcttccagcatctctgtgtcttccagcatcttcatgtcttccaacaactacccagtcttccatcaactggctcaatatccatgtcttccaacgtctccagtgtgctgatcttctgacattcaggtcttccagtgtctgcaatatccagggtttccgatggcacctgtgtcaaggtcttccaacaactccgggtcttccagcgacttcaagtcttccaataatctcaaggtcttccagataatcctgagcttccagaaaatccacatcttccagacaatccatgtcttccggacaatccatgtcttccaagaagctccaagtcttccagtaaatcaagtcttccagcaaatccagtcttccagcaattactggtcttccaccaaatccagatcttccggaaaaaatccaggtcttccagccaatatatgtcttcctgaagatccacgtcttccagaaaatccatgtcttccagaaaatccatgtcttccagtaacctcccagtcttccagaaaatccacgtcttcccaacaatccaagtcttccggataatttgggtcttcctgaaaatctacgtcttccaaaaaagccatgtcttccagaaacacattccacatcttccaatggcctccaggtcttccagactatccatgtcttccagaaaatccttgtcttcccttaaatctatagcttccaaaaaatccgggtcttccaggaaatccgtgtcttccagcaagtccacgtcttccaacaaagccatgtcttccagactatccatgtcttccagaaaatccttgtcttccctcaaatccatagcttccgaaaaatccaggtcttccaggaaatccgtgtcttccagcaaatccacgtcttccaacaaagccatgtcttccatcaaattaatgtcttccagcctacttgtgtcttccaacaaaggtacgtcttccaacaaaggtacgtcttccaacaaaggtatgtcttccaacaaaggtacgtcttccagaaaatccacgtcttccaaccaagccatgtcttccagaaaatccacgtcttccagaaaatatatgtcttccaactaagctacgtcttccaacaaatccatgtcttcctatatctccaggtcttccagcatctccagggcttccagcatctgctcgtcttccaacatctccacgtcttccagcatctctgtgtcttccagcatcttcatgtcttccaacaactacccagtcttccatcaactggctcaatatccatgtcttccaacgtctccagtgtgctgatcttctgacattcaggtcttccagtgtctgcaatatccagggtttccgatggcacctgtgtcaaggtcttccaacaactccgggtcttccagcgacttcaagtcttccaataatctcaaggtcttccagataatcctgagcttccagaaaatccacatcttccagacaannnagnnccggacaatccatg

SEQ ID NO: 366154 - DNA, 1367 bp, Homo sapiens
  misc_feature (1347)..(1349): n is a, c, g, or t
  misc_feature (1352)..(1353): n is a, c, g, or t
aagacatggatagtctggaagacatggcttcgttggaagacgtggacttgctagaagacacggatttcctggaatccccggtcttccaccaaatccaagtcttccagtaaatctagttcttccagaaaaatctagatcttccagtcaatcagtgtcttccagaaagaaatccaggtcttccagtcaatcagtgtcttccagaaagaaatccaggtcttccagtcagtcagtgtcttccagaaaaatctacgtcttccaccaaatccaggtcttccagtcaatccacatcttccggaaaaaatccaggtcttccagccaatatatgtcttcctgaagatccacgtcttccagaaaatccatgtcttccagaaaatccatgtcttccagtaacctcccagtcttccagaaaatccacgtcttcccaacaatccaagtcttccggataatttgggtcttcctgaaaatctacgtcttccaaaaaagccatgtcttccagaaacacattccacatcttccaatggcctccaggtcttccagactatccatgtcttccagaaaatccttgtcttcccttaaatctatagcttccaaaaaatccgggtcttccaggaaatccgtgtcttccagcaagtccacgtcttccaacaaagccatgtcttccagactatccatgtcttccagaaaatccttgtcttccctcaaatccatagcttccgaaaaatccaggtcttccaggaaatccgtgtcttccagcaaatccacgtcttccaacaaagccatgtcttccatcaaattaatgtcttccagcctacttgtgtcttccaacaaaggtacgtcttccaacaaaggtacgtcttccaacaaaggtatgtcttccaacaaaggtacgtcttccagaaaatccacgtcttccaaccaagccatgtcttccagaaaatccacgtcttccagaaaatatatgtcttccaactaagctacgtcttccaacaaatccatgtcttcctatatctccaggtcttccagcatctccagggcttccagcatctgctcgtcttccaacatctccacgtcttccagcatctctgtgtcttccagcatcttcatgtcttccaacaactacccagtcttccatcaactggctcaatatccatgtcttccaacgtctccagtgtgctgatcttctgacattcaggtcttccagtgtctgcaatatccagggtttccgatggcacctgtgtcaaggtcttccaacaactccgggtcttccagcgacttcaagtcttccaataatctcaaggtcttccagataatcctgagcttccagaaaatccacatcttccagacaannnagnnccggacaatccatg

SEQ ID NO: 366155 - DNA, 998 bp, Homo sapiens
  misc_feature (37)..(37): n is a, c, g, or t
  misc_feature (978)..(980): n is a, c, g, or t
  misc_feature (983)..(984): n is a, c, g, or t
tactgctgtgtgatggagaaggagcttcaattgaggncgctgtgctatcctccctgacaggagagtataagccactcatttctgccactctcggaatatcgtcttccaaaaaagccatgtcttccagaaacacattccacatcttccaatggcctccaggtcttccagactatccatgtcttccagaaaatccttgtcttcccttaaatctatagcttccaaaaaatccgggtcttccaggaaatccgtgtcttccagcaagtccacgtcttccaacaaagccatgtcttccagactatccatgtcttccagaaaatccttgtcttccctcaaatccatagcttccgaaaaatccaggtcttccaggaaatccgtgtcttccagcaaatccacgtcttccaacaaagccatgtcttccatcaaattaatgtcttccagcctacttgtgtcttccaacaaaggtacgtcttccaacaaaggtacgtcttccaacaaaggtatgtcttccaacaaaggtacgtcttccagaaaatccacgtcttccaaccaagccatgtcttccagaaaatccacgtcttccagaaaatatatgtcttccaactaagctacgtcttccaacaaatccatgtcttcctatatctccaggtcttccagcatctccagggcttccagcatctgctcgtcttccaacatctccacgtcttccagcatctctgtgtcttccagcatcttcatgtcttccaacaactacccagtcttccatcaactggctcaatatccatgtcttccaacgtctccagtgtgctgatcttctgacattcaggtcttccagtgtctgcaatatccagggtttccgatggcacctgtgtcaaggtcttccaacaactccgggtcttccagcgacttcaagtcttccaataatctcaaggtcttccagataatcctgagcttccagaaaatccacatcttccagacaannnagnnccggacaatccatg

SEQ ID NO: 366156 - DNA, 1253 bp, Homo sapiens
  misc_feature (62)..(62): n is a, c, g, or t
  misc_feature (65)..(65): n is a, c, g, or t
  misc_feature (67)..(67): n is a, c, g, or t
  misc_feature (71)..(71): n is a, c, g, or t
  misc_feature (74)..(74): n is a, c, g, or t
  misc_feature (77)..(79): n is a, c, g, or t
  misc_feature (103)..(103): n is a, c, g, or t
  misc_feature (1233)..(1235): n is a, c, g, or t
  misc_feature (1238)..(1239): n is a, c, g, or t
tacttttccacaggtcacaggtcttccaacgaactccgggtcttccagcgacttcaagtctnccngnaagngcncgnnntccaacaaagcctatgtcttccangactatccatgtcttccagaaaatccttgtcttccctcaaatccatagcttccgaaaaatccaggtcttccaggaaatccgtgtcttccagcaaatccacgtcttccaacaaagccatgtcttccatcaaattaatgtcttccagcctacttgtgtcttccaacaaaggtacgtcttccaacaaaggtacgtcttccaacaaaggtatgtcttccaacaaaggtacgtcttccagaaaatccacgtcttccaaccaagccatgtcttccagaaaatccacgtcttccagaaaatatatgtcttccaactaagctacgtcttccaacaaatccatgtcttcctatatctccaggtcttccagcatctccagggcttccagcatctgctcgtcttccaacatctccacgtcttccagcatctctgtgtcttccagcatcttcatgtcttccaacaactacccagtcttccatcaactggctcaatatccatgtcttccaacgtctccagtgtgctgatcttctgacattcaggtcttccagtgtctgcaatatccagggtttccgatggcacctgtgtcaaggtcttccaacaactccgggtcttccagcgacttcaagtcttccaataatctcaaggtcttccagataatcctgagcttccagaaaatccacatcttccagacaatccatgtcttccggacaatccatgtcttccaagaagctccaagtcttccagtaaatcaagtcttccatcaaattaatgtcttccagcctacttgtgtcttccaacaaagccaggtcttccagcatctccagggcttccagcatctgctcgtcttccaacatctccacgtcttccagcatctctgtgtcttccagcatcttcatgtcttccaacaactacccagtcttccatcaactggctcaatatccatgtcttccaacgtctccagtgtgctgatcttctgacattcaggtcttccagtgtctgcaatatccagggtttccgatggcacctgtgtcaaggtcttccaacaactccgggtcttccagcgacttcaagtcttccaataatctcaaggtcttccagataatcctgagcttccagaaaatccacatcttccagacaannnagnnccggacaatccatg

SEQ ID NO: 366157 - DNA, 912 bp, Homo sapiens
  misc_feature (892)..(894): n is a, c, g, or t
  misc_feature (897)..(898): n is a, c, g, or t
agaggaagacctggatttgtttctggaagacatgatggactggaagatctagattttactggaagaactagatatactggaagactgggattgggtggaagacagagatttttctggaagacatggattagctggaagatctgtattggatggaagacctggaaattattggaagagatggatttcctgaaaaatctgtgtcttccacctaatccatgtcttccagaaaatccttgtcttccctcaaatccatagcttccgaaaaatccaggtcttccaggaaatccgtgtcttccagcaaatccacgtcttccaacaaagccatgtcttccatcaaattaatgtcttccagcctacttgtgtcttccaacaaaggtacgtcttccaacaaaggtacgtcttccaacaaaggtatgtcttccaacaaaggtacgtcttccagaaaatccacgtcttccaaccaagccatgtcttccagaaaatccacgtcttccagaaaatatatgtcttccaactaagctacgtcttccaacaaatccatgtcttcctatatctccaggtcttccagcatctccagggcttccagcatctgctcgtcttccaacatctccacgtcttccagcatctctgtgtcttccagcatcttcatgtcttccaacaactacccagtcttccatcaactggctcaatatccatgtcttccaacgtctccagtgtgctgatcttctgacattcaggtcttccagtgtctgcaatatccagggtttccgatggcacctgtgtcaaggtcttccaacaactccgggtcttccagcgacttcaagtcttccaataatctcaaggtcttccagataatcctgagcttccagaaaatccacatcttccagacaannnagnnccggacaatccatg

SEQ ID NO: 366158 - DNA, 2297 bp, Homo sapiens
  misc_feature (62)..(62): n is a, c, g, or t
  misc_feature (65)..(65): n is a, c, g, or t
  misc_feature (67)..(67): n is a, c, g, or t
  misc_feature (71)..(71): n is a, c, g, or t
  misc_feature (74)..(74): n is a, c, g, or t
  misc_feature (77)..(79): n is a, c, g, or t
  misc_feature (103)..(103): n is a, c, g, or t
  misc_feature (2277)..(2279): n is a, c, g, or t
  misc_feature (2282)..(2283): n is a, c, g, or t
tacttttccacaggtcacaggtcttccaacgaactccgggtcttccagcgacttcaagtctnccngnaagngcncgnnntccaacaaagcctatgtcttccangactatccatgtcttccagaaaatccttgtcttccctcaaatccatagcttccgaaaaatccaggtcttccaggaaatccgtgtcttccagcaaatccacgtcttccaacaaagccatgtcttccatcaaattaatgtcttccagcctacttgtgtcttccaacaaaggtacgtcttccaacaaaggtacgtcttccaacaaaggtatgtcttccaacaaaggtacgtcttccagaaaatccacgtcttccaaccaagccatgtcttccagaaaatccacgtcttccagaaaatatatgtcttccaactaagctacgtcttccaacaaatccatgtcttcctatatctccaggtcttccagcatctccagggcttccagcatctgctcgtcttccaacatctccacgtcttccagcatctctgtgtcttccagcatcttcatgtcttccaacaactacccagtcttccatcaactggctcaatatccatgtcttccaacgtctccagtgtgctgatcttctgacattcaggtcttccagtgtctgcaatatccagggtttccgatggcacctgtgtcaaggtcttccaacaactccgggtcttccagcgacttcaagtcttccaataatctcaaggtcttccagataatcctgagcttccagaaaatccacatcttccagacaatccatgtcttccggacaatccatgtcttccaagaagctccaagtcttccagtaaatcaagtcttccagcaaatccagtcttccagcaattactggtcttccaccaaatccagatcttccaggaaaatccacgtcttccaggaaatccatgtcttccaataatttcaaggtcttccatcaaatacagatcttccagctaatccatgtcttccagaaaaatctgtgtcttccaccaaatccaagtcttccagtaaatctagttcttccagaaaaatctagatcttccagtcaatcagtgtcttccagaaagaaatccaggtcttccagtcaatcagtgtcttccagaaagaaatccaggtcttccagtcagtcagtgtcttccagaaaaatctacgtcttccaccaaatccaggtcttccagtcaatccacatcttccggaaaaaatccaggtcttccagccaatatatgtcttcctgaagatccacgtcttccagaaaatccatgtcttccagaaaatccatgtcttccagtaacctcccagtcttccagaaaatccacgtcttcccaacaatccaagtcttccggataatttgggtcttcctgaaaatctacgtcttccaaaaaagccatgtcttccagaaacacattccacatcttccaatggcctccaggtcttccagactatccatgtcttccagaaaatccttgtcttcccttaaatctatagcttccaaaaaatccgggtcttccaggaaatccgtgtcttccagcaagtccacgtcttccaacaaagccatgtcttccagactatccatgtcttccagaaaatccttgtcttccctcaaatccatagcttccgaaaaatccaggtcttccaggaaatccgtgtcttccagcaaatccacgtcttccaacaaagccatgtcttccatcaaattaatgtcttccagcctacttgtgtcttccaacaaaggtacgtcttccaacaaaggtacgtcttccaacaaaggtatgtcttccaacaaaggtacgtcttccagaaaatccacgtcttccaaccaagccatgtcttccagaaaatccacgtcttccagaaaatatatgtcttccaactaagctacgtcttccaacaaatccatgtcttcctatatctccaggtcttccagcatctccagggcttccagcatctgctcgtcttccaacatctccacgtcttccagcatctctgtgtcttccagcatcttcatgtcttccaacaactacccagtcttccatcaactggctcaatatccatgtcttccaacgtctccagtgtgctgatcttctgacattcaggtcttccagtgtctgcaatatccagggtttccgatggcacctgtgtcaaggtcttccaacaactccgggtcttccagcgacttcaagtcttccaataatctcaaggtcttccagataatcctgagcttccagaaaatccacatcttccagacaannnagnnccggacaatccatg

SEQ ID NO: 366159 - DNA, 1574 bp, Homo sapiens
  misc_feature (62)..(62): n is a, c, g, or t
  misc_feature (65)..(65): n is a, c, g, or t
  misc_feature (67)..(67): n is a, c, g, or t
  misc_feature (71)..(71): n is a, c, g, or t
  misc_feature (74)..(74): n is a, c, g, or t
  misc_feature (77)..(79): n is a, c, g, or t
  misc_feature (103)..(103): n is a, c, g, or t
tacttttccacaggtcacaggtcttccaacgaactccgggtcttccagcgacttcaagtctnccngnaagngcncgnnntccaacaaagcctatgtcttccangactatccatgtcttccagaaaatccttgtcttccctcaaatccatagcttccgaaaaatccaggtcttccaggaaatccgtgtcttccagcaaatccacgtcttccaacaaagccatgtcttccatcaaattaatgtcttccagcctacttgtgtcttccaacaaaggtacgtcttccaacaaaggtacgtcttccaacaaaggtatgtcttccaacaaaggtacgtcttccagaaaatccacgtcttccaaccaagccatgtcttccagaaaatccacgtcttccagaaaatatatgtcttccaactaagctacgtcttccaacaaatccatgtcttcctatatctccaggtcttccagcatctccagggcttccagcatctgctcgtcttccaacatctccacgtcttccagcatctctgtgtcttccagcatcttcatgtcttccaacaactacccagtcttccatcaactggctcaatatccatgtcttccaacgtctccagtgtgctgatcttctgacattcaggtcttccagtgtctgcaatatccagggtttccgatggcacctgtgtcaaggtcttccaacaactccgggtcttccagcgacttcaagtcttccaataatctcaaggtcttccagataatcctgagcttccagaaaatccacatcttccagacaatccatgtcttccggacaatccatgtcttccaagaagctccaagtcttccagtaaatcaagtcttccagcaaatccagtcttccagcaattactggtcttccaccaaatccagatcttccaggaaaatccacgtcttccaggaaatccatgtcttccaataatttcaaggtcttccatcaaatacagatcttccagctaatccatgtcttccagaaaaatctgtgtcttccaccaaatccaagtcttccagtaaatctagttcttccagaaaaatctagatcttccagtcaatcagtgtcttccagaaagaaatccaggtcttccagtcaatcagtgtcttccagaaagaaatccaggtcttccagtcagtcagtgtcttccagaaaaatctacgtcttccaccaaatccaggtcttccagtcaatccacatcttccggaaaaaatccaggtcttccagccaatatatgtcttcctgaagatccacgtcttccagaaaatccatgtcttccagaaaatccatgtcttccagtaacctcccagtcttccagaaaatccacgtcttcccaacaatccaagtcttccggataatttgggtcttcctgaaaatctacgtcttccaaaaaagccatgtcttccagaaacacattccattttcacggctcaggcttcaaattcagggttccgaaacctgtgtcctaactaactccaaatcggtctcgaaacggggtaccaacagtttccagacagtcccaacttgttcaacactttgccaaccggcgattcacg

SEQ ID NO: 366160 - DNA, 2104 bp, Homo sapiens
  misc_feature (62)..(62): n is a, c, g, or t
  misc_feature (65)..(65): n is a, c, g, or t
  misc_feature (67)..(67): n is a, c, g, or t
  misc_feature (71)..(71): n is a, c, g, or t
  misc_feature (74)..(74): n is a, c, g, or t
  misc_feature (77)..(79): n is a, c, g, or t
  misc_feature (103)..(103): n is a, c, g, or t
  misc_feature (2084)..(2086): n is a, c, g, or t
  misc_feature (2089)..(2090): n is a, c, g, or t
tacttttccacaggtcacaggtcttccaacgaactccgggtcttccagcgacttcaagtctnccngnaagngcncgnnntccaacaaagcctatgtcttccangactatccatgtcttccagaaaatccttgtcttccctcaaatccatagcttccgaaaaatccaggtcttccaggaaatccgtgtcttccagcaaatccacgtcttccaacaaagccatgtcttccatcaaattaatgtcttccagcctacttgtgtcttccaacaaaggtacgtcttccaacaaaggtacgtcttccaacaaaggtatgtcttccaacaaaggtacgtcttccagaaaatccacgtcttccaaccaagccatgtcttccagaaaatccacgtcttccagaaaatatatgtcttccaactaagctacgtcttccaacaaatccatgtcttcctatatctccaggtcttccagcatctccagggcttccagcatctgctcgtcttccaacatctccacgtcttccagcatctctgtgtcttccagcatcttcatgtcttccaacaactacccagtcttccatcaactggctcaatatccatgtcttccaacgtctccagtgtgctgatcttccaagaagctccaagtcttccagtaaatcaagtcttccagcaaatccagtcttccagcaattactggtcttccaccaaatccagatcttccaggaaaatccacgtcttccaggaaatccatgtcttccaataatttcaaggtcttccatcaaatacagatcttccagctaatccatgtcttccagaaaaatctgtgtcttccaccaaatccaagtcttccagtaaatctagttcttccagaaaaatctagatcttccagtcaatcagtgtcttccagaaagaaatccaggtcttccagtcaatcagtgtcttccagaaagaaatccaggtcttccagtcagtcagtgtcttccagaaaaatctacgtcttccaccaaatccaggtcttccagtcaatccacatcttccggaaaaaatccaggtcttccagccaatatatgtcttcctgaagatccacgtcttccagaaaatccatgtcttccagaaaatccatgtcttccagtaacctcccagtcttccagaaaatccacgtcttcccaacaatccaagtcttccggataatttgggtcttcctgaaaatctacgtcttccaaaaaagccatgtcttccagaaacacattccacatcttccaatggcctccaggtcttccagactatccatgtcttccagaaaatccttgtcttcccttaaatctatagcttccaaaaaatccgggtcttccaggaaatccgtgtcttccagcaagtccacgtcttccaacaaagccatgtcttccagactatccatgtcttccagaaaatccttgtcttccctcaaatccatagcttccgaaaaatccaggtcttccaggaaatccgtgtcttccagcaaatccacgtcttccaacaaagccatgtcttccatcaaattaatgtcttccagcctacttgtgtcttccaacaaaggtacgtcttccaacaaaggtacgtcttccaacaaaggtatgtcttccaacaaaggtacgtcttccagaaaatccacgtcttccaaccaagccatgtcttccagaaaatccacgtcttccagaaaatatatgtcttccaactaagctacgtcttccaacaaatccatgtcttcctatatctccaggtcttccagcatctccagggcttccagcatctgctcgtcttccaacatctccacgtcttccagcatctctgtgtcttccagcatcttcatgtcttccaacaactacccagtcttccatcaactggctcaatatccatgtcttccaacgtctccagtgtgctgatcttctgacattcaggtcttccagtgtctgcaatatccagggtttccgatggcacctgtgtcaaggtcttccaacaactccgggtcttccagcgacttcaagtcttccaataatctcaaggtcttccagataatcctgagcttccagaaaatccacatcttccagacaannnagnnccggacaatccatg

SEQ ID NO: 366161 - DNA, 1233 bp, Homo sapiens
  misc_feature (62)..(62): n is a, c, g, or t
  misc_feature (65)..(65): n is a, c, g, or t
  misc_feature (67)..(67): n is a, c, g, or t
  misc_feature (71)..(71): n is a, c, g, or t
  misc_feature (74)..(74): n is a, c, g, or t
  misc_feature (77)..(79): n is a, c, g, or t
  misc_feature (103)..(103): n is a, c, g, or t
  misc_feature (1213)..(1215): n is a, c, g, or t
  misc_feature (1218)..(1219): n is a, c, g, or t
tacttttccacaggtcacaggtcttccaacgaactccgggtcttccagcgacttcaagtctnccngnaagngcncgnnntccaacaaagcctatgtcttccangactatccatgtcttccagaaaatccttgtcttccctcaaatccatagcttccgaaaaatccaggtcttccaggaaatccgtgtcttccagcaaatccacgtcttccaacaaagccatgtcttccatcaaattaatgtcttccagcctacttgtgtcttccaacaaaggtacgtcttccaacaaaggtacgtcttccaacaaaggtatgtcttccaacaaaggtacgtcttccagaaaatccacgtcttccaaccaagccatgtcttccagaaaatccacgtcttccagaaaatatatgtcttccaactaagctacgtcttccaacaaatccatgtcttcctatatctccaggtcttccagcatctccagggcttccagcatctgctcgtcttccaacatctccacgtcttccagcatctctgtgtcttccagcatcttcatgtcttccaacaactacccagtcttccatcaactggctcaatatccatgtcttccaacgtctccagtgtgctgatcttctgacattcaggtcttccagtgtctgcaatatccagggtttccgatggcacctgtgtcaaggtcttccaacaactccgggtcttccagcgacttcaagtcttccaataatctcaaggtcttccagataatcctgagcttccagaaaatccacatcttccagacaatccatgtcttccggacaatccatgtcttccaagaagctccaagtcttccagtaaatcaagtcttccagcaaatccagtcttccagcaattactggtcttccaccaaatccagatcttccaggaaaatccacgtcttccaggaaatccatgtcttccaataatttcaaggtcttccatcaaatacagatcttccagctaatccatgtcttccagaaaaatctgtgtcttccaccaaatccaagtcttccagtaaatctagttcttccagaaaaatctagatcttccagtcaatcagtggtttccgatggcacctgtgtcaaggtcttccaacaactccgggtcttccagcgacttcaagtcttccaataatctcaaggtcttccagataatcctgagcttccagaaaatccacatcttccagacaannnagnnccggacaatccatg

SEQ ID NO: 366162 - DNA, 1685 bp, Homo sapiens
  misc_feature (62)..(62): n is a, c, g, or t
  misc_feature (65)..(65): n is a, c, g, or t
  misc_feature (67)..(67): n is a, c, g, or t
  misc_feature (71)..(71): n is a, c, g, or t
  misc_feature (74)..(74): n is a, c, g, or t
  misc_feature (77)..(79): n is a, c, g, or t
  misc_feature (103)..(103): n is a, c, g, or t
  misc_feature (1665)..(1667): n is a, c, g, or t
  misc_feature (1670)..(1671): n is a, c, g, or t
tacttttccacaggtcacaggtcttccaacgaactccgggtcttccagcgacttcaagtctnccngnaagngcncgnnntccaacaaagcctatgtcttccangactatccatgtcttccagaaaatccttgtcttccctcaaatccatagcttccgaaaaatccaggtcttccaggaaatccgtgtcttccagcaaatccacgtcttccaacaaagccatgtcttccatcaaattaatgtcttccagcctacttgtgtcttccaacaaaggtacgtcttccaacaaaggtacgtcttccaacaaaggtatgtcttccaacaaaggtacgtcttccagaaaatccacgtcttccaaccaagccatgtcttccagaaaatccacgtcttccagaaaatatatgtcttccaactaagctacgtcttccaacaaatccatgtcttcctatatctccaggtcttccagcatctccagggcttccagcatctgctcgtcttccaacatctccacgtcttccagcatctctgtgtcttccagcatcttcatgtcttccaacaactacccagtcttccatcaactggctcaatatccatgtcttccaacgtctccagtgtgctgatcttctgacattcaggtcttccagtgtctgcaatatccagggtttccgatggcacctgtgtcaaggtcttccaacaactccgggtcttccagcgacttcaagtcttccaataatctcaaggtcttccagataatcctgagcttccagaaaatccacatcttccagacaatccatgtcttccggacaatccatgtcttccaagaagctccaagtcttccagtaaatcaagtcttccagcaaatccagtcttccagcaattactggtcttccaccaaatccagatcttccaggaaaatccacgtcttccaggaaatccatgtcttccaataatttcaagtcttccaacaaagccatgtcttccagactatccatgtcttccagaaaatccttgtcttccctcaaatccatagcttccgaaaaatccaggtcttccaggaaatccgtgtcttccagcaaatccacgtcttccaacaaagccatgtcttccatcaaattaatgtcttccagcctacttgtgtcttccaacaaaggtacgtcttccaacaaaggtacgtcttccaacaaaggtatgtcttccaacaaaggtacgtcttccagaaaatccacgtcttccaaccaagccatgtcttccagaaaatccacgtcttccagaaaatatatgtcttccaactaagctacgtcttccaacaaatccatgtcttcctatatctccaggtcttccagcatctccagggcttccagcatctgctcgtcttccaacatctccacgtcttccagcatctctgtgtcttccagcatcttcatgtcttccaacaactacccagtcttccatcaactggctcaatatccatgtcttccaacgtctccagtgtgctgatcttctgacattcaggtcttccagtgtctgcaatatccagggtttccgatggcacctgtgtcaaggtcttccaacaactccgggtcttccagcgacttcaagtcttccaataatctcaaggtcttccagataatcctgagcttccagaaaatccacatcttccagacaannnagnnccggacaatccatg

SEQ ID NO: 366163 - DNA, 1483 bp, Homo sapiens
  misc_feature (62)..(62): n is a, c, g, or t
  misc_feature (65)..(65): n is a, c, g, or t
  misc_feature (67)..(67): n is a, c, g, or t
  misc_feature (71)..(71): n is a, c, g, or t
  misc_feature (74)..(74): n is a, c, g, or t
  misc_feature (77)..(79): n is a, c, g, or t
  misc_feature (103)..(103): n is a, c, g, or t
  misc_feature (1463)..(1465): n is a, c, g, or t
  misc_feature (1468)..(1469): n is a, c, g, or t
tacttttccacaggtcacaggtcttccaacgaactccgggtcttccagcgacttcaagtctnccngnaagngcncgnnntccaacaaagcctatgtcttccangactatccatgtcttccagaaaatccttgtcttccctcaaatccatagcttccgaaaaatccaggtcttccaggaaatccgtgtcttccagcaaatccacgtcttccaacaaagccatgtcttccatcaaattaatgtcttccagcctacttgtgtcttccaacaaaggtacgtcttccaacaaaggtacgtcttccaacaaaggtatgtcttccaacaaaggtacgtcttccagaaaatccacgtcttccaaccaagccatgtcttccagaaaatccacgtcttccagaaaatatatgtcttccaactaagctacgtcttccaacaaatccatgtcttcctatatctccaggtcttccagcatctccagggcttccagcatctgctcgtcttccaacatctccacgtcttccagcatctctgtgtcttccagcatcttcatgtcttccaacaactacccagtcttccatcaactggctcaatatccatgtcttccaacgtctccagtgtgctgatcttctgacattcaggtcttccagtgtctgcaatatccagggtttccgatggcacctgtgtcaaggtcttccaacaactccgggtcttccagcgacttcaagtcttccaataatctcaaggtcttccagataatcctgagcttccagaaaatccacatcttccagacaatccatgtcttccggacaatccatgtcttccaagaagctccaagtcttccagtaaatcaagtcttccagcaaatccagtcttccagcaattactggtcttccaccaaatccagatcttccaggaaaatccacgtcttccaggaaatccatgtcttccaataatttcaagtcttccaacaaagccatgtcttccagactatccatgtcttccagaaaatccttgtcttccctcaaatccatagcttccgaaaaatccaggtcttccaggaaatccgtgtcttccagcaaatccacgtcttccaacaaagccatgtcttccatcaaattaatgtcttccagcccaggtcttccagcatctccagggcttccagcatctgctcgtcttccaacatctccacgtcttccagcatctctgtgtcttccagcatcttcatgtcttccaacaactacccagtcttccatcaactggctcaatatccatgtcttccaacgtctccagtgtgctgatcttctgacattcaggtcttccagtgtctgcaatatccagggtttccgatggcacctgtgtcaaggtcttccaacaactccgggtcttccagcgacttcaagtcttccaataatctcaaggtcttccagataatcctgagcttccagaaaatccacatcttccagacaannnagnnccggacaatccatg

SEQ ID NO: 366164 - DNA, 804 bp, Homo sapiens
  misc_feature (784)..(786): n is a, c, g, or t
  misc_feature (789)..(790): n is a, c, g, or t
agctcggtacccactagtccacggttggctactccgggtcttccaggaaatccgtgtcttccagcaagtccacgtcttccaacaaagccatgtcttccagactatccatgtcttccagaaaatccttgtcttccctcaaatccatagcttccgaaaaatccaggtcttccaggaaatccgtgtcttccagcaaatccacgtcttccaacaaagccatgtcttccatcaaattaatgtcttccagcctacttgtgtcttccaacaaaggtacgtcttccaacaaaggtacgtcttccaacaaaggtatgtcttccaacaaaggtacgtcttccagaaaatccacgtcttccaaccaagccatgtcttccagaaaatccacgtcttccagaaaatatatgtcttccaactaagctacgtcttccaacaaatccatgtcttcctatatctccaggtcttccagcatctccagggcttccagcatctgctcgtcttccaacatctccacgtcttccagcatctctgtgtcttccagcatcttcatgtcttccaacaactacccagtcttccatcaactggctcaatatccatgtcttccaacgtctccagtgtgctgatcttctgacattcaggtcttccagtgtctgcaatatccagggtttccgatggcacctgtgtcaaggtcttccaacaactccgggtcttccagcgacttcaagtcttccaataatctcaaggtcttccagataatcctgagcttccagaaaatccacatcttccagacaannnagnnccggacaatccatg

SEQ ID NO: 366165 - DNA, 1718 bp, Homo sapiens
atgtttttggtccccctacatgacagctgtttatagataatgtctgcagtttctgtttgagagagataattatgacacttagcattggaaaactaagaagaacgtaagcaggtcagctatcagaagtcttcagactggagagattcctggagggggagtggccctttaatccatcagctgaagccatctggtaggacgctcgttgcagaaatggttagttctgaaatgttgtagctcagcaacatcactgaatgtcacagaattgacaggcacggagctaaaagggcctctagccacccccacaactccgctctacctctgtctccctaacacatgacttggaacaaatacactctaggtacaaagatggctacctgaagtttatgatccctactcatggagctgcttgaggacttcacattttttaaaaagctgctttgggcacccccattcctgaggagttttgtagcttggtttctctttgccacattacgtttgtaagactaacattttataaccataagcagttaggcctttttattttgagaaatttatctgtagcttccttttatttacacttggggactatttttaagtaaccgattgaaatatttttgtttctccattgcaagtgaaatccttgttgctaatcttttgccacatgtaaaattgttcacttgttatcaagcaggtagttcaatatctgtaattcttgagttcttttcaactagcatgatgctaggtgtcactcactgttttttaattgtgggagattgatgcgtcagtgcatgaagtggggggtggtcaccagcatctaactcaaagtgtgattatagctatcttaccacattttttttttctttctcactctgtcacccaggctggagtgcagtggtgtaatctcagctcactgcagcctcgacctcctgggctcaagcgatcctcctacctcagcctcccaaatagctgggaccacaggcgcatgccaccccactaagctaatttttctattttttgcagagacagggttttgccgtgttgcctaggttgttctcaaactcctgagctcaagcctgcctcagcctcccaaagtgctgggattacatgtgtgagccaccatgcctggccgtcactaatcttcaaggttaatatttggaggacccatccagagtccaaaggtggtcttcgagggatagcacgaggtggtctgacaggactaacacttaccagcctctatgcactatataataactgggagcacatgaaaggctccttgctccaacagtcactctgaagattttgccaactcatgaatggaggacacttcagtagtcatctagatccttttataagacagtttggagttattctctctcttctacctacaattagtttgaaaaattggagattttgatttgctgtgatgaaaatcctggatggctgaccaagactggcacttgttccagccattagtgagttgaagccaaagccctttggtgactcactgagtaccatggttctgttctcctctggagatcttgcacgtatctgttttcctcccccatgaactagaaaaccacttactcccagaattcaggtcgtgcttgttagtactatatcaccaagtccattcatttaatgatccaaaactgtaatgttgcactgtattccaaataaagggtaaaaacagaaccaaagttataactccaacacaaaaa

SEQ ID NO: 366166 - DNA, 744 bp, Homo sapiens
  misc_feature (733)..(733): n is a, c, g, or t
gcacattgccgcaaagcggaagtgtggcgcttaacgggaaccggcgcccggaaggtcagcgtgtgaagtaggcgctggcaacgcggggttacccgctgttattgaggagtaacggcccagcggaccacccaggcttgaggcagcggcgggaaccactcggtttgctgcgataccatggaaggaggcgggggaagcggcaacaaaaccacagggggattggccggctttttcggagccggcggagcaggttactcgcacgcggatttggctggcgtcccgctaactggtatgaaccctctgtctccttatttaaatgtggatccacgatacctcgtgcaggatacagatgagtttattttacctaccggagctaataaaacccggggcagatttgagctggccttctttacgattggaggatgttgcatgacaggggctgcgtttggtgcaatgaatggtcttcggctaggattgaaggaaacccagaacatggcctggtccaaaccaagaaatgtacagattttgaatatggtgactaggcaaggggcactttgggctaatactctaggttctctggctttgctctatagtgcatttggtgtcatcattgagaaaacacgaggtgcagaagatgaccttaacacagtagcagctggaaccatgacaggcatgttgtataaatgtacagaaacggggtttcaccatggtgcccaggctggtcttacaggtggtncttcgaggcaa

SEQ ID NO: 366167 - DNA, 936 bp, Homo sapiens
  misc_feature (935)..(935): n is a, c, g, or t
gcacattgccgcaaagcggaagtgtggcgcttaacgggaaccggcgcccggaaggtcagcgtgtgaagtaggcgctggcaacgcggggttacccgctgttattgaggagtaacggcccagcggaccacccaggcttgaggcagcggcgggaaccactcggtttgctgcgataccatggaaggaggcgggggaagcggcaacaaaaccacagggggattggccggctttttcggagccggcggagcaggttactcgcacgcggatttggctggcgtcccgcagtcaggacctcgttctgtcacccatattggggtgcggtggcatgattatagttcactgaagcctcgcactcctgagctcaaacaatcctcccctctaagcctcctaagtagctgggactctagtaactggtatgaaccctctgtctccttatttaaatgtggatccacgatacctcgtgcaggatacagatgagtttattttacctaccggagctaataaaacccggggcagatttgagctggccttctttacgattggaggatgttgcatgacaggggctgcgtttggtgcaatgaatggtcttcggctaggattgaaggaaacccagaacatggcctggtccaaaccaagaaatgtacagattttgaatatggtgactaggcaaggggcactttgggctaatactctaggttctctggctttgctctatagtgcatttggtgtcatcattgagaaaacacgaggtgcagaagatgaccttaacacagtagcagctggaaccatgacaggcatgttgtataaatgtacagctggagtgcagtggcgtgatctcggctagctacaacctccacctcccagccgcctgccttggcctcccaaagtgccgagattgcagcctctgcccggctgccaccccgtctgggaagtgaggng

SEQ ID NO: 366168 - DNA, 1324 bp, Homo sapiens
  misc_feature (1252)..(1254): n is a, c, g, or t
  misc_feature (1272)..(1272): n is a, c, g, or t
  misc_feature (1274)..(1274): n is a, c, g, or t
  misc_feature (1276)..(1276): n is a, c, g, or t
  misc_feature (1288)..(1288): n is a, c, g, or t
  misc_feature (1297)..(1297): n is a, c, g, or t
  misc_feature (1299)..(1299): n is a, c, g, or t
  misc_feature (1302)..(1304): n is a, c, g, or t
gcacattgccgcaaagcggaagtgtggcgcttaacgggaaccggcgcccggaaggtcagcgtgtgaagtaggcgctggcaacgcggggttacccgctgttattgaggagtaacggcccagcggaccacccaggcttgaggcagcggcgggaaccactcggtttgctgcgataccatggaaggaggcgggggaagcggcaacaaaaccacagggggattggccggctttttcggagccggcggagcaggttactcgcacgcggatttggctggcgtcccgctaactggtatgaaccctctgtctccttatttaaatgtggatccacgatacctcgtgcaggatacagatgagtttattttacctaccggagctaataaaacccggggcagatttgagctggccttctttacgattggaggatgttgcatgacaggggctgcgtttggtgcaatgaatggtcttcggctaggattgaaggaaacccagaacatggcctggtccaaaccaagaaatgtacagattttgaatatggtgactaggcaaggggcactttgggctaatactctaggttctctggctttgctctatagtgcatttggtgtcatcattgagaaaacacgaggtgcagaagatgaccttaacacagtagcagctggaaccatgacaggcatgttgtataaatgtacaggtggtcttcgagggatagcacgaggtggtctgacaggactaacacttaccagcctctatgcactatataataactgggagcacatgaaaggctccttgctccaacagtcactctgaagattttgccaactcatgaatggaggacacttcagtagtcatctagatccttttataagacagtttggagttattctctctcttctacctacaattagtttgaaaaattggagattttgatttgctgtgatgaaaatcctggatggctgaccaagactggcacttgttccagccattagtgagttgaagccaaagccctttggtgactcactgagtaccatggttctgttctcctctggagatcttgcacgtatctgttttcctcccccatgaactagaaaaccacttactcccagaattcaggtcgtgcttgttagtactatatcaccaagtccattcatttaatgatccaaaactgtaatgttgcactgtattccaaataaagggtaaaaacagaaccaaagttataactccaacacaaaaaaaaaaaaaaaaaaaaaaaaatttnnngggcgggcatagggcccnananagaaggtttctnaaaacccantncgnnnggggcgcggcgggcgcccca

SEQ ID NO: 366169 - DNA, 1384 bp, Homo sapiens
gcacattgccgcaaagcggaagtgtggcgcttaacgggaaccggcgcccggaaggtcagcgtgtgaagtaggcgctggcaacgcggggttacccgctgttattgaggagtaacggcccagcggaccacccaggcttgaggcagcggcgggaaccactcggtttgctgcgataccatggaaggaggcgggggaagcggcaacaaaaccacagggggattggccggctttttcggagccggcggagcaggttactcgcacgcggatttggctggcgtcccgctaactggtatgaaccctctgtctccttatttaaatgtggatccacgatacctcgtgcaggatacagatgagtttattttacctaccggagctaataaaacccggggcagatttgagctggccttctttacgattggaggatgttgcatgacaggggctgcgtttggtgcaatgaatggtcttcggctaggattgaaggaaacccagaacatggcctggtccaaaccaagaaatgtacagattttgaatatggtgactaggcaaggggcactttgggctaatactctaggttctctggctttgctctatagtgcatttggtgtcatcattgagaaaacacgaggtgcagaagatgaccttaacacagtagcagctggaaccatgacaggcatgttgtataaatgtacagacagggttttgccgtgttgcctaggttgttctcaaactcctgagctcaagcctgcctcagcctcccaaagtgctgggattacatgtgtgagccaccatgcctggccgtcactaatcttcaaggttaatatttggaggacccatccagagtccaaaggtggtcttcgagggatagcacgaggtggtctgacaggactaacacttaccagcctctatgcactatataataactgggagcacatgaaaggctccttgctccaacagtcactctgaagattttgccaactcatgaatggaggacacttcagtagtcatctagatccttttataagacagtttggagttattctctctcttctacctacaattagtttgaaaaattggagattttgatttgctgtgatgaaaatcctggatggctgaccaagactggcacttgttccagccattagtgagttgaagccaaagccctttggtgactcactgagtaccatggttctgttctcctctggagatcttgcacgtatctgttttcctcccccatgaactagaaaaccacttactcccagaattcaggtcgtgcttgttagtactatatcaccaagtccattcatttaatgatccaaaactgtaatgttgcactgtattccaaataaagggtaaaaacagaaccaaagttataactccaacacaaaaa

SEQ ID NO: 366170 - DNA, 1267 bp, Homo sapiens
gcacattgccgcaaagcggaagtgtggcgcttaacgggaaccggcgcccggaaggtcagcgtgtgaagtaggcgctggcaacgcggggttacccgctgttattgaggagtaacggcccagcggaccacccaggcttgaggcagcggcgggaaccactcggtttgctgcgataccatggaaggaggcgggggaagcggcaacaaaaccacagggggattggccggctttttcggagccggcggagcaggttactcgcacgcggatttggctggcgtcccgctaactggtatgaaccctctgtctccttatttaaatgtggatccacgatacctcgtgcaggatacagatgagtttattttacctaccggagctaataaaacccggggcagatttgagctggccttctttacgattggaggatgttgcatgacaggggctgcgtttggtgcaatgaatggtcttcggctaggattgaaggaaacccagaacatggcctggtccaaaccaagaaatgtacagattttgaatatggtgactaggcaaggggcactttgggctaatactctaggttctctggctttgctctatagtgcatttggtgtcatcattgagggcatgttgtataaatgtacagagacggggtttcaccatggtgcccaggctagtctcaaactcctgagctcaagcgatccaccctgccttggcctcccaagtattgggattacaggtggtcttcgagggatagcacgaggtggtctgacaggactaacacttaccagcctctatgcactatataataactgggagcacatgaaaggctccttgctccaacagtcactctgaagattttgccaactcatgaatggaggacacttcagtagtcatctagatccttttataagacagtttggagttattctctctcttctacctacaattagtttgaaaaattggagattttgatttgctgtgatgaaaatcctggatggctgaccaagactggcacttgttccagccattagtgagttgaagccaaagccctttggtgactcactgagtaccatggttctgttctcctctggagatcttgcacgtatctgttttcctcccccatgaactagaaaaccacttactcccagaattcaggtcgtgcttgttagtactatatcaccaagtccattcatttaatgatccaaaactgtaatgttgcactgtattccaaataaagggtaaaaacagaaccaaagttataactccaacacaaaaa

SEQ ID NO: 366171 - DNA, 1171 bp, Homo sapiens
gcacattgccgcaaagcggaagtgtggcgcttaacgggaaccggcgcccggaaggtcagcgtgtgaagtaggcgctggcaacgcggggttacccgctgttattgaggagtaacggcccagcggaccacccaggcttgaggcagcggcgggaaccactcggtttgctgcgataccatggaaggaggcgggggaagcggcaacaaaaccacagggggattggccggctttttcggagccggcggagcaggttactcgcacgcggatttggctggcgtcccgctaactggtatgaaccctctgtctccttatttaaatgtggatccacgatacctcgtgcaggatacagatgagtttattttacctaccggagctaatagggctgcgtttggtgcaatgaatggtcttcggctaggattgaaggaaacccagaacatggcctggtccaaaccaagaaatgtacagattttgaatatggtgactaggcaaggggcactttgggctaatactctaggttctctggctttgctctatagtgcatttggtgtcatcattgagaaaacacgaggtgcagaagatgaccttaacacagtagcagctggaaccatgacaggcatgttgtataaatgtacaggtggtcttcgagggatagcacgaggtggtctgacaggactaacacttaccagcctctatgcactatataataactgggagcacatgaaaggctccttgctccaacagtcactctgaagattttgccaactcatgaatggaggacacttcagtagtcatctagatccttttataagacagtttggagttattctctctcttctacctacaattagtttgaaaaattggagattttgatttgctgtgatgaaaatcctggatggctgaccaagactggcacttgttccagccattagtgagttgaagccaaagccctttggtgactcactgagtaccatggttctgttctcctctggagatcttgcacgtatctgttttcctcccccatgaactagaaaaccacttactcccagaattcaggtcgtgcttgttagtactatatcaccaagtccattcatttaatgatccaaaactgtaatgttgcactgtattccaaataaagggtaaaaacagaaccaaagttataactccaacacaaaaa

SEQ ID NO: 366172 - DNA, 1194 bp, Homo sapiens
gcacattgccgcaaagcggaagtgtggcgcttaacgggaaccggcgcccggaaggtcagcgtgtgaagtaggcgctggcaacgcggggttacccgctgttattgaggagtaacggcccagcggaccacccaggcttgaggcagcggcgggaaccactcggtttgctgcgataccatggaaggaggcgggggaagcggcaacaaaaccacagggggattggccggctttttcggagccggcggagcaggttactcgcacgcggatttggctggcgtcccgctaactggtatgaaccctctgtctccttatttaaatgtggatccacgatacctcgtgcaggatacagatgagtttattttacctaccggagctaataaaacccggggcagatttgagctggccttctttacgattggaggatgttgcatgacaggggctgcgtttggtgcaatgaatggtcttcggctaggattgaaggaaacccgattttgaatatggtgactaggcaaggggcactttgggctaatactctaggttctctggctttgctctatagtgcatttggtgtcatcattgagaaaacacgaggtgcagaagatgaccttaacacagtagcagctggaaccatgacaggcatgttgtataaatgtacaggtggtcttcgagggatagcacgaggtggtctgacaggactaacacttaccagcctctatgcactatataataactgggagcacatgaaaggctccttgctccaacagtcactctgaagattttgccaactcatgaatggaggacacttcagtagtcatctagatccttttataagacagtttggagttattctctctcttctacctacaattagtttgaaaaattggagattttgatttgctgtgatgaaaatcctggatggctgaccaagactggcacttgttccagccattagtgagttgaagccaaagccctttggtgactcactgagtaccatggttctgttctcctctggagatcttgcacgtatctgttttcctcccccatgaactagaaaaccacttactcccagaattcaggtcgtgcttgttagtactatatcaccaagtccattcatttaatgatccaaaactgtaatgttgcactgtattccaaataaagggtaaaaacagaaccaaagttataactccaacacaaaaa

SEQ ID NO: 366173 - DNA, 1117 bp, Homo sapiens
gcacattgccgcaaagcggaagtgtggcgcttaacgggaaccggcgcccggaaggtcagcgtgtgaagtaggcgctggcaacgcggggttacccgctgttattgaggagtaacggcccagcggaccacccaggcttgaggcagcggcgggaaccactcggtttgctgcgataccatggaaggaggcgggggaagcggcaacaaaaccacagggggattggccggctttttcggagccggcggagcaggttactcgcacgcggatttggctggcgtcccgctaactggtatgaaccctctgtctccttatttaaatgtggatccacgatacctcgtgcaggatacagatgagtttattttacctaccggagctaataaaacccggggcagatttgagctggccttctttacgattggaggatgttgcatgacaggggcactttgggctaatactctaggttctctggctttgctctatagtgcatttggtgtcatcattgagaaaacacgaggtgcagaagatgaccttaacacagtagcagctggaaccatgacaggcatgttgtataaatgtacaggtggtcttcgagggatagcacgaggtggtctgacaggactaacacttaccagcctctatgcactatataataactgggagcacatgaaaggctccttgctccaacagtcactctgaagattttgccaactcatgaatggaggacacttcagtagtcatctagatccttttataagacagtttggagttattctctctcttctacctacaattagtttgaaaaattggagattttgatttgctgtgatgaaaatcctggatggctgaccaagactggcacttgttccagccattagtgagttgaagccaaagccctttggtgactcactgagtaccatggttctgttctcctctggagatcttgcacgtatctgttttcctcccccatgaactagaaaaccacttactcccagaattcaggtcgtgcttgttagtactatatcaccaagtccattcatttaatgatccaaaactgtaatgttgcactgtattccaaataaagggtaaaaacagaaccaaagttataactccaacacaaaaa

SEQ ID NO: 366174 - DNA, 888 bp, Homo sapiens
gcacattgccgcaaagcggaagtgtggcgcttaacgggaaccggcgcccggaaggtcagcgtgtgaagtaggcgctggcaacgcggggttacccgctgttattgaggagtaacggcccagcggaccacccaggcttgaggcagcggcgggaaccactcggtttgctgcgataccatggaaggaggcgggggaagcggcaacaaaaccacagggggattggccggctttttcggagccggcggagcaggttactcgcacgcggatttggctggcgtcccgctaactggtatgaaccctctgtctccttatttaaatgtggatccacgatacctcgtgcaggatacagatgagtttattttacctaccggagctaataaaacccggggcagatttgagctggccttctttacgattggaggatgttgcatgacaggggctgcgtttggtgcaatgaatggtcttcggctaggattgaaggaaacccagaacatggcctggtccaaaccaagaaatgtacagattttgaatatggtgactaggcaaggggcactttgggctaatactctaggttctctggctttgctctatagtgcatttggtgtcatcattgagaaaacacgaggtgcagaagatgaccttaacacagtagcagctggaaccatgacaggcatgttgtataaatgtacaggtgagtactgttgaatggggagccatctcttaatatacttgaagtgcgctttttaaaattcatggttttcaaggaaattacactctgttgcagtataatctagtgttctaactttatggttattttggtttggtttggtttttaattgtggtaaaataaacataagatttacccatcttaaccatttttaagtatacagt

SEQ ID NO: 366175 - DNA, 630 bp, Homo sapiens
gcacattgccgcaaagcggaagtgtggcgcttaacgggaaccggcgcccggaaggtcagcgtgtgaagtaggcgctggcaacgcggggttacccgctgttattgaggagtaacggcccagcggaccacccaggcttgaggcagcggcgggaaccactcggtttgctgcgataccatggaaggaggcgggggaagcggcaacaaaaccacagggggattggccggctttttcggagccggcggagcaggttactcgcacgcggatttggctggcgtcccgctaactggtatgaaccctctgtctccttatttaaatgtggatccacgatacctcgtgcaggatacagatgagtttattttacctaccggagctaataaaacccggggcagatttgagctggccttctttacgattggaggatgttgcatgacaggggctgcgtttggtgcaatgaatggtcttcggctaggattgaaggaaacccaaaaccacttactcccagaattcaggtcgtgcttgttagtactatatcaccaagtccattcatttaatgatccaaaactgtaatgttgcactgtattccaaataaagggtaaaaacagaaccaaagttataactccaacacaaaaa

SEQ ID NO: 366176 - DNA, 169 bp, Homo sapiens
tttttttttaatatttacatttgtctttttctattaaataaaaatgaaaaagaatcagaagtgtagttatgcagatttgagtttgtttttttaatataaagctgtctttatctgggtgaattgttatgatttaccagggctgcgtttggtgcaatgaatggtcttcggc

SEQ ID NO: 366177 - DNA, 439 bp, Homo sapiens
caagactggcacttgttccagccattagtgagttgaagccaaagccctttggtgactcactgagtaccatggttctgttctcctctggagatcttgcacgtatctgttttcctcccccatgaactagaaaaccacttactcccagaattcaggtcgtgcttgttagtactatatcaccaagtccattcatttaatgatccaaaactgtaatgttgcactgtattccaaataaagggtaaaaacagaaccaaagttataactccaacacaaaaacaaacatagtggttgtctcaatttaaaagtatctacctgggtataaagtgaaaggtacccttggcattttttgtcccagtgggcaaaacaacatcttcgtgtttgtgttaaaatgagctacttggtggccgggtgtggtggctcacgcctgtaatccctgtacttt

SEQ ID NO: 366178 - DNA, 1270 bp, Homo sapiens
gcacattgccgcaaagcggaagtgtggcgcttaacgggaaccggcgcccggaaggtcagcgtgtgaagtaggcgctggcaacgcggggttacccgctgttattgaggagtaacggcccagcggaccacccaggcttgaggcagcggcgggaaccactcggtttgctgcgataccatggaaggaggcgggggaagcggcaacaaaaccacagggggattggccggctttttcggagccggcggagcaggttactcgcacgcggatttggctggcgtcccgctaactggtatgaaccctctgtctccttatttaaatgtggatccacgatacctcgtgcaggatacagatgagtttattttacctaccggagctaataaaacccggggcagatttgagctggccttctttacgattggaggatgttgcatgacaggggctgcgtttggtgcaatgaatggtcttcggctaggattgaaggaaacccagaacatggcctggtccaaaccaagaaatgtacagattttgaatatggtgactaggcaaggggcactttgggctaatactctaggttctctggctttgctctatagtgcatttggtgtcatcattgagaaaacacgaggtgcagaagatgaccttaacacagtagcagctggaaccatgacaggcatgttgtataaatgtacagtgtcagagatggctttggattccccgttctgtgtgctgctgtctggctcctgaacccagctgtagaggtgtgtgtcaatcccaactggtgaagtactgagaagaagctacacaaaaggcagcaaagtattagtaagtgtacctctgacattttaaccacctctgacttttccatggaatggacaagtagtagtctctgtcagagctacattttaaaggagaaaaagaaacgtgaagtcatgaactgtttatttatgctgttatttttgtgtttactcacctcatttatattgacttgtaaattagtaatttctgaactattatttatcaattcattgcctacatgtcagcaaacaaattttcttcttaataaagaatccagttgctgggcacaatggttcacacctgtaatctcagcacgttggagggcaaggcaggaggattccttggggctaggagttcacgaccagcctgggaatatagcaagattccatctctacaaaaaatgaaaacattggctgggcatgggggtccattcctaaagttcagggtacggggggctgatgttgagggtccctgaacc

SEQ ID NO: 366179 - DNA, 1228 bp, Homo sapiens
gcacattgccgcaaagcggaagtgtggcgcttaacgggaaccggcgcccggaaggtcagcgtgtgaagtaggcgctggcaacgcggggttacccgctgttattgaggagtaacggcccagcggaccacccaggcttgaggcagcggcgggaaccactcggtttgctgcgataccatggaaggaggcgggggaagcggcaacaaaaccacagggggattggccggctttttcggagccggcggagcaggttactcgcacgcggatttggctggcgtcccgctaactggtatgaaccctctgtctccttatttaaatgtggatccacgatacctcgtgcaggatacagatgagtttattttacctaccggagctaataaaacccggggcagatttgagctggccttctttacgattggaggatgttgcatgacaggggctgcgtttggtgcaatgaatggtcttcggctaggattgaaggaaacccagaacatggcctggtccaaaccaagaaatgtacagattttgaatatggtgactaggcaaggggcactttgggctaatactctaggttctctggctttgctctatagtgcatttggtgtcatcattgagaaaacacgaggtgcagaagatgaccttaacacagtagcagctggaaccatgacaggcatgttgtataaatgtacaggtggtcttcgagggatagcacgaggtggtctgacaggactaacacttaccagcctctatgcactatataataactgggagcacatgaaaggctccttgctccaacagtcactctgaagattttgccaactcatgaatggaggacacttcagtagtcatctagatccttttataagacagtttggagttattctctctcttctacctacaattagtttgaaaaattggagattttgatttgctgtgatgaaaatcctggatggctgaccaagactggcacttgttccagccattagtgagttgaagccaaagccctttggtgactcactgagtaccatggttctgttctcctctggagatcttgcacgtatctgttttcctcccccatgaactagaaaaccacttactcccagaattcaggtcgtgcttgttagtactatatcaccaagtccattcatttaatgatccaaaactgtaatgttgcactgtattccaaataaagggtaaaaacagaaccaaagttataactccaacacaaaaa

SEQ ID NO: 366180 - DNA, 1321 bp, Homo sapiens
gcacattgccgcaaagcggaagtgtggcgcttaacgggaaccggcgcccggaaggtcagcgtgtgaagtaggcgctggcaacgcggggttacccgctgttattgaggagtaacggcccagcggaccacccaggcttgaggcagcggcgggaaccactcggtttgctgcgataccatggaaggaggcgggggaagcggcaacaaaaccacagggggattggccggctttttcggagccggcggagcaggttactcgcacgcggatttggctggcgtcccgctaactggtatgaaccctctgtctccttatttaaatgtggatccacgatacctcgtgcaggatacagatgagtttattttacctaccggagctaataaaacccggggcagatttgagctggccttctttacgattggaggatgttgcatgacaggggctgcgtttggtgcaatgaatggtcttcggctaggattgaaggaaacccagaacatggcctggtccaaaccaagaaatgtacagattttgaatatggtgactaggcaaggggcactttgggctaatactctaggttctctggctttgctctatagtgcatttggtgtcatcattgagaaaacacgaggtgcagaagatgaccttaacacagtagcagctggaaccatgacaggcatgttgtataaatgtacagagacggggtttcaccatggtgcccaggctagtctcaaactcctgagctcaagcgatccaccctgccttggcctcccaagtattgggattacaggtggtcttcgagggatagcacgaggtggtctgacaggactaacacttaccagcctctatgcactatataataactgggagcacatgaaaggctccttgctccaacagtcactctgaagattttgccaactcatgaatggaggacacttcagtagtcatctagatccttttataagacagtttggagttattctctctcttctacctacaattagtttgaaaaattggagattttgatttgctgtgatgaaaatcctggatggctgaccaagactggcacttgttccagccattagtgagttgaagccaaagccctttggtgactcactgagtaccatggttctgttctcctctggagatcttgcacgtatctgttttcctcccccatgaactagaaaaccacttactcccagaattcaggtcgtgcttgttagtactatatcaccaagtccattcatttaatgatccaaaactgtaatgttgcactgtattccaaataaagggtaaaaacagaaccaaagttataactccaacacaaaaa

SEQ ID NO: 366181 - DNA, 1169 bp, Homo sapiens
gcacattgccgcaaagcggaagtgtggcgcttaacgggaaccggcgcccggaaggtcagcgtgtgaagtaggcgctggcaacgcggggttacccgctgttattgaggagtaacggcccagcggaccacccaggcttgaggcagcggcgggaaccactcggtttgctgcgataccatggaaggaggcgggggaagcggcaacaaaaccacagggggattggccggctttttcggagccggcggagcaggttactcgcacgcggatttggctggcgtcccgcgatacagatgagtttattttacctaccggagctaataaaacccggggcagatttgagctggccttctttacgattggaggatgttgcatgacaggggctgcgtttggtgcaatgaatggtcttcggctaggattgaaggaaacccagaacatggcctggtccaaaccaagaaatgtacagattttgaatatggtgactaggcaaggggcactttgggctaatactctaggttctctggctttgctctatagtgcatttggtgtcatcattgagaaaacacgaggtgcagaagatgaccttaacacagtagcagctggaaccatgacaggcatgttgtataaatgtacaggtggtcttcgagggatagcacgaggtggtctgacaggactaacacttaccagcctctatgcactatataataactgggagcacatgaaaggctccttgctccaacagtcactctgaagattttgccaactcatgaatggaggacacttcagtagtcatctagatccttttataagacagtttggagttattctctctcttctacctacaattagtttgaaaaattggagattttgatttgctgtgatgaaaatcctggatggctgaccaagactggcacttgttccagccattagtgagttgaagccaaagccctttggtgactcactgagtaccatggttctgttctcctctggagatcttgcacgtatctgttttcctcccccatgaactagaaaaccacttactcccagaattcaggtcgtgcttgttagtactatatcaccaagtccattcatttaatgatccaaaactgtaatgttgcactgtattccaaataaagggtaaaaacagaaccaaagttataactccaacacaaaaa

SEQ ID NO: 366182 - DNA, 861 bp, Homo sapiens
aattcggcacgatgaccaatctgaagtgggagctggccttctttacgattggaggatgttgcatgagggctgcgtttggtgcaatgaatggtcttcggctaggattgaaggaaacccagaacatggcctggtccaaaccaagaaatgtacagattttgaatatggtgactaggcaaggggcactttgggctaatactctaggttctctggctttgctctatagtgcatttggtgtcatcattgagaaaacacgaggtgcagaagatgaccttaacacagtagcagctggaaccatgacaggcatgttgtataaatgtacaggtggtcttcgagggatagcacgaggtggtctgacaggactaacacttaccagcctctatgcactatataataactgggagcacatgaaaggctccttgctccaacagtcactctgaagattttgccaactcatgaatggaggacacttcagtagtcatctagatccttttataagacagtttggagttattctctctcttctacctacaattagtttgaaaaattggagattttgatttgctgtgatgaaaatcctggatggctgaccaagactggcacttgttccagccattagtgagttgaagccaaagccctttggtgactcactgagtaccatggttctgttctcctctggagatcttgcacgtatctgttttcctcccccatgaactagaaaaccacttactcccagaattcaggtcgtgcttgttagtactatatcaccaagtccattcatttaatgatccaaaactgtaatgttgcactgtattccaaataaagggtaaaaacagaaccaaagttataactccaacacaaaaa

SEQ ID NO: 366183 - DNA, 1169 bp, Homo sapiens
gcacattgccgcaaagcggaagtgtggcgcttaacgggaaccggcgcccggaaggtcagcgtgtgaagtaggcgctggcaacgcggggttacccgctgttattgaggagtaacggcccagcggaccacccaggcttgaggcagcggcgggaaccactcggtttgctgcgataccatggaaggaggcgggggaagcggcaacaaaaccacagggggattggccggctttttcggagccggcggagcaggttactcgcacgcggatttggctggcgtcccgctaactggtatgaaccctctgtctccttatttaaatgtggatccacgatacctcgtgcaggatacagatgagtttattttacctaccggagctaataaaacccggggcagatttgagctggccttctttacgattggaggatgttgcatgacaggggctgcgtttggtgcaatgaatggtcttcggctaggattgaaggaaacccagaacatggcctggtccaaaccaagaaatgtacactttgctctatagtgcatttggtgtcatcattgagaaaacacgaggtgcagaagatgaccttaacacagtagcagctggaaccatgacaggcatgttgtataaatgtacaggtggtcttcgagggatagcacgaggtggtctgacaggactaacacttaccagcctctatgcactatataataactgggagcacatgaaaggctccttgctccaacagtcactctgaagattttgccaactcatgaatggaggacacttcagtagtcatctagatccttttataagacagtttggagttattctctctcttctacctacaattagtttgaaaaattggagattttgatttgctgtgatgaaaatcctggatggctgaccaagactggcacttgttccagccattagtgagttgaagccaaagccctttggtgactcactgagtaccatggttctgttctcctctggagatcttgcacgtatctgttttcctcccccatgaactagaaaaccacttactcccagaattcaggtcgtgcttgttagtactatatcaccaagtccattcatttaatgatccaaaactgtaatgttgcactgtattccaaataaagggtaaaaacagaaccaaagttataactccaacacaaaaa

SEQ ID NO: 366184 - DNA, 1133 bp, Homo sapiens
gcacattgccgcaaagcggaagtgtggcgcttaacgggaaccggcgcccggaaggtcagcgtgtgaagtaggcgctggcaacgcggggttacccgctgttattgaggagtaacggcccagcggaccacccaggcttgaggcagcggcgggaaccactcggtttgctgcgataccatggaaggaggcgggggaagcggcaacaaaaccacagggggattggccggctttttcggagccggcggagcaggttactcgcacgcggatttggctggcgtcccgctaactggtatgaaccctctgtctccttatttaaatgtggatccacgatacctcgtgcaggatacagatgagtttattttacctaccggagctaataaaacccggggcagatttgagctggccttctttacgattggaggatgttgcatgacaggggctgcgtttggtgcaatgaatggtcttcggctaggattgaaggaaacccagaacatggcctggtccaaaccaagaaatgtacagattttgaatatggtgactaggcaaggggcactttgggctaatactctaggttctctggctttgctctatagtgcatttggtgtcatcattgagaaaacacgaggtgcagaagatgaccttaacacagtagcagctggaaccatgacaggcatgttgtataaatgtacagacagggttttgccgtgttgcctaggttgttctcaaactcctgagctcaagcctgcctcagcctcccaaagtgctgggattacatgtgtgagccaccatgcctggccgtcactaatcttcaaggttaatatttggaggacccatccagagtccaaaggttgttaatactctttccaaatagggtgtcaccttgtttacattacagacttaaatccattgacagtgctagtggagttctaaatcatattactagcaggaaacgactgttctagttggaactccgtaataaactgccataggaacaaattggaaagtagggggaaaaaaattatgaatatgaaaatgttaagtcatatgtattacacaagtggtattactttaaaaacgttgtctcctttttgagatggaatattgatttatttttaaaatggtctctccatttcata

SEQ ID NO: 366185 - DNA, 872 bp, Homo sapiens
gcacattgccgcaaagcggaagtgtggcgcttaacgggaaccggcgcccggaaggtcagcgtgtgaagtaggcgctggcaacgcggggttacccgctgttattgaggagtaacggcccagcggaccacccaggcttgaggcagcggcgggaaccactcggtttgctgcgataccatggaaggaggcgggggaagcggcaacaaaaccacagggggattggccggctttttcggagccggcggagcaggttactcgcacgcggatttggctggcgtcccgctaactggtatgaaccctctgtctccttatttaaatgtggatccacgatacctcgtgcaggatacagatgagtttattttacctaccggagctaataaaacccggggcagatttgagctggccttctttacgattggaggatgttgcatgacaggggctgcgtttggtgcaatgaatggtcttcggctaggattgaaggaaacccagaacatggcctggtccaaaccaagaaatgtacagtaagtctcttgtaaccatctgatgtagtgatacttgaatattaagctctgttgtattggtttgatgagtacaaccttgagattacagatggttagcatagttatgtgcttttttgtctttgttttttaatcttaatcaaaataaaagcaactaaggaatcagattactgactctaagcttttaaaaaggagtgatttttttaatcagtgtccctcagtcagctagtgctatgccagcctgacttctcagctgcacctgttacattctccaaccctatgtgacttgcttttcaaattgttgagttgctaatgggaattttggattgtttgggggcatgcagatccataggaaat

SEQ ID NO: 366186 - DNA, 714 bp, Homo sapiens
tgaaaaggagccagtcttgcaaacagccgggcaaagagtgagcaagagttttttgggaagaggtgcacacagcaagtgctgagacccagaggaaggaaggggcttgtctgctgaaggacccaggtgccctgggagaggtagccagaggcgcttagtaagcttcaatcaggattttaatcttaatatagtgctgagggttttaagcagaagagtgatagaagagagttagcttttgtgcaagcactattattcatggaagtcccctttcgatggggtagtggggactcctcactaagctgtccttctatctctgtggctgtctcagagaagcactgtggaactccagggtgctacgtagctcaccacggtgacccccaatgcaggccacttacagaagcttgaagatctgtgatttgctcacccaggctcccatgccgagtgttcttgtcattaactcaaaagccaaatgctgttatttctgttcttacttgcttgattgtttgtttaccagttctcaacatcttcagtgtccacttggttactaaaatgtttactccttagcccggtgtgtaggcatgtgcctgtaatcccagctactcaggaggctgaggcagaagaatctcttgaacctgggaggtagagattgaagtgagccaagattgtgccactgcaatccagcctgggcaacacagcgggactctgtctccaaagaaa

SEQ ID NO: 366187 - DNA, 461 bp, Homo sapiens
atatgtagagcacaaatgtgcagacttgtttagggaatagaaagaatttttgtttggtttcagagtggagtgcttagagttactgtgacagataaaactggagaaatacatcagaccaggtcctaatgccacaccaagtaaggagttctgtgttctggtgacttcataacagattgaattctgcgaaatcacagaggtttgcactagttaagccaaatgggagaactgaacaagatgcatggatgtatttagatgactagcaactcaacagaagagactagagctagcctctggtttcaactgagtttcagaggagaaatatctgggccaacctgactaggatgctagcaaacttttgaattcagcatataatttatcttgtaaatgtgactattttagaaaaaacaaaatacatttgtggagagcaccacacaattaacttcattcagatttggcatttg

SEQ ID NO: 366188 - DNA, 1397 bp, Homo sapiens
tcggaaaggaaagctgtgggaccatcctggcaaccccggtgtttggctgggttctagcgtagccgtctgtgtggccggtgggggacctgcggtcggagtgggagggccagtctgcacccaagaggtggaagaggacgggctttaggctggaagcgccttagaggagccatttttccaggtggggccccaggcagaggctccgacagggagcctggccatagtcgcgcagccggggaggtggagcgcgtcccagacccgagcccccgacctcagccaaacccattccttctgtccttggaggccagaggggactctgagcatcggaaaggatgcctggtttgcttttatgtgaaccgacagagctttacaacatcctgaatcaggccacaaaactctccagattaacagaccccaactatctctgtttattggatgtccgttccaaatgggagtatgacgaaagccatgtgatcactgcccttcgagtgaagaagaaaaataatgaatatcttctcccggagtctgtggacctggagtgtgtgaagtactgcgtggtgtatgataacaacagcagcaccctggagatactcttaaaagatgatgatgatgattcagactctgatggtgatggcaaagatcttgtgcctcaagcagccattgagtatggcaggatcctgacccgcctcacccaccaccccgtctacatcctgaaagggggctatgagcgcttctcaggcacgtaccactttctccggacccagaagatcatctggatgcctcaggaactggatgcatttcagccataccccattgaaatcgtgccagggaaggtcttcgttggcaatttcagtcaagcctgtgaccccaagattcagaaggacttgaaaatcaaagcccatgtcaatgtctccatggatacagggcccttttttgcaggcgatgctgacaagcttctgcacatccggatagaagattccccggaagcccagattcttcccttcttacgccacatgtgtcacttcattgaaattcaccatcaccttggctctgtcattctgatcttttccacccagggtatcagccgcagttgtgccgccatcatagcctacctcatgcatagtaacgagcagaccttgcagaggtcctgggcctatgtcaagaagtgcaaaaacaacatgtgtccaaatcggggattggtgagccagctgctggaatgggagaagactatccttggagattccatcacaaacatcatggatccgctctactgatcttctccgaggcccaccgaagggtactgaagagcctcacctgggggcattttgtgggtggagggccagagtgtgtatacccaggcttgtctggaaggagaaggcctttgctgcctgaaagtctca

SEQ ID NO: 366189 - DNA, 1101 bp, Homo sapiens
tcggaaaggaaagctgtgggaccatcctggcaaccccggtgtttggctgggttctagcgtagccgtctgtgtggccggtgggggacctgcggtcggagtgggagggccagtctgcacccaagaggtggaagaggacgggctttaggctggaagcgccttagaggagccatttttccaggatgcctggtttgcttttatgtgaaccgacagagctttacaacatcctgaatcaggccacaaaactctccagattaacagaccccaactatctctgtttattggatgtccgttccaaatgggagtatgacgaaagccatgtgatcactgcccttcgagtgaagaagaaaaataatgaatatcttctcccggagtctgtggacctggagtgtgtgaagtactgcgtggtgtatgataacaacagcagcaccctggagatactcttaaaagatgatgatgatgattcagactctgatggtgatggcaaaggaactggatgcatttcagccataccccattgaaatcgtgccagggaaggtcttcgttggcaatttcagtcaagcctgtgaccccaagattcagaaggacttgaaaatcaaagcccatgtcaatgtctccatggatacagggcccttttttgcaggcgatgctgacaagcttctgcacatccggatagaagattccccggaagcccagattcttcccttcttacgccacatgtgtcacttcattgaaattcaccatcaccttggctctgtcattctgatcttttccacccagggtatcagccgcagttgtgccgccatcatagcctacctcatgcatagtaacgagcagaccttgcagaggtcctgggcctatgtcaagaagtgcaaaaacaacatgtgtccaaatcggggattggtgagccagctgctggaatgggagaagactatccttggagattccatcacaaacatcatggatccgctctactgatcttctccgaggcccaccgaagggtactgaagagcctcacctgggggcattttgtgggtggagggccagagtgtgtatacccaggcttgtctggaaggagaaggcctttgctgcctgaaagtctca

SEQ ID NO: 366190 - DNA, 709 bp, Homo sapiens
tcggaaaggaaagctgtgggaccatcctggcaaccccggtgtttggctgggttctagcgtagccgtctgtgtggccggtgggggacctgcggtcggagtgggagggccagtctgcacccaagaggtggaagaggacgggctttaggctggaagcgccttagaggagccatttttccaggatgcctggtttgcttttatgtgaaccgacagagctttacaacatcctgaatcaggccacaaaactctccagattaacagaccccaactatctctgtttattggatgtccgttccaaatgggagtatgacgaaagccatgtgatcactgcccttcgagtgaagaagaaaaataatgaatatcttctcccggagtctgtggacctggagtgtgtgaagtactgcgtggtgtatgataacaacagcagcaccctggagatactcttaaaagatgatgatgatgattcagactctgatggtgatggcaaagatcttgtgcctcaagcagccattgagtatggcaggatcctgacccgcctcacccaccaccccgtctacatcctgaaagggggctatgagcgcttctcaggcacgtaccactttctccggacccagaagatcatctggatgcctcagaagagacgaggtttcaccgtgttagccaggatggtctcgatctcctgacctcgtgatccgcccacctcagcctccca

SEQ ID NO: 366191 - DNA, 660 bp, Homo sapiens
tcggaaaggaaagctgtgggaccatcctggcaaccccggtgtttggctgggttctagcgtagccgtctgtgtggccggtgggggacctgcggtcggagtgggagggccagtctgcacccaagaggtggaagaggacgggctttaggctggaagcgccttagaggagccatttttccaggtggggccccaggcagaggctccgacagggagcctggccatagtcgcgcagccggggaggtggagcgcgtcccagacccgagcccccgacctcagccaaacccattccttctgtccttggaggccagaggggactctgagcatcggaaaggtagggtcagggaggctgagagtccttaggcggggtgggaggaaggggccatctcctcagatccgggccgtcgtttcccaagttgcagagacccttgggttcaggtttagtgacaccactgctgataatggcgacctccagccctgcaagctttagaggaccactattctgtgttccagatgagcaaataggttgtagggacaacaacttccgtggtcatacagttcctgtcttctctcgcctgcccggcagtgctctgacggtcccactgtttctgctttacgaataaagacactgtggctgaggccaagtggatttgtagagtttaaaaa

SEQ ID NO: 366192 - DNA, 1247 bp, Homo sapiens
tcggaaaggaaagctgtgggaccatcctggcaaccccggtgtttggctgggttctagcgtagccgtctgtgtggccggtgggggacctgcggtcggagtgggagggccagtctgcacccaagaggtggaagaggacgggctttaggctggaagcgccttagaggagccatttttccaggatgcctggtttgcttttatgtgaaccgacagagctttacaacatcctgaatcaggccacaaaactctccagattaacagaccccaactatctctgtttattggatgtccgttccaaatgggagtatgacgaaagccatgtgatcactgcccttcgagtgaagaagaaaaataatgaatatcttctcccggagtctgtggacctggagtgtgtgaagtactgcgtggtgtatgataacaacagcagcaccctggagatactcttaaaagatgatgatgatgattcagactctgatggtgatggcaaagatcttgtgcctcaagcagccattgagtatggcaggatcctgacccgcctcacccaccaccccgtctacatcctgaaagggggctatgagcgcttctcaggcacgtaccactttctccggacccagaagatcatctggatgcctcaggaactggatgcatttcagccataccccattgaaatcgtgccagggaaggtcttcgttggcaatttcagtcaagcctgtgaccccaagattcagaaggacttgaaaatcaaagcccatgtcaatgtctccatggatacagggcccttttttgcaggcgatgctgacaagcttctgcacatccggatagaagattccccggaagcccagattcttcccttcttacgccacatgtgtcacttcattgaaattcaccatcaccttggctctgtcattctgatcttttccacccagggtatcagccgcagttgtgccgccatcatagcctacctcatgcatagtaacgagcagaccttgcagaggtcctgggcctatgtcaagaagtgcaaaaacaacatgtgtccaaatcggggattggtgagccagctgctggaatgggagaagactatccttggagattccatcacaaacatcatggatccgctctactgatcttctccgaggcccaccgaagggtactgaagagcctcacctgggggcattttgtgggtggagggccagagtgtgtatacccaggcttgtctggaaggagaaggcctttgctgcctgaaagtctca

SEQ ID NO: 366193 - DNA, 1289 bp, Homo sapiens
tcggaaaggaaagctgtgggaccatcctggcaaccccggtgtttggctgggttctagcgtagccgtctgtgtggccggtgggggacctgcggtcggagtgggagggccagtctgcacccaagaggtggaagaggacgggctttaggctggaagcgccttagaggagccatttttccaggtggggccccaggcagaggctccgacagggagcctggccatagtcgcgcagccggggaggtggagcgcgtcccagacccgagcccccgacctcagccaaacccattccttctgtccttggaggccagaggggactctgagcatcggaaaggatgcctggtttgcttttatgtgaaccgacagagctttacaacatcctgaatcaggccacaaaactctccagattaacagaccccaactatctctgtttattggatgtccgttccaaatgggagtatgacgaaagccatgtgatcactgcccttcgagtgaagaaggggctgaactactttacattcccaccaacagtatatcttgtgcctcaagcagccattgagtatggcaggatcctgacccgcctcacccaccaccccgtctacatcctgaaagggggctatgagcgcttctcaggcacgtaccactttctccggacccagaagatcatctggatgcctcaggaactggatgcatttcagccataccccattgaaatcgtgccagggaaggtcttcgttggcaatttcagtcaagcctgtgaccccaagattcagaaggacttgaaaatcaaagcccatgtcaatgtctccatggatacagggcccttttttgcaggcgatgctgacaagcttctgcacatccggatagaagattccccggaagcccagattcttcccttcttacgccacatgtgtcacttcattgaaattcaccatcaccttggctctgtcattctgatcttttccacccagggtatcagccgcagttgtgccgccatcatagcctacctcatgcatagtaacgagcagaccttgcagaggtcctgggcctatgtcaagaagtgcaaaaacaacatgtgtccaaatcggggattggtgagccagctgctggaatgggagaagactatccttggagattccatcacaaacatcatggatccgctctactgatcttctccgaggcccaccgaagggtactgaagagcctcacctgggggcattttgtgggtggagggccagagtgtgtatacccaggcttgtctggaaggagaaggcctttgctgcctgaaagtctca

SEQ ID NO: 366194 - DNA, 1057 bp, Homo sapiens
tcggaaaggaaagctgtgggaccatcctggcaaccccggtgtttggctgggttctagcgtagccgtctgtgtggccggtgggggacctgcggtcggagtgggagggccagtctgcacccaagaggtggaagaggacgggctttaggctggaagcgccttagaggagccatttttccaggatgcctggtttgcttttatgtgaaccgacagagctttacaacatcctgaatcaggccacaaaactctccagattaacagaccccaactatctctgtttattggatgtccgttccaaatgggagtatgacgaaagccatgtgatcactgcccttcgagtgaagaagatcttgtgcctcaagcagccattgagtatggcaggatcctgacccgcctcacccaccaccccgtctacatcctgaaagggggctatgagcgcttctcaggcacgtaccactttctccggacccagaagatcatctggatgcctcaggaactggatgcatttcagccataccccattgaaatcgtgccagggaaggtcttcgttggcaatttcagtcaagcctgtgaccccaagattcagaaggacttgaaaatcaaagcccatgtcaatgtctccatggatacagggcccttttttgcaggcgatgctgacaagcttctgcacatccggatagaagattccccggaagcccagattcttcccttcttacgccacatgtgtcacttcattggtatcagccgcagttgtgccgccatcatagcctacctcatgcatagtaacgagcagaccttgcagaggtcctgggcctatgtcaagaagtgcaaaaacaacatgtgtccaaatcggggattggtgagccagctgctggaatgggagaagactatccttggagattccatcacaaacatcatggatccgctctactgatcttctccgaggcccaccgaagggtactgaagagcctcacctgggggcattttgtgggtggagggccagagtgtgtatacccaggcttgtctggaaggagaaggcctttgctgcctgaaagtctca

SEQ ID NO: 366195 - DNA, 221 bp, Homo sapiens
ctgatccaagtggaaagggcccaggaccaatcgtgaagttcactttctctctttgtattcatagaggtcctgggcctatgtcaagaagtgcaaaaacaacatgtgtccaaatcggggattggtgagccagctgctggaatgggagaagactatccttggagattccatcacaaacatcatggatccgctctactgatcttctccgaggcccaccgaagggt

SEQ ID NO: 366196 - DNA, 959 bp, Homo sapiens
tcggaaaggaaagctgtgggaccatcctggcaaccccggtgtttggctgggttctagcgtagccgtctgtgtggccggtgggggacctgcggtcggagtgggagggccagtctgcacccaagaggtggaagaggacgggctttaggctggaagcgccttagaggagccatttttccaggatgcctggtttgcttttatgtgaaccgacagagctttacaacatcctgaatcaggccacaaaactctccagattaacagaccccaactatctctgtttattggatgtccgttccaaatgggagtatgacgaaagccatgtgatcactgcccttcgagtgaagaaggaactggatgcatttcagccataccccattgaaatcgtgccagggaaggtcttcgttggcaatttcagtcaagcctgtgaccccaagattcagaaggacttgaaaatcaaagcccatgtcaatgtctccatggatacagggcccttttttgcaggcgatgctgacaagcttctgcacatccggatagaagattccccggaagcccagattcttcccttcttacgccacatgtgtcacttcattgaaattcaccatcaccttggctctgtcattctgatcttttccacccagggtatcagccgcagttgtgccgccatcatagcctacctcatgcatagtaacgagcagaccttgcagaggtcctgggcctatgtcaagaagtgcaaaaacaacatgtgtccaaatcggggattggtgagccagctgctggaatgggagaagactatccttggagattccatcacaaacatcatggatccgctctactgatcttctccgaggcccaccgaagggtactgaagagcctcacctgggggcattttgtgggtggagggccagagtgtgtatacccaggcttgtctggaaggagaaggcctttgctgcctgaaagtctca

SEQ ID NO: 366197 - DNA, 1134 bp, Homo sapiens
tcggaaaggaaagctgtgggaccatcctggcaaccccggtgtttggctgggttctagcgtagccgtctgtgtggccggtgggggacctgcggtcggagtgggagggccagtctgcacccaagaggtggaagaggacgggctttaggctggaagcgccttagaggagccatttttccaggatgcctggtttgcttttatgtgaaccgacagagctttacaacatcctgaatcaggccacaaaactctccagattaacagaccccaactatctctgtttattggatgtccgttccaaatgggagtatgacgaaagccatgtgatcactgcccttcgagtgaagaagaaaaataatgaatatcttctcccggagtctgtggacctggagtgtgtgaagtactgcgtggtgtatgataacaacagcagcaccctggagatactcttaaaagatgatgatgatgattcagactctgatggtgatggcaaagatcttgtgcctcaagcagccattgagtatggcaggatcctgacccgcctcacccaccaccccgtctacatcctgaaagggggctatgagcgcttctcaggcacgtaccactttctccggacccagaagatcatctggatgcctcaggaactggatgcatttcagccataccccattgaaatcgtgccagggaaggtcttcgttggcaatttcagtcaagcctgtgaccccaagattcagaaggacttgaaaatcaaagcccatgtcaatgtctccatggatacagggcccttttttgcaggcgatgctgacaagcttctgcacatccggatagaagattccccggaagcccagattcttcccttcttacgccacatgtgtcacttcattgaggtcctgggcctatgtcaagaagtgcaaaaacaacatgtgtccaaatcggggattggtgagccagctgctggaatgggagaagactatccttggagattccatcacaaacatcatggatccgctctactgatcttctccgaggcccaccgaagggtactgaagagcctcacctgggggcattttgtgggtggagggccagagtgtgtatacccaggcttgtctggaaggagaaggcctttgctgcctgaaagtctca

SEQ ID NO: 366198 - DNA, 988 bp, Homo sapiens
tcggaaaggaaagctgtgggaccatcctggcaaccccggtgtttggctgggttctagcgtagccgtctgtgtggccggtgggggacctgcggtcggagtgggagggccagtctgcacccaagaggtggaagaggacgggctttaggctggaagcgccttagaggagccatttttccaggatgcctggtttgcttttatgtgaaccgacagagctttacaacatcctgaatcaggccacaaaactctccagattaacagaccccaactatctctgtttattggatgtccgttccaaatgggagtatgacgaaagccatgtgatcactgcccttcgagtgaagaagaaaaataatgaatatcttctcccggagtctgtggacctggagtgtgtgaagtactgcgtggtgtatgataacaacagcagcaccctggagatactcttaaaagatgatgatgatgattcagactctgatggtgatggcaaaggaactggatgcatttcagccataccccattgaaatcgtgccagggaaggtcttcgttggcaatttcagtcaagcctgtgaccccaagattcagaaggacttgaaaatcaaagcccatgtcaatgtctccatggatacagggcccttttttgcaggcgatgctgacaagcttctgcacatccggatagaagattccccggaagcccagattcttcccttcttacgccacatgtgtcacttcattgaggtcctgggcctatgtcaagaagtgcaaaaacaacatgtgtccaaatcggggattggtgagccagctgctggaatgggagaagactatccttggagattccatcacaaacatcatggatccgctctactgatcttctccgaggcccaccgaagggtactgaagagcctcacctgggggcattttgtgggtggagggccagagtgtgtatacccaggcttgtctggaaggagaaggcctttgctgcctgaaagtctca

SEQ ID NO: 366199 - DNA, 1199 bp, Homo sapiens
tcggaaaggaaagctgtgggaccatcctggcaaccccggtgtttggctgggttctagcgtagccgtctgtgtggccggtgggggacctgcggtcggagtgggagggccagtctgcacccaagaggtggaagaggacgggctttaggctggaagcgccttagaggagccatttttccaggatgcctggtttgcttttatgtgaaccgacagagctttacaacatcctgaatcaggccacaaaactctccagattaacagaccccaactatctctgtttattggatgtccgttccaaatgggagtatgacgaaagccatgtgatcactgcccttcgagtgaagaagaaaaataatgaatatcttctcccggagtctgtggacctggagtgtgtgaagtactgcgtggtgtatgataacaacagcagcaccctggagatactcttaaaagatgatgatgatgattcagactctgatggtgatggcaaagatcttgtgcctcaagcagccattgagtatggcaggatcctgacccgcctcacccaccaccccgtctacatcctgaaagggggctatgagcgcttctcaggcacgtaccactttctccggacccagaagatcatctggatgcctcaggaactggatgcatttcagccataccccattgaaatcgtgccagggaaggtcttcgttggcaatttcagtcaagcctgtgaccccaagattcagaaggacttgaaaatcaaagcccatgtcaatgtctccatggatacagggcccttttttgcaggcgatgctgacaagcttctgcacatccggatagaagattccccggaagcccagattcttcccttcttacgccacatgtgtcacttcattggtatcagccgcagttgtgccgccatcatagcctacctcatgcatagtaacgagcagaccttgcagaggtcctgggcctatgtcaagaagtgcaaaaacaacatgtgtccaaatcggggattggtgagccagctgctggaatgggagaagactatccttggagattccatcacaaacatcatggatccgctctactgatcttctccgaggcccaccgaagggtactgaagagcctcacctgggggcattttgtgggtggagggccagagtgtgtatacccaggcttgtctggaaggagaaggcctttgctgcctgaaagtctca

SEQ ID NO: 366200 - DNA, 1255 bp, Homo sapiens
tcggaaaggaaagctgtgggaccatcctggcaaccccggtgtttggctgggttctagcgtagccgtctgtgtggccggtgggggacctgcggtcggagtgggagggccagtctgcacccaagaggtggaagaggacgggctttaggctggaagcgccttagaggagccatttttccaggtggggccccaggcagaggctccgacagggagcctggccatagtcgcgcagccggggaggtggagcgcgtcccagacccgagcccccgacctcagccaaacccattccttctgtccttggaggccagaggggactctgagcatcggaaaggatgcctggtttgcttttatgtgaaccgacagagctttacaacatcctgaatcaggccacaaaactctccagattaacagaccccaactatctctgtttattggatgtccgttccaaatgggagtatgacgaaagccatgtgatcactgcccttcgagtgaagaagatcttgtgcctcaagcagccattgagtatggcaggatcctgacccgcctcacccaccaccccgtctacatcctgaaagggggctatgagcgcttctcaggcacgtaccactttctccggacccagaagatcatctggatgcctcaggaactggatgcatttcagccataccccattgaaatcgtgccagggaaggtcttcgttggcaatttcagtcaagcctgtgaccccaagattcagaaggacttgaaaatcaaagcccatgtcaatgtctccatggatacagggcccttttttgcaggcgatgctgacaagcttctgcacatccggatagaagattccccggaagcccagattcttcccttcttacgccacatgtgtcacttcattgaaattcaccatcaccttggctctgtcattctgatcttttccacccagggtatcagccgcagttgtgccgccatcatagcctacctcatgcatagtaacgagcagaccttgcagaggtcctgggcctatgtcaagaagtgcaaaaacaacatgtgtccaaatcggggattggtgagccagctgctggaatgggagaagactatccttggagattccatcacaaacatcatggatccgctctactgatcttctccgaggcccaccgaagggtactgaagagcctcacctgggggcattttgtgggtggagggccagagtgtgtatacccaggcttgtctggaaggagaaggcctttgctgcctgaaagtctca

SEQ ID NO: 366201 - DNA, 789 bp, Homo sapiens
ggctggagtgcagtggcatagtcatagctcactgcagcctcgatttcctgggatcaaaccatcctcccacctcagcctccggagtggctggaactgcaagcatgaggccccacgcctgttcgctcccaggaccccgggcagcggcgggtgctggaccgggctgcccggcagcgtcgcatcaaccggcagctggaggccctggagaatgacaacttccaggatgacccccacgcgggactccctcagctcggcaagagactgcctcagtttgatgacgatgcggacactggaaagaaaaagaagaaaacccgaggtgatcattttaaacttcgcttccgaaaaaactttcaggccctgttggaggagcagaacttgagtgtggccgagggccctaactacctgacggcctgtgcgggacccccatcgcggccccagcgccccttctgtgctgtctgtggcttcccatccccctacacctgtgtcagctgcggtgcccggtactgcactgtgcgctgtctggggacccaccaggagaccaggtgtctgaagtggactgtgtgagcctgggcattcccagagaggaagggccgctgtgcactgcccggccttcagaaagacagaatttcatcacccaatgcagggggagctcttcctggaccaagggaggagccgctcattcacccaacaaaactgtgtcttatctgccaggaaagaccagcctcactcctgggaactgtctggcaggtaggctgggccccccagtgctgttagaataaaaagcctcgtgcc

SEQ ID NO: 366202 - DNA, 1173 bp, Homo sapiens
  misc_feature (458)..(459): n is a, c, g, or t
  misc_feature (464)..(464): n is a, c, g, or t
  misc_feature (466)..(466): n is a, c, g, or t
gctgcatctgaccagcctgactcagctgccaccactgagaaagccaagaagataaagaacctaaagaagaaactccggcaggtggaagagctgcagcagcggatccaggctggggaagtcagccagcccagcaaagagcagctagaaaagctagcaaggaggagggcgctagaagaggagttagaggacttggagttaggcctctgaggccttggggaatagggaatggactgcagaacaaaccgtggggctctctggggtctgggggaatacgggcaacagcagtcaggaggggtaccccccatactggcttccacctcctgcggcccagctctgtcctccagagcctagcgtctccctcaatccttcccttttcttcccaacttctacttttggactttcccccacccacctgattttcttttaaacaagacacccaaatcagcagcaaaggaccnngggtngnccacgcgtcggccaatggtggagaagaaaacttcggttcgctcccaggaccccgggcagcggcgggtgctggaccgggctgcccggcagcgtcgcatcaaccggcagctggaggccctggagaatgacaacttccaggatgacccccacgcgggactccctcagctcggcaagagactgcctcagtttgatgacgatgcggacactggaaagaaaaagaagaaaacccgaggtgatcattttaaacttcgcttccgaaaaaactttcaggccctgttggaggagcagaacttgagtgtggccgagggccctaactacctgacggcctgtgcgggacccccatcgcggccccagcgccccttctgtgctgtctgtggcttcccatccccctacacctgtgtcagctgcggtgcccggtactgcactgtgcgctgtctggggacccaccaggagaccaggtgtctgaagtggactgtgtgagcctgggcattcccagagaggaagggccgctgtgcactgcccggccttcagaaagacagaatttcatcacccaatgcagggggagctcttcctggaccaagggaggagccgctcattcacccaacaaaactgtgtcttatctgccaggaaagaccagcctcactcctgggaactgtctggcaggtaggctgggccccccagtgctgttagaataaaaagcctcgtgcc

SEQ ID NO: 366203 - DNA, 1481 bp, Homo sapiens
tggcggcgacagggagggaggaagcctaggagtccgccgcgggacggaggcctgggggaactgggagttcagctttctgcagagggccactaggaacctcggattgcccacggaagccagccactttctttgacagtccagcccacctcctcttctgcccggagaagctccaggggctgcctttgtgatcacagcatcttcacaaggaccaaaggaaaataagatttcttgtaagaacaccgtgaccacatctttaaaatgacccatttcgtggctcccacaagatttacacctccacactgaggccggaagtggttttgcccctataaaacatggcgaaaagctttcttgtctccaaggaaacgccacgtaatgagtcaaagctgtggcgcacgcgcagaagtacaagctaccggaagtgatggcgcccctactaaagccttggggttagtacgcgtgcgcagcagtttcttccgacagttgtgttgtgccaatggtggagaagaaaacttcggttcgctcccaggaccccgggcagcggcgggtgctggaccgggctgcccggcagcgtcgcatcaaccggcagctggaggccctggagaatgacaacttccaggatgacccccacgcgggactccctcagctcggcaagagactgcctcagtttgatgacgatgcggacactggaaagaaaaagaagaaaacccgaggtgatcattttaaacttcgcttccgaaaaaactttcaggccctgttggaggagcagaacttgagtgtggccgagggccctaactacctgacggcctgtgcgggacccccatcgcggccccagcgccccttctgtgctgtctgtggcttcccatccccctacacctgtgtcagctgcggtgcccggtactgcactgtgcgctgtctggggacccaccaggagaccaggtgtctgaagtggactgtgtgagcctgggcattcccagagaggaagggccgctgtgcactgcccggccttcagaaagacagaatttcatcacccaatgcagggggagctcttcctggaccaagggaggagccgctcattcacccaacaaaactgtgtcttatctgccaggaaagaccagcctcactcctgggaactgtctggcaggtaggctgggccccccagtgctgttagaataaaaagcctcgtgccggaaaaaaaaaaaaaaaaaaaaaaaaaaccggggaatccgtgcggggaaagaagggtagcgccctgagggaggagcacaccgggcggttgtaaaaccattagaaacggcccattagggggggcaagagcccaatatctcgacattttgtaacaggaggagggggccccggaagagggagcgatactcaggaccctaaggtttgaaggcatattggcctcggtggagttcaaattgacagatccaacgaaggagagaagccgtgggcggggagtgccaagagagcgccaatgtggc

SEQ ID NO: 366204 - DNA, 1744 bp, Homo sapiens
tggcggcgacagggagggaggaagcctaggagtccgccgcgggacggaggcctgggggaactgggagttcagctttctgcagagggccactaggaacctcggattgcccacggaagccagccactttctttgacagtccagcccacctcctcttctgcccggagaagctccaggggctgcctttgtgatcacagcatcttcacaaggaccaaaggaaaataagatttcttgtaagaacaccgtgaccacatctttaaaatgacccatttcgtggctcccacaagatttacacctccacactgaggccggaagtggttttgcccctataaaacatggcgaaaagctttcttgtctccaaggaaacgccacgtaatgagtcaaagctgtggcgcacgcgcagaagtacaagctaccggaagtgatggcgcccctactaaagccttggggttagtacgcgtgcgcagcagtttcttccgacagttgtgttgtgccaatggtggagaagaaaacttcggttcgctcccaggaccccgggcagcggcgggtgctggaccgggctgcccggcagcgtcgcatcaaccggcagctggaggccctggagaatgacaacttccaggatgacccccacgcgggactccctcagctcggcaagagactgcctcagtttgatgacgatgcggacactggaaagaaaaagaagaaaacccgaggtgatcattttaaacttcgcttccgaaaaaactttcaggccctgttggaggagcagaacttgagtgtggccgagggccctaactacctgacggcctgtgcgggacccccatcgcggccccagcgccccttctgtgctgtctgtggcttcccatccccctacacctgtgtcagctgcggtgcccggtactgcactgtgcgctgtctggggacccaccaggagaccaggtgtctgaagtggactgtgtgagcctgggcattcccagagaggaagggccgctgtgcactgcccggccttcagaaagacagaatttcatcacccaatgcagggggagctcttcctggaccaagggaggagccgctcattcacccaacaaaactgtgtcttatctgccaggaaagaccagcctcactcctgggaactgtctggcaggtaggctgggccccccagtgctgttagaataaaaagcctcgtgccggaaaaaaaaaaaaaaaaaaaaaaaaaaaaaaaaaaaaaaaaaaaaaaaaaaaaaaaaaaaaaaaaaaaaaagagaggggagggagaggaaaaagagaagaaacaaaagagagggggcacaagagaagaaggggaaaaagatagaaacaaaacggggggaaaacacaagagggagacgacaaaaaagaagcggagaaaggaggcaggacaaaaaaaacaggagagaggaagaggggaacagaagggaggcgacggggagaaaagggaggacaagagagcaccacaaaagagcgcgggggggcgggaaaaaccgggggaggaaaagaagagaggaggagaagaaaaaacagggccgcacgagggaagcagaaaacaaaagaccaagaaagagggaggcagccaaacgggtgcaatacaaacacacacgagagacgataataggtatattgagaggagaatggagaggagacgagagagagtattgcgagaggcagaagaaagataaagaagagaaaaaattgatatatgtcggagagggaggacacgcgaaaaaataga

SEQ ID NO: 366205 - DNA, 3190 bp, Homo sapiens
caaagtgctgagataacaggcatgagccactgcgcctggcaaggtcatgctttttgatgctgggtagttctttgactcctgacctggccacttgttagctatgtgaactttggacacatttcttaatctctgaatgttggtaaattggggatgatgatactgtcccatacagctgttgtaagggttaaatggttcaagtgttgcaaagagctgagcacgtgcctggctcatagtaagtgtccaacaagtgatagctactggggctgctgctgttattattatgcttaacaggtggttaatgaataaagagatatattatgcaaaattatcagaatctggcaaacagctgataaggcaatgaggaaagaggttttttgttttttgtttttgagacagggtctctctctgttgcccaggctggaatgcaatggcgcgatctcagctcgctgcaacctccacctcccgggttcaagcgattcttgtgcctcagcctcccgcgtagctgggattacaggcatgtgccaccacaccctgctaatttttgtatttttagtagagacatggtttcaccacgttggtcaggctggtctcgaactcctgacctgaagtgatgagcccacctcagcctcccaaagtgctgggattgcaggggtgagccactatgtccagccgaggaaagaggtttaaaataacttctaggtttctggtttggatgtctgcatagacggttccatttgcgtagagagaatctgcaggagaagcagacttggatgggaatttttttttttttggagttgcagtgtccacagggccagtgggtgatttcttttttccttctttctttttttttttttttggagacagtcttgctttgtcactcaggctggagtggtggcgcgatcacggcttgctgcacactgcagcctcaacctcccgggcccatgtagtcctcccaccgcagcctcccaagtaactgggactacaggcatgtgcaaccacgcctggcttattttttaattttttgtagagatggggtttggctatgctgcccaggctggtttctaactcctggcatcaagcgatcctttggcctcccaaagtgctgagattacaggcgtgcgccaccacacccggcctcaccaggcgctggctgcatggccagtttctggagcccgggagcaggttctgtgttgagggagtcactctgggagtcatttgcttgtgggtgatcatcagagccctttgtttggagtcaaaatcccaggaagagtgcatagactgagcagagaagagggccagccacctccatagaggcagggagagcagccgagctggagccggaggattcctggacatggagaaggcctgcagttttgtcaaggaagcaagcaaagggtctctttctactcgatgaaggtagtcggcaccgccacagggtggacagggctcaggtccaaggaggaggaggaaggcacactggagccgctctggggcccagagcgtgggtgggtggtcccccaggatgaccaggcaggtgtcagattttggggttcaaggagaggatgggaggtgaaaaagtgacacatcacgtgagttgctgtgaaggagaaggagctgtgaagccgagtagacacatgagcgtcgccagctctttgatggaaagtgccggttgaggaggaggggttgaagatgggagagggagggaatgggctggaggtgaaggctcggggtcagtggtgggacttggggcgctccagggcaggggtgtgcccacttggcatcacgtttgtgggtaggtggcctggaagatgagcgtatccaagcatgggtggcccctggttcctttgaggtaggaggtgagatgctgagtgtgagggccatgtgtattgagggcccaggacagcctggaagccccagggcgctgtgacctccccagtcagcagtgagctgtctccaggccggggctcactggctgggactgggattgagaggaaggcggagaaaacaggcaggagaaactgaaagggtctcagctggcgggacaggaagtgtgggcccaggggcttggcccgggaggagacaaggggaccaagggcttggcaatggggatgagatcagagagctgcagcttccaccccgggtgccttcctcgccctgcccagagcggcggccacactgctctttcttggaagccctgtaactttgcgtgccctgctccatccagttcgctcccaggaccccgggcagcggcgggtgctggaccgggctgcccggcagcgtcgcatcaaccggcagctggaggccctggagaatgacaacttccaggatgacccccacgcgggactccctcagctcggcaagagactgcctcagtttgatgacgatgcggacactggaaagaaaaagaagaaaacccgaggtgatcattttaaacttcgcttccgaaaaaactttcaggccctgttggaggagcagaacttgagtgtggccgagggccctaactacctgacggcctgtgcgggacccccatcgcggccccagcgccccttctgtgctgtctgtggcttcccatccccctacacctgtgtcagctgcggtgcccggtactgcactgtgcgctgtctggggacccaccaggagaccaggtgtctgaagtggactgtgtgagcctgggcattcccagagaggaagggccgctgtgcactgcccggccttcagaaagacagaatttcatcacccaatgcagggggagctcttcctggaccaagggaggagccgctcattcacccaacaaaactgtgtcttatctgccaggaaagaccagcctcactcctgggaactgtctggcaggtaggctgggccccccagtgctgttagaataaaaagcctcgtgccggaaaaaaaaaaaaaaaaaaaaaaaaaaccggggaatccgtgcggggaaagaagggtagcgccctgagggaggagcacaccgggcggttgtaaaaccattagaaacggcccattagggggggcaagagcccaatatctcgacattttgtaacaggaggagggggccccggaagagggagcgatactcaggaccctaaggtttgaaggcatattggcctcggtggagttcaaattgacagatccaacgaaggagagaagccgtgggcggggagtgccaagagagcgccaatgtggc

SEQ ID NO: 366206 - DNA, 3309 bp, Homo sapiens
tggcggcgacagggagggaggaagcctaggagtccgccgcgggacggaggcctgggggaactgggagttcagctttctgcagagggccactaggaacctcggattgcccacggaagccagccactttctttgacagtccagcccacctcctcttctgcccggagaagctccaggggctgcctttgtgatcacagcatcttcacaaggaccaaaggaaaataagatttcttgtaagaacaccgtgaccacatctttaaaatgacccatttcgtggctcccacaagatttacacctccacactgaggccggaagtggttttgcccctataaaacatggcgaaaagctttcttgtctccaaggaaacgccacgtaatgagtcaaagctgtggcgcacgcgcagaagtacaagctaccggaagtgatggcgcccctactaaagccttggggttagtacgcgtgcgcagcagtttcttccgacagttgtgttgtgccaatggtggagaagaaaacttcggggtctctctctgttgcccaggctggaatgcaatggcgcgatctcagctcgctgcaacctccacctcccgggttcaagcgattcttgtgcctcagcctcccgcgtagctgggattacaggcatgtgccaccacaccctgctaatttttgtatttttagtagagacatggtttcaccacgttggtcaggctggtctcgaactcctgacctgaagtgatgagcccacctcagcctcccaaagtgctgggattgcaggggtgagccactatgtccagccgaggaaagaggtttaaaataacttctaggtttctggtttggatgtctgcatagacggttccatttgcgtagagagaatctgcaggagaagcagacttggatgggaatttttttttttttggagttgcagtgtccacagggccagtgggtgatttcttttttccttctttctttttttttttttttggagacagtcttgctttgtcactcaggctggagtggtggcgcgatcacggcttgctgcacactgcagcctcaacctcccgggcccatgtagtcctcccaccgcagcctcccaagtaactgggactacaggcatgtgcaaccacgcctggcttattttttaattttttgtagagatggggtttggctatgctgcccaggctggtttctaactcctggcatcaagcgatcctttggcctcccaaagtgctgagattacaggcgtgcgccaccacacccggcctcaccaggcgctggctgcatggccagtttctggagcccgggagcaggttctgtgttgagggagtcactctgggagtcatttgcttgtgggtgatcatcagagccctttgtttggagtcaaaatcccaggaagagtgcatagactgagcagagaagagggccagccacctccatagaggcagggagagcagccgagctggagccggaggattcctggacatggagaaggcctgcagttttgtcaaggaagcaagcaaagggtctctttctactcgatgaaggtagtcggcaccgccacagggtggacagggctcaggtccaaggaggaggaggaaggcacactggagccgctctggggcccagagcgtgggtgggtggtcccccaggatgaccaggcaggtgtcagattttggggttcaaggagaggatgggaggtgaaaaagtgacacatcacgtgagttgctgtgaaggagaaggagctgtgaagccgagtagacacatgagcgtcgccagctctttgatggaaagtgccggttgaggaggaggggttgaagatgggagagggagggaatgggctggaggtgaaggctcggggtcagtggtgggacttggggcgctccagggcaggggtgtgcccacttggcatcacgtttgtgggtaggtggcctggaagatgagcgtatccaagcatgggtggcccctggttcctttgaggtaggaggtgagatgctgagtgtgagggccatgtgtattgagggcccaggacagcctggaagccccagggcgctgtgacctccccagtcagcagtgagctgtctccaggccggggctcactggctgggactgggattgagaggaaggcggagaaaacaggcaggagaaactgaaagggtctcagctggcgggacaggaagtgtgggcccaggggcttggcccgggaggagacaaggggaccaagggcttggcaatggggatgagatcagagagctgcagcttccaccccgggtgccttcctcgccctgcccagagcggcggccacactgctctttcttggaagccctgtaactttgcgtgccctgctccatccagttcgctcccaggaccccgggcagcggcgggtgctggaccgggctgcccggcagcgtcgcatcaaccggcagctggaggccctggagaatgacaacttccaggatgacccccacgcgggactccctcagctcggcaagagactgcctcagtttgatgacgatgcggacactggaaagaaaaagaagaaaacccgaggtgatcattttaaacttcgcttccgaaaaaactttcaggccctgttggaggagcagaacttgagtgtggccgagggccctaactacctgacggcctgtgcgggacccccatcgcggccccagcgccccttctgtgctgtctgtggcttcccatccccctacacctgtgtcagctgcggtgcccggtactgcactgtgcgctgtctggggacccaccaggagaccaggtgtctgaagtggactgtgtgagcctgggcattcccagagaggaagggccgctgtgcactgcccggccttcagaaagacagaatttcatcacccaatgcagggggagctcttcctggaccaagggaggagccgctcattcacccaacaaaactgtgtcttatctgccaggaaagaccagcctcactcctgggaactgtctggcaggtaggctgggccccccagtgctgttagaataaaaagcctcgtgccggaaaaaaaaaaaaaaaaaaaaaaaaaaccggggaatccgtgcggggaaagaagggtagcgccctgagggaggagcacaccgggcggttgtaaaaccattagaaacggcccattagggggggcaagagcccaatatctcgacattttgtaacaggaggagggggccccggaagagggagcgatactcaggaccctaaggtttgaaggcatattggcctcggtggagttcaaattgacagatccaacgaaggagagaagccgtgggcggggagtgccaagagagcgccaatgtggc

SEQ ID NO: 366207 - DNA, 2501 bp, Homo sapiens
tggcggcgacagggagggaggaagcctaggagtccgccgcgggacggaggcctgggggaactgggagttcagctttctgcagagggccactaggaacctcggattgcccacggaagccagccactttctttgacagtccagcccacctcctcttctgcccggagaagctccaggggctgcctttgtgatcacagcatcttcacaaggaccaaaggaaaataagatttcttgtaagaacaccgtgaccacatctttaaaatgacccatttcgtggctcccacaagatttacacctccacactgaggccggaagtggttttgcccctataaaacatggcgaaaagctttcttgtctccaaggaaacgccacgtaatgagtcaaagctgtggcgcacgcgcagaagtacaagctaccggaagtgatggcgcccctactaaagccttggggttagtacgcgtgcgcagcagtttcttccgacagttgtgttgtgccaatggtggagaagaaaacttcggggtctctctctgttgcccaggctggaatgcaatggcgcgatctcagctcgctgcaacctccacctcccgggttcaagcgattcttgtgcctcagcctcccgcgtagctgggattacaggcatgtgccaccacaccctgctaatttttgtatttttagtagagacatggtttcaccacgttggtcaggctggtctcgaactcctgacctgaagtgatgagcccacctcagcctcccaaagtgctgggattgcaggggtgagccactatgtccagccgaggaaagaggtttaaaataacttctaggtttctggtttggatgtctgcatagacggttccatttgcgtagagagaatctgcaggagaagcagacttggatgggaatttttttttttttggagttgcagtgtccacagggccagtgggtgatttcttttttccttctttctttttttttttttttggagacagtcttgctttgtcactcaggctggagtggtggcgcgatcacggcttgctgcacactgcagcctcaacctcccgggcccatgtagtcctcccaccgcagcctcccaagtaactgggactacaggcatgtgcaaccacgcctggcttattttttaattttttgtagagatggggtttggctatgctgcccaggctggtttctaactcctggcatcaagcgatcctttggcctcccaaagtgctgagattacaggcgtgcgccaccacacccggcctcaccaggcgctggctgcatggccagtttctggagcccgggagcaggttctgtgttgagggagtcactctgggagtcatttgcttgtgggtgatcatcagagccctttgtttggagtcaaaatcccaggaagagtgcatagactgagcagagaagagggccagccacctccatagaggcagggagagcagccgagctggagccggaggattcctggacatggagaaggcctgcagttttgtcaaggaagcaagcaaagggtctctttctactcgatgaagttcgctcccaggaccccgggcagcggcgggtgctggaccgggctgcccggcagcgtcgcatcaaccggcagctggaggccctggagaatgacaacttccaggatgacccccacgcgggactccctcagctcggcaagagactgcctcagtttgatgacgatgcggacactggaaagaaaaagaagaaaacccgaggtgatcattttaaacttcgcttccgaaaaaactttcaggccctgttggaggagcagaacttgagtgtggccgagggccctaactacctgacggcctgtgcgggacccccatcgcggccccagcgccccttctgtgctgtctgtggcttcccatccccctacacctgtgtcagctgcggtgcccggtactgcactgtgcgctgtctggggacccaccaggagaccaggtgtctgaagtggactgtgtgagcctgggcattcccagagaggaagggccgctgtgcactgcccggccttcagaaagacagaatttcatcacccaatgcagggggagctcttcctggaccaagggaggagccgctcattcacccaacaaaactgtgtcttatctgccaggaaagaccagcctcactcctgggaactgtctggcaggtaggctgggccccccagtgctgttagaataaaaagcctcgtgccggaaaaaaaaaaaaaaaaaaaaaaaaaaccggggaatccgtgcggggaaagaagggtagcgccctgagggaggagcacaccgggcggttgtaaaaccattagaaacggcccattagggggggcaagagcccaatatctcgacattttgtaacaggaggagggggccccggaagagggagcgatactcaggaccctaaggtttgaaggcatattggcctcggtggagttcaaattgacagatccaacgaaggagagaagccgtgggcggggagtgccaagagagcgccaatgtggc

SEQ ID NO: 366208 - DNA, 1134 bp, Homo sapiens
ggctggagtgcagtggcatagtcatagctcactgcagcctcgatttcctgggatcaaaccatcctcccacctcagcctccggagtggctggaactgcaagcatgaggccccacgcctggttaatttttaatttgttatgtggtgacgggctctcgctatgttgcccagttcgctcccaggaccccgggcagcggcgggtgctggaccgggctgcccggcagcgtcgcatcaaccggcagctggaggccctggagaatgacaacttccaggatgacccccacgcgggactccctcagctcggcaagagactgcctcagtttgatgacgatgcggacactggaaagaaaaagaagaaaacccgaggtgatcattttaaacttcgcttccgaaaaaactttcaggccctgttggaggagcagaacttgagtgtggccgagggccctaactacctgacggcctgtgcgggacccccatcgcggccccagcgccccttctgtgctgtctgtggcttcccatccccctacacctgtgtcagctgcggtgcccggtactgcactgtgcgctgtctggggacccaccaggagaccaggtgtctgaagtggactgtgtgagcctgggcattcccagagaggaagggccgctgtgcactgcccggccttcagaaagacagaatttcatcacccaatgcagggggagctcttcctggaccaagggaggagccgctcattcacccaacaaaactgtgtcttatctgccaggaaagaccagcctcactcctgggaactgtctggcaggtaggctgggccccccagtgctgttagaataaaaagcctcgtgccggaaaaaaaaaaaaaaaaaaaaaaaaaaccggggaatccgtgcggggaaagaagggtagcgccctgagggaggagcacaccgggcggttgtaaaaccattagaaacggcccattagggggggcaagagcccaatatctcgacattttgtaacaggaggagggggccccggaagagggagcgatactcaggaccctaaggtttgaaggcatattggcctcggtggagttcaaattgacagatccaacgaaggagagaagccgtgggcggggagtgccaagagagcgccaatgtggc

SEQ ID NO: 366209 - DNA, 1084 bp, Homo sapiens
ggctggagtgcagtggcatagtcatagctcactgcagcctcgatttcctgggatcaaaccatcctcccacctcagcctccggagtggctggaactgcaagcatgaggccccacgcctgttcgctcccaggaccccgggcagcggcgggtgctggaccgggctgcccggcagcgtcgcatcaaccggcagctggaggccctggagaatgacaacttccaggatgacccccacgcgggactccctcagctcggcaagagactgcctcagtttgatgacgatgcggacactggaaagaaaaagaagaaaacccgaggtgatcattttaaacttcgcttccgaaaaaactttcaggccctgttggaggagcagaacttgagtgtggccgagggccctaactacctgacggcctgtgcgggacccccatcgcggccccagcgccccttctgtgctgtctgtggcttcccatccccctacacctgtgtcagctgcggtgcccggtactgcactgtgcgctgtctggggacccaccaggagaccaggtgtctgaagtggactgtgtgagcctgggcattcccagagaggaagggccgctgtgcactgcccggccttcagaaagacagaatttcatcacccaatgcagggggagctcttcctggaccaagggaggagccgctcattcacccaacaaaactgtgtcttatctgccaggaaagaccagcctcactcctgggaactgtctggcaggtaggctgggccccccagtgctgttagaataaaaagcctcgtgccggaaaaaaaaaaaaaaaaaaaaaaaaaaccggggaatccgtgcggggaaagaagggtagcgccctgagggaggagcacaccgggcggttgtaaaaccattagaaacggcccattagggggggcaagagcccaatatctcgacattttgtaacaggaggagggggccccggaagagggagcgatactcaggaccctaaggtttgaaggcatattggcctcggtggagttcaaattgacagatccaacgaaggagagaagccgtgggcggggagtgccaagagagcgccaatgtggc

SEQ ID NO: 366210 - DNA, 1294 bp, Homo sapiens
  misc_feature (1198)..(1198): n is a, c, g, or t
tggcggcgacagggagggaggaagcctaggagtccgccgcgggacggaggcctgggggaactgggagttcagctttctgcagagggccactaggaacctcggattgcccacggaagccagccactttctttgacagtccagcccacctcctcttctgcccggagaagctccaggggctgcctttgtgatcacagcatcttcacaaggaccaaaggaaaataagatttcttgtaagaacaccgtgaccacatctttaaaatgacccatttcgtggctcccacaagatttacacctccacactgaggccggaagtggttttgcccctataaaacatggcgaaaagctttcttgtctccaaggaaacgccacgtaatgagtcaaagctgtggcgcacgcgcagaagtacaagctaccggaagtgatggcgcccctactaaagccttggggttagtacgcgtgcgcagcagtttcttccgacagttgtgttgtgccaatggtggagaagaaaacttcggttcgctcccaggaccccgggcagcggcgggtgctggaccgggctgcccggcagcgtcgcatcaaccggcagctggaggccctggagaatgacaacttccaggatgacccccacgcgggactccctcagctcggcaagagactgcctcagtttgatgacgatgcggacactggaaagaaaaagaagaaaacccgaggtgatcattttaaacttcgcttccgaaaaaactttcaggccctgttggaggagcagaacttgagtgtggccgagggccctaactacctgacggcctgtgcgggacccccatcgcggccccagcgccccttctgtgctgtctgtggcttcccatccccctacacctgtgtcagctgcggtgcccggtactgcactgtgcgctgtctggggacccaccaggagaccaggtgtctgaagtggactgtgtgagcctgggcattcccagagaggaagggccgctgtgcactgcccggccttcagaaagacagaatttcatcacccaatgcagggggagctcttcctggaccaagggaggagccgctcattcacccaacaaaactgtgtcttatctgccaggaaagaccagcctcactcctgggaactgtctggcaggtaggctgggccccccagtgctgttagaataaaaagcctcgtgcccggacaacaaanccaacacaaaccctgcagggcctcaacgtccgggacgcggcaaacagacggcacccgcacccggcccactggccacataccggtcccgggccccag

SEQ ID NO: 366211 - DNA, 1483 bp, Homo sapiens
tggcggcgacagggagggaggaagcctaggagtccgccgcgggacggaggcctgggggaactgggagttcagctttctgcagagggccactaggaacctcggattgcccacggaagccagccactttctttgacagtccagcccacctcctcttctgcccggagaagctccaggggctgcctttgtgatcacagcatcttcacaaggaccaaaggaaaataagatttcttgtaagaacaccgtgaccacatctttaaaatgacccatttcgtggctcccacaagatttacacctccacactgaggccggaagtggttttgcccctataaaacatggcgaaaagctttcttgtctccaaggaaacgccacgtaatgagtcaaagctgtggcgcacgcgcagaagtacaagctaccggaagtgatggcgcccctactaaagccttggggttagtacgcgtgcgcagcagtttcttccgacagttgtgttgtgccaatggtggagaagaaaacttcggttcgctcccaggaccccgggcagcggcgggtgctggaccgggctgcccggcagcgtcgcatcaaccggcagctggaggccctggagaatgacaacttccaggatgacccccacgcgggactccctcagctcggcaagagactgcctcagtttgatgacgatgcggacactggaaagaaaaagaagaaaacccgaggtgatcattttaaacttcgcttccgaaaaaactttcaggccctgttggaggagcagaacttgagtgtggccgagggccctaactacctgacggcctgtgcgggacccccatcgcggccccagcgccccttctgtgctgtctgtggcttcccatccccctacacctgtgtcagctgcggtgcccggtactgcactgtgcgctgtctggggacccaccaggagaccaggtgtctgaagtggactgtgtgagcctgggcattcccagagaggaagggccgctgtgcactgcccggccttcagaaagacagaatttcatcacccaatgcagggggagctcttcctggaccaagggaggagccgctcattcacccaacaaaactgtgtcttatctgccagggcaaaggacccaggaccttcacttcctggggacactggttctgtgcaagggtaagggcactgggggccccccccccaggttggcctggattaagcaacattatacacacaagcgcgccctatccgagttgtggcccccgggggaacatagcccagacaccagaccgtactaatcatccaagcgtcactacacattccccctaccgcccctacccccacacccccacccccacactaaatccaatcaaaaccactagacatcccccccactccttcatcacaacactactcaaccaactacctcttatctactctctttatttcactgtatggccgctcaacgccacccctctacccaccaccacctacaatccatct

SEQ ID NO: 366212 - DNA, 1236 bp, Homo sapiens
ccccagcgcttgtggggcgcttgttggaaaataatcaatatcgttataaaaacttcacagaccaccaagagaaggcagctgttaacatctcataggatagaactttattaagactgaaatgaaaatactattctctcttctctactctctttatgtctttgacataaaataagtcatccaaatccataaatcagtatgagatgcagtgtgtagagataagtaccaacaagcgcctccaggcgcttgttggaggagcagaacttgagtgtggccgagggccctaactacctgacggcctgtgcgggacccccatcgcggccccagcgccccttctgtgctgtctgtggcttcccatccccctacacctgtgtcagctgcggtgcccggtactgcactgtgcgctgtctggggacccaccaggagaccaggtgtctgaagtggactgtgtgagcctgggcattcccagagaggaagggccgctgtgcactgcccggccttcagaaagacagaatttcatcacccaatgcagggggagctcttcctggaccaagggaggagccgctcattcacccaacaaaactgtgtcttatctgccaggaaagaccagcctcactcctgggaactgtctggcaggtaggctgggccccccagtgctgttagaataaaaagcctcgtgccggaaaaaaaaaaaaaaaaaaaaaaaaaaaaaaaaaaaaaaaaaaaaaaaaaaaaaaaaaaaaaaaaaaaaaagagaggggagggagaggaaaaagagaagaaacaaaagagagggggcacaagagaagaaggggaaaaagatagaaacaaaacggggggaaaacacaagagggagacgacaaaaaagaagcggagaaaggaggcaggacaaaaaaaacaggagagaggaagaggggaacagaagggaggcgacggggagaaaagggaggacaagagagcaccacaaaagagcgcgggggggcgggaaaaaccgggggaggaaaagaagagaggaggagaagaaaaaacagggccgcacgagggaagcagaaaacaaaagaccaagaaagagggaggcagccaaacgggtgcaatacaaacacacacgagagacgataataggtatattgagaggagaatggagaggagacgagagagagtattgcgagaggcagaagaaagataaagaagagaaaaaattgatatatgtcggagagggaggacacgcgaaaaaataga

SEQ ID NO: 366213 - DNA, 3518 bp, Homo sapiens
tggcggcgacagggagggaggaagcctaggagtccgccgcgggacggaggcctgggggaactgggagttcagctttctgcagagggccactaggaacctcggattgcccacggaagccagccactttctttgacagtccagcccacctcctcttctgcccggagaagctccaggggctgcctttgtgatcacagcatcttcacaaggaccaaaggaaaataagatttcttgtaagaacaccgtgaccacatctttaaaatgacccatttcgtggctcccacaagatttacacctccacactgaggccggaagtggttttgcccctataaaacatggcgaaaagctttcttgtctccaaggaaacgccacgtaatgagtcaaagctgtggcgcacgcgcagaagtacaagctaccggaagtgatggcgcccctactaaagccttggggttagtacgcgtgcgcagcagtttcttccgacagttgtgttgtgccaatggtggagaagaaaacttcggggtctctctctgttgcccaggctggaatgcaatggcgcgatctcagctcgctgcaacctccacctcccgggttcaagcgattcttgtgcctcagcctcccgcgtagctgggattacaggcatgtgccaccacaccctgctaatttttgtatttttagtagagacatggtttcaccacgttggtcaggctggtctcgaactcctgacctgaagtgatgagcccacctcagcctcccaaagtgctgggattgcaggggtgagccactatgtccagccgaggaaagaggtttaaaataacttctaggtttctggtttggatgtctgcatagacggttccatttgcgtagagagaatctgcaggagaagcagacttggatgggaatttttttttttttggagttgcagtgtccacagggccagtgggtgatttcttttttccttctttctttttttttttttttggagacagtcttgctttgtcactcaggctggagtggtggcgcgatcacggcttgctgcacactgcagcctcaacctcccgggcccatgtagtcctcccaccgcagcctcccaagtaactgggactacaggcatgtgcaaccacgcctggcttattttttaattttttgtagagatggggtttggctatgctgcccaggctggtttctaactcctggcatcaagcgatcctttggcctcccaaagtgctgagattacaggcgtgcgccaccacacccggcctcaccaggcgctggctgcatggccagtttctggagcccgggagcaggttctgtgttgagggagtcactctgggagtcatttgcttgtgggtgatcatcagagccctttgtttggagtcaaaatcccaggaagagtgcatagactgagcagagaagagggccagccacctccatagaggcagggagagcagccgagctggagccggaggattcctggacatggagaaggcctgcagttttgtcaaggaagcaagcaaagggtctctttctactcgatgaaggtagtcggcaccgccacagggtggacagggctcaggtccaaggaggaggaggaaggcacactggagccgctctggggcccagagcgtgggtgggtggtcccccaggatgaccaggcaggtgtcagattttggggttcaaggagaggatgggaggtgaaaaagtgacacatcacgtgagttgctgtgaaggagaaggagctgtgaagccgagtagacacatgagcgtcgccagctctttgatggaaagtgccggttgaggaggaggggttgaagatgggagagggagggaatgggctggaggtgaaggctcggggtcagtggtgggacttggggcgctccagggcaggggtgtgcccacttggcatcacgtttgtgggtaggtggcctggaagatgagcgtatccaagcatgggtggcccctggttcctttgaggtaggaggtgagatgctgagtgtgagggccatgtgtattgagggcccaggacagcctggaagccccagggcgctgtgacctccccagtcagcagtgagctgtctccaggccggggctcactggctgggactgggattgagaggaaggcggagaaaacaggcaggagaaactgaaagggtctcagctggcgggacaggaagtgtgggcccaggggcttggcccgggaggagacaaggggaccaagggcttggcaatggggatgagatcagagagctgcagcttccaccccgggtgccttcctcgccctgcccagagcggcggccacactgctctttcttggaagccctgtaactttgcgtgccctgctccatccagttcgctcccaggaccccgggcagcggcgggtgctggaccgggctgcccggcagcgtcgcatcaaccggcagctggaggccctggagaatgacaacttccaggatgacccccacgcgggactccctcagctcggcaagagactgcctcagtttgatgacgatgcggacactggaaagaaaaagaagaaaacccgaggtgatcattttaaacttcgcttccgaaactacctgacggcctgtgcgggacccccatcgcggccccagcgccccttctgtgctgtctgtggcttcccatccccctacacctgtgtcagctgcggtgcccggtactgcactgtgcgctgtctggggacccaccaggagaccaggtgtctgaagtggactgtgtgagcctgggcattcccagagaggaagggccgctgtgcactgcccggccttcagaaagacagaatttcatcacccaatgcagggggagctcttcctggaccaagggaggagccgctcattcacccaacaaaactgtgtcttatctgccaggaaagaccagcctcactcctgggaactgtctggcaggtaggctgggccccccagtgctgttagaataaaaagcctcgtgccggaaaaaaaaaaaaaaaaaaaaaaaaaaaaaaaaaaaaaaaaaaaaaaaaaaaaaaaaaaaaaaaaaaaaaagagaggggagggagaggaaaaagagaagaaacaaaagagagggggcacaagagaagaaggggaaaaagatagaaacaaaacggggggaaaacacaagagggagacgacaaaaaagaagcggagaaaggaggcaggacaaaaaaaacaggagagaggaagaggggaacagaagggaggcgacggggagaaaagggaggacaagagagcaccacaaaagagcgcgggggggcgggaaaaaccgggggaggaaaagaagagaggaggagaagaaaaaacagggccgcacgagggaagcagaaaacaaaagaccaagaaagagggaggcagccaaacgggtgcaatacaaacacacacgagagacgataataggtatattgagaggagaatggagaggagacgagagagagtattgcgagaggcagaagaaagataaagaagagaaaaaattgatatatgtcggagagggaggacacgcgaaaaaataga

SEQ ID NO: 366214 - DNA, 1186 bp, Homo sapiens
tggcggcgacagggagggaggaagcctaggagtccgccgcgggacggaggcctgggggaactgggagttcagctttctgcagagggccactaggaacctcggattgcccacggaagccagccactttctttgacagtccagcccacctcctcttctgcccggagaagctccaggggctgcctttgtgatcacagcatcttcacaaggaccaaaggaaaataagatttcttgtaagaacaccgtgaccacatctttaaaatgacccatttcgtggctcccacaagatttacacctccacactgaggccggaagtggttttgcccctataaaacatggcgaaaagctttcttgtctccaaggaaacgccacgtaatgagtcaaagctgtggcgcacgcgcagaagtacaagctaccggaagtgatggcgcccctactaaagccttggggttagtacgcgtgcgcagcagtttcttccgacagttgtgttgtgccaatggtggagaagaaaacttcggttcgctcccaggaccccgggcagcggcgggtgctggaccgggctgcccggcagcgtcgcatcaaccggcagctggaggccctggagaatgacaacttccaggatgacccccacgcgggactccctcagctcggcaagagactgcctcagtttgatgacgatgcggacactggaaagaaaaagaagaaaacccgaggtgatcattttaaacttcgcttccgaaaaaactttcaggccctgttggaggagcagaacttgagtgtggccgagggccctaactacctgacggcctgtgcgggacccccatcgcggccccagcgccccttctgtgctgtctgtggcttcccatccccctacacctgtgtcagctgcggtgcccggtactgcactgtgcgctgtctggggacccaccaggagaccaggtgtctgaagtggactgtgtgagcctgggcattcccagagaggaagggccgctgtgcactgcccggccttcagaaagacagaatttcatcacccaatgcagggggagctcttcctggaccaagggaggagccgctcattcacccaacaaaactgtgtcttatctgccaggaaagaccagcctcactcctgggaactgtctggcaggtaggctgggccccccagtgctgttagaataaaaagcctcgtgcc

SEQ ID NO: 366215 - DNA, 1143 bp, Homo sapiens
tggcggcgacagggagggaggaagcctaggagtccgccgcgggacggaggcctgggggaactgggagttcagctttctgcagagggccactaggaacctcggattgcccacggaagccagccactttctttgacagtccagcccacctcctcttctgcccggagaagctccaggggctgcctttgtgatcacagcatcttcacaaggaccaaaggaaaataagatttcttgtaagaacaccgtgaccacatctttaaaatgacccatttcgtggctcccacaagatttacacctccacactgaggccggaagtggttttgcccctataaaacatggcgaaaagctttcttgtctccaaggaaacgccacgtaatgagtcaaagctgtggcgcacgcgcagaagtacaagctaccggaagtgatggcgcccctactaaagccttggggttagtacgcgtgcgcagcagtttcttccgacagttgtgttgtgccaatggtggagaagaaaacttcggttcgctcccaggaccccgggcagcggcgggtgctggaccgggctgcccggcagcgtcgcatcaaccggcagctggaggccctggagaatgacaacttccaggatgacccccacgcgggactccctcagctcggcaagagactgcctcagtttgatgacgatgcggacactggaaagaaaaagaagaaaacccgaggtgatcattttaaacttcgcttccgaaaaaactttcaggccctgttggaggagcagaacttgagtgtggccgagggccctaactacctgacggcctgtgcgggacccccatcgcggccccagcgccccttctgtgctgtctgtggcttcccatccccctacacctgtgtcagctgcggtgcccggtactgcactgtgcgctgtctggggacccaccaggagaccaggtgtctgaagtggactgtgtgagcctgggcattcccagagaggaagggccgctgtgcactgcccggccttcagaaagacagaatttcatcacccaatgcagggggagctcttcctggaccaagggagaaagaccagcctcactcctgggaactgtctggcaggtaggctgggccccccagtgctgttagaataaaaagcctcgtgcc

SEQ ID NO: 366216 - DNA, 1468 bp, Homo sapiens
  misc_feature (458)..(459): n is a, c, g, or t
  misc_feature (464)..(464): n is a, c, g, or t
  misc_feature (466)..(466): n is a, c, g, or t
gctgcatctgaccagcctgactcagctgccaccactgagaaagccaagaagataaagaacctaaagaagaaactccggcaggtggaagagctgcagcagcggatccaggctggggaagtcagccagcccagcaaagagcagctagaaaagctagcaaggaggagggcgctagaagaggagttagaggacttggagttaggcctctgaggccttggggaatagggaatggactgcagaacaaaccgtggggctctctggggtctgggggaatacgggcaacagcagtcaggaggggtaccccccatactggcttccacctcctgcggcccagctctgtcctccagagcctagcgtctccctcaatccttcccttttcttcccaacttctacttttggactttcccccacccacctgattttcttttaaacaagacacccaaatcagcagcaaaggaccnngggtngnccacgcgtcggccaatggtggagaagaaaacttcggttcgctcccaggaccccgggcagcggcgggtgctggaccgggctgcccggcagcgtcgcatcaaccggcagctggaggccctggagaatgacaacttccaggatgacccccacgcgggactccctcagctcggcaagagactgcctcagtttgatgacgatgcggacactggaaagaaaaagaagaaaacccgaggtgatcattttaaacttcgcttccgaaaaaactttcaggccctgttggaggagcagaacttgagtgtggccgagggccctaactacctgacggcctgtgcgggacccccatcgcggccccagcgccccttctgtgctgtctgtggcttcccatccccctacacctgtgtcagctgcggtgcccggtactgcactgtgcgctgtctggggacccaccaggagaccaggtgtctgaagtggactgtgtgagcctgggcattcccagagaggaagggccgctgtgcactgcccggccttcagaaagacagaatttcatcacccaatgcagggggagctcttcctggaccaagggaggagccgctcattcacccaacaaaactgtgtcttatctgccaggaaagaccagcctcactcctgggaactgtctggcaggtaggctgggccccccagtgctgttagaataaaaagcctcgtgccggaaaaaaaaaaaaaaaaaaaaaaaaaaccggggaatccgtgcggggaaagaagggtagcgccctgagggaggagcacaccgggcggttgtaaaaccattagaaacggcccattagggggggcaagagcccaatatctcgacattttgtaacaggaggagggggccccggaagagggagcgatactcaggaccctaaggtttgaaggcatattggcctcggtggagttcaaattgacagatccaacgaaggagagaagccgtgggcggggagtgccaagagagcgccaatgtggc

SEQ ID NO: 366217 - DNA, 1412 bp, Homo sapiens
tggcggcgacagggagggaggaagcctaggagtccgccgcgggacggaggcctgggggaactgggagttcagctttctgcagagggccactaggaacctcggattgcccacggaagccagccactttctttgacagtccagcccacctcctcttctgcccggagaagctccaggggctgcctttgtgatcacagcatcttcacaaggaccaaaggaaaataagatttcttgtaagaacaccgtgaccacatctttaaaatgacccatttcgtggctcccacaagatttacacctccacactgaggccggaagtggttttgcccctataaaacatggcgaaaagctttcttgtctccaaggaaacgccacgtaatgagtcaaagctgtggcgcacgcgcagaagtacaagctaccggaagtgatggcgcccctactaaagccttgggttcgctcccaggaccccgggcagcggcgggtgctggaccgggctgcccggcagcgtcgcatcaaccggcagctggaggccctggagaatgacaacttccaggatgacccccacgcgggactccctcagctcggcaagagactgcctcagtttgatgacgatgcggacactggaaagaaaaagaagaaaacccgaggtgatcattttaaacttcgcttccgaaaaaactttcaggccctgttggaggagcagaacttgagtgtggccgagggccctaactacctgacggcctgtgcgggacccccatcgcggccccagcgccccttctgtgctgtctgtggcttcccatccccctacacctgtgtcagctgcggtgcccggtactgcactgtgcgctgtctggggacccaccaggagaccaggtgtctgaagtggactgtgtgagcctgggcattcccagagaggaagggccgctgtgcactgcccggccttcagaaagacagaatttcatcacccaatgcagggggagctcttcctggaccaagggaggagccgctcattcacccaacaaaactgtgtcttatctgccaggaaagaccagcctcactcctgggaactgtctggcaggtaggctgggccccccagtgctgttagaataaaaagcctcgtgccggaaaaaaaaaaaaaaaaaaaaaaaaaaccggggaatccgtgcggggaaagaagggtagcgccctgagggaggagcacaccgggcggttgtaaaaccattagaaacggcccattagggggggcaagagcccaatatctcgacattttgtaacaggaggagggggccccggaagagggagcgatactcaggaccctaaggtttgaaggcatattggcctcggtggagttcaaattgacagatccaacgaaggagagaagccgtgggcggggagtgccaagagagcgccaatgtggc

SEQ ID NO: 366218 - DNA, 1308 bp, Homo sapiens
tggcggcgacagggagggaggaagcctaggagtccgccgcgggacggaggcctgggggaactgggagttcagctttctgcagagggccactaggaacctcggattgcccacggaagccagccactttctttgacagtccagcccacctcctcttctgcccggagaagctccaggggctgcctttgtgatcacagcatcttcacaaggaccaaaggaaaataagatttcttgtaagaacaccgtgaccacatctttaaaatgacccatttcgtggctcccacaagatttacacctccacactgaggccggaagtggttttgcccctataaaacatggcgaaaagctttcttgtctccaaggaaacgccacgtaatgagtcaaagctgtggcgcacgcgcagaagtacaagctaccggaagtgatggcgcccctactaaagccttggggttagtacgcgtgcgcagcagtttcttccgacagttgtgttgtgccaatggtggagaagaaaacttcggttcgctcccaggaccccgggcagcggcgggtgctggaccgggctgcccggcagcgtcgcatcaaccggcagctggaggccctggagaatgacaacttccaggatgacccccacgcgggactccctcagctcggcaagagactgcctcagtttgatgacgatgcggacactggaaagaaaaagaagaaaacccgaggtgatcattttaaacttcgcttccgaaaaaactttcaggccctgttggaggagcagaacttgagtgtggccgagggccctaactacctgacggcctgtgcgggacccccatcgcggccccagcgccccttctgtgctgtctgtggcttcccatccccctacacctgtgtcagctgcggtgcccggtactgcactgtgcgctgtctggggacccaccaggagaccaggtgtctgaagtggactgtgtgagcctgggcattcccagagaggaagggccgctgtgcactgcccggccttcagaaagacagaatttcatcacccaatgcagggggagctcttcctggaccaagggaggagccgctcattcacccaacaaaactgtgtcttatctgccaggaaagaccagcctcactcctgggaactgtctggcaggtaggctgggccccccagtgctgttagaataaaaagcctcgtgccgggtaataaaaattataaataaacttggggggggggccgggtcccaattcgccttaagggggcgtattaaaattaatgggccgtgtattaaaacgtctgaatgggaaaaacctggggtatcc

SEQ ID NO: 366219 - DNA, 1061 bp, Homo sapiens
  misc_feature (1026)..(1026): n is a, c, g, or t
tggcggcgacagggagggaggaagcctaggagtccgccgcgggacggaggcctgggggaactgggagttcagctttctgcagagggccactaggaacctcggattgcccacggaagccagccactttctttgacagtccagcccacctcctcttctgcccggagaagctccaggggctgcctttgtgatcacagcatcttcacaaggaccaaaggaaaataagatttcttgtaagaacaccgtgaccacatctttaaaatgacccatttcgtggctcccacaagatttacacctccacactgaggccggaagtggttttgcccctataaaacatggcgaaaagctttcttgtctccaaggaaacgccacgtaatgagtcaaagctgtggcgcacgcgcagaagtacaagctaccggaagtgatggcgcccctactaaagccttggggttagtacgcgtgcgcagcagtttcttccgacagttgtgttgtgccaatggtggagaagaaaacttcggttcgctcccaggaccccgggcagcggcgggtgctggaccgggctgcccggcagcgtcgcatcaaccggcagctggaggccctggagaatgacaacttccaggatgacccccacgcgggactccctcagctcggcaagagactgcctcagtttgatgacgatgcggacactggaaagaaaaagaagaaaacccgaggtgatcattttaaacttcgcttccgaaaaaactttcaggccctgttggaggagcagaacttgagtgtggccgagggccctaactacctgacggcctgtgcgggacccccatcgcggccccagcgccccttctgtgctgtctgtggcttcccatccccctacacctgtgtcagctgcggtgcccggtactgcactgtgcgctgtctggggacccaccaggagaccaggtgtctgaagtggactgtgtgagcctgggcattcccagagaggaagggccgctgtgcactgcccggccttcagaaagacagaatttcctnacccggggagggggggggatcctcgagatcgtcct

SEQ ID NO: 366220 - DNA, 4510 bp, Homo sapiens
agccggcgcagcggggggtcggtgtggggtagaatggccgctgccgccgtcacccgcgggaccccgggagcacagactccccctccccccggcccctcaggccgggggtgaccttgccccctggagccctcaccatgaataccaaggacaccaccgaggttgctgaaaacagccaccacctgaagatctttctccccaagaagctgctggagtgtcttcctcgctgcccgctgctgcctccagagaggctacggtggaatacaaatgaggagattgcatcctacctgatcacctttgagaagcatgatgagtggctgtcttgtgccccaaagacaaggcctcagaatggctccatcatcctctacaatcgcaagaaggtgaaatatcggaaggatggttacctctggaagaagcggaaggatgggaagaccacccgagaggaccacatgaagctgaaggtccagggcatggagcctggcagtgtctctatggctgctacgttcactcttccatcgtccccacattccatcggcgctgctactggctgctccagaaccctgacatcgtccttgtgcactacctgaacgtcccagccctggaggactgtggaaagggctgcagccccatcttttgttccatcagcagcgaccgtcgagagtggctgaagtggtcccgggaggagttgttgggacagctgaagcccatgtttcatggcatcaagtggagctgcgggaatggaacagaagagttctctgtagaacacctggtgcagcagattttggacacccacccaaccaagcctgctccccgaacccacgcctgtctctgcagtggggggcttggttctgggagccttacccacaaatgcagcagcacgaaacaccgcatcatctctcccaaagtggagccccgagctttaaccctgacctctatcccccaccctcaccccccagagcctcctccactgatagccccacttcccccagagctccccaaggcacacacctccccatcttcttcctcttcttcctcctcatcaggttttgcagagcccctagaaatcagacctagccctcccacttctcgagggggttcttcaagaggaggcactgctatcctcctcctgacaggactggagcagcgggctggaggcttgacgcccaccaggcacttggctccacaggctgatcctaggccttccatgagtttggcagtggttgtaggcactgagccttctgccccaccagctcctcccagtcctgcctttgaccctgatcgttttctcaacagcccccagaggggccagacatatggaggggggcagggagtaagcccagacttccccgaggcagaggccgctcataccccctgttctgccctagagcctgctgctgccctggagccccaggcagctgctcggggtcccccaccacagtcagtagcaggtgggagaagaggaaactgcttcttcatccaagatgatgacagtggggaggagctcaagggtcacggggctgccccacccataccttcaccccctccctcacccccaccctcacctgcccccttggagccgtcaagcagggtaggaagaggagaggccttgtttggaggacctgttggggccagtgaactggagcccttcagtctttcatcattcccagaccttatgggagaactcatcagtgacgaagctccaagcatccctgctccgaccccccagctgtctcctgctcttagcaccatcacagacttctccccagagtggtcctacccagagggtggggtcaaggtgctcatcacaggtccttggaccgaagccgccgagcattactcctgtgtctttgatcacatcgcagtgccagcctcacttgtccagcctggtgtcttacgctgctactgtcccgcccatgaggtagggctggtgtctttgcaggtggcagggcgggaggggcccctttctgcttctgtgctctttgagtatcgagcccgccgattcctgtctctgcctagtactcaacttgactggctgtcactggacgacaaccagttccggatgtccatactagagcgactggagcagatggagaagcggatggcagagatcgcagcagctgggcaggtgccttgccagggtcctgatgctcctccagttcaggatgaaggccaggggcctgggttcgaagcacgggtagtggtcttggtagaaagcatgatcccacgctccacctggaagggtcctgaacgtctggcccatggaagccccttccggggcatgagccttctgcacctggctgctgcccagggctatgcccgcctcatcgagaccctgagccagtggcggagtgtggagactggaagcttggacttagagcaggaggttgacccgctcaacgtggatcatttctcttgcacccctctgatgtgggcttgtgccctgggacacctggaagctgctgtgctccttttccgttggaaccgacaggcactgagcattcccgactctctgggccgtctgccattgtctgtggctcattcccggggtcatgtgcgccttgcccgctgccttgaggaactacagagacaggagccttcggtggagcccccatttgccctatcgccaccctcctccagcccagacactggtctgagcagcgtctcctcgccctcggagctgtcggatggcaccttttccgtcacgtcagcctattctagtgccccagatggcagtcccccccctgcacctctgccagcctctgagatgactatggaggacatggccccaggccagctttcctctggtgtcccagaagcccccctactcctcatggactatgaggctaccaactccaaggggcccctctcctcccttcctgccctcccaccagcttcagatgatggggctgctccggaggacgctgacagcccacaggctgtggatgtgatcccggtggacatgatctcactagccaagcagatcatcgaagccacaccggagcggattaaacgagaggacttcgtggggctgcccgaggctggagcctcaatgcgggagcggacaggggctgtggggctcagtgagaccatgtcctggctggccagctacctggagaatgtggaccatttccccagctcaacccctcccagcgaactgccctttgagcgaggtcgcctggctgtcccttcagcaccctcctgggcagagtttctctctgcatccaccagtggcaagatggaaagtgattttgccctgctgacactatcagatcacgagcagcgggaactgtatgaggctgcccgagtcatccagacggccttccgaaagtacaagggccggcggctgaaggagcagcaggaggtagcagcagctgtaatccagcgctgttaccggaagtacaagcagctgacctggattgcacttaagtttgcactctataagaagatgacccaggcggccatcctgatccagagcaagttccgaagctactatgaacagaagcgatttcagcagagccgccgagcggctgtgctcatccagcagcactaccgctcctaccgccgcaggcccggccctccccaccggacttcggccaccctgcctgcccgcaacaaaggctcctttctcaccaagaagcaggaccaggcagcccggaagatcatgagattcctgcggcgctgccgacacaggatgagggaactgaagcagaaccaggagctggaagggcttccccagccgggactggccacatgacctggccaccgcctttctcaccaccctgggggcgcctcgtgcagtcttaacagggagagggctttctggggcagggggagcccctgtcggcagctttcctgttcacctttgttggagccctctgtaggcctcctccctcctccccacgccttgctcccacacccctctcctcgtccctcctggtcgtgccccgtctcttttggtcctggctccagaaaacccgcgccccacatacctgcatcttccgctgtgacctccggagccctgcctgcccctgctccccagctcctcctgcctgcacccgactcggccccctcctgacttgccttatttatttgttcgacgcgtctctgaatgtatccgcctcggttcccaccactgccttcgctgcgcacgcccctcgtgtttcagggctgaccgtgtccccacccgactccgcatgtttgcgtctgtttcctccctctctggccctgtcttaccccatcacccgactctggccactgacctcagggccgaaggggaggtggtgtacataggaacgcgttgcggagtccgccccgtcccccgaggggaggggtcttgtacatactgtaacatacagagtatagtgaagaatctatttaaggcgccgcggggagggctgcacggccgggcttgtggttctctagcgcggcgggggcctcctgccggctccacgggcactttctacttgtgcatgggcttggtttatacgaattgccattaaacatcgctgcacca

SEQ ID NO: 366221 - DNA, 862 bp, Homo sapiens
ccgacaacctttttcccatccgtagccttaaattcccgagctgcccgggcggatcgtagtgttgattggagggatgagaatacccgccgggtccgattggccactgtctccgcctgcgttctcggagtagcttccctgcgggtgggctggagttcggcggccggcgtagggcgcggccctgcagggcggtgggagcctccccggggctgctcgtgttgcagcttgggatgatactggcggaacgcaggaccccaactcccaaacctgcggaccttgaccacggacgagccctgtcccagctccccacgtgccccagggggaccagagcaggcaggacgccttccaagtattcaagggccgctggttgcctacgcttcgtccccttgtttcttgaacaaccgttagggaccaggggtacccctcagggaggccacagtccggggctggggcgctcattgatgcagtgatcacacgtaagtttaataaccaacttgataagtgctctgagagaaaaataactgtgagagcggccacctgaggttctcccccaatctgcagtgagccgagatcagaacaggtaattccgtaaatgagagagagaagcaaagcgttacaggcagaagagtctatttgaaatctctgagaaaggaggaagcatgatgggaatggggaactggaattctctaatgctccgatgactgtctaagtgggggatcacccggcattgacagactgggaagcttaaatgagtcactcgcctgaggtcacatggttagtttgatgcagagaagactcgaaaaccagttaaagaacagtcagtggggcccggccttgtagctcacacctttaataccaccacttt

SEQ ID NO: 366222 - DNA, 6144 bp, Homo sapiens
cctcttcccggttcgccctcacctcccgcttccgtcctcctcccccgcgccagggggcgccgctcaccgcagggccccacggcggaccagcgcgtgccggggactgtcccggagacccccgcacccggcacctgcactgtccctcgcccaccgcgtgcccgcggactctgctcccggcttctccagaacatccctctatgcgggcgggaccctcccacctcggaggttctcctgggaccaccactccgccggggggccgcccagagtgccaagcgtccgatccggcgccgcccaagtgcagcccaaggacccgctcccgctccgcaccctggcaggctgcctagccaggactgcgcacctgcgccctggggcggagtccttaccccaaccccagcttcactgcacatagccgagcccgacgggcctcctcccatctccatcctggacacctggcggagcccgtgctgagagcctccgccagctcccatctgttccccgaggagggcggggggctcaggctggagccagagcggtagatgggcacagactccccctccccccggcccctcaggccgggggtgaccttgccccctggagccctcaccatgaataccaaggacaccaccgaggttgctgaaaacagccaccacctgaagatctttctccccaagaagctgctggagtgtcttcctcgctgcccgctgctgcctccagagaggctacggtggaatacaaatgaggagattgcatcctacctgatcacctttgagaagcatgatgagtggctgtcttgtgccccaaagacaaggcctcagaatggctccatcatcctctacaatcgcaagaaggtgaaatatcggaaggatggttacctctggaagaagcggaaggatgggaagaccacccgagaggaccacatgaagctgaaggtccagggcatggagcctggcagtgtctctatggctgctacgttcactcttccatcgtccccacattccatcggcgctgctactggctgctccagaaccctgacatcgtccttgtgcactacctgaacgtcccagccctggaggactgtggaaagggctgcagccccatcttttgttccatcagcagcgaccgtcgagagtggctgaagtggtcccgggaggagttgttgggacagctgaagcccatgtttcatggcatcaagtggagctgcgggaatggaacagaagagttctctgtagaacacctggtgcagcagattttggacacccacccaaccaagcctgctccccgaacccacgcctgtctctgcagtggggggcttggttctgggagccttacccacaaatgcagcagcacgaaacaccgcatcatctctcccaaagtggagccccgagctttaaccctgacctctatcccccaccctcaccccccagagcctcctccactgatagccccacttcccccagagctccccaaggcacacacctccccatcttcttcctcttcttcctcctcatcaggttttgcagagcccctagaaatcagacctagccctcccacttctcgagggggttcttcaagaggaggcactgctatcctcctcctgacaggactggagcagcgggctggaggcttgacgcccaccaggcacttggctccacaggctgatcctaggccttccatgagtttggcagtggttgtaggcactgagccttctgccccaccagctcctcccagtcctgcctttgaccctgatcgttttctcaacagcccccagaggggccagacatatggaggggggcagggagtaagcccagacttccccgaggcagaggccgctcataccccctgttctgccctagagcctgctgctgccctggagccccaggcagctgctcggggtcccccaccacagtcagtagcaggtgggagaagaggaaactgcttcttcatccaagatgatgacagtggggaggagctcaagggtcacggggctgccccacccataccttcaccccctccctcacccccaccctcacctgcccccttggagccgtcaagcagggtaggaagaggagaggccttgtttggaggacctgttggggccagtgaactggagcccttcagtctttcatcattcccagaccttatgggagaactcatcagtgacgaagctccaagcatccctgctccgaccccccagctgtctcctgctcttagcaccatcacagacttctccccagagtggtcctacccagagggtggggtcaaggtgctcatcacaggtccttggaccgaagccgccgagcattactcctgtgtctttgatcacatcgcagtgccagcctcacttgtccagcctggtgtcttacgctgctactgtcccgcccatgaggtagggctggtgtctttgcaggtggcagggcgggaggggcccctttctgcttctgtgctctttgagtatcgagcccgccgattcctgtctctgcctagtactcaacttgactggctgtcactggacgacaaccagttccggatgtccatactagagcgactggagcagatggagaagcggatggcagagatcgcagcagctgggcaggtgccttgccagggtcctgatgctcctccagttcaggatgaaggccaggggcctgggttcgaagcacgggtagtggtcttggtagaaagcatgatcccacgctccacctggaagggtcctgaacgtctggcccatggaagccccttccggggcatgagccttctgcacctggctgctgcccagggctatgcccgcctcatcgagaccctgagccagtggcggagtgtggagactggaagcttggacttagagcaggaggttgacccgctcaacgtggatcatttctcttgcacccctctgatgtgggcttgtgccctgggacacctggaagctgctgtgctccttttccgttggaaccgacaggcactgagcattcccgactctctgggccgtctgccattgtctgtggctcattcccggggtcatgtgcgccttgcccgctgccttgaggaactacagagacaggagccttcggtggagcccccatttgccctatcgccaccctcctccagcccagacactggtctgagcagcgtctcctcgccctcggagctgtcggatggcaccttttccgtcacgtcagcctattctagtgccccagatggcagtcccccccctgcacctctgccagcctctgagatgactatggaggacatggccccaggccagctttcctctggtgtcccagaagcccccctactcctcatggactatgaggctaccaactccaaggggcccctctcctcccttcctgccctcccaccagcttcagatgatggggctgctccggaggacgctgacagcccacaggctgtggatgtgatcccggtggacatgatctcactagccaagcagatcatcgaagccacaccggagcggattaaacgagaggacttcgtggggctgcccgaggctggagcctcaatgcgggagcggacaggggctgtggggctcagtgagaccatgtcctggctggccagctacctggagaatgtggaccatttccccagctcaacccctcccagcgaactgccctttgagcgaggtcgcctggctgtcccttcagcaccctcctgggcagagtttctctctgcatccaccagtggcaagatggaaagtgattttgccctgctgacactatcagatcacgagcagcgggaactgtatgaggctgcccgagtcatccagacggccttccgaaagtacaagggccggcggctgaaggagcagcaggaggtagcagcagctgtaatccagcgctgttaccggaagtacaagcagtttgcactctataagaagatgacccaggcggccatcctgatccagagcaagttccgaagctactatgaacagaagcgatttcagcagagccgccgagcggctgtgctcatccagcagcactaccgctcctaccgccgcaggcccggccctccccaccggacttcggccaccctgcctgcccgcaacaaaggctcctttctcaccaagaagcaggaccaggcagcccggaagatcatgagattcctgcggcgctgccgacacaggatgagggaactgaagcagaaccaggagctggaagggcttccccagccgggactggccacatgacctggccaccgcctttctcaccaccctgggggcgcctcgtgcagtcttaacagggagagggctttctggggcagggggagcccctgtcggcagctttcctgttcacctttgttggagccctctgtaggcctcctccctcctccccacgccttgctcccacacccctctcctcgtccctcctggtcgtgccccgtctcttttggtcctggctccagaaaacccgcgccccacatacctgcatcttccgctgtgacctccggagccctgcctgcccctgctccccagctcctcctgcctgcacccgactcggccccctcctgacttgccttatttatttgttcgacgcgtctctgaatgtatccgcctcggttcccaccactgccttcgctgcgcacgcccctcgtgtttcagggctgaccgtgtccccacccgactccgcatgtttgcgtctgtttcctccctctctggccctgtcttaccccatcacccgactctggccactgacctcagggccgaaggggaggtggtgtacataggaacgcgttgcggagtccgccccgtcccccgaggggaggggtcttgtacatactgtaacatacagagtatagtgaagaatctatttaaggcgccgcggggagggctgcacggccgggcttgtggttctctagcgcggcgggggcctcctgccggctccacgggcactttctacttgtgcatgggcttggtttatacgaattgccattaaacatcgctgcaccagccagcctccggcctctgtctgcgggggcggggcggggcctaggccagctggaggccgccatgcaccgcgggcctgggatctgcgcccaggccaggcgggcccagggttttccgcctccgacgtgtttccggccttaaaggcattccgcccttccctttaagacgcaccgccccctctcagtcactcccaagatggcggacctactgggctccatcctgagctccatggagaagccacccagcctcggtgaccaggagactcggcgcaaggcccgagaacaggccgcccgcctgaagaaactacaagagcaagagaaacaacagaaagtggagtttcgtaaaaggatggagaaggaggtgtcagatttcattcaagacagtgggcagatcaagaaaaagtttcagccaatgaacaagatcgagaggagcatactacatgatgtggtggaagtggctggcctgacatccttctcctttggggaagatgatgactgtcgctatgtcatgatcttcaaaaaggagtttgcaccctcagatgaagagctagactcttaccgtcgtggagaggaatgggacccccagaaggctgaggagaagcggaagctgaaggagctggcccagaggcaagaggaggaggcagcccagcaggggcctgtggtggtgagccctgccagcgactacaaggacaagtacagccacctcatcggcaagggagcagccaaagacgcagcccacatgctacaggccaataagacctacggctgtgtgcccgtggccaataagagggacacacgctccattgaagaggctatgaatgagatcagagccaagaagcgtctgcggcagagtggggaagagttgccgccaacctcctaggcgccccgcccagctccctttgacccctggggcagggcagggggcagggagagacaaggctgctgctattagagcccatcctggagccccacctctgaaccacctcctaccagctgtccctcaggctgggggaaaacaggtgtttgatttgtcaccgttggagcttggatatgtgcgtggcatgtgtgtgtgtgtgtgagagtgtgaatgcacaggtgggtatttaatctgtattattccccgttcttggaattttcttccccatggggctggggtactttacattcaataaatactgtttaacccaa

SEQ ID NO: 366223 - DNA, 5690 bp, Homo sapiens
aatgagatttttggagagtaaaataattcacaaaaaaatgttagacttttgtcttaggacaaaagaagggttcttaggagggcagtgggtcttgctgggtccagatacctagaagcatcctccactagctgccagaactcagcagagagtgagacactgacaggatgaccaagaggccaggctgagactctctgtgaaggagatgcccagctgagtgcctcctctcctacaggagattgcatcctacctgatcacctttgagaagcatgatgagtggctgtcttgtgccccaaagacaaggcctcagaatggctccatcatcctctacaatcgcaagaaggtgaaatatcggaaggatggttacctctggaagaagcggaaggatgggaagaccacccgagaggaccacatgaagctgaaggtccagggcatggaggaacagaggaagagttggggagcagactagccctccccccaccccagcctgtctcctggcagtgtctctatggctgctacgttcactcttccatcgtccccacattccatcggcgctgctactggctgctccagaaccctgacatcgtccttgtgcactacctgaacgtcccagccctggaggactgtggaaagggctgcagccccatcttttgttccatcagcagcgaccgtcgagagtggctgaagtggtcccgggaggagttgttgggacagctgaagcccatgtttcatggcatcaagtggagctgcgggaatggaacagaagagttctctgtagaacacctggtgcagcagattttggacacccacccaaccaagcctgctccccgaacccacgcctgtctctgcagtggggggcttggttctgggagccttacccacaaatgcagcagcacgaaacaccgcatcatctctcccaaagtggagccccgagctttaaccctgacctctatcccccaccctcaccccccagagcctcctccactgatagccccacttcccccagagctccccaaggcacacacctccccatcttcttcctcttcttcctcctcatcaggttttgcagagcccctagaaatcagacctagccctcccacttctcgagggggttcttcaagaggaggcactgctatcctcctcctgacaggactggagcagcgggctggaggcttgacgcccaccaggcacttggctccacaggctgatcctaggccttccatgagtttggcagtggttgtaggcactgagccttctgccccaccagctcctcccagtcctgcctttgaccctgatcgttttctcaacagcccccagaggggccagacatatggaggggggcagggagtaagcccagacttccccgaggcagaggccgctcataccccctgttctgccctagagcctgctgctgccctggagccccaggcagctgctcggggtcccccaccacagtcagtagcaggtgggagaagaggaaactgcttcttcatccaagatgatgacagtggggaggagctcaagggtcacggggctgccccacccataccttcaccccctccctcacccccaccctcacctgcccccttggagccgtcaagcagggtaggaagaggagaggccttgtttggaggacctgttggggccagtgaactggagcccttcagtctttcatcattcccagaccttatgggagaactcatcagtgacgaagctccaagcatccctgctccgaccccccagctgtctcctgctcttagcaccatcacagacttctccccagagtggtcctacccagagggtggggtcaaggtgctcatcacaggtccttggaccgaagccgccgagcattactcctgtgtctttgatcacatcgcagtgccagcctcacttgtccagcctggtgtcttacgctgctactgtcccgcccatgaggtagggctggtgtctttgcaggtggcagggcgggaggggcccctttctgcttctgtgctctttgagtatcgagcccgccgattcctgtctctgcctagtactcaacttgactggctgtcactggacgacaaccagttccggatgtccatactagagcgactggagcagatggagaagcggatggcagagatcgcagcagctgggcaggtgccttgccagggtcctgatgctcctccagttcaggatgaaggccaggggcctgggttcgaagcacgggtagtggtcttggtagaaagcatgatcccacgctccacctggaagggtcctgaacgtctggcccatggaagccccttccggggcatgagccttctgcacctggctgctgcccagggctatgcccgcctcatcgagaccctgagccagtggcggagtgtggagactggaagcttggacttagagcaggaggttgacccgctcaacgtggatcatttctcttgcacccctctgatgtgggcttgtgccctgggacacctggaagctgctgtgctccttttccgttggaaccgacaggcactgagcattcccgactctctgggccgtctgccattgtctgtggctcattcccggggtcatgtgcgccttgcccgctgccttgaggaactacagagacaggagccttcggtggagcccccatttgccctatcgccaccctcctccagcccagacactggtctgagcagcgtctcctcgccctcggagctgtcggatggcaccttttccgtcacgtcagcctattctagtgccccagatggcagtcccccccctgcacctctgccagcctctgagatgactatggaggacatggccccaggccagctttcctctggtgtcccagaagcccccctactcctcatggactatgaggctaccaactccaaggggcccctctcctcccttcctgccctcccaccagcttcagatgatggggctgctccggaggacgctgacagcccacaggctgtggatgtgatcccggtggacatgatctcactagccaagcagatcatcgaagccacaccggagcggattaaacgagaggacttcgtggggctgcccgaggctggagcctcaatgcgggagcggacaggggctgtggggctcagtgagaccatgtcctggctggccagctacctggagaatgtggaccatttccccagctcaacccctcccagcgaactgccctttgagcgaggtcgcctggctgtcccttcagcaccctcctgggcagagtttctctctgcatccaccagtggcaagatggaaagtgattttgccctgctgacactatcagatcacgagcagcgggaactgtatgaggctgcccgagtcatccagacggccttccgaaagtacaagggccggcggctgaaggagcagcaggaggtagcagcagctgtaatccagcgctgttaccggaagtacaagcagtttgcactctataagaagatgacccaggcggccatcctgatccagagcaagttccgaagctactatgaacagaagcgatttcagcagagccgccgagcggctgtgctcatccagcagcactaccgctcctaccgccgcaggcccggccctccccaccggacttcggccaccctgcctgcccgcaacaaaggctcctttctcaccaagaagcaggaccaggcagcccggaagatcatgagattcctgcggcgctgccgacacaggatgagggaactgaagcagaaccaggagctggaagggcttccccagccgggactggccacatgacctggccaccgcctttctcaccaccctgggggcgcctcgtgcagtcttaacagggagagggctttctggggcagggggagcccctgtcggcagctttcctgttcacctttgttggagccctctgtaggcctcctccctcctccccacgccttgctcccacacccctctcctcgtccctcctggtcgtgccccgtctcttttggtcctggctccagaaaacccgcgccccacatacctgcatcttccgctgtgacctccggagccctgcctgcccctgctccccagctcctcctgcctgcacccgactcggccccctcctgacttgccttatttatttgttcgacgcgtctctgaatgtatccgcctcggttcccaccactgccttcgctgcgcacgcccctcgtgtttcagggctgaccgtgtccccacccgactccgcatgtttgcgtctgtttcctccctctctggccctgtcttaccccatcacccgactctggccactgacctcagggccgaaggggaggtggtgtacataggaacgcgttgcggagtccgccccgtcccccgaggggaggggtcttgtacatactgtaacatacagagtatagtgaagaatctatttaaggcgccgcggggagggctgcacggccgggcttgtggttctctagcgcggcgggggcctcctgccggctccacgggcactttctacttgtgcatgggcttggtttatacgaattgccattaaacatcgctgcaccagccagcctccggcctctgtctgcgggggcggggcggggcctaggccagctggaggccgccatgcaccgcgggcctgggatctgcgcccaggccaggcgggcccagggttttccgcctccgacgtgtttccggccttaaaggcattccgcccttccctttaagacgcaccgccccctctcagtcactcccaagatggcggacctactgggctccatcctgagctccatggagaagccacccagcctcggtgaccaggagactcggcgcaaggcccgagaacaggccgcccgcctgaagaaactacaagagcaagagaaacaacagaaagtggagtttcgtaaaaggatggagaaggaggtgtcagatttcattcaagacagtgggcagatcaagaaaaagtttcagccaatgaacaagatcgagaggagcatactacatgatgtggtggaagtggctggcctgacatccttctcctttggggaagatgatgactgtcgctatgtcatgatcttcaaaaaggagtttgcaccctcagatgaagagctagactcttaccgtcgtggagaggaatgggacccccagaaggctgaggagaagcggaagctgaaggagctggcccagaggcaagaggaggaggcagcccagcaggggcctgtggtggtgagccctgccagcgactacaaggacaagtacagccacctcatcggcaagggagcagccaaagacgcagcccacatgctacaggccaataagacctacggctgtgtgcccgtggccaataagagggacacacgctccattgaagaggctatgaatgagatcagagccaagaagcgtctgcggcagagtggggaagagttgccgccaacctcctaggcgccccgcccagctccctttgacccctggggcagggcagggggcagggagagacaaggctgctgctattagagcccatcctggagccccacctctgaaccacctcctaccagctgtccctcaggctgggggaaaacaggtgtttgatttgtcaccgttggagcttggatatgtgcgtggcatgtgtgtgtgtgtgtgagagtgtgaatgcacaggtgggtatttaatctgtattattccccgttcttggaattttcttccccatggggctggggtactttacattcaataaatactgtttaacccaa

SEQ ID NO: 366224 - DNA, 3951 bp, Homo sapiens
cgcctcccgggttcaaacgattctcctgcctcagcctcctgagtagctgggattacagggtggggtcaaggtgctcatcacaggtccttggaccgaagccgccgagcattactcctgtgtctttgatcacatcgcagtgccagcctcacttgtccagcctggtgtcttacgctgctactgtcccgcccatgaggtagggctggtgtctttgcaggtggcagggcgggaggggcccctttctgcttctgtgctctttgagtatcgagcccgccgattcctgtctctgcctagtactcaacttgactggctgtcactggacgacaaccagttccggatgtccatactagagcgactggagcagatggagaagcggatggcagagatcgcagcagctgggcaggtgccttgccagggtcctgatgctcctccagttcaggatgaaggccaggggcctgggttcgaagcacgggtagtggtcttggtagaaagcatgatcccacgctccacctggaagggtcctgaacgtctggcccatggaagccccttccggggcatgagccttctgcacctggctgctgcccagggctatgcccgcctcatcgagaccctgagccagtggcggagtgtggagactggaagcttggacttagagcaggaggttgacccgctcaacgtggatcatttctcttgcacccctctgatgtgggcttgtgccctgggacacctggaagctgctgtgctccttttccgttggaaccgacaggcactgagcattcccgactctctgggccgtctgccattgtctgtggctcattcccggggtcatgtgcgccttgcccgctgccttgaggaactacagagacaggagccttcggtggagcccccatttgccctatcgccaccctcctccagcccagacactggtctgagcagcgtctcctcgccctcggagctgtcggatggcaccttttccgtcacgtcagcctattctagtgccccagatggcagtcccccccctgcacctctgccagcctctgagatgactatggaggacatggccccaggccagctttcctctggtgtcccagaagcccccctactcctcatggactatgaggctaccaactccaaggggcccctctcctcccttcctgccctcccaccagcttcagatgatggggctgctccggaggacgctgacagcccacaggctgtggatgtgatcccggtggacatgatctcactagccaagcagatcatcgaagccacaccggagcggattaaacgagaggacttcgtggggctgcccgaggctggagcctcaatgcgggagcggacaggggctgtggggctcagtgagaccatgtcctggctggccagctacctggagaatgtggaccatttccccagctcaacccctcccagcgaactgccctttgagcgaggtcgcctggctgtcccttcagcaccctcctgggcagagtttctctctgcatccaccagtggcaagatggaaagtgattttgccctgctgacactatcagatcacgagcagcgggaactgtatgaggctgcccgagtcatccagacggccttccgaaagtacaagggccggcggctgaaggagcagcaggaggtagcagcagctgtaatccagcgctgttaccggaagtacaagcagtttgcactctataagaagatgacccaggcggccatcctgatccagagcaagttccgaagctactatgaacagaagcgatttcagcagagccgccgagcggctgtgctcatccagcagcactaccgctcctaccgccgcaggcccggccctccccaccggacttcggccaccctgcctgcccgcaacaaaggctcctttctcaccaagaagcaggaccaggcagcccggaagatcatgagattcctgcggcgctgccgacacaggatgagggaactgaagcagaaccaggagctggaagggcttccccagccgggactggccacatgacctggccaccgcctttctcaccaccctgggggcgcctcgtgcagtcttaacagggagagggctttctggggcagggggagcccctgtcggcagctttcctgttcacctttgttggagccctctgtaggcctcctccctcctccccacgccttgctcccacacccctctcctcgtccctcctggtcgtgccccgtctcttttggtcctggctccagaaaacccgcgccccacatacctgcatcttccgctgtgacctccggagccctgcctgcccctgctccccagctcctcctgcctgcacccgactcggccccctcctgacttgccttatttatttgttcgacgcgtctctgaatgtatccgcctcggttcccaccactgccttcgctgcgcacgcccctcgtgtttcagggctgaccgtgtccccacccgactccgcatgtttgcgtctgtttcctccctctctggccctgtcttaccccatcacccgactctggccactgacctcagggccgaaggggaggtggtgtacataggaacgcgttgcggagtccgccccgtcccccgaggggaggggtcttgtacatactgtaacatacagagtatagtgaagaatctatttaaggcgccgcggggagggctgcacggccgggcttgtggttctctagcgcggcgggggcctcctgccggctccacgggcactttctacttgtgcatgggcttggtttatacgaattgccattaaacatcgctgcaccagccagcctccggcctctgtctgcgggggcggggcggggcctaggccagctggaggccgccatgcaccgcgggcctgggatctgcgcccaggccaggcgggcccagggttttccgcctccgacgtgtttccggccttaaaggcattccgcccttccctttaagacgcaccgccccctctcagtcactcccaagatggcggacctactgggctccatcctgagctccatggagaagccacccagcctcggtgaccaggagactcggcgcaaggcccgagaacaggccgcccgcctgaagaaactacaagagcaagagaaacaacagaaagtggagtttcgtaaaaggatggagaaggaggtgtcagatttcattcaagacagtgggcagatcaagaaaaagtttcagccaatgaacaagatcgagaggagcatactacatgatgtggtggaagtggctggcctgacatccttctcctttggggaagatgatgactgtcgctatgtcatgatcttcaaaaaggagtttgcaccctcagatgaagagctagactcttaccgtcgtggagaggaatgggacccccagaaggctgaggagaagcggaagctgaaggagctggcccagaggcaagaggaggaggcagcccagcaggggcctgtggtggtgagccctgccagcgactacaaggacaagtacagccacctcatcggcaagggagcagccaaagacgcagcccacatgctacaggccaataagacctacggctgtgtgcccgtggccaataagagggacacacgctccattgaagaggctatgaatgagatcagagccaagaagcgtctgcggcagagtggggaagagttgccgccaacctcctaggcgccccgcccagctccctttgacccctggggcagggcagggggcagggagagacaaggctgctgctattagagcccatcctggagccccacctctgaaccacctcctaccagctgtccctcaggctgggggaaaacaggtgtttgatttgtcaccgttggagcttggatatgtgcgtggcatgtgtgtgtgtgtgtgagagtgtgaatgcacaggtgggtatttaatctgtattattccccgttcttggaattttcttccccatggggctggggtactttacattcaataaatactgtttaacccaa

SEQ ID NO: 366225 - DNA, 2348 bp, Homo sapiens
cctaacttgggtgagcctcagggctttgggtctccgtccctctatttcagcccctgtccctcctccccacccctgcagtttgcactctataagaagatgacccaggcggccatcctgatccagagcaagttccgaagctactatgaacagaagcgatttcagcagagccgccgagcggctgtgctcatccagcagcactaccgctcctaccgccgcaggcccggccctccccaccggacttcggccaccctgcctgcccgcaacaaaggctcctttctcaccaagaagcaggaccaggcagcccggaagatcatgagattcctgcggcgctgccgacacaggatgagggaactgaagcagaaccaggagctggaagggcttccccagccgggactggccacatgacctggccaccgcctttctcaccaccctgggggcgcctcgtgcagtcttaacagggagagggctttctggggcagggggagcccctgtcggcagctttcctgttcacctttgttggagccctctgtaggcctcctccctcctccccacgccttgctcccacacccctctcctcgtccctcctggtcgtgccccgtctcttttggtcctggctccagaaaacccgcgccccacatacctgcatcttccgctgtgacctccggagccctgcctgcccctgctccccagctcctcctgcctgcacccgactcggccccctcctgacttgccttatttatttgttcgacgcgtctctgaatgtatccgcctcggttcccaccactgccttcgctgcgcacgcccctcgtgtttcagggctgaccgtgtccccacccgactccgcatgtttgcgtctgtttcctccctctctggccctgtcttaccccatcacccgactctggccactgacctcagggccgaaggggaggtggtgtacataggaacgcgttgcggagtccgccccgtcccccgaggggaggggtcttgtacatactgtaacatacagagtatagtgaagaatctatttaaggcgccgcggggagggctgcacggccgggcttgtggttctctagcgcggcgggggcctcctgccggctccacgggcactttctacttgtgcatgggcttggtttatacgaattgccattaaacatcgctgcaccagccagcctccggcctctgtctgcgggggcggggcggggcctaggccagctggaggccgccatgcaccgcgggcctgggatctgcgcccaggccaggcgggcccagggttttccgcctccgacgtgtttccggccttaaaggcattccgcccttccctttaagacgcaccgccccctctcagtcactcccaagatggcggacctactgggctccatcctgagctccatggagaagccacccagcctcggtgaccaggagactcggcgcaaggcccgagaacaggccgcccgcctgaagaaactacaagagcaagagaaacaacagaaagtggagtttcgtaaaaggatggagaaggaggtgtcagatttcattcaagacagtgggcagatcaagaaaaagtttcagccaatgaacaagatcgagaggagcatactacatgatgtggtggaagtggctggcctgacatccttctcctttggggaagatgatgactgtcgctatgtcatgatcttcaaaaaggagtttgcaccctcagatgaagagctagactcttaccgtcgtggagaggaatgggacccccagaaggctgaggagaagcggaagctgaaggagctggcccagaggcaagaggaggaggcagcccagcaggggcctgtggtggtgagccctgccagcgactacaaggacaagtacagccacctcatcggcaagggagcagccaaagacgcagcccacatgctacaggccaataagacctacggctgtgtgcccgtggccaataagagggacacacgctccattgaagaggctatgaatgagatcagagccaagaagcgtctgcggcagagtggggaagagttgccgccaacctcctaggcgccccgcccagctccctttgacccctggggcagggcagggggcagggagagacaaggctgctgctattagagcccatcctggagccccacctctgaaccacctcctaccagctgtccctcaggctgggggaaaacaggtgtttgatttgtcaccgttggagcttggatatgtgcgtggcatgtgtgtgtgtgtgtgagagtgtgaatgcacaggtgggtatttaatctgtattattccccgttcttggaattttcttccccatggggctggggtactttacattcaataaatactgtttaacccaa

SEQ ID NO: 366226 - DNA, 2182 bp, Homo sapiens
tgatcatcatgcctcactgccattccctgcctagggttcctgggggggccgaaggcatgcgatgccttctgtgaggtccatcttttgtttctttcaccagaggctcctttctcaccaagaagcaggaccaggcagcccggaagatcatgagattcctgcggcgctgccgacacaggatgagggaactgaagcagaaccaggagctggaagggcttccccagccgggactggccacatgacctggccaccgcctttctcaccaccctgggggcgcctcgtgcagtcttaacagggagagggctttctggggcagggggagcccctgtcggcagctttcctgttcacctttgttggagccctctgtaggcctcctccctcctccccacgccttgctcccacacccctctcctcgtccctcctggtcgtgccccgtctcttttggtcctggctccagaaaacccgcgccccacatacctgcatcttccgctgtgacctccggagccctgcctgcccctgctccccagctcctcctgcctgcacccgactcggccccctcctgacttgccttatttatttgttcgacgcgtctctgaatgtatccgcctcggttcccaccactgccttcgctgcgcacgcccctcgtgtttcagggctgaccgtgtccccacccgactccgcatgtttgcgtctgtttcctccctctctggccctgtcttaccccatcacccgactctggccactgacctcagggccgaaggggaggtggtgtacataggaacgcgttgcggagtccgccccgtcccccgaggggaggggtcttgtacatactgtaacatacagagtatagtgaagaatctatttaaggcgccgcggggagggctgcacggccgggcttgtggttctctagcgcggcgggggcctcctgccggctccacgggcactttctacttgtgcatgggcttggtttatacgaattgccattaaacatcgctgcaccagccagcctccggcctctgtctgcgggggcggggcggggcctaggccagctggaggccgccatgcaccgcgggcctgggatctgcgcccaggccaggcgggcccagggttttccgcctccgacgtgtttccggccttaaaggcattccgcccttccctttaagacgcaccgccccctctcagtcactcccaagatggcggacctactgggctccatcctgagctccatggagaagccacccagcctcggtgaccaggagactcggcgcaaggcccgagaacaggccgcccgcctgaagaaactacaagagcaagagaaacaacagaaagtggagtttcgtaaaaggatggagaaggaggtgtcagatttcattcaagacagtgggcagatcaagaaaaagtttcagccaatgaacaagatcgagaggagcatactacatgatgtggtggaagtggctggcctgacatccttctcctttggggaagatgatgactgtcgctatgtcatgatcttcaaaaaggagtttgcaccctcagatgaagagctagactcttaccgtcgtggagaggaatgggacccccagaaggctgaggagaagcggaagctgaaggagctggcccagaggcaagaggaggaggcagcccagcaggggcctgtggtggtgagccctgccagcgactacaaggacaagtacagccacctcatcggcaagggagcagccaaagacgcagcccacatgctacaggccaataagacctacggctgtgtgcccgtggccaataagagggacacacgctccattgaagaggctatgaatgagatcagagccaagaagcgtctgcggcagagtggggaagagttgccgccaacctcctaggcgccccgcccagctccctttgacccctggggcagggcagggggcagggagagacaaggctgctgctattagagcccatcctggagccccacctctgaaccacctcctaccagctgtccctcaggctgggggaaaacaggtgtttgatttgtcaccgttggagcttggatatgtgcgtggcatgtgtgtgtgtgtgtgagagtgtgaatgcacaggtgggtatttaatctgtattattccccgttcttggaattttcttccccatggggctggggtactttacattcaataaatactgtttaacccaa

SEQ ID NO: 366227 - DNA, 5969 bp, Homo sapiens
cctcttcccggttcgccctcacctcccgcttccgtcctcctcccccgcgccagggggcgccgctcaccgcagggccccacggcggaccagcgcgtgccggggactgtcccggagacccccgcacccggcacctgcactgtccctcgcccaccgcgtgcccgcggactctgctcccggcttctccagaacatccctctatgcgggcgggaccctcccacctcggaggttctcctgggaccaccactccgccggggggccgcccagagtgccaagcgtccgatccggcgccgcccaagtgcagcccaaggacccgctcccgctccgcaccctggcaggctgcctagccaggactgcgcacctgcgccctggggcggagtccttaccccaaccccagcttcactgcacatagccgagcccgacgggcctcctcccatctccatcctggacacctggcggagcccgtgctgagagcctccgccagctcccatctgttccccgaggagggcggggggctcaggctggagccagagcggtagatgggcacagactccccctccccccggcccctcaggccgggggtgaccttgccccctggagccctcaccatgaataccaaggacaccaccgaggttgctgaaaacagccaccacctgaagatctttctccccaagaagctgctggagtgtcttcctcgctgcccgctgctgcctccagagaggctacggtggaatacaaatgaggagattgcatcctacctgatcacctttgagaagcatgatgagtggctgtcttgtgccccaaagacaaggcctcagaatggctccatcatcctctacaatcgcaagaaggtgaaatatcggaaggatggttacctctggaagaagcggaaggatgggaagaccacccgagaggaccacatgaagctgaaggtccagggcatggagcctggcagtgtctctatggctgctacgttcactcttccatcgtccccacattccatcggcgctgctactggctgctccagaaccctgacatcgtccttgtgcactacctgaacgtcccagccctggaggactgtggaaagggctgcagccccatcttttgttccatcagcagcgaccgtcgagagtggctgaagtggtcccgggaggagttgttgggacagctgaagcccatgtttcatggcatcaagtggagctgcgggaatggaacagaagagttctctgtagaacacctggtgcagcagattttggacacccacccaaccaagcctgctccccgaacccacgcctgtctctgcagtggggggcttggttctgggagccttacccacaaatgcagcagcacgaaacaccgcatcatctctcccaaagtggagccccgagctttaaccctgacctctatcccccaccctcaccccccagagcctcctccactgatagccccacttcccccagagctccccaaggcacacacctccccatcttcttcctcttcttcctcctcatcaggttttgcagagcccctagaaatcagacctagccctcccacttctcgagggggttcttcaagaggaggcactgctatcctcctcctgacaggactggagcagcgggctggaggcttgacgcccaccaggcacttggctccacaggctgatcctaggccttccatgagtttggcagtggttgtaggcactgagccttctgccccaccagctcctcccagtcctgcctttgaccctgatcgttttctcaacagcccccagaggggccagacatatggaggggggcagggagtaagcccagacttccccgaggcagaggccgctcataccccctgttctgccctagagcctgctgctgccctggagccccaggcagctgctcggggtcccccaccacagtcagtagcaggtgggagaagaggaaactgcttcttcatccaagatgatgacagtggggaggagctcaagggtcacggggctgccccacccataccttcaccccctccctcacccccaccctcacctgcccccttggagccgtcaagcagggtaggaagaggagaggccttgtttggaggacctgttggggccagtgaactggagcccttcagtctttcatcattcccagaccttatgggagaactcatcagtgacgaagctccaagcatccctgctccgaccccccagctgtctcctgctcttagcaccatcacagacttctccccagagtggtcctacccagagggtggggtcaaggtgctcatcacaggtccttggaccgaagccgccgagcattactcctgtgtctttgatcacatcgcagtgccagcctcacttgtccagcctggtgtcttacgctgctactgtcccgcccatgaggtagggctggtgtctttgcaggtggcagggcgggaggggcccctttctgcttctgtgctctttgagtatcgagcccgccgattcctgtctctgcctagtactcaacttgactggctgtcactggacgacaaccagttccggatgtccatactagagcgactggagcagatggagaagcggatggcagagatcgcagcagctgggcaggtgccttgccagggtcctgatgctcctccagttcaggatgaaggccaggggcctgggttcgaagcacgggtagtggtcttggtagaaagcatgatcccacgctccacctggaagggtcctgaacgtctggcccatggaagccccttccggggcatgagccttctgcacctggctgctgcccagggctatgcccgcctcatcgagaccctgagccagtggcggagtgtggagactggaagcttggacttagagcaggaggttgacccgctcaacgtggatcatttctcttgcacccctctgatgtgggcttgtgccctgggacacctggaagctgctgtgctccttttccgttggaaccgacaggcactgagcattcccgactctctgggccgtctgccattgtctgtggctcattcccggggtcatgtgcgccttgcccgctgccttgaggaactacagagacaggagccttcggtggagcccccatttgccctatcgccaccctcctccagcccagacactggtctgagcagcgtctcctcgccctcggagctgtcggatggcaccttttccgtcacgtcagcctattctagtgccccagatggcagtcccccccctgcacctctgccagcctctgagatgactatggaggacatggccccaggccagctttcctctggtgtcccagaagcccccctactcctcatggactatgaggctaccaactccaaggggcccctctcctcccttcctgccctcccaccagcttcagatgatggggctgctccggaggacgctgacagcccacaggctgtggatgtgatcccggtggacatgatctcactagccaagcagatcatcgaagccacaccggagcggattaaacgagaggacttcgtggggctgcccgaggctggagcctcaatgcgggagcggacaggggctgtggggctcagtgagaccatgtcctggctggccagctacctggagaatgtggaccatttccccagctcaacccctcccagcgaactgccctttgagcgaggtcgcctggctgtcccttcagcaccctcctgggcagagtttctctctgcatccaccagtggcaagatggaaagtgattttgccctgctgacactatcagatcacgagcagcgggaactgtatgaggctgcccgagtcatccagacggccttccgaaagtacaagggccggcggctgaaggagcagcaggaggtagcagcagctgtaatccagcgctgttaccggaagtacaagcagtttgcactctataagaagatgacccaggcggccatcctgatccagagcaagttccgaagctactatgaacagaagcgatttcagcagagccgccgagcggctgtgctcatccagcagcactaccgctcctaccgccgcaggcccggccctccccaccggacttcggccaccctgcctgcccgcaacaaaggctcctttctcaccaagaagcaggaccaggcagcccggaagatcatgagattcctgcggcgctgccgacacaggatgagggaactgaagcagaaccaggagctggaagggcttccccagccgggactggccacatgacctggccaccgcctttctcaccaccctgggggcgcctcgtgcagtcttaacagggagagggctttctggggcagggggagcccctgtcggcagctttcctgttcacctttgttggagccctctgtaggcctcctccctcctccccacgccttgctcccacacccctctcctcgtccctcctggtcgtgccccgtctcttttggtcctggctccagaaaacccgcgccccacatacctgcatcttccgctgtgacctccggagccctgcctgcccctgctccccagctcctcctgcctgcacccgactcggccccctcctgacttgccttatttatttgttcgacgcgtctctgaatgtatccgcctcggttcccaccactgccttcgctgcgcacgcccctcgtgtttcagggctgaccgtgtccccacccgactccgcatgtttgcgtctgtttcctccctctctggccctgtcttaccccatcacccgactctggccactgacctcagggccgaaggggaggtggtgtacataggaacgcgttgcggagtccgccccgtcccccgaggggaggggtcttgtacatactgtaacatacagagtatagtgaagaatctatttaaggcgccgcggggagggctgcacggccgggcttgtggttctctagcgcggcgggggcctcctgccggctccacgggcactttctacttgtgcatgggcttggtttatacgaattgccattaaacatcgctgcaccagccagcctccggcctctgtctgcgggggcggggcggggcctaggccagctggaggccgccatgcaccgcgggcctgggatctgcgcccaggccaggcgggcccagggttttccgcctccgacgtgtttccggccttaaaggcattccgcccttccctttaagacgcaccgccccctctcagtcactcccaagatggcggacctactgggctccatcctgagctccatggagaagccacccagcctcggtgaccaggagactcggcgcaaggcccgagaacaggccgcccgcctgaagaaactacaagagcaagagaaacaacagaaagtggagtttcgtaaaaggatggagaaggaggtgtcagatttcattcaagacagtgggcagatcaagaaaaagtttcagccaatgaacaagatcgagaggagcatactgagctggcccagaggcaagaggaggaggcagcccagcaggggcctgtggtggtgagccctgccagcgactacaaggacaagtacagccacctcatcggcaagggagcagccaaagacgcagcccacatgctacaggccaataagacctacggctgtgtgcccgtggccaataagagggacacacgctccattgaagaggctatgaatgagatcagagccaagaagcgtctgcggcagagtggggaagagttgccgccaacctcctaggcgccccgcccagctccctttgacccctggggcagggcagggggcagggagagacaaggctgctgctattagagcccatcctggagccccacctctgaaccacctcctaccagctgtccctcaggctgggggaaaacaggtgtttgatttgtcaccgttggagcttggatatgtgcgtggcatgtgtgtgtgtgtgtgagagtgtgaatgcacaggtgggtatttaatctgtattattccccgttcttggaattttcttccccatggggctggggtactttacattcaataaatactgtttaacccaa

SEQ ID NO: 366228 - DNA, 6251 bp, Homo sapiens
cctcttcccggttcgccctcacctcccgcttccgtcctcctcccccgcgccagggggcgccgctcaccgcagggccccacggcggaccagcgcgtgccggggactgtcccggagacccccgcacccggcacctgcactgtccctcgcccaccgcgtgcccgcggactctgctcccggcttctccagaacatccctctatgcgggcgggaccctcccacctcggaggttctcctgggaccaccactccgccggggggccgcccagagtgccaagcgtccgatccggcgccgcccaagtgcagcccaaggacccgctcccgctccgcaccctggcaggctgcctagccaggactgcgcacctgcgccctggggcggagtccttaccccaaccccagcttcactgcacatagccgagcccgacgggcctcctcccatctccatcctggacacctggcggagcccgtgctgagagcctccgccagctcccatctgttccccgaggagggcggggggctcaggctggagccagagcggtagatgggcacagactccccctccccccggcccctcaggccgggggtgaccttgccccctggagccctcaccatgaataccaaggacaccaccgaggttgctgaaaacagccaccacctgaagatctttctccccaagaagctgctggagtgtcttcctcgctgcccgctgctgcctccagagaggctacggtggaatacaaatgaggagattgcatcctacctgatcacctttgagaagcatgatgagtggctgtcttgtgccccaaagacaaggcctcagaatggctccatcatcctctacaatcgcaagaaggtgaaatatcggaaggatggttacctctggaagaagcggaaggatgggaagaccacccgagaggaccacatgaagctgaaggtccagggcatggagcctggcagtgtctctatggctgctacgttcactcttccatcgtccccacattccatcggcgctgctactggctgctccagaaccctgacatcgtccttgtgcactacctgaacgtcccagccctggaggactgtggaaagggctgcagccccatcttttgttccatcagcagcgaccgtcgagagtggctgaagtggtcccgggaggagttgttgggacagctgaagcccatgtttcatggcatcaagtggagctgcgggaatggaacagaagagttctctgtagaacacctggtgcagcagattttggacacccacccaaccaagcctgctccccgaacccacgcctgtctctgcagtggggggcttggttctgggagccttacccacaaatgcagcagcacgaaacaccgcatcatctctcccaaagtggagccccgagctttaaccctgacctctatcccccaccctcaccccccagagcctcctccactgatagccccacttcccccagagctccccaaggcacacacctccccatcttcttcctcttcttcctcctcatcaggttttgcagagcccctagaaatcagacctagccctcccacttctcgagggggttcttcaagaggaggcactgctatcctcctcctgacaggactggagcagcgggctggaggcttgacgcccaccaggcacttggctccacaggctgatcctaggccttccatgagtttggcagtggttgtaggcactgagccttctgccccaccagctcctcccagtcctgcctttgaccctgatcgttttctcaacagcccccagaggggccagacatatggaggggggcagggagtaagcccagacttccccgaggcagaggccgctcataccccctgttctgccctagagcctgctgctgccctggagccccaggcagctgctcggggtcccccaccacagtcagtagcaggtgggagaagaggaaactgcttcttcatccaagatgatgacagtggggaggagctcaagggtcacggggctgccccacccataccttcaccccctccctcacccccaccctcacctgcccccttggagccgtcaagcagggtaggaagaggagaggccttgtttggaggacctgttggggccagtgaactggagcccttcagtctttcatcattcccagaccttatgggagaactcatcagtgacgaagctccaagcatccctgctccgaccccccagctgtctcctgctcttagcaccatcacagacttctccccagagtggtcctacccagagggtggggtcaaggtgctcatcacaggtccttggaccgaagccgccgagcattactcctgtgtctttgatcacatcgcagtgccagcctcacttgtccagcctggtgtcttacgctgctactgtcccgcccatgaggtagggctggtgtctttgcaggtggcagggcgggaggggcccctttctgcttctgtgctctttgagtatcgagcccgccgattcctgtctctgcctagtactcaacttgactggctgtcactggacgacaaccagttccggatgtccatactagagcgactggagcagatggagaagcggatggcagagatcgcagcagctgggcaggtgccttgccagggtcctgatgctcctccagttcaggatgaaggccaggggcctgggttcgaagcacgggtagtggtcttggtagaaagcatgatcccacgctccacctggaagggtcctgaacgtctggcccatggaagccccttccggggcatgagccttctgcacctggctgctgcccagggctatgcccgcctcatcgagaccctgagccagtggcggagtgtggagactggaagcttggacttagagcaggaggttgacccgctcaacgtggatcatttctcttgcacccctctgatgtgggcttgtgccctgggacacctggaagctgctgtgctccttttccgttggaaccgacaggcactgagcattcccgactctctgggccgtctgccattgtctgtggctcattcccggggtcatgtgcgccttgcccgctgccttgaggaactacagagacaggagccttcggtggagcccccatttgccctatcgccaccctcctccagcccagacactggtctgagcagcgtctcctcgccctcggagctgtcggatggcaccttttccgtcacgtcagcctattctagtgccccagatggcagtcccccccctgcacctctgccagcctctgagatgactatggaggacatggccccaggccagctttcctctggtgtcccagaagcccccctactcctcatggactatgaggctaccaactccaaggggcccctctcctcccttcctgccctcccaccagcttcagatgatggggctgctccggaggacgctgacagcccacaggctgtggatgtgatcccggtggacatgatctcactagccaagcagatcatcgaagccacaccggagcggattaaacgagaggacttcgtggggctgcccgaggctggagcctcaatgcgggagcggacaggggctgtggggctcagtgagaccatgtcctggctggccagctacctggagaatgtggaccatttccccagctcaacccctcccagcgaactgccctttgagcgaggtcgcctggctgtcccttcagcaccctcctgggcagagtttctctctgcatccaccagtggcaagatggaaagtgattttgccctgctgacactatcagatcacgagcagcgggaactgtatgaggctgcccgagtcatccagacggccttccgaaagtacaagggccggcggctgaaggagcagcaggaggtagcagcagctgtaatccagcgctgttaccggaagtacaagcagtttgcactctataagaagatgacccaggcggccatcctgatccagagcaagttccgaagctactatgaacagaagcgatttcagcagagccgccgagcggctgtgctcatccagcagcactaccgctcctaccgccgcaggcccggccctccccaccggacttcggccaccctgcctgcccgcaacaaaggctcctttctcaccaagaagcaggaccaggcagcccggaagatcatgagattcctgcggcgctgccgacacaggatgagggaactgaagcagaaccaggagctggaagggcttccccagccgggactggccacatgacctggccaccgcctttctcaccaccctgggggcgcctcgtgcagtcttaacagggagagggctttctggggcagggggagcccctgtcggcagctttcctgttcacctttgttggagccctctgtaggcctcctccctcctccccacgccttgctcccacacccctctcctcgtccctcctggtcgtgccccgtctcttttggtcctggctccagaaaacccgcgccccacatacctgcatcttccgctgtgacctccggagccctgcctgcccctgctccccagctcctcctgcctgcacccgactcggccccctcctgacttgccttatttatttgttcgacgcgtctctgaatgtatccgcctcggttcccaccactgccttcgctgcgcacgcccctcgtgtttcagggctgaccgtgtccccacccgactccgcatgtttgcgtctgtttcctccctctctggccctgtcttaccccatcacccgactctggccactgacctcagggccgaaggggaggtggtgtacataggaacgcgttgcggagtccgccccgtcccccgaggggaggggtcttgtacatactgtaacatacagagtatagtgaagaatctatttaaggcgccgcggggagggctgcacggccgggcttgtggttctctagcgcggcgggggcctcctgccggctccacgggcactttctacttgtgcatgggcttggtttatacgaattgccattaaacatcgctgcaccagccagcctccggcctctgtctgcgggggcggggcggggcctaggccagctggaggccgccatgcaccgcgggcctgggatctgcgcccaggccaggcgggcccagggttttccgcctccgacgtgtttccggccttaaaggcattccgcccttccctttaagacgcaccgccccctctcagtcactcccaagatggcggacctactgggctccatcctgagctccatggagaagccacccagcctcggtgaccaggagactcggcgcaaggcccgagaacaggccgcccgcctgaagaaactacaagagcaagagaaacaacagaaagtggagtttcgtaaaaggatggagaaggaggtgtcagatttcattcaagacagtgggcagatcaagaaaaagtttcagccaatgaacaagatcgagaggagcatactacatgatgtggtggaagtggctggcctgacatccttctcctttggggaagatgatgactgtcgctatgtcatgatcttcaaaaaggagtttgcaccctcagatgaagagctagactcttaccgtcgtggagaggaatgggacccccagaaggctgaggagaagcggaagctgaaggagctggcccagaggcaagaggaggaggcagcccagcaggggcctgtggtggtgagccctgccagcgactacaaggacaagtacagccacctcatcggcaagggagcagccaaagacgcagcccacatgctacaggccaataagacctacggctgtgtgcccgtggccaataagagggacacacgctccattgaagaggctatgaatgagatcagagccaagaagcgtctgcggcagagtggggaagagttgccgccaacctcctaggcgccccgcccagctccctttgacccctggggcagggcagggggcagggagagacaaggctgctgctattagagcccatcctggagccccacctctgaaccacctcctaccagctgtccctcaggctggccaacgctgctcacattcataaataggaatatgggcaacgctgctcacattcataaataggaatatgggctcctagaataagtaatatttaattattagtgaaaagcaccattttgagaggtttttttgtgtttgtttgagactgagtctcgctcttctactgcccatgctggagtgcagtggcgtgatctccactcactgcggcctccacctcctaggtttaggtgattctcagcctcctgagtggctgaaattacaggcgtgtgccaccatgcccagctaatac

SEQ ID NO: 366229 - DNA, 6174 bp, Homo sapiens
  misc_feature (5910)..(5910): n is a, c, g, or t
  misc_feature (5913)..(5913): n is a, c, g, or t
cctcttcccggttcgccctcacctcccgcttccgtcctcctcccccgcgccagggggcgccgctcaccgcagggccccacggcggaccagcgcgtgccggggactgtcccggagacccccgcacccggcacctgcactgtccctcgcccaccgcgtgcccgcggactctgctcccggcttctccagaacatccctctatgcgggcgggaccctcccacctcggaggttctcctgggaccaccactccgccggggggccgcccagagtgccaagcgtccgatccggcgccgcccaagtgcagcccaaggacccgctcccgctccgcaccctggcaggctgcctagccaggactgcgcacctgcgccctggggcggagtccttaccccaaccccagcttcactgcacatagccgagcccgacgggcctcctcccatctccatcctggacacctggcggagcccgtgctgagagcctccgccagctcccatctgttccccgaggagggcggggggctcaggctggagccagagcggtagatgggcacagactccccctccccccggcccctcaggccgggggtgaccttgccccctggagccctcaccatgaataccaaggacaccaccgaggttgctgaaaacagccaccacctgaagatctttctccccaagaagctgctggagtgtcttcctcgctgcccgctgctgcctccagagaggctacggtggaatacaaatgaggagattgcatcctacctgatcacctttgagaagcatgatgagtggctgtcttgtgccccaaagacaaggcctcagaatggctccatcatcctctacaatcgcaagaaggtgaaatatcggaaggatggttacctctggaagaagcggaaggatgggaagaccacccgagaggaccacatgaagctgaaggtccagggcatggagcctggcagtgtctctatggctgctacgttcactcttccatcgtccccacattccatcggcgctgctactggctgctccagaaccctgacatcgtccttgtgcactacctgaacgtcccagccctggaggactgtggaaagggctgcagccccatcttttgttccatcagcagcgaccgtcgagagtggctgaagtggtcccgggaggagttgttgggacagctgaagcccatgtttcatggcatcaagtggagctgcgggaatggaacagaagagttctctgtagaacacctggtgcagcagattttggacacccacccaaccaagcctgctccccgaacccacgcctgtctctgcagtggggggcttggttctgggagccttacccacaaatgcagcagcacgaaacaccgcatcatctctcccaaagtggagccccgagctttaaccctgacctctatcccccaccctcaccccccagagcctcctccactgatagccccacttcccccagagctccccaaggcacacacctccccatcttcttcctcttcttcctcctcatcaggttttgcagagcccctagaaatcagacctagccctcccacttctcgagggggttcttcaagaggaggcactgctatcctcctcctgacaggactggagcagcgggctggaggcttgacgcccaccaggcacttggctccacaggctgatcctaggccttccatgagtttggcagtggttgtaggcactgagccttctgccccaccagctcctcccagtcctgcctttgaccctgatcgttttctcaacagcccccagaggggccagacatatggaggggggcagggagtaagcccagacttccccgaggcagaggccgctcataccccctgttctgccctagagcctgctgctgccctggagccccaggcagctgctcggggtcccccaccacagtcagtagcaggtgggagaagaggaaactgcttcttcatccaagatgatgacagtggggaggagctcaagggtcacggggctgccccacccataccttcaccccctccctcacccccaccctcacctgcccccttggagccgtcaagcagggtaggaagaggagaggccttgtttggaggacctgttggggccagtgaactggagcccttcagtctttcatcattcccagaccttatgggagaactcatcagtgacgaagctccaagcatccctgctccgaccccccagctgtctcctgctcttagcaccatcacagacttctccccagagtggtcctacccagagggtggggtcaaggtgctcatcacaggtccttggaccgaagccgccgagcattactcctgtgtctttgatcacatcgcagtgccagcctcacttgtccagcctggtgtcttacgctgctactgtcccgcccatgaggtagggctggtgtctttgcaggtggcagggcgggaggggcccctttctgcttctgtgctctttgagtatcgagcccgccgattcctgtctctgcctagtactcaacttgactggctgtcactggacgacaaccagttccggatgtccatactagagcgactggagcagatggagaagcggatggcagagatcgcagcagctgggcaggtgccttgccagggtcctgatgctcctccagttcaggatgaaggccaggggcctgggttcgaagcacgggtagtggtcttggtagaaagcatgatcccacgctccacctggaagggtcctgaacgtctggcccatggaagccccttccggggcatgagccttctgcacctggctgctgcccagggctatgcccgcctcatcgagaccctgagccagtggcggagtgtggagactggaagcttggacttagagcaggaggttgacccgctcaacgtggatcatttctcttgcacccctctgatgtgggcttgtgccctgggacacctggaagctgctgtgctccttttccgttggaaccgacaggcactgagcattcccgactctctgggccgtctgccattgtctgtggctcattcccggggtcatgtgcgccttgcccgctgccttgaggaactacagagacaggagccttcggtggagcccccatttgccctatcgccaccctcctccagcccagacactggtctgagcagcgtctcctcgccctcggagctgtcggatggcaccttttccgtcacgtcagcctattctagtgccccagatggcagtcccccccctgcacctctgccagcctctgagatgactatggaggacatggccccaggccagctttcctctggtgtcccagaagcccccctactcctcatggactatgaggctaccaactccaaggggcccctctcctcccttcctgccctcccaccagcttcagatgatggggctgctccggaggacgctgacagcccacaggctgtggatgtgatcccggtggacatgatctcactagccaagcagatcatcgaagccacaccggagcggattaaacgagaggacttcgtggggctgcccgaggctggagcctcaatgcgggagcggacaggggctgtggggctcagtgagaccatgtcctggctggccagctacctggagaatgtggaccatttccccagctcaacccctcccagcgaactgccctttgagcgaggtcgcctggctgtcccttcagcaccctcctgggcagagtttctctctgcatccaccagtggcaagatggaaagtgattttgccctgctgacactatcagatcacgagcagcgggaactgtatgaggctgcccgagtcatccagacggccttccgaaagtacaagggccggcggctgaaggagcagcaggaggtagcagcagctgtaatccagcgctgttaccggaagtacaagcagtttgcactctataagaagatgacccaggcggccatcctgatccagagcaagttccgaagctactatgaacagaagcgatttcagcagagccgccgagcggctgtgctcatccagcagcactaccgctcctaccgccgcaggcccggccctccccaccggacttcggccaccctgcctgcccgcaacaaaggctcctttctcaccaagaagcaggaccaggcagcccggaagatcatgagattcctgcggcgctgccgacacaggatgagggaactgaagcagaaccaggagctggaagggcttccccagccgggactggccacatgacctggccaccgcctttctcaccaccctgggggcgcctcgtgcagtcttaacagggagagggctttctggggcagggggagcccctgtcggcagctttcctgttcacctttgttggagccctctgtaggcctcctccctcctccccacgccttgctcccacacccctctcctcgtccctcctggtcgtgccccgtctcttttggtcctggctccagaaaacccgcgccccacatacctgcatcttccgctgtgacctccggagccctgcctgcccctgctccccagctcctcctgcctgcacccgactcggccccctcctgacttgccttatttatttgttcgacgcgtctctgaatgtatccgcctcggttcccaccactgccttcgctgcgcacgcccctcgtgtttcagggctgaccgtgtccccacccgactccgcatgtttgcgtctgtttcctccctctctggccctgtcttaccccatcacccgactctggccactgacctcagggccgaaggggaggtggtgtacataggaacgcgttgcggagtccgccccgtcccccgaggggaggggtcttgtacatactgtaacatacagagtatagtgaagaatctatttaaggcgccgcggggagggctgcacggccgggcttgtggttctctagcgcggcgggggcctcctgccggctccacgggcactttctacttgtgcatgggcttggtttatacgaattgccattaaacatcgctgcaccagccagcctccggcctctgtctgcgggggcggggcggggcctaggccagctggaggccgccatgcaccgcgggcctgggatctgcgcccaggccaggcgggcccagggttttccgcctccgacgtgtttccggccttaaaggcattccgcccttccctttaagacgcaccgccccctctcagtcactcccaagatggcggacctactgggctccatcctgagctccatggagaagccacccagcctcggtgaccaggagactcggcgcaaggcccgagaacaggccgcccgcctgaagaaactacaagagcaagagaaacaacagaaagtggagtttcgtaaaaggatggagaaggaggtgtcagatttcattcaagacagtgggcagatcaagaaaaagtttcagccaatgaacaagatcgagaggagcatactacatgatgtggtggaagtggctggcctgacatccttctcctttggggaagatgatgactgtcgctatgtcatgatcttcaaaaaggagtttgcaccctcagatgaagagctagactcttaccgtcgtggagaggaatgggacccccagaaggctgaggagaagcggaagctgaaggagctggcccagaggcaagaggaggaggcagcccagcaggggcctgtggtggtgagccctgccagcgactacaaggacaagtacagccacctcatcggcaagggagcagccaaagacgcagcccacatgctacaggccaataagacctacggctgtgtgcccgtggccaataagagggacacacgctccattgaagaggctatgaatgagatcagagccaagaagcgtctgcggcagagtggggaagagttgccgccaacctcctaggcgccccgcccagctccctttgacccctggggcagggcagggggcagggagagacagtgtgtatagagcatctnganccacttgacactctacagtgtctcagtggggacacaggctttggatgtcacgggagctggaatgtgcgtgcagtagttgtcttacaccgtcactcgcaggggaaatacaggaaatccagaggaaaataccccaggcgggggagtactaacaaggtcctaaaaaaaaaaaccggctttctcgcaaaaagtgacgtgtcccctatgagtcctatgtatctaatatacataacacacgtaatcgaccatttattatttcatgtg

SEQ ID NO: 366230 - DNA, 4960 bp, Homo sapiens
cctcttcccggttcgccctcacctcccgcttccgtcctcctcccccgcgccagggggcgccgctcaccgcagggccccacggcggaccagcgcgtgccggggactgtcccggagacccccgcacccggcacctgcactgtccctcgcccaccgcgtgcccgcggactctgctcccggcttctccagaacatccctctatgcgggcgggaccctcccacctcggaggttctcctgggaccaccactccgccggggggccgcccagagtgccaagcgtccgatccggcgccgcccaagtgcagcccaaggacccgctcccgctccgcaccctggcaggctgcctagccaggactgcgcacctgcgccctggggcggagtccttaccccaaccccagcttcactgcacatagccgagcccgacgggcctcctcccatctccatcctggacacctggcggagcccgtgctgagagcctccgccagctcccatctgttccccgaggagggcggggggctcaggctggagccagagcggtagatgggcacagactccccctccccccggcccctcaggccgggggtgaccttgccccctggagccctcaccatgaataccaaggacaccaccgaggttgctgaaaacagccaccacctgaagatctttctccccaagaagctgctggagtgtcttcctcgctgcccgctgctgcctccagagaggctacggtggaatacaaatgaggagattgcatcctacctgatcacctttgagaagcatgatgagtggctgtcttgtgccccaaagacaaggcctcagaatggctccatcatcctctacaatcgcaagaaggtgaaatatcggaaggatggttacctctggaagaagcggaaggatgggaagaccacccgagaggaccacatgaagctgaaggtccagggcatggagcctggcagtgtctctatggctgctacgttcactcttccatcgtccccacattccatcggcgctgctactggctgctccagaaccctgacatcgtccttgtgcactacctgaacgtcccagccctggaggactgtggaaagggctgcagccccatcttttgttccatcagcagcgaccgtcgagagtggctgaagtggtcccgggaggagttgttgggacagctgaagcccatgtttcatggcatcaagtggagctgcgggaatggaacagaagagttctctgtagaacacctggtgcagcagattttggacacccacccaaccaagcctgctccccgaacccacgcctgtctctgcagtggggggcttggttctgggagccttacccacaaatgcagcagcacgaaacaccgcatcatctctcccaaagtggagccccgagctttaaccctgacctctatcccccaccctcaccccccagagcctcctccactgatagccccacttcccccagagctccccaaggcacacacctccccatcttcttcctcttcttcctcctcatcaggttttgcagagcccctagaaatcagacctagccctcccacttctcgagggggttcttcaagaggaggcactgctatcctcctcctgacaggactggagcagcgggctggaggcttgacgcccaccaggcacttggctccacaggctgatcctaggccttccatgagtttggcagtggttgtaggcactgagccttctgccccaccagctcctcccagtcctgcctttgaccctgatcgttttctcaacagcccccagaggggccagacatatggaggggggcagggagtaagcccagacttccccgaggcagaggccgctcataccccctgttctgccctagagcctgctgctgccctggagccccaggcagctgctcggggtcccccaccacagtcagtagcaggtgggagaagaggaaactgcttcttcatccaagatgatgacagtggggaggagctcaagggtcacggggctgccccacccataccttcaccccctccctcacccccaccctcacctgcccccttggagccgtcaagcagggtaggaagaggagaggccttgtttggaggacctgttggggccagtgaactggagcccttcagtctttcatcattcccagaccttatgggagaactcatcagtgacgaagctccaagcatccctgctccgaccccccagctgtctcctgctcttagcaccatcacagacttctccccagagtggtcctacccagagggtggggtcaaggtgctcatcacaggtccttggaccgaagccgccgagcattactcctgtgtctttgatcacatcgcagtgccagcctcacttgtccagcctggtgtcttacgctgctactgtcccgcccatgaggtagggctggtgtctttgcaggtggcagggcgggaggggcccctttctgcttctgtgctctttgagtatcgagcccgccgattcctgtctctgcctagtactcaacttgactggctgtcactggacgacaaccagttccggatgtccatactagagcgactggagcagatggagaagcggatggcagagatcgcagcagctgggcaggtgccttgccagggtcctgatgctcctccagttcaggatgaaggccaggggcctgggttcgaagcacgggtagtggtcttggtagaaagcatgatcccacgctccacctggaagggtcctgaacgtctggcccatggaagccccttccggggcatgagccttctgcacctggctgctgcccagggctatgcccgcctcatcgagaccctgagccagtggcggagtgtggagactggaagcttggacttagagcaggaggttgacccgctcaacgtggatcatttctcttgcacccctctgatgtgggcttgtgccctgggacacctggaagctgctgtgctccttttccgttggaaccgacaggcactgagcattcccgactctctgggccgtctgccattgtctgtggctcattcccggggtcatgtgcgccttgcccgctgccttgaggaactacagagacaggagccttcggtggagcccccatttgccctatcgccaccctcctccagcccagacactggtctgagcagcgtctcctcgccctcggagctgtcggatggcaccttttccgtcacgtcagcctattctagtgccccagatggcagtcccccccctgcacctctgccagcctctgagatgactatggaggacatggccccaggccagctttcctctggtgtcccagaagcccccctactcctcatggactatgaggctaccaactccaaggggcccctctcctcccttcctgccctcccaccagcttcagatgatggggctgctccggaggacgctgacagcccacaggctgtggatgtgatcccggtggacatgatctcactagccaagcagatcatcgaagccacaccggagcggattaaacgagaggacttcgtggggctgcccgaggctggagcctcaatgcgggagcggacaggggctgtggggctcagtgagaccatgtcctggctggccagctacctggagaatgtggaccatttccccagctcaacccctcccagcgaactgccctttgagcgaggtcgcctggctgtcccttcagcaccctcctgggcagagtttctctctgcatccaccagtggcaagatggaaagtgattttgccctgctgacactatcagatcacgagcagcgggaactgtatgaggctgcccgagtcatccagacggccttccgaaagtacaagggccggcggctgaaggagcagcaggaggtagcagcagctgtaatccagcgctgttaccggaagtacaagcagtttgcactctataagaagatgacccaggcggccatcctgatccagagcaagttccgaagctactatgaacagaagcgatttcagcagagccgccgagcggctgtgctcatccagcagcactaccgctcctaccgccgcaggcccggccctccccaccggacttcggccaccctgcctgcccgcaacaaaggctcctttctcaccaagaagcaggaccaggcagcccggaagatcatgagattcctgcggcgctgccgacacaggatgagggaactgaagcagaaccaggagctggaagggcttccccagccgggactggccacatgacctggccaccgcctttctcaccaccctgggggcgcctcgtgcagtcttaacagggagagggctttctggggcagggggagcccctgtcggcagctttcctgttcacctttgttggagccctctgtaggcctcctccctcctccccacgccttgctcccacacccctctcctcgtccctcctggtcgtgccccgtctcttttggtcctggctccagaaaacccgcgccccacatacctgcatcttccgctgtgacctccggagccctgcctgcccctgctccccagctcctcctgcctgcacccgactcggccccctcctgacttgccttatttatttgttcgacgcgtctctgaatgtatccgcctcggttcccaccactgccttcgctgcgcacgcccctcgtgtttcagggctgaccgtgtccccacccgactccgcatgtttgcgtctgtttcctccctctctggccctgtcttaccccatcacccgactctggccactgacctcagggccgaaggggaggtggtgtacataggaacgcgttgcggagtccgccccgtcccccgaggggaggggtcttgtacatactgtaacatacagagtatagtgaagaatctatttaaggcgccgcggggagggctgcacggccgggcttgtggttctctagcgcggcgggggcctcctgccggctccacgggcactttctacttgtgcatgggcttggtttatacgaattgccattaaacatcgctgcacca
